United States Patent 7,745,391 (HUMAN THROMBOSPONDIN POLYPEPTIDE) - sequence listing, part 74

SEQ ID NO: 265652 - DNA, 766 bp, Homo sapiens
ctggcgctgccatccgggccactgtcccaggtcccggcccggagctatggagcggcgctggcccctggggctagggctggtgctgctgctctgcgccccgctgcccccgggggctcgcgccaaggaagttactctgatggacacaagcaaggcacagggagagctgggctggctgctggatcccccaaaagatgggtggagtgaacagcaacagatactgaatgggacacccctgtacatgtaccaggactgcccaatgcaaggacgcagagacactgaccactggcttcgctccaattggatctaccgcggggaggaggcttcccgcgtccacgtggagctgcagttcaccgtgcgggactgcaagagtttccctgggggagccgggcctctgggctgcaaggagaccttcaaccttctgtacatggagagtgaccaggatgtgggcattcagctccgacggcccttgttccagaaggtaaccacggtggctgcagaccagagcttcaccattcgagaccttgcgtctggctccgtgaagctgaatgtggagcgctgctctctgggccgcctgacccgccgtggcctctacctcgctttccacaacccgggtgcctgtgtggccctggtgtctgtccgggtcttctaccagcgctgtcctgagaccctgaatggcttggcccaattcccagacactctgcctggccccgctgggttggtggaagtggcggggacctgcttgccccacgcgcgggccagccccagg

SEQ ID NO: 265653 - DNA, 334 bp, Homo sapiens
cacattatttaactttccttcagcaaagtattggatatacacaaaaaacgtgatgcctccctgatattaaacgagaaaaagggggaaaaaagcatgtatacgtcgatactttcatttaaaaatcatggtgattcgcttatgtctccatacaattttcctcgtcccctgtgcaaattcccctgaacggatttcagaaccaaaaactagctgatgagctgggggccatttaaattcgctcccctcgaaggcgcccgaagttcgccttcctttccctttcttccctcttcgctccctttttgtgccagctcagcagtctcattgaagcgagcggcgg

SEQ ID NO: 265654 - DNA, 951 bp, Homo sapiens
tgctgggcatgatggtatgtacccgtagtcccagctacttgggagactgaggcgggaagggattatttaagtttaagagtgccactgtactctaccctggggaacaaagtgaaaccctgattcaaaaaaaaaagagagaaaaaaagaaaaaaatccaagggctacttttgattaaaggaattatggatcaaggaattcacattgcttttatttcagaatttacgaaagaaaagacaaacctatctcagagatttgagccaatgtagcaaagtgggatgtgggagaatcagcgtgacctacagctgggcttcagacaaggaatggaggagaatggtgtgcccgtgcctgtgggtgccctgagacagccacatataggagcacctttgatcaagttcagaatggaatcaaattcttctgaatcagagcagaagtgtggggctgtggggctcctgcctccttcctctccacctcctatcccctttccctagaacagtccagattcttttttttttttttttaaaggaagaggaaatactaagagagcttctcccagtcaaatttggtaaagggggtaaaaaaaaaaaaacagaaaaattcattcatctaccatcatatgttattgaggggcctgctgtgtgacaagccccattcagcaggagatgaaatgcacaaaacccttgccttcatcacaccctagtagggagaggaataacatatggagcatggcagacagtgccaagcatggaggtaaacacagaggcaggtgaagagagaagagggctggcacgtggggtctgaactgtcaatgaggaggtatgaaggagagcccacgcccgaggaaggtgcaggccaagtcacgagggtctcgggaagagccgtccaggcagagggctggaggacagcaggcagaacagcagggcgtgcgggagaggcagctggacctccaccgag

SEQ ID NO: 265655 - DNA, 289 bp, Homo sapiens
ttctcccccatattattttaaagcagcatattatttcatttataaatatttcagtagtttgggtacttaaaaaatacataaccacaatagtattatcatgcctaaaaaatttaacatgtaataaaatattcagtcagtgctcaactttctaatcatgtttttagactgcttagcattttgttgtggagatggatcataatatatttaaccagttcctgttgatgaagcttgaggttatttctaactttccaactgataaatagtgcttcaataaacatccttatatata

SEQ ID NO: 265656 - DNA, 587 bp, Homo sapiens
  misc_feature (2)..(3): n is a, c, g, or t
  misc_feature (7)..(8): n is a, c, g, or t
gnnacgnngcaaagaatcccttcaccccctccagggatggctctgagctctcgggcgcgtgccttctccgtggaagccttggtggggagacccagcaaaagaaaactccaagacccaatacaggcggagcagcctgagctgcgggagaaaaagggcggagaggaagaggaggagagaaggagcagcgctgcagggaagagcgagccgcttggtaagtactgccattgccctgagcccgttgcctgagcttactggttccgcatctctccgcctggctcgcgtcccgacgcagccagacagccacattaggagccgcgagacacctcgaccacctggtgaaggggaagtttcagcgcctccgaatccatcccggagtacagcagtttctttgcggtaaaggggagggtccctacataattgtgaagtgagtctctcctacatcctcctcctaccttcgcggaaagctctcaccgccagcgggtggctgctgtatcctgggatgggaagcagggcgagttcccaaatcccgagggcatccagtctcggttatcaacgtctccaggagagtgaggattggcaaatctaaa

SEQ ID NO: 265657 - DNA, 2321 bp, Homo sapiens
  misc_feature (2)..(3): n is a, c, g, or t
  misc_feature (7)..(8): n is a, c, g, or t
gnnacgnngcaaagaatcccttcaccccctccagggatggctctgagctctcgggcgcgtgccttctccgtggaagccttggtggggagacccagcaaaagaaaactccaagacccaatacaggcggagcagcctgagctgcgggagaaaaagggcggagaggaagaggaggagagaaggagcagcgctgcagggaagagcgagccgcttgaaaaacaacctaagacagagccctcaacatctgcttcctctggctgcggcagcgacagcggctacggcaacagctctgaaagtctggaagagaaagatattcaaatggagcttcaaggatctgaactgtggaaaagattccatgacatcgggactgagatgatcattactaaagcgggcaggttcggttctgcccaagctgttcacaagggtcacacacattaggcacttaatttaccgctctggcggatgttcccctctgttcgggtcaaggtgaaagggttggatccagggaagcagtaccatgtggccatcgatgtggtgccggtggattccaaacgctataggtacgtctatcacagctcacagtggatggtagctgggaatacagaccatttgtgcatcattcctagattctatgttcacccggactcaccctgctcgggagagacctggatgcggcagatcatcagctttgatcgcatgaaactcaccaacaatgagatggatgacaaaggccacatcattctgcaatccatgcataagtacaaaccccgagtgcacgtgatagagcaaggcagcagtgttgacctgtcccagattcagtccttgcccactgaaggtgttaaaacattctcctttaaagaaactgagttcaccacagtaacggcttaccaaaaccaacagattacgaaactaaaaatagaaagaaatccttttgctaaaggatttagagatactggaagaaacaggggtgtattggatgggcttttagagacctacccatggaggccttctttcactctcgattttaaaacctttggcgcagacacacaaagtggaagcagtggctcatctccagtgacctctagtggaggggccccctctcctttgaactccttactttctccactttgcttttcacctatgtttcatttacctacaagctcccttggaatgccctgtccagaggcatacctgcccaatgtcaacctgcctctatgctacaagatttgtccaactaatttttggcaacagcaacctcttgttttaccggctcctgaaagactagcaagcagcaacagttctcagtctttagccccactcatgatggaagtgcctatgttatcttccctgggggtcaccaattcaaaaagcggttcatctgaagactccagtgatcagtatctacaagcacctaattctaccaatcaaatgttatatggattacagtcacctggaaatatttttctgccaaactccatcaccccagaagcacttagttgctcctttcatccttcctatgacttttatagatacaatttctctatgccatctagactgataagtggttccaaccatcttaaagtgaatgacgacagtcaagtttcttttggagaaggcaaatgtaatcatgttcattggtatccagcaattaaccattacctttagtaagacaatagcatttctagaacaattacatgtaaacaaatattttctttatttgtagccaaagaaatttcaacagttattgggcttaaaaagcatcattacaatacagtatttctttgttatacatttaaagatttaaagtgccttatcaaataatattcatgaagagttgtttataatgtcaaatgaaacctacaggaatctctgattacagtggccttgagcttcaaaatgagatatgcaataaatattatttgatgatactccaccagtgaaaattgatgctaagtgatgggattttcaattatactgaagctagttcaccacgttaactgcattttacacattgacaatgacaaaaagaagatggatgtaattctcatgaaagcagtgaagcaatttcagttttaaaaatgaagatcggctttcatgtaattatctagtagttgtagaagaaaatttaattatttgtttgcctcatgcctttatactttgctgttgaagaaactactaatctcaatttaagatacaaataaggacacaaactttcaagtattatattttatttatctttgtagcctaaagaccatttaatcttgaaggaacacaaagatcaaatgaaaagtaaaacactctaaataaatttgcttttattttct

SEQ ID NO: 265658 - DNA, 2258 bp, Homo sapiens
  misc_feature (2)..(3): n is a, c, g, or t
  misc_feature (7)..(8): n is a, c, g, or t
gnnacgnngcaaagaatcccttcaccccctccagggatggctctgagctctcgggcgcgtgccttctccgtggaagccttggtggggagacccagcaaaagaaaactccaagacccaatacaggcggagcagcctgagctgcgggagaaaaagggcggagaggaagaggaggagagaaggagcagcgctgcagggaagagcgagccgcttgaaaaacaacctaagacagagccctcaacatctgcttcctctggctgcggcagcgacagcggctacggcaacagctctgaaagtctggaagagaaagatattcaaatggagcttcaaggatctgaactgtggaaaagattccatgacatcgggactgagatgatcattactaaagcgggcaggcggatgttcccctctgttcgggtcaaggtgaaagggttggatccagggaagcagtaccatgtggccatcgatgtggtgccggtggattccaaacgctataggtacgtctatcacagctcacagtggatggtagctgggaatacagaccatttgtgcatcattcctagattctatgttcacccggactcaccctgctcgggagagacctggatgcggcagatcatcagctttgatcgcatgaaactcaccaacaatgagatggatgacaaaggccacatcattctgcaatccatgcataagtacaaaccccgagtgcacgtgatagagcaaggcagcagtgttgacctgtcccagattcagtccttgcccactgaaggtgttaaaacattctcctttaaagaaactgagttcaccacagtaacggcttaccaaaaccaacagattacgaaactaaaaatagaaagaaatccttttgctaaaggatttagagatactggaagaaacaggggtgtattggatgggcttttagagacctacccatggaggccttctttcactctcgattttaaaacctttggcgcagacacacaaagtggaagcagtggctcatctccagtgacctctagtggaggggccccctctcctttgaactccttactttctccactttgcttttcacctatgtttcatttacctacaagctcccttggaatgccctgtccagaggcatacctgcccaatgtcaacctgcctctatgctacaagatttgtccaactaatttttggcaacagcaacctcttgttttaccggctcctgaaagactagcaagcagcaacagttctcagtctttagccccactcatgatggaagtgcctatgttatcttccctgggggtcaccaattcaaaaagcggttcatctgaagactccagtgatcagtatctacaagcacctaattctaccaatcaaatgttatatggattacagtcacctggaaatatttttctgccaaactccatcaccccagaagcacttagttgctcctttcatccttcctatgacttttatagatacaatttctctatgccatctagactgataagtggttccaaccatcttaaagtgaatgacgacagtcaagtttcttttggagaaggcaaatgtaatcatgttcattggtatccagcaattaaccattacctttagtaagacaatagcatttctagaacaattacatgtaaacaaatattttctttatttgtagccaaagaaatttcaacagttattgggcttaaaaagcatcattacaatacagtatttctttgttatacatttaaagatttaaagtgccttatcaaataatattcatgaagagttgtttataatgtcaaatgaaacctacaggaatctctgattacagtggccttgagcttcaaaatgagatatgcaataaatattatttgatgatactccaccagtgaaaattgatgctaagtgatgggattttcaattatactgaagctagttcaccacgttaactgcattttacacattgacaatgacaaaaagaagatggatgtaattctcatgaaagcagtgaagcaatttcagttttaaaaatgaagatcggctttcatgtaattatctagtagttgtagaagaaaatttaattatttgtttgcctcatgcctttatactttgctgttgaagaaactactaatctcaatttaagatacaaataaggacacaaactttcaagtattatattttatttatctttgtagcctaaagaccatttaatcttgaaggaacacaaagatcaaatgaaaagtaaaacactctaaataaatttgcttttattttct

SEQ ID NO: 265659 - DNA, 388 bp, Homo sapiens
ttctttcttttgcaatcagcattaaacctgtcatcattaggtgaaatctacattccctgggcccttgctactcaaactgtggtccccctggacaagcagcatcagcatcatcacggaacttgttagaaatgcagaaagccagacccaccccagacctacagacagaatctgcagttcaccaagaccccaggggctcccaaggcacattcaagtttaagaagccctgttccaacgcaatgccctaaagagtctgcaatgggcctccactctcctaaaaacctcttctcaggaagcagtgtgctctgggactcttagtctttggtgagactctgcatcacagcgccactctctgaggagaatgcacattaaaacacttgtagaactataa

SEQ ID NO: 265660 - DNA, 452 bp, Homo sapiens
tttttttttttatgaagtttttatgaagccttgctctgtcacccaggctggagtgcactggcacatctcagctcactgcaacctcagcctcccgggttcaagggcttctcttgcctcagtctcttaggtagctgggattacaggtgcccaccaccacacccagctaattttttgtacttttagtagagatggggttttgccatgttggtctggctggtctcgaactcctgaccttgggtgatccgcccaccttggcctcccaaaatgctaggattacaggtgtgagccaccgtgcaagccgaaagtcttctttagctatgatcttcctgaatcctagtttgatttgatccttcaggacatgtttgtgtgtatttacatatctgtgttttatacacatagaaatgtgtgtgtgtgtgtgtgtgtgtgtgtgtgtgtgtgtgtatttgaaatag

SEQ ID NO: 265661 - DNA, 401 bp, Homo sapiens
actcctgatctcaggtagtccaccctcctcggcttcctaaagtactgggattacaggtgtgagccaccatgcccagccagaaatattttaaaatcagctgttttgtgaagataggagttccagaaagtaaaggtgacatcggaaaaattaccaaaagctatttaaaacatctataagatggtcttcccatctttctctcttctacagatgagtcatatctttgagattaatttttgaaagcttagagaataaatagatgtttacaaatactgaaaatcattccttttacaagtatcttggacaaattacgtttaaaatttgttcttgtgtttattgattgtaaaggcattgtcatgcacagaacttaattaaaagcaaatcatttgtttaaaaaggcactt

SEQ ID NO: 265662 - DNA, 298 bp, Homo sapiens
gaacaaactctggacacactgactttaagaactgttaacacaccgcgagtgtctgcggcttcgttcttgatgtcagtgagaccaaaaccccaccaattccaggcacagtatctagtaaacctgttagaaacccacgaggcaaaatgcttctgcgttcagagacttcaagtagttgaaatcccatttgatggcttaatagctgggtgtctttggacaagttaattaacctttctctgtattggttttctcgcaggcatgttgacaggaataaatgagataatctgtgttaaactaatca

SEQ ID NO: 265663 - DNA, 726 bp, Homo sapiens
catccccaagtcaaggaccaggtgctaattaagtttgcataccccagggcacctttaaaatagttttatttatttatttatttattttttcagatggagtctcgctctgtcacccaggctggagtgcaatggtgcaatctcgactcactgcaacctctgcctcccggattcaatcgattctcatgcctcagcctcccgagtatctgggactacaggtgcccatcaccatgcccggctaatttatgtatttttagtagagatgttgagaccatgttggccaggctggtcttgaactcctgacctcaagtgatccacctgcctcagcttcccaaagtgctaggattacaggcatgagccactgtgctcggcctaaaaatagttttaaaagtacactgttgaagaaaaactcttaataaagacatgaatttttgtaacagcatatgatatgaacacagtttgcagaatgaatacattttcttcagagtttaaaactcttcagtcattatctctttgttcacgtggtcacaaagcattctattggccacaactaaaccagttccttctttttaaaaataatacagatggacctctttgggggatggttttaatattgcctgtctgccaggaaggagactcctcaaggtctcctttgtccttctgattcaagatgaattatttttttctagaatcttttaattcaattattccagaagtaaattactttat

SEQ ID NO: 265664 - DNA, 476 bp, Homo sapiens
gcggccgctactactactactactactaaattcgcggccgctcgacaaaatggagaaattccaaaatctagtgccatgttctagaaattgcagcaatgtttttttctctttttaatctgtaaaagttgactatgtgtttaaaaatatctttgggtcacagaggaagatctcatgttcagaaagaatgttttcatcaaattgacttatgctcattgatttctaaagcatcaattttgagaatttggccattctccataattttttcctgaggaagctaattcattcagttgctcaagctggcagcatttgactgctccttccaaaataaaaaatgaaaaattcgtttgaatccgtcgataaagtatgagctgtattttggttagaaatcgaagccaatgcatagtttatgttattaattaccctagcgttgaaaatttccttttgttttgtcattcttgactgtgtatattcatgaa

SEQ ID NO: 265665 - DNA, 465 bp, Homo sapiens
ccaggctccctgggggggcccttcgtcggctcttgcttcactgtagataagaaatcagaaaatccttgttgattgcatcaactcctcaggttaatttgacagtaagtcatcaggcatcatctataaagtccagaggaatctgtttgtgttgtttgaaagggcttgaaggccaggtgcagtggctcatgcctgtaatcccaacactttgggaggctggggcaggtggatcgcttgaggtcaagagtttgagaccagtttggccaacatggtgaaacccgatctctaccaaaaatagaaaaattagccgggcatggaggcaggcgcctgtattcccagctacttgggaggctgaggcagcagaatcgcttgaacccaggaggcagaggttgcagtgagctgagatcgcaccactgtactccagcctggacaacagagcaagactccatctcaaaaaaatatataaat

SEQ ID NO: 265666 - DNA, 368 bp, Homo sapiens
atattttctaaacagctccattaagagataattaacataccaaagaattcaattaagtatacaattcaatggtatttattatatatctctatgaatgtattaaaatccattcagctgtgatatactaaaaaacatagagctgtatttatttttaaattattttttcatgtgcttcattttgcatagtttcttttgctattttcaggtttatttattattttcttttttggcaatatgtaatctgcaactaatctcatccaatgtactttattattattattattatttttttagataaggtctcattttgtcattcgtgccactccactccagcctgggtgacagagcaagactctgtctcgaaaaaa

SEQ ID NO: 265667 - DNA, 434 bp, Homo sapiens
aagcaaataaaatgtggtaaagatgaccacaagtcagtgtgaatgggaaaagttattaaacaaatggtgctggagcagttggtttgcttttaagaaaaagatcgattttaattcgcacctcttgtcttataccaaaattaattccaggagcatgaagcatcattacatgtaagtaaagccttaaaaaagaaaaagaaaaactagaagtcagtttactggacatttataaacaatctatcaagaagaatgttgtaagcttaaaagaatggaagtcataaacgaaaatattattttatttaactacataaaatgcagaacttcccagcattaagagaatctacttaaatacagttttttaaaagcaacaaatagttccgtggaatatgacagagaaaggaaaatatcctcagtccatgacaatcgtatgcaaatag

SEQ ID NO: 265668 - DNA, 437 bp, Homo sapiens
cacgaggtaattttgtttgtaactttaccaagagttgttttctgtttcgtaaagtcctatctccagcatcgtcactgtgacgtttcagtcatccatagacctccccttcgtcacatcccatttgcagcagcagcactcccagtgggtctgtgggtaggtgcaagcgtggaccgcctccgtctcctagtgtagctgggtctggccctttatgtgttgtaatgcacattttattatagactgcttctcttttctctctcctttgcagtacatgtaaggcattatatccgaatttatgtaggtaggttatgtaatctatgaatttcacttcaggataatgcaaggatcattacaaaacattataataaaaagaggaccatcgggcctgagagggttgaagttttgtgaaactcgggctggttccttcctgcattgcatct

SEQ ID NO: 265669 - DNA, 237 bp, Homo sapiens
agcactgcatgataggaggacacattaagaaaggaggaagatttcctggggttaatcttcatccacttaaactattgtttagagttgggcttgctgatggcagtagtttttcaggcactcagcaactttctgagaaagtctttatatattaattccacaatgacaggtaatcattgtggcacagtagttgatgtctccttttcttcaataaataaatatcttattaaatattaatat

SEQ ID NO: 265670 - DNA, 891 bp, Homo sapiens
ttcacttacaatggggttggggttgtagaagttgcagttattatcatgaagcttgcttatctcatgactgttaggaaaagcacatgaaaaaacggaggtgaaaggattttgtgaattgtggcagtggtataataattattcttcgatgctggtaaaatatgggtgaaacaataggagtttagaaaatgcttaataataagggtaattcttattatacatcttgtaatgttactctcccaaagtaaaatctggtaatagaaagtaggatttaatactttgagcatttaatactttgagaaggcttatggtatgctcattaaaaatgaatcaatgaaatatttatttaaacacttttatttaaaacatgttatacccttgaatggcgtgccccctgttgacattttcaaacagacattccaaatcatttccaagtacagtcatccctctgtatcagcccggagattggttctagtatccccttggataccaaaattcacacatactatttttcctctgcttttaagaattgaagtttgattgtaaaactgttttaatttgaataaaatgatactgaggtagacaagttctctggtaggaatcttcttttattctctttctccattcaaagccacttctagtgaggttttctctgatctcaggttatattaccttgatagcatatgataaagggtccttaacgtagtctgtgagataactatttttgaagtaggcatatttattccttagttttgttttgcatataaaaaaattagaatcacgtgatataattttataagtttgttttcccctgtaacatatatattatgtattttaaatgttattaacattttaaaataaaatacataataaggtaaactttttatatgttgt

SEQ ID NO: 265671 - DNA, 431 bp, Homo sapiens
ctggtggcttgggtaatgtggcagccccctccccaggagtccctgcactggccactccaggcaccaggattctttttgccttaatgaattcccctcaagtctccggttagaagtttcctgctccaatcttgaatatgcatcttttaaaatactctgcaaatttgagggcctctcatgtatcatttcaatcctccagctattagagaaattggggtatcatatagattacggaaaaattactttgggcagagaaggaggtagaagatcaaacgcttatctgtacaaataaattcagtgcgatccacaattaagcagcatttgacatttaaaaaatatttgatccatgttttggcttccagagctgcttaagggagctgcgatgtgtaaattacattcaaatcagggttaaatatagttcccagagaaagata

SEQ ID NO: 265672 - DNA, 453 bp, Homo sapiens
aggaggatgaggaggaagactttttagatgacagtaaggagactccctttactacaagaacccctgcttgtaagaacctctgctttaggagcacttaatacttctcttttctccttcatattcttaccacctccccatgtctttccactgctccttctccccttttccctgtgcatgggtgtaaagcatgtgcataaagccacacagagacaaggcaagaaccagaaagagaagacagagaggggcaaggagctgcaggcaagatggaacatttattcttttcttgtctttgacaaaacaaatattggtattagacttctctgagaaaatatctctgaggcactatagttgtggaaaatttactgtcctagaagagattttgtcaggttttgtgttttttatattgctccaggaaacaaaatcagaccaaataaaattgaatgtgaaatattt

SEQ ID NO: 265673 - DNA, 440 bp, Homo sapiens
gacccatacacatgacttgagaccacaagtcggaggtggtctttaggtaatagcttaaaataattgtgaaagtcaatagaagaaaggtgtggtagaagtcttcagtactacatgttgccttgacatctaggaaaatccagcaagtcttcacattgttatactacaagctcttcttcccaactgctcccacggataaagtctcctcctttccatgcagagcaggtacgattcctgcttaccccttagtagcagatttcatttccttgccatccagtgaaattactcaaaaaagccaatcacacccttctttggggaccagggtttaccccacgcttttgctactacaaaacctgcctcccacagttcctgcttcttcaatctattcccaagtacaatccctgtgtgaccttgaatagcatgctatgttgtcctcccctggt

SEQ ID NO: 265674 - DNA, 443 bp, Homo sapiens
gggacaccttgggtgcctaacagaggcaaatgcaaatcctctccaaagactcatgtcttcaacctaggctacctaagattctgctatggtttgaatatttttccctccaaaactcctgttgaaatttaatccccattgtggccatattgagaggtggggtctttaagaggtgattgggtcataagggatctgccctcattaatggacgaatccattcatggattaatggattaatgggttatcacaggagagggactggtggctttataaggagaaaagagacctgagctagcatactcagtcctcttaccatgtgatgccctgcaccacctttggacgcttcagagtccccaccagcaagaaggccctcagcagatgtggccccctgacctaaaacttcccagcctccattattgtaataaataaatcctattctttataaa

SEQ ID NO: 265675 - DNA, 161 bp, Homo sapiens
ttagtattaaaaaggggacctaggactgagattctcagtatgaaaaacagttatataagaatgctatacatacacacagccacaacatcatatatacaccaaccctccattctgataagccccacggtgctgctactagaaatggtcagccagggaaaagg

SEQ ID NO: 265676 - DNA, 596 bp, Homo sapiens
ttcttaagacataataataatgaaaatattacatatcagaacttacagaacacttttagagtagatatcagagaaaaattcatagaactaaacacttttattagtaaaatagtgaaaataaagtaaattctcagctgaaaagttaagaacctctccccagcaaagtaaagagaattaaaaaaccagagaaagaaacagtaaagataaaagtagaaattaatgagctatatatagaaagatagtagatctaagatacaattaacttgttaaaattctgtttcttgaaaacaattggtacatagaaaaaacaccagctaacttagtcaagggaagaaaaggagaaagaatacacatacataaacacaaataaagagatggtaagggtgaaataaacattgaaatcagaagaaaataaaaaaacaagagatattatcaaatatgactttttcacacttctaagccaataaatttgaaaacttagatggataattttcaaggaaaattttatttaccaaaattggactcaaagaagacagaaagcttagaaggatgctaggaaaatgcaataggctgataggctgaatgtgcaggggaaa

SEQ ID NO: 265677 - DNA, 837 bp, Homo sapiens
gatggagcaagaatcatcttgtaacaggaatagtcagcatttcacataaattaaccttgaagagagaaatgcaaaagaagaaggaaattttccatcttacaaaactacattactttaaaagggacctctcatggtgcaccacctgagcgagggccttggatgtcttatggtggaagcagctgccatgattataacaatacatgagatagatacggcagaagtcaggaaagttgctcaaggagctatggcgatttttattcttgtggtcatgagaacattggcagaaaagaccaaaggaatccaccttctctggatagggtgcactctgctcctcttgaagcatatggtagttcaagttatgtgccatctacaggagatggtggggaaagtcaatctgaaaaaggcgactaaagcggattttaaaccagagaggtgctgtttcagagaaactaggcaacaacatcattctgcaacaaccagccgtggttgatgggtctgccaggctcaaatcattggccaactgccaaatcccatcctggtttttttctgcaaaacagccaatgctgtgacaaagtggcagcttggtgattatccacagaaggggcatgtgaccccaccccattgcagcagccatacttttgaccatcctagccctgtgtgctccatccatccccaggctgaaaatcggaggcaatttagtggttaaggatgaagtttctggccctacctggacccagcagaatcaaagtggatccagtgtcagctccagcctattcaatttcaatttttgaaatggagtcattactaataaataacctaccagccaaaaaaaaaaaa

SEQ ID NO: 265678 - DNA, 430 bp, Homo sapiens
gtgtaagaaagttcacaaagctgaagttccaagctgcactcctactcatagttatgaaagtatgatatacttagtgaaaagggaaaaaaggaatgtatctgtccttatagttccaagtagcaggcaggtaacccacttgcattttgatccttccattatttattttatcaatcttaaggatggtatgcatgctgcttatttttatcagaattttaaaaatggggcttgggttgtggaaacttctactttctgtagcctgtggagtaactgtaatctactaaggggtacaaatattttgtcaaatccaagcataattttaattactattgctcttgtcttaatcttctgagttagtttaacttaacacctactttaccaaaaaggggctcaataaatatttttaaattaataaatcaatcttatttgatgc

SEQ ID NO: 265679 - DNA, 376 bp, Homo sapiens
gagctaattagccccactcccaactttagtacccataattggtggctgtgagctgtagaaggattgttttcttccgtgactgtttgtgggtcatgggcagcaactgtgggcctggtctctggcttgctatgtagctctaaacaaggcacttagttctctcagctccagtttcccctataactataaactagacaatcttgaaaggtttatcctgttctgtatttttatggtcctttacgaaatatcatctgaccaggtatcatggcatgctcctatagtcctagctactcagaaggctgaggtgggaggatcacttgagcccaggaggttaagtccaaatccagcctaggcaacatagcgaaactccatatctaaa

SEQ ID NO: 265680 - DNA, 493 bp, Homo sapiens
cgatcaagatagtgtggcattggtgtaaaaacagacatgcttatcaatggcgcagaattaaaagaatagaaattaacttctgctttgataggcaatggagtttccaaacagcactaaatcattcactggggggaaagatggttattttttttaacaaatagtgttagaagaattggatctataaaaaatagacttgaaccctactcacactatacacaaacattgactggaaaatggatcagagacttaaatgtaagagctaaagctataaaacttttagaagaaaataaaatagaaatcaagcacacaatatacaaaagaaaaaatgataagttaaacttcaaggaaattatacactcttatgctttattgttttaaatttttttcctcttgcatgtctagaaaaaaaattcttatgctttaaaagacactgataaggcaatgaaaaggtaagtcacagactgggatttaaaaaagttttatacatctaaaa

SEQ ID NO: 265681 - DNA, 317 bp, Homo sapiens
acccagatttggggaaggggtccctttcaagtttgtcttctttgagtattggtccttagccataggttccttatattttctagacacactttaatcagagttgttgttttttcagagatggggtctcactaatgttttccaggctggagtccagtggctattcacaggtgctatgattatagcacactacagtctcatactcctggcctcaagcattcctcctgcctcagcctcctgagtagctgagattacaggtgcatgtcacctgatcagagtttactcattcattatattaaactttccctgtttaacctaca

SEQ ID NO: 265682 - DNA, 125 bp, Homo sapiens
aggtggcaattgaacaatgagaacacttggacacaggaagaggaacatcacacaccaggatttttttttttaaaggagagatgtagctgagcaaatagtggacaaattaaactgcttcagatcta

SEQ ID NO: 265683 - DNA, 377 bp, Homo sapiens
gtgagggataccctcaagttaactatgggaaaagaagacagcaattgtatgaggcagacactgttatcttattcacatgaggaagcagatgcttagagaagttagataactttctcaatataacgtgtctttgactccaaagcctgtgtatgtatataaaacacaaaaaacatgttattatagctaactataggaaatacatataagcaaaaagaaaaagaaatctaatcactgagaaatgactactgttaacattttgctgtgcacccttccagactttccatgtgtctgtgtctgagtccatacaaatacagcatatgtgaatatttataagtgtggtatctatgcacacagacatatactccagtcctttctaa

SEQ ID NO: 265684 - DNA, 1029 bp, Homo sapiens
acagtgatgccatcaggtgtggtatgtgatcacaggcaactcaggaacagctctccagccccaggacttctgctggaaccgctgggagttggaagctttcttcccactgaggggcaaaccttctaggtatctgaagatgttgaagaccatttcctggaacagcagaggtaaatgcccagaggatgagaacacatagccattaggagagcctgaaagttcagtgtgactgaaagatgaagttcaagagaagggacaaactgcaaaacacaagctggagagttttagagagactgtggaatggaatgactctccagagctgcagattgaaggcatattttcatctgactttgatctcaatggcgggaacaccttcatggcccctttatagctggtatgttttcttcttatggacaatgagaaacatgtaataaactgtgtttccttctcgctaggaaaccctgagttaaagctttacttccctctcaggaaccatcaaagagccataatctgtacaccctggtgcaacatttcccctggatttgatcccctttcaattgttttagccttattttacatttcttaaatctatttctctatgttgccatgtgtattatcaaatgctatttcagatgccaaccatgagctaaagcatatgttggaattattaagagaaacagagggatatacttatgtaaaataacacatataaatgcaatgctgattttttttccttaagaagtctttaacaattgcttcggaggaatctgcttttcactgaagcttcaatattttcagatcctttaataccaggtgtcaaacttattcactgggatgaattatagaaagttgcaccactttcttctgcctcatttattctcattgtaaatatgagaattttaaaaagtcttcctaattcttgctttatgatggattctatacaaacaattgaggtgctgttcactaaactactggaaacatggggaagtgagctaaggagataggaactatgaaatgacctgttttaagaaa

SEQ ID NO: 265685 - DNA, 953 bp, Homo sapiens
ctacatttcacaatgctgttaccataggatgcaaaagctggcacccacccttggacgactgcagtgggaggggattcctggaagcttgtgccagcgatctatagactttgctctgtgagcctgttctctttgctgattttgctttacatcttttgttatgataattcacagctgcagagagactgtggaatggaatgactctccagagctgcagattgaaggcatattttcatctgactttggtgattatgtttccaatctctctgggaataagatctcaatggcgggaacaccttcatggcccctttatagctggtatgttttcttcttatggacaatgagaaacatgtaataaactgtgtttccttctcgctaggaaaccctgagttaaagctttacttccctctcaggaaccatcaaagagccataatctgtacaccctggtgcaacatttcccctggatttgatcccctttcaattgttttagccttattttacatttcttaaatctatttctctatgttgccatgtgtattatcaaatgctatttcagatgccaaccatgagctaaagcatatgttggaattattaagagaaacagagggatatacttatgtaaaataacacatataaatgcaatgctgattttttttccttaagaagtctttaacaattgcttcggaggaatctgcttttcactgaagcttcaatattttcagatcctttaataccaggtgtcaaacttattcactgggatgaattatagaaagttgcaccactttcttctgcctcatttattctcattgtaaatatgagaattttaaaaagtcttcctaattcttgctttatgatggattctatacaaacaattgaggtgctgttcactaaactactggaaacatggggaagtgagctaaggagataggaactatgaaatgacctgttttaagaaa

SEQ ID NO: 265686 - DNA, 919 bp, Homo sapiens
tgtgatcaaagagtgagaacacagccatagagagctttacaaagggcatcagtattaatgtcaaatgttactgaggcctcgagggaactaaccagtcagaagcaaccatcgaatttagtaatggacttcactcacttggtgaaagctgttccgtgtcatggtggcagagacacagcacagtggctgagagtgagcaggagctgtggaagttgaataatgcctgaagggaccattctttctatctcaatggcgggaacaccttcatggcccctttatagctggtatgttttcttcttatggacaatgagaaacatgtaataaactgtgtttccttctcgctaggaaaccctgagttaaagctttacttccctctcaggaaccatcaaagagccataatctgtacaccctggtgcaacatttcccctggatttgatcccctttcaattgttttagccttattttacatttcttaaatctatttctctatgttgccatgtgtattatcaaatgctatttcagatgccaaccatgagctaaagcatatgttggaattattaagagaaacagagggatatacttatgtaaaataacacatataaatgcaatgctgattttttttccttaagaagtctttaacaattgcttcggaggaatctgcttttcactgaagcttcaatattttcagatcctttaataccaggtgtcaaacttattcactgggatgaattatagaaagttgcaccactttcttctgcctcatttattctcattgtaaatatgagaattttaaaaagtcttcctaattcttgctttatgatggattctatacaaacaattgaggtgctgttcactaaactactggaaacatggggaagtgagctaaggagataggaactatgaaatgacctgttttaagaaa

SEQ ID NO: 265687 - DNA, 1061 bp, Homo sapiens
acagtgatgccatcaggtgtggtatgtgatcacaggcaactcaggaacagctctccagccccaggacttctgctggaaccgctgggagttggaagctttcttcccactgaggggcaaaccttctaggtatctgaagatgttgaagaccatttcctggaacagcagaggtaaatgcccagaggatgagaacacatagccattaggagagcctgaaagttcagtgtgactgaaagatgaagttcaagagaagggacaaactgcaaaacacaagctggagagttttagagagactgtggaatggaatgactctccagagctgcagattgaaggcatattttcatctgactttggtgattatgtttccaatctctctgggaataagatctcaatggcgggaacaccttcatggcccctttatagctggtatgttttcttcttatggacaatgagaaacatgtaataaactgtgtttccttctcgctaggaaaccctgagttaaagctttacttccctctcaggaaccatcaaagagccataatctgtacaccctggtgcaacatttcccctggatttgatcccctttcaattgttttagccttattttacatttcttaaatctatttctctatgttgccatgtgtattatcaaatgctatttcagatgccaaccatgagctaaagcatatgttggaattattaagagaaacagagggatatacttatgtaaaataacacatataaatgcaatgctgattttttttccttaagaagtctttaacaattgcttcggaggaatctgcttttcactgaagcttcaatattttcagatcctttaataccaggtgtcaaacttattcactgggatgaattatagaaagttgcaccactttcttctgcctcatttattctcattgtaaatatgagaattttaaaaagtcttcctaattcttgctttatgatggattctatacaaacaattgaggtgctgttcactaaactactggaaacatggggaagtgagctaaggagataggaactatgaaatgacctgttttaagaaa

SEQ ID NO: 265688 - DNA, 964 bp, Homo sapiens
acagtgatgccatcaggtgtggtatgtgatcacaggcaactcaggaacagctctccagccccaggacttctgctggaaccgctgggagttggaagctttcttcccactgaggggcaaaccttctaggtatctgaagatgttgaagaccatttcctggaacagcagaggtaaatgcccagaggatgagaacacatagccattaggagagcctgaaagttcagtgtgactgaaagatgaagttcaagagaagggacaaactgcaaaacacaagctggagagttttagatctcaatggcgggaacaccttcatggcccctttatagctggtatgttttcttcttatggacaatgagaaacatgtaataaactgtgtttccttctcgctaggaaaccctgagttaaagctttacttccctctcaggaaccatcaaagagccataatctgtacaccctggtgcaacatttcccctggatttgatcccctttcaattgttttagccttattttacatttcttaaatctatttctctatgttgccatgtgtattatcaaatgctatttcagatgccaaccatgagctaaagcatatgttggaattattaagagaaacagagggatatacttatgtaaaataacacatataaatgcaatgctgattttttttccttaagaagtctttaacaattgcttcggaggaatctgcttttcactgaagcttcaatattttcagatcctttaataccaggtgtcaaacttattcactgggatgaattatagaaagttgcaccactttcttctgcctcatttattctcattgtaaatatgagaattttaaaaagtcttcctaattcttgctttatgatggattctatacaaacaattgaggtgctgttcactaaactactggaaacatggggaagtgagctaaggagataggaactatgaaatgacctgttttaagaaa

SEQ ID NO: 265689 - DNA, 568 bp, Homo sapiens
acagtgatgccatcaggtgtggtatgtgatcacaggcaactcaggaacagctctccagccccaggacttctgctggaaccgctgggagttggaagctttcttcccactgaggggcaaaccttctaggtatctgaagatgttgaagaccatttcctggaacagcagaggtaaatgcccagaggatgagaacacatagccattaggagagcctgaaagttcagtgtgactgaaagatgaagttcaagagaagggacaaactgcaaaacacaagctggagagttttaggtaagagtcatatcacaaaaagccattaagcattttaaaatgcttagcctttatccaaagactaatggaaaggcactgacatgacctaatcatgaatgagaagatttgattaaatatatctctctacaatgatggagaatggaccaaaagcaggcggggacaaggacagtaaactctgctagggactgctagaatgaccctgaaagaatagccctgaagatagaaagaagtagatagttgccaaagatacctgtggaatacaaaagtaccagtgcccaccaga

SEQ ID NO: 265690 - DNA, 591 bp, Homo sapiens
acagtgatgccatcaggtgtggtatgtgatcacaggcaactcaggaacagctctccagccccaggacttctgctggaaccgctgggagttggaagctttcttcccactgaggggcaaaccttctaggtatctgaagatgttgaagaccatttcctggaacagcagaggtaaatgcccagaggatgagaacacatagccattaggagagcctgaaagttcagtgtgactgaaagatgaagttcaagagaagggacaaactgcaaaacacaagctggagagttttagagagactgtggaatggaatgactctccagagctgcagattgaaggcatattttcatctgactttggtgattatgtttccaatctctctgggaataagatctcaatggcgggaacaccttcatggcccctttatagctggatgatcatttcctgttctctccaccatggccacctggtccaagccaccatcttcatgcacctggatacctgccataacctcagctgacctttcctgtgtccattcttgttcctttgggcccagtctcctcgctcatagcagcagaatgagtctattaaaaagtgaaa

SEQ ID NO: 265691 - DNA, 469 bp, Homo sapiens
atggcttcacaactgccacgtatgcaaatcctgcatttgaaacaacaatgggctatcagtcaggtgaattaatagggaaggagttaggagaagtgcctataaatgaaaaaaaggctgacttgctcgatactataaattcatgcatcaggataggcaaggtaagtaagaggtcagtgccttttttaactttcacaacacagagagaaggaggagggggtggggggggggtgctgaccaggtaatcttaatcttactcctcccagcagcccagggaagtatagggaatgttatccctgttatatccattttacacttaaggaaactgagggcccaagttgaggaatgattacccatgttcacaagactttgatattgcacttaaaatggaggagtatatttgagtgcttaatttattttaaaaaagacaagcagcaatgacaataaaaacaatttttatctcattctcata

SEQ ID NO: 265692 - DNA, 248 bp, Homo sapiens
cggtggtactccatgaatttcaccccacatctgagaaacggctggttcagcaagctaacagcatacagatcctactcttttctattttaaccaaaaaaattcctaagtggtattccttaaatcttgagcaagtacgattccttaaatcttgagcaaatcttgagaaaactgtgtcctactaaaattaaaaggtattctcctgggaagtgggccctatgtctattaaacatacttagcaaaatctcttg

SEQ ID NO: 265693 - DNA, 575 bp, Homo sapiens
  misc_feature (519)..(519): n is a, c, g, or t
catcaaaatgtcaatgacaaatttgaattattgttagagctgtaaaactgttgtgagcataggcaaattcccttatcaaaattactctatacctgggaaaagcccaagtaattttccagtggtgtgaaggacagagagtgttcggtcgatgagacttaggaagaggacttcggaggtgactttcaggggacagtgcagtctctcaatttgtatatgagaccctgggcttcacacagctcttgtttcactgaaatccctcagcactccactcctaaaggtaatacctttatgtctggaaggttattatgcaaatgattttttatatttacatttagtggctacattaacacttcagtgagtgtttataatgccatatatctttttctacttggtccagttctttttttattttattttttttttgagatggagtctcgctgtgtcacccaggccagagtgcagtggcatgatctgggctcactgcaagctctgactcccaggagaattgcttgaaccagngaggcggacgttgcagtgagctgagattgcaccaacggactccagcctgggtgacg

SEQ ID NO: 265694 - DNA, 793 bp, Homo sapiens
cacggtgagtatgagtatggcattattgagtcaataaatttctttatataaaagaatttataggtatatgtatttttatttctttgtattctgcttttctcccactgattgtattatttttttagttaggtaagaaagcttaatacgttatgctgcttcctaattttattaatttctgttttaaatgaaaatagttgtattaatttttactgattaagaaaacagaaaagtataaagaagaaattctttatacctgaagaaaatacctgaagtcccacatccttaataaaaagagtcatcctttttacttgacatagctttactctagacatggattattcaggtatcaataagaatgtgcacctggaattcgctcaccgcatccatgtgtgggtaaggcctgttgctaagcatagcactttgccttgagagctttcaacctggctacctggctggcttccttccttcctccccttttcttaagagaatgaatgggacagaattttatttttatttaaaaaatgataacagtaaaagtacatcagcaagcaattgatgaatgaactgaggtatactcatatagtgaaatattattttatggcaattgaatgaattaaagctatatgtagcaaagagataaacatcacaaatagtgttgagggtatataccatgtgatcatttatgtgtatacagagtaattataaaatgtttgctgtgtacaaaactattttattagtggatttttaaatacattaaatgggtatatatagtatatatgatctaggagtatat

SEQ ID NO: 265695 - DNA, 2460 bp, Homo sapiens
caaaacaatttttttaagagcaaagttggaggatttatagaacctgattccaaaactgtcagtaaaactacaataattacaaagtatcagccaggtgccgtggctcacatctgtaataccagctctctgggaggctgaggcgggtggatcacttgaagtcgggagtttaagaccagcctggccaacttggtgaaaccttgtctctactagaaatacaaaaaattagccaggcatgatggcacacacctgtaatctcagttactcaggaggctgaagcagaatagcttgaacccaagagagtccagctcaaaaacaacaacaagaacaaaagtatcacattggcataagaatagacatgtaaatcaaataacaaaatagagaattcaggtataaatcttcatatttatggctgattgactttgaacaaaggtgacgaggcaagtcagtatagcagcatattcttttcaacaaatggtgctggcagaagaaaaaaaaagtacttggatccttacctcacaccatgcacaaaaattagctcaacgtggactatatcagggtttctcaacatcagcagtgttggcgtttgctggggtggataattctttcctgtggagagctgtcctgtgcactgtagaatgtttagctgcatcctggcctctgcctattagatgccagtggcatccctcccctgacacacacctagttttgacaatctctgtctccagatattcccaaatgtgccctggagagcaaaactgtttccagttgagaaccattgacctaatgtaaaaaataaaatgtacagaagaaagcatagcaggaaatcattctgacctcaggttaggcaaagctttcttagatatgacactaaaggcataattcattaaaaaaataagttgggctttgtcaaaattttaagttttgctcttctgaagaaaccattaaaaaaaaatgaaaagacaagccacagactatgaaaaaatacttgcaaatcatatatctgataaaggacttgtacccagaccatgtaaagaactcataactcattaataaaaggataaagaaaaagctgaagacaattcatgcaagaagatatacaaatattaagcacattaaaatgctcaatattattagtcactagggaaatacaaattaaaggcccaatgaaatacctattacacacccattagaatgactgtaaacaacaagactgataattccaacatctgaccaagatatggagaaactagaactctcctacattgctggcatgagtgcaaaatgatacagccactttgaaacaccatttggcagttgcttaaaaaattgaacattcaactaccatatgacccagcaatttcactctcaggtatataaccaaaatacatgaaaacatggatctgcacaaggtcttgtatacaaatgttcatagcaacattattcataataaccaaaaattagcccatcaactgaaaagtagataaacaaaatgtatatccacaccatggaacgctactcagcaaacttctaaaaagcaacaaactactaaacacgtgcaacaacatgaatgagcctcagaaacataagtgaaagaggtcagacacaaaagactacaaattgtaagattccatttagataccatttctacaaaccgcaaaactgtagaggcacgaaacagattcatggtctgctgcagctggggatgggagtgggaacagagagcaaacattttgggatgatggaaacattctaaaactggattgtgattttggttacacaactgtatacatttactaaaatcaatgaacagaacacttttaatgggtaagccttaaggcatgtgaattatacaccaataaagctattttttttaaaaaaaagagagagagagaacgagagctacatggcagccccagggcaatagctctcagatctcccttagagaaagaactttctcttccacagcaatgagtgcaggtagctaacactgaccaacctgcatctggtagttcatttaaggtcggccttggctttcaagttaaggccatggtctttctctgcagtccccagccaatacgtgggcacagaaaggcacagggcatggctgattcagcccaacatgaggctccacaccctagaactccctgtggagttggccgatactgcctgtgacctgcaatgtggtctaagctgtcagacctccacagtggccagaaggttttccatacctgagcctgcttctacccacttttatttttcccaggagtcacgcttagtcatctcttgctctttgaactccatgtctgtatcagctacccagaggacccatcagacagaaagtaatatgcagataacagcccaggggaatctgggaagcactgtgaaaccaacatttcttcagtgaaacctagaacaaaagtggaataaataaaaactaactgtctcatttcaaaactggca

SEQ ID NO: 265696 - DNA, 1048 bp, Homo sapiens
gtatataagtaaaatatagatgaaaaattgtataatttatagctatctgaaaacaacttttttttaatatttgaacactttgaaatgccttacacttccttgttaaaaatcttaaagggatattaaaattaaatggcacttaattactattagtaattcctaatataatatttaattcataaaagaaaaaagcttaatgttgaattctggcactcatcgggaagatgacattatatgttaagagataatttgtggggcatagtaactatagttaatattgcatacttgaaagttgctaggagagtacattttaagtgttcacaccacaaaatataactatgtgaggtaatgcatgtgttaattagctagatttaaccattgcataatttatatgtatttcaaaatgtgttgtacaccataaatatatacaatttgtatttatcagtttaagaagaagaagaagaaaaaggtaatttgtgggcatttataaatagattgtataggtcagcactgcccaatagaaatataagttgagccacaaatgcaattttagattttctatagccacatcaaaaaataaaataaataggtgaaattttattaatggatttttatttaacccagtatctaaatactattatttcatcatataaacatgattgaactattttacattttttctttttttaaccatgttaagtcttcaaaatctgttagtattacatacttaaagcacatctcaattcagactagccagagttcaggtattcagtagccacatgaagttactgtattggacagtgcaattacagatagtaagtcctatggggtatagggaaagaataacatagaaattgaactgaaccgtaaaggatagctgagaacagaaaatgcttgagaagaatattcccataaagaagtgataggaattaaaacagcaaatacagtttgataccaggtaatagagtggcttgaatccagtttagggaatttggtttgggtgtgtatatgtgtgtgtgtgtgtgtatgtgtgtgtgtgtgtgtgtgt

SEQ ID NO: 265697 - DNA, 441 bp, Homo sapiens
aaatttttaagcagaacattttttacatttgggctttaaaaagtggtgtgtatgtatatatgtaaaagtactgaaataaggattagaaagcaaagatcaagtaacatagtgattatctccaggaatcaagtacaaactttgaaaaaagactggaggtggccaagcacggtggctcatgcctgtaattccagcaccttggaaggccaaggcaggtggatcacttgaggacaggagttcgagactagcctggccaacatggtgaaacaccatatctactaaaaatacaaaaaatcagctgggcatggtggccggtgcctgtaatcccaattacttgggaggctgaggcaacagaatcgcttgaacccaggagacggaggttgcagtgagccaagatggcaccactgcactccagcctaggtgacagagcgagattctgtctca

SEQ ID NO: 265698 - DNA, 298 bp, Homo sapiens
taaacagaaaacaaaacataaaaggctagttggagtctgaatgaaacatagtataaaacaaagagatttatgtaacaccatctttgtactgagaagagcatcagacactcttaaccttaataaacttcaggcaatccacttggtttctattctgcactgccaacccaagttcttcaatttgtcgcagataaatgatacaatttcaaagagctcagtcaagacaatatttaactcaaatatctagaggcagggaacagaagagttttcttttgttgttgttgttgttttttttagaatg

SEQ ID NO: 265699 - DNA, 449 bp, Homo sapiens
cacgagggtcatctctgccaggaatgggtgactttgctggggtctaaaaatgggcagctagtagaggaggtgctgggaaaggaggctgagaaggttggaggaagccaagaggggcagtgatgttgggaagagagggtgttgaaagtggtgccagccatggcggacactgcatgctttgtctgatgaaggatacacctgcaggggtgttatgggatctcagcctgtgtgtcatgggtgctggccttgaggcctgggagtctgactgggctgctggggcctggatggtatgcaccctcatgggcatggaacccagccttatgaagggggcccaggggtttgggtgtggcaccagcttgggatcactgtcacagtgaagttcccttctgcggctctcagctcaggcccactttgcccagaagacatgtttctacccaaccagctgtgttttc

SEQ ID NO: 265700 - DNA, 145 bp, Homo sapiens
attgggtagtgacaccagaagaggcctggcaggagggaggaacaatatacaaaatgtatccctttctcctctttgatccccttattctcctcttcctcctgtacatagagctggaaatagaagtttgaaatacaagaatgtcttc

SEQ ID NO: 265701 - DNA, 415 bp, Homo sapiens
  misc_feature (208)..(208): n is a, c, g, or t
ggcaaagtgagtcacactggacaggagagtctggaagaatggcaggcacagcttgcaagcgcatctggaggtggctggagagaaacatgtactcatccgaagaggggacccatgaccgtggtgtgcacagtacaagagctcgcttgggatctctgataaaggaagtccaccatgcagggttgagctgaaccacagaagcccagcctgngagcagggctccaggactccccaaggatcagaaacctcaatgataaatttccgactggatgatacacactacacctgttcttcagcgatgatgtatggtgtgtctaacatctgcctattagcagctgaattcccttctatgacgtgatacataatgtatggtgtgacacagctgggtaataaacaatgtcagctgcgtcctaaaagc

SEQ ID NO: 265702 - DNA, 552 bp, Homo sapiens
cacgaggcttatttgaaatgcttgggaccggaagtgttgtggattttggattttggattttggaatatttgcattataccggttgagcatcccaaatccaaaaatccaaagtgttccaatgagcatttccttttagcatcatgtcagtgtttaaaaagtttcagattttggagcattttgtattttcagatatgggttgctcaacctgtacaagtaaaacaaaaaccactttggtttttcttaactgaacccagcttgttgctattggtagtcatgtaaaaatatgataaagctatgacatgaataaagaggttgactttttattttgttttgttgttttaatgagactttatatctcaaagtcccacaagcctgggtgatttatcttcgttctcaccttcagttcaaggacatttatccccttgaaaatgggttttccaatcagaccctccatgtcttgttttgaactcttgctgcttgccagagtgttataagtgcttgtttagagtgaggggagatgggctacttagcatcagaatcaccactgtgggt

SEQ ID NO: 265703 - DNA, 235 bp, Homo sapiens
gtcttccctaagatttttctctgcgagggaatcaaactgctctatgaagctctatgaagaggcttatatggaaagatacagagactttctgccagcaaccatgtggtcagcccacacagaagtggatgttccaggccaggtcaaaccttcattcactgcagccccagctgaactctcaactacaacctcatgagaattcctcagaagaatcacccagcaaagccgctcctgaatt

SEQ ID NO: 265704 - DNA, 387 bp, Homo sapiens
tcacatgctgagatgaaagcactgagaggttagataagataaaaatgtgctggttaaataaaagaggggcctggtgtgttttaatgatgatggtgaatgagaagaataacacaacttcagaatttaggagtatacacaactcaaccctgtgcacctcgtgtgtgtgtgtgtgtgtgtgtgtgtgtgtgtgtgaacatgagatccttgctactcactcaatgttgtacagatccttcctattcaatgtgtagtcctcagacaagcagcatctgcatgaactaggacttactaggagtgcagaatcccaggtcccaccccaggtcttctgaatcagaatctatagtctatcaagatccccaggtgatttgtatgcacattagatcagca

SEQ ID NO: 265705 - DNA, 403 bp, Homo sapiens
gcatttctttggattttttttttcaaataagtaaaatgaagttcttaatacctggaaaatatttccaaacattctactcacctttcatcaatactcttattgtcttttgctttttaaaattctctggacaatgcagataataaaattccttgtcagccatccaactatgctgatcacctttctcacaaatgagtgtttcctattcatttgctgccttgtgttaattttctgggctagacagtattgttgaaaatgcaggatagactggctttggttcagttctttttttttttttgagacacagtctcactccgtcgcccaggctggagtgcagtggtgccatctcggctcactgcaacctccgcctcctgggttcattccattctcctgtctcagcctcccg

SEQ ID NO: 265706 - DNA, 405 bp, Homo sapiens
aacagaaaagatatcccataaatagaccttcacaaatatggtaatttgatttttgataaaagtgtaaaataattcaatggagaaagggtggtcttttcaacacatggtgttggaacaatctgtcattcacatgcaaaaggagacatgcatcctcaactttatccctcataccaaaaattaattgactcatagctctaagtattcactgtaagactataaaatttttaggagaacacaggaccacagggacctctttgcttagttattcgggtcagagagaagtactttctttcagtttcatgcctcacattgctgtgtgcctagtgctgtatccgcctatgttgctgccttgagaatgcagcttcatgactgggacttgcttcagtctagggcagggagaacaaa

SEQ ID NO: 265707 - DNA, 513 bp, Homo sapiens
aggagtgatttctgtccgaggctggatggagtggtgacagatttcatcacactatgcagaatggtatgaaatttaaaacttatgaattatttatttctagaattttctgtttaatattttcagatctgaaggcacagaaaatgaaactgtgggtaaaagaggacaactgtaatttattctacaggttcccaagtaaatgcttggcttgtacaaaagcatatttttatatcaatgttggttgtttttgtttctaaaaattgtcagtcttaggtgaaataggggatcagctgctagtcatatgtaaaattggcttcgagaatactagccctgcatacctctgccttgtagctaagtcttaaggctttatcccatcctccttaccatgtggtggtgggagggggatatatctttcctttaacagtgttaagacttcatacataaatgtccctgggagaaataaaaaatgttcctcaagtcatattaaatcctttcttaagagcagaattggattga

SEQ ID NO: 265708 - DNA, 339 bp, Homo sapiens
tcaccccagagtgtgaccttggttcaaaagcttgggttaaaaatccattggttggctagcaccgtggctcacgcctgtaatcccagtactttgggaggccacggtgggtggattacttgagcccaaaagaccaacctgggcaatatggtgagaccctgtctctacaaaaaatgtttttaaaaattagctgggagtagtggcatgtgctgtagtcctagctgttagggaggctgaagtgggaggatcgcttgagcccggaaggtcgaagctgcagtgagctgtgattgtgtcattacactccagcctgagcaacagaatgagactctatctctctcaaaa

SEQ ID NO: 265709 - DNA, 142 bp, Homo sapiens
tacctgtaaaagggtagcacaaggaataccttatgaggaaactcttgtgtctaactctagtggtaaatatattaatctacacatacacagagtgcatgtaaaactgatgaagtctgaataaagttgtgaattgtgtcaatgt

SEQ ID NO: 265710 - DNA, 704 bp, Homo sapiens
aagcaaacaaaggaaggaccttatgaaacgcacccccaaagcaaccaaccaattcaagaaaaaaaaacacacacgtctcagggctccgttggttttcctgggtggggggccctgaccccctgttctagcccggcccaagcaccctccaccccaccccggcctgctgaaaggtgccctgtctacctgagcagagcctccctctccaaggctctgtcgctgtcgctctacaactccctcaccctctccctttctctacttccacctccacttcgctctctactgtggggctctctcttcccccctctgtctcgcctcccccttctctgtctctctctctatcgctgtctctctgtccctctggttctatttctccatccctctctcccttgctctccttctgtagcaggaggagctgcagacaaaacccctcagacaccgagttgtagaagggagggctttattcagctgggagcataggcagactcacgtctccaaaaacctagctctctgagtaagcaattcctgtccctcttaagggcttacaactctaagggggtccgtgtgagggggtcgtgatggattgaggaagcagagggtacgggacgggggtctgcatgcaccggtaattagatcagaacaaaacaggacagggattttcacagtgcttttctatataatgtctgtaatctatagataacataatc

SEQ ID NO: 265711 - DNA, 333 bp, Homo sapiens
cccagttgacctaggggtgaaacaactggaatggaagacttatggagtaaaatggagaggggaggacaggaaatttgaagtctgaaagaaagagatgagggtatgtattcccttggtttctcctatctgctttttggtctgttgtcagtggctgcaattctctacataaaaccacggctctggttgagtggtaatccctcttgcaccatgactgtctctgaattttgagagtcattctttccttttcctctttcggcttacacatgaaaatggcttccttttgtgtagctaggttaagatgctttatttttcttattgattttgtcagggtcc

SEQ ID NO: 265712 - DNA, 373 bp, Homo sapiens
gaacacaacctcctgaagaacagcagaaaatgccctgccctctctcctgccaacaaaacattttttcaattctactcactctaccccttcacctggtaagagtaagaagtactatcacaacttcccatcaaagtactacctaaatatagcatcaaaagaataaaatagtcgggtgcggtggctcacgcctgtaatcccagcactttgggaggccgagacgggcggatcatgaggtcaggagatcaagaccatcctagctaacatggtgaaaccccatctctactaaaaatacaaaaaaattagccgggtgcggtggcgggcacctgtagtcccagctactcagaggctgaggcaggagaatggtgtgaacccg

SEQ ID NO: 265713 - DNA, 231 bp, Homo sapiens
ccccctccccgcccctcgcggctcccccaccctcgcgttcggcagcgccaggctgcgctctccccggtgcacacccggccgcgccgagaactaaatccgcgggctgaaattacgttttaaaaattaacatgttgaagcgtgtgccatttagtgagaggtgttttgggcaaagaatcaatttaactgtgactgaccgacgggcttgactgtattaattctgctaccgaaaaa

SEQ ID NO: 265714 - DNA, 529 bp, Homo sapiens
agtagtaattcatacttaaaaaaaaaaacaaattggagtggtttaaatgtcactccgatcactaagaacctatcatggtccctgtgacctgcagaagataatccagagtccttaacctggttttgaaaacctctcctgatgtggccccatcctgcctatgagccttccttcccttcatgatgttcaaatgcagatgtaaagtctgatcagtgccctcagcctcccaaagtgctgtgattacaggtgtaagcctctgtgccctcccctgaatatgtactttctgctagaagcctggctcccaggagaagagaggaagggacaggctcaatcccaagctcaacaaaatgacaagttactcctcctttcctggagaagaattatatggggagtcagagagaggccagaagtacgctgctaggagattctgcatgtgggaggacacatgaggattggagacttcattttactgtatcatgtctgcataaattcaaactaagttctagcgaatttggaagtagtaattcatact

SEQ ID NO: 265715 - DNA, 293 bp, Homo sapiens
aatgttgctggttcataaggcatactttgagtagcaaggacgaggaataatgctgtatctttaagaatttattagaaacttgtttggcttcctctaaaggtatcactggaaggaaataaaaagcatattttgtatatgcaaagtttcacaatactccactgggctcactcatcttcataccgctgtctatggaagatgagtaaaaatttccattaaaggaaaaccttttaaaccagaatgtaaataggcctttgctgctttcagttggtcagggcaaaaaaaaaaaaaaaaaa

SEQ ID NO: 265716 - DNA, 643 bp, Homo sapiens
atattttaattttggaattgaaaatagaaataagtaaaacagcccagtctagttttagtatgttatgtgaacataactctttagccatttgtaaaagtttgagtttggtggtaatattgtatgatggagatgaatgaattttttagttatataaataattatgtaaataatacaataacagaccatacatttttagacatcattgcaaatattcttttattaaatttaccttttctttaatacctattttttaataggtagaagataatgtgatgtttgatggccaattgaaggacatgaaggaattgggagttaattctgtatgcacagaggaatgcctgaactgttttaaagaggataatggcatgatcagatttatgttttagagagaaaacccatgtgggccctgtggagtatggattgtcataggggaaaaaccaaaggcaggaagaagctcttagaacagtctaggtgtgagaaataacgcagggccagtaggaatggagagaaggaaatagatcgtgtaatattttggaggtagagttgacaggctttggtgatcaattataaatatgccatagaacaggaatcagatgataaacagatgttcttggttttatggcatttgcattcttgtgtatgc

SEQ ID NO: 265717 - DNA, 442 bp, Homo sapiens
taaccagagaaagtaatatgatcagaacattgttttaggaaaattaatggtggctgttgtggaagatggattgaacatagataaataagctattggaatagttcaggcaaggatattaaggggcggtattcaggcatggtagtgttaatgaaaggagaagggaggatgcatgggagaggcttcagtgggaaagttaaaagacttgtctgatgggataatggggatgtaggaggcatgaaaaatcccaccaaggttttgcctgcttttatgaaacaatggaggctggtgaaatgtggggcaaaagagatgtttggtttagacatttgagtttgagatgcttatagattatcaagacataatgctaagtaggcttttggacacatagaactgtagattagggtaaagaggaaagcttagaagttttactaccgccaaaaaaaaa

SEQ ID NO: 265718 - DNA, 413 bp, Homo sapiens
gttcctccatcattctccatccttttctctgctgcaacagactattatgtgagtctgctttggaccactggatttgaaataacaaaaaggaattcatgtgtaatagacttagcattaagatgactctatgacacggatcctgaaacaaattgtagcgttattcatccatatacatcaataaaagttctatttccagacataatgacatttgctggtttggaaactgtttccatcataatattaaagaatattacttttattaaaagtatcttggaggtctgatggcatttgctaattgaatttgaaagtcaagtacaatgagatgttcactcttaatcactatatatgtgggttttaaagttaggaagaccgggcttcaaatctcgggcctgcaactaactagctgtatgaac

SEQ ID NO: 265719 - DNA, 1255 bp, Homo sapiens
ggttactggacaacatagtgtgactgaaaatgattgagtgtcggagaagcccgccatccttctgctcgattatttcattttgcatttaggcttccccaggcttcatttgtgcatgtattttccctatcacaaaccaaaatataaagtctccctggcttaggattgtatgcatattttttcttcctttaaaatgtctccaaatgaaagttccccttgagtattgactcagaagctgaggagttcattttcagtgcacacatggtcagtggaggtggttaggcttcagagataggtccctctgaacagtttatctaaataggtctatggcagttgtttaaaagccagcaaaactcaccaccgtttgatagatggaaattgtcacagaatatgccttctctgacaagtagaagatttggaataagtagtgaggccagaaaaatgtttaaaaaacatgggcaagaataggcagaaactgtatttaggcaattaaaatgtcttttggaagagtgcgtttcagtgatagttgaagagttactaaaaatatatttgaatagtcaggaaaattaagctatgtctttttttttggcctgcagttttggtctgaggcgctctgggcaccatcactcacattgttttgttggtattatttcacctagtgtctgagcaaggaagaggctaaggcttcctttcaacattctgttctccaacctcatttattggattcccctctgctactggtgacaaaaagaatggattatacctttgtgtaattgtgcttgttccagtacttcatgtgaccaaatctaggaaagaataggaatttactgagtttgttaaaagtgggaatggcccaattgttttagtctttgcagcatcttaatcctagagagcagtgaccagtgagaagaggtcaggattttctcagaaatgggggcatgcgttacatggctgtgctccactcaaaaaagttacatgaatgctccccacgtttcagctctcagaagatattttgcttgtttcagtactagatggtcaaatggtaaaggcctagatctgaagttcatgaggaagaaacccctgaaatgacagacactgaatggggataaatgcatctatgtgattaagtagttggtagttcttccagggtttattactcaagagaggaggtagggaaatcgtgcaagtagaaaacttgaaaagactcaccttagaggggatagctaaagagtaaaatgagtaacagttaaataagaaa

SEQ ID NO: 265720 - DNA, 1209 bp, Homo sapiens
ggttactggacaacatagtgtgactgaaaatgattgagtgtcggagaagcccgccatccttctgctcgattatttcattttgcatttaggcttccccaggcttcatttgtgcatgtattttccctatcacaaaccaaaatataaagtctccctggcttaggattgtatgcatattttttcttcctttaaaatgtctccaaatgaaagttccccttgagtattgactcagaagctgaggagttcattttcagtgcacacatggtcagtggaggtggttaggcttcagagataggtccctctgaacagtttatctaaataggtctatggcagttgtttaaaagccagcaaaactcaccaccgtttgatagatggaaattgtcacagaatatgccttctctgacaagtagaagatttggaataagtagtgaggccagaaaaatgtttaaaaaacatgggcaagaataggcagaaactgtatttaggcaattaaaatgtcttttggaagagtgcgtttcagtgatagttgaagagttactaaaaatatatttgaatagtcaggaaaattaagctatgtctttttttttggcctgcagttttggtctgaggcgctctgggcaccatcactcacattgttttgttggtattatttcacctagtgtctgagcaaggaagaggctaaggcttcctttcaacattctgttctccaacctcatttattggattcccctctgctactggtgacaaaaagaatggattatacctttgtgtaattgtgcttgttccagtacttcatgtgaccaaatctaggaaagaataggaatttactgagtttgttaaaagtgggaatggcccaattgttttagtctttgcagcatcttaatcctagagagcagtctaccttggccaggtgcagtggctccttccagcaattccagtgcttggggaggccaaagcaggaggttaacctgaaaccaggagttcgagaccagcatggacaacatagcaaaaccccatctctacagaaaataaaaagatcagcccggcatggtggtgcatgtctatagtcccagccacttaggaggctgaggcgggagaatcgcttgaggctgagagacggaggctgtggtgagctgagatcgcaccattgcactccagcctgggcaacaagagcgaaactccatgtcaaaaaaacaaaaaaacaaacaaata

SEQ ID NO: 265721 - DNA, 461 bp, Homo sapiens
cgcttactgcaaaggtctgcagcttcactcctgaaatcagcgagaccacgatcccaccagaaggaagaaactccggacacgtttgaacatcgaaggaacaaactccagacataccatatttaagaactgtaacaccacgagggtctctggtttcattcttgaagtcagtgagaccaagaaccctcccaattctggacacaaaagtacatcactcagagatctgttaatgacaaagttaaatttgtgagggacgggttggtagtaatattttatagtatttcccatgtttctgcattgccaataaagtagcattgtagaagctgacatctcagaatttacaagtaactaaacatttttaggtgattcagaaagatatatgctaggagacagcaaagaattcaatcttttgccttttcatttcaatcttcaggcttgttaaataaactcctttaactaacaaa

SEQ ID NO: 265722 - DNA, 997 bp, Homo sapiens
cccttcagcctggctggctctccagccatctcggaaagcttctctttcctaaaccctccatactcgcaggttcagctacagaggtaactgcaggctcaggttctccagggtggccagcccaccagcccaccgtcccggtgcagcagtgcctctccagcgacagctccaccgcgagcctggcgggctcccgaccttgctccccagcacgtcgtctccaagccacggtctcaccaccctccatcagcctcgggcgacaccaaggggaacagagcgctggagctcctcgaagtcctcccgaccttagcggggctccgttcatcctcccggacgtggccaggccccgctctggccccgcgcccgcccctcccgcggggctgcccctggctctctgccggagacccggactcagtgagtgagcgcagcgcggccatagggcttcctgcagcggggtctcagcacgtcttctggctggactctggggtctcctggcctggctgtgtctcctggttctcagcgctcgcctcccacgcggggcggagtatgggagtgggctgctcccgcggaagaatcctggggaagttgaggcactggctcctgctgttcagaacactgcccgacgtccccagagctagccactcctccttcccacccacccgcagcactctcgaggtcgcaacggcagtcaccaggtcccggggcctgcgttcagctgcttgatccgactaggtttggcttcggacccgaatgggtcagctccacgcccgatggagtttttcaagctggtgcctgcacgtgcccccgccgcggggcatgaagccgtgggctgcgcccaaactgcctcacaaccaccgctgacccgaagcctctctcactccgtccactgttagaaacctgaagctgccctctgtgagaaagcgttgggattgaatccagacttttggggaaccttaacaataaagaatacaaaatattgactaaaaattggatttgaaagtga

SEQ ID NO: 265723 - DNA, 379 bp, Homo sapiens
agtaaattatctattttctctcctcctgctttttttactggacaaaggaacatgacctggccaaaatttcttctcctgggatgtttgtctgcccggctacttatatccattgtacccatttccaacaaccatgcacccatggctttgcccagagtccctggaatcttttcaggttcatgtaaacttaaaatttatgcaaaggaaatccaccaaggattggagaccaaaaaacaaacgtatgacatcatgctataatttcacacacacagaattattttaaaaatagaatgggttcataaaaatgaaataaattgctgatatgtaaaactcatcatagaaaaatcaatgttattaaaatggttattcataaaataattca

SEQ ID NO: 265724 - DNA, 521 bp, Homo sapiens
cagaattaaagagacctgtgtaggaatcgtgttggtgttagaatactattagcatttctaaggagagaggagctggcctgggaatatagtcatcagatggttttaggaggtcgatgggcaagatcattgtgaaattttagaagagatggtccaaagaaaaacttacctgcttgggtcagtaataatcaactagacaggaaggggaaaattgattgttagtttgattttttagtgatcacttaaaaaaaaaaggtcagtcatgggggctcacgcctgtaatcccagcactttgggaggccgaagtgggtggatcacccaaggtcaggagttggagaccagcctggccaacaaggtgaaaccccgtctctactaaaaatacaaaaatgagccgggtgtggtggcacgcacctgtacttgggaggctggggcaggagaattgcttgaacctaggaggcagaggttgcagtgagctgagatcttaccactgtactccagcctgggcgacagagcaagactctgcc

SEQ ID NO: 265725 - DNA, 424 bp, Homo sapiens
ctaaaatatgttccatgaacatggcagaataaacattaagtcatatctaactgtttacaattatgagacaaaatcagccctggatttaggaaatagttggtgtaagactaatgctatagactaaatgtgtcttcccaaaattcctgttaaaattctaactctggaggtgacggtattaggaaataatgcctttgggaagtgattatctcacaaagtcacagtcctcatgaatgggattcctttcattataaaatagaccataggaagtgctttcatcctttccaccatgtgaggacatggcaagaaagtgcattctatgaaccaggaaatgtgccttctccagacactgaatcatcaggcaacttgatcttggacttcccagcctcagaactgtgagaaataaatttctgttgtccacgagaca

SEQ ID NO: 265726 - DNA, 519 bp, Homo sapiens
tgcaaatgtagctccactgcctacttacaatggtgttaatagtacaggagggtaagagagacttaaagaagggttagtcgaaattctttcagcaacggtggagcataaatatgtattctggtaaatattcgttgagtgtttagcaatttctcgagcacttaactgtgtgccaagtacgcgataggcaacccggcattcatctgagaaagagacactgtcactgcccttatggagcctgcagcttgggggaaactcgtccgcaaactagcaaaatcgttccagattttaatagaatggccagactgagaaagttcaagagacagtagcggtggcggggacggggggaggctcttcagagagagtggcaaggcaagttctctgaggatgtgatatctgagctgaaacctgaagaatgagaaatattcagacaggcaaagaactgggaaagaattacatgccacgcctttcacagcgcatgccactctaggctcttaataaatatttgttcttttaaaaaaa

SEQ ID NO: 265727 - DNA, 427 bp, Homo sapiens
ccttgggtttttttgtttgtttgtttcttgaaagacatatttcaagatacaaagacataattttgttatgagggaaaaaaatcaatgtattctttctatctatgtataaacatcctggacgtggaatgtttaaaatattcaaaggggttgcaatgtcagcttaaaaagccaagagttttacttttcaggggaccaaagtcaagaattggaggcaggaggaaaacataatataaacaaattgtttctttcaacactctaataagttttgctagcaaaaatgactgagctacctaacttcaaggcagtgagcaagtcttctaggttccatgaacacatcccacccacaccaccaggacatagatactcagtttttattaacatgaaaggaaagttgaagggagcagaaataagaaatacatcttacatt

SEQ ID NO: 265728 - DNA, 644 bp, Homo sapiens
gaaagattttacagtaataaaacaaatttaatgggccagttcactctttttcaatcatgctgttaaagtttactattgaaatacttgctgtcttgggaattaccatcacttcagtttatttgcagcctctgtcctaaagtgaatctcacataacaaaagcacttgtactttaaaaaatgtcttaagacttcctactacaaataacagatttaaagcagatttaagacgtgactaactttatttaatccaccataagggatcctaaatgtaaagaatgagactttgtaagaaacaaactgcaaattaatctctagcatcacagaaatattccccattcactgccttttatgactttcaattcattgataatcaaaaacatcagttattctctaattgtatggaaaataactggttgtctataaaaagaacagaactttccaataatagctttaaactttcaaattatcattcttttccaaaattcataaacaagaaagagtcactagctgttactgacatcttttaataaacatggaacttgaaaaaaataattcacagagggattctttcctttatgttcctatctcctttgttctctttcccatgaattcccctctttttattaaattcctaacttcataact

SEQ ID NO: 265729 - DNA, 619 bp, Homo sapiens
cacatcaatgtgtcatatgcacttctgtcctaacatatccaaggctgaacactggacctccccctccataaacagttcctgttccagttttccctgagtagtggctgtatctatttgcccaagtgcacaactcagaaaactcaaaactactccacatgctgacttctgttcacactcacatgaacttatcagaaggtcctttctgttctaaaaatcctctaaaaatccatctgctttccatctgctttgctccattttcattgccatgacctggactgcagtgacagcctactaatgagtatcccccattctccaaccagctaaaaagagtgatcttggctgggcatggtggctcacacatgtaatcccagcactttgggaggcagaggtgggcagatcgcctgaggtcaggagttggagaccagcctgaccaacatggagaaactctgtctctactaaaaatacaaaattagccaggcgtggtggtgcatgcctattatcccagctactaaggaggctgaggcaggagaattgcttgaacccgggaggtggaggttgctgtgagttgctatcacaccattgctctccagcctgggcaacaagagtgaaactctgtctc

SEQ ID NO: 265730 - DNA, 549 bp, Homo sapiens
cacgaggaatgacaacataaatagaaaagcccaaaaggaaacttaaacatgcagacttgtcatcagaatcgaggagaagggtgagctgtttaacttcagctgagcagcatatttgggttcaggggctagtttgagccagggtttaaatcaggcacaggccagagtgatgtcccatgggtggcccgagagtgggctcctggcaaccttccctgatctggaagcttcaccccctgcacctcctacctgtcttggatacagatcacatcacattgtgatcatctgtgtttcttgagtgcaggaattatctgtctcttctttgaaaccccagcccagggttcaatgcctggtgctcgctggatggatccttcttgccgatggacacattcacttggcaatgaattctgtcttatgtggtgcatgacttcccaactaggtggggaacttgctcacttgccatgtcttgcactctgaccccctctcccccacaggaagcctacatatagtaggtgctatactagtaactgacgaagcgacacacatcccaacctg

SEQ ID NO: 265731 - DNA, 172 bp, Homo sapiens
ggtgttccatggagagggagaaaggaacaagcttggccaattcattcaactccttataaaaatgatgaggaggctgaaaaccaagaattttgattgggaacagaatacaagcagctgaagcagatgaattactaagcaacaaagatcctgtttttatacaaatatccttagt

SEQ ID NO: 265732 - DNA, 486 bp, Homo sapiens
tgattcgtaagaccttcaggatcctgtagtgcctcagggtcaccattaggtttatcatcatccttgatgaggtggggcagctgaataaaagcaacagatttaaaattacagatcgcactcccaccctgcctacttgggtggtattggacaggtgactttgacctctggagcctcagagtctcttccaaaataagggtggcagcattacctcatagggttgtcatagcagaaaactatgtgcatgaagaatattgtccttatcatcattactattaagctacaaggacatcaaactgccagctgatacaatgtcttttttttttattttaagcatgtttcaaagccatttactttggtctccttttaaggaaaatgacttccccagcagcaggaattgctgagaaagtgatatttagtcaagtgctaagaagagtgctataaaacattgtttaacctgcagaagcagtataagtctgttgttaaaaa

SEQ ID NO: 265733 - DNA, 335 bp, Homo sapiens
aaaataatttgagattaaaggaaacaaaaacacacccaaaaaatccataacaaaacttatgatatgcagctaaagcagtgcttaaagggaaatttataaacaccaaattataaaaagaaaaaatattaaattaatcatctgtttaccttaaactagaaataaaggaacaaactaaacctaaagcaagaagaaggaaggaaataataaagactagagtggaaataaatgaaatagagattataaaagcaatagagaaaaacaaattaaaccaaaaatgtcttctttgaaaagatcaagaaaattgacaaactttttgttatgctaaattgaccaag

SEQ ID NO: 265734 - DNA, 561 bp, Homo sapiens
tctgcttaaacctcacaggctcggagatgagtgattaaaaagccatctcgaacttggatggaatccacattggtagtaatgccgcatccgcactggctttcttcaggccccgtgtcattgggaaccaggcccagggaacatttgactggagatgatacatggattatataggtcaattatacacttaatctgccttctggaggattaagtatttgcagattgactctgcatttggcttctccgtggcagttatcagatcaggaaagggcctcttaccaaaccacctcgtaagaacttaatcaagcagtgtggtcagcttcggaaggggctgctactcagtattctttgcctcgcacggattttaatttgctgttccattttcaaatcgtgtatttgtccagtttgtgtggcagaacaataattgagtgtgactagttcccttgaaaagggtaatttgaaacatgaaacctttgcctgttaaaatatatttgctatatttatatatgaaaccacagatacccttattttaacaaccttattaaattactaaagcaccataca

SEQ ID NO: 265735 - DNA, 495 bp, Homo sapiens
catcacaaacgaatattgcagcaggtcaaggggacactgctattgtgtgcacactgatggagacccagagtaaaacgtggcctgaggtttgccagaatgtgcttaagaagcaaacctcacatacctgaaactctcttcgtgccctcctgtccttccaaaaactatcagttcgaatatcctgagaaatgtcacataggtaagctgtaggaccatccttgagaggttgctgttggtaaaaaccaatggggccagaaaacatgaatttatatcccagcactctgggctataactttgagcaaattaatctctctgatattctattatagcaattgtgaattgacaatgtcatcatagcccatttcttatttctgaaaaagtgctttttctggatctcattcacttaagaactcaaattctaaacatggagaccatcagagccaaggtccttgttaaaagaaatgtatgttttatatattaaagtttaaaagaaatata

SEQ ID NO: 265736 - DNA, 697 bp, Homo sapiens
tagatgttctgacctttaccttctttccttgcttagttactcccattactaaggcttccagtccttttagcctttgtttctatgtcacattaaattaatgaaactagataactttggatctccttaagccatctgaaactagataaaccaatgaaactagataactttggatctccttaagtgaatgccatgagtgcatgatgaccaaacactagaatctggggacagactgtctagatttgaatcttgacaatgcttcttcctagcagcatgaccttgggcaggctacttaactaagactcagtttcttcatctgtaaaatgaatacagtcatattacctacctcataggctagtcgtgaggatcaataacatactgtatataaaagaacatatgtaagtgcctaggataagtgaggagctagatggttgttaagtactaactgcagtaccaggaatttcataggaagctataacagctacatatgtgtgccttcataagccagaaacacttattcagtgaattgtcaactacttattaaacatgtcctctgaacataggactctgctaagctcagctcaggatttgaagctgaaccttgaagtttcattaagtaggatttagttaagtggagaagaagactgatcgacgttgttcagtatggcaggtggcctctagctacgtgtggctactcagc

SEQ ID NO: 265737 - DNA, 389 bp, Homo sapiens
gtttactgctctatctccagcacataataggtgtctgataaatatttgttgaatttctacgtaattccctaggatgcatggcttatgcatggctttaaaaattacctaaatgcaggctagacacagtggcttacacctgtaatcctagcaccgtgagaggccaagacgagcggattgcttgatcccaggagttcaagaccatcctgggcaacatggcaaaaccccgtctctactaaaaatacaataaattagccaggcatggtgatgtgcatctgtagtcccagctacttgggagtctgaggtgggaggattgcctgagcttgggaagtcgaggctgcagtgagctgagatcgtgctactgctctccagcctgggtgatggatgtgaga

SEQ ID NO: 265738 - DNA, 472 bp, Homo sapiens
tccgtctacagctgggaagggtcctggcctaaaacccacttaagaaaacaaatgagcagcaacagtacatccaaagccatgtaaataaatatgtcccgctcctccactgtccagctgcatggccttaattctctgagcctcagtttcctcatttgtgtgaacagcatgatgaacgatagtgtctgctaccagagctgtaaggagcagcactgagcacgcccagcagccggaggacagcacctggctggcagggagtgcacgaatgtgctgttgtgtgtgtcagtgtgcgcacgagagagagagagagagagagagagagaaatctggaaggagaccaaccaatccaaaattacgctcaggaggctgggccagtgactgactttagtttatctatatttgctctttttttccacaactttagaaagtgaacttactcacttttgtgggttctaaaactactttgaaaaagaaa

SEQ ID NO: 265739 - DNA, 444 bp, Homo sapiens
cgtcacttgaaacagcagagctagtttaaaaggctgatagatgtaactggaaagacatccagtcctacatccttcactgttcaaaaaagataagatatatatatatatatatatatatagttgtggaaacatcagttcctattatagatcattatgttcttcctctgagatctcctcccagcattttgcttcttaatttccagcgaaagcctctcttttttagcttcttccaacttctcttgaggaccaagttaacaacacccagaaaaataatcaccagcagcgagcgaccttggggtccttttctgcaatctctagcttgtgatttttcgcaagcagtttgtgttagcatttgctctgcaaaaggttttttttttcttttttaatacctaaaatcacaataggaaagactaccatcgtggtcaggagcaggtggagaaaaaa

SEQ ID NO: 265740 - DNA, 646 bp, Homo sapiens
ggtaccatccataatgtgtgccaggaaaagggctgccatggtggagcatgcacacgcatcgtgtgtgtgtctatagaatctgcagatttcatcagctttttaaagggctgtgaccgcaaaagtgtaaggatcacaggaatagactctataaaacaaccagcagtgatcagaaggaaccagttttcctttctgaaaggccgaagttggtattaaatgctttagcttagcagaaattgaaagagggtcatgaaacaccgatggacattgatagcgatgattccaaagcagcttctccgccactcaagggctctgtgagttctgaggcctcagaactggacaagaaggaaaagggcatctgtgtcatctgtatggacaccattagtaacaaaaaagtgctaccaaagtgcaagcatgaattctgcgccccttgtatcaacaaagccatgtcatataagccaatctgtcccacatgccagacttcctatggtattcagaaaggaaatcagccagagggaagcatggttttcactgtttcaagagactcacttccaggttatgagtcctttggcaccattgtgattacttattctatgaaagcaggcatacaaacagaagaacacccaaacccaggaaagagataccctgg

SEQ ID NO: 265741 - DNA, 803 bp, Homo sapiens
actgaattactacaggagatatcagagatcgaaaaaaggtatgacatttgcagcaaggtttctgagaaaggtcagaaaacctgcattctgtttgaatccaaggacaggcaggtagatctatctgtgcatgcttatgcaagtttcatcgatgcctttcaacatgcctcatgtcagttgatgagagaagttcttttactgaagtctttgggcaaggagagaaagcacttacatcagaccaagtttgctgatgactttagaaaaagacatccaaatgtacactttgtgctaaatcaagagtcaatgactttgactggtttgccaaatcaccttgcaaaggcgaagcagtatgttctaaaaggaggaggaatgtcttcattggctggaaagaaattgaaagagggtcatgaaacaccgatggacattgatagcgatgattccaaagcagcttctccgccactcaagggctctgtgagttctgaggcctcagaactggacaagaaggaaaagggcatctgtgtcatctgtatggacaccattagtaacaaaaaagtgctaccaaagtgcaagcatgaattctgcgccccttgtatcaacaaagccatgtcatataagccaatctgtcccacatgccagacttcctatggtattcagaaaggaaatcagccagagggaagcatggttttcactgtttcaagagactcacttccaggttatgagtcctttggcaccattgtgattacttattctatgaaagcaggcatacaaacagaagaacacccaaacccaggaaagagataccctgg

SEQ ID NO: 265742 - DNA, 374 bp, Homo sapiens
caatgtaaataactccaacttctttagtgggactaagtagtgagatagaagaaaagcacacacgatgaagtaaaacttgaaaaatggtgtggatcttatagcacaagtttgtaagtctgattcatagttttatttctccacagtttgacccttactgttcaggtacttaatgatgcattctttatcagatttaaaattactagaaggcaagttattttctttttctgagaagacgaagagtcaaaagcaaaatggaaatgtctctaagctatttaactctgtatcttggtctaaaagtatactgaaaatgttctttgtacaaatacagctccagttctggacaataattaaatatttataattttaaagcttca

SEQ ID NO: 265743 - DNA, 449 bp, Homo sapiens
taaatactgaatgaatgaatgaagcactaaactgaatgcatataaggcaaagacacaaataacttaattttgtgcagccaaatcagtttgtaacttcaccaaacagttcacatcaacatttaatgagcgtccctttgcccaaggcactgggtgaaggatgagggggtattggtttgtgtttatgtagaattttgcagtttgcaaagtcccttctcttacatctcttcatgagggtttcacaacgactctgtaaggtaggggttgtcattattcctgctttcccgataaggatacagaagctcagagagggcagacatttgacctggagtagaactagggcaagaatacaggccactgtgtgccccctcctcccacgctctgtttctctctgaagatgacctggggacagcataatacaaagtggatggaatgggctgagaaaggagagg

SEQ ID NO: 265744 - DNA, 421 bp, Homo sapiens
catggggtccctgattagctgatctgagctggggtggggcttggcaatcattggatccagtgcttttcctgaaacatgagcattgagtttcctgcccacacaaccctgggcttaattaagtccaagcaacaaacagggtcctcagtatgcttaaaggattgacattggatggaagacaattcaatgtttgagaaatccctgcagaccctctgggagtgtcttgaattctaaggagaccatcttgccctacttccttatttgacagaaatggaaaactgtggctcactgaggtggagtgaaataccccaggtcatccagcaaggtgagggtggagcaaaggcttggtcccatggcatatattcatccatctccttgcccatccgttgtcttccagcagaatgtaagctctgagaagataagg

SEQ ID NO: 265745 - DNA, 570 bp, Homo sapiens
ggagttggaatcaggctgttagcgataaaagggttcaagttgactcattttccttatcaggcttagtagttgaagtgacttgctgagcttcataattcttagagaacctgccatgaacccagctccctttctatgactcaccctgccaccctgtgacacatagagtctgaatggcaggtctggggctagaacccacgtcatctggacttggagtccagtgaccctttgggttaagcatgtgtgtgtgtgtgtgtgtgccatgatgcgggaggaaggtccctgctctctgtagctgttttcttcatcctttgctctacaagccctaacagccgattctgtcatccctagtctgcccctctcctgtttctccatctcctctgaccatgatttttttctgtccctggagggatgatggtctcattctcacctcctccacgaaacgtgttagcttttcatattcctagatccactcacttctcatcatctttttttttaaacaaaattttattgaaaaatgtaatatgacgtgtcaaagttgtaaagttattgagtaaataagcatgtatccta

SEQ ID NO: 265746 - DNA, 385 bp, Homo sapiens
taagtaaggtaatattgatattaatagaacttcattttatttgcatcatttacaaaaatttaacttccagttcaaccgactgtgaaaatttatgttatttaaagtcagtagaccaattgatatgcaaagaaaatggccattttaaaatcaggatttgttctgcattattttcagtttgggatatcacaatgttttcagaaatatatctcattcataataagtgatgactgagttttgtgtatttgttattttattgttttattttgtttttctaaagagactttgcctactacttagaagcaaaatgaatatatttcacagtgactactgagctctccactggatattgaaatgtaaatgattaaagttctatacgttcagccca

SEQ ID NO: 265747 - DNA, 509 bp, Homo sapiens
gtggtcataacaaatttatagacaaatgaagggaagtgacaaatcggaagtgaggtacacagtggctggattggttacagatttgcaattgtcttatttgaacacagttagaacactcagcagtccatgagtggttgaaggatggctgctgggattgcccaagacgcagctactgttacaggcgcatactcctaagttaggctttcaatcttgtctacctattaagctaggttacagttcatccacaaggactcaaatatagacatacggagtccttctcaggcaatatttagtttgctttaagagctataaatgctagccaaaaccataaatgggtatggggcatcggaaggatagtgaagaaacaggagtggacaagtcagcctttggggtacagttcagaccatcctgggtaaatgttgagaagcaaagaagcaaaaggagacttagtaggatatcagaggaaattctgtgacatatgtgttttattcagaattggagcaaaagaa

SEQ ID NO: 265748 - DNA, 316 bp, Homo sapiens
tggccccaaaactggccataagcaatatctctatagcactgtgacatgcttctgattgctatgatgactacaatgaaggttgtttatcagaatgaaggccaaggacacctggcacacccagggcagaaaatcactgaaggtattcctgaaccacaaataataccatgaacgatctgtgcctcaaagacactttcccactgcagataactagccagagcccatcctttgtctcctgttttagttaacctgtaatctatagaaacaatgcttatcactggcttgctgtcaataaatatgtgtgttaaactctgtttat

SEQ ID NO: 265749 - DNA, 211 bp, Homo sapiens
cacgcagtggggaggggcgaggggtcccagggccagcagctcccatcctgctgtgtccatggccctggaccctggaccctgtgtcagtgtggctgcctctcccctgagcttctgggctgagctgttactgatgtcagtgagagagtaggacgctgtagcctctagggctttggtaagtcagccctcaagagtctctgatccccaaacttga

SEQ ID NO: 265750 - DNA, 455 bp, Homo sapiens
aaataatgaaacaaaaatagataccaatcttaaaagccttcttgtggggctaggcacggtggctttggttgtaatcccagcaccttaggaggccaaggtaggagaattgtctgagcccaggagttcaagaccagcctggggaacatggtaaaaccccaacaggatggatttgattcctatacaaattgaagctgccctgccaaggagggcctgcctggaggggatgagaccttcgtcctgaggcctcagagtcaggggatcaggagtcggggagctagaatagaagcacacagcctgggcacggtggctcacgcctgtaatcccagcactttgggaggccgaggcgggtggatcacctgaggttaggagttcgagaccagcctggccaacatggtgaaaccctgactctactgaaaatataaaaattagccaggcatggtggtgtacccctgtag

SEQ ID NO: 265751 - DNA, 481 bp, Homo sapiens
tatttttgtggtcttagaaaaaaattattaaatgaaccaagtaagcagaatatacaacattttcaaatactaaagaaaaaaatcattgaaaattgcaaaattttaggctccaaaagactcactaatttaatagaagcagaaatcctacagctagaaaatttgcagatagaaaatatatttttcagcttggaaatcaaaatggaaactacaaattcaagcgtaaccaacaaataatatatacctacatatcgtgtaactttttgttgaaaaaagacatttcgaatattatagtaattttgaaatcagattatcatccttcttctgtgtttttgttgctacctattgcgacgtgtgctctgtcatgcatgtacattgacatctctgttccattagcttggtagtaagctactgatttgcagagattttcttaaatgtttgttatttccccacttcctccaaataaattttataatgttcaaat

SEQ ID NO: 265752 - DNA, 422 bp, Homo sapiens
gctgagtcagggagaactgcttgaacccaggaggcaggaggcaaaggttgcagtgagccgagatcacgccagcctgggcgacagagcgagaatccatctaaaaaaaaaaaaaaaaaaagtgtctttaaagtgaggtatagtctttctctgatccacttttcaccttctgaggtttttcatcttggcccctgaaaggagctatttttgaaggacttgtgttactcagtttctacaggaattacaagataagaaaaaaaaaatcatatttagtcttatgcgtgcctactggctaatgttcacatatgccaaacactactcaataacataaaataatgtatgaacttattctctggaaatgagtgatgccctctgctctaagtagaccatttatattaaatatcataaatgtataaaggacaaaa

SEQ ID NO: 265753 - DNA, 585 bp, Homo sapiens
tattcatcgagcctgtacctgtgggtagcacaaacagaaatagcggcattgacgtgggccatggagaggcctaaacagatgactgcagtccactgctaaggtcatcaaaggggtgactctgaaataataaatttcagacgccacggcccaaatagctgcatgagctggggaagtcctccacatgcctctgcttccttcggtacctgtttatgaaatcagccaaggtacttccctggggaatttcctttctctttctttctttcgagatggagtcttgctctgtcgcccaggctagagtgcagtggtgcaatctcggctcaatgtaacctctccctcctgggtttcagcaattctcctgcatcagacctctgagtagttgagattacaggtgcatgccaccatgcccagctaatatttgtatttttagtagagacagggtttcaccatctaggccaggctggtcttgaactcctgacctcgtgatccacccgtcttggcctcccaaagtgctgggattacaggtgtgagccatcacgcccggactttttttttttgagacgacgtttcactcttgttgctaccacg

SEQ ID NO: 265754 - DNA, 362 bp, Homo sapiens
tattcatcgagcctgtacctgtgggtagcacaaacagaaatagcggcattgacgtgggccatggagaggcctaaacagatgactgcagtccactgctaaggtcatcaaaggggtgactctgaaataataaatttcagacgccacggcccaaatagctgcatgagctggggaagtcctccacatgcctctgcttccttcggtacctgtttatgaaatcagccaaggtacttccctggggaatttcctttctctttctttctttcgagatggagtcttgctctgtcgcccaggctagagtgcagtggtgcaatctcggctcaatgtaacctctccctccacgagccggtaccgagctcgatcac

SEQ ID NO: 265755 - DNA, 369 bp, Homo sapiens
ttatcctctacagtcctttctgtttacttagttctacaactgcctcatctcactgtgttcttgtagtataactgtggggctcttccccttttagttaagaaagaagcaagacctggagagaataacatgctcaattatggagccaggactttacatagctccctctgctgttttctggaagctctgagaaggcggtgcctacagttcacaactccaaaagcacccaacacattgttatcacaataatttatagccaggatgcctcttccacctgagagtgagctgcctgagccctcaggtttatgtctccagccccgaacacaattccaggcacaaaggaagttctcaataaatacttgtgaaatgaaa

SEQ ID NO: 265756 - DNA, 454 bp, Homo sapiens
ggcttctcagcttttgatattgggtgaaaggaaggatgagaaagtgttacgtctgtcatcagaggagcctgggatgcgtgtgagcttctttgttacccttgtctaatggcttattcttggaacccaggcctgtacactagtataaaactgttaccacctgactagctgtggtctctaaataagaaagtggaaccagaaaatctttccccatccctctatcacaattaatgacagttctttgtggaagcccaggactgccattcccctttcctctttgaatgggtatcagagatttgcagcactatttgcttaaggttttttcttcatgttctgctaacctcctttcacggtctgaataagtgagtgggaattcctctaggataggaaaatatattaaaaagtcaaaatttaaagagatacctgtcaaaatatatggctgaaaatgacacgatga

SEQ ID NO: 265757 - DNA, 495 bp, Homo sapiens
cacctgaccctctgcaggtcataaagggtgaattctccccggaaaagtgatcgattcgttgcctgagtcgtccatcgatctgggcttgtgtaactaccctgtgcatcatttaccaatgacaacgttacagactctgcataacaccactgccttaagcccagggctcccctggggaccctccccaagctggcgacagggaaaggagcatacaatggtgggaaaacccacccggttggaggccagctcaccgtgagccccaggctctggcattctcacccctccctctagtctggaaaacccactttccaagccacttgtccgtggtccctggacttggagcacagttactacttaattcaatgtagcttccccccttctagttcaacatttttttcccattctgctttcaaacatttaaagggtagtgttttcacaactactccagttgttacacaatcacaataaagctttgtgactgtggaccaatgtgaaaca

SEQ ID NO: 265758 - DNA, 364 bp, Homo sapiens
caaagtcagtatttctatattgtttcaatgaataattggaaaataacatttaaaaatatataccctttataatagtgtcaaaaatataaaaatgtataagtttaagaaaaggtataaaggatctccactttgaaaaccacgaaacagaaaaaaagaaattaagaagcttaataaatgtatgtatatgtcatgcacttggttggttgcaagactcaatattgtaaagctgttcttctcccctaagtgatcggtaagattgacgtacttctaactcagaatgggttcttggtggaaattaataatctaacatgaaatgttatgttatatgcaaatgcaaggacctaagatagtcaaaatcttgaaa

SEQ ID NO: 265759 - DNA, 383 bp, Homo sapiens
catgtgaattcccacaggcgttcagaagtttttttctgccctgtaaaagttcccaaatgggtagactagtttatattttgatggccattagtatccggagttctctgtcatggttctgatgccaggggcacatactggcatttaggacccaattgtttgcaaggagttttggaagtctaactgcagcccttttctggaggctggacttgacttggggagggggagaagtacttgctcttttctaagatttgcctccaaattgctactgaagcacattacctgtcttactatgaataattgtaattgtttctcagtgagcatgctagctactttagatatattatgtaatttaatcttcagaatctgtgacagagaaaaaaaat

SEQ ID NO: 265760 - DNA, 435 bp, Homo sapiens
cgtgttctttagatgttgccagggatttttaataaattagctaagaagtgtgtgtgtgtgtgtttttaagagatggggccttattgcccaggctggactcgaacttctgagcttaagtgatcctcccacctcaggttccctagtagctgggattacaggcaggtgtcactgtgcctggctgaaagtatatactgaatgtttcatacatagcactctcctagaaataggggcaggaagtaaatgtcatggttgccttgcctgaaaggaacttaattttgttgtggagcaagtgcaaacacttaagaaaacaaggaaggctgggcgtggtggcttacgcttgtaatcccagcactttgggaggccgaggcaggtggatcacgggaggttgggagttcaagaccagcctggccaacatggtgaaaccccatctctact

SEQ ID NO: 265761 - DNA, 673 bp, Homo sapiens
ccattgtgttgccacccgacgcttcgagcattatgcacgctctatacaacggggagcgcaattctcaaattctcattgtggtgcctgggcgctagaaatgcctttctctctataccaccaacaccctcctttccttgggtacactgtctctcttcccttctcctcctgctcacaaaggcaagctctttcagaagtacgcagaaagggcgattttggccttcagttttaatgatagctgtctttagacataatgaattctaattgtagattatttgtggatggtctgagagtcaagagttggtgttagtagggacttgttaaatatatttcctttataggattcataatctttcaatcacattatcactatataggagttaataaaatccagcgtcaatacttcatgattcacaggtgtttcttgtgcctcatttcattcttatgatcaatatctgctggatcgtaatcctcccttttagcatctggcacataaatgactttctgtatgatgctaattaagtaaaatgaatttcaggacaaaaaaatttcccacttctttactaatgtttatagatagatatttagaaggaaatgcacaacttattttagaatgacatagtatacaccaaatcattataacttttattatgatttttacattcaatatgttact

SEQ ID NO: 265762 - DNA, 619 bp, Homo sapiens
ttattaggttttgtagccaaaaacccaagagcaataacaagctctatagacaataaacacaattctcaaattctcattgtggtgcctgggcgctagaaatgcctttctctctataccaccaacaccctcctttccttgggtacactgtctctcttcccttctcctcctgctcacaaaggcaagctctttcagaagtacgcagaaagggcgattttggccttcagttttaatgatagctgtctttagacataatgaattctaattgtagattatttgtggatggtctgagagtcaagagttggtgttagtagggacttgttaaatatatttcctttataggattcataatctttcaatcacattatcactatataggagttaataaaatccagcgtcaatacttcatgattcacaggtgtttcttgtgcctcatttcattcttatgatcaatatctgctggatcgtaatcctcccttttagcatctggcacataaatgactttctgtatgatgctaattaagtaaaatgaatttcaggacaaacaacttattttagaatgacatagtatacaccaaatcattataacttttattatgatttttacattcaatatgttact

SEQ ID NO: 265763 - DNA, 820 bp, Homo sapiens
agaagaaattcctttggattttcatgggggagcaaccaagaagagttcttcagaaactcagatttaaaaattccttttctagagaattaaaatatattaataacagatttgactttagataaatgtcacactccagtaaagagactttaagaattactcagtaatcaaaccatgtgaattcaatggtctgcacgcttggaatcttaagaaactgctgatgatgacattggctgcctcggttttaggaactgccagaaatagccactaaccaagagaaagagagcaaggactagccctgaataattggtcaacgatgctgatttcgttggtttcctgttccttttgcttcctggaaaatacagacctacaaagcaaacattgtgtgtgggttgatgctacagcatcgtctgaacttggaaggacgatcgtggattctgatgcctcgtggtctcactacaggtctaattttcatgtgttttaggagtcttgggattaggttatgtactctgactctgggcaaatggaaacatcaggcgagaattatttatctcataacatttcttacaaggtattaacttttggaccattttggagaagatgagcaaattcatttctcaagaccagcagggttggttgctatgagcaggcctgggtcagcacataagacctgcccttgctgacctgggaagtttctatatatgatgaaaatctttttcgtaatcggatgatggtaactggcagggtgtcattagatcatgtagatgatggcttatgttaacaacaactattttgttaaaaagtatttgttgaacttctactt

SEQ ID NO: 265764 - DNA, 315 bp, Homo sapiens
gtcacatatgtcaatgaatttccttattagctgtaacttaaaaatacataaaatatagtatttcaaaaattatttttatctaaaattttgtgcaagtcacctaattaatcactatgtcagtataagatttctctaacatggctgggcgccgtggctcacgcctgtaatcccagcactttgggaggctgaggcgggtggatcacaaggtcaggagatagagaccatcctggctaacacagtgaaaccccatctctactgaaaatacaaaaagaaattagccgggcatggtggcgggcgcctgtagtcccagctact

SEQ ID NO: 265765 - DNA, 97 bp, Homo sapiens
aatagaaactagtatttgatgaggagaatggcattcctttggaaacccatctcattcttggcagttaattagttcttactgtgaacatctaaccctt

SEQ ID NO: 265766 - DNA, 99 bp, Homo sapiens
cccccacgccccccaccccaaaaaagagggagatctgaaacacttctggtctcaagcattttggatgaagaacacttaatctgtatgttttctttatag

SEQ ID NO: 265767 - DNA, 395 bp, Homo sapiens
gaactttcagaatctgctggccttctatcacagtcgctctgctgcagagcaccatttttgctattataggcagtaagccagctagcaaacagccatgctggggtacttgccaaactcaacaaatgccatttagaaacaaaagaacctctaatggagacatcagccgtttgttaaacaaaccattagtttggaagcagaagctgcacatgtgatgaatctactaatttacagagcattattggacattagttaattgccagacaacttcatgtcccaggatacattgaggaagcctctattactaaggagagattggatgtcttgcctgttaatgattacaggacgcatatacaagaatgaacgagtgagtagctcctgcatcatcctagtgtttc

SEQ ID NO: 265768 - DNA, 476 bp, Homo sapiens
actgccctgattgaatgagttggtatttgttcctgtttctgttttttggaattgtttgtaaagcattgagcttaattatttaaatgtttgttagaattcagcattgaagccatcttggcctgggctcttcttataggtagttttttttctttttagtattatggtaaatatatatataacataaaatttactattttgacagtaaaaaggcaacctaccatatgggaaaaatatttgcaaatcatacatctgataaggggttaatatcaaaaatacataaaggattcctacaacacaacaacaaaaataatatgatttaaatatgggcaaaagagttgatagacatttctctaaaaatgatatacaaatggccaagaagcacatgaaaagatgtctagcatcactaatccttagggaaatgcaaatgaaaactgtaatgagataccaccacacacccattaggatgggctactatg

SEQ ID NO: 265769 - DNA, 464 bp, Homo sapiens
tcttttttttaccttaagtattataaataattgtaaaggtcctttttactagtttgatgagagttttaaatcatgaataaacatttaattttgtcaaaaatattctaaaattcaattgacataacatgtagtttttcttcttttgactgttaatatggtagattacactggttcattttcaaacactgaatcatccttgcattcctagtcatggtgtattattctttttatagattgttggattcaatttgctagtttaaaaaaacacattaaaaataaaaacatactttttaataattattaaacaattttaaagtgcacaatgcaatggtttgtggtatatttacaaggctgtataacctataccacttatctatcccagaacattttcaccaccccaaaaagaaaccctgtgcccactaattgttactccaaattatcccaattattccccattacctctg

SEQ ID NO: 265770 - DNA, 618 bp, Homo sapiens
gggggaagagatgccacttcagtgttgaatggaatgattgaactccccccacgttcttttcagtcttccacactgcacactccacagacgaacacttctgggtgaaatatgattttatagccagggggttgcatctagatgtgagtgatgttacagtgaagctccagagatagcttagttctgaagtttttgcagaatttgaaaatgagactattttaaaagaaatgcagttttataactcagatcaatgaaataggctctcagtactgtttttttcccgtgggaactctgctttatttgtcattagggtgtccattgtcagtaaagcagtagccttgctaagtacctggaggtcctcaaaataattttttctttaagtaatgtaaatcttgtttctgtaaagcagtctggtttttttttttttttttagaaagttagcttggccaaccctttccccctagttttggaaagatggagcgtagccctgactacctggatgctcagaggcagttcatgttgagaattaacacactacatgattggctctcaggaggaaggtccttacggtctattagtactttaaagaatatacagtagaggccaggtgcagtggctcac

SEQ ID NO: 265771 - DNA, 1130 bp, Homo sapiens
cagctcaattttctatatcctctgtagtcggaattctcaaccattaagacctgaaatcttactgatgttactgataactaccacaatcctcttcaaaggcccatttaactttattaaaaaaaatttaaagtggtcttaaaatttttcggtaaaattctttgtagggttaaagtaagttaaattatttgtaaggttactaagttacttgtaggttatgtaaccatcccccaatgtagctcaaactcatcagttccagttgattgaaactaggcagtctctgaacagacaaaagaactaattctgatctacctttcacacaaaaaagataaagaaattggttttcaccctgcttaaactaatgaaatagcaccgtttacataaagaaaataaataatacatccaagtcactcttcatattttcattctcattttgaaaacttcactttggggcaataactggagacagcaaaatgtaatcaaataaggaggaaattctcctctcattcttctttaaaatacccaagttgttatgacattgttaactttcacttttagtaagattcacttttataaaacttgatgtagattaatttctataaaacactcttggtcttttcacttcccaactcttccccaacttcaattatacaatcagaaaaagttgcttgttgaaaagttttgaaaggaagaggtaaaacagtagctactcctgtgatgggctggatctgggtttgccagcagtactaaaatgcctgtggaaaggtatagcgcttccattcagcagctgcttcccttctcccctcttggctctccaagaacatggtgcttaactgttctttccatctcgggtccaataattgcaacattttgatagactagtctaattccatgtttgtaaaaccaaataaaacctatctaaaagataatacactaagtgggtaacaatgattatttctaagaggtgcagcaagcaaatggtactgagaagtagtcatttaagatttgttctgtatttttgcatctgttcaacaagcatgtattgcttttgtaatataaaaatattaatatttacttaaagattgtcagagaaaaataaatgaattaaagaaaaaaattcctaagaataaaag

SEQ ID NO: 265772 - DNA, 174 bp, Homo sapiens
ttttttaatttgtctgttttaatagctttaagagaagtaatttttcgaatagggtggaggagagttaggagttaactttgtaagagtggtagagataagtttttgtataaaattttgaaggcagggaataacataatagcttataagtatattaataagagcgaacaaggtgag

SEQ ID NO: 265773 - DNA, 151 bp, Homo sapiens
cctccacacctcttgccctgagccccaccgctgtcctggtctgcacacccctcaacccgactgcacatccccaggcacctcccgctccacctgcccacgccggatcctcccctgcgatcacttcctctgtgcaagggggaattacagagct

SEQ ID NO: 265774 - DNA, 370 bp, Homo sapiens
taaaagcaaggatgttttggagaatgaaggggaggatgggcattggagagtggtcagaaataaacacacctttaggcaagtgttagtgaaatgctgttttctaaggagtcagcaatcaaacctatgtgtcggggtcacttaggtctgtttcaagggatgttcttttttggttcactagatatttactgaacaaaatcattgcctctttctgtaatgaagccacacaggtatctcaacagtagtctgtacttgactaagagtcatggctttgactgatacaatcaacaaaaggccatttatttatttttgagattgagtcttgctctgtcacccaggcaggagtgcagtggcgtgatctcagctaactgca

SEQ ID NO: 265775 - DNA, 351 bp, Homo sapiens
agagaggggaggacatgaagaagggctgtcagatttctgaaaatctacaggcgggaaataggcatacatggctattcggtcacaagcacatgttatccttccagaaaagaaaaggatgactccaaagatggttcagagtctggggtgggaggggttgctaatgcattcaaaggcctggagaatacagactcaaaggataggaccatatcttcctaaattccaaggggccaggttacttcctatggctgagtagccctagtgggcccagaacatgaggctaccacctggttgggcatggagaacagaacatcaggcccaagagggttgttctagaacaaaaaaccaaacacc

SEQ ID NO: 265776 - DNA, 267 bp, Homo sapiens
ataatggtgaaaataggcagagtgcatgaacgcatcagagggagtattgtcatcagagggatttgtcattctcaagagtggtcagggaaggctatccgccaagccattggttgagcagaaacctgaagaaggtgagggaatgtggaggaaagagcattccaggcatgtgcaaaggtcctgaggtagaaatttggctgctatgcttctgggagggcaaggaggcaggtccagccagggaagagtggcaggaggtatatccagaggggt

SEQ ID NO: 265777 - DNA, 516 bp, Homo sapiens
atattattctttatcaaaatttaaaatgattgctctataaataggaaactattaagaggatgaaaaggcaaactatagactctgagaacattttgcaaatagcatacctgacaaagaatttgtatccagaacatataatgaactctcaaaactcagcaataagactacgatttaaaaataattttaaaaatcaatagtaagaagatttaaaaattggcaaaatatttgaacagatacatcaccaaagaagatatatggatgtcaaataagcatatgcaaagatgctgaatagcattagccattaggaaaatgaaaattaacaccacaatggcataactattagaattaatggcactttggaaaattgacaataccaacttatgtcaaaaatacagaccaagaggagccctcacactttgctcttaaggatgccaaatggtgcagtccttctggaaaacgcttttgcagtgtctttgaagctaaccttactgtatgatccaacagttccactcctga

SEQ ID NO: 265778 - DNA, 284 bp, Homo sapiens
tcccggtcaggggtcctccagtgcgtgatttcttggttctctcaggacatcaatgatcatcctttggataggtagcgaagtcacattttgctgttaagtggttgtttttctattctttgcccctttccgcagcagcaggtggggcctcgtctatgcactgcgctcaggtgcagatggtatcgagataattgcttgaattcttgtgcagacttttgtaattctgcagtagagacaaaagtcttggaatccgtgctatcaatgtaagaatgttggaatgctgtttt

SEQ ID NO: 265779 - DNA, 400 bp, Homo sapiens
acatgggactactccagtccctttcccaggccagcatgggtgtgctgtctgctatgctgccagaactccctttgtctcaacttccatccagcccactttcctggaaggccaaactgcagtcctttcagccacatcaagacggatctggctgacaactggcctgctgcttggctgaccaactgctgctgttctgttcaccttgggtgcaagttctctgagctccacttcacccgttccctcagctcttgcccccatttcaccatcctggggaaagtttccatgatgtttcactggtgctgccctctgcttccagggtccagtgaagctggaggcccaagtcccctactaaccagcccgcaggcaagctgcctaacctctctgacagggtttcacctacaaa

SEQ ID NO: 265780 - DNA, 437 bp, Homo sapiens
aacacacacaacagacataaacacaaacacacacacaaagacacacacagacacaaacacacatacacatgcacagacacaacacacacatacacaaacacatacatacacacagacacacacatgcacgcagacacaagacataacacacacagacacacacacatgctgctgcctgctgaacaaaaggcatgcctgctttggggcagaggctatcagtgcatcacaacaagcacattagatgggccacctgggctctggcactggccctggcatctccgggaggagtggcggagcatcccgactcaggtgtttgagagcccctgctggggtgagcagggctgctgggtgaccttgaaggccccttctgaccttgccagtctacctagagctgatgcacccaccagctccccttctgtgcctgtgtccacgtttct

SEQ ID NO: 265781 - DNA, 106 bp, Homo sapiens
aaattcatcacttcaataaaatagttatgttaaaggaagcctaaaactttcctattagaagagttggtttttaagtgaaaagtctactcctttcaattaaaaaaaa

SEQ ID NO: 265782 - DNA, 248 bp, Homo sapiens
gccagaggagaggagaggcgcggggctagagtgggagtgtggccaggggagaggcgcagggctggagagggagtgtggccagaggagagaagcagggctggagagggagtgtggccagaggagagaagcagggctggagagggagtgtggccaggagagaagcagggctggagagggagtgtggccagacgagagaagcagggctggagagggagtgtggccagaggagaagagaggcgtggggctgg

SEQ ID NO: 265783 - DNA, 257 bp, Homo sapiens
catctttgtaattcaaactctactgcagtcaagtttaatgaagtgactcttatttaagtccctattacatgatccatgtaggaaatttctgttaggatttggtactagcattaactgtgtcttctttgagaagcatcacctgtcttttccttttatagaataatactagataacatccttagacatctcccatgtgccaggcactatgcccaacacttcacctacattttctcagggtgttcttacaatgtctcttt

SEQ ID NO: 265784 - DNA, 456 bp, Homo sapiens
cagcttttatggtggtaaatttaaggatttggagtataggaataggccataccctgcaagagagagctatcagaagctgttctgtgttttttccaaaaagcagatgtgttatgtaaaatgaaatagaatctgttgctttgctttagctcacttacctgctcagtttctgctgaggtgcatttcctggcagtcttgcttacaggctcaagcagagtgggggtgtttgatgattggcattacgtaaatgattagagggaaattaaatatgagaatttggcctgaggcgaagaggtatcttcttatcaactatgtccacacaaacccatggacaggattagctggtgtctctgtgatgcatgtctgaacattcctgtcttacggtactcaaattcttaatagagtcatttcaacaataggcattttcaaggacatcggtgtgctttctcatatatcctg

SEQ ID NO: 265785 - DNA, 448 bp, Homo sapiens
cctcgaatccatcctttcttaattgctgctgctttgttatcagtaatgagttggtggttgccaaagccttttgccccaggagtgagaaaaagggtttaaaaaataagcatcccagaaaagatgcaatacttctcaaactttggggtactaaaaaaaccaacacaggagcatgtttcactgcagattcctaggccgtacatccaaaggttctattaggttctataataattcagagggactgacgtgggtgggacccaggaatatgcattttaaataaataaactcaagttattcaagatgtagagggcctgtgggtctgtggatcactcctagagactagtttaaatgtacatccagaagtgaaggactcattttgagattcccttggaatggcagaaacattggtagctgagcagatagaagtatttcagtattccacatgcctcgg

SEQ ID NO: 265786 - DNA, 379 bp, Homo sapiens
gaatatttatgtaagacgtgaatacatgggagattataaggagcctgtttggaaattctatactaaggaaattaaatgagttataaaagcaatgcaggccgggcgcagtggctcacacctgtaatcccagcactttgggaggctgagacaggcggatcaactaaggtcaggagtttgagaccagcctggccaacatggtgaaaccccatctctactaaagatacaaaaattaatcaggcgtggtggtgcgtgcctgtaatccccgctactcgggaggctgaggcaggaaagttgcttaaacctgggaggcagaggttgcagagtgttgagatcacgccattgcactccaccctggacgacaagagtgaaactctgtctc

SEQ ID NO: 265787 - DNA, 290 bp, Homo sapiens
ttgaccattgtttttcttgtgcatagactatcctttcctttttttgtacatcttgtaatttttgttttattaaaactggaattttaaaaataatgcagtgtggcaactctactgcttgatttggctcaaaggtatattatttattttttaatataacaaaccaatatttgggttctctattctatagttttagcattttgaatgcaacaactgtcttattcaccatttaattctcagtactaccgtttctagtacacaatatgcacttaatgaatatgagggattgtatc

SEQ ID NO: 265788 - DNA, 215 bp, Homo sapiens
agaggagattcccacctcctgctcacatcaagcctcctcctcccagaatgagggggaagcaggcagcctcagctcctataggaaaggagtcacacggcttcttcctggatttcctgcttgtgacagctgaacttaagactgccacccccatgtcctctgcctgctgcagggagagggggggaggggcagcgctggggcctcctgtttaaaggttg

SEQ ID NO: 265789 - DNA, 294 bp, Homo sapiens
ccggctaattttttgtatttttagtagagacggggtttcaccgtattagccaggatggtctcgatctcctgacctcgtgatccacccgtcttggcctcccaaagtgctgggattacaggtgtgagccactgcacccggccttattatttgtttaccgaaactctgatttattttgggctttgcacctgttgattagagatgaagtctagtctgaattattttatgcttcagttcatgtttcctacctaagggagtttgggagggagacatgattagggatgtgaaggaagaaac

SEQ ID NO: 265790 - DNA, 399 bp, Homo sapiens
agtgactcagcctcagtgctcagtgatcacataggctgcctctcaatattggttcttgagaggctgcttactggggtcccttttccagggagagtggcaatgctgggagatcacctctgaggcctcatccaactttgagagcccacgagtgtattaaaatgagaagggagctcaagtccaagctctttgtcccaactcccaagacccttacttagcacccagccaaccctcaacatgcccctcgccttgcgctctggtgggcactggagggcacttccgagctctgtaaccctgggcctctatgggcctcagcttcctcttctgtacaatgaggacgataaaagtttccacacttcacagggctgctgtgaggcttggaggaagcgtttggcagatggt

SEQ ID NO: 265791 - DNA, 730 bp, Homo sapiens
cccccagttatattttcttggttgagaaagacctgaaaaatttccagcctttttagtctattatattgttccacccttttcatacttaaccctttttagagcagtagtctttaaaatatggtcaacagacccctgtggatcaccaagacccttttagggggttatatgggtccaaaaggtcaaatgattttgatactactacttaggcttttttgtccttacttgctatattgacgcacgtcttgatgatataaaagcataggtgggtgaaaaccagtagcacctaatcattaattaaggcaaactgtactagtaatcattgtacagttttccattgaacaacataggtctgacctttgtgggtccatgtatacatgaattttcttccatacacagcaagaccaccaactccctaagttttgggagggtcaaaaattatatgcaggtttttgattgtgtgatgggttggtgcctgtaacacctgtgttattcaaaagtcaactgtatttttaatgccacacacccacagttaaaaaaaaaaatcagttttacctaatgtgcacattaaaagcagtaaaaaaaaaaaagaaaagaaaagaaaagaaaaattgattctggtgtggtagctcacacctgtaatcccaacacttttggaagctgaggtggttggattgcttgagcccaggagtttgagaccagcctgggcagcatggtgaaaccctgtctctac

SEQ ID NO: 265792 - DNA, 482 bp, Homo sapiens
tgtcaatttatagtacagttaaaaagtacttaaaagatacaagaggaaatggacagaaacatgctaatcagtcatttgaaattaacactttcatatcttgatacagtggattaaaaattgaacaaatatatatagagcaggaaatgcagagtgaatagtgtttattatgtgtatatttgagtgtgtgtagagagattctacatcagtgtgtgcatcttttcaagtacttacaagatgtacagaaattggccatattagttaaaaatgaaaaataaattttaatgtacggaaactactcagtgcatgttctctactacaaaacattaaataaaaaataataaaatttgcacaaatggccgggtgcagtggctcacacctctaatggcagtgctttgggagactgaggtgggagaattacttgaggccagggttccagagcagcctgggcaacataatgagatctcgtctctacaaaaaggaaa

SEQ ID NO: 265793 - DNA, 454 bp, Homo sapiens
gcctttcccagctgtaagaaacctgtctttcagcatgataaacacatttacttatttgctcagtcctctaatatgcagaaagtagttttagaattgccaaaaccatacaacttggaaaaacaagcatgattacttcaagatgtgtttgtagctccttctgtcctggcattggacgtggagagaaagcacagactgttccaagtttcatttttccccttctctgaaacgcagagagcgttgtttgtttctgtttgtatttcatttgggtcctccctctagccttattcataaatttgtaaatgatctttaacaatctgttatatttatgatgttttactgcgtgctgcctgtgaaaatgtttccttcttctgacacgttccagaacaactaggcttttaaattccaaatattcctgtttcacaataaaccagatgagggcctctgttgtgccaca

SEQ ID NO: 265794 - DNA, 128 bp, Homo sapiens
cgactatcttgattccacttcctcttctcactgctgcaccagctttgtacatggtccccggccaagctgagatacccaaagtctggtccacgttgtttttctccactgcatcatttctcactcaccca

SEQ ID NO: 265795 - DNA, 398 bp, Homo sapiens
actgtttgagcctctggtcgagccccttggctcagtggggggcccagtgacctaccagctgttccattatatgttgtggacacctccacggcccacctgggtgggagggaaggggcttcaggaggtgggaggggtacagggaacacagtccagcctgcttgggcccaataccttgaccttcaaggtaccccttgagggtagcatgaggctaagctcttgttctcctccaggactctgttcctgtgagggcctcggggtcccttgctttcttctgggggccttgctggtcaggatcacagagaagctctttgctgttgatctttctgcctctgtatcttttggcaagccattttatgactcagttgctttgtctgtaaaatgggttgaataacattgtc

SEQ ID NO: 265796 - DNA, 589 bp, Homo sapiens
  misc_feature (589)..(589): n is a, c, g, or t
ctccagcctgggtgacagagcgagactccatctcagacaaacaaacaaaaaaagaatcagagttattaatttgctgccagtaagcacaccacatcaattttcctctcgagagacgcaggtattcatatttagagctcctgatgtgggcctgtcagcactgcctgagacttggcagaaactgtcaataatgtaaaggattcacctatctaagagaactccacgatctcaataaaaatatcagattgcatcaataaaatccatcatctggccaggtgtggaggctcaaacctgtaatcccagcacttgcggaagctgaggcgggcagatcacctgaggtcaggagttcaagaccagcctggccaacatggtgaaaccctgtctctactaaaaatataaaatttagctgggcgtagtggtgcatgcctgtaatcccaactactcaggaggctgaagcaggagaatcgcttgaacccaggaggcgtaggttgcagtgagccaagatcgcgccactacacgccagcctgagcaacagagcgagactccatctcaaaaaaatatagggagtcggattactccttgcccgcgtttn

SEQ ID NO: 265797 - DNA, 439 bp, Homo sapiens
tcgtcttttcaaataccactctgcttttatgcctggaagaatatgtctttaaatcatggattctatagtctgtagtagacataactgtgatcagagataaaattctaggcccatttctgaggtttacttgttagcagaataaacttgggttctgaggaaacatctgagttttgatcatttcttcagggtttgagaagactatggtggcttaatgatcttctgtattccataactagtacacctagttacagaattgacatagatacattcaggtcctggaggaaatttgtggtatctattaaaaaaatgaaaattgccagtcatgtagtagtcacctgtagtccctgctactcaggagtgtgaggtgagaggatcacttgagcccaggagttcaaggccagcctaggcaatatagcagaacatggtctcaaaaaaataa

SEQ ID NO: 265798 - DNA, 476 bp, Homo sapiens
tggataaccaaaaacactgaattcttggagctcatacgttcttctttggtacgtccgagtatacttctagcagttgagctgtatgtgtagtcactaagagtcaggtatgactgtagcaaaacctatttatgccagtttacctgctataattatttccaacgaaataattacaaaaagaatactgtttctatgaaaccaaattttaccactttgaaaagattcaataaagataagctgataaaaaaatttctaaagaagtgaatgtgggcaaaaataatcataaaaattagtgaaaaaatctttaaaaatgaatagaagtctgactgcttcacaggatctttaagttcttaaagacactgaaaatgtaactaaagataatgtgttatgggtatggtttagaccagaaaaattacatgctattcaacaaccaaatttctcactgaaagaaaagagcttggccttaaataaaaaaaaaa

SEQ ID NO: 265799 - DNA, 455 bp, Homo sapiens
tagactggcttagtcttccagcctcatctttttctcgtgcttcctgccctcggacatcggacttcaagttctcttggactttcaaccacagactgaaggctgcacagttggcctccctacttttgaggttttgggatgcagacatccctttgggatgaggcttcctggatcctcagtttgcagatggcctattgtgggacctcaccttgtgatcgtgtgagtcaatactccttaataaactcccctttatatatacatctatcctattagttctgtccttctagagaaccctgactaatacagacatgaaatcaaaatttactagaagaattggccatcaaacaaattgcacttttttgtattgtttcctctatctttggtgcctcggatacgcttgctggacaaacagttttaaagaagaatgctttgatgctgggtttcaaattaggacccct

SEQ ID NO: 265800 - DNA, 499 bp, Homo sapiens
aaattagtcatataaacagcataactatagggatatttaaactgtttaccaaaagaagctgcttttaaagcctgctgaagtacttatttattactaataatgtctaatattattgacacttataatgttgctggcactcttcattgtcttatttaatttccatagcaactctaagagctaggtattatcactcccatttttgaaataaagaaattgaggccaggcgcagtggctcatgcctgtaatcccagcactttgggaggccgaggtgggtggatcacgaggtcgagagatcgagatcaccctgaccaacatggtgaaaccccatctctactaaaaatacaaaaaaagccaggcatggtggcaggcacctgtaatcccagctacttgggaggctgaggcaggagaatcacttgaacccaggaggcggaagttgcagtgagccaagatcgtggcattgcactccagcctgggcaaaaagagtgaaactgtgtctcaa

SEQ ID NO: 265801 - DNA, 328 bp, Homo sapiens
tagggaacatttttgtccattgtcttcatgcacctccataagagtttcctcagaccaaatctgtagagatggtgatgctgtgtcaaaggatataaatatttgaaacttaatagtattaccaaatttgcatattcagtaagatggaaaaaggagaactgtcatctttaaagtaactgctcttctctgtttacttctcttgagagaggataaagagactcagacagtactttcttataaaggaagaagctttgaatttggtgagatatatttagctacaaatgagccagttgttgggggcaagtggagggctggcctctgtgaaaatggt

SEQ ID NO: 265802 - DNA, 522 bp, Homo sapiens
agagcaggaccagtcaaaagtgtagtttgtcaaccagctctttgttttctaagcgctgcacttcagctgacctgtttttcacagcaagactctcattgaaagaagcagtgtgctgatttttccccgtggcacaagctccttaccacatcttggagcagcatttttttgagaccgagttttactctgtcacccaggctggagtgcagtagcgcgatcttggctcactgcaacttccgctagagttcaagcaaatttctcgtgcctcagcttcccgagtagctgggattataggcgtgcgctaccacacctgactatttttttttatttttagtagatacggggtttcactatcttggccaggctggtctccaactcctggcctcaagtgatctgcccgccttagcctcccaaagtcctgggattacaggtgtcagccactacgtctggccttggagcagcaatatgagtactactcttccagaagccagttgggccgcattattgaatacctagttcatagat

SEQ ID NO: 265803 - DNA, 409 bp, Homo sapiens
atcaggctcaaactccgagctcttagcctgcatcccagctgtgcttgacagcacattcgcaagctggctcagaccccactttaggctctgaattccatgctaccaggctctcgcttaccatgcgatgcccttcctcagagacagtggtaagccagagtccaacccaatgaagacaaagtccaaatgggtaaaaacctgaaggattatgctgtcctgtagcagcagtcacacctactacagctgagaactactatagttgagtaactttgggatgtggagtaggcccagggcagcctccagctttgtgtaccttgtttgtagctggttggtgttagctgttttcatggaaaaggtcatcatttagatccacggttgtactggcttctagtttgagctaaataaagcaaga

SEQ ID NO: 265804 - DNA, 287 bp, Homo sapiens
tgttcactgtccccagcacccagaacacagcccggcgtataatacgcctctttcttttctagccactcaacttaaaacactgctgcagaaggagctgctaaacgtcacccccgatttcccttgttggggaggaaacatcattttgcaatgatgcaatgacttattcaaagacctgtttcctatgagatgacaggacaaaaaccacattgccgagaactccatcaccagatttcagtggaactatttcattaatcttgtatgcagcaaaatgttggcaggtacacaag

SEQ ID NO: 265805 - DNA, 211 bp, Homo sapiens
aaaaagcttagaaaaatgatgaaggtgaccgttaacttgctgaaagtttgtacaggaaacatttgtgtttcatccctgcaagtggaaatggagggatatgggcatgagagattggatttttggtgattgttctcaaaacccagtatttaccttaattactgcataccacttgcttggtgcacccatcttcttaactgtccaatcctatgcc

SEQ ID NO: 265806 - DNA, 451 bp, Homo sapiens
atttgtttgaatcaaagtgtttctggctaaggatcatttggctcttccagaaaaccggcttggtcaccatattgttcttttgatattgtcactctgagtctctgctttaccagttactggatcaaggataaacaagtctaatctgcagctgtctttgggactgtttcgtaagtcagattaagtaaaggcaggtttctaataactttaaaacaagttcatttataaggatactgagcctacttatgtttaaaaatctagactaaaatattgtttaaatacagtatttacaaacttatgcagagcctgtcagtcatggtttatgggaactgacatcacattttcttcgtcattcttctgttggttcattcagctgaagtctttgatactactagtcttcttctgccaatgggggcacttaagttgaagaaggcctgacatttatgaactgcca

SEQ ID NO: 265807 - DNA, 357 bp, Homo sapiens
cgggggcctgctgctgccctttgctccctctcccatccccactgccacagccttggcaccctcctgctcccagtcaccacagtgccaccccccaccctgatggaatagcctctgggcacagggctctggattactctagttctgtgctgccaacacgggaaaccagccacacaggatgtgtcccaatggagctgtgctgtgggtgtgaatacatacgacgtcaagggtttggcaggaaaaagaacagaaagtacctggctgttcatttatggattgatcacatgttgacatgataatactttcaatatagtgattagtaaaatattgtaggaaaataaatttcaccagcttcttttt

SEQ ID NO: 265808 - DNA, 503 bp, Homo sapiens
ttttttttttttagacaaggtctcattctgtagtcccaggtactcagaggttgagatgggaggatctcttgagcccagaaaatttaactggagtctgcagtgagtcgtgtttgcgccactccattccagcctaagtgacagagtgagatcatctcaaaaaaataaaaatataataaattttctgagaaccaattttgccttgttgaaatgtttaaatgctgatactgttcttaggataattacctcagaacctgtatcttttaatacatcatcaaacatactaattagattaactacttgccaggtactgaatatattaagttaaacttaagggcctagtttgttttgcagcatgaatgaaatgaattgcctaaaattccttcattaaatgacaagatatttacttaaaagcagggctaatatgattgttgaggtaaattactatatctgttgaaagaggagaattctgaatcttttgcagagcacccttctgtcgtcttctc

SEQ ID NO: 265809 - DNA, 229 bp, Homo sapiens
caaggggtagatgggccccggtggcaggaagggggatttctgagctgcatgtctttgctgagggtgagtttgggcagaggtcatctaaggatggggccagccgaggggcccccaggaacacccagccccacaggccagcagtacacggtagggttggagtggtggtggccgcaggagatgagtgtgaccgggaaccagggccactcccagagttaccatgtgacaggac

SEQ ID NO: 265810 - DNA, 451 bp, Homo sapiens
ccgtctgtggcctgggggttggggactctttttctatagctttgagtattattagtactttttttttgggtggggggaagtaattcagtagtttaaaagggcattttattttaaatttatatttatttcaatatgtataaagttaaatagactgaggcatttgtgttaaattttaaaaatgagaaacatttagagcttttttaactagggagtagcttttatattacccatctgaactgaacttgaaggaatatcctggtggcctaaagctaattccaacacctgtactctgcagatacacttcctccttccttctcagagaccccatccagtggaatatgtcacttaccttttatcttccaactgtctctaaactggcttcttcccaaagcatttaaatatactcaaatccaccccatcttaaaaaaaattatccacttcactgctcccc

SEQ ID NO: 265811 - DNA, 654 bp, Homo sapiens
agtctcttcacaaatacactgttcccaatatgcaaatgtgatcatttgaagagtggaaaaggtggaagtggagtaagtccaattttcccaaagaaacgctggtcactggcgtggcagctccgccctagccaggccaacgtgaaaggagaggggttgcacaaaagtacccgctttcgccatggctggaaagcagggctcacagtttccgctctccctttccaaggcatcaaattccttttaccgtagagtcttcaccctagagggaaggagcagtcagatgaacctgctttgaagcccagccgtctgccatgcccaggtggatccgatgaggtctgagaggcagtccctgcagtgccacagcctgggctgtcgctgcagcaggccacacgggagcaagatgcccaaggggaggccaggctgggtggctgttccaaagtaccccaactcaacacatataaaaccagccccacctgggactgctgtcctcgtggaagtcctcatgaccgcataagctgtccaagccagaaacctggaaattgctctagagctgcactaacgtgatagccactagccacttgtggctatttcgatttaaatgaggtttaaaattcagtcccacagtctcactggtcaccttaaaatgctcgacagcca

SEQ ID NO: 265812 - DNA, 286 bp, Homo sapiens
ctgttgcttgaaacttggcatgtatcctgcctttggttgttcctttaatcctgccaacttctcccttaatagacccttaggtaaagtttttatcagttaatcctttgaatgtgccatctatctgctcagacactgactgaaacccattcttattcctattctgataattagatggtgttttaaggctgagtagctgggatagttttttgctgaaaactgtggcctttttacttatgcaaacttgtgtttaattgagagcaaaacctaaaagatagttaatggtaaa

SEQ ID NO: 265813 - DNA, 2627 bp, Homo sapiens
ttccattggaaactgattgggcagatttgaaaattaagctttcacaatcacaatttttatgagagttcattcagttttggagaagtcgaggaaagaattgggaattgaaattttgatgtggcctgataggatcaggtggggcttttgataggaagtgagtgttttgggttgtttcttgactggattatgatgcggaatacagcgggtagagggccgattaagttttagtcattagtgtagcttttcagtatacacgccttttcattttcagtccctttcagaagaaaagaccacaggcatcagaaatcaatcaacttgctaatttatgccagattccactggagatctgccttcccaagactttactgactggtgaagaacaggaaatgaacaattcccagggaagagtgaccttcgaggatgtcactgtgaacttcacccagggggagtggcagcggctgaatcccgaacagagaaacttgtacagggatgtgatgctggagaattacagcaaccttgtctctgtgggacaaggggaaaccaccaaacccgatgtgatcttgaggttggaacaaggaaaggagccatggttggaggaagaggaagtgctgggaagtggccgtgcagaaaaaaatggggacattggagggcagatttggaagccaaaggatgtgaaagagagtctcgcaagagaagtcccatcaatcaataaggaaacgctgactacgcagaaaggtgtagaatgtgacggatctaagaaaatacttccactgggcatagatgatgtatcttccttgcaacactatgtacaaaataattctcacgatgataatggatacagaaaattagttggcaataatccatccaaatttgtaggacaacaactgaaatgtaatgcctgtagaaagttattcagttcaaagtcacgccttcaaagtcacctgaggaggcatgcctgtcaaaaaccctttgaatgtcatagctgtggaagagcattcggggagaagtggaagcttgataaacatcagaaaactcacgcagaggaaaggccctataaatgtgagaactgtggaaatgcctacaagcagaagtcaaatctctttcaacatcagaaaatgcatactaaagagaaaccctatcagtgtaagacatgtggaaaagccttttcctggaaatcatcctgcattaatcatgagaaaattcataatgccaagaaatcctatcagtgtaatgaatgtgagaaatccttcaggcagaactcaaccctcattcaacataaaaaagttcacactggacaaaaaccctttcaatgtacggactgtggaaaggctttcatttacaagtcagatcttgtgaaacaccagagaatacacacgggagagaaaccctataaatgtagcatatgtgagaaggccttttcccagaaatccaatgtcatcgatcatgagaaaattcacactgggaagagagcttatgagtgtgatctatgtggaaatacctttatccagaagaaaaacctcattcaacataaaaaaatccatactggggaaaagccctatgaatgtaacagatgtggaaaagccttctttcagaagtcaaaccttcatagccatcagaaaactcatagcggagagaggacctatagatgtagtgaatgtggaaaaaccttcatccggaaattaaaccttagtttgcataaaaaaacccatactggacaaaaaccttatggatgttctgaatgcggtaaagccttcgctgacaggtcataccttgttaggcaccagaaaagaattcactccagataggagccccatgcacttaaaaaaacatgggaagatatggttgcctggaattgtcaccccagaattccatgttgaaatggcctctaatttggaggctatttttgaaggtagcgaggacttattatcacagtatcctttgaaaacccattcggcatactcactcagcaaatgtttattaagtataaatatttattagatgccttttgtgtaccaggaactcttaaacactgaagatgtagcaataaaccaaatgtgctaaaaccctgatggagttttattccagtgaataatgaccagtggtatccatatctttaaaaacgtttaaaagactatacttttggccaggcgtggtggctcaaatgcctgtaatcccagtactttgggaggctgaggtgggcgcatcacctgaggtcaggagttcgagaccagcatgaccaacatggtgaaaccctgtctctaccaaaaatacaaaaattagccaggcatagttgtgggcacctgtaatcccagctacccgggaggctgaggcaggagaattgcttgaacctgggaggtagaggttgcagtgagccaatattgcaccattgcactcctgcctgggcaacaagagcaaaatttcatctcaaaaataagataaaataaaataaacaaataagacagcactttatacttttagggatgatttctataattcatgagtggagaggtttctctagaggtgtaggggactggaaaccacatccaggaagtacagctttctctcctgagcatgaaggtatcttggcatttcttcactgcaattgccatttgccttttttgtttttc

SEQ ID NO: 265814 - DNA, 189 bp, Homo sapiens
caaaaggaaactaaacaaaagggcttcaggcaggggatatgcttgtgctctgccttctcactttgacaattatgcaggaaggttgcaatgaccttggcttgccttgcttaggaacaaaagtcataatcttctaccccctactcccacaaaaaggaaaaacgttttcatatctgattccaggagtttggg

SEQ ID NO: 265815 - DNA, 600 bp, Homo sapiens
aggacccccgaggaagaattcagcgtcggagacaagctcttcaggcagcagagcgttcctgctgcctccagctacgactctcccatgccaccctcgatggaagacagggcgcccctgcccccggttcccgcggagaagtttgcctgcttgtcgccagggtactactccccagactatggcctcccgtcgcccaaagtcgacgctttgcactgcccaccggctgccgttgtcactgtcaccccgtctccagagggcgtcttctcaagtttacaagcaaaaccttccccttcccccagagccgagctgctggttccttccctcgaaggggcccttcccccggacctggacacctccgaggaccagcaggcgacggccgccatcatccccccggagcccagctacctggagccgctggacgagggtcccttcagcgccgtcatcaccgaggagcccgttgagtgggcccacccctccgagcaggcgcttgcctctagcctgatcgggggcacctctgaaaaccctgtgagctggcctgtgggctcggacctcctgctgaagtctccacagagattccccgagtccccaaagcgtttctgcccc

SEQ ID NO: 265816 - DNA, 263 bp, Homo sapiens
  misc_feature (148)..(148): n is a, c, g, or t
aagtttacaggcaagatcctactcacagaggctcttgggatcaaggctgacagaagctccatctgaagacttttatactatagaggcagaaaaagagtgatgaatcaagcactggcttctaaagcttccgcccagatgggaagcatanctcctctgctcacatttccctgaccaaagccagtcacatggccatcctcagcttcagagaggttgggaaggcattcccactatgtgtctggatgccagcaactcagaaatatttg

SEQ ID NO: 265817 - DNA, 415 bp, Homo sapiens
cgcccctccagcaaatacataaaccagtaatagtcatttattattattatatactgtatgttattgtgtgtgctatacttttacatgactggcaatgccgcaggtttgtttatatcggcatcaacacaaacaggtgagtatcacattgcactatgatgccttgcctactagacaataggaatttttcagctccattgtaatcttaggagcccaccattgtatatgcggtctgttgttgactaaaagattgttatgcagtacatgaatgtatattaaaacatcacgttatataccttaattatatacaagttttatttgtcaatcatacctcaataaagctgaaaaataaaaagaaatgagttttttcttaaaatcattatcaaaagaaaattaaaagctgtactgagctaaatac

SEQ ID NO: 265818 - DNA, 1166 bp, Homo sapiens
ggcaatgtctgggtcccccttcctcaaggctgggcaagcggccctgcccctgtgagaggtgctgcccctgctactcagccctgccctgcggacgcagtctgctgcgggggtttcttggcaaattagccaacacatcagggtctcgagtatgcaaataatggaagactgacatggaagtagtctatgttgtaaccatccttgcgacagagcccacctgacttgctgtgtccctggatccgcaatacattctaaatgctggagacagtagaggtcacatctcctaactacagtgtaatgacagtcaaaataaaaattcaggaataaattggaacaagaagactcgcttcctgggaacttaaaacagtcatctcatggataaaagagaaaaaccaaatcagcagtgacacaatatttagaaaagaacaaaaaagaaaaagttacatgctagagcttattagatgtagcttggactatactgagaaaataattccacagtttaaaaactgttaaaggaaattaagaaatcacttgaaatgaaagacaaacaaacccaaggaaagcagaagtaaggactacagataacagcagaaataatgaattcaaagatggaaacaagtgaattgataaatgaagcctgagagctgactctagaaaaatcgaatagataatctactaacttgttaaccaagaagaaatgtaagaaaacacaaattcccctcataagactagccttggataaaccagaatttacagagaacaattcttaccattctaagttaaaagagtttgaaaacgtagttgaagaaggtaatttttgaaaagtatgtattattaaaattaattgaagaagtgttaacatattgaaatgcaccaacatctgtagaaacatttgagaaagctgtaaaagaatcaacgcaacgaagtgtagcttgtgtgtgtgtgcatggtgtgtgagagtgtgtgcctatatgagcatgtgtgcatacatgtgcatatttatgggatgtgtgtgcatgctgtgtgtgtgtgcctgtgtgcatgtgtgcacatgcatatgtgtgtgtgatgtgtatcatgcatgatgtgtgtgtacgtggcaagtgtgtgttcctgtctgtgcacgcatgtgcatgtgtgcatggtgtgtgtgtgtgtatgtgtgtgtg

SEQ ID NO: 265819 - DNA, 281 bp, Homo sapiens
tgcactgcctactcagtgcctggaaaggaaaccccagctccagccctacctgccccgagctttcggtgcagaaggtggactctaggtggagatagatgggaatcagagcctggcagcgtggggtcacagcggagcaagcacaggcagccccggttacagaggggaggttccagccccaatctgggggctgaacagagaagcccactgagtgggggaacattggggtgctgggaggggttcacgtcccaggcagaggaaacagcatgtcagcaaaaatgcaa

SEQ ID NO: 265820 - DNA, 454 bp, Homo sapiens
ctgtgaattccaagcttagagctaatccaagttgtcaatgcatattctaaagtatctaagtagtcatagaagattgctgctaagaagtgctaaaggcaattggagggatctggacgaccactacccagcagaaatataatgtgagccacagaagtaaatgcaggcacacctcactctattgtgctttgtgttattgtgctttgcagatactgttttttaacaaagtaaagacttctggcagtcctgctcaagtctattgctgccattttgccaacaccatgtcctcattttgtgcctctatgtcacatttgggtaattctcacaatatttcaaacttttttattattattatatctgttttagtgatccatgatcagtgatatttgatgttactatcataattgttttggggtgctatgaactgtacccatagaatacagtgaacttcatcaat

SEQ ID NO: 265821 - DNA, 153 bp, Homo sapiens
ctggtggcctgggcacatgcagaggacagcacacccccatctcccgggctcacctgccagggcttcacggggtcctgcgcggggcagcctgaggcgttgcactgaagagtgttgtgcagggcctgggccacgctatacacagctgcgtagaca

SEQ ID NO: 265822 - DNA, 395 bp, Homo sapiens
ctttaatctaccaatatttactgagaatttctgagattggctagctgcttcccatttgccatgttcttgccctcctgggcacactgctggcttgcatagcccatgtgccttgaatctaggaagggaccatagagagctctctctccagtgcgttgtgagcagggcgatgggaggcacttgtgggccatggcagttgacaggtgtgctttctacatccactctcttttgtcccttatctgaggctgtgctggagggctctgacttcctgggtattgcaaagacttcggaaagaaggtctcttaagtgactgcacagagcagagcttccacctcccctaattccaatctgaggtttctctgttatctgagtttaaattggagcctaggagtcatttt

SEQ ID NO: 265823 - DNA, 468 bp, Homo sapiens
cacgagggtgattcataaggaaaagaggtttatttggcttgcaattctgcagactgtacaagaagcatggtgtcagcatctgtcgctggtgagaccctcaggaagcttctactcatgttggaaggcagtagggagctggcatggcttggcgagaggcaaggaaggagaggggaaggctcttttccataagcagttctccctatggcaccaagccatttatgagggacccacccccatgacccagtcacctcccaccgagcaccacctccaacattggggatcacattgcaacatgaggtttagaggggacaaatattcaaactgtatcactgggagatggggctaccggaagtcaagccattcccctcccatggcacccttttccacctgaagtaggataacttgcacacggacaagaaccaggtgtctctgctccctgatgcaaagtcagcaccgctcatggtacca

SEQ ID NO: 265824 - DNA, 394 bp, Homo sapiens
ttaaaaattcagagactgtgaccttgttattttgggtttaaatatacattttcctcttaaaaatgatagatatatgtttacaaattgtctttactcttcacttataaaacacacacatacagataggatagtcctgtcagtttaccctattttttgtttcaaatttataggtaatttcaaatttataggtgttggtgagatttatcacttttaagataccatctagccttgatatttgttgtaccttctatatgcaaccaaatggctcctgatctcctgatcttctggagatcaaagaatttttattcgccactctccccacccatcattggttggattgagactctaattacatacaagcataatttccaatgcaagtagaactttgatgctc

SEQ ID NO: 265825 - DNA, 816 bp, Homo sapiens
tttagtagagacggggtttcaccgtgttaggcaggctggtctcgaactcctgaccttgtgatctgcctgcctcggcctcccaaagtgctgggattacaggtgtgatcattaatcttttgctaacaagactttccaactttccactgtgcaaggaggcagcaaggggcttttgaggctgatgtgggtgcaggccacaggcatgagcgctctgctctgggtatgacagaatgaggtaccaccccgtaacagtccccccagagatccactggaacacctggcgtacgtaatccttcacaggcccattgtgtatggtgcagggagggacagtagacagagaggaggctcacgtggaaggcagagagtgaagtcacaggaggcagatctccctgcaccctctaccctggcactagacacggtcttcttggcacacacagcagggaaggtggggcccacatagaaaagaaatagagtcccgctgacctcagcaccaggaaagagaagtctagaaactggcaacacagaagagaatagaaagcgagccagtggccaggcacagtggctcacaactgtaatcccagccctttgggaggtcaaggcgggcggatcacctgaggtcaggagttcaagaccatcctggctaacatggtgagaaacctgtctctgctaaaaatacaaaaattagccgggcatggtggcgggtgcctatagtcccagctactcgggaggcttaggcaggagaatcacttggacccggaggtggaggctgcagtgagcagacattgcaccactgcactacagcctgggccacagagtgag

SEQ ID NO: 265826 - DNA, 396 bp, Homo sapiens
tttcaacagcatttaccaaaaactctcccaaatagagaatcttgagtagataaaattcctttccattagattgagtaaaaactccatctccttgcatcaaaaaaagaaaaataaatcctttccaaggagaaaaaaatatctcccattattcttcaacataaagtactcagaataatttactaaaataacattttttggagaatggatggtaattcatctcctcaatgtagtgtttgtctagtgttggtatgaaaataacttttctttctcttttttgtttctgagatggagtctcactctgttgcccaggctggagtacagttgcatgatcttggctcactgtaacctctgcctcctgggttcaaacaattctcctgcctcagcctcccaaggagc

SEQ ID NO: 265827 - DNA, 256 bp, Homo sapiens
tagaaaattagtactacccagcatgggaggaggtggttgggccaacctccagtggctgtgaggttgtgattttcagacatttttcaaagacgagtgtataaactggggcaccagcttcaataaagatgaaaacaagctctacacagtagctcacacctgtaattccagtgcttcagaggaggccaaggaagaaggatcacttgaggccaggagttcaagactagcctgggcagcatagaaagaccttgtctctaca

SEQ ID NO: 265828 - DNA, 682 bp, Homo sapiens
  misc_feature (682)..(682): n is a, c, g, or t
tgggattacaggtgtgagccaccgtgccccgccagttctttttatgttgttgcaaatgttcctctctccttttattgtactactgaggacattctttcctcatttgcttaattttttcccccataattcttcaagaatcttcgcttttctctgtttgggctaccattacgggagagttcttggttagtaactagggttaattattcattcattctacagatatttgttgagtaccttttaagttcaagataaagttctgaaattgacgaggctgcatgtctcaaagggcatgccatagaaatattaatcctatgagatgtgtcgcaaaaaaaaaaaaaaaaaaaaaaaaagaaacattgtgtggggccggctctgggcccttagaaaaaggttttctataaacccttctctgtggggcgcgcgggggccccaggtgtgtggtacccgtgtaacactgggtgcagtaagggtggtccctaaggaggaacccggcggcagagaaacagggtggcggggagttctctccccaattaaaaaaaagcgcccgggggggacaccgcgaggccgtctctctgaaaacaactcccaaaggggattcccgggagggaccacacagggggtcctaatcacacaggggagttcccaagggaaccgcaaataaattacccggcggggggggagn

SEQ ID NO: 265829 - DNA, 216 bp, Homo sapiens
ggggatggtggtatatctgtagtggtggctacttgggaggctgaggcaggaggattgcttgagcccaggagttggaggctgcagtgagctatgactgtgccactgcactctatcatgaatgacagatggagaccctgactccccacccttaaaaaaggtggatcttgtcctcaaagggacaaagactgtactactccttcctgtcctttccttcct

SEQ ID NO: 265830 - DNA, 294 bp, Homo sapiens
cctccttaggcaacctggtggtcccccgctcccgggaggtcaccatattgatgccgaacttagtgcggacacccgatcggcatagcgcactacagcccagaactcctgacctcaagtgatctgcccacctcagccccacaaagtactgggattacaggcgtgagtcactgcaggcagcctctgactcggttctgaaagtgggaacttacattgttgatctgagactattcttcttttctaatgtgtgcatttggcactgtaagtttccctctcaatccttctgtgtggcacaaa

SEQ ID NO: 265831 - DNA, 370 bp, Homo sapiens
agtctgtaatcagtttgagattatgctctggtgtgttctacagcagacagattgcaattttcactttagttttccagtaaaacggaagatgattgggcaagttaccctgcagtatacttgttagtggctttaaaaacggcattaacttttgttcatttggttgctacgaaactgaaaaaggctctgtgagactctgactttttcataccacattgtattttataagtatgtccccatttccagccccggaccccatgttcctccagagaagagtctgttcaggtattttatatctttatatccctagagcctagtgcaatgtctagatattttttcagaatgaagtaatagaaacacattttttaaagtt

SEQ ID NO: 265832 - DNA, 421 bp, Homo sapiens
ccttggggcatatttggaagacaggcaataaataattcacctttacaaaaactaaattatatagtgcattagaaaaggcagtaatggaaatgaaaaagtaaataagcaaagagaatcagttgagctatcataatcgtagaggtcagagtagacaatatcgaaaaaatgaaatgtgtcacagttggggaatatagccataggaattaatggtagaagagtattattctagacagaaggaacaactacaacaaagactctatgttatgtgtgttcctactgtgtttcagtagcaacaagcaggcaaatgtagcagagcagagtgaatagggaaaaatgttagaaaaggatatcagaagagtaagatcggaccaaataaggatgtcttggaggctatttagggacattgattctttatttggta

SEQ ID NO: 265833 - DNA, 536 bp, Homo sapiens
tgtttgctgtcttgaaagaagtgctctgagagaatacttatttatatttcaaaagctggattttaataacctactaaaacagaggcctgttgggatatggaatttaaaaaataaaaaagcttgaggtcaggaattcaagactagcctagccaaaatggggaaaccacatctctacgaaaaatacaaaaaaagtagctggaacttagggagcctgaggcaggagaatcgcttgagcccaggaggcagaggttgcagtgagctgaaatcatgctactgcactccagcctgggcaacagagcaagactctgtctcaaaaaaaaaaagggaaggagaatcttagaagagaaacagtggagatgtacaagaatgatggagaaatatggaagataatggaaaagtgcggaagggaacagaatttggagggagagccaagaattatgggaaaggacagactcatggggaaaaaatggtggaaaactgggacttacaagagaaaaagaattatgggaaagatagggtattgtgggagagaacag

SEQ ID NO: 265834 - DNA, 464 bp, Homo sapiens
atgcacaagggttccaatttctctatattcttgccaacatctgttagtttctgttttcttcctggtagccatcattatgggtgtggagtggtctcttggctccttcttgacaggggttctctttggaatccgtacctgccagccaggatccctgtctactggctgctccttggtcctgtggagctttgctcctgcactctgccaagctctgaggctggcctctgtttaggctgctgatagacacctgtcttcatgctaaggcctagctgactggctgagccaacctactcctccagggcctgcccaaccctgatgggtgcctgacgcaggcctggaacatcttgctgccttctcgtactcacagcttaggaagcaaaaagcaagccaggtgttcatacttctctgctggggacataacaaatggcatgacaaatactaaagcaataaatgaactgaaaaataaa

SEQ ID NO: 265835 - DNA, 465 bp, Homo sapiens
ctagcagtctctgctcctcctatggaaaacacaaggtccacctgaggccggttcccaggtgccttgaggcaggcactgcccttcctgtgcctcagtttcctctgtgatccctttttttttcttttgggatggtgtgttgctctgtcacccaggccggggtcgcgccattgcactccaggctggatgacagagcgagacttcgtctcaaaaaaaagaaaacaaaactagatgtttttaatcagcagggtctcataaggcatgcgaaattgcttaaggatttaacagatggtatctcaggttgctgttatttttgagaactcttttcgacagaagaaatccctaagaaccaggagatagtctgtgaacctgctttgaggttacaaaggaggtggtgtctgtcagtcacttgcaaagagctgataacttgagcaaacatgttaaataaagtcccattggactcctgtt

SEQ ID NO: 265836 - DNA, 587 bp, Homo sapiens
cttttggggtctttgctttggtccgatcagaagggatcacagaggaaagctggtggtggtggctcatgcctgtaatctcagcactttgggaggccaaggtgggcagatcacgaggtcaggagatcgagaccatcctggctaacacggtgaaacgccgtctctacttaaaatacaaaaaattagccgggcatggtggcacgcacctgtagtcacagttacttgggaggctgaggcaggagaatcacccgaaccagagaggcggaggttgcagtgagccaaaatcgcgccattgcactccaggctggatgacagagcgagacttcgtctcaaaaaaaagaaaacaaaactagatgtttttaatcagcagggtctcataaggcatgcgaaattgcttaaggatttaacagatggtatctcaggttgctgttatttttgagaactcttttcgacagaagaaatccctaagaaccaggagatagtctgtgaacctgctttgaggttacaaaggaggtggtgtctgtcagtcacttgcaaagagctgataacttgagcaaacatgttaaataaagtcccattggactcctgtt

SEQ ID NO: 265837 - DNA, 1221 bp, Homo sapiens
aaaatgaaaaaaatctattttttttggctttagttaaatgggctcccattctccctctctggttctatctagaggagtctcctaaagagcctggagtgcccgtcctctaaactccacctttacagccagagagagtggccagactcaggtgggaccagggagttccaggcccaagttccttccaccaatccatggcaaaggctacccactgggctgggagaacagtcctggagtgagtttagggtttagtatggtgtgattagtgagcaaataactcactcctgcacagtggccccaggaggagatgccactattggaggggagggcagaaagacaaagatggggcaggaaggggccagagagattctaaaaatctagatgttggctaggcatggtggctctcatctgtaatcctagcactttgggatgccaaggtgggcagatcacctgaagtcaggagttcgagaccagcctggccaatatggtgaaaccccatctctactaaaaacacaaaaattagccaggcgtggtggcacatgcctgtaatcccaactactaaggaggctgaggcaggagaatctcttgaacccaggtggtggaggttgaagtgagctgagattgccccactgcactccagactaggtgacagagagagactctatctcaaaaaacacaaaatttagccgggcttcgtggctcatgcctgtaatctcagcactttgggaggccaaggtgggcagatcacgaggtcaggagatcgagaccatcctggctaacacggtgaaacgccgtctctacttaaaatacaaaaaattagccgggcatggtggcacgcacctgtagtcacagttacttgggaggctgaggcaggagaatcacccgaaccagagaggcggaggttgcagtgagccaaaatcgcgccattgcactccaggctggatgacagagcgagacttcgtctcaaaaaaaagaaaacaaaactagatgtttttaatcagcagggtctcataaggcatgcgaaattgcttaaggatttaacagatggtatctcaggttgctgttatttttgagaactcttttcgacagaagaaatccctaagaaccaggagatagtctgtgaacctgctttgaggttacaaaggaggtggtgtctgtcagtcacttgcaaagagctgataacttgagcaaacatgttaaataaagtcccattggactcctgtt

SEQ ID NO: 265838 - DNA, 231 bp, Homo sapiens
cactttgggagtgctgaggcaggcagatagcttgagcccaggagttagagatcagcctggtgaaaccccatccctacaaaaaatacaaaaatattaactggatggtggcgtgtgcctgttgtcccagctactcaggaggattgcttgagtccaggagcagaggttataccgcactgtgatcgtgccacagtaatccagcctgggtaacagagcgagactgggtcaaaaaaa

SEQ ID NO: 265839 - DNA, 346 bp, Homo sapiens
gcttagaatttcatatttaaaattctaaataaattatcattcaaattgttatagtttgggggccaggtgtggtggctcatgcctataatcccagcactttgggagactaaggcgggcagatcacttgagctcaggagtttgagacgagcctggcaaacacggcaaaaccccatctcaaaatacaaaaattagctagatgtggtggtgcatgcccataatcctagctacttgggaggctgaggcacgagaattgcttgaacttgggaggcggaggttgcagtgagccaagatcgtgccattgcactccagcctgggcgacagagtgagactcggtctcatatatata

SEQ ID NO: 265840 - DNA, 456 bp, Homo sapiens
ccttccctttctattcctttcatgacaggttctcactctgtcacccagtggcacaggctggaaggcaatgatgtgatcacaactcactgaagccttgaactcctgaactcaagagatcctcccttcagcctcccgagtagccaggactacagacatggagctgaagaagctggcaacccagaaacatcaggggaaataaaccaaaaagccccaacaaatggctgctttctctagctaaggaccagaaaatgggcaacctatcaaggcgaagaactcttagacaataacctctctattcccaacaatgccatggataaaactgtgacctcccgacacaccaaccgacctcaagagaaaagactgagagaagtgcctagactcacttttcccaggcactagagtcaacaacaaattgttatttttacctttccaagacaattaaaaaaaactcaaaac

SEQ ID NO: 265841 - DNA, 417 bp, Homo sapiens
gggaactgggcaaccctctcctaggactggatttccgcacctttctggactgcaccctaagagggcctgcgtggattgtgcttaaagaacttggccaactctagctgtcatgggtcctttatggggctcccaggagagcgtgtctgttcctccactgctgctctaaaggttgctcagcttggacctcaggtggcaccagcttgtgggctggcctggaggtgggaggcccaaccaggcctctccgcaacccttctgcacaggctttggattctaccacccagtgttcctcccttcccactcaaaacctgatctgcagaccatatctcatcacagcttttctcatgaggatttactgctttcatcttagtccttgggaaagaagttctgcctctgtttagttgggaggaaggcattaag

SEQ ID NO: 265842 - DNA, 2356 bp, Homo sapiens
  misc_feature (1153)..(1153): n is a, c, g, or t
ttagaaggtgagattagcataagcagaggtttgagggaagagtgggagcaaggagtggaggacaggaaacaggaaggagactgggctgctggtggggaggaggcaggacaggccctgtgagggcagggcaaagtgggagtcagcgttggccaaagcgagagagccccaggcagtggagcctttgatgtcaggcctgaaggcagtggggactgtcttagaattttatgctgagatgaaaatgtatgactgaaaaattggtctggtggcaggaggtgatcagagtgggtggccgcaagaggcttcctggggaatgggcttcctcagtatccgggtgcagcaggtgggccagaggcgacccatggcagcccccagtgtcaacgtgagcaagtgcaggactgtggacaagactgtgatgccatgcccggggcagagaagatgatggaaaaggagaagttgccccagatccagtggctcacagaagcactcttcctgaggaagagcttgttcttgaagtttgcacccacagcttctcctaggcgatgggcttggagagctgtggtcagcatcaagagctagcctggcagcagggcaaggatgtggctgcgagatggcatcgtggtacccactctctctcggtgcctcagtgtccttgtggaggatctggcctctatgacttgagtgatggtaaagtgagatgatcccatatggcgtttgacgttgtgctgcacacggggtgggtgcccagtaaatgggagtggttattattttgaagatcctttagggaaaaaatgtccattctttaagaagctaaagcagaaatgaagggaatgagcactcagacatcttccactctgcaaacatttttgttaataacaggaaggaagagaagcagccacattttttctgtggttctcatataacattgtcgtgtacttggtggaaattacagagggagctagactttgaaaagccttaagacttgtcaacccagcttatcagatgaggtctccagtatttttcagaaggtaatcacttgagaggctttgtttcttcttatcaattcacaattaatgtgtttttattaaactggcagattataattttgcattagagttctggggctcttaagtgcataaaattcatttgcctacanctttttttcaactacgtatttcaattcagtgtttattggcatttgctaactacatattcattaccttactggtcaaataaaacaatatatgtgtgtctcactcctaaaggatcttatcagaaaggactgtcaaatgatgatagaagacggtaagtgaatgaggactaacaggagtggtctagacagtgagctctccagaactggaaggaagttagaaccgggcactaaaatcctcagcagaggccttgcaaggtgagataagaagccgggttttgaaaaggtggtctggtgtgggcagtgggaggtcagtgtgaggagagatgaccaacatgagcagagagacccgagtgggtctgagcaggcctccaccaaaggatgggcagacctggccaaagagacattttgagtaagtctgagggggcctgatagccacagtccgtgtgactctatttcactcctacgattctatgaaaataggctggaatgatgttttagggggagagaatgggagccaggggggtgttttattttcaaattaattgcatgtgactgaaaatgaaatttcaaagtatatatgcttaccatccaatttgtcttatacttgctgctgaataaaaagtcctgaaattcagtttaaatattggtctttgttatcccaaaatagcaatcataattatggtaaattagttgaattcacctttcatttattttgtagtaaatatctatttcacttaactttagtagataaagtaaccaactattgttcagctttttaaaaagccttcacaatacaattaaaaaaattatatgtagtaactaataaaagtaaaccatttctttaaaattcacggggtgtacttgcaaaacagttcatgcacacctgggaagatggagagagaactatgaaataagaatgcacagggccgggcgcggtggctcatgcctgtaatcccagcactttgggaggccgaggcgggcagatcacgaggtcaggagatcgagaccatcctggctaacacagtgaaaccccgtctctactaaaaatacaaaaatttagctgagcatggtggtgcgtgcctgtagtcccagctagtggggagtctgagggaggagaatcgcttgaacctgggaggtggaggtcacagtgagccgagatcgtgccacggcactccagcctgggtgacagagtgagactccgtctcc

SEQ ID NO: 265843 - DNA, 374 bp, Homo sapiens
ttcttattttctgggagaatttgcacaagagtagaattttttgtttgtttcattttttaaatgattgttggaactcagttgtaaaaccaactggtctggcattttctttgtggaagattttactaccaataattagtaactactgatttaatttcaagtttttcatttctatttgagccaaccttggtaagttataattttctagatttgtcatttccatctaacttttcaaatgtattttataaagtttttaaaataacatatagatgctgtcagtttaacctctgcagcttctttagctatgttcccctttgcatttctaacatttatttttacctcctcatttaaatacatacacacctcagatgagtttc

SEQ ID NO: 265844 - DNA, 423 bp, Homo sapiens
tcagagaagtatgttgccattcaaaggaaaacaccccactttattgtggtggtgtcccacgttctttgatatctcagctattagaacatcaggtgcaaaagatcaaagatctcacaggcaaaagcaggaagagcatggcctgtggtggtactccccggtaaactccctttatgaacatttctagaaactgccagagccaggcatggtggcatgcctctgtaatcccatctactcaggagctgaggaggggaggagcacttgaggccccaaacttgagaccagcttgggcaacatagtgagacccctatctctgaaaagataaaaaatgaggcaggcaggtggcttacttgagcccaggagtttgagactgcagtaagctatgatcatgccactgcactgcaaactaagacctcatctctgaaa

SEQ ID NO: 265845 - DNA, 425 bp, Homo sapiens
aaacatttgagccatactagctgaagtctatggattgttttttgagtattctgaaacagtaaaagaataagggaggagggagaacacttttagagagagaaaaaacattcaaattaatacaatgataaaaatattttcacttgctaagatttccaatttctttagtaatggaaaggaaatgcccagaccctagaaggattgaaagtaaagtcctactgtgaatttgtatttaatgacattgctgaatttccagattttcttttcacacctacaaaagaaatgctgggatacaaatctcacaactatagttatttcaagtttaagctttggactcagtgtgtatatatacagaaattatttagtagtactagatcattctaaaatttaccttttagccatggaacatcaattgccaaggtctgtta

SEQ ID NO: 265846 - DNA, 411 bp, Homo sapiens
tgaaatatatgtctataatcactgtgatatgctgagggaagaaagattccaaatgctattggagcctggaagaagggcaggtgagccagtgatcagggaagattccagagaaggtgggatttgacctgagactgaaagatgggtatgagtttacctggtggataggggaaggcattttagaaagcatgtgcaaaatagaaacagtatatttgaggactcctaaatagagtatgatggacagggggtaagaagaaagcaggttggatgccaaagaaagagaggtgaagctggcacagtagtgcatgcctgtaatcccagctactcaggaggctgagacaggaaaattgcttgagcccaggagttccagatcagcctgggagacatagcaagaccctgtctcttaaaaaaaaa

SEQ ID NO: 265847 - DNA, 356 bp, Homo sapiens
tttttcttttgatcttgatgtacatttggtattaatttttttcttggtgtatttccatttacacatgaatgacctcagtctgtttttagcaaagcattgctagagctggatgaggatgcagggctcattaacaaaaaatcatcggggggcctaggttataactgctctttcaaagctcacacaaccataacacacattctgttacacaaacacacacacagtcacaggacagcaggttgtgaaacagagagggactctactttgaggaatatggccatgaatatgaacaagtaaaacaaccatgatcttaataaaaaagtggtggggaccaggttaggtacaagctgtgacctgtg

SEQ ID NO: 265848 - DNA, 447 bp, Homo sapiens
gaccaatggaaaactgagaactatatcaatgagagcacggaagcccagagcaaacagaaagagcagaagtcaagtgaggtgaggaccacacagaaacatgaaacccagattttcctatcatttagcatcttccaggaaagtgcccacacaggagaacctgggactcccagaccatagtttgtcttggccatgtaacttcagccgtgacagtgatctcccactttgctcatttagagagtgaaacaggttagtacacaagataaactgtaggccggacatgatggctcatgcctgtaatcctagcactttgggaggctgaggtaggtggatcacttgaggtcaggagtttgagaccagcttggccaacatggtgaaaccctgtctccaaggggaagccaatcttaatgcccaccaattttctttgataatgaagctgtattatttata

SEQ ID NO: 265849 - DNA, 422 bp, Homo sapiens
ttatcagctggggttaatgagaggttgaccaaatcttaaaaggaaaaatggaaatgagatattcacaggggactctgaaaatctctcacttatttctgggaatctagaagtccatgaacatatgcagcactatgttcgtgccccagaaagactggagaagggcctaacctctcttttaaggaaatctctggccatcacagctggccattaagctgagtggcaacacacaacaaaaaatgaagactttacagtattagtctgggaaagttactgaacaaacagcaataagagcaaaaaccacaaacccaggcaatgggagaaatctgggaagatttctggagttgacgtatagttaaaaatgtccagttttcaataaaaaaaattatgacatgcaaagaaacagtatggctcatacgtcgggg

SEQ ID NO: 265850 - DNA, 554 bp, Homo sapiens
aagactgctcttgaaacttttgtctgatgtcttcaatttttctacttctttgtagagctgcttaaaatgttgatttctccttttaggactgggttatcttgtgtcccagcacttagagtatagtgagaataatggacaacctagttcggtccttgacctacatctgttagacaggtttcactgtgatgttgacatgttatgcatgtctagaactgttataaattaaatagcatttttataattatgcataattcaaatgataaattcctcattacagtcatgacctcattcaattggtaaagatttttgtgtctgctgtggaccatgcaccatgctaggcagtggggatatagaaataaaagattcatttctggtcctcaaagagcctaggttctagggaagatgaaaacacagaattaagatactttgggtgggatgcggtggctcatgcctgtaagcccagcactttgggaggctgaagcaggagtatcacttgaactcagaagttggagactagcctgggcaacataacaagacctcgtgtctactaaaaa

SEQ ID NO: 265851 - DNA, 140 bp, Homo sapiens
tttttttttttgctgttaattgtcagtcctcttcagttagagcacaaacaagatgaattttttctttctaatttgatgtggatggtctggcacttcaggctttatcttcaacatcatctcatcccttctgtcgtcttctc

SEQ ID NO: 265852 - DNA, 436 bp, Homo sapiens
aaatgagacttttcttctgtgacatctatattttcttatttttatagtgcatgtatatttctcctggaagcagggaaatggtatctttaagtagcttttaaaagtatttttaagaaaggtgttttttaaaagatatttatggggttcgaaagaaaaaaatattagggctgggcatgatggctcatgcctgtaattccagctacttgggaggccgaggctggtggatcacctgaggtcaggagtatgggaccagcctggccaacatggtgaaaccccatctctactaaaagtacaggcgtggtggcacgcctgtagtcccagctacttgggtggctgaagcatgagaatcacttgaacccaggaggtggaggttgcagtgagctgagattgcaccactgcactccagtctgggcaacagagtgagaatctgtctcaa

SEQ ID NO: 265853 - DNA, 606 bp, Homo sapiens
tatagtagttaccatgctgtcctgccttggcgatttctgcccagagggttttgagaatgcagtatatttgcatcagctgtatagcatttccatcaaaacagttgtgccctgcctgctgtcaattgtggcggcaccattttatattttgttttatagagttgcagaagcagcctttgccccatccacactttgttcaattacaaagctgatctcactcctcaccccaaaagactgttactactcctggagaggtttgtgaaggtcgacctgatccctccaggatggagaacggacagaacagaccttaagctggggaccagggtttcaaagtggagcctcccaatcagggccagattgacttcagattgtaagcacagggcatgttgatgtttggatgaggctcccagaagagacagagaaagagagaaaaggatatgatttattgtgaggattcatcccacatcagaaattctctaaccaacccctaatgccagacttcaggcttggcattagagtaacactccctgctgtaacagataaaccctgaatattgtttatttcctgctcatgtcaaaggctctgcaggttttcctggccctgcagact

SEQ ID NO: 265854 - DNA, 861 bp, Homo sapiens
tatagtagttaccatgctgtcctgccttggcgatttctgcccagagggttttgagaatgcagtatatttgcatcagctgtatagcatttccatcaaaacagttgtgccctgcctgctgtcaattgtggcggcaccattttatattttgttttatagagttgcagaagcagcctttgccccatccacactttgttcaattacaaagctgatctcactcctccctcctccatgtcctgcaggagcctctctaatcagacagcagctgggaaaagacaaagggaggtcacaccgggaggttcttatggaccaagcctgcaagtggagcatgttacctctgctgagatccactggccatatatcctggtcacatggtcacacctaactgcaagggaggctgggaaatgtagtctctattctcaggagaaaaaggactttggatttaggggaactcctgggagtctctggcccacactttatcttttgcatattccctgcctccttcagagagcagtttcccagctgaactctttcaattaaaagaaaaaaagtgacataagtatagtggttggaaatggatcaaacaggctgtactcttttgggattttgttgtttatggtaggagtgtgtgaggtttctgtccatagagaccaagcccgaggtcatctcttaccaaacatctttcttctaagcatcttctgtcttctctaaatgattattttgtctccttcctccttcttcctttttattgataaaacatgaggcagtaacatgatttttcttgtgcagattaaatctagattcctcaaggccagtcttctataacactacaattctgtctgtgaataaaacactaacaataaa

SEQ ID NO: 265855 - DNA, 487 bp, Homo sapiens
tctccaccccgttgggcacttgaacttgtgccgtcggattgtttctccccaagctttctgtgaattccaagaatgcaactgataactatttaaaaactacccttaacttgaagaaagaatactttaaagtcttagcaaaggaaatgttctagatgggttttaagtcgaggactttcaagggtgggagtaacacgaaaatcactacaccagggaacacaaatactgttgagaatgtatcacacacaccaactacacacttgaagcaggtaggttgtacgcttaggttgggctcatcctattttaagtgtactgttggtggaacttaacctgagtctaggatgaatattttaattttacgtttttaatttaaatacacattccaaaggttatacagaaagcatataaagcccaccttatatcattttaacaaaaacagcaaaagagataatatgtaaatgacagcctcataaaatggtctttaagtact

SEQ ID NO: 265856 - DNA, 238 bp, Homo sapiens
gccagaggttataatattagtgctatttattagttagtgtttatctgaatgccagcaaagaacattgtatgtgaaggtgttttttgcccttctcccatgatgtcgaatctacaaaattaatgttaatcccataatcatagctttcctggtaattcattttggatacttttgtctaaactttcctgaagctttatttttttacagtgttattgaggtattattgaagtatacagtaaat

SEQ ID NO: 265857 - DNA, 356 bp, Homo sapiens
tatgttttctcctaggagttttatagattcaggtcttacatttaaatcattaatccagccaggcacagtggctcatgcctgtaatcccagcactttggcaggccaaggtggttggatcacttgagtttaggagtttgagaccagcctagccaatatggtgaaactctatctctactaaaaatacaaaaaaataaaataaaataaaatagccggacacagtggcggctgcctgtgatcctagctactcaggaggctgaggcacgagaattgcttgaatctgggaggtggagcttgcagtgagccgagatcacgccactgcactctagactgggtgacagtgagactatatctccccc

SEQ ID NO: 265858 - DNA, 331 bp, Homo sapiens
tgcagctattaacatttagcacacagagtagagtcactttaattggcaactcatctgctgactctcacttttttcttcaaagtgattctagcctctggcctcactaaactccttgctattgccatatccatgctgtgcaacttgcctgcatgcccagggtgctccctcttccagtcctgtctctctcttttgtctgcctggtcttccagccaagactcagatcaagtgtatcctcttgtggtgttccacctcccactccagcccattgggtcctccttcctcttcccatatattcctccatcatttgtttagtaaatacttatctatctat

SEQ ID NO: 265859 - DNA, 621 bp, Homo sapiens
ttgcaaggatggaatgagatgtattgacagcagtaaactataaaatacatagtttatataataaactatgaaataaatacaaaccttaagttgaggttttgcattatttttggttaaatataaagaccagggtaatcatagaactgccaagcagaaagaaatgtagaatgtagcagtggtgtggagacccgtggctgacaggtggtggtcttcatataggctgagggacaggctagatgcatgtcaagtggcagctcaggttggaagacaggagttggggatgtgagagtccaggccagggtgaagagaagtggctgggaaggcagccaggctcagctcttaggaggcagagagctgcaagcagagggtgggaccaggtctcttttttcaacccagtcttgagggatgggggcaaagtcaacctagacttgatttagagctagttctgttcacttgatcatctttattgggccttcaggctcctagaagactaccgtgatagactgactagtggtctgtaaatggtttttattaaaaaaatcacataccctttttgataaaacatgtatttgtttatacactttaaatatattgtgtaattatataatacattcacaaata

SEQ ID NO: 265860 - DNA, 157 bp, Homo sapiens
aatatatgtaaagcagtggtgcaatccatcacatagtaaggggctcaaaaaatggaaatattgtcttctttcacttctcaatttttattgtcaccattattatcagcaatcatttgtgtttcattttctcatctataaaatgcagatgcagtcataa

SEQ ID NO: 265861 - DNA, 442 bp, Homo sapiens
tacaaatgaggaaaaagtcttgaagggattaagtaaattgccaaggcctctttatttgtaagtggctaaaatgaatatggcttctcacatttgtgccactcttctgaaatacaggaaacacagacatcaacagtatttatctttgtatgcttactaaggaaaatactgtgtggtacaaccactgaaaaggctataatagcttttttgttattgcactttaacagagagctctttcttaaaattacagatttttaggaccaaattcagttcagtcgtctggcctactatgtgccaggtacagtattgaatcctggggatatgaaggtgagacagaccatggtccctggtccctgattatagtctgagttgggagtagaggtggagggaaaggaaagaaattgccctgtgaacaaattccatgccatatgactaaggtaaattt

SEQ ID NO: 265862 - DNA, 507 bp, Homo sapiens
gtgccaacagctcatctatctcagtctttggcaggctttcttctccgcctttgcctccacaaactgccactgcttaacggtcactcacaaagggctcccctctctgaaaattagtccttctggacttttcttgcaactaccattcttcagtagtttcataaatgagtaagagttttataacatctgaggggtgggggtttttttatgttaccataggagcaaatgtgttccacatcctttcacacgctacacagaaaattgtatgttgtgtttaaatcatagccaaattgcaaagaaaattatggtttctttattttgttcataactgatctaatctttctcataattatctccttctaggttgaaaggattataaaatgtaattatgtttaaaattccatgtgatctaaaattccatcattctatcatgagcccaggagctcctgctacataaaacatatgctaatcaataaatgtgatacatcacatcaacagaataaaaaacaa

SEQ ID NO: 265863 - DNA, 386 bp, Homo sapiens
gtagaacactcacctgcagtaacagctgttcatctgttgggacccttatcttaactcaccactttcagaagagcagacaaactcaatttggtacttacggagtttcgctcttattgcccagactagagtgcgatggtgcgatctcggctcactacaacctccgcctcccaggttcaagtgattctcctgcctcagcctcctgaatatctgggattacaggtgcccgctaccatgcccgggttgaaaggattataaaatgtaattatgtttaaaattccatgtgatctaaaattccatcattctatcatgagcccaggagctcctgctacataaaacatatgctaatcaataaatgtgatacatcacatcaacagaataaaaaacaa

SEQ ID NO: 265864 - DNA, 535 bp, Homo sapiens
ctggtgttaatacaatcaattattgaactgcagttatcaccccaaaaagggtggctcacaaccctgccatcagttgtaaccataaggtgattcccttacccatgccagtcctaggtttacatgggtctacagaaatcccaaacatcgtctacaaggtggctacagtagtcacagagcttagggaaaacatcagcatttgaaactgcaagatttaacatagccattggtgataaaaggacatagaaggcccgtatacctctgatactagggacaaatacaagtttctgaatattaggaagcagcacttagaaatattcataaacactttgggatgcccaggcgggtggctcacgaggtcaagagattgagaccatcctggccaacatggtgaaatcctatctctactaaaaatacaaaaattagctgggtctggtggcatgtgcctgtagtcccagctactccagaggctgagacaggagaatcacttgaacccaggaggcggaggctgcagtgagccaagatcgcaccactgcac

SEQ ID NO: 265865 - DNA, 279 bp, Homo sapiens
ccacctcccacagacactgcccacctcccacagacactgtccacctcccacagacactgcccacctcccacagacactgtccacctcccacagacactgtccacctcccacagacactgcccacctcccacagacactgtccacctcccacagacactgcccacctcccacagacactgtccacctcccacagacactgtccacctcccacagacactgcccacctcccacagacactgcccacctcccacagacactgcccacctcccacagacactg

SEQ ID NO: 265866 - DNA, 496 bp, Homo sapiens
ttgacgtcttacacgcaacatttctacttaaaatagagcagccattctgcctatttcacaaagggcagggctttgaagccacccacggcatgagctaacttgctcctgtattaagtgaccttataccaagtcacttttaaaaagttgctcggatcagagcagccacagtgcagtgccctcgagttccccttgcctgcagcttctgtgcctcagatggtaagtggcagaaagacaagtggctctgggcaagtaacagaccctctgagccttgtttcccaacacacccaccctttccttatctgtagaatggaaactatgatgcctctcttgcggggtcagtatgagtactaacttagtgcctggaactggggccatcaacaaatgtttctcaaatgaatgaataaatgttcttggtaatgttttgggcaccttgtcagtgctttgaaaagccagctggtactcttaccctgggaaaatgtccaaggccatgagatgg

SEQ ID NO: 265867 - DNA, 262 bp, Homo sapiens
tttgggatcctgtttgaagggaattctaaaagttctgctctccaaacttcaaataaggggtcagagacatgggtcaagacttcaggaaaagccccagaaataccctgcactcaaaagcagtttcagagtttcacattttcctgagaatgaaacaaattatcctccaaattctgctgcttgttttgaattatgtttacgctggttatgttaccagtgagtttttatctccacatacttgaattaaaccgtgtagttcttcttt

SEQ ID NO: 265868 - DNA, 359 bp, Homo sapiens
ctttcctgtgtccacaactgtagtaatactctaaccgtcctcagttctgctctccaaacttcaaataaggggtcagagacatgggtcaagacttcaggaaaagccccagaaataccctgcactcaaaagcagtttcagagtttcacattttcctgagaatgaaacaaattatcctccaaattctgctgcttgttttgaattatgtttacgctggttatgttaccagtgagtttttatctccacatacttgaattaaaccgtgtagttcttctttacatctgacacctacaatctcttcactgggtctgtacttcacagctattttaccactttctgaaataaagttagcaaggatcaat

SEQ ID NO: 265869 - DNA, 652 bp, Homo sapiens
aaccgctgcagggtttctggactaaagggagctctgtcgatctttctgggaatgttctgggtgcatggggttgggtcagcctgtttcggttccccacagatgaagagaacttgccagagcctaggcgaccctctgtgatcctgccctgcccatcttgcagttactgcgtgtttttctcctgccccttcatgctccagcctcaatggcctgttcccaacatgccatgctcacagcctttgcacttgctgttccttctgcctagaaggcttttccctcaactcttcacaagtctgactccttatcatttaggtcccagctcaactgagaccctagagaggcctttcctgaagtccccaccctcaactctccatcactgcagaaagttctattgggtaccactgctcttgaccacagacatgcattacactttcctacttctgtcctttgctcatgttatttgctttgcctggaatgctttacctcaccttaacagaaatccaacccctgtagaatttggcaatatgctaaaataaaagtcttaaaattagttcagcaatgtaacttgtcagaatgtatccttaaggaaataacttgttgatatatgcaaagatttagctacaaggatgttcagtgcaacactgtttataatagc

SEQ ID NO: 265870 - DNA, 416 bp, Homo sapiens
ccatataaaaacaagcagtgtgtcatagtttgccaatccctgttttaaataattcaatggttctttaaagctgatgaatccagcagagccctaattatggaaaagcattgtggaagagagaaatcaagagccagccaatctgtcagctagttagccccgagcacagctatattaattactcccttgcctaacacaattcatgcaactcctttgagcttaaccttttcatctataaaaatggagtaatgatagatctccaacccatacctactttatcctggtgaagggagtttagtaataattaaataataattaaattactgaatttttatccctgtgctagatatttgagtcatttaagttctaatctttttattcccactttatagaggaagaaatggaagttcagggagcca

SEQ ID NO: 265871 - DNA, 404 bp, Homo sapiens
ctcaggcaatctgcccgcctcggcctcccaaagtgctgggattacagacgtgagccattgcgcctggcccccttttctttatttcgaaagttaaacttcccagggtcataagattccagtctcatgactggaagaagctctaattagctgctcttcttcccagtccctgccacagcctcattccgccacctcacacttctacttcctcaccttgacaagatacctgtgctcctgacatactgcaggctaggcattcaggaaaggtcagaatgaaagtgcatcccaaaacatgttttattccacctgggatgtccaagaaaggctctggacatttaacaaacttgttagtttacaaatgctacgtttattatcagaggccaaccaaggcctcagactaaggaaca

SEQ ID NO: 265872 - DNA, 695 bp, Homo sapiens
aaacaactaaaactgacttaaataacgttgtaggaatgctgaaaaggtgaatgatttacaacaaccaatcaaatgtccaattaagaaaaaatgacatttagaatgatagaaaattctgtggagtttttactacctactcccactgcacaagatccaccctggcccagtgtgggagaaatagctgtccagcttccgatttcctccttcaaactggagggagcaaagaagactttatttgcactgttgaaatctttctagggaatgcctgaaagatgagtctctatttttcctccctctgaactcatttggggaaaagctgcatatcttgggtctcaggctgggaaaagtcatgcaaagtagcttttgaaaacttcaggaggtgtacagacccacagatgcctggggcaagatttttttgtggagggatatgatagcatatctacagacccaatataaaccaggagtgggactctttggaaaattaagatatttaatttatgccatatattggtgtacatttttatttttttgagatagggtcttgctctgtcacccagaacagagtacagtggcctaatcatgtctcactgcatcctcaaactcttgggctcaagcaatctttctgcctcagcctcccaatgagctgggactataggcatacactatcacacctggctaactttttaatttttttg

SEQ ID NO: 265873 - DNA, 336 bp, Homo sapiens
tcaaaaaaaaaaaaaaaaaaaaaaaaaaaaagaaatatatataaaaacaaatatgcggggcttctcctaggctttatttttagcaatagaattgccaaagacatttcaggccatggaagtaagcttgtggttttacttattctaactttgtttttaggatatcgtagtattttttgatgggaatatcttttttttttttttttggagacagggtatctccctgtgtcacccaggctgaggcaggaggattacttgaactcagaagttcaaggttacagtgagccaagatcacaccactgcactgcagcctcgacgacagagcgagactccgtctca

SEQ ID NO: 265874 - DNA, 461 bp, Homo sapiens
tactaagaaagtcaccatctaatgtcctgatcatccatctggcacattcagaagatttttctgttttacaggttgttttgcttcattccctcctccagcaggtattccctgcagcagggctgacctgagtacctagatgtcagttccctgatctcgccacacatacattaaactcaaggttcggcagggcacggtggctcacgcctgtaatcccagcactttcagaggccaaggcgggaggatcacctgaggtcaggagttcgagaccagcctggccaacatggtgaaaccccgtctctactaaaaatacaaaaattagccgggtgtggtggcacatgcctgtagtcccagctattcaggaggctgaggcaagagaatcgctcctgggaggcgcaggctgcagtgagccaaggtcatgccactgcactccagcctgagcgacagagtaagactctgtctca

SEQ ID NO: 265875 - DNA, 381 bp, Homo sapiens
tttttatgttagagactgactttggcttttagctccatgacattgtcattgtataaagcaagcaccataaaagggaaggtgaacatgtgaaacatgaagtctgaattgcatattgccacacgttttctgagagccaggaaaaataatctgtattgcaggcctccccatggtggcccactgaacactgtgctactgccgcgcatttcaagtctccttgacttagagctcacttagctctaaggaagtcaaagggaaaaaggaaccttattacttttaaaatacttgatagtgggatggctttttcccaatcctcaacagttttttcttatttctcaaggtgaagagacctagtttgttgtatttattggcctttgtgagtga

SEQ ID NO: 265876 - DNA, 326 bp, Homo sapiens
tctttttttgagatgaagtcttgctctgtcacctaggatggagtgcagaggcaccatctcagctcactgcaacctctatatcccaggttcaagcaattcttgtgcttcagcctcccaagtagctgggattacagatgcacaccaccacgcctggctaatttttgtatttttagtagagatggggtttcaccatgttggccgggctgtcaagtaatccgcccgccttggcctcccaaagtgctgggattataggcatgagccaccccacctggctgaaaacattgttattaactactgtcacccacgttgtacaacagatctcttga

SEQ ID NO: 265877 - DNA, 206 bp, Homo sapiens
aaaagccacacacctccctcacaatttgtgcacaaggaaattccccgtggggctcaagatctttaccctagagcagttgttgggttttcaccctggcaatgtcagtggacagcttatcttcacaggtgcagacaaaggacagaactcaaagtcatccctctgctcccccgaaacaaacgcatatctgactgcttcctctgccctgt

SEQ ID NO: 265878 - DNA, 902 bp, Homo sapiens
  misc_feature (32)..(32): n is a, c, g, or t
  misc_feature (40)..(40): n is a, c, g, or t
  misc_feature (67)..(67): n is a, c, g, or t
  misc_feature (90)..(91): n is a, c, g, or t
tgctgcaagggatcataggggcaaacacagcnatctaggnctagtgtagagatgagcgctagccttncaagcatgaagtcggggacaatnntagcctttaactcataaagagagggtagggcttttctttttccatatgtcaattgtggtgttcccagaatgtatagcagttataaaaataggtgaaagaattgttagcttgtaaatactgagagattggtgatttatataaggtaatctgttagtcttaaaatagttaaaagaaaaaggagaattatgaagaacttggttccacaagtaagatagtcctcatactgcatcagtagtgacttaaacttttttaaaacttttattttttgtggggggatctgttgaatttgggaagcctccagttttaataaaatttttttattatggtggaaacatgtctgtaaaacttaggactatagaaatgcaaagaataaagaactgagggagttacacacatttgtagtcagaaattaagttcaaaaaataatttaggtcatttgcattttttagtatgcaaaataaatggaaaaattaaagtgcaataaaaatataatttgggaaatgaatgcagtaaaattgaaaacattgaaatattatcatttaataaaataaacttcaaaaaatgtatgaaaatataagtatctttacttatataggattaaatatatttctgataatctgtcctctataatgaattggtttaattatgtttttctgtttttagaaatgggcatctttttatttctggaaacaactttttaatgagattttatcaaacattagactatgactaattataatattcaaagccaataccaaaacgatggataaataaatgaataaaacaaggcacattaatagaaaaaaatgaa

SEQ ID NO: 265879 - DNA, 412 bp, Homo sapiens
aaaaaaaacaaatttagccaggtgtgatggtgcatacctgtagtcccagccactccagaggttgagatgggaggattggcatgagcccaggagtttaaggttgcagtgagctatggctgtgccattatactccagcctgggtgacacagtgagacattctctctaaaataaaaaataaagcagattgaagaaagcgggcttctagtagaaacagagacaggaaaaaaggcagaaagtaacttccagatcaagaactgagctggcctctgggcatggctgtctcttctactgcttttttgttcaaccacctcatgtgttagcccacatggaaaatgcttctgctttgtaatctgcactttttatggggcttgttcagatggtgctggtataaaggctgaaacccacattgctg

SEQ ID NO: 265880 - DNA, 377 bp, Homo sapiens
gaaacctcgtctctactaaaaacacaaaattagccaggcgtggtggcgcatgcctatagtcccagctactcaggaggcagaggcaagacaatcgcttgaacccgggaggcagaggttgcggtgagctgagattgtgccattgcactccagcctgggcaacaagagtgaaactccatctcaaaaaaaaaaaaaaaaaaaaattgcagcctggcagtatagtgagacctcatctctacacaaattttaaaattggctaggagtggtggcgtggcatgtacctgtggtcccaactacttaagaggctgagttgggaagatcactggagctggggaggttgaggctgcagtgagccatgattgtgcccctgtactctaggc

SEQ ID NO: 265881 - DNA, 154 bp, Homo sapiens
gtctcccaaggcctctttccagcctcattgcaactgcctctgctgtatgacctttcaccctgacaaggggaaagctgagggccagggcgtctcctcactcctcttctgagcagcaaatgcagcccaggggtgaaggcacggactccagaaccat

SEQ ID NO: 265882 - DNA, 454 bp, Homo sapiens
tcaactatgaagcactacctgaatgtgaggagctgtggctctcctaggactacaggtacccctacagctggaagtgaggtcattggagcagccacctgatctgcagctgggactgaatgctgaacctctgcctgattacagaggactggatcaaaagggatgctccagtgactagcaaagaggggtggagccttacattagaagaacggacttgtttccatcccagagccagtgggctagcgtggcatggtggagaaagcacaagctttgcagtcccagttactgggtttaaatctcggctgtgctgtttacaaactgcatgatcaagggcaggtcacctggcctctttgagcgccagttcttcctcggtagaaaggggcagatgctcattttataatgtgactgtgttgggaactctcatagaacctaaataaatagcagtcatggagttctg

SEQ ID NO: 265883 - DNA, 190 bp, Homo sapiens
gccctctgggagcctgacgtctaaaggagagaaggtatttgtgagaacaacactactagaaagcatatgactgcatgagggtgggggcttgagaaatatacgcctgatcttctggaaggctcgctgcaggacatcccgctgagaagttgggaaaatactggtctgtagaagccatactgagctagtgatg

SEQ ID NO: 265884 - DNA, 255 bp, Homo sapiens
tgggaacctcgataggaactttctctataaaagccatatcctctctttgttctctggaactgcacttttgttttacactgaagtctgcacctccctggtttgcaaactgtacacaggaatagcctctttcctccaaattcctttacaaagaatttttcttcacaatatgatgcgagaggtagaagacatgcttacagctgtggattcatatcctgaaatcaccacgattacaataaaacgaaaaatcaaacaaag

SEQ ID NO: 265885 - DNA, 426 bp, Homo sapiens
tttccttcttttattaaaaaacctggatattaaaattatggaagcttctcaccattaatgggttttaaattcaaccttaacaacatgacattctttagaataatgcaaccagtgtcagcagctgaattgttagtggacagtgcccaaatataacaagcagcacatcctgctagattcccacaaaatttgctgaggaagaaaacgttatcatggaggacagaatttgaggcaagaaaaagcaagaaatgagacatcttctgaagatcaaggacattaggtgggaacatattagagatatcaaaaagggagagaacagagagggttgcttagaattaaaaataggcctgtacaattttctctgacgcaaaaaagattatgggcaagaagaccaggtaactaatctagagcctggcagccatctacacc

SEQ ID NO: 265886 - DNA, 207 bp, Homo sapiens
catttgtaaaaggttctattccctgagagccaatgcttttattatacaatctctaatgtcagtgcctgcagtctctgccttcttcaagcccatgaggccctggagatgagtgagaacccctacagggagggggagccttagagagagaggcacagccttagagggagaggcaccatcaagtgttattagggcctgccaaggcttctg

SEQ ID NO: 265887 - DNA, 359 bp, Homo sapiens
ctcacacacactgagaatcctcggcagggagatcacagaaagtctccctttgttcacattctgggaacgcgttacagtgaacacggatgcaaatttatttctgagatcaacgcctgcctcagggaacagttgttcccgtgctattttttacccccgtgggctgcgagttctggaacgttccaaacgacagtgacaacggtgacggtggtgggggcagggagggtggcgtccttccgtccctaagcgcacgcgggccgggcgctgctgaccacatcaccgtagtgaatgacttctttctcacggcggctggcgtcctattggctattaaatataatcattacaataattattaaatataa

SEQ ID NO: 265888 - DNA, 510 bp, Homo sapiens
ggggagctgaggaagagctcagatgtgggggagctgaggaagagctcagatgtgggggagctgaggaagagctcagatgtgggggaggtgaggaagacctcagatatggaggagctgaggatggaactctgacctctgctgtttgttctaaatttcttcctaaggagcctggaggaagtcacaccctcaggccagagctaacgttcttttctgctgatccaaaatgtttcgacaaagcttcacctccttaaccgatcacagatcagaaaatctttgaatttacctataacctgtgggttcctgctttaagatgtccttttaggtaaaaccaatgtgtcacctccgtgtcctgatgcttgactctgcctgaagcctctgcctctctgcctttatggatccttactgtaagccataggagaggtcaggtcttaggcttgagtgacccgattctcctggcctggtgccctgaaagacacacctcactttctctcgctgcaatcccgatgtcaa

SEQ ID NO: 265889 - DNA, 291 bp, Homo sapiens
ggggagctgaggaagagctcagatgtgggggagctgaggaagagctcagatgtgggggagctgaggaagagctcagatgtgggggaggtgaggaagacctcagatatggaggagctgaggatggaactctgacctctgctgtttgttctaaatttcttcctaaggagcctggaggcgtgacacattccgagccatccacggaagtgctgcagacctcgtacacgaaaatgtcatcccgaggcatgatgtggtttaaaccttcatccatttggaaaattttgtggaatcggt

SEQ ID NO: 265890 - DNA, 424 bp, Homo sapiens
ctgtgtccctaacattacctggcagaggcctcaacacaaacatggaagacagctaggtatacttcaattctacctcctctgataaaacttatcccaggcgtccggctcccacctgagattgcaggaatcttcaagccttaacatatctactgggcctcaagatgcagcaggccctcagagagccatcgcaaccatcacaacactcctggagagccccagggaacgtacatatcttcattccacctacgttcttatgaagtagcttgtcttctccttcatttaaaaaatgaagaaactctccactctcactgcttcatttgactaccctttaaaaaaaaaaggagaaactgagacctataaattttatcaaaaccctgagccttgaaaaaatatatatataagaaataaacaaatagaaaacaag

SEQ ID NO: 265891 - DNA, 293 bp, Homo sapiens
ggctgcagtgagttatgatttcaccactgcactccaacctggctgcaagaccctgtctcaaaaaacaaaaatggagctcagagaaaagagatttccagttaaggtgagtaagtttaaacagtagtcatgcgggctctgggcctgaatctggtcttcgaatatgactaatggcctagccctggggtaagcggacggcagctgcaagagcacagggagggggcgaggtggggcagagaggggtcctactgatggccgcaggggaaggtgcacgtgaggagtgagcagaaatacag

SEQ ID NO: 265892 - DNA, 515 bp, Homo sapiens
gtgtttcaggtgaagcgcagagccctgcggcacatgccagcatagtttgtcctgaggctgactgtgcccgagtggcctgcctgtggcaggttgctgagtctccttcccctgtcattacagcgccatgcttcttctagcgatgacttctctgacttctcagatgactcggatttcagccccagtgagaaaggtcaccgcaagtacagagagtacagccccccatatgcgccggtgagtgactggcatgcactgctgagctctggggccgggaggagttcaactgcttgtgtttcttgagcacttgctgtgttctgggcattttttgtgagtttcagtcctgggccatcaggtattaatttaatccccattttatgagtgaggaaactgaaacttagacaatttcaacaaggcagcccagacaaccaagtgagaccccacaaaaaataaaaaaattaaccaggcatgcctgtagttccagctactcaggaggcagaggtgagaagatcccttgagcc

SEQ ID NO: 265893 - DNA, 696 bp, Homo sapiens
tgcgtttcccccccctcgcggcgctcgcccgctctccctcgctctcgctctgtcttttttgggcgccatgctgaggggaagggaagatggagagttggaagaaggtgaattggaagatgatggggcagaggagacccaggatacctccggagggcctgagagaagccggaaagaaaagggggagaagcatcacagtgattcggatgaggagaagtcccacaggagactgaagcggaaacggaagaaagagcgggagaaagagaaaaggaggtcgaagaagaggaggaaatccaagcacaaacgccatgcttcttctagcgatgacttctctgacttctcagatgactcggatttcagccccagtgagaaaggtcaccgcaagtacagagagtacagccccccatatgcgccggtgagtgactggcatgcactgctgagctctggggccgggaggagttcaactgcttgtgtttcttgagcacttgctgtgttctgggcattttttgtgagtttcagtcctgggccatcaggtattaatttaatccccattttatgagtgaggaaactgaaacttagacaatttcaacaaggcagcccagacaaccaagtgagaccccacaaaaaataaaaaaattaaccaggcatgcctgtagttccagctactcaggaggcagaggtgagaagatcccttgagcc

SEQ ID NO: 265894 - DNA, 397 bp, Homo sapiens
agcctgggggattcccctgcggtagacctgggatggtgggcggcgcgcggccgggtaggtccctgcagcctccgaggcccacgtgaggtcggggtcggggcggctgtacagtgcccagcacaggccactggcctcccttgtgggtctttgcacaggtccgcttactctcggaaatcttgggttccccagggccggggaagggtcttctgcctggtctggggcccctcccccgacactgtggatgtctaggtgtcccgggtggggtcaaggagtgaccccacgggttcccccatctttgtccctatccagctcacaccttcgcctgtcttttgcatgtgttttttccacaaccttttgttcaccgggtttttaacaacagaaataaacctaaccccca

SEQ ID NO: 265895 - DNA, 406 bp, Homo sapiens
agacggcgaccgcggggtgctgcaggcttcggcgcggcgcattatcgggctgtgccgaaccccccgggccgccctgggatcgcgggcccacgtgaggtcggggtcggggcggctgtacagtgcccagcacaggccactggcctcccttgtgggtctttgcacaggtccgcttactctcggaaatcttgggttccccagggccggggaagggtcttctgcctggtctggggcccctcccccgacactgtggatgtctaggtgtcccgggtggggtcaaggagtgaccccacgggttcccccatctttgtccctatccagctcacaccttcgcctgtcttttgcatgtgttttttccacaaccttttgttcaccgggtttttaacaacagaaataaacctaaccccca

SEQ ID NO: 265896 - DNA, 230 bp, Homo sapiens
gggacagaggtggcttctggatgcctgtgtgtcccagcctttgacttgggtgagcctgtgtgaatgctcagagcttcctggctattaaagtgtggattttaaagcaactgctcaaagcagttcaggaaatgagtacgcgcggctgctatggtttgggtgtttgtccaggtgtcaggctgttctcgcattgctgtaaagaaatacctgagactgggtcatttataaagaag

SEQ ID NO: 265897 - DNA, 297 bp, Homo sapiens
gctgcccagtagcaacaaaacttctgaaaagagttgtctcatttgtgctcctccattctccctgaatcccaatcctgtcagatgcagctcccgctgctccactgaaatgctcctggcagggccaccggtagcctccacattggcaaatgctgccgtcagttcttaatctactgcaaactccgcctcctgggttcaagcgattctcctgcctcagcctcctgagtagctggattacaggtgtgagccactgcacccggcaaagtcataacactctgtcctctttcaattatttcctcc

SEQ ID NO: 265898 - DNA, 177 bp, Homo sapiens
tttttttgcataaatataagagcacagactctggcgccagaatgcctcatttaaaatccctgctacatcatttattggccatggtatgttgggaaaattacttagcattcagcatctagcttcctcacttgaaaatgggaataaaacagcacctattgcataggtttgttgcgagga

SEQ ID NO: 265899 - DNA, 641 bp, Homo sapiens
ggctgagcacaggatttggtgcaaagctgacacttggcagtggtttgttgaatgactgagtggagtaacaccctcaactcagtgtcctgggagcccccactcatgccagatcacacaagggatccaaagagagcccctcacagcacttgtcatgtggtcctggacagataacagtttccttaagagccagtggttctgagatggagaagcccggggtgctgtgggagccgagtgggcaggtggggcttcctgggggaggtaaggagagcagaggacgctgggcagagggagcagtgtgtaccaggaaatgcggtgcagtgagtgggggcacctgattaaagagcttgatctcaaacctcttggttggtggggagagctatgccgggggtgggggggcagagatttaagaagaaggaatcgggttggaatcatgtttctggaagaatctgcaattggaaacgtgtctcctggcagccgtgtggatgctgttggatggggagaggggctaggggaccagggtcgtgggtccaggtgagagatggcttgagaccagcagcagaatgtgggggggagggttgtttttagttcatttcttcattttgcaaagcaatgcactaaaaagccaaacagcatgtaaaagc

SEQ ID NO: 265900 - DNA, 489 bp, Homo sapiens
aaataaaatttctatatgggcatggagctcagggtgagactgagtgactgagccatgacaaaaagctcaggcttgattcagtagataccggggagctgctgcactcttgaggaaggagtgatcgttgaaatccaggttttagaaacatttgctgaaagaggccctaacaagccctcacagcatggatgggagggccctgctgccagctgctgcattttcctgttgtaaaggggaaagtgtaggcttagatcttggctcagagaggaggaccagcctatgaacactgaaaggatgaaactcaagaactggacctgaggttaagatgcgggggatgaagaaggaaggatttatttattctgtttgtttacaaagagtcactttcacctgagacactctttaatccattcctacatgcagattaaacagggattttctctgattagcaatactttgcattccaccctttctgaaagacaaatgaaaaaaaaa

SEQ ID NO: 265901 - DNA, 282 bp, Homo sapiens
ctacaattggtccttgtatttgtgtttgggaagactagctctaccaagcgtaggactgtgttgtcccttcccaaatggaatgtcagagtgtgtgtgattgatgcagacacctctcaagccactccctgctctggaaaagagactgtcatgctaatgaacaagtgtaaatattccaggggaacacagttcagtctgaaatgaccacatgcaatttggcctatgctctgttttaatgcaatacaattattcttggatatgttgcaaacatagctccttccttcc

SEQ ID NO: 265902 - DNA, 389 bp, Homo sapiens
cttggagaagcagggcctggtatctggaagtcagctgggtggcctggcaacccattctgctgttcacgtggctctcgtccagtatctcctgagctctagctcccacttcctcaacttcatctctgtatgcagtcacttcttcgtgccacttctgaaatgacaaagtatcgaagggaaagattcaatcttagccattcgaataagccaaatgtatatcttcttataggaaatggtttcagtgtaggtttagaagatgtttattttgagatttaattttgaaaatgccatatgttatcttcataaatattatattacaacaatgtgatacaaactgtacacttgagttggatagttttctgtatctattacacttcaattcaaaaattaaa

SEQ ID NO: 265903 - DNA, 211 bp, Homo sapiens
tggaagaggggaacaatacttgttttatttaacgaccagaactttttgacaacaccccccttccccgcaggatatgagaatgcctggtccactgcagtccatccccagggacctcgaagcaaaatttggctggagggggtgcgggggggattctaatgtaaacagtgaccctgaagccctggagccagttcccccttctttcccctgtctc

SEQ ID NO: 265904 - DNA, 166 bp, Homo sapiens
gaatgacatgctcagatctaaggccgtgcaatagtaccctgtgaaggataccattaggtatcctttaatcagataaatgcagaatgtggcacttcaataagaaaactggactcttcagtcgatgtcaacaaaaaaggaaagagagagagagagagagaaaaaaaaa

SEQ ID NO: 265905 - DNA, 295 bp, Homo sapiens
ggctgggtaatttatgaagaaaagaggtttaattgactcacagttccacaggcttaacaggaagcatgactgggaggcctcaggaaacttacaatcatggcagaaggcggaagggaagcaaggaccttcttcacatagtggcaggagagagggagagagtgaagggggaagtgccacacacttttacaccatcagatttcctgagaactcactcactatcatgagaacagcaagcgggaaatcttcccccatgatccagtcacctcctaccttggcatactgcgttaaaaaatca

SEQ ID NO: 265906 - DNA, 1444 bp, Homo sapiens
  misc_feature (1147)..(1147): n is a, c, g, or t
tgcctccccaccattcaccaggctccactgcactggctcattcctgcctcagttgtgcttcttttccctggaaagttctttctgtagatctttaaagggtgatttccttctcaacattcaggtgtcagctcgtttcactttcctgaccatgcccatccactcagagatcactcaaaatcccattaccctattttatttctccatcatatgtatcactatctgaaactatcttgttgttgatgcaggctattttcttgaccccttcatgggactcccaacaggggtaccccatttactcagcctgccctgctcaacctcttgcaggagggagcacacgagtgaacgagtgcaggaaccagctggctgctttagtgctgtgaggagtaaactccatgcaggccctgcagcagcaaccagtttttccagatttgctcaaagcaatcccagtgagcatccacgtcaatgtcattctcttctctgccatccttattgtgttaaccatggtggggacagccttcttcatgtacaatgcttttggaaaaccttttgaaactctgcatggtcccctagggctgtaccttttgagcttcatttcaggctcctgtggctgtcttgtcatgatattgtttgcctctgaagtgaaaatccatcacctctcagaaaaaattgcaaattataaagaagggacttatgtctacaaaacgcaaagtgaaaaatataccacctcattctggctgactaaaggccacagctgagcctggaactgacccttccttcatcctcaacctgctgtcctccagaaagcaccaaggaaaaagcagagaatgacagcaaacagatcactaggcctctgaccacaggtgctgagtactcagcagccctcatataataggtttgaaagtactccttaaaataaaacactgtttccctttggaactatttacaaggatgaaacaaccgtatacctgagaaataacttgctctggtgtcaattcgctattcgccagcagacatcagaacacaccgagtttccagatgctggtttttccccttaaatcaggaaatacacctggacaatttctagaagactacaattcagtctagccacaaaggggattttttttttttggtaacaggctagagcccngttctgtaagtctttagctgaaatggtccagtacaaaagcactggaaatgagtgggctaggaggacaaggaccgtctcctgcgtgaggagttggttggaggtccccaaggccaggtaccccctgcactcttattggattcctctctgtcttcttggagttttgaaaaactccttcgaacaccaggcttttttctttagaaaacaagtctccaatcgttctctgttccgtagaaagagaaagaaaacctggagcagctgctgaaaaatctaatgaggaactaagaggcaaacccacca

SEQ ID NO: 265907 - DNA, 1530 bp, Homo sapiens
  misc_feature (1233)..(1233): n is a, c, g, or t
tgcctccccaccattcaccaggctccactgcactggctcattcctgcctcagttgtgcttcttttccctggaaagttctttctgtagatctttaaagggtgatttccttctcaacattcaggtgtcagctcgtttcactttcctgaccatgcccatccactcagagatcactcaaaatcccattaccctattttatttctccatcatatgtatcactatctgaaactatcttgttgttgatgcaggctattttcttgaccccttcatgggactcccaacaggggtaccccatttactcagcctgccctgctcaacctcttgcaggagggagcacacgagtgaacgagtgcaggaaccagctggctgctttagtgctgtgaggagtaaactccatgcaggccctgcagcagcaaccaggttataagctctgtgagacaacaggaatcttgtccatcttgttttatggctctacttccaacacctagaataatgcctggcacatatttttccagatttgctcaaagcaatcccagtgagcatccacgtcaatgtcattctcttctctgccatccttattgtgttaaccatggtggggacagccttcttcatgtacaatgcttttggaaaaccttttgaaactctgcatggtcccctagggctgtaccttttgagcttcatttcaggctcctgtggctgtcttgtcatgatattgtttgcctctgaagtgaaaatccatcacctctcagaaaaaattgcaaattataaagaagggacttatgtctacaaaacgcaaagtgaaaaatataccacctcattctggctgactaaaggccacagctgagcctggaactgacccttccttcatcctcaacctgctgtcctccagaaagcaccaaggaaaaagcagagaatgacagcaaacagatcactaggcctctgaccacaggtgctgagtactcagcagccctcatataataggtttgaaagtactccttaaaataaaacactgtttccctttggaactatttacaaggatgaaacaaccgtatacctgagaaataacttgctctggtgtcaattcgctattcgccagcagacatcagaacacaccgagtttccagatgctggtttttccccttaaatcaggaaatacacctggacaatttctagaagactacaattcagtctagccacaaaggggattttttttttttggtaacaggctagagcccngttctgtaagtctttagctgaaatggtccagtacaaaagcactggaaatgagtgggctaggaggacaaggaccgtctcctgcgtgaggagttggttggaggtccccaaggccaggtaccccctgcactcttattggattcctctctgtcttcttggagttttgaaaaactccttcgaacaccaggcttttttctttagaaaacaagtctccaatcgttctctgttccgtagaaagagaaagaaaacctggagcagctgctgaaaaatctaatgaggaactaagaggcaaacccacca

SEQ ID NO: 265908 - DNA, 198 bp, Homo sapiens
ctttacacactgagatgtgggtgtatgactgtcatcacccaccataccaagggcagctagaagaccaaaggcattgcttactttacctgggtgatttttcatagttgtttgttggtgttgtgcattcagcgggcactcagcagtccttgttgagtgactaacggctgagagcctcagaaatacaagcctcaagtcaca

SEQ ID NO: 265909 - DNA, 519 bp, Homo sapiens
cagagaatagcatccattcatccaccctccaccacctgtcactctcactaaagaccagaagaagtctgcctccaggtgaggtttctcagtgatggactgatagaaagagtgctggagttactctaagctcagcagaccaggctaatgctttaatagaccatgtagacaaagggcagtgaaagaactagggcagaaatgattttttacttggagaatcagactagattgtagcccacacagatgcagcctcctgaatgattggaggagtttcagtattcccagccccgccctaggctgaaatccaaaccgggaaggcaaggcaaggtgtgagcacataggtgaaggaatttccctcaagcagaggcccaagctcagaaggggtcctgtgaggcacataattcctagggtcttggctgaggcaagtctgccaaccctgaaaagccaggggatttcctgcatgttagagaatggctgaggccctggagtattttaaccactccgggaaaagtagatggagca

SEQ ID NO: 265910 - DNA, 811 bp, Homo sapiens
gagacaggtgtttgcattgtgtcaaaggaaatgctcacataggtgggtctcttccttgtccactaaaggatccccctcactggtcagggattgctgaccccacaaccatcagcagggtgaccaggtctgctggtgcctggtgactggctgggagaagctaggcaccaggccgtgtggcgagcccgttggtagggccagtggtttcaggggagctgtgctaggagttgggccaagggcagcacccttccacatgccaacgagggctgaaaaaagggccttcctccacagcccaaagagctggtgccatgggaggacatggcctataaccaggtgtaatatggggcagccgctaacaaggaaccaaatcgtagagactgggaaaagcatgatgggccggatgaaaaagcaaaacaccaaactgaatttgtgttatgtggacaaaggctagacttcaatgtggaacaaaggaaagtttaatttcccgagatgtcaggaccctgggagagcttttttcctctcctttggttacccaggaggcagcacggagcactggagagggagccctggagccaggatgcctggccgccgcccccggcccctctctgcagagctaggaggcagcacccaggccatgagggacaaatgtggagcaagggatggagctggaacttgctattatgggacgttaaagctggcaggacctgaggtagcatctaacccagtggttcttaccttggctacagcactaaaggctcctagagaatctgtttcaccatattgatgcttgaatcttaaattcagctgattagtt

SEQ ID NO: 265911 - DNA, 388 bp, Homo sapiens
agatgacatgattattctatttaggaaattccaaggaatctacaaaacaagtactgctagaactaataaataaattcagtatgattaacaggatgaaagaacaacatgcttaaagcaattgcatttctgtattcctacgatgaacatgtggaaatagaaatttaaaacgtaaaacatttacaatcactccaaagtaaatgaaatacttaggtataaacctaacaaaaaaatgtacagaatctgtctgtgaaaaccacaaaatgccataagagaaatcaaagatctgaataaatggggagacatactgtattcatgtatcagaagagtcagtatagtaaatatgtcagttctccccaaatttatctatagatttaatgtaattcctatc

SEQ ID NO: 265912 - DNA, 485 bp, Homo sapiens
ccaaaagcacatttcattgtactcagtattttccctagttctggtctgtgcttgccatattgttgggttcagtatcactgtcaactgagagacaagggcacatgagcaggactgaaagtatttgttctgttccacctctgtacctggcagaaatgttagaactgccaaaggcctggcatgactgaagcctacgaaactaactgtgtgctgttgaggggcaggaaggaattaacaataggaagagattttatttcccttctgaaattttttgtttttccttgaaccttgacatttctgaatgtttcaaatatgataatttcatgagtacatcaagctgctcataatacattttcaacttttatattctgaaaataacctattacttttataagagcacttaagatgtaaatagtaaatttttttgctgttttctcctcttgctcagctttttatcccatcctttcttccttctcctcctcaaaaaa

SEQ ID NO: 265913 - DNA, 325 bp, Homo sapiens
gattcaatttttgattgtatcaatgtacatgacgactatacaacatccctaccataagattgttgaatccctcctaattcggtgttaactgggacaggttatttatcctattaacccatattcgatgatggcaattgataatacaatttttaaatatatttagttatttgccttaatagagtcctatacctatctggatccattttgatgtgcttgttgaaggcttatttgtctgagtactcaattaacagaaaaaagattcaatttataaacattagtagaaggaatgggttacgaaaaggatatgaaataaattgtggtgacg

SEQ ID NO: 265914 - DNA, 488 bp, Homo sapiens
cacgagggttggagcggcagcggttaaatttgttacattggattctcaaacttcctgagtcctttgtccgaagtggatgtgtattggaattcctgctgtttctgaatagttcagtctcatgtgaaaattactcatcagatagcatttctgcaaaatacttttaagtcttgtcttttcacaggatgccacctgactctaggctttcatgctatagcttttggtgtctgaaaattctttggtgttttaagcaagcagaattagggatcctaagtgtggacgcgactgccattttgtagaggtcacgaggacacagaggtgccattagccctgcatgattgatgaggtagaatttttaatgctggtgtgccttaaatcacagctaaagatagagaagaatcattagctaaggctgatttgaatgatttactgtaggattaatggatcagatttttaaaaagttacttcataaatgtgttaaatatttagtt

SEQ ID NO: 265915 - DNA, 644 bp, Homo sapiens
tgaaaatgccaaagtcatcctttgtcttgcagtcaatattattttggagatgaacagagatttaaatttaaacaggacttaaaactacagcctaatagagaaagagtttatactagaagacatttctttaagaccaatattttttagttcttttcttttttacagttaatatagcccaaccctggcaagataaagagaataaatttaccttccaagtccttgggacttaaaacaacagctcaatagagaagaagtctatactagaagacatttctttaagaccaagatgttttagttttttttttttaagttaatataacccaaccctggcaaaacaaaaagcctgagtttaccttccaagtctttctggtaaactccagcataagaaattatacatctgactcttttaaacttaacttttttgtctttttctaaactaacaatagcttcaaggaaaggtgtccaaaattgactcaaaaggaaaagaaagacccattaccaattgagatgtcattggaaaagtgggctatgagaggttcttactggctccttgaagggttatattctattttggctcctttatttattatttatttaagataagagaaattgcttttcaaaattacaaaattaacttttgctct

SEQ ID NO: 265916 - DNA, 597 bp, Homo sapiens
caatgctcatggattttttttaaatttatggcagagataaaatttcagctttttttagctttaaatttacctatttagagttaccagtggtagaatgtttgtgtattatgtgcatactcattttagagtcacttacaaattaatgatatagcctatcatttataaacagtgattgaacatgtaaacctcagtctgcattaccctttgtgtctttaaagaacagatctgcattttttcgggatcctcaaatgaataagtcttggttattttattttaatggcaaatctgttctactactggaatgtttttaggacagttcagagaaatgaagtccaactcagatttggattcttgacgaataaatttgactgctgtaatctttgtttttttaaatccaccttatatttgtattgggaaaacatcaggctgtttatataaatctttctatataaattgtgtatgtcagtcataatgacatatttcttatggaaatttttatatttaatgaatgataattctcttgtgtgaagtttctatttttaatcaaatttaagatcatttctgattctatttcgtaacatagagcagttattaggg

SEQ ID NO: 265917 - DNA, 228 bp, Homo sapiens
gtctacatttcatctgaaagaggattctggtcagcagtcagagaggaaataaggtcctcagcccagtatcctgagaagaactgaaattctgccaacaaccataatgtgaatgaatttaaaagcaaattgttccccaatttctacttcaaaggaaactgcaatgccctgagagaccttgagtcagaggcacccagctaagctgggccagtattcctgatccaccaacac

SEQ ID NO: 265918 - DNA, 471 bp, Homo sapiens
agacgggcactcacagacagaggtttatgtatttttattttttaaaatctgatttggtgttccatgaggaaaagggaaaatctagggaacgggagtacagagagaataatccgggtcctagctcgccacatgaacgcccagagaacgctggaaaaacctgagcgggtgccggggcagcacccggctcgggtcagccactgccccacaccgggcccaccaagccccgcccctcgcggccaccgggccttccttgctcttcttatcatctccatctttatgatgaggcttgttaacaagaccagagagctggccaagcacctctatctcagccgcgcccgctcagccgagcagcggtcggtggggggactgggaggcgctaattaattgattcctttggactgtaaaatatggcggcgtctacacggaacccatggactcataaacaatatatctgttgggcgtgaaaaaaat

SEQ ID NO: 265919 - DNA, 489 bp, Homo sapiens
gatgtagtgaattctctgtctccaagcaagactacatgcagacagatagtgattatatgtttttaaaacattgttcttcacctagtaaggcaaggcaggtagacagcaaactcaatgtggttcatggttcgttacttcccatcttcatttctcagataaaaatctgcgacaaatttgccataataagacactagtttggtaaactggcaagtgccttgcagcatttcttgtgaggagcatatgctaatggatgcttgtatttgaaaggatgactcacagttaatcattataagaaataggcttaccacttcataaactctaggaaagactgttttctaaacatttaaattgctcagccattttatgcattaaaacccaattataacttagtatgttggagaatttcaaaagctattccctgcaggatctgtgcctaagactacattttatcattccgtagttcacactctgtctaatacaggcaaaaaa

SEQ ID NO: 265920 - DNA, 359 bp, Homo sapiens
ctatttagtgtgtgaacatgtatgtgtgtgtgtttgggaacttctgtgagccatcttccccaggccctttaaggaaggacatttgcaaagcagaatgaatggggctcacatatagtcgaaggtaaatctgagagacagaatttaaatgacatttgctcctggatttagctgtgcctgaaattacttaaaagagaatttggacttttcacttaagagagcagatcaaataccttttaaggcttacactagcttgacttagatctcttttgctagcacccaacaaatcttgactaatagattgggaaatctgatgcatattaaaggaatattctatagacttcagcatttacaggatagta

SEQ ID NO: 265921 - DNA, 761 bp, Homo sapiens
atttttttttaactgaaaatggacgacagaactaggtttctatactggaaatttctttatggactcctataaagggttaaaaaggagaaagtataatattttttaggaatgaagagtcaatttctgacttctgtttccagccaacatggagtaataaggattggatttacccttctatctaaagcaatcaaaaaggaaaaaagaacaaaatatatgaaacaacagcttataagaaactagatatcaggcagtaaacaacagtgatctctaagaaacaagaaacaaagatcactccagcttactgctttgtgagaatttttaggctattgtgcagagtgggtcagtgcagtcagagcctggcagaattctggatttagcagcacagaaagaaaattctggagatctgcagttgtctcccttgagtattcagcagagtactgattagcatatgcatgtgaggacactacctcgggcagggaaagaaccatctcatccgacgggattagaagaatactcagaagggtcttgcctcaatagttatctcaagcctacacactgctctagtttcaacgaacaaatattaaaagcaagatgtgaaaggattaaattttttccaagtaacttaaatgtgttcattaaaacctatccaaaagcaacacagatgttagagttatcagataaggactcttcagcagttattattattgtgttccatatgtacaaaaagtttaaagtttagtagagacatggaagatggtaaa

SEQ ID NO: 265922 - DNA, 612 bp, Homo sapiens
acactttctctttcataaaatagttcctcattcttccaggtagccttcaaattcttccaggcttcttattgcatatgaataactacatgatactgaattgtaacacattaataaatattgcttatttttttagataatgaaagtagataccatgttcattattgttactagcttggtttttagtgcataattgttcaataaatacttgttgaatgaatgcaggtgaaatgattctaaagcaaggattggcccaattcacatgaagctttcagtcaggccgtaacactcactgacacatcactgtccttccctaagttaatttttctgttatctgtgctctcatgagagtaaataggtcacctactctctcttattattaactattatcatgtctatcttactcactagaatgaaagctagtctagtgtatcagcttggtcttacttattttttatgctgagaggagaccttaaatagcagtaagtatttgttgaacaaaatacatcattttagtgttacatggtggacaaaaaaatgagagaagaaaaaaataaatattaaaagtttgaagggataaatggcaaaggtgaagttttacacaactaattagac

SEQ ID NO: 265923 - DNA, 472 bp, Homo sapiens
ccaaatccatagtttagtttacactagggttcactcttggcattggcattgtacattctttgcctttggacaaatgcgtaagcaaggagagagagatgaacaggcaaaacacagaggatttttagggcactaaaactactctattttaatggtagatatacatcattacacatttgacctgtgttcagttctgttcacttgtagtatctctagtttagcaattcctgacatgtagtaagataaactaattacccatctgaccttagtctggccctgaaaactagtgtaccattcttcctggcttcttgaattcaagataaacacttgcagtactgtttttgcagtagacattgtgtcctagccccaaacaaatcttagcagtgaggactgtttctacttagaaaattacaccacccaactccagcagattactatatcatcaaagattctaagatttgtgtcttctgcaagt

SEQ ID NO: 265924 - DNA, 454 bp, Homo sapiens
tatggccggggtgaaacggtgagacaaaaaggttgatttacattgtttacaaatcaccacatcaataactagaaatgcctggggctcttgtctgctgggcgtggtgtgagcaggactgaccgcctcaagaactgacggcaacatgtaaacactcgaaaagcaatgacactatgaagatcaatgtgagaaatgtgttccatgctaggataaagtttggataataaagctttgcattcaggaaggaattactgttggttccagtgttctgagacacttcctaaagatagaagatgggttttaaataatagcagaggtttggaaaatcatagaggttgagagaagggaatttccagcgaggaattgcatggacacaggcatgcagatagaagccaagaaatatatttaggggactttacccagttgtattggagtaatcataagaagaaagcagagt

SEQ ID NO: 265925 - DNA, 203 bp, Homo sapiens
atattagtatgagaaggaacgacataaagatatgaataacagaacacaaccattgggtgccattttggaggctggctaccactgtatgatgcatctgtaaaatttctttttagcccctctggcatgccctgacttgtctctggatattgctacatattgttctttcttgccacaaaaaacttctcccttctgtttctcttctc

SEQ ID NO: 265926 - DNA, 449 bp, Homo sapiens
tagttgatttgcatttttgcctggttcaatcaagaaattatcgcgtgacatcaggcaagttgccaaatttctttggactatacctataaaataaaatttgaaaatattagctagatctaacccatttgtctccggatgtctgcaaagtggttggaaatcacaagcctaacctgatctgcagaggtgttacctttggcaaacttatggtttttgtgtttgttttgaaatctaaggccaagcgcggtggctcatgccggtaatctcaacactttgggaggctgaggcgggtggatcacttgaggtcaggagttcgagaccagcctggccaacatggcaaaaccccgtctctactaaaaatacagaaattagcccggtgtagtggcatacgtctgtaatcccagctatttgggaggctgaggcaggagaatcgcctgaacctgggaggctga

SEQ ID NO: 265927 - DNA, 387 bp, Homo sapiens
tttttttttctgacatggagtcttgctcttgtcacccaggctggagtgcaatgacgtgatcttggctcgctgcaacctccaccgcccgggttcaagcgattctcctgcctcagcctcctgagtagctgggattacaggcgcctgtcaccacgcccagctaatttttgtatttttgtagagacatggtttcgccatgttggccaggctggtctctaactcctgacctcgtgatccacctgcctcagcctcccaaagtgctgggattacaggcgtgagccactgtgcccagactattcatcttatttcttaataaacatttaaaaatttacacccttctgggaggagtcttttgactctctgctctaaccttcaccatgttcttgttaa

SEQ ID NO: 265928 - DNA, 628 bp, Homo sapiens
gatagagtctggcacatttccttattgtttgttctttaacttaatataaatgtacagtactagattaacttcttgtagttaaaaatgaaaaccaaatataccagtaaaaatggtgttattatttaaaatattaacatttcaacaccggaagagatgtgaaggcaattatttgaatccttaccttttgcagatagcagaatggaagcatagaggctatacctgactgttcaaagtaactgtagggttgttcaagggcagccaagtgagaatccagtccttctaattatttcaggggtgttctttctagtccactaggcttttcttatcttcagcacattaattgataatctgacttaagtgagaaaatagaagcaatcggaatcaaacacccacaagcacctagtacatctacccaattaccagcatctgtaatgggatgttttctgccttcactcctgttatgatggatggactctccatgccacaccaaggtcaactccttcacttgtgcataagatcctgttccctccagcctaatcaaggatattatttcagcttttctgccctcttcacactgtggaagatcattcccattagcagacaaacatgctgttatttttctcattta

SEQ ID NO: 265929 - DNA, 406 bp, Homo sapiens
tctgcactagtcttgcctgtcctgatcttcctggggtgcgcgcactccttcagcgtgtcctggttttaaaagactaacccatccggatgggcctgaactcaagaagcaactattctaagctagactgagccttggcgtctccgcagcctgggaagctcggatagagctctttgaagaaggcggctgcaagccagtctccgaaccccaggggacttttgggcaagggagccggtggaagcagaaggaagaagatgcgctgagagtcctcacaactgcgtctccggaggcagaacgaagtggggacttcagacaatcaagcgtcatccttgctccccctccccacacggaaccctgcgattatggcaagagaaaactggtttgagcttgagaaaatttcaaaaaaaaa

SEQ ID NO: 265930 - DNA, 822 bp, Homo sapiens
ttttttttttttaagagaaggggttctgccatgttgcccaggctagtttcgaactcacaggctcaagcaatccacctgggattacaggcatgcgccaccgtacccggctgaattttttcaagcaattgtctgagtgtttgtaatttggttcctccattttgtcagggaggttgcaggaacaggaggcatcctgcataagcaggtgcatttctgcttcttttggggtcccagcaagacaagtgttgggctccaaaaggggctttcggctcctgctgtgtgttcacaaacatgtgttgtgtttctggctctccctctcaatttgcaagtaaaggatgcaatggtggtgtcctccagacccaaagccacaacccatcgcaagtcaagaacactttccagaagataaacatgagtgggttcatgtctctctccttcaaagccaggacaaaatccccacttctttgctgccgcgagtcaatttgtgatttattttgtctgcacctgtttgatgccaggtcgacatttcctaaggcaagcccctgtatttgttgtggatttaagtggaggcggccagcacacaccttggatgtaatttaaaaccatttcctgaggaaagatgtgtgatatgctttcctttgtttagcaaatgtttatggttttaactttaaatctcaccgcaaatcacttacacttgaaaacagggctggtctgaaagtaattaccctccctgagtgccaagacctccagaagttgttttcattcccgaatggcaatcactgtactcatgcgctccacgcatcttaaataaactcagttcaaagcaca

SEQ ID NO: 265931 - DNA, 695 bp, Homo sapiens
ctttattcaacactcctttggctaaggtgtaggaataaggagtgctgtgagtttcattgcatcctcaaaaggtggtttaagtcctaatccctgtggcctgtgaatgtgaccttctttggtgatagcgtctttgcagacgatcaagttaagatcattagaatgggcccttctccaatacgatggtgtctttataaaatgggcagatttggacacagacaagcacatgaggagagcaccatatgaagatgaagccggggatgctgtgatgcttccacacatcaaagaccgtcagcacaaccccggaagctaggagaatgcctggagtagattcttcctcacaccttcatgagaaaccagtcctgtcgatgagagagaatatatttctgctgttctaagccaccagtttttggtaactttgtcatggcagccttgggaaactaaaacaagggtcaagtggaggcagcactgcccttggagggttgaggcccagctcactccattgctgcaaatcctgtctaaatcatctccctttgctaagtgctcccaaacacccagcttgtcagaaaccaaaaataagccatcctaggaggagtacagtaacattcaaggcctcaggatatttccacatacgccatgttcagcaccatatcaaaacaaccaggcgtagaataaaacaaaacggaaactacagcagc

SEQ ID NO: 265932 - DNA, 457 bp, Homo sapiens
aaaagattagagagcccagaaattgacatgcaattttttggcaaagattcaaaggcaatctgatgtagagagaatagtcattttaatacacagtgctggaaccatgtgaatgagagacttgacccactccttattatttatacaaatactaatcttaaaggggtattagaataaaataaaaacgtaacactaaaatagttcttcaagaaaacataagttttgtgacgttgggctaggcaaaagatttccctgtagatggcagggaaagaacttataccacgaatgaattagataagttggacttcagcaaaattgaaaacttctactacttgaatggcaaaaagtaaatgaaaaaataagctacatactgagataaaatattttctaccaataacaaggaggaaaattaaacaagactaaaaatgacacagaagatagaattagtggatgaggacat

SEQ ID NO: 265933 - DNA, 95 bp, Homo sapiens
tatagcatttcagtgctttatcacatcatgcccacatatgcaaacatatgtacatgaatgaactaatagtaaacaatttctcttcatcctttata

SEQ ID NO: 265934 - DNA, 369 bp, Homo sapiens
ttttcacagaacatcaaacgacaaataagtataagcaacacacatccaaaaaaaagtatttaaaaagtgctttctgcatttcatctggccccgccccatcagctctcactctcatgcatatatagacccttcacaattatatctaattcatagaaacataagtactttcaacctatatgggcctcccctatcccaatgacgttttccttgaatttctctttgtgaaaccatactttcagtccctttcttaagatttataaccccgattatatttctaaggcagattcatatgacccaatactccacttagattctgtctattttcctcttgttatttttcagaaggccatagactgcaggatcgaaatt

SEQ ID NO: 265935 - DNA, 1091 bp, Homo sapiens
  misc_feature (4)..(4): n is a, c, g, or t
  misc_feature (13)..(13): n is a, c, g, or t
  misc_feature (17)..(17): n is a, c, g, or t
  misc_feature (44)..(44): n is a, c, g, or t
ggtnagggggggngggngtttattgcatgcctagaacggccgtngggtgtatgagccctcccgggtgggagagacagggtttcctcatgttgcctaggctggtctcaaactcctgggctccagcgacccacccaccttggcctcccaaagggttgggattacaggcatgagccatgatttgtattccccttatattaataacttttttaaatttaataaatactacctcccaatcacattaaataagagagcttctttgtacatcaaaatagacagaatctatgtggattatgagagatttttacaataactgataatgtttttggaatacttattatatgctaggcaccgtcctaaacatattatctcacttaaacctcatttaaaaaccccatgaattagacactataccccaattttacagaggagtgaggcttagagagtggagctcagactcacactcaggtctagatcccaagctcataatcttagctattcactacctttattttctttatcttttctgtattttaaagttttcttcaatacacattataagcacagtcggttaacgtataaggtttgttaacttagttcaactgttgatgactcttcaaggccttctggaaataccatctccactctggtacacagctggtactcaatgaattatatagtattatataaatgtcaaagaatgtttttatattgcttgatgaaagatatattacacatctaattttctcattgccctgataaagcaagaaaagcagcatgttaggagcacgtattctagagccaggctgcctgagttcaagtcctagctccaccacagacaagatgtgtgaacctaagcaagttgcttattgtccctgtgcttcagttccctcatctgcactacagatatagtaacagtaactaattccactgggttgttgtagggattaaatgaattaaaatcttaaaagcagtactgaaatcagtgcctagaacacagaaaattacatttaactaaagtaaaaccagtatctcgtgggagaaaaaaagaaacaaaggaaactcaaccagtaaattcaaaccaaaacttctgt

SEQ ID NO: 265936 - DNA, 1146 bp, Homo sapiens
  misc_feature (4)..(4): n is a, c, g, or t
  misc_feature (13)..(13): n is a, c, g, or t
  misc_feature (17)..(17): n is a, c, g, or t
  misc_feature (44)..(44): n is a, c, g, or t
ggtnagggggggngggngtttattgcatgcctagaacggccgtngggtgtatgagccctcccgggtgggagagacagggtttcctcatgttgcctaggctggtctcaaactcctgggctccagcgacccacccaccttggcctcccaaagggttgggattacaggcatgagccatggtgcctggcctctatgttttcttaaacaaaataaacatttaaggtagaatgtatcatttgtattccccttatattaataacttttttaaatttaataaatactacctcccaatcacattaaataagagagcttctttgtacatcaaaatagacagaatctatgtggattatgagagatttttacaataactgataatgtttttggaatacttattatatgctaggcaccgtcctaaacatattatctcacttaaacctcatttaaaaaccccatgaattagacactataccccaattttacagaggagtgaggcttagagagtggagctcagactcacactcaggtctagatcccaagctcataatcttagctattcactacctttattttctttatcttttctgtattttaaagttttcttcaatacacattataagcacagtcggttaacgtataaggtttgttaacttagttcaactgttgatgactcttcaaggccttctggaaataccatctccactctggtacacagctggtactcaatgaattatatagtattatataaatgtcaaagaatgtttttatattgcttgatgaaagatatattacacatctaattttctcattgccctgataaagcaagaaaagcagcatgttaggagcacgtattctagagccaggctgcctgagttcaagtcctagctccaccacagacaagatgtgtgaacctaagcaagttgcttattgtccctgtgcttcagttccctcatctgcactacagatatagtaacagtaactaattccactgggttgttgtagggattaaatgaattaaaatcttaaaagcagtactgaaatcagtgcctagaacacagaaaattacatttaactaaagtaaaaccagtatctcgtgggagaaaaaaagaaacaaaggaaactcaaccagtaaattcaaaccaaaacttctgt

SEQ ID NO: 265937 - DNA, 435 bp, Homo sapiens
catattttgggttgtcattttctgaaccccaataaaactttagaatcagcttatcaatatctccaaaatagtgtactaagattttctttgagattcaattgaatcacttgagagagtttggaagaattgtcatcttaagaatattgaatcttggctaggcgtggtagctcacacctgtaatctcaacacttcgggaggctgaggcgggcagatcacggggtcaggagttcgagtccagcctgaccaacatggtgaaaccctgtctctactaaaaaaatacaaattatctgggcatggtggtggctgcgtgtaatcccagctactcaggaggctgaggcaggagaatcgcttgaacctgggaagtggaggttgcagtgaaccgaggtcacgccattgcataccagcctaggtgacagagtgaacctctgtctcaag

SEQ ID NO: 265938 - DNA, 458 bp, Homo sapiens
acagacaggaaaacacatttaaattagtttgccctttaaagattatttcctacttgtctcttatcaatgtgagtacataaaagagaccttattacaattaaaaacaatgatggtttagcagcagatttagataccttacattttctctttaagagagagaatgtaaggcctggcacggtggctcacacctgtaatccagcactttgggaggctgaggagggtagatcacctgaggtcaggagttcgagaccagcctggccaacatggtgaaaccccgtctctactcagaatacaaaaattagctgggcgtggtggtgcatgcctgtaatcccagctacttgggaggctgaggtaggagaactgcttgaacccaggaggcagaggttgcagtgagccaagatggtgccattgcactccagcccgagcaacaagagcaaaactcttatctcaaaaaaaaa

SEQ ID NO: 265939 - DNA, 408 bp, Homo sapiens
gaatttttgaaattgaaagatcaaatcataaagaaatgagtcttaaataggttctagccattttgacaaatgttgtggaaagtatttggggaaaaatagtattcctgatagaaatttttgagttgcacgtgaagacgatagattttttaaagtcaataataataataatagttactacttagagagcccttactatgtgtcaggtagctggtcatatctcctttataagaatattatgagactgtctatgaaaatagtgaaatctctgaaagtattgtcattaggcataaaactacaaaatgatattctttgaaagcattgtttttaacaattgaacattcttgttatttttatgtagctttaatatgcctgtctgttggacatttaagctctatgcaattacaaaat

SEQ ID NO: 265940 - DNA, 378 bp, Homo sapiens
ttcatcaatacttgcttataattatgtttaatagtaatgatcttaacttcctacatgaagtaaattaagtactctgatcattgataaaagatgtaattgccttaatgactactcacattttaaaacactgatgctgtcattttctatgactgtgataatttgttaagtgtttgaaaggattaagttaaaagaacatcagttctgtgactaggagataaatcaatatcaaatgtcaaggggagggtacgtgaatgctgaaaataagctccccagatggttctgaaaggccctcggtttcacttgagaatcatatgaaaatacttaagaaggcttcaccaaatttaaaactgaaacttaagtttataatcaagcaaaaaa

SEQ ID NO: 265941 - DNA, 365 bp, Homo sapiens
ctactaagcccttgatgtaggcttaggggattcatcttcacatgaccccttggaaccaggtgctattacagagaagaaaagtgaggtacagagagatgacacaacttgcttgacatcacagagctgcagcgctcaagctgagttggtccagctccagagccatttagctattaccctctgctgtctcctaagtggggtgtcatccctgccccatcgagctcctgtgaaaatcagtagcatatgagcatctgccagtgagcatcaaacagtggtaactaccagcattagtccttgctccagaagaaaagcaagctccagccctggctccgcaacttgcaagctgtgtaagctggggccacttacct

SEQ ID NO: 265942 - DNA, 798 bp, Homo sapiens
cgggttgtcccaactactctctgtgtctcagtgtcctcatctggaaaactataaggcgtaacttaatgacctctaacatccttttcagcttggcagttcattatgtctcagtttaggccccttctcagcccctaaagcaatgcagttctctctgaaattaataataagcaacatattggttgataatttaggcctcagtgtaaatacattaatatgtatttcttttctaaaatgatcttttatattcaatgttattaccctatatttctcttaaactgagaacagacactttaagcgtcagtgattttagtatttaaaactgaaaatcatattgagaatgaattgtgaagaaaatagttttttttaaaaaaacagtgtaattgcatcaccgtttgtatgtgtttactaagtaaggttcaggttattttgtatcctgtgcttgctgtacctttcaggaagttaattttgcagttgttgttcttgtatataatttaaaatcctattttgaatttatgctttttaaaaaactcagatgtgtgtactacatgtgtaatttatattatctataactttagtaattatctgttaatatttattgaacattttctggatgcattacacagaactaatgcattctctggtagtgaactgcatttaaattagaaattctccttatggaagaggaagtttaaaaatcaattctctgattatgatgaggttttctttagactagatataaacctagatccttggcatgtacattctgttctgcctctctggctatgttcttctcttgtc

SEQ ID NO: 265943 - DNA, 340 bp, Homo sapiens
atttctctgcccaggagctccctctgctgcaggaactcaacgatagggaggaagagtccagaaaagtagggctgtcagcacctctgtgagcagccgacgatccacagcggatggagtttggtggtaaaggtactcacttcctgtctctctggtgatgattttgagcatgttctacaaagtctttcagatggtcccagtaggttggagcccagctgccctcagtggtaacctgcccattaacgtatcctgtgttggtttcctttcctcccctacctcacctccccactcccctttctatgattcctagagtcacctcccaaataaactttcacatttacat

SEQ ID NO: 265944 - DNA, 383 bp, Homo sapiens
attaaacaccaagtatatgtcaggtcctatgctgggtgttgaggacagaagatgagtgaggagctcataatgttgtacaggagaaagacatataagtaaataataatgaaagggattgccactttttaagtgcagactacgtgctaatggtttcacatatattatttcaccaaatctttaaaacaatcctagagtcatgtttatttttatcctcattttacaagcgaggaaacaaaatcatggacgatggaccatatgccatggtagaactaaagttcagacgcgagcacagagaagacccaggtttttgggaggccctctttaaaaaagaatgcactttgtactcatcagacggctactatgaaacaaaaagaaaaccaacc

SEQ ID NO: 265945 - DNA, 695 bp, Homo sapiens
gcacagccctggagagggtactgcgtggagtgggcccaagccccatccccacctcagcagggaaaagggaccttcttggctgtagaccctgggctcactcccatttcctgtcctgtcagctggattgagttgtcagggctaggagaagggcggagagtgaggcatcctggaaggccaccaaggaacaagtcccttctagccctttccttctgccagatgggccatggggcccagagcgtgggggtacaggagagggtcagctccttgcctcagggtgatcaaagagaatggatccaaactcagattcccaataaaagcagatgggagcaagggagaggctaggaaggacttccaggcctgttttaaatcatatgtcaaggtacatctgagggcatcattgccgggaggcttttggtggaggtggggttcgtgtcagggtgacacagtgaaaggtgtcttgggaaccaggataaggtaactgtgactggcgaggggatgggtagaggacaccagagtcaggatacagagctattctctgctctgatgtctctaatgctgaataccccctgcccttgcccaagagacatctccccatacccagccttcacccatgtcggggggcagtacacacacattcattgtccattttgcacttaaaagttcagaatcattgataatagcaacatatatttaat

SEQ ID NO: 265946 - DNA, 450 bp, Homo sapiens
ggagaaagtgtttgcaaaagattcatccagcaagggactaatatccagaatatgcaaggaagccaacagtaagaaaaacaaccccattaaaaagtgggcaaaggacatgaatagacgtttctcaaaagaagacatacaaatggccaaaaggtatgtgaaaaaatgtgcaacatcactaatcgtcaaggaaatgtaagtgaaaaccacagtgaggtgtcttaccccagtcagaatggctattgttaaaaagacaaaaaaatatactactggtgagagtgtgaagaaaaggcaactgttacagactgttggtgggaatgttacaataattaggacaggcactatgaaaaacagtttggaaatttctcagaaaaccgaaaacagaactaccatatgatccggcagttccactgctgggtatctatctaaaggaaaagaaatcagtatatcaaa

SEQ ID NO: 265947 - DNA, 454 bp, Homo sapiens
ccatgattgctccagtggtcctcaaactgctccagggaccagcagcatcagcaccacctggggactagttagaaaaggcaagttcttgggccccatcccaggcccactgaatgaagactcctgcaggtaagcacagcagtgtggttcggcaaacctgccctgcgactctgagaactactggccaacactgccctgccattttgaagacaatgaatgagcttcactgtcttgggctggggttcaaacaactcccaagagcagggagaagcaaaaacgctgtgggaaccatgcaaaagactactggctgctgctgctctgctctgcaaatgcagggtcgtacagctaggtgatgagttcagtgagcttttggaggcaagcctggaaaacgaacattcacatatgtatgctgtttctaggaaaaaatgtatttttgataataaaaacctttcaccac

SEQ ID NO: 265948 - DNA, 495 bp, Homo sapiens
ccatgattgctccagtggtcctcaaactgctccagggaccagcagcatcagcaccacctggggactagttagaaaaggcaagttcttgggccccatcccaggcccactgaatgaagactcctgcaggtaagcacagcagtgtggttcggcaaacctgccctgcgactctgagaactactggccaacactgccctgccattttgaagacaatgaatgagcttcactgtcttgggctggggttcaaacaactcccaagagcagggagaagcaaaaacgctgtgggaaccatgcaaaagactactggctgctgctgctctgctctgcaaatgcagggtcgtacagctaggtgatgagttcagtgagcttttggaggcaagcctggaaaacgaacattcacatatgtatgctgtttctaggaaaaaatgtatttttgataataaaaacctttcaccacacaacctatttctaacttcaggaatacaggttttgccttaa

SEQ ID NO: 265949 - DNA, 526 bp, Homo sapiens
cagtaagttactctaaccaaggaggaaagggctagacttaggactaggtacctaagttcatttatggagtcaggagggctgggagggtgtagcctctgccaaccctgcctctgcttcctgtagcttccactgctctttagtccaatttttggagctggagtaatgatatgatcaccaccccagccaattttctgatgtactggccagtcttcccataagacctggggtctctcagagggaatatttactaaataagggaaaactaaagtggcatactagtaaaggataggaggtacaaaagctactcccaaaccccaccataaattagtatcacctggggagtttcttttaaaatgtaacagatttctggtcttgacccagacctactgaaaatacttgcagagttgggactcattaggctggtaaacagcaccccagcattgtagatattagccccagtttagattagttggctagctcctttatattctctttttttccctcttggggagagaagtccagttca

SEQ ID NO: 265950 - DNA, 591 bp, Homo sapiens
ggattaacctaaatctaattcttcctgagtagcttctgaaactctttttaaaatctcaaagctttatttacttagggcttcctgtcctcagtgggaatgctattaggccacgcctttgcaattggcctgaggatgacactaatgtttactattaaggtgtactgtataaacatcctcttcctagcctggactctcgcattttatatttttaccagaagaaaggtgagttaaattttagaggcattgttttccaaccacctactaaagattctgttgagtatcagtcaggctttatccttagccagacagctactagaaagctgaccatcaaaagctaattacagtgttgaaggggatatggtctgaagcaaatattgccaaggtgaactttgtacaaatgttatttgaaggagtaaatggcactgataactgcttcacatattttagaagcagttataataaacttaattataataaactataaagttataactttagtgaagtgtgtaaatgaaaagtatgggggggaatctaatgagaaacctaatatcttaatgacaatcagagtatttcacccaaaattagaaagtt

SEQ ID NO: 265951 - DNA, 266 bp, Homo sapiens
ggtcagagtcaatcaaaaaacaagacccaacaatatattgtctacaaaaaacccactttaaatataaagacaaatcagttaaaaataaatggatggagaaaaatatatcatgttaccactaatcaaaagagcataaatagctatgctcatttcagacagagcacacttcaaagtaagaaaagttatcagggataaagaagggcaatgataaagaggccaattctccaggaagatacaataatctttaatgtatatgtaacagagtg

SEQ ID NO: 265952 - DNA, 131 bp, Homo sapiens
tttttttttaaacaacaacaacaacaacaacaacaacaaaaacttctccaagtcatggagacacacattgtaactcttcggaaactgacttgtaatgttctgaagccaataaaggcccgttgtcttgattc

SEQ ID NO: 265953 - DNA, 869 bp, Homo sapiens
tttgaataaaagagatgaggtcttgctatgttgaccaggctggtctcaaactcctgggctcaagcaagccatccgcctcagcctcccaaagtgcagaactacaggcatgagtcaccgtgcccagtcctgggtgactccattttaaaatgttcactatgataagggagaagggaaatgcctgcattgtagggctttgtgattttatctatatccttaattgaagccttgggtaaagtgttcactgagtatgttaaggatgaaaagtgtttaagtattatcagaactccacaggcaaaaagtgttcaaaatcatgtttttattaatttttgtccacatgcatccccaccctgctcacctggcatcacccagatttccctgcccctggcttgggttgggtgtgcccagaggaagatgggagtgcagaagccttcgctgaccaggttaacccttttgtgtgctgcagagaacttattaccatctttccacttaccagattgtatggtgattactcatcaatctctcccacaacattctcaaacagaggatgcagtcttggcccagagatttttttgaagtttaatttaaaaattggggtgggcaatagagtgagaccctgtctctacaaaaaatttaaaaaattagctggcctccagcttgagcccaggatgtcgaggctgcagtgagccatgatcacgccactgcactccagcctggcaacactgtgaaaccctgtctcttagagaaaaaaaaacagttgggtggttgggagtatacatttgtcaaaaccgtacacataaaatgtatgcactgtattactgcatgtaagttctaccacaataaagttgattttttaaaagtcatgatatata

SEQ ID NO: 265954 - DNA, 505 bp, Homo sapiens
caccgctcaggctcccttggtctagcgccctccagtgttgccggccagcactgctgcagaggccgcgggtcgctcggacgggaatggatggaaatgtggctgaggccactgttgacccggaagtgttttgcctttgtttgttaaccagctatgaaactaaacattctcacactgccagcaaaatgaccattttttcatttaatttgcagagaacagcattattagtggcaaacatcttgaagcaaacaaaatgtggtcaagttgagctaacatcacattattttcctgaagaatgctgtgtgaactcacggagtccgtctgcactaatcagtccagtgaacggcttccttccttctggcagagttccttctccagcacttcctccaaatcccacccagcattaatgacatctgtctataaacattagttttagtctcaaatattttttccctcaaaactcagaagcttagtgagaaaataaaaatcacaatgagcaacgtgtcca

SEQ ID NO: 265955 - DNA, 695 bp, Homo sapiens
tgattgttaattgctagcatgaaccgcgtgggcttctcagggtctagagtggagagaaatcggtaagaattggtggcacgcctgtcagaactccccagaccaagctaagcaaaaattaaccaatcagtagagcagccttcggagtaagggctaaaatgatgtcctcagggcctggttttgctttccttccatgtcagtttgcttctttgggtctggctgcattcccagacaggccatgctctcgtggtagcaaggtgacatgacacagggtcaggtccagcaggaaagaatgctgtcctgtgtccccgcttcctccagaagccacactcacccatcccacctggcttggtcctcatgtctatcccagaatccattaatggggccaggggactatgacacaccacttggcttagactgaggagctctgtgggcagccccacctgaagctctgggactaagcctgcgagagagatggattccccaagggaaatggggccattgcttgagtaaaaaggaaatagttgctgaagaggaaaaccacgtgcttactccacatagggcagactcctggaagaggggggcagggtagggaggtggatatgcaggttgccctggcagggtctggaaatgggggctgcaggcttggagggaggcctcagtgtggcttggaacgtggtgtatggtggtctgccgcg

SEQ ID NO: 265956 - DNA, 202 bp, Homo sapiens
tgattgttaattgctagcatgaaccgcgtgggcttctcagggtctagagtggagagaaatcggtaagaattggtggcacgcctgtcagaactccccagaccaagctaagcaaaaattaaccaatcagtagagcagccttcggagtaagggctaaaatgatgtacccagatccggggatacgatcctgctagagtcgccccgc

SEQ ID NO: 265957 - DNA, 2170 bp, Homo sapiens
gtccaccttgattctgcccgtagcaggtgaacctggtgtggtgcgcgcactgcgggtcctgattggctgtgcacgccacggtgaaaaacttgagcgtctactccgagtcctgcaagctcctagtgtctcctctgggtggacgcctaggcgcacggccgttacttctctttcacctgtggattcgtcagtttctcgttcgtttcaggaggcgatcccgcgccctgggtgcggtgaggccgctgggacagcggaggtgcctcccgacgcgaagcagcgagctgaggcggcggccagcggggaagatgagcggcagcagcgccaggtccagccacctgtctcagcccgtcgtgaagagcgtgcttgtgtaccgcaacggggaccccttctacgcggggcgccgcgtcgtcatccatgagaagaaggtgtccagcttcgaagtcttcctgaaggaggtgaccggcggcgttcaggcaccctttggggccgtcaggaacatctacaccccgcggactggccaccgaatccggaagctagaccagatccagagcgggggcaattacgtggctggaggccaggaagccttcaagaaactcaattacttggacataggagaaatcaagaaaagaccaatggaagttgttaatacagaggtaaaaccagtaatccatagcaggatcaacgtgtcagctcgctttagaaaaccgcttcaggagccgtgcactatcttcttgattgcaaatggagacctcataaacccagcttctcgcctccttatccccagaaaaaccttgaatcagtgggatcatgtactacaaatggtcacagaaaaaatcactctgaggagcggggctgttcacaggctttatactttagaaggaaaacttgttgagagtggagcagagttggagaatgggcagttttatgtggctgttggcagagataagtttaagaaactgccttacggtgagttactttttgacaagtcaacgatgagaaggccttttggtcagaaagcttcttcactacctcctattgtaggatccagaaagtctaaagggagtggaaatgatcgccactctaagtcaacagttggatccagtgacaactcatctcctcagcccctgaagaggaaagggaaaaaagaagacgtgaattcagaaaaactgacgaaattgaaacaaaatgtaaaattaaagaattcacaagaaaccattccaaatagtgatgaaggcattttcaaagctggagcagagaggtctgaaacacggggggcagcagaagtccaagaagatgaagatactcaggttgaggttccagtcgatcagaggccagcagaaatagtagacgaggaagaagatggagagaaggcaaacaaggatgcagaacagaaagaagacttttcaggaatgaatggtgaccttgaagaggaaggaggtagggaggctacagatgcccctgagcaagtcgaggagattctggatcacagtgagcagcaggcacgccctgctcgtgtaaatggaggcaccgatgaggagaatggtgaggagctgcagcaggttaataatgagcttcaactggtcctagacaaggaaagaaagtctcaaggagctggcagtggacaagatgaggctgatgtagaccctcaaagaccaccaaggccagaagtaaaaattaccagtccagaagaaaatgaaaacaaccaacaaaacaaggactatgctgccgtggcttagaagatttttaaaaagagagtatatggatcgcaagaaaaatgaagggttatcatacttgaaagataagcacatagttattgctgaatataatgtgacactatggtcgaatactacctacgaattataacattagaagcctagtggaaagaccagataactttaaatggctactaaaggataattacttacttttattgcatgtgttttaaaagtcatatagaaatattaaataagacggacagaggagaatttgcactggaagacaattgccacttgtaaaggatgaaaaataggatcactcttattgtacgctttattataagtttagaaggcagtttattctaaataatttttctctaggaaggcgtagaattttaaagaactggtaataggaaagcatgtactattttcttaaagcaataaactcttgaatgaac

SEQ ID NO: 265958 - DNA, 1936 bp, Homo sapiens
  misc_feature (1)..(2): n is a, c, g, or t
nngaccactgaatgttttctcaatgaaaatgtggaacaactgggggtggtgtggtggtcggaggagggggtgcacaaaaatactatcaactaaaaagggaatccaaatgtctattaaaaataagcatttgattgtaattccagcattcagccacacgatgtcacaattggattttgattttcactgtgtgtttgtctcaatagatgaaggcattttcaaagctggagcagagaggtctgaaacacggggggcagcagaagtccaagaagatgaagatactcaggttgaggttccagtcgatcagaggccagcagaaatagtagacgaggaagaagatggagagaaggcaaacaaggatgcagaacagaaagaagacttttcaggaatgaatggtgaccttgaagaggaaggaggtagggaggctacagatgcccctgagcaagtcgaggagattctggatcacagtgagcagcaggcacgccctgctcgtgtaaatggaggcaccgatgaggagaatggtgaggagctgcagcaggttaataatgagcttcaactggtcctagacaaggaaagaaagtctcaaggagctggcagtggacaagatgaggctgatgtagaccctcaaagaccaccaaggccagaagtaaaaattaccagtccagaagaaaatgaaaacaaccaacaaaacaaggactatgctgccgtggcttagaagatttttaaaaagagagtatatggatcgcaagaaaaatgaagggttatcatacttgaaagataagcacatagttattgctgaatataatgtgacactatggtcgaatactacctacgaattataacattagaagcctagtggaaagaccagataactttaaatggctactaaaggataattacttacttttattgcatgtgttttaaaagtcatatagaaatattaaataagacggacagaggagaatttgcactggaagacaattgccacttgtaaaggatgaaaaataggatcactcttattgtacgctttattataagtttagaaggcagtttattctaaataatttttctctaggaaggcgtagaattttaaagaactggtaataggaaagcatgtactattttcttaaagcaataaactcttgaatgaacagattgcgatttactttcagacataatttggagatggcagtagatcaaaatgtgtccatgacttgttaacatgcctttctttcttcctccttagccaaaatccacctttgaactacaaagacagagcaaggcgttcattttggtgggaggaagcattggttcagagtgttagtgactagtatcgccatgccgtcacttaaatgctttcaggcttgcatgcttgtggctccaatggcgcacactcaggaaggaattgtaaaggagcacccagttatattataaagcctggatgtatggtttgcagataatggaaatcctgtggattttcactgatccagtctatctttaccaatagtatctctctcttctcccttatgttattagagaacctgatattggctattccaaagattaaattattttcaaatagttttcaacaaaaataaaagtgtattaggaagaaaaaagtagactatatgaagagtttgtgactgctcaatttaacttgttttttgccttatttctattaagactgttttactatgtttttgccctagggatatcagcaaatatttatttttcctagcatgatatagttagaatttcaagcagatttctttgtaattagaaggcatctgatagaaattgtaaaactttagaagttattataatgaaaccaattcctgaatcacaacttcatggactgactaaattgatttatagttgccttgtgaggtatgtatggggaaaacataaaaacataattaaaacataatttcgtcctttt

SEQ ID NO: 265959 - DNA, 6847 bp, Homo sapiens
  misc_feature (3418)..(3418): n is a, c, g, or t
  misc_feature (3471)..(3471): n is a, c, g, or t
  misc_feature (6561)..(6561): n is a, c, g, or t
gtccaccttgattctgcccgtagcaggtgaacctggtgtggtgcgcgcactgcgggtcctgattggctgtgcacgccacggtgaaaaacttgagcgtctactccgagtcctgcaagctcctagtgtctcctctgggtggacgcctaggcgcacggccgttacttctctttcacctgtggattcgtcagtttctcgttcgtttcaggaggcgatcccgcgccctgggtgcggtgaggccgctgggacagcggaggtgcctcccgacgcgaagcagcgagctgaggcggcggccagcggggaagatgagcggcagcagcgccaggtccagccacctgtctcagcccgtcgtgaagagcgtgcttgtgtaccgcaacggggaccccttctacgcggggcgccgcgtcgtcatccatgagaagaaggtgtccagcttcgaagtcttcctgaaggaggtgaccggcggcgttcaggcaccctttggggccgtcaggaacatctacaccccgcggactggccaccgaatccggaagctagaccagatccagagcgggggcaattacgtggctggaggccaggaagccttcaagaaactcaattacttggacataggagaaatcaagaaaagaccaatggaagttgttaatacagaggtaaaaccagtaatccatagcaggatcaacgtgtcagctcgctttagaaaaccgcttcaggagccgtgcactatcttcttgattgcaaatggagacctcataaacccagcttctcgcctccttatccccagaaaaaccttgaatcagtgggatcatgtactacaaatggtcacagaaaaaatcactctgaggagcggggctgttcacaggctttatactttagaaggaaaacttgttgagagtggagcagagttggagaatgggcagttttatgtggctgttggcagagataagtttaagaaactgccttacggtgagttactttttgacaagtcaacgatgagaaggccttttggtcagaaagcttcttcactacctcctattgtaggatccagaaagtctaaagggagtggaaatgatcgccactctaagtcaacagttggatccagtgacaactcatctcctcagcccctgaagaggaaagggaaaaaagaagacgtgaattcagaaaaactgacgaaattgaaacaaaatgtaaaattaaagaattcacaagaaaccattccaaatagtgatgaaggcattttcaaagctggagcagagaggtctgaaacacggggggcagcagaagtccaagaagatgaagatactcaggttgaggttccagtcgatcagaggccagcagaaatagtagacgaggaagaagatggagagaaggcaaacaaggatgcagaacagaaagaagacttttcaggaatgaatggtgaccttgaagaggaaggaggtagggaggctacagatgcccctgagcaagtcgaggagattctggatcacagtgagcagcaggcacgccctgctcgtgtaaatggaggcaccgatgaggagaatggtgaggagctgcagcaggttaataatgagcttcaactggtcctagacaaggaaagaaagtctcaaggagctggcagtggacaagatgaggctgatgtagaccctcaaagaccaccaaggccagaagtaaaaattaccagtccagaagaaaatgaaaacaaccaacaaaacaaggactatgctgccgtggcttagaagatttttaaaaagagagtatatggatcgcaagaaaaatgaagggttatcatacttgaaagataagcacatagttattgctgaatataatgtgacactatggtcgaatactacctacgaattataacattagaagcctagtggaaagaccagataactttaaatggctactaaaggataattacttacttttattgcatgtgttttaaaagtcatatagaaatattaaataagacggacagaggagaatttgcactggaagacaattgccacttgtaaaggatgaaaaataggatcactcttattgtacgctttattataagtttagaaggcagtttattctaaataatttttctctaggaaggcgtagaattttaaagaactggtaataggaaagcatgtactattttcttaaagcaataaactcttgaatgaacagattgcgatttactttcagacataatttggagatggcagtagatcaaaatgtgtccatgacttgttaacatgcctttctttcttcctccttagccaaaatccacctttgaactacaaagacagagcaaggcgttcattttggtgggaggaagcattggttcagagtgttagtgactagtatcgccatgccgtcacttaaatgctttcaggcttgcatgcttgtggctccaatggcgcacactcaggaaggaattgtaaaggagcacccagttatattataaagcctggatgtatggtttgcagataatggaaatcctgtggattttcactgatccagtctatctttaccaatagtatctctctcttctcccttatgttattagagaacctgatattggctattccaaagattaaattattttcaaatagttttcaacaaaaataaaagtgtattaggaagaaaaaagtagactatatgaagagtttgtgactgctcaatttaacttgttttttgccttatttctattaagactgttttactatgtttttgccctagggatatcagcaaatatttatttttcctagcatgatatagttagaatttcaagcagatttctttgtaattagaaggcatctgatagaaattgtaaaactttagaagttattataatgaaaccaattcctgaatcacaacttcatggactgactaaattgatttatagttgccttgtgaggtatgtatggggaaaacataaaaacataattaaaacataatttcgtcctttttatgaattcttaagagatgttcttccataaatatagaaataatatatttttcttaaaggatatatttttaattatgtggaagttgtaagcttgaaattttaacttctagtgcttttctaaaattcacaattacaagtttaaaacattttttctcttccaggtttcatttggaataaagagttggcagttatataaagcacttaataatactatagaaaatagatgtgttttttcttaatatgattttggtattttccacagatcagaagtgtaaacagagagataatgtaacagtatttggaagagataatgacacaaggatatagtgatctgggagcatgaattagaaacagggtactatgtttctggtgtaaaatctaaattgtgctttctactagcgttactttttcaaatgggatgatataaagcactgtgggctataagcaacaatcttgggttgntaggcaaatagaccaattgatctttattattattattattattattattattnttttttgagatgaagtcttgctcttgtcgcccaggctgggtgcagtggcatgatcttggcttactgcaacctctgcctcctgggttcaagcacctgagcctcccgagtagctgggattacaggcatctgccaccacacctggctaatttttgtattttttgtagagacagatgtttcaccatgttggccaggctggtctcaaactcctgacctcaggtgatccgcccgcctttgcatcccaaaatgctgggattacaggtgtgagccacagcacccggtcccagttggtcttttaatattaaatttgtgcactattactgggtctggagttaatgatttcaaatagtttctaaaaataactgattaaatgtaagaaattataactaattatcaaggtgattctcttttgtttcttcaatggagagtttctctttctcttttcctcctctaataaaaatatttctttttttcctgtccttttattcattatattatgaaacttaggttttaggaaacaccttaagcgtcattttaatgaagcacaacattgatattttacatgaataataacgtttggtattttaaatatacttcaagggggtaataagccacaataactgtaccaaaaaaacttaaaaatggggacatattcatcccttgtgtgtgcatattttaccacttgttgacaagatacaattgtgacctactttgaggggatgaataacgacttatcactttaagacactttgcaaacatgttactaaaaaaaggtgcctagccaaggaaaaaaccattcacttggaattaaaattgtggatgtcacttcagagatgactttaacataaatgctgaaagttcattcacctcacaaatgtggcagttttctctgtggagaatggtggtctccgtggcagactggctctccaaattaaatgaaactcattgacagacctgggaccttttatgtgagtggacagacaagatcttggtttggcttcatgtactgttttctagagagagtgctacgaaaaacttatgatgcttttatgtgataaccaatataatgctttaatatgttaattctttgtgatgctatatacatagtttttatagttttatgaaaccactttgttaaacttatctggattttaagacacttgtaaacaaatggtttgttagtaaaattggggcattaagagttttacagagcaaataaagaagattttgacaaaagtcattttgaggctaagggtgttttacctgggttaacttctgttaaaatagctattgagtgcccattgacttataaaatacgatactatgaccataaaataactttttacttcttattcttctctatgaccttaggatgactttatttttttaagacatttttcctatatgtttttgggggaatgttaggttgccacactcataggaaaagtgtgatgctatcatgcctcctgttttattgtaaaggtgtgaattcttgctatgtggtgtgtgaagacagaactatcccatacatacgtggttcagagtgagatatctctaggctcacagttgtgaacccatattaatatggtattattcctgccaactcttccaatttatagctcataaactaacatcctaaacattgtcattgaatgacctaccttatacacaaaggataaagttcattcacctagaaaaaaatctgtgcatttaaattagtggccgcaagacaacaggaagctttctttcattttttgttcaacaaaccttgcaaaagcaaagtttaaaaagtagattaattcatcaacagaaagcatcacatggaaactgtggccaatctgaagagaaatatagcatgtagacatagatatgtatcaaatacttatacagatgcactcacacactttaaaacattaaaaaggcctcctgaggcacagcgttattaataaaacaaggctcttttgggtgaagttgagagaagcaatgagttaaaacgtgagaggaaatgctaagaaatgatatatattatggtgctttaaatcttgatttcctaagactttaagagatttaaaattcttctccaaataagaaaccagcatgtcaatgaaaaatgtattctagggaggtgttgaaacaaatccggtttttaaaatgtgatatatcacataaaccaaaacagaaaccaagacatatcttgttttcctgaagtaactacagagcatggttcttttccatcaaccttaagcacgatacatttcaggtgtagattcttttataccaatacagattctgttattactgtttgtgaccatgtgtgtgcatgtgtgatttacatagatgtgtcaggactctttttcataccagttagccggggtatcacaaatagaatgaaagactgacttattggtccattagtttatataatgttcaggttcagtgcggaagcattttggcattcttcaggaatgaaaccatttttaaaaggttagtctgttactctaagatgatgaacacatacagttctttgtcattaaatatcatttttgtaaataccacaagatttttcctctttaaaacatatcgggacatttagatgggactgatttttgttctccctacatgaaatttgtatatttcctcccatgaagtttgagtgacatgaatggggaatacaagagtgttcccttatgttgataaggaaaaagatactgttttttgaagaggcataacatcctgtaggagatggggagttaggacagtttttaaaaatgcctggattaccataaggcatttataaaatgaggaggtgtaaccagtggagctctgttgacttaacgccaacaacgacttcagctttactctaagaatgggaccagatgaattctctgtagtttcatcagcttgaacgatatagtttgtttcatttattgtcacgaatgcaatgacatatggaaagagggaatgattgtagtcattcttaggagaattttcgagaaagcctgttttgtcttttgcttcagtgttttttcttgtgccttaaatctttaatgggtacaatgataatgggtgattgttgatgtaagtaaagattanattgaaggccagcacggtggttcacacctgtaatcccagcacgttgggaggctgaggcgggtggatcacgaggtcaggagatcgagaccatcctggctaacatggtgaaaccccgtctctactacaaatacaaaaaattagccaggcgtggtggcgggtgcctgtagtcccagctactcaagaggctgaggcaggagaatggcgtgaagccaggaggcggagcttgctgtgagccgagatcgcgccactgcactccagcctgggcgacagagcgagactccgtctc

SEQ ID NO: 265960 - DNA, 3701 bp, Homo sapiens
  misc_feature (1)..(2): n is a, c, g, or t
  misc_feature (2397)..(2397): n is a, c, g, or t
  misc_feature (2450)..(2450): n is a, c, g, or t
nngaccactgaatgttttctcaatgaaaatgtggaacaactgggggtggtgtggtggtcggaggagggggtgcacaaaaatactatcaactaaaaagggaatccaaatgtctattaaaaataagcatttgattgtaattccagcattcagccacacgatgtcacaattggattttgattttcactgtgtgtttgtctcaatagatgaaggcattttcaaagctggagcagagaggtctgaaacacggggggcagcagaagtccaagaagatgaagatactcaggttgaggttccagtcgatcagaggccagcagaaatagtagacgaggaagaagatggagagaaggcaaacaaggatgcagaacagaaagaagacttttcaggaatgaatggtgaccttgaagaggaaggaggtagggaggctacagatgcccctgagcaagtcgaggagattctggatcacagtgagcagcaggcacgccctgctcgtgtaaatggaggcaccgatgaggagaatggtgaggagctgcagcaggttaataatgagcttcaactggtcctagacaaggaaagaaagtctcaaggagctggcagtggacaagatgaggctgatgtagaccctcaaagaccaccaaggccagaagtaaaaattaccagtccagaagaaaatgaaaacaaccaacaaaacaaggactatgctgccgtggcttagaagatttttaaaaagagagtatatggatcgcaagaaaaatgaagggttatcatacttgaaagataagcacatagttattgctgaatataatgtgacactatggtcgaatactacctacgaattataacattagaagcctagtggaaagaccagataactttaaatggctactaaaggataattacttacttttattgcatgtgttttaaaagtcatatagaaatattaaataagacggacagaggagaatttgcactggaagacaattgccacttgtaaaggatgaaaaataggatcactcttattgtacgctttattataagtttagaaggcagtttattctaaataatttttctctaggaaggcgtagaattttaaagaactggtaataggaaagcatgtactattttcttaaagcaataaactcttgaatgaacagattgcgatttactttcagacataatttggagatggcagtagatcaaaatgtgtccatgacttgttaacatgcctttctttcttcctccttagccaaaatccacctttgaactacaaagacagagcaaggcgttcattttggtgggaggaagcattggttcagagtgttagtgactagtatcgccatgccgtcacttaaatgctttcaggcttgcatgcttgtggctccaatggcgcacactcaggaaggaattgtaaaggagcacccagttatattataaagcctggatgtatggtttgcagataatggaaatcctgtggattttcactgatccagtctatctttaccaatagtatctctctcttctcccttatgttattagagaacctgatattggctattccaaagattaaattattttcaaatagttttcaacaaaaataaaagtgtattaggaagaaaaaagtagactatatgaagagtttgtgactgctcaatttaacttgttttttgccttatttctattaagactgttttactatgtttttgccctagggatatcagcaaatatttatttttcctagcatgatatagttagaatttcaagcagatttctttgtaattagaaggcatctgatagaaattgtaaaactttagaagttattataatgaaaccaattcctgaatcacaacttcatggactgactaaattgatttatagttgccttgtgaggtatgtatggggaaaacataaaaacataattaaaacataatttcgtcctttttatgaattcttaagagatgttcttccataaatatagaaataatatatttttcttaaaggatatatttttaattatgtggaagttgtaagcttgaaattttaacttctagtgcttttctaaaattcacaattacaagtttaaaacattttttctcttccaggtttcatttggaataaagagttggcagttatataaagcacttaataatactatagaaaatagatgtgttttttcttaatatgattttggtattttccacagatcagaagtgtaaacagagagataatgtaacagtatttggaagagataatgacacaaggatatagtgatctgggagcatgaattagaaacagggtactatgtttctggtgtaaaatctaaattgtgctttctactagcgttactttttcaaatgggatgatataaagcactgtgggctataagcaacaatcttgggttgntaggcaaatagaccaattgatctttattattattattattattattattattnttttttgagatgaagtcttgctcttgtcgcccaggctgggtgcagtggcatgatcttggcttactgcaacctctgcctcctgggttcaagcacctgagcctcccgagtagctgggattacaggcatctgccaccacacctggctaatttttgtattttttgtagagacagatgtttcaccatgttggccaggctggtctcaaactcctgacctcaggtgatccgcccgcctttgcatcccaaaatgctgggattacaggtgtgagccacagcacccggtcccagttggtcttttaatattaaatttgtgcactattactgggtctggagttaatgatttcaaatagtttctaaaaataactgattaaatgtaagaaattataactaattatcaaggtgattctcttttgtttcttcaatggagagtttctctttctcttttcctcctctaataaaaatatttctttttttcctgtccttttattcattatattatgaaacttaggttttaggaaacaccttaagcgtcattttaatgaagcacaacattgatattttacatgaataataacgtttggtattttaaatatacttcaagggggtaataagccacaataactgtaccaaaaaaacttaaaaatggggacatattcatcccttgtgtgtgcatattttaccacttgttgacaagatacaattgtgacctactttgaggggatgaataacgacttatcactttaagacactttgcaaacatgttactaaaaaaaggtgcctagccaaggaaaaaaccattcacttggaattaaaattgtggatgtcacttcagagatgactttaacataaatgctgaaagttcattcacctcacaaatgtggcagttttctctgtggagaatggtggtctccgtggcagactggctctccaaattaaatgaaactcattgacagacctgggaccttttatgtgagtggacagacaagatcttggtttggcttcatgtactgttttctagagagagtgctacgaaaaacttatgatgcttttatgtgataaccaatataatgctttaatatgttaattctttgtgatgctatatacatagtttttatagttttatgaaaccactttgttaaacttatctggattttaagacacttgtaaacaaatggtttgttagtaaaattggggcattaagagttttacagagcaaataaagaagattttgacaacgagaaacaaaacacaacac

SEQ ID NO: 265961 - DNA, 2116 bp, Homo sapiens
gtccaccttgattctgcccgtagcaggtgaacctggtgtggtgcgcgcactgcgggtcctgattggctgtgcacgccacggtgaaaaacttgagcgtctactccgagtcctgcaagctcctagtgtctcctctgggtggacgcctaggcgcacggccgttacttctctttcacctgtggattcgtcagtttctcgttcgtttcaggaggcgatcccgcgccctgggtgcggtgaggccgctgggacagcggaggtgcctcccgacgcgaagcagcgagctgaggcggcggccagcggggaagatgagcggcagcagcgccaggtccagccacctgtctcagcccgtcgtgaagagcgtgcttgtgtaccgcaacggggaccccttctacgcggggcgccgcgtcgtcatccatgagaagaaggtgtccagcttcgaagtcttcctgaaggaggtgaccggcggcgttcaggcaccctttggggccgtcaggaacatctacaccccgcggactggccaccgaatccggaagctagaccagatccagagcgggggcaattacgtggctggaggccaggaagccttcaagaaactcaattacttggacataggagaaatcaagaaaagaccaatggaagttgttaatacagaggtaaaaccagtaatccatagcaggatcaacgtgtcagctcgctttagaaaaccgcttcaggagccgtgcactatcttcttgattgcaaatggagacctcataaacccagcttctcgcctccttatccccagaaaaaccttgaatcagtgggatcatgtactacaaatggtcacagaaaaaatcactctgaggagcggggctgttcacaggctttatactttagaaggaaaacttgttgagagtggagcagagttggagaatgggcagttttatgtggctgttggcagagataagtttaagaaactgccttacggtgagttactttttgacaagtcaacgatgagaaggccttttggtcagaaagcttcttcactacctcctattgtaggatccagaaagtctaaagggagtggaaatgatcgccactctaagtcaacagttggatccagtgacaactcatctcctcagcccctgaagaggaaagggaaaaaagaagacgtgaattcagaaaaactgacgaaattgaaacaaaatgtaaaattaaagaattcacaagaaaccattccaaatagtgatgaaggcattttcaaagctggagcagagaggtctgaaacacggggggcagcagaagtccaagaagatgaagatactcaggttgaggttccagtcgatcagaggccagcagaaatagtagacgaggaagaagatggagagaaggcaaacaaggatgcagaacagaaagaagacttttcaggaatgaatggtgaccttgaagaggaaggaggtagggaggctacagatgcccctgagcaagtcgaggagattctggatcacagtgagcagcaggcacgccctgctcgtgtaaatggaggcaccgatgaggagaatggtgaggagctgcagcaggttaataatgagcttcaactggtcctagacaaggaaagaaagtctcaaggagctggcagtggacaagatgaggctgatgtagaccctcaaagaccaccaaggccagaagtaaaaattaccagtccagaagaaaatgaaaacaaccaacaaaacaaggactatgctgccgtggcttagaagatttttaaaaagagagtatatggatcgcaagaaaaatgaagggttatcatacttgaaagataagcacatagttattgctgaatataatgtgacactatggtcgaatactacctacgaattataacattagaagcctattgcatgtgttttaaaagtcatatagaaatattaaataagacggacagaggagaatttgcactggaagacaattgccacttgtaaaggatgaaaaataggatcactcttattgtacgctttattataagtttagaaggcagtttattctaaataatttttctctaggaaggcgtagaattttaaagaactggtaataggaaagcatgtactattttcttaaagcaataaactcttgaatgaac

SEQ ID NO: 265962 - DNA, 352 bp, Homo sapiens
agcagaagtccaagaagatgaagatactcaggttgaggttccagtcgatcaggtaatctccatgccttaaaaaatatgtgtaagacaattatagtgttttttttccaagttttgtgttatctcctacaaattgttcctatacctgtatgaattaaaccctctaaggtactatgtggctgatcaaccttaaaaacataacaaaacaccattctttctcctagtattcctgtgaagaatagccatttagaccaagtctttttaaataacagcaaatggtatttccttaataaagagcattgaagagcaagatgggatgggattaggtatgagataaagtgataaagtttgatat

SEQ ID NO: 265963 - DNA, 419 bp, Homo sapiens
ataaatgagaagatttttttctctttcccatgtaagtccagtacaggtgatccagacctgatatggcgctccacagggtgaggaatcctggcccctcaaatgtgttactctgctatgtattgcctccatttccaaggtcattattgattcaaaaatggttgcttcaaactcagtaattacattcacaatccagccagcaacaaggaagaaagagcaaaaacaaggcgtactccttatccttgacattgcacgtgccactttgcccacagctcagaagaacataaaagaagacctgaacaaaggagagatatagtatatttattgatagaatttcttagcattgtaaaattgtcacttgtctccaacataatctagtaaactcacattccaataaaataaaattaaggtcaattctaaaa

SEQ ID NO: 265964 - DNA, 481 bp, Homo sapiens
cacgaggccaatttgagcatttctatcgctacagaaagttctattggacagcgacagcacttgtgtagaccagttctcaactgaggccagttttgccctccagggaacatttggcatttttgattgtcacagctgtagctgcagtactactagcatctaatagttagaggccagggatgctcctaaacattccacgatgtgcaggtcagctccctacaggaaggaatgatgtgatccaagatccaaaacgtcagtagtggcaaggctgaaaaaccctggtctagatagaagctgttgccagccatggctggaatgtgaggtttgttctctctctctccctctctctctctctccttttgttataagagacgagcatgtataccaaaggtgctaaagaccaattataccaaattgaggttttctctatgacttcctaaggactgaaattgcaaagggaataattttcccactacatttttca

SEQ ID NO: 265965 - DNA, 659 bp, Homo sapiens
aagctttaaatatatatatttatatctcaagactgctctgagatactcttgtccccagtagttttactgccaacaaataccaataatgacaaacggtgattaaaagggcagatagatgtaaatgaaggcagaggaggaggatgaaatgaacatctgcttttttcagctctctgacagaaattcttaaaggaccaaaaataacactcttgtttcaacttatgttaggtgtaggaaaattttctttttttctctttccagtctgagtatgcttcattgatttgtatattgaatactaaattgttttagaaaaaaaaatcattggctgataagacacttaaatgagaaaagctagtctgtcacaggcatgtaggtgtgccatatctatttaaatagaggtttaaattattgatgagacttaatgaggaactggtgtatattgtaaccaaaattgtagattccactgtgaacaatctgtgcatggatcgattcacatatttgagtctaccatttcaggtacatgaatgtacaggagctactgggaatataaaaactggaaaataaacattatcatctattaccactccctcctccttggtccattttagtaaagaattcagtaaagtgataggtaggctatcttgaatgagaagaaaataaaa

SEQ ID NO: 265966 - DNA, 959 bp, Homo sapiens
gaacaacttcagggccaccatcctcttctgggcagcggcagcatgggctaaatcaggcaagccttcgggagagatggacgaagttggagttcaaaaatgcaagaatgccttgaaactacctgtcctggaagtcctacctggagggggctgggacaatctgcggaatgtggacatgggacgagttatggaattgacttactccaactgcaggacaacagaggatggacagtatatcatccctgatgaaatcttcaccattccccagaaacagagcaacctggagatgaactcagaaatcctggaatcctgggcaaattaccagagtagcacctcctactccatcaacacagaactctctcttttttccaaagtcaatggcaagttttccactgagttccagaggatgaagaccctccaagtgaaggaccaagctataactacccgagttcaggtaagaaacctcgtctacacagtcaaaatcaacccaactttagagctaagctcaggttttaggaaggaactccttgacatctctgaccgtctagagaacaaccagacgaggatggccacctacctggcagaactcctggtgctcaactatggcacccacgtcaccaccagtgtcgacgctggggctgctcttattcaggaggaccacctcagggcctccttcctccaagacagccagagcagtcgtagtgccgtgaccgcctctgctggacttgcctttcaaaacaccgtgaacttcaaatttgaggaaaactatacctcgcagaatgtcctcaccaagagctacctctcaaaccgaaccaactccagggtgcagagcattggaggggttcctttttacccaggcatcaccctccaggcctggcagcagggtatcaccaaccacctggtggccatcgaccgctctggcctgccgctgcatttcttcatcaaccccaacatgctacctg

SEQ ID NO: 265967 - DNA, 342 bp, Homo sapiens
aaagcagggaagaagagaatgggaagagaaatggcagggcagagagaaaggacagcagtggaatagccaccccctgtctcttaaaaaggtacactacccagaagatgcactcccagtgaggaaaccccagcagctggacactgtaagctgtggtgttgttggctgtgcttgaagcagttgttgggggcagggagtgtgtgagaagaggctgtcccttggtaccatagttatagaagaatgagaaagaggaaggaggaaggaagaggaaggaggaagaagaggaaggaggaaggaggaggaaggagaaggagaaggaagaaggagaagaagaaaagaaggaaa

SEQ ID NO: 265968 - DNA, 431 bp, Homo sapiens
accagagttgaaatccagatgactcttatttgctttttgattacgggccagttattttgcttcagcaagccttgatgtgttagtaaatgaaataattaaagcatatgaacaaaagctgcttttaaatacagactacatttttattttgtatgaatgttggcgcagatgaaattaccagcttttccatttaagcagactaaaggaaagaagtgatcttagaaaggtaatggatattttacacagttttgaaaaatccacattcatcaaatgtggattttaggaatctccaaaagattcacccatttgaagtatctgggccaagcacgatggctcacacctgtaatcccagtgttaggggaagccaagacaggaggatcgctttaggtcaggagttccaaaccagcaagacctctgtctctccaaaaaaaaaa

SEQ ID NO: 265969 - DNA, 288 bp, Homo sapiens
gctcctggtggtgatgtgtgtgtgtgaggcctcattctgctgccatcattttgcagccacagaggaagccaggccaaaaaggaaccagcacagagaagcccaggaaagcccaggaaagggcagagaaatagctcacagtgcacataaagctaccgcctgtgtcagtttttggctcacaaagcgcctctggttaagccagtttgagctggggtttctgtgcttgcatccacgtgcatgcatactcttcttgcctaaagcctgctcaactctgcagggcagcctctggct

SEQ ID NO: 265970 - DNA, 568 bp, Homo sapiens
cagaagaggcaagacacagtcaccaatgatatctcgccaaagaaaccacgcccacaccaatgccaacacaaaactgtgtttactgaaagccgaaaacagtattaaaaaaagtgtgtaagtaaagtgttatggtagggttcttcagatgtaatattttactggtactatttatttataaataggaattctaattaagtaataacatgaaatgaaacccagcataggagctggccaagagcttttaattttattgatactcaaaaccaagtttgtgtttttttgtttttttttgtttttttcctctttcgaatgtgctttgctttttttgattaaaaagaatttttttttccttttttataaacagaccctaataaagagaacagggtaagatgtgaggctgagtgtgtttaagtacgtgagagagtgtgagtgtgtttgtaagtgagtgtccctatgcgattatgtctctttacgttgctaaggggggagggtgaggattaagtactcgtgccttatatttgtgtgccaattaatgcctaataaataccatgtgcttaaacaagtaaaa

SEQ ID NO: 265971 - DNA, 646 bp, Homo sapiens
ctacttgggaggctgaggcaggagaatcacttgaatctgggaggcagaggttgcagtgagccaagatcgagatcacaccactgcactccaacctggcgacagagcaagactccgtctcaaaaaaaaaatctaactctttgggcataataatgattatatccatttctaatattaggccgttctcacattggtataaagaaatacatgagactgggtaatttataaagataagaggtttaattggctcacagttctgcaggctgtacaggaagcatagcaacttctgcttctggggagtcctcaggaaacttacagtcatggcggaagtggaagtaggaacatcttacatggcacaaactggagggagagagagataggggaggggctacaaactttttaaaacaatcatatctcatgagaactctaccacaagaacagcaccaaagagatagtgctaagctattcttgaaggatccaccttcatgatccagtcccttctcactaggcctcacttccaacactggggattacagttgaacataagatttgggtggggacacagatccaaaccatatcacttagtatgtacagatatgtaggagccttcacatacggtgtttcttcttccattcgtcacttgacttaa

SEQ ID NO: 265972 - DNA, 460 bp, Homo sapiens
gtgtaatttgcttagttaacggcataaaaggccagaatccatatgatcatctccatatatgataaatatcagaagcaatggattaggagaaataaagcttcaataaagttgaagaaaatgaatattgttttcatctgatatcagtaaccatatatatagtattatgggatgaaagggatacctttcacaattgcatcacaatctataaaaatgtaaaagtaaaattaacaaaaaacgtctatgagataaacgatagaaatttactgaagtatctggaaagtgatattgataaacagagatacatttcactcctggctaggagctcagtattataaattctcttcaaattaatgtaacattcctgtgcaatttcaatgaaattttaatagaatttctttttacaactttaaagtttgtttctaaagttcatacaggagaataagtaagcaaaaatatcaaa

SEQ ID NO: 265973 - DNA, 331 bp, Homo sapiens
tctctgccaacttaatatttgaacagagatttaaaggaaaaaatattacagaagtgggaatcctcaaaatactttctaaaactagctttgggctgggcaccatagctcatgcctataatcccagcactttgggaggccaaagaaggaggatcgcttgaggccaggagttggagaccagcctggggaacacagtgagactttatctccttaaaaaaattagctgggcatggtggtatgagcctgtagtcccagttacttgggaggctgaggcaggaggatcgcctgaggccagaagtttaccagcctggggaacatagtgagactctatatc

SEQ ID NO: 265974 - DNA, 523 bp, Homo sapiens
catgtccatcaacatactaacagtgatcatctttgatgaattatgggtaatatttcatcttttaaagtttatattttctgaagtttctacagtgaacatgtattgttttatactaagaaaaaagtaattattttaataacatccttcttttgtaattattgcctaaaatagtcattctgttacatataagtacctaggcagaaagtgttatttctacccccgccaagaacaccaaaaaaatgttgtttaaaaactcttatatccagaaacttgaagataatctatactgatccactaaataactgctatctgaaatcactattactttgttctccactgaactgctaagggtgtggtggtggttggaaaagtcaccattgggccttgtgactttctagtgaggtgctgggccccaaaccctctctccaacccaaagctactctacaacagtacagctgccatggaaagcctcttctcttgtcattgaacgactctttttttttcttttttgaaatggagtctc

SEQ ID NO: 265975 - DNA, 1019 bp, Homo sapiens
tggctactccatagacagagcagccccgaggactgctggttgcccatttttatggttatttcttaatgatatgctaaacatcgggtggattattcacgcctcccctttttagaccatatagggtaacttcctgacgttgccatggcatttgtaactgtcatggccctggtgagagtgtagcagcgaggacgaccagaggtcactctcatcgctatcttggttttggtgggttttgggcggcttctttattgcaagctgttttatcggcaaggtttttatgacctgtatcttgtaccgacctcctatctcatcctgtgactaagaatgccttaacttactgggaatgtagcccaaccggtcttagccttagtttagagagtccctattcaagatggaattgctctggttcaaacacacctgacactaccccccaggccgaggacggggtccccaggggcaggcgagcctccacagatccggggccattcatctctgcagcggccgcagccagccgccagggtgccctgctcccaggtgtagccaaaatggccctgagtctgtttccaccaggcccgggagcgagaagaggcgcaagacgctgattgggccaggcaccggcacacgcaagtagcggtatggaggaggcaagaatctggttgggcaagacaaggaactaaccgggcaggcgagacgctgattggatgaggcaggttgcttatttgccaaagcgtgactcttacccggcaacgtgtgtcgccgcttgatcgcagcggtgcggtgattgggtaggtcagttctggcgggccgcgcgcgcgggctttggggacgtgtcgtttccggcctccagcgtgaagccgactgtgggctctggaatagtcggcggttgtgtgtcctggtgctcgaagcttagccgggcgacgcttcgggagagaggcagaaccagcctcccagagctgtgggctcggctggatcgcgactccgccattaacccctccgccaacgtccccgcttgtcgtcct

SEQ ID NO: 265976 - DNA, 588 bp, Homo sapiens
cctgcctgggattccccacctcgccctgacaccccagctaggagacgagaaagaccttcagggaactggcctggccaagggcctctcaccggactctgttcatctttgcaatcatcacaacctccgggagagacagatgctgacgatttgtaacaacaactctcatttgtggagccagcccttttccagcccgtttagttcttgcaattaacgagatacgatatcattagaccccatttacagacaaggaaactgaggctcagggagactaactaccctggccaaggtcacatgcctagtaaaagtggcagagccacactggagcccaagtctggccaccccagagcctgagctcccttcccctccctggtcctggctctaacttgggtcctgtcccctgagagtcccatagtaatatccctcgaggctgggcaaccccagcctgcaccctgaagagtcacttcctccggatgtcccttcctccatggtccccatgatctctgggcagggtctttgctgtcctctcccttccttcacccagactcctgcttccaagttcatggccagagctgccctactgttctgccc

SEQ ID NO: 265977 - DNA, 514 bp, Homo sapiens
  misc_feature (46)..(46): n is a, c, g, or t
  misc_feature (70)..(70): n is a, c, g, or t
ccctgccgccgcccccccgcccgtacgtgcccccgccccccccccnggttatgggcaactgtctcctttntttttcagcatgaaaacagactaatacaaactcccttctaatgattggaataccacagatgtgatatgatgtcacttctgagattagcctatgaaaggactgtgtcttctatctcttggattgctcactctggagaagccagccatcatgctgaaggtccatgtgacaagggacagaggcctgacaaaatccatgtgagtgagcctgcaagagggtcctctgcaagataatccttcagatgacaccacagacgtagttgacaactggactgcaatctaataaaacaccttgagacagaggcactcagctaaacctaaccctgattcctgacacatggaagctgcaaaacatgaactacggagtccccatccaaggcactgaatgagaacatctggaacactcaataaatatttcatcaacaaataaatgagggctttaatttac

SEQ ID NO: 265978 - DNA, 378 bp, Homo sapiens
gtgcatgattccacataaatttagggaattagagatcagacaaagttataagacagctgttgacgtcccactcaccagttaggaggattgagaagaagctgctttccaggaaatcccagtcgacttccagatagatctctttggtcaaaaatgtgtcacagctccaactctttttttgtaagatggtgaacacaggcaggggccacatctgacttacctctagctccaggtactaaagagccactggggagagctcagtcatgtaatccaatactatctaaacatgaactacggagtccccatccaaggcactgaatgagaacatctggaacactcaataaatatttcatcaacaaataaatgagggctttaatttac

SEQ ID NO: 265979 - DNA, 194 bp, Homo sapiens
ttccttaaaaacatatacaaaacatggtcacttctcactgctaacaccctgatctaagccacaaccacctctcacctggattactgcaatagcatcttaactggtctccccacttctacctctaccctactatagccaacctcaacacagtagccagagtaatccctttatttaaaaagtcagattatgtcact

SEQ ID NO: 265980 - DNA, 365 bp, Homo sapiens
cactgaaagctgtctgatagaactgtgtactgtcccaaatattgtcagtactggtgcctctagctcagtggttgccaaaatacaatgtgattagaatcacctatagggcttgttaaaacacagaatgttcagctccatgctcagcatttctggttcattaagtcttgaattggatgctgagaagattcatttcaaacgagttttcaagtggtgctcataatgatggtttgggagccacgcgttgagaaccaccatctagaataaattataaattgacattctatatcagcaatagaacaggaattacatgttttgatttcatacaaaactgtagtcgtttaaataaattgtaatgtcatggaagt

SEQ ID NO: 265981 - DNA, 474 bp, Homo sapiens
agtcatatcacagggtaacaaagccctcagttcctagaatgtaaccaaattattgaggccattttcagaatcacttcttctcctgctcttcctgttcggacttccttcccagcccaccagcaacacacaaggagtggaagagaaaacaaactgagaaggacgttttctctttgctgccaaacttttggaccatgtttcataggtgggaagggaagagaacatgctgagaggcaagatctgcatcaatgaaaggacgcttcggtggatgctcagacaacccagtcttaccttccagctgccttacacccagtgaaacaagaggccaccctgtccccagccgcacctgcactccctgggcagactggagccttggagtcatgctgtgatgtgtgtgtgtgggtgtgcgtgcatgtgtactttgggcggtttcctttttttcttttctaccttttaaatggaaatactgcattaaaa

SEQ ID NO: 265982 - DNA, 427 bp, Homo sapiens
gagagcccccagatcctgccttctattgctccggggctcagatggccctttcaagcccgaggcggggtccgggccctcttgctttatgagattctggtcctgctgtgctggggacagatctggagcagactcccccaggccccgcaccaacccggccactgctgagggcctgccctggcccactcttctcactgccctacaccagagcctcctcgccctcccatccttgctgccctgtccctgctccaggtttgacacctggtcctcaccacatctccctgacctccagggatggccaggaccctccacttctccagaccccctcccgccttcctctgccgcggaggccccctcctcattcttgccgcctcctggggcatttttccttccccgatgggattacagatcctgaggaggattacaggag

SEQ ID NO: 265983 - DNA, 672 bp, Homo sapiens
cacagctgatagcttagatatgttaacttagatacattaagataacttagatacaataacgaagacacattactggaacttagaacagtgttcttctacctgcgtccctacctcactccttctggttgcagagcaaaaaaacaaaaacaaaaaaaagcaaaacccaacaatctttgagacaatgcaataattaaacagggaatatacagttgaatgtaggtttataaagatagaaggaatgttaaaattctcagcaaatttaacaattcagttccagagaacttgccatgacctatgatacatgaatacaagaattaaaaatggtgtcaccaagagctttggctctatatgaaaaatattgaagcaaaaaaaaaaaaaggagatctaaaatctggaagcttctcccatccagcctgcagcttggggttgtctttgtgccgacagctgcccagtaagtcagaagatacctgaaggcttggatctccctgttgccatgttgtttactcaggaaaagccccagccaagagtcacatcttttaagaactgtgaaaaaaagcaagtaatctgtcttacctatttaatggtgagaaacactgaaaagattgataggaatgcccctcttctgctgaatccaactctgcaaactggttggagagctgaaagggaagtgtg

SEQ ID NO: 265984 - DNA, 405 bp, Homo sapiens
gagcactcacagttatagatccctgacactttgcaggccagaagaagctgaatttttagttatttgatcctttccccagttagggttccagcttcctcctcctttccctttttcagatactaagaacccaccatgagcaccacactgacaggccggcatagacaagtaaaactctgccctcaaggatctaggcccagtgaggaagccgagacctttctaaatagttgtaacatatagaaaatgagaacagctgaaggaagtgcaggaggaacgccacatgagggcatttgcgggtgagggagggtccaaggaactttgtggagcaggtgtcatctgagcagaaccttaaaagataaatggtatttaagcatgtatcaatttgccaaataaaattgttaacacaaa

SEQ ID NO: 265985 - DNA, 424 bp, Homo sapiens
aacgacatctgcatattcagggactgggtatttattttagtctttgcagtctggcttagtttgtgcttgtcctttttgggaggcccttccaggaatttaagcaaactggcttttgtgttccctgaggctgtgatcactgcagctgttgaacactagagaataatctacatccaggcttgctgcaggtcttacaagggcttcaaggttgacatggctttctggcccacatggacctgggaaggggtcaagttgcgtactaaggctgtgggaatgcttgccagggacccaggtccagaaggctgtcctggtggcccagatgggcatgtttcccagcaaatcttttgacaggtgagatgagtctctagttgcaatgagaggggctggagttgagactggccctcttgggatatattgtggaatggag

SEQ ID NO: 265986 - DNA, 401 bp, Homo sapiens
aggtttttaccgaaacacacagtggaaaatagagaatatactttacgccatgacttagtgtacacatacatgtatttcacacaactgacataggttacagggaataactttcacccttcgtaaaagcggtgcacttggatttttcttttcagttttatttcattaaataaaaaagtggccgggcacggtggctcacgcctgtaatcctagcactttcggaggctgaggcgggcaaatcacgaggtcaggagttcaagaccagcctgaccaacatggtgaaaccccatctctactaaaaacacaaaaaattagctgggcatggtggcgggtgcctgtaatcccagctacttgggaggctgaggcagaagaatcacttaaacccgagaggtggaagttgcaga

SEQ ID NO: 265987 - DNA, 851 bp, Homo sapiens
ccagaggcaacactgatgaccaaacatttattttgtctcatgtcactgccagggtggtgtggttacctgccccatgctcattttgttctttggtgggatccctgtggccaagggacttggaaccaaaagacttaaaactaattaaacattggaggccagatgaagatggaggttcacaggcacgcattaacccttaaaaaccttttgagcaacataaccaaaaagcagtgttacaaaagtgacttgtctatgagttctgtgtgttgagccatgagctgtttggtaatctgtatgcccatctttaatttggagggtctgaactaattttatctgttgaaactggcccttacaatctcatgtgcccaccccttctgtgatagtccatgggcctactgggagggtgcttgatactgtattgctttagcagtagtgccttggcaatggaaagcagattggcctagggggattgaatagttttcaaattctagagatactaggtagagagaaaggtaatcttcaatgttttacccaatttctgtaagctgtaaatagtttaaaagaaaaaaggttttattgactctgaaaagcaaaacatgaagaattagcaatgtttatttgattttgaggacatttgtcaaagatgttcaaaggctcaaagcttttaatcaaaatggaattacaggtcattgtaatagttattcattaaaccaagagtaataatcaaaagactttaaatgcaatatggaaagtcacatggatgtaaaaaccttaacccttttaaagcttagttttcctaagtaataaaaaatctaataaagaaaacatgggaattatcttgataaaatgtaaaa

SEQ ID NO: 265988 - DNA, 521 bp, Homo sapiens
ctggaggcgtttttggttgtcacaattctgtgtatgtgtgtgggtgggcggggggcaggggattatgttggcatctagtgagtagataacagagatgctgctaaacctacaatgctcagatggcccctaacaaagaagtatgttgtccaaaatgtcaatggtgcagagggtgagaagccctggtctatacagagctcagcagtccagagcaattgcaacctctgggagttgccaagagctcctctgcccagcaacaggcttggcctctctcctgtggctgccacaagagttaaagccactgtctggaatgccctttggcagtggccaagtgtcccctgcagaactgactgcgggacatgcggtgcatcagccggagctgatgtgttttgtaatttatagtcacagggcgcctgtcttcatttagcagtaggcctgctggcagcttccctgccagggaggaagcaagttccacagaggcccacagcccccgccagctgccggcccgtggtatttggggacgg

SEQ ID NO: 265989 - DNA, 469 bp, Homo sapiens
ctgtggttgtgaccagttggagagacattaggagatgagatactatgttcactcctcacagctgtaccagggacctgagatattccgtcactattctatgagattttggagatcccaccagtggttttccggtgccagggtatgagaagatagtctccatgtccaaactcacaatttcagaacaaatttcatcaagataaaggcctgggctggtgaatggttcctgctttcactattccagatgtccagctctgtaccttgctgctctccttaaagcctgcctccctctagatggtctggcttgatgatatccaacctgacgtggcctgaagagacagacagtggctcttgctagctaattattgtcagatggatcggcagccgaccaacgcttctgaaactattgtttttggcaaatgttcctcaacattttcctggtatataaataatgatcccttgcagaaagtca

SEQ ID NO: 265990 - DNA, 361 bp, Homo sapiens
tgccactgcactccagcctggcaacagagtgagactccatctcaaaacaaaacaaaacaaaaacaacaacaaaaaactcagctctaccacttgctagctgtgtgatcctaaccaagtcagcctacttcttggagcttcattttcctcatatgtcaaatggagaaaaagatcttaatctcataaagttgatgtgaagattaaattacataacaaaaatatagttccaggaacatcaataaacattagttatcctcctctataaaaatgtttctctagggagcaaaggagttacagagcagaggtagacaagcatttcttagctggtaaagggtaaagtcagaaacataaaccaggtatgatg

SEQ ID NO: 265991 - DNA, 322 bp, Homo sapiens
gtttttttttaaattacattcagtgtttaaacctggacagaaaactgctgaagtctacaaactttggcattcaagagtagaaaacagccacaaaaatactgaaaatattaagcaatagttgatactacatccttagaatgggaaatttaactatttaaaatataattatgttgttcacttcaggattttcagaaaaacattgttccctctctctcttcccttcagtagttaagttgggaaagttagcaagccaattttatgccttctttcctagaacagacaacacatcaccaaactgctacaagttgggctcaaaataaaa

SEQ ID NO: 265992 - DNA, 401 bp, Homo sapiens
ccaagttgtagaaaggaatccagctacccttatcagggagagatgtggagaaggaacaaaaggcccctcccagaaggcactgcctaacccataccctctgctttgccctctcgaataaaaaaagacgtcacccctgaatgccaagatgcacggcactccagacatctgcagtacttaacagggcattaaacagctcgcactgcagaaacagacgctgcacgtggttctgaggctctgaatatggacggaacgtagaaaatctgtttctaaacctcttccagtgagttcttcttggttgactaaggctgcaatttctgttttcagacacaaaatactcttgccccctcatttccttcttttcttctaaaccaggaaagaatacaaccttgctgtttcccaag

SEQ ID NO: 265993 - DNA, 492 bp, Homo sapiens
cgcaggcatagcgctaggccccggcgccttcacaacaaagggacgctggcgggcggggcctgagaggcgcgcggtggaggggccgggcgcgaggccgcggagacagctcggagctcggcactggggagtggcacagcgctggcggatccaggtgggcttcacggggcgcccgcgggaccggaaatgacgcgcagaaccctgcatcgggctcctcgctgccccgcgggcgccgctcctcagtgccccagagccacggagccggggaaacgcgccgcggcccacaacgcccccgcggctgcccgttggttccgcccgggccgttctactccaggcagacgggaggagaaacacggcgcgctcagcgtcccctcccccgttggttctgctcgggcccttccactgcaggccgacgggggtggaaacacgcagtttttttttttttttttaaggtctagggtaacacggggcttttaagtgcctctccgctgccgc

SEQ ID NO: 265994 - DNA, 450 bp, Homo sapiens
actaaatggtcctaggttggaggaagaaaacttactgtaaaggacagtattggggaaaactggcaaatttggaatatgtactgactgttagatgatactcttatatcaatgttaagtgtcctaagtctgataatacattatggaaatgaagagaatgaccttgttcttaagcggggtgaatgatcatggtctttacaacttattctcaaatgattcacaaaagagagataaagcaaaagtggccagttttaaagggcatatgggtgtttattgaattattcctgcaacttttctataggtttgaaattttttcaaaataaaacttttttgcccaggcatggtggctcacggctataatttcagtgctttgggaggctgaggtggaagtatcgcttgaggccaggaattggagaccagcctgggcaacatagagagatcccatctctacaa

SEQ ID NO: 265995 - DNA, 587 bp, Homo sapiens
aggatgttcttgctcaaaacttaagtggtggacagaaaagaaagctaacctttgggattgccattttaggagatcctcagattttcctgttggatgaaccaactgctggattggatcccttttcaagacaccaagtatggaaccttctgaaagaacgcaaaacagaccgcgtgatcctcttcagtacccagttcatggatgaggccgacatcctggcggacaggaaagtatttctctcccaagggaagctaaagtgcgcgggctcttctttgtttctaaagaagaaatgggggattggatatcacttaagcttgcagttaaatgaaatatgtgttgaggaaaacataacatcacttgttaaacagcacatccctgatgccaaattatcagccaaaagcgaaggaaaacttatttatacattacccttagaaagaacaaataaatttccagaactttacaaggatcttgatagctatcctgacctaggaattgagaattatggtgtttccatgacaactttgaatgaagtattcctgaagctagaaggaaaatctacaattaatgaatcgggtaaataaaatgcatga

SEQ ID NO: 265996 - DNA, 618 bp, Homo sapiens
aggatgttcttgctcaaaacttaagtggtggacagaaaagaaagctaacctttgggattgccattttaggagatcctcagattttcctgttggatgaaccaactgctggattggatcccttttcaagacaccaagtatggaaccttctgaaagaacgcaaaacagaccgcgtgatcctcttcagtacccagttcatggatgaggccgacatcctggcggacaggaaagtatttctctcccaagggaagctaaagtgcgcgggctcttctttgtttctaaagaagaaatgggggattggatatcacttaaggtaaggtcacttaagaaggctgggagtagatctagtgtaaggcttgattggttttgtttttgagacggagtctcgatcatctcggctcactgcaagctccgcctcctgggttcactccattctcctgcctcagcctcccgagtagctgggactacatgggcccgccaccacgcccagctaagtttttttgtgtttttggtagagtcggggtttcaccgtgttggccaggatggtctcgatctcctgacctcgtgatccgcccgcctcggcctcccaaagtgctgggattataggcgtgagccaccgcg

SEQ ID NO: 265997 - DNA, 490 bp, Homo sapiens
ggaagattcctgtattagttatctactgttatgtaacaaattactctaaaactagcagcttaaaaaacaacaaatatttattgtctcaatgtttttgaaagtcaaaaatatggaagaagtttagctggcaagttctggatcagggtctttcataaggttagatttgagatgtcatctggggctgcagtcatctgaaggctggactggggctgaaaaatctacctcctgcatagctcaaccccatggctgttggcaggaggccacaggtcctcactgactattggcactaatcataaaaaagttggagtggctatattaatgttaggctaaatatattataagataaaaagtatattttgagatgaagaagaatatttcataataaaaaaaatgccatttgccagtaagatataacaattataaatgtgtacatgcctcataacaaattcaaaatacataaagcaaacgtgaaagaactaaagggagaaat

SEQ ID NO: 265998 - DNA, 257 bp, Homo sapiens
atgttccattgtaattctctgcctgtaatctcccgctccaagtgcccttgggtctacagttctccggcagttttcatgtgccatggcacctgccactgctttcagtggggtccaacctgctatccaactatgccaccgttcccatctaagctgagtcagatgagataaaaatcagttcctcaggcagcctccagacaagacagaacagtgcaaacaagtcccagtcttttccctctgaaaggggaattgtgtgactt

SEQ ID NO: 265999 - DNA, 1060 bp, Homo sapiens
attttaagcccaatgctaagatctgattcatcaagtacttaggacatgggcatcaaaggaaacacaaagtatctggtagaacaaatggcatccagtgtaggagcaaaacaaggaattagaaactaaacaggtgccagcatcacttcaaatattacttaggtagaacatggcatttgaaaaaggtcagaagcttgatctggggaaggaagaaataaaagtgaagcaacatacagaaccctgagaaacattcagcagttgagacgagcagcctttccatttgtcttagattacttatcttgcccagaatagacaaggagactaatgaagtcacagagtgtggaagctgccccattgtctggggctttatgaagtcatcagtcaaaagtataaaaagaagagtgatgccagaagtttggatgagatctctgaatatcctaagccaagtgcaggccataggagaaagcagtgaaaaagaaacactgtgacaagcaaggaagaaacttcagaccaagttgacaggcagcccttcagtttactgactgccgcttcttacctgccaacgccaagcacaaagctgcctgcagagccagcctctatctgtggtccttgtgccaattatcactgccccactcatgccgcaggatataaagcagagtgacagggtcacaggactgccagaggaatacagcttctagaggctacccacattcctgggctaatggccccttcctacatcttcaaagccagcagtggtgggctgagtctttctcctggtatcatctcttcattctctatctccctctcccaattttaaggacctctgtgattatattgggcacctggatattgcaggatacgctctctattttaaggctatgctccgtaaagagagtgcctcctctagaatcacaagacctaagcatgaatcttcctttgaaggataaaatggaaggaaaaaaactggatgaggaaaagaagagtggggaatagaaagagagagagagagaaagatggataaatttttaaagttactataataaaaatcttctacaacgaaaaa

SEQ ID NO: 266000 - DNA, 1124 bp, Homo sapiens
attttaagcccaatgctaagatctgattcatcaagtacttaggacatgggcatcaaaggaaacacaaagtatctggtagaacaaatggcatccagtgtaggagcaaaacaaggaattagaaactaaacaggtgccagcatcacttcaaatattacttaggtagaacatggcatttgaaaaaggtcagaagcttgatctggggaaggaagaaataaaagtgaagcaacatacagaaccctgagaaacattcagcagttgagacgagcagcctttccatttgtcttagattacttatcttgcccagaatagacaaggagactaatgaagtcacagagtgtggaagctgccccattgtctggggctttatgaagtcatcagtcaaaagtataaaaagaagagtgatgccagaagtttggatgagatctctgaatatcctaagccaagtgcaggccataggagaaagcagtgaaaaagaaacactgtgacaagcaaggaagaaacttcagaccaagttgacaggcagcccttcagtttactgactgccgcttcttacctgccaacgccaagcacaaagctgcctgcagagccagcctctatctgtggtccttgtgccaattatcactgccccactcatgccgcaggatataaagcagagtgacagggtcacaggactgccagaggaatacaggtaggggcctgcagagtatgcggattactgccaagtgatcaactatacaaaggaagtcccatgttacgacactaactcatatttttctactattagcattagtccctggtatataaaatttccatatattggctgaactgaagtgggatccctgtaggtaactctggttatatttaacaaaaataagatgtagaacctgtttgaggggcaaatgaaggaaaacatcctcgtgggaagtccaactggactaagaaccctggactctagcactgttttcaccttgcccttgggggttcttggtattatcactaccgtgactctactgcctgttggagaggggtggtcctcttccactttgtcactctgatccaagcatgaaagatttcttcctctattctccatagaacaaaataaaatttacttatgtccaacttag

SEQ ID NO: 266001 - DNA, 448 bp, Homo sapiens
cataaaggaacccaacacattgaacatgatgaacattagagaaaatacagctgaattgtctcatggattcatgaccttcccagccctgagtattgtgaaaagtcttcattttcctgttgtccttttatcccctccttagcctctacctccttgggcagggaaaaataagaaatgttacagagaacagaataagcaatgataggatataagacaaggcctgggattcatgcattggcctaagtgtctacattttccaagtgagaggactaagtcatcaatgagttgggtctcttttcttcccctttcctggataatgatgtgtttttgtctgggaagaaatttttcttttcttttttggctgagactcctaaaaaccaaaaggcaataggaatctgtgtgacaggagccaaagagttatgagtaccaggaccctagactgcactgtggc

SEQ ID NO: 266002 - DNA, 253 bp, Homo sapiens
gtgttcatgaaaacttgaaggttgtgtggagcagaaggaagagggggtctgatatgcatgttctccatggcactccttatctaggatttctctagggcaaatgctcattttacctcccacatccccagtggtaactcagcctttaatacttcatggcaagataggattgatgttggaatccagctaaattggatacaaatggtacaatgcagcttggttatgaatgaataaaggactgcaacaggaagcaaaa

SEQ ID NO: 266003 - DNA, 422 bp, Homo sapiens
gatcaaacctagtgtcacttatgggacggcctgatgtttctgtgcttcctaagatgataccaagaacacagcagtatctcaccaagaaattgttgactggaatctaaccaagcatctagacctccagctgacaggaaatggagagggggtagaggcacaagttaacatttagaaacaatcaggtgagcagaatatctgtgatattccgtaactgccagggctcttcagtaagtgtcatttcaaaaaaggaaggagtaggcattctggggttaaaagacatttaagagacaacccaatacaatgtatgaataattttttttgcatcctagttcaacaaaaatgactataacaattcttgtaacaattggaaatttgaaaatgaaacgaatataggtaatatagaattgttttcttcagtacga

SEQ ID NO: 266004 - DNA, 302 bp, Homo sapiens
cataatgtcagtgacgtggcagacacaggaaggctgcagcacacctaactttgttggtcacttttgtctatctgctactctcaaggctccatttgtctctgttgtgtaactctgagcaagctagtcttctttctaagaaagtggaagctgatcagcagaaggtggccatggacaaaatgggaagcaggaccgctggagaaataggcccagttgcttatttcaggaaatcctctagtcttgttcactcgaaattgtgcaaggacaaagctgggtccattgaaacagaaagcataagaaaacaa

SEQ ID NO: 266005 - DNA, 469 bp, Homo sapiens
ctggagtccttagtagtctagtcaacattctagaattctctagccagtgacaagttcctatatcagctgactccaaagcagatatctcttaagggggctgagctgcctgctactcccgatagacaagacctttttattttacaaaataccttgatgttccttgatgaaaagaaaaagaactttggaaatgcaaaatcacctctgtctgtcacgtagctgacacgaggtgcggctcctggggaggggcccactggggagcgggacatgcgttgcaaagacacacttgtcagaaacaaaccaggaaacaaaattcagggaaatacagggggcggggcctgagcattgcttccaggagcctcgttgtcttgttcacagcattccatcgttttaaaaatagctattcttcatttgatgataactttatcttcttgaagctcaaaataaaattaaccttttctggagggaagaa

SEQ ID NO: 266006 - DNA, 585 bp, Homo sapiens
tggagggaactgttaagttttgttgaagtgacggagacaaaaacctaaatggagtgggagagaaattggagacagaaagaacccttcagaggtctgttgtaaaaggatgcaaagaaacagggaactagaagggattgtggggtccaaaggagaaataccagcacgtttgtatgttgtcaataatgtttcagtagaaaggtaaaaattgagacaagagagaagaaagtgtagctggctagtccaacatcctagaatagccaagaagggatgggacatagtgcaaaactaggctgcccaaagcagagttctcacagtggcttgcaaaattcagcaggcatcagagtcacctggagggcttgctgaagcacagatggttggaccccatctccagagtttctgacacaaaaggtctgcagtggaactccaagaatttgcgtttctagcaagttcccggatgattctattgctgctggtccagaaacctcattttgagaaccactgctctgtatcaaaaggagggaagacagaaaagatgagtatatacattagtacaaatgctgaacacctgggttatcaaaaaaaaaa

SEQ ID NO: 266007 - DNA, 420 bp, Homo sapiens
aagtcttccccacagggcacaactattatgaggttcgcctcctccccccggttaaacattaagcactaagatttccccaagcagcttgacagaacatcgttttccttgagcatcttccctgtgactaccttgcacaacggcatgtggcagaagtgatgtccagggtctcccgaggctgggtcggaggcatccttacagctcccatctgggtctaccggaatcgtcttggaggtttgcgccgccatggaagaaggctgactacgcaggctgccgtgtcgtgaggaagcccgaggctttgtggagagaaatgcatggaaacggtttcagtccccagcggagaccctaggcatcagggagcagaacatcaaaactgcggacttgggatacaaatgaatgatcactgttgttgcaaagccaaaa

SEQ ID NO: 266008 - DNA, 537 bp, Homo sapiens
agtttttcatttatgcttgaaaaatacagcaatttggaaagtgagggaggggaagtcacccataatcttattaccattatataattattagtattaaagacagatgacgttaattaagcatctactatattcttttaataatcctgtgatgtatatattcccactttacatgtgaggaaacacatccacttaataatggagtagccaagtttgaacctaggtatatcttgagaaggtctagagaggagacctttctgttctaccttcctgttcttcttacatatatatccttttacctagttgttacacaatttgtaagtttcatctcctagttttaaaacttagcattataaaaacatttttctccccccccttatttcaagtggtgtcgtattgctctcattgtctattcataccaccatataaaggctctttgtcttggctgctggacattggtacaatgatgttgaccaaaatggatgctgccctttactgagtgactaagatgaaaaaaatcaggcttaatcagaactaata

SEQ ID NO: 266009 - DNA, 467 bp, Homo sapiens
gctatgattttctccactattcccatggcattttcttcctcctacccattcatcattcagagaagagttactgagcacctattattactggaaactgtcctggccataggcagatggaaatgactaagagatggcccctttctgtgggggaatccaggttcgtaaatggagagatgagtccacagctggctcttccacggccttactatgtgatttgcacattttcaatcagcaaacatctctattctttctatttgccagtaatatttcagaatgccttcaattaatgaagacacatttgtggaattggatgtaaatcactcgaaagtatataattaatggcaagctgcctcggtgatggttcctagaagagagcggcttcccagctgaccactggtggcagttggcctcttgaagctagtatgtgaattaatttgtgtcaataaatttatcgacatgaaatggta

SEQ ID NO: 266010 - DNA, 472 bp, Homo sapiens
gagattctgaatgtcaaggactgtaatttttgttttcctttcattgaaaagtacaacaatataaaatgcacatctgcttttctatatgtattgccatatttcaaaattcagatttaaagtcaataaggtgatggcactttaatataaaggaaataaaatgttgttgttcctattaatggtcctcactggagaagttctatagttctccttggatgatttaaggaagttagactgagaataccacaaaagagcagaaacatgtttccttaaaaggtatagtcttagactggttgcgttcttcatcatggtacaaataaaagataatttctacctatactttagtcattctacaattaacttttggcaatgaaatcccagttatatttacttttttaaaatgtcatttttttgcaatatgactgttcatgaaggaaaaaaatgtaaattaaattaaaaaaatattttgactgtc

SEQ ID NO: 266011 - DNA, 401 bp, Homo sapiens
gccaaagcattatccattagccagactgcctgagaaaggcaaaagactcccgacatctggaaatcttgcaggctttcaaggctgcctatctgcttataaaacaaggatgtgtccgttatagctttaagtctgcactctatgtctagctcctaaaactagagtctgccaggttccacgctgatgatgctcatcttcctgggtacagaacaaagacaagataaggtcaaccattcttctgccacccgccatcctacaagccttctccctgtaaggaaatatgtaaattctaaacctcctgaaaacctgtttggataacgtcagacacagacatgtctgtgacttgtgtttttccccaacacaccctcaagctctggcttaataaaacttgatcaattgagaaa

SEQ ID NO: 266012 - DNA, 423 bp, Homo sapiens
gtaacagtggaaagtcattatctctggctttggtgttaacatagggagggatagcaaattgcctcactctactagtgaatgaatagaagagaaatccttgatggtttatcaagagaggtattatgggaacacaaaggaaaaaaataaattcttacaaaataccaacagcagccttgcaatccccgtcaaaatgtacccaaccaacttaagggggaaaaaaaaattcaaactatgtcctagccataaattgaagaaagaagtccagaaatgttaaaaatgtttataatcatcaaaattagtattttttgccttgaaggatgtctctttaaaaggctattcttaccaggttttgtgttgtaatattaaaagtggcttacaaaagagtgaatgtcaattgcaaaattaaatttatctctgggtatg

SEQ ID NO: 266013 - DNA, 494 bp, Homo sapiens
gggtgtggtggtgcatgcctgtggtcccagcaacttgggaggctgaggtggggagaccgcttgagcccaggagttggaggctgcagcgagctatgattgcgccactgcactctagcctggacgacagagtgagacgctgtctctgaaatacaaacaaaagccctttcttctcctacagctgcaagaggaaaaaaagaaaaaagcaagccaaggtgcggccggggttcagcagagtgcgcagatcagcagggagggactgacgtgaccagcctgggattgccacagcgctcgctccaacagatcagcatgcccagagcgtgcttcacagatgtccccgagggccctgagcccctttcagggtatatgtgaggtcaacaccatgttcacaacagccctaagatgtgatctgctttttccactggggtgacctttgctggtgacgcgcgagcgacgcagaaactgctggatcagcggatcgagtcacagctccggca

SEQ ID NO: 266014 - DNA, 558 bp, Homo sapiens
ttcactggagcatttcaggtaacagattttcagattaggcatttaaacaaattgaaccaatgaattattcttttcctctgttaattattgatttttataagtaaatcaataatgtatgtatatatttgcagttctataatgtccatttgatcttaccatatagattccaattcattttactatgttgtccacttttcctttttacatataataaatcacctacaaatttagtggcttaaaacaaacatatgattcccaagattctacaggtgatttggggatgggctgagttggctggggttggatggtctatgatggcctcatgctcatgtttggcagttggtaggctatctggtctgcagggagggctgggctgagctgagggctctgctgctcaagaaagtaaactaggctttttgagatagtctcatggagttccaaagagcaacaagaatgggagggtcattgctgtagcactttgtaaacaatctatcataattcacaacagctcttcttttccaatatgtcaataaagagttgacatttaaaaaaaaaaaa

SEQ ID NO: 266015 - DNA, 285 bp, Homo sapiens
agaagaagaagaaaaagaaagaaaggccctgacaaaaggaccagagcacagagtcctgaaaacctcaagggagcagcaaacaattgccttcccctatcattactttatatcctggtattttccatctccaaaatgttagcattccatcaaagcatttttttttaaactaaggaacctatgtcaatgggtagacagtgaagataaaattattgaaatattacctcactattctagtattcaattcagcagacatttaatctatttcatcattcagtatccaaactc

SEQ ID NO: 266016 - DNA, 345 bp, Homo sapiens
taggtatttcctggtctcggacctatgggcccaaagggggtaattgggtaagcagcaaatggaataggaggaggcagggttagggtaaggttaatgaactagaatgccaatttaaaatatgcccaattgtaactaactccccatattcttttaaatgttgttctaatctatatgctctttttcttcatttatgtaaatggatcagtcaatgattcctaggctcagctgttttaatggataattctattttaggagaaagacagaaataggcagagaagcagtgttttccaaattacatctcagagaatactcattcttcaagatgttaacatgtcatgcaggaaa

SEQ ID NO: 266017 - DNA, 190 bp, Homo sapiens
gccaataaatagtatccgtactttccattttctgaaaatgaagctgaactatatatctcacatagaaaggtagtttttttaattcatcaggatttgaatatggttaacagataaatatttccttacttctattttccaaataagcttagaatccctttcagagaatatcacagaatagtttgcagacaag

SEQ ID NO: 266018 - DNA, 355 bp, Homo sapiens
ggaacatgtctaaggaataggggtgaaccagagaagacctagcttactgaaattacaatgtggtcccaatccagctaaacccctggttggattgaggtaatcaatctctcaccctatctacagaagaaaagagaaactcatggtggagtaagatgccatctggagcctctatgattcatttatatatatcctacagaatacagtcaaaattgctagatatgcaaaaacacaggaaaaggtgatttaaaaatcaaaacagaaaatagaagtagacacatcatgttggatttagcagacaatgatttgaaactaaccatgattgatatgtcaaaaatgtatgaaagttgataaaaaa

SEQ ID NO: 266019 - DNA, 502 bp, Homo sapiens
tgataaacccattagatcacgtgagacttattcactatcatgagattgcacgggaaagactggccccatgattcaattacctccccctgggtccctcccacaacacttgggaattctgggagatacaattcaaattgagatttgcgtggggacacagccaaaccatatcaagtgcattacaaatattaattgatttcaccctcagaacggacttataggtagatactattattatatccattttgacagatgaggaaactgaggcacagaggaattaaggcatttgtccaaggatgataaacagtggaggcgggattcatactcacagaactggcttgactctgagctctgctgctttgaagaactaggttggaaaaccaccaagggtttagtccactctgcccccaaatcctgagtctgctgaaccagcaccaccgccttcggtgttggttcaggaagttgcccttgtctggtagggagggtgagcctctgaaataagggt

SEQ ID NO: 266020 - DNA, 474 bp, Homo sapiens
cagacccagtacccccaggagaggggacagaagcagagccctcctccaattaaatgtaggctaactctaaaaggttttatatagctgtgcaaaagttgtatgatctcactaggtgcagatttataagaccctttctttttgtgtggggtgttattagaagaattcttgggctgggcatggtggctcataggccaggcacactggctaatgcctgtaatcccagcaccttgggaaactgaggcaagattgcttgagccccggagtttgagagcagcctgcgcaactggcgaaaccccatctctacaaaaatacaaaaaatagccgggtgtagtggcatatgcctatagtcccagttatttggcaggctgaggcagaaggatcacctgagcccaggaggtcgaggctgctgtgagctatgatcgcatcactaccctccagcctggatgaccgaatgagatcctgtttcaagaaaga

SEQ ID NO: 266021 - DNA, 398 bp, Homo sapiens
cctaacccagcttgaagatttttgcagaggatggtccataaaatgccaaatcaagctacatggaccatctcaggtttatttgaggactaagtagcttgcattccactcctgggcgctgccccactctccactgcacccatagatttaccatggtagatttaacttcccggttgaggaaaacaccaatttcagagtagccccagaagccctgcctcctctccctcccaagtccctgtggccttgcagggagctgcctgtttggtttaatctggggagctggcacctctcccattccctactgtcaggcctgcactgttcagcattcttgtttttgcatctgtcattatcttttgtatgcaaagaggtttaatgtgcaataaatgtaaatggccagtata

SEQ ID NO: 266022 - DNA, 397 bp, Homo sapiens
tcctgaggcctctccagccctgtggaaataaatgattattattcttcaagaagaaatccactaacagcatccttttcagaatgaagatctgaaaaggaagagattatctcctctttaatgctgtatcccaaagcctagaagaaccagagacttactagctaatcaataaatattgctgagtaaataaatgacagacatttgcatgcaggcctcaaggagcagctgaagtgatagaggtagaatgaggcaataaattattagcaaagagagcggagtatttacaggcagcgatatactaatgaacctaaaaatttggagaatatttggaaaaataaaagagcttgcatccctggaatgcaacgaaaagaaaagtgctcaaaaagtgataatatacaca

SEQ ID NO: 266023 - DNA, 549 bp, Homo sapiens
cacaagatacaatgtgtttgttttgcagaaattgtctctatcacctgtgggcttttgctacccatagagctacttgtacctaattcaaccaataaaaataatgctagaaactgaagccaacaaagctgtcaaaatttgtcttgggttcttgggttagacaacttgttgagattttataatacatttccttttttctcctctttttctaggttctttcctgctggatgcgaaacactcaattatcacttcctcatgtgtgtagtctccctcactgagtcagctctcactggggccttcccatgacttgtttgttgtctttatctgtctgaagcctcatcttcctttgacatttatcttcatctggaaattctataatcttccttttcctcttgtcttgatcttacataaaatcaacattgtccattgaaagttatgtttaagaagcattgttaacaaaactatcatgaagtcccttgtaccttgttaaaaaccactgtattcataactttgttgtttttttcaaatatatttttctctggattgaaaaaa

SEQ ID NO: 266024 - DNA, 461 bp, Homo sapiens
cctcctgaggccacctccttaccccgaccccctgccattgggccacctcctcaagccctccagggtatcccgctccgttcatcagtgacctccctgagcccagcccgatgacgtcttccctcatgcctccctgcccttgacctgttgcctggacccacatggctggccaaggcctccctggaatctgcaatctcccgcacggtctcctctgacgtcttggacactgacagtcctctgcttcctgtggtggctgctcttctcctccccagcgtaggcagctctcaaggggtcctctctcatctcctattacaccctgtccccagatgctcactcctgggcttccaaccaccgtggtccaggctctccctgcagacttgcacttctctccctgcaccctggcttcaaccaccttggttgattctttttttttttttggagatggagtcttgctttgttgccta

SEQ ID NO: 266025 - DNA, 418 bp, Homo sapiens
tcagagcagaaaaggatattagacagtctataaggtctgtggaagtgagcaagatcctagctcccagtggtccaagggtcatatgactccactgttgaggtgtagaaaataggtaaggatggagggcattgactcagtctggccatattcctgacaacctagacattgtccaaagaatgtacccaccaacagcattctcacccttagcatggccaccaatgcatgaaacacaaataaaaagggatatttaggcatagtaacgtttaatgtggaaagttgaagactgcctgtgaatcgacatttctataaactttcctccctttggattccttgctcatgctatatccacagtgcctggcatatacacaagctcaataaatatttgttaaaaagaatatgaataaatacgcttacaagt

SEQ ID NO: 266026 - DNA, 516 bp, Homo sapiens
agtgacaccaagcatcacgtcctcctgaccaaggccttggccttacaccctgggagcgtcccccagctctggcggccaccacctctgcctgtgccaggcacctggagtggtcacagtgctgtcactgaaggactgagcacgccggaacaccttcccgggcggctccccctttctggaagggacactcctggctgaaggtgtccatgaccaggccctgtgctcatggtaccaaggaggccacggagacagaggagggcccacctcagcccccgccgggtgtgcacctgtcggggaggtggggcgagctgaggacctgctcagctccttcctgaggacacccccgaggaccctcgtgcatctctcatcgtcagggcgctttcccgacagcctccatggccggcagctcctttctcagccaagctggaagcatgcagggcggaaccttctggtaccctgtgccccctgcggtcagcgctctgaagtccttgtcgggtgggactggacggcggcggccgc

SEQ ID NO: 266027 - DNA, 637 bp, Homo sapiens
tttttttgagatggagtctagctctgtctcccaggctggagtgcagtggggcaatctcagctcactgcaacctctgcctcccgggttcaagcaattctcctgcctcagcctcccgaggagctgggattacaggcacgtgccactgcgcccggctgatgtatgactcttttatccagtaatcaaaacacatacgtacatacacacacataccagcccaaaagaggtgttaaaacatacatattacacgtactttttggaggggtggggtggggtgggatggggtgggggttatctatctatctcaaaattaccttttggtgccttgtcaagctgtggagttttgaccacacacacaaattgagccaatgaacaatttcaatgatcctgaaagttcttaagtcttatgaataattatcaagagttctgagaagttatctgtaaatcagcctatgacaccatttcttgagagttatgattaaagaaacagcaattatgcttgaagcgaacatacatcaactagttagagcaaggtcagcctgtacaagctgacataaattatgagaatgatgctctatctctagaattggaatattctgtggcttctttgtaaaactatagatctggtgggtcatgggaa

SEQ ID NO: 266028 - DNA, 282 bp, Homo sapiens
aacttcacttcttttcatttgaatacttactacagtcagatatatttgcgggtgtgtctctgaatagctttgtgtctttttttcttttaagattatattataagcgttttatgtcatctaatgtttgaaagcattattatttttttgcggcacagtcttgctatgttgcccaagctgatctcgaactcctgggctcaagtgatcctcctgcttcagcctccccggtggctgagagtacaggcacgtggaaagcatgattttttttttttcttcctgagacag

SEQ ID NO: 266029 - DNA, 586 bp, Homo sapiens
gagtcagaggctcaccctgttgcccagttggaatgcagtggtgtgatctcggctcactgcaacctccacctcccaggttcaagtgattctcctgcctcagcctcccaagtagctgggattacaggcgcgtgccaccaggcccggctaatttttgtatttttagtagagacggggttttgtcatgttggccagactggtctcgaactcctgacctcaggtgatccgcccacttcggcctcccagagtgctggaattacaggtgtgagccaccgcgctcggcctgatctgccttttcctagtcttcgttgaaacaagagtatagagcagtgtgatttaatagtttatgccatcattgcataataaaatgaattttcaaatctatatgtactgaaatggaaggctttgaatatatgttgtaattgttgctttagagtaatacctcaggatacattctgcatacattttaattaagtggtgtcttttacatctttattacatataggtgtcataggttttaagatctttagcagttctagtgttggggtagcctctgtttgtggagtagcctaggatcctgctagagtcg

SEQ ID NO: 266030 - DNA, 674 bp, Homo sapiens
acatttcacctgccctgggtatctttcttttttttgagacagaatctccctgtgccatccaggctggagtgcagtgatgtgatcatagctcactatagctttggccttctgagatcaagcaatcctcccatctcaacctcccaagtagctaggactacacatgcatgtcacccatgcccagatcatttttgtagagtcagagtttcaccgtggtggccaggttggccatgttggccagatggggtcttcttttgttgcccaggctggccacaaattcctgggctcaagttatcctcccacctcgtccttgtagagatgagatttagttatgtcgtccaggctgatctcaaactcctgggctaaatcgattgactcacctcagcctctcaagtatgttatgaaggttatatgttaggaagggtcccaggaggtagacccacacagatgggatttgggcataggtttggtttcccagggggcagtgctgagctctttgccagtgggaaatgggatgctggtgatttccagtaggtgacctcacagtgactcaagctaccacttactgttgattgtgacgaaatgccagctgaggcacatgccttgggagctaagtggttgctgcccttgaccactgtgaagactggtgtgggaagggtcgttttggatgcacttga

SEQ ID NO: 266031 - DNA, 237 bp, Homo sapiens
aaacaaaacaaacaaaaaacaatactggaaaatacaaacaagcccaaggagtgattggtagatgtttagagtctaccatttctcgacttcaggaaatgtctgtgtgtatctcagtcttctgctattgtaggcacacatcatacttcaactgtatgaagattattctattcctgctctataaatatgttattggattggatgagcaagatatacacttacacatttgaagccgtaagt

SEQ ID NO: 266032 - DNA, 681 bp, Homo sapiens
ggtgtacaaaaagactaagtcgaaaaatctcagctgtgcacagtggctcatgcttgtaatcccatctctttgggtggccaagggaggaagactgcctgaggccagcagttcaagaccagtataggcaacatagcaagagcccatctctaaaacaaaacaaaacaaaacaaaacaaaattagccaggtgtcgtggctggcacctgtgttccaacaacttgagagactgaggtggcaggaggattgcttgagcctaggagttaggggctgcagtgagctgtgatcgtgacaccgcactccagtctgggcaacacagcaagaccttgtgtcaaaaaattttttttaattaaatataaaagagtttcatgacattcagagaccatccaaagaacctgtgggttccggccaggcacagtggctcacgcctgtaatcccagcgctttgggaggccatagcaggtggatcgcttgaggtcaggagtttaagagcagcctggccaacatggtgaaaccccatctcttctaaaaatacaaaaaattagtcaggcatggtggtgggtgcctgtaatcccagccactcaggaggcggggacagcagaatggcttaaacttgggaggcggaggttgcagtgagccaaggtcacaccattgcactccagcctgggcaatcaagagcaaaactac

SEQ ID NO: 266033 - DNA, 445 bp, Homo sapiens
tatgggcattctacctttcactaaatttttctgtgaacataaaactgctctaaacataaagtctgtttttttaaaggagcaaaatatcaagtaaactggagatttaaataaaaagaaaacctggtctctcctaatagaatgcaaatactgtgaggttaagagctgcaacactatttttctctagtatctctcactcttttaggcacatattttgcactcagtaagattttctgaaatgaagggaattttgtgtatgaccttaggcaagtcatttctcccctccctttttttttctggagatggagtctcgctctgtgccactgcactgcagcctgggcaacagagcaagactccatcaaaagaaagaaagagaaagagagagagggagggagggaggaagggaaagaaagaaagagagagagagaaagaaggaaagaaagaaaga

SEQ ID NO: 266034 - DNA, 147 bp, Homo sapiens
tacagaggcaaaggtttattgaaagaagcaaagtacaactgagagatcaagtgccccgctcaacctttggctcggggcttttatacactggcttggttctggggtttcttctcctccttgattcctcccttcggtgggctgctgcgc

SEQ ID NO: 266035 - DNA, 409 bp, Homo sapiens
ttatttacactcaaaatattttctatttttggctacacttttcaaaaactctctacatcataaataattcacctttttggaattttggctatttctagttgagttgtaagtagttctaatttttctaccttacattttagtaatctttatatgtttactttcacaatacaacatgtgctcagatagttacaactcagatagtagtgtggcctctatgcaaggatgactctcaacattccatgaaacattccatgtttttaatgtcttcccagctgggtcataagccttttgagtgtgtggcccgcaaattagtaggttcttttgttttttgttttgtaatcaccgaaatgcctatatatagtagtgtttggtaaatacatattgaataaatgtgatgctatgtaagttt

SEQ ID NO: 266036 - DNA, 774 bp, Homo sapiens
gacaaacgaaccaatgccttgcctttattattatggctctttctatgaggctggattttgctagtatcttttcttctctgaatttctcattctgggtacctcatattgcaaaagagcctgtggcctctgagctgacttggtccagtaggaaaacagggaaaacagttcgtatttcagaattgactgtcacagccttgagacctgaaatgtagcccccatccatgagtcagtgaaatatctgtatttcttaattttctttccttaaaaccacactctccctgactaccttgcaagtgaacggtgaggctcaaatgaggtcatagatatggaacgtttttggaaaaaaaaagaaaagcttctatgcaaatgtagggtgtgatgatgacgattattaatatgccttgggcttggttaagggaggaaccgaaggaacaagcaaagctcctgctcctggaggcagccaggggctgcagctctctgttagcacggggtggatgcattctcagacgatcaatgtccatgaggctgcacatctatccctgccacaccagcggtgtagactcactgtgttttcattccagaagggttcccttcttctatccccacaccctcctcagagatcttctcttcctcccactccaactccccctaaacccagatttgcttcagcctgtctgcttctatttccttcatgcttgaatgtcagtgaacacacagcctccttctgcttaaactctgtagcccacttctttgctcaaggcatattatttttct

SEQ ID NO: 266037 - DNA, 348 bp, Homo sapiens
gcaaaaccccgtctctactaaaaatacaaatattagccgggtgcggtggcacatgcctgtagtctcagctactcgggaggctgaggcagaagaatggcttgagcccaggaggcaggggttgcagagagctaagatcgcaccactgcactccaacctgggcaacggagtgagccccgtctccaaaaaaaaatagcatcctgatttgtcatcgtgttttgttttagcctgcccttactctctttaattccgccatgaatctgcaagacatagccggggtgcagctaaaatttcgcctttgctaataacttagtttatgaatgttacaaatataactggtttgtaagagag

SEQ ID NO: 266038 - DNA, 400 bp, Homo sapiens
gatgcacgtcccgaaacttacattaagaaaagctctttcaattaacaaaatcgaattcagagcaaacgggtgaactggactgagtgtgcctctattgttgggtaaagcttagtaatactgcccacagtatcatttgccagagatttcttgagaggttgcacagaaaggtcttgttgttgaactgaagaaaaatgttgggaatggctctgtgatcctgcctgttgtcaggttggtttcaccagcaaggggcccaccgtacctctcctgtggagacactgcttagtttcaatgtgcttttcattctcttggctgcctgagcaaatggccatcactgtttccattgtgagctcttccccttccggagctgagcccaagtacagggaacatgtgctggagacca

SEQ ID NO: 266039 - DNA, 311 bp, Homo sapiens
cagcctgggcaacaaagcgaaaccccatcttaaaaaaaaataatttagttaaacgcattattctgttttccttttttttgagacaaggtctctctctgccacccaggttggaatgcagtggtgtgaccatggctcactgcagccttgacctcctgggctcaattaatcttcctacttaagctcccagctactccggaggctgagacaggagaattgcttgaaccctggaggcagagcttgcagtgagctgagatcgcgccattgcactccagcctgggcgacgcagcaagactatctcaaaacaaaacaaa

SEQ ID NO: 266040 - DNA, 361 bp, Homo sapiens
tactactgtagagagaatggccagaaatgatttctctggaaagatggcatttgagcagagacttgaatgaagtaagagagtgaaccatggacattgggtaagagacttacaggctgttaagagagcaagtacaaagatctaggggtggaggtgtgcccaggggagcagcaaagggctgcggagctggaatagactgagtaatagaaaatgaggagggcggggtgtggtggctcatgcctgtagtcccagctactcgggaggctgaggcaggagaatcatttggacccaggaggcagaggttgcagtgagcagagatcgcgccactgcactccagactggtgacagagagagactccgtctc

SEQ ID NO: 266041 - DNA, 343 bp, Homo sapiens
gaaatgtaaggtttgttttgccttcgtcacagatgtaaattttgttttaaaaatatatttgaggccaggcgcgttggctcacgcctgtaatcccagcattttgggaagccgaggtgggtggaacacgaggttaggagttcaagaccagcctggccaagatggtgaaactccgtctctactaaaaatacaaaaaaattagccgggcgtggtggctggcgcctgtaatcccagccacttgggaggctgagacagagaattgcttgaaccggagaggcggaggttgcagtgagccgagatcacgccactgcactccagcctgggcgacagagcgagactcgtctca

SEQ ID NO: 266042 - DNA, 477 bp, Homo sapiens
gggaaactgcccccatgattcagttacctccacctcgcctctcccttgacttgtgggaattacaaggattatacttcaagatgagatttggctggggacacaaagcctgagcatatcactatcgctctcagtcttgtccgactggcctcgtgtaggagaaggctctcacctatctgtctgaccagagattttaagaagatggagcctccatcagcctgggcctggaatgagaagcagaaccccctggctgctaatgtagtccaggaaagagaaatgaacagaatccctctgataacccacattaaacattgcagcttgagcaagaaataaacatgatttgtggccaggcacagtggctcacatctgtaatcccagcattttgagaggatcacttcagtgcaagttcaagaccaacctgggccatcaaactccaaatggtcgtgcaaccggagcctcggaagatggcgccttctgccg

SEQ ID NO: 266043 - DNA, 467 bp, Homo sapiens
gttttcgtgacggcatttgtcttgtgtggtatggggtgggggctttgggaggggtgtgtaggaaaggacaccatactttaaaaattaaaatgaatacatttttaaagtgaccctttactatttcaaaagcaaattcaaagataggaggagtttctactcttcaggtttgaatggagtccgccatcaccttgagttcttccatgcaatgtggtagtcctttagaagttacaaataaaaacacctcccctccccagagttaacattggccaagagcccctgcttccattatttttaaagcatgtgtgagtcatttaaaagcagtgctttccatgcttatcttggtggttgaggtggaataatcagggtttcagcccttacttagatactaactgtgctggaacttgagcaaggaatttgaggtttctgtttcagttctctcaacagatgtgattaagaggaaggacaaa

SEQ ID NO: 266044 - DNA, 475 bp, Homo sapiens
ttgttgttgttgttgttttaaatatggagtctcgctgtattgcccaggctggagtgcagtggcgcgatcttggttcactgcaacctccacctcttgggttcaagcgattctcctgcctcagcctcctgagtagctgggattacaggtgtgcgccgctacgcctggctaatttttgtatttttagtagagacagggtttcaccatgttggtcaggctggtctcaaacttctgaccttgtgatctgcctgccttggcctcctaaagtgctgggattacaggcatgagccaccgtgcctggctgtagttgtttataatagcaacataattgtctatcaagtgggagtatgacataagtttatcctggacaatttccatattgctggacatttgaattgtttctggttggtcactcgtttagatactgcaacgaatatcttatatgaagcttttcctgcgttttggaataaacagtaaa

SEQ ID NO: 266045 - DNA, 1092 bp, Homo sapiens
acagtttaaagggcacttctgtttgtggagtaaagcctgccacattgtcaaaatatgtaactggaggattacagtatgcttacctctgattttatttctacagtgctgctataagtaacaatgagtaaatctactaaattatgtggtaagacttcttgtccaagaagcaatatattctgcaatctccttgacaaaattgttaaaagaccctccctacagtttttgggtcagtggggatatcactgttacgaaccaaggatttacagatcactggcaaaaattctgaggtatgtggacttggatggttttgacgcactactcacagattacattgcatttgtggaaaaatcaggataccgttttgaagtaagttttaacctcgacttcactgaaatatgtgtgaatacaattctgtactgggtttttgccagaaaaggtaatcctgactttgtggaattgcttctcaagaagacaaaagactatgttcaagacagaagttgtaacctggcactgatatggagaactttcacaccagtatactgtccaagcccattaagtggcatcacacctctcttttatgtagctcagacaagacagtctaatatcttcaaaatactactgcaatatggaatcttagaaagagaaaaaaaccctatcaacattgtcttaacaatagtactctacccttcgagagtaagagtaatggttgatcgtgaattggctgacatccatgaagatgccaaaacatgtttggtactatgttccagagtgctttctgtcatttcagtcaaggaaataaagacacagctgagtttaggaagacatccaattatttcaaattggtttgattacattccttcaacaagatacaaagatccatgtgaactattacatctttgcagactaaccatcaggaatcaactattaaccaacaatatgctcccagatggaatattttcacttctaattcctgctcgtctacaaaactatctgaatttagaaatctaacatacgtcagtgtcctaagttccttaacaatgcttaccaatgtatggcttagaagttaataaaaattcacttcatgtaagtttt

SEQ ID NO: 266046 - DNA, 1030 bp, Homo sapiens
acagtttaaagggcacttctgtttgtggagtaaagcctgccacattgtcaaaatatgtaactggaggattacagtatgcttacctctgattttatttctacagtgctgctataagtaacaatgagtaaatctactaaattatgtggtaagacttcttgtccaagaagcaatatattctgcaatctccttgacaaaattgttaaaagaccctccctacagtttttgggtcagtggggatatcactgttacgaaccaaggatttacagatcactggcaaaaattctgaggtatgtggacttggatggttttgacgcactactcacagattacattgcatttgtggaaaaatcaggataccgttttgaagtaagttttaacctcgacttcactgaaatatgtgtgaatacaattctgtactgggtttttgccagaaaaggtaatcctgactttgtggaattgcttctcaagaagacaaaagactatgttcaagacagaagttgtaacctggcactgatatggagctcagacaagacagtctaatatcttcaaaatactactgcaatatggaatcttagaaagagaaaaaaaccctatcaacattgtcttaacaatagtactctacccttcgagagtaagagtaatggttgatcgtgaattggctgacatccatgaagatgccaaaacatgtttggtactatgttccagagtgctttctgtcatttcagtcaaggaaataaagacacagctgagtttaggaagacatccaattatttcaaattggtttgattacattccttcaacaagatacaaagatccatgtgaactattacatctttgcagactaaccatcaggaatcaactattaaccaacaatatgctcccagatggaatattttcacttctaattcctgctcgtctacaaaactatctgaatttagaaatctaacatacgtcagtgtcctaagttccttaacaatgcttaccaatgtatggcttagaagttaataaaaattcacttcatgtaagtttt

SEQ ID NO: 266047 - DNA, 470 bp, Homo sapiens
aaagagcagggatcctgagagcagccaagcgatcctgagagcagccaagcgggatgctgttgagatgggcccggagtagccacaaccctggaacagggctaggcagagtcctaaggcccagtgctgcttgagattcttaataacgcttttggttttttcttgggttgtaggaaaattccttttgaaaattctagcctgtctcagctctgctgagggaagatggaaacagtattttttgttttgttctgttttccccacatctcactcaggagaagaaaagtagtgcattccctggaggctcccagggtggcaccgataagagcatgtgcagaggttccctcgccccagctggagtgcagtggtgtgatcatagctcactgcagcctcagcctcctggagtcaagtgatcctcccatctaagctttttgagtagctgggactgtaggtatgcaccaccatgcccagctaat

SEQ ID NO: 266048 - DNA, 286 bp, Homo sapiens
gaagaattcatatagagactctctaccaggagggttcctttagacccctagtctgtcattttgtttgctgtctctcaatgccattgctttgtgatagttatgaaatttcatttaaaattaaggtctcagatgtgtgaaattattggaagttcccatactgtccatcaaaagcttttcatctggccttaggcttgatcctatataaaatttatattctgtcagctatattgtatctttcaaactgtaatcaacacatctacattcacacgtttaacaaaaatagaaa

SEQ ID NO: 266049 - DNA, 677 bp, Homo sapiens
ctgaccccagtttgtgcttttctctttatactgaagcatgcagtgaagactggaccagatccacagggaactgattctgtgttccaagatggggggctggccctggtgttgagtttgcaggtgaaggagctccaattataggaggaaacaaaaggctaggagcagcaagagcccaacacattttcaagggagaaatttagggacaggggacacaagcacaagagatgactataactagggatcccattaatgtctcagaaataaggggaaaatcccagctactggaattgaggctctggcaggcagactaagtgactgagtaaaacgcttgcatcccttccctgtctcaccactggactgcacagctgccttggctgtgagtacagcagggctaaagaatgtgggagtagggcggattatgagaacagttcaaaggtggtccatccacgtttatagagtagagaaagaaatagaatccaacaaaagaaagtggaagaaataatcattgaggtagaaaaaatggaaatagcgtagaaggcaaaacaaaattttcataggaaagggatggtgaaaccaaggtctggcatagaatatgagtggaatacacttggatacatccacgcgtgcatgaatgaataaatggctgaatgaattggccaagcacaggggaagggcca

SEQ ID NO: 266050 - DNA, 481 bp, Homo sapiens
ggtatttatcccagacaacaaagccattttattttggttctccttaagctctacctatcggcagagaggatgcattttgagctattttccattatgcaataataatgataaatccaaacatataaatagaattgtaaataatgataaatccaaacatataaataaacagtcccagggactgttctaagcactatataaataaatttacttctttccccaaaaccttgagatataattattcccattttacagataaggaaactgaggctcaaagagatttagtgaattccctgaggtccaacagttgataaatgtttctgaatgctccttcggggagggctgaagattctagctaacacagtgactgggtagtcaagtctgtctcattttagaagtccattttgctgtagatctaaaactattaatatgttgtctaattggttttatcactaattaaagcaatattgttattttccaaata

SEQ ID NO: 266051 - DNA, 467 bp, Homo sapiens
cactgcaagaccctgtccctaaaaaaaggaaaaacaaatagaagacaaatttcaatttctgagtttatacaaagaaagccttaattcagatcataaatatcccattgttatttttagttcattgtttcctagaacaaaggatggacatttaggatcctcacattgatttatgtcatatatatgtattgcattgaatatatatatacgcatgtagatatatacaattgttatatataattaaaagtcagaatcttaggtgataactgtcagacctctgagcccaagctaagccatcgcatcccctgtgacttgcacgtatacatccagatggcctgaagtaactgaagatccacaaaagaagtaaaaatagccttaactgatgacattccaccattgtgatttgttcctgccccaccctaactgatcaatgtactttgtaatctcccccacccttaagaaggttcttt

SEQ ID NO: 266052 - DNA, 192 bp, Homo sapiens
atgatggttacacaataatgtgaatgtacttaataccaatttaagtacatttaaaaacaattaaaatgataaattttaccacaaaaattacatatatggcttgtattatatttctgttggattgtactggtctagaaacacaacgtgttttatagttaattgtgattagtggtcataattcacaaatacttt

SEQ ID NO: 266053 - DNA, 446 bp, Homo sapiens
ggtgctgtatgtggctacaggcacttaacattgtcacctggaggcttccccagcacattgtgagatccaagcctcaggaaccagaacagcagaactcctgtcacccacagaagccggcgccggggactgcagtgcagataggcaggcgttcttcacagcagtggctactgcgcactccactcacgcagcagcggtccccagatgcctgccgttcacctgaggctgctctgagtgctttggatatggcaggagacacacaagtctggccctcacagagtctgtttgcaaagttaaaagttaaataagtaaaatagatgccaggcagggtggtgcatgcctgtaatccagggcatttgggaggctggggcaggaggatcacttgagcccaggagttcaagtctaacctgagcaacatagcaagaccctgtctctacaaaaaaaactaa

SEQ ID NO: 266054 - DNA, 650 bp, Homo sapiens
ggagaggttaaatataataacttgctagtggtcaatcagtaggcagtagaggagccagcatataaacccaagctgcccagctgcagaaccacattcttgtcccatatgctatgcctctcaaaaaaggaggccctctccttgggacacaaaggtaataaaaatgcctgccctgagctgtgtctctgtctaggtacacagttcatgagtgaaggagctcctggagtcatgaataatggaagtccagattggtcaagtaacttgtcccagccccagcccatgcatctggtatgtggttggacaggtttctaactcattacgtaacatcaagaacattttaaactgctttgagacatttgtgaattaagatctcaataaatagtcctccctggcaccagctccatccacattaaatgagacttgaaaatttctttgaatggatattagtttagaaggagctaagttattagttggcctcacattcctcagttgggccctgggcccagcatgccacttctcctggttattatggttcacatctgaggtaacccatcgggaaactggatgggacaacaaactaaaaatgttttagtttggacctgtccaaaaccaagagaataaaaacaaaatggatagtcaagatgattcagagc

SEQ ID NO: 266055 - DNA, 421 bp, Homo sapiens
tggtaggacacatctaccccacaaagggcaggctgtgccttctggtgatcactaagggagtcagtcttctaacacttcattctctttaatcctataaagttagacatattcctaaatggttcttagttttttttttcaaaacacatgacaactgtgtaccacaatatcattgattttaacatcttatatcagagtcagggtgtaaagcccgccacaaatgtattaaaggaaaaaataatgtaaaacctgcgattggtaatataatttcccacaaaatgattagaatttatttctgtctggttacatgtttgttttcatttatttaacaattatgtgttaagccccctcttcctcatcttttctatattatacctaacctactaaaaatataatacagatatttttgagtacttatcttgtg

SEQ ID NO: 266056 - DNA, 943 bp, Homo sapiens
ccctgtcatgcccgtgtcctggggctgccccagcaaaacaccacagaccagggcttacacaaggtgcgtgtatttcctcatggtcctagaggctggagtcggaggtcacagtgtcagcagggttggctccctcgaggtccctccttggcttgtggccgccaccacctccccgcatcctcatgtggtcgtccttctgtgtgggtccccatctcgtcttcttacagggaccccagtcatgccggatcagggcccgcccaacaacctcacttgaccgtagtgacctccttagacatcctgtctctaagtagtcacatcctggccaggcgtggtggtccacgcctgtaatcccagcactttgggaggccgaggtgggtagatcacctgaggtcaggagctcaagaccagcctggccaacatggtgccatcttgttgcaagcatctgtcctagcacacagtcagcaatcgctcctcagaaaggctctgtcctatgaagtcactgagaaccctgagaagtgcatgcagacctgtccctccaaggggaccctggtcacgtgttcgccaactgatcattccagaaccttactgtgtgtgttttgggttcaagacaccttactgctgtacagcgctgacgggttcacgttgaacacatggctggtggctctgtcacccacacctgagcacagcttgcacacacagggtgtccccatgaggcacatcatggcctcctggtgctgaaggagacgagacagtgctctgcacaacgcttggggccttttaaacacaaaatcaccaagagcagaaagatgcaaacaccgtgcccccactagactgagaaaaggacgcttgctcataaaatgagccgaagtgagaagacagagtgcggcccttctgaggaccgtctgctcaggggcgccgcagtgctggcctctggggtttttgtgga

SEQ ID NO: 266057 - DNA, 455 bp, Homo sapiens
gatttattaagcagaagcaatgtgcccgttaatattgcatgtgaaagacttaaatacataaccaagtgtctatactttaagatcttacattctgaagttggaagattacagtttgttcgaaagataaagttgtgtatattaatgtaataaaaagtactaaattttaaggtgttgaaaaatacaaaaataataatatttagtaaaatattattttgtgtttaaagtagctatatccggctgggtgccctgcctcacgcctgtaaccccagcactttgggaggctaaggcgggtggatcacctgaggtcaggagatcgagaccagcctgggcaacatggcaaaaccctgcctctgctagaaatacacaaaaaaattagctgggcatggtggcatgtgcctgtaatcccagctacttgggaggctgaggcacaagaatcctttgagcccaggaggtgg

SEQ ID NO: 266058 - DNA, 430 bp, Homo sapiens
aacagccttgcacaggccagttcaccacccctgctgctggtatgaaggcctgcaaaaatgtgtcagcccagcccccactgctacctcaccacagccgatgcacatgcaccccaccacactgccgctgctgctggcacttgtgaacaagcttgaatcctgctgccactgtcttaaagaaccactctggctggcaccactcatcagagtgctgtggtcagtggtacgggagcacctaggccccaccaatgcagcacgttcctaagctcacaagggtccagaaaacaaagctggggaccaacatgaaaccacacagcacacattcctggagggctgagctgagccttggccccctaaaaatgtctggaaatgtagcataaatccatcttatgcaaaaatcaaacccccaagggcatcaaagaaaataaaagcc

SEQ ID NO: 266059 - DNA, 407 bp, Homo sapiens
ggagcaagcccctcacaccctggagcaatgagcacaactagtgcctggatattgatttccaattactattctctgctaaaaggaactggagctctatgaagaaatgtctgattttaaggaacatttttgtgtcagaaaataaagtattcaaagaatagggacatgtcaaaaggaaacagcagctagcttaaggacatgctagcttaggacaagcttaaggacaagctagcttaggacaaatcaggtataatttgagcatcaaggccaagtgcagtggctcatgcctgtaatcccagccctttgggaggccaaggtgggaggattgcttgagaccaaaaattcgagaccagcctgggtaacataacaagaccctgtctctacccaaaaaaaaaaataataataataat

SEQ ID NO: 266060 - DNA, 172 bp, Homo sapiens
agctacttagagctgtagtcctttaaagctggttctcttctttgggtgtttgtgggttctgcagtacccccaacaggcactgagaccctctcgcttgcagttgcctggacatgggtgaatgtctgccctggcagcctgtctatataggcgccttcacaggggagtatcacac

SEQ ID NO: 266061 - DNA, 235 bp, Homo sapiens
cccgtgtaagcgactactggagttgagagctgcagggggcaagggtggaggaagaagaggattcctggtgggcaaacccaggaggaaagggaacccaggaggaggatccctggaggagcgagagtaagagtaggaccccagagcaggcaggaggtgggcagggccccctgggccaaggacaggggtctgatctttgtcctaagagcagtgcaaaccattaaaggggtttgagcca

SEQ ID NO: 266062 - DNA, 384 bp, Homo sapiens
cacgaggccagccctggtatttccaggacaaaggctcacccaagtcttccccatgcaggcccttgccctcactgcccggttacacggcagcctcctgtgcacagaagcagggagctcagcccttccacaggcagaaggcactgaaagaaatcggcctccagcaccctgatgcacgtccgcctgtgtctctcactgcccgcacctgcagggaggctcggcactccctgtaaagacgagggatccaggcagcaacatcatgggagaatgcagggctcccagacagcccagccctctcgcaggcctctcctgggaagagacctgcagccaccactgaacagccacggagcccgctggatagtaactgagtcagtgaccgacctggag

SEQ ID NO: 266063 - DNA, 343 bp, Homo sapiens
ggcctagggcttaggatggcctaggttaaaggtttagctgcagagaacagaacacttccaggtacggtggctcacacctaataatccaagcagtttgagaggccgaggtgggcagatcacttgagcccaggagttcaagaccagcctgggcaacatagcaaaaccctgtctccactaaaaatacaaaagtgagctgggtgtggtggtgcactcctgtagtcccagctactcgagaggctgaggtggcagtaccacctgagcctggggaagtcaaggctgcaacaagccatgattgtgccactgctctctagcctgggtgacagagtgagaccatgtctgagaa

SEQ ID NO: 266064 - DNA, 437 bp, Homo sapiens
gtgggcttgtgtcagagctaaagaacactgaaattaggaaacccccagtcttataaggagctactaaaaacctacctaacctttgacctggaggaaaatgttgtttttattgtcttggtcaggagaggaatctaccctctgtccttccagaatgtttgcagcacaaaagacattgagaacagaagctgtcacaagacgtatagaaacaccatgaaggattgtctctcaacactgccaatctgataagggaagaacagtatttgaatatacgctgtccagtacctcctgtgaataccaaaatccatgaatgctcaggtcctttatgtaaaatgtggtaatatttgcatataacctatgcacatactccagtatactttaaataatctctagattacttataatacctaatacaatataaatgctatgcaaatgattga

SEQ ID NO: 266065 - DNA, 518 bp, Homo sapiens
ttatttttttcaatagtgatattctttaacaacaatgtatgtttaaagacattcttaataatataaaaaatatcaaaaacctaggtaaaaagatgtgcaaactatttattataggaaaactgtggctagctactgaaacaaactaaaaaagacctaatagagatatggactaggtgtatggattagaaaacattctaaagagacaaattctccccaatctacagatgatgtgatatcaattaatatccaaatgagtgtgtctctatgtgtgagaaacttaacatgctgattcaaaaatttatgtggaaatacaaaagacaggccaacaacagtggaaatgattttaaagaaaaaaatgagaagactttactatatatcagtacttactacaaatatacagtaattaagatggtatagtatgccattggcttaattatagacaaagagaccaataaaacaggacacagcccataaactgacctacccatataagataatttagaacaaaggtggttttg

SEQ ID NO: 266066 - DNA, 503 bp, Homo sapiens
ttttgaggtgaagttttgctcctttttgcccaggctggagtgcaatggtgcgatctctcggctcactgcatgccagcatgggcgacagagtgagacctccatatcaaaaaataaaataaaataaaataaagttgcatttagtctccagttttgcttcctagacaaaagataaaatcacccaagctcccagaaaattaagaaacaaaccatttgaggatgaacacctaagacacacgtcattgaaggcaccaaatgcttgatcttgcatcatgacctaaaagtctcttctactggattatacattttttgagggtacagactgtgatgcatgtactttagcatcccctatggcactcagctaatgcctggcacaaagcagttattcaataaatatctgttgaattactcactgcctttaattgaaaaatggcattcatcagtcatggttactatttagaaataaacttgaaagtctgtgggcatactctggctctggaggctgc

SEQ ID NO: 266067 - DNA, 419 bp, Homo sapiens
aaaaaaagaatatacagtaaatactaggttttattaatgataccaggatttaaaggaagactgatatagagagaaggttcatttgtggtgtgtgtctttgtgagagatggagtagagggacaaggatcctttcacatctcatcccagatcatggtcaaaatctgtcctcaaattgtcaagaagtaacaatcatagctatgatttgaattcctgttacctgctaggcactttacttacgttttcttatttaatccttacaacaacctccttgaagtttataaatgatactgtcctccctttagagatgagcctccaagaagttacattacttgcccaggattataggtagtaagtattaaagccaggttataaactaaggactttataaccttgaaactacttatttatctgcttactac

SEQ ID NO: 266068 - DNA, 759 bp, Homo sapiens
aattatatggttcccacccccaacagagtataagttagtgaggtccacagatcattacagagtaaaacaatcaatatgtagttccatgtttggtggatactttgaagcaaacaaacagggtgcagtgatagaaaagacagaagaaagacctgcgcaggtaaggttaggtggtcaccgaagcttctctgaaaatgtgacatctctgaggaaggtggaacattaatcatctctagcagtgcataggccctctctatggcattgtcaactaagcactaataatagtcaggggacaacatgcagcgatagccaagagcatggatcttggagccaaagagatcaggttttaatctcagctctgcagcgctagccatgcgctagcttcatgcaggcttccttcattttaattctcagtgacctcatccaaacgtgaggattatcataaaaccaacctcatgaggctggtgtgaggatcaagtgctgccacttagagcaatgcctggcagtcgtttacttaataggcatttgtgtctacagaagatatttcgaaagagctgttatgaaaacaaggccacttgtatctgaagtatagaaaaacattgaaaaatacttgggaactgagaaaagcctgttttaggttgaaaaatagaaaaaaagtcaaaagaaaaatgccactattaccaccaataacaccaacaataataccaccaccaccaccaacaataatgccagcaacaataccaccaccatcacatcaccacc

SEQ ID NO: 266069 - DNA, 225 bp, Homo sapiens
tttttttttttcctttttattgaaacaaggtctctctctgttacccaggctgtagtgcagcagtagaaacatagctcctatctccctgccaaataacggcccaggtctggaacagttatttggttggttggcaaagagaacattgcaatccatgcttcagggaggaaggttgtgaaggcaacaatgaaaatgaatcgtctgctgggagggaggagggtgtaggga

SEQ ID NO: 266070 - DNA, 376 bp, Homo sapiens
ttctcagagaggagctggagccccagaccctgggagcctcacagatattcccaacacaggacctggttttccatttcccaaaatgatgcttcctccaaagatggccagtgactctctgtgccaagcatctgagaaactctccaggtcctagggctgccaggcagtcagctgtgcacatgttggagcccaaatcccatcaatagtgaggccctgggtaaaacacatccccacttttaattatgaggagatgcctggcctcagcattgagaacaccaacttccctcaagtgaaaacttatttaatctcttagaaatgatggagcacaccagcctgaacaacatggtgaaaccctgtctgtaataaaaacacaaaaatt

SEQ ID NO: 266071 - DNA, 375 bp, Homo sapiens
taggagtacataaatgagaggtgcaaaaagtggggtgcttggtgcaactggatttcttgtggacagcggccaggggtgggatgtgcgcattgcgtgggcacaggaatctcaatagctggccccagagcagaagcagagaaggtgtgaaggcctggactcttctgagcttgaggtcaggggatctacttgcacattagagttatttaaatgaggaaaatgcatgccctttttgaatcgatgttgtcaagcctttcttttcctaggagaatctttcgattcccagcatggggaaagcatgttttcaggtattaaaatgagtaaggttgtaacagttaccatgaatccacatgttgtgccccattctaaatcaagtat

SEQ ID NO: 266072 - DNA, 635 bp, Homo sapiens
ttagaaattttaagatattagacggttagacttgtctaatctcacatttatgagcagttttttacatttatctttgttttggagcttatgaagacttctaggccattggcagctgcatcatctcaggttttcttgtttagtggattaagaattcataatttgtttggtttttggtttcttgtagagtagtaggttgtcctctattactttctattcctcctaccacacagttgttaatcttttgttggtcatgctgctcttgatgacatagtcacattctagggtttggaaaattgactgttacctagtttttttgaaaatgtcacctgtgggcgtgggttctgttatgttggttttggtgctggctttttgttgttcgtttttgcccttctggttggagaaaattgagaagattttacaaatgtagtgcctccataatcacatcattgaaagtcacctttgtgtatttttattgtctgttatagagcatgttagttttgttggcatattctaagtcagagtatttataaatattagtgagactgtgcttcttcaaatgcagtttgggatagctcagatctgtaatggagttccacacagagtaggcttgggggtgtgtgggtgtgtgtgattta

SEQ ID NO: 266073 - DNA, 386 bp, Homo sapiens
ttagaaattttaagatattagacggttagacttgtctaatctcacatttatgagcagttttttacatttatctttgttttggagcttatgaagacttctaggccattggcagctgcatcatctcaggttttcttgtttagtggattaagaattcataatttgtttggtttttggtttcttgtagagtagtaggttgtcctctattactttctattcctcctaccacacagttgttaatcttttgttggtcatgctgctcttgatgacatagtcacattctagggtttggaaaattgactgttacctagtttttttgaaaatgtcatcgtattgaattcaacacaccacaatactatgtaacatttttaatgtggcaggggatcgtg

SEQ ID NO: 266074 - DNA, 486 bp, Homo sapiens
tggatcagtctcatcataatgttttaattatttgagctctgtaacattttaatgcctaataaaacaagtaatccctttctctttgtttattcatccagatgagatttaaaatcattttgatgatttctctaagattatgttgagtttctaaaacttggtttgtgttaaatctgttcattgatttggagactgacagatataaaagatgtaaaacttttttacatgttcatagccttctatgaagagtgtggaagaatcacaacaatgaagagaagatatgtttcttggggagcatgttcaatctaattcaagtagatacatggagtcgtgaagataaattctgatcacaccgcattctggtcatcattacctagttgaagaggtttattggagaagaactatcagtgttttaaagcagtggtcttcaaacgggggcacacaaagactttccaaggggggtacataaatataaatagttttaaggta

SEQ ID NO: 266075 - DNA, 378 bp, Homo sapiens
aattaatggtgaatgtggtatgagcctaatctatgcagtgggagatgctgtggacactccaccagtttgatcacaaagaattacaggcatgagccaccgtgcctggccctgcattcttaacaaatctgctatatgataaatttagatttcaattttgtgatcaaaactctttttttgctataaaatgaaactattgccctcttagcttcaaatatggtaatgtaggaggttggcatatatttggataaaattatgtaaacttaaaaaaaaacactttccacaataggatgttttaatattggttcagtttcagccataattaatgatttattttatgtcttttgttttagttcaaattagttcatcattaaaaaaaaa

SEQ ID NO: 266076 - DNA, 495 bp, Homo sapiens
aatggtgccatgtacagtttgtgtgtatacgttttgatgggttttaactttttatagtttttatatgttttatggtagtaaatgacaaaatgtgcatatattttatgcattcttgacatacctaactttttcttaattttttcagtatctctaggctatactgttcatctgtgcgttttttcaaattgtcacagatctccaaataattttctaataaattcattgaaaaaaatccacatatgagtgaacccatgcagttcaagcctgtattgttcaagggtcagctgtacatggaaaagatagttgagcaccatagatacgtgtgtttaataccctgcactgaagccacctacttgttccttttctgagcctcagtgttggcttcgtcttagcatatggttcctaataagtttgagtatctgaatactcagcctacagcagattagcagcaacagctctaagtatgttgttgggggccagggagaaaagaggatg

SEQ ID NO: 266077 - DNA, 407 bp, Homo sapiens
tgggtcaaggggaaacggactataaagtgggtcaagggagagtttatcgataggagattgaacaacccgcaaggacccagggaaaaagtgctgccctgatgttataagctgcttggcttggagaaaatggtggctgacactaagaagaaatgtcagaactgatgtgacagagggtggaggcaagaacaggaaagctcagagtgaggagactgctggagcaggtatgctaggtacccccaaatccactggatgcctctgctctgcgagagaggctggggacattcattccagcaatgaattgaaggaaggtgctagaagggcacccacatccctgcaggccaggactgagggtagaagatgtcatgacagaactgggccccaggtatcaaggaggatgacaaggtcct

SEQ ID NO: 266078 - DNA, 333 bp, Homo sapiens
ccaccctatgttaggggaccactgaaggggctttaagctggagagtgactccgccagatttgcatcctggaaagatagctctgacttagtttgcagaatgaactggcagagacaagattgtatgcagaaagagttttaggaagttgatgaagtagccttggtgagaaatgcagcggacctgaaccaagacagtgtcagaggccatcactcactttacattacattacattactttacattacagtgtaaaggccatcactcacttgtcttctgactgggctggcaggattcaagcagccggggctcctgtatcccttttctcgctgactctct

SEQ ID NO: 266079 - DNA, 173 bp, Homo sapiens
tcaaagatactgcaaattcagttccagaccaacccaatgaggcaaatatggcaataaaatgcatcacacaatttttttgtctcccagtgcatataaaagtggtttacactatactgtagtctagtaagtatgcaacagcattatatctaaattaagtacatacataccttaat

SEQ ID NO: 266080 - DNA, 569 bp, Homo sapiens
gtccatccaaaaagaaatacatgtgccttttgactaattaagtgattcttttaggaatatatcctactactatactcacatatgtgggaaataatataggtacaaggatattcattgcaatcctctgcataatagcaagagattagaagcattccaaatgctcaacagaggactagttaagtaaattaggctccaattatatagtaaaatactatatttagccagaatgaggctgctattttatgcactgacatggaaaatctccaggatcacatacacacacacagttgaacaaagcaaggtaagatcaatagatgtaaaaaaatactgctatttgtgtagaaaagattttttttcacagatggatataataaaactggctttttgcttaaaaacacagaatatccctggatttacacccaaaaaagcagtgaacatggttgcttctggggaaaaaaaaatagatggctagacagacgaaggagaaagcaatctgtgtggcatcccatgtatgtccattggccattcaaaaaaatattttaaacagtaaaaataagtcagtgttcttt

SEQ ID NO: 266081 - DNA, 980 bp, Homo sapiens
gaaggacggttttttatctgagtcaaaaggagaggaaatcggtaatgatacaaagagatttttgaggagaagcaaaattgaggtcctattactttagctcttagagcaggggttggcaaaccgtggcttgtgggccaaatctggcctgctcctatttttgtacagctcacaagctaaaaatggtttttatacttttcagttgctgggaaattaaaagaatgttttaaaaattgaaataatctgtgatgtgaaaattatatagaattcaaatttcattaataaagttgtattggagcacagccacacttatttccatacatattgttatggctgcttttccactgtaacagtggaattgaatagtttgcacagagactatatgtgaaattccgatggcttcacttttgctctgcccactacaaatttcagtaacttagttataacttgatagcatgatgagtaatatatacattgttatactacagtgggttttttttgaaattatgaattcatatatgacacacaagaaaaaagtgtactttgagtgtcatattttcaaggcacagtatagtatgaattatttcgttattgaattagatagtaaaaaaaactgtatttattatacaatgacactatagctatgttaaatggctatactacatatcagcattaccagattgagcactcatcacagaaaatcaacagtcaaaaaaattagaaaatttaaaatggaattctcatcacagcagaatttccgcatcaaaataaaaataaaataaaatgaggctgcaaccaaaataagttcctgagaggttcatatgttacccaagcaaggaaacctgtttactcatggtcattgcaacagccaaaaaaaatatgtccagagaaagtaaacttgtttaagattattagcttctcagtgagaacagttccttgaagagttgatggcattttgaacaacatggccaacttaaaataag

SEQ ID NO: 266082 - DNA, 429 bp, Homo sapiens
ttatgtatggtggaaggtatgaattattttatctttttccaaatggctaaccagttgttccagaaatagttattaaaaccttcatatttttcccagtgatttgagatgccatgtttatcatatgctaaattttctgatatactggtgtatttttggactttctgttgttttctactggtctgtctatccatacacctgtgctacaccaggctttctggtatgttctaatgtctcctagggctagccctccattgcagattttctttctcagggttttcttggctattcttgcatgtttatttttccacatgaactttaggatcaacttatctaattccataaaaatgtatgtagataattttattggtattgtgttaaatcaattttgggaaaagtgaaattttcatgatgttaaaatgtctttactaa

SEQ ID NO: 266083 - DNA, 479 bp, Homo sapiens
ggaggaggagggggaaccaggaaggcaggaaactggagcacttgagtacagcgttcctagctggagacgaaaggctggggatctggttcaatctaatagaaagttgcaataattgctatatcggtagccaactcttaagctagtggctgtggaattcttcccctgatgtaggatttaatagtctggcaattagatgcattgatttctcttaactgttcatttggatgtgtaaacgaaaggaacctaccactgaggctgatggtgcagacatgctccccggctctttgaaaaaggctgatttaggtggtggtggtgggagtatatgctttttcaaggcagtgttaggaccagttccctcttctttcaaaatttctgtccattctgtagtgaagtgaacggcacctgttcaaattctgtttaaaaataaaacaacggtatcccattatagctgaaaagtaaaaacatccttttctgccgca

SEQ ID NO: 266084 - DNA, 398 bp, Homo sapiens
gtcacctatgcatttttgatcatatccaagaaatcactgcccagaccaatgccatggaacttttccccatatttttattctggtaatattacagtttcatgtcatacatttaagtcttaattcattttatttttgtatatggtgtggacaagagtccagtttcatttttctgtatgtagatatccacttttcccaacaccacttattgaagagactgtcctcattccattgtgtgttcctggcacctttgtaaaaaatcaattaactataaatatatggggttatttctggggcctctattctgttccattggtctatatgtctgtttttatgctagtaccatgctgttttgatgaaaactgctttataatgtgttttgaaatcagggtaatgctgct

SEQ ID NO: 266085 - DNA, 342 bp, Homo sapiens
gtcgcccaggctggagtgcaatgccgcgatctcggctcactgcaatgccgcccgggttcaagcctcagctcctgcctcatttttagtagagacggggtttcaccatgttggtcaggctggtctctacctcccgacctcagatgatccacccgcctcggcctcccaaagtgctggggttacaggcgtgagccaccgcgcccggcctgtaatcatattttcaaaggtgcctttgactcttaaaaagtcaattgtttggggcaacccactcgggtccccttccaccctgtgtaagctttgttctttcgctcttcacaataaatcttgctgctgctcaaaaaaaaa

SEQ ID NO: 266086 - DNA, 348 bp, Homo sapiens
tctagttatggtgaaaataaaacaaggggaagatacatagcataatacaaatgctgaagatcactgttatgtacatgtcatgtatcttattcagtttaactctctttgaacaactttcccagacccacaccttggtagctgatgaaactgctttttgaaatgcaatagtggaagcagagaaaaaacagtgaagatgcctaaattgccgtttttcaaccctgagactaaggatcatttaacattgagtgcttaccacatatttttaaaagaggttcttttctctctatgatccagaagaatgtcctttaaaataatttctaattaaaagacatttttgttgctattaat

SEQ ID NO: 266087 - DNA, 404 bp, Homo sapiens
ctcatatctctgcaaaatatgatatttgcaaattaaaccacttggagataacatttttcacctctcagattggcaaagatcaaaaagtttgataacacggtgttgatgaggatatgaggaaacagccacttaaggggaattgagcaataacttatcaaaactctgacccaaatatcctatttctaggaatagatgatatatatagagagagagagaaagagagagagagaaatgcaaagttactgcagcagtgtaataacaaaaggttggaacttatttcaatgtccttcatcagggcactggctaaataaattactgtgtataaaatggtatgaaccataaaactagtccttttatactcttaaggaatgattttcaaaatatattttgtgtagaaccatatg

SEQ ID NO: 266088 - DNA, 727 bp, Homo sapiens
  misc_feature (720)..(720): n is a, c, g, or t
cgtgccggcctgagtcgtcatagccgacgtcgcttgttgatcctgcgactgtcgcgctctaaccgtcatcagttgtgacgcggaatccaccacgactttggctggttgcctgcctactagggaccgtgcgccgggattcgaccgcctggcttggaaaacaatggaccctactgatgatgtgttgttgccatggtaatcctgctcagtacgagaggaaccgcaggttcagacaacactaaaggacgagcctgatctcttatactagtatccttaatcatttttattgccacaactaacctcctcggactcctgcctcactcatttacaccaaccacccaactatctataaacctagccatggccatccccttatgagcgggcgcagtgattataggctttcgctctaagattaaaaatgccctagcccacttcttaccacaaggcacacctacaccccttatccccatactagttattatcgaaaccatcagcctactcattcaaccaatagccctggccgtacgcctaaccgctaacattactgcaggccacctactcatgcacctaattggaagcgccaccctagcaatatcaaccattaaccttccctctacacttatcatcttcacaattctaattctactgactatcctagaaatcgctgtcgccttaatccaagcctacgttttcacacttctagtgagcctctacctgcacgancacacac

SEQ ID NO: 266089 - DNA, 925 bp, Homo sapiens
actgtgtgctatgtacggtctatacaattcttcctgcaggttatcacagttcattagacttcaaaatgcgtaatcatctgtacgttggcacttgttaggctcttgtcagcattgctaactggcatgtcttattgcagcccagttccagccagtgttagccaacttgtacaaccagaagtccagcaataggtggggagtttgactggggcggtacacctgtcaaacggtaacgcaggtgtcctaaggcgagctcagggaggacagaaacctcccgtggagcagaagggcaaaagctcgcttgatcttgattttcagtacgaatacagaccgtgaaagcggggcctcacgatccttctgaccttttgggttttaagcaggaggtgtcagaaaagttaccacagggataactggcttgtggcggccaagcgttcatagcgacgtcgctttttgatccttcgatgtcggctcttcctatcattgtgaagcagaattcaccaagcgttggattgttcacccactaatagggaacgtgagctgggtttagaccgtcgtgagacaggttagttttaccctactgatgatgtgttgttgccatggtaatcctgctcagtacgagaggaaccgcaggttcagacatttggtgtatgtgcttggctgaggagccaatggggcgaagctaccatctgtgggattatgactgacctcagatttctgacattcgattcccaagaggggaaagcagtgttctggcactccagcacccatgtcctggggtcagcagctgtactattccttaggtgctgttctctgcagaggtccaagtacagtatatgctgttaccatgattcttcctgggaaagggagacatccgggctagagctgcctgtttgacgattccagaactacagcggatcctctagatacc

SEQ ID NO: 266090 - DNA, 1143 bp, Homo sapiens
tccagtatacctagccaacatggtgaaaccccatctctactaaacataccaaattaataggtgtggtggcatgtgcctgcaatcccagctactcgggaggctgaggcaggagaatcgcttgaacctgggagacaagaggttgcagtgagccaagatcgtgccattgcactccagcctgggtgacagagtgagactccgtcaaaaaaaaaaatagtaataataataataatatttttctcaataaactcccccaattttaagcaccacttcataaaagtggggggaagggattaacattacagctaaggggaagacttcaataccttaattttcctctttaaggaaaatctctaacaaatatcccataaaattttacctattatttaagaagctacttttataaaaggtaagaagacaatggttacatggtggtatcatataccaccaacgcaggtgtcctaaggcgagctcagggaggacagaaacctcccgtggagcagaagggcaaaagctcgcttgatcttgattttcagtacgaatacagaccgtgaaagcggggcctcacgatccttctgaccttttgggttttaagcaggaggtgtcagaaaagttaccacagggataactggcttgtggcggccaagcgttcatagcgacgtcgctttttgatccttcgatgtcggctcttcctatcattgtgaagcagaattcaccaagcgttggattgttcacccactaatagggaacgtgagctgggtttagaccgtcgtgagacaggttagttttaccctactgatgatgtgttgttgccatggtaatcctgctcagtacgagaggaaccgcaggttcagacatttggtgtatgtgcttggctgaggagccaatggggcgaagctaccatctgtgggattatgactgacctcagatttctgacattcgattcccaagaggggaaagcagtgttctggcactccagcacccatgtcctggggtcagcagctgtactattccttaggtgctgttctctgcagaggtccaagtacagtatatgctgttaccatgattcttcctgggaaagggagacatccgggctagagctgcctgtttgacgattccagaactacagcggatcctctagatacc

SEQ ID NO: 266091 - DNA, 786 bp, Homo sapiens
actgtgtgctatgtacggtctatacaattcttcctgcaggttatcacagttcattagacttcaaaatgcgtaatcatctgtacgttggcacttgttaggctcttgtcagcattgctaactggcatgtcttattgcagcccagttccagccagtgttagccaacttgtacaaccagaagtccagcaataggtggggagtttgactggggcggtacacctgtcaaacggtaacgcaggtgtcctaaggcgagctcagggaggacagaaacctcccgtggagcagaagggcaaaagctcgcttgatcttgattttcagtacgaatacagaccgtgaaagcggggcctcacgatccttctgaccttttgggttttaagcaggaggtgtcagaaaagttaccacagggataactggcttgtggcggccaagcgttcatagcgacgtcgctttttgatccttcgatgtcggctcttcctatcattgtgaagcagaattcaccaagcgttggattgttcacccactaatagggaacgtgagctgggtttagaccgtcgtgagacaggttagttttaccctactgatgatgtgttgttgccatggtaatcctgctcagtacgagaggaaccgcaggttcagacatttggtgtatgtgcttggctgaggagccaatggggcgaagctaccatctgtgggattatgactgaacgcctctaagtcagaatcccgcccaggccaactcgaggctgccgcgcgctgccgtatcgttccgcctgggcgtcgacgcggccg

SEQ ID NO: 266092 - DNA, 942 bp, Homo sapiens
tccagtatacctagccaacatggtgaaaccccatctctactaaacataccaaattaataggtgtggtggcatgtgcctgcaatcccagctactcgggaggctgaggcaggagaatcgcttgaacctgggagacaagaggttgcagtgagccaagatcgtgccattgcactccagcctgggtgacagagtgagactccgtcaaaaaaaaaaatagtaataataataataatatttttctcaataaactcccccaattttaagcaccacttcataaaagtggggggaagggattaacattacagctaaggggaagacttcaataccttaattttcctctttaaggaaaatctctaacaaatatcccataaaattttacctattatttaagaagctacttttataaaaggtaagaagacaatggttacatggtggtatcatataccaccaacgcaggtgtcctaaggcgagctcagggaggacagaaacctcccgtggagcagaagggcaaaagctcgcttgatcttgattttcagtacgaatacagaccgtgaaagcggggcctcacgatccttctgaccttttgggttttaagcaggaggtgtcagaaaagttaccacagggataactggcttgtggcggccaagcgttcatagcgacgtcgctttttgatccttcgatgtcggctcttcctatcattgtgaagcagaattcaccaagcgttggattgttcacccactaatagggaacgtgagctgggtttagaccgtcgtgagacaggttagttttaccctactgatgatgtgttgttgccatggtaatcctgctcagtacggcacccaaatagctgttgtctcgcagacacgacgactcacagccacgcagtttatccggtaagcgaatgaatagagtctagggagaaacgatctgggatgctctagagtc

SEQ ID NO: 266093 - DNA, 324 bp, Homo sapiens
ttctaatcattcgtgaagcgaggaatcaccaagacgtcgagatggttcacctacatactagggagcgtgcgccggtgattaaaccgtcttgattggaaaacccttgggcctactgatgatgtgttgttgccatggtaatcctgctcagtacgagaggaaccgcaggttcagacatttggtgtatgtgcttggctgaggagccaatggggcgaagctaccatctgtgggattatgactgaacgcctctaagtcagaatcccgcccaggccaactcgaggctgccgcgcgctgccgtatcgttccgcctgggcgtcgacgcggccg

SEQ ID NO: 266094 - DNA, 1474 bp, Homo sapiens
  misc_feature (199)..(199): n is a, c, g, or t
  misc_feature (264)..(264): n is a, c, g, or t
  misc_feature (1468)..(1468): n is a, c, g, or t
attaaatatgtgcaccaaaaactccccggcagtctgtctgcctggaacagcatttcagcccctcaccttggggctcttagttctttggagcctccatctgctgaggaccctgacgttccttgccagggtctgctggatctcacccccagggggtcctgccagtctggtgtttatcagagaaactgcccatacatcaacnggaggtgagaagggatgcttatggggactattatacagctttagtagtggaaaattagaggtttnaagctgtcatgctctgtctctgtgccatacagacctttctatataccctatacaacagattgaaacaatgaattgcattgtacttatttacaatagatcctaagttattgatgattaacctgtttttctaagtaaagtctagcccagctctattgcagcacctggtacctcttagaggctcaataaatacctcctgagtgagcgctctgtgttccatgccagatgcaaggtttagggacagcttaatgaggaaggactttctaatctggaggaaattggggagtcccttggcaagggtgtagcagaggcagtaagatgttagacagtcaggagacctgggatgtcatcctcaattcatttgctagctagatgcacttggaaatgcactcccttctctgattctcaagtttttttagtttgccaaatattaaagtaactcccatctgatggctctcttggatggtataagaataatagatgaggaagctactattcacctttcatgcaggagagaggttccattcatcatgtggagattggagttaagatcttacaatgcctaacaatcctggaattatcaaattctagttgctgtgcatcaaattgaatacattttagatagccataccatcatcataattgcttggagtgaatagataaaaattgaaaaaaatcttggtatattttctcatagaaatctgcccagggatcaaatgttaagcagggatttattagtggacacaatgtagtcagcaaagaggcagtagtattttgagaagcttcctggaggaagaggaactggaactaggtgttgaagggatgttcaggtttaaacgatggagtagaagtgaagaagttaatgaatatagcacttctgacatgtgccaggtgcttaatgtcatttaatcctcacaacatgaaagaggcaaagataactatcttctttttaatgtaagtactgacagtgtgccaggcaacagataagtcaatatgatacctgagatagctgccagggtaacacagagctcactctgaggacctagggacagctccaagagctgagacatgaacaaaaagtaggaattagatcagaaatgaagaaagagaaggaaagtaatgatcgagaaaagggtgccccaagccacgagggtaacatgagctatggcagtcggttgtgaaaccacaggaagtgtatgggggaacnaaaaaa

SEQ ID NO: 266095 - DNA, 242 bp, Homo sapiens
ttattattatactttaagttttagggtacatgtgcacaatgtgtaggttagttacatatgtatacatgtgccatgctggtgtgctgcacccattaactcgtcatttggcagtaggtatatctcctaaagctatcccttccccctccccccaccccacaacagtccccagagtgtgatgtgttattaaactattattaaacatgcagtttttaccattatactgggcactgtacagtgttacc

SEQ ID NO: 266096 - DNA, 585 bp, Homo sapiens
atcctctagagcggccgcctactactactaaattcgcggccgcgtcgaccacaaatttgtgagggggctgcccatcacagacccattaatccatgacactgggtaggcccacctaggattggactttcccaggactaaccagacaaaaagaatcgagcctttttgtctggactaaccagacaaaaagaatgacaaaagcccgctatggatgggacttaagacaaactctcctgaggtcttggcatattcagaacaaagagtaggctgcttaatatgttacatgtctcggagttcccagtcttttcaggctggccaccagacatgaccgaaaaatcatgtcccctagagggtggaaaccaagagcaggtattcctgtttggtcacaaagcaagctctcaaggatgtaaaataagatgagagggacgctttataacaaatgacacagaaagacagagacagctgaaaagctatttgtgggaggaaaaggatcagacaatatgaatattcatgttgaaaatacaccagaatttctacacccaagtcaagtcataccaataattttctcccattaatcaaaattttgga

SEQ ID NO: 266097 - DNA, 924 bp, Homo sapiens
aatcacagtgttctgactctaagtcccatattttccactatattagtttgtctctttgctttttacactctattgtatgcaaagtgatatcaaagaaaaagttgctgggtagaaagtattggctggctggtggcctcttacaatgcaaagaatatttagtatgtatttaaaatccaataattgatggtataaaatatttatctactatatactatgttaggcaattcaaataactcagaaatgattatgaaactgtctctggtttaatttagtagggaaatagatgggaacacaagtcactaaaaagcatttcttggacttctctcacatcctaaacgtgcttctacaatactctatatttaccacattctgtatacagaggagaatacagtatctgtaatataatgggctctcaatgaatatttgtcaaatttaaaaatgatgacagttaaacaaggattaaaatagtggggtggatgctgtgataagcattggatgccatgataaggatgcatgttgaaggtagcgtcaggaaatcttctggaagaaatgacttctaaattgatgaagcgttagctggatgaaaagcaagagtgttggtgttggaaggcagcgtacagaatgcataaagttttggagatgtgagacatggcaagtttgaagaacaaaaatttagtatggctaaagtttagagtgtcaagtgatgaatgagaaggtaggcagggtcaaggttagagccttattcaaaggaccctataagctgaatgtaaggagttttaacatttttcttctatgggaagtcattgaggaatattaagaaggttgttgccataatcaagcttacatttaagaatattgttctgcattgtgaaaattacattgaggaggaacaagactggatgtggggaaaagttggaaagccat

SEQ ID NO: 266098 - DNA, 620 bp, Homo sapiens
tcattgcccctatcttgaagacatcgagttgtctatgaaccttctgctttctccaggccgaaatattctttccttgttcacttccatttctttaagcgtgtgcttaaggcctgtgtttttggttctcgccgcctggtcattctttcacttcctacaattctggcttctttccccaatgacttctactctctattatgcttcttcccagcccactgaattaatcaccatgttctatctgtccttctgtactagtgtcttcaacatcctccctttcccactcatcacagacattaactttgaacaagctctccagtttgtgttattactgcagcctcttggtttctaatgtaccttgcaaaacacttcaaaattaatcttgctaaaatgagtttcatcacttgattcttctcttcaaaaatctttaaggactgtccatacttgtgagacacaaggcccaacccttcagtctgtgaagtcagtcaaccagcaattgtcctgtgtgcccagaagaatctctggaaaatggttgcaacttcctaccattcttgtttctaacctattcccaacaaaaccccctctcccagcaggaagtccccaccccaaaagctattgaggttaaa

SEQ ID NO: 266099 - DNA, 245 bp, Homo sapiens
acggcattgggaagcagaggtcctgtcctccctctgagcacagtcccggctcagcgtctgccccggagaggctgcaaggcaagaggagcagcggcgttaatctgctgagggctgagagaaacgtgagcgttaccctgggctggccccttggctgctctcccttactacggagctggaaggtggcccctgacttctttgcaaaggtatgaagcagacaaattaaaaaatcaacataatggaggaaa

SEQ ID NO: 266100 - DNA, 1058 bp, Homo sapiens
gcggccgcggatcctcgcgcgtgcagatcatccagacctccaccaacacctcccacaggcggatcttggagtagaggcctcgtttctgccacacatcacgcctgcccctcaccgccctctcctcaaactcctcccctccacgcccttcctgatcccctctcattcacttttcttaatgggtctcagcaattttgccaataaattcgactctaatgggggaagcagggtggataagtccaaacagcagatctctctttggagggcactggcttgcagtcagattcacagctaggcacattctcactcagaccccgctctgctggccctgctgctgttcctgctcccacctttttggaagatcggtagcccagggtgagcacaaacattccagttagaggcagaggctgcgtgagttggcaaggtagggagaagtcattgttatcattcctctgcctccaagtagaatgcccttatgccccagttcaagccactgcagctaagtattaatccccagtgctaaaagataccaggcatctagtttagcaatggagggaaacagaaacagcctgtagagagcatcgacaaggcgcataatggagagttggtatctcaaccccaagctccctttgctgtacctgggctgctctgtgaacaagaatccacgcccccctgccctgctggggaccacataatgatccctttgggggaagttgctgattgcagggcaagctagcttggtaaggaaaacctctgcaccagcggcctattcctgcctcttggtccatagcctcatacactcatgttgatggatagtatagatttgctgcccacaccagatatctgtaaggcatcactgtcctgattctgaacctctgtttcaggaagcattctcccctgtgtaaacaactcaaggtggaagtatttcagagggcatagggtcatgaatccttacccaaaggaagcctgttttagcagtggatgcaggagttgatgaacagacaagcaagttctgcttctgtcctgtttcctcctgacagctccattcttttgaagcctga

SEQ ID NO: 266101 - DNA, 537 bp, Homo sapiens
atctcatgatgtgtcttatcttaaaaacaaaaagttgtatcattctagtaataggcaaagaaacgaagactgtttgagtagtaatgagtagccagagtgcccagagtttcatatctaaatatctttttttatagaaataggtaatttcaggacaagtaatgtataacccttaaaatctcttataaaagaagacaaaacactacctaacactattaggatatattatatagactcaggagacaatatgaagaagttcttattggccaaatttgagattattttagcatcagtgagaatcttaacagtgatggattaaatatgtttaaaactttgaatttaaatggatactaaaataaaatccccttttgccttctttgaaggagagttcgggaaaaaaatcattatattgaaagtagagataaataattgagcatttttcctgtcttttctataaggtctgtttttcaagttacatgaatagttgataagatgatgttttccattaaatatattctagggaataagtgaatgtcacct

SEQ ID NO: 266102 - DNA, 410 bp, Homo sapiens
ttttttgatacggagtctcaccctgttgcccaggttggagtgcagtggcacgatcttggctcactgcaatctccgcctcccgggttcaagcgattctcctgccttagcctcccaagtagctgggattacaggtgcctgccaccacacccagctaatttttttgtatttttaataaagacggggtttcaccatgttggccaggctggtttcaaactcctgacctcaagtgatccgctcgcctcaggcccccaaaatcctaggattacaggcatgagccaccatgcctggcctcatatattgccttttatgaaatttattcccatgcatcttacttattgtgcagtaaaggattaaccttgcctaaaaagagatttggcctttgccctcaactcctaggaggtaacctcttg

SEQ ID NO: 266103 - DNA, 438 bp, Homo sapiens
ggctgtgagtgtctattaacacgtgcacttttgcttcacaaatggaggaaaaacctgttaatggtagagcctttggataattcaggcaaggattagactgaagatgaccttgactttggagataatgaaatttaattatgcaaatacaattggaacactgaaagcacataagtaaaattggttttgagcacccaactcactctttatgtggtgaccactggcgggattgtgatttaagctaggtaggctgtgggctattcacataaagagtatcagtgagactgtagttcttttcaaagatcttgttgatttctctgttcatgtattgcaaatgactgaagacttgttccatgttttctctctcctctagaagtgatttttaagatcttttaatgcctagggcatgttcattcattcaataaacagtttttgaggctt

SEQ ID NO: 266104 - DNA, 470 bp, Homo sapiens
cctgtatctacaaaaaaaaaatacaaaaatgagttcttgtgatggtgtgcccatgtagttagctacttgggaggctgaggtgggaggactgcttgagctcaggaggttgaggctgtggtgagcggagatcatgccactgtactccaacctgggtgacagagtgagaccctatctcaaaaaaaaaaagaaaagaaaagaaaaaaaaagaaaatgcttcttgactgtcaccaccccccagttccacaccgctcctcagtccctgactcccagcccctggcagccagcaatctgcattctgtctctaaaaatctccccattctgaacatttcctataaatgggattgtacactatatggccttttgtgtctggcttcttctactcagcataatgttttcaaggttcatccatgttgtagcatgtgtcggtattttgtttctttttatgagactgaataatattccattgtatg

SEQ ID NO: 266105 - DNA, 191 bp, Homo sapiens
gcaggtggaaatttaaaaaactaacaaatgggtgaggtggctcatacccgtactccaagctatgtgggagactgaggtgggaggatcacttgagctcaggggtccaaggctgcagtgagctacgatcgccacaggactccagcctggatgacagtgcgagaccccaattccaaaaaaaaaatagtaatggt

SEQ ID NO: 266106 - DNA, 296 bp, Homo sapiens
agaacactgagtctcagacacatgaagtaacttattgaaagtcctaatcagctcctatgcaccagtgcaggcaggtgaatccacagccctcgctattaaccatggggcagtactccctccacaagaggcattcggtttgcgaggagagcttagaggtttggaaagaagactcatacctccggcctggaggatcagggaggacttagccctctgagctggacttctggggacaggttggattttagcaggtgagtgtaataggcacaggagaggccctctaggctgaggggactgag

SEQ ID NO: 266107 - DNA, 338 bp, Homo sapiens
atgtggaggtagtagcacagagtctcggtccagggccctgttccccagggagctgggcgtcctcagagccttcccaaatgcccacaccgggggcacccgggtttccccaaacactccaggacagagcgggggctttgatcacagggagggggctgcagagctgctgtgtctcctggctcctctgccccatgctccccactcagggctccagcagtgggctcagaggacagtgtggcattagcatcccctgcccgtccaggttgtcactctccttggccccttgctgctccccagtggaaaaaaaagggggaaataaagaatcgtaaaaaatacatata

SEQ ID NO: 266108 - DNA, 634 bp, Homo sapiens
tgaagtcaaaagaacaatgaaataacaaactaagaactttgacaaagagatagaaagtataaaatagtaccaaatagacatcaaagatgtgaaaaatactgtaactgaactaaaaaaattcaatggaggtattcaacagcagattcaatgaagcagaagaaaggatcgatgaaatcaaagacaggtcactgaaaaaaatccaatctgagcaaaaagaaaaaagaatgaaaaggatagtttaaagatagtttatgagacctgtgggacaccatcaagtggacaacaaatgcattattgatatgtcagaaaaagaagaaataaaatatattcaaagaaattatgtcagaaaacttcccaagccttatgtcagaaaacttcccaagcctggggaaggagatagaaagccaaatccaggaagcccaaagaacaccaaataagatgaacccgaaaagatccacaccaaagcaagttataatcaaattctaagttagagagagttgaaaacagcaagggaaaagtgaattgtcatatgtaagggaaccaccctaaggccagcagtggatttcacagcagaaaccttacagatcagaagagagtaggatgatacattcaaaaccctgaaaggaaaaaaaaa

SEQ ID NO: 266109 - DNA, 428 bp, Homo sapiens
atttccggactagtcttgtcaacacattctttatctgtaggcttgaaatccttctcattttgccaggtggggctggatttagggagaccttgccaatgtattttgaaatattttctgcttgatattcaaatcaagatgttctcaactgcctgaaggatgggcaaggccacaaatttttatttatgcctcctctgacactgggatttacaaggctacctcttggttgaactgtgtgtctagtgaggaactgggagggagctgcagagccgaaggatcctgtgaccagcaatgagctttttctataccaggaaatgcaagggaagaagatatggtgattgaattgagtgtggcctgagcccagaacatctcttagaagcacttttaaaaaaaaatctgttaacaaataaatatttattgagtagcttatt

SEQ ID NO: 266110 - DNA, 586 bp, Homo sapiens
agaagggttgtgggcctgagagaggctgtgtctggggacagaaggtagcagagtgggaataaagatgtggccccagccaaggactttacccaagactcattgctttcacatctgggtatgtggaggagaagaaaacgcaacaaaatgtttccatttggctgaacgagagttttctccagacccacctcctatctaaagtgtcctgtcgccacacttgggccaatggcacttgtggtttgtgtgttatcacttctccactcggtgtggtcaaggagctttgcagccctgacttgtagcacagaaagatttattcaggccgcatccacaaagggacaggcagactcctaaagaatcaggctttgtaggcaaatgcagccctgcctgatttccagagacctttgtcccatgggataggtaagatgagcagaaaatctgaaaccagtggcttgaaaactgtttaccacagaatttcctgtatgggtcccatacgtgtacaacacacttattttgaaaattttttcttccttgctcttaccttgctgaaatcattgtttttacaataaagaaaaaaatcaaaaagtgttta

SEQ ID NO: 266111 - DNA, 1661 bp, Homo sapiens
  misc_feature (1298)..(1298): n is a, c, g, or t
  misc_feature (1366)..(1366): n is a, c, g, or t
  misc_feature (1383)..(1383): n is a, c, g, or t
  misc_feature (1393)..(1393): n is a, c, g, or t
  misc_feature (1395)..(1395): n is a, c, g, or t
  misc_feature (1442)..(1442): n is a, c, g, or t
  misc_feature (1472)..(1472): n is a, c, g, or t
  misc_feature (1478)..(1478): n is a, c, g, or t
  misc_feature (1492)..(1492): n is a, c, g, or t
  misc_feature (1510)..(1510): n is a, c, g, or t
  misc_feature (1520)..(1520): n is a, c, g, or t
  misc_feature (1529)..(1529): n is a, c, g, or t
ggggcgcggcctcctgtctgcaccggcagcaccatgtcgctcactgtcgtcagcatggcgtgcgttgggttcttcttgctgcagggggcctggccactcatgggtggtcaggacaaacccttcctgtctgcccggcccagcactgtggtgcctcaaggaggacacgtggctcttcagtgtcactatcgtcgtgggtttaacaatttcatgctgtacaaagaagacagaagccacgttcccatcttccacggcagaatattccaggagagcttcatcatgggccctgtgaccccagcacatgcagggacctacagatgtcggggttcacgcccacactccctcactgggtggtcggcacccagcaaccccctggtgatcatggtcacaggaaaccacagaaaaccttccctcctggcccacccagggaccctgctgaaatcaggagagacagtcatcctgcaatgttggtcagatgtcatgtttgagcacttctttctgcacagagaggggatctctgaggacccctcacgcctcgttggacagatccatgatggggtctccaaggccaacttctccatcggtcccttgatgcctgtccttgcaggaacctacagatgttatggttctgttcctcactccccctatcagttgtcagctcccagtgaccccctggacatcgtgatcacaggtctatatgagaaaccttctctctcagcccagccgggccccacggttcaggcaggagagaacgtgaccttgtcctgtagctcctggagctcctatgacatctaccatctgtccagggaaggggaggcccatgaacgtaggctccgtgcagtgcccaaggtcaacagaacattccaggcagactttcctctgggccctgccacccacggagggacctacagatgcttcggctctttccgtgccctgccctgcgtgtggtcaaactcaagtgacccactgcttgtttctgtcacaggaaacccttcaagtagttggccttcacccacagaaccaagctccaaatctggtatctgcagacacctgcatgttctgattgggacctcagtggtcatcttcctcttcatcctcctcctcttctttctcctttatcgctggtgctccaacaaaaagaatgctgctgtaatggaccaagagcctgcgggggacagaacagtgaataggcaggactctgatgaacaagaccctcaggaggtgacgtacgcacagttggatcactgcgttttcatacagagaaaaatcagtcgcccttctcagaggcccaagacaccccnaacagataccagcgtgtacacggaacttccaaatgctgagcccagatccaaagttgtctcctgcccangagcaccacagtcaggncttgaggggntnttctagggagacaacagccctgtctcaaaaccaggttgccagctccnatgaaccagcagctggaatctgaaggcgtnagtctncatcttagggcatngctcttcctcacaccacnaatctgaacntgcctctcncttgcttacaaatgtctaaggtccccactgcctgctggagagaaaacacactcctttgcttagcccacaattctccatttcacttgacccctgcccacctctccaacctaactggcttacttcctagtctac

SEQ ID NO: 266112 - DNA, 483 bp, Homo sapiens
acaatgttaaaatttttgctttcaacagttaaacgtatttcaaaagcaatgttatcatttctgttgctcttccttcattccttatgttccagatttccttctaatgttattttccttctgtctgaagaacttccttaagcagttttagagctgatctgctagcaactaatgctcttagttttcctttatttgaaaatgtcttggctgggtgcaatagctcacgcctgtaatcacagcactttgggaggccgaagcgggtggatcacgaggtcaggagttcaagaccagcctggccaagatggtgaaactctgtctctaccaaaactacaaaaaaattagccaggcgcagtggtaggcgtctgtaatcccagctacttgggaggctgaggcaggagaaaggcttgaaccaggacagtagaggttgcagtgagccaagatcacaccactgcactccagcctgggagacagagcaaaactccatct

SEQ ID NO: 266113 - DNA, 139 bp, Homo sapiens
gggaggggagcaaccaacattagtgtaaaccccagaatctgagcctgagaacagaagctctgatgtccgagagcaaacgatgacgtcccaactctagaacagagagcaaattcacttttcctctgcctttttgttctag

SEQ ID NO: 266114 - DNA, 613 bp, Homo sapiens
ttgggtcctgataaacccattatatgttgaaatattgtaagttgaaagtgccaatattttcagtgtaggattggtttatctggatgtattacttttgtaccgttataaagttgaaaaatcagaagacaaaccatcataagttggagacgatctgtattatttttgctttgtacagtgaataattgcttagatttactcacatagttaccattttgttacttttcattccctcctggatttccatgtttctatctgaaatattctcccttattctcgaggaatcccctttcgtatttcttgtagtgctggcttcctggtgaagaattctcagaatctttgcctgcagatattttttatttcgcctctacttttgaagaagcttttcactaagaattctaggttggcagtcactttctttttgtattttaaagatattattccattgtctgacttttattgattcttttgagaagtcagtcattagttttattgctgatatagtgaataataatacatcttttagtctcaggctgttctgttttttatattttattcccctgcctttggtttgaaacagttgtactatgatgaagttaggacttttttaaaattt

SEQ ID NO: 266115 - DNA, 261 bp, Homo sapiens
gagatggggtctcactttattgccgaggttggtctgtatctcctgtgctcaagcaacctttcccactgtggcctcccaaagtgctaagattacaggcgtgagccaccatgcccagcctgcatgaactttttatatattagaatattcacacattgttatctgttgcagagagaatctaacaatgtaatttggttttactttcatgaaataagtcaagattttccttttatgattaaaaagttaaatgtcaaccaggcgtgg

SEQ ID NO: 266116 - DNA, 294 bp, Homo sapiens
ggcccatgcaagcctcatttcaattcgtggtggtaaaatgagtcatctcatagaaaaagaagctgcctggcagttgcccctggggtgctcttgggcactttctctggtatctcgcccctgccccccaccctcatctaacctgcagcaatccctgcctaggaagtggtccaaatgacagtcattccacttgagaagtcaagtacaaaggaaccctaagtacttatatatacagtggggttttataaacatttactgagcagataaatcatctcttttaacagcacccaagatgca

SEQ ID NO: 266117 - DNA, 531 bp, Homo sapiens
gttttgttttgttttgttttgagacagggtctcactctgtcgcccaggctggactgcagtggcatgatcacagctcactgcagcctcgacttcccaggctcaagccatcctcccacctcagcctccccagtagctgggactatgggcatgtgccatcacacatttttgttgttgttttgagacagggtctcaaaaaaacaaaaacaaaacccaggcgagggcacggaacctttgtggatagcacggaggtgaacctactgtcacacacagaacggacagcccacaccccaacaccagtcattcctcactgctgccctgggaccaggacggaacgacggctacctggaggcagagagaggggcaatgccccacgcagctcccatggccagcagagctcgcaccttccacctcataacccaggcgtgtgcctactggtaagcaccccaggtgaccccagaccgcagagcatgcactcaggactcaagctggagctgttaccataaagggcttcccatcctccactgcggggca

SEQ ID NO: 266118 - DNA, 410 bp, Homo sapiens
gcggaggttgcagtgagccaagatggtgccattgcactccagcctgggcgagagagcgaaactacgtctcaaaaaaacaaaaacaaaacccaggcgagggcacggaacctttgtggatagcacggaggtgaacctactgtcacacacagaacggacagcccacaccccaacaccagtcattcctcactgctgccctgggaccaggacggaacgacggctacctggaggcagagagaggggcaatgccccacgcagctcccatggccagcagagctcgcaccttccacctcataacccaggcgtgtgcctactggtaagcaccccaggtgaccccagaccgcagagcatgcactcaggactcaagctggagctgttaccataaagggcttcccatcctccactgcggggca

SEQ ID NO: 266119 - DNA, 330 bp, Homo sapiens
ttaacagcctggccctacagaccgctgagtgaccaggactgccctgagccaccagttatcaccagtaacaggggatgacacacctacctcctggggctgttgtgagaattaagaaacactaagtaaggaaagcacactctcaggtatgcggcaggtagtaaagaaaggtagctgcccttccttgatctttctgtccatagcacctgtgcccactgaacgcccctgcatttatctgtggtatctatgccattgtacaaagcttcaataaaataatgataaaatacaattcttaaaaatcataaacaagagaaaccaaaaaaaaacagaaac

SEQ ID NO: 266120 - DNA, 404 bp, Homo sapiens
ccgcctgcctcggcctcccaaagtgctgggattagaggcatgagctgccgtgcctggtctgggaatggtcaaatgggcaacttcactccatcgtgcctgtgtcgaaaactccactgtcctggatgagagaaacggactcatggagcagtgaggaattcagtgggcctggctccagcaggacggtggctgtgggattcacctggctctgcagagcgctcctctgtttattttttataatctgcttttctgcaattctgggtcagagagagtgcagggttcacaaggaggtaggggtgtgtccagcagggagttgctgagctggacggaggtcgaagcgagaacggtctcctcttgctttttcagtttcgattgtaggggtcgctggcatgccctgtgggtttttt

SEQ ID NO: 266121 - DNA, 646 bp, Homo sapiens
attccgtgccaggtgccacgttcagctctctgcccacgtaagctcacttaaggcccccaacgaccccgtaaagcaggtgacgatatcttaactctgagtccataaacactttttatttccttaagaaaacatgctttacggtatcaataaacacggcgacttttcgcccttgacagtcaaactcccccttctccgcccatgaaccggccagagccaatcaaaagccccagacacacagaaccaggcagctgccaatgcaaaagctctccacccgccccagggcctggggattcccagaacaaacaccactgacactgacatgggccagaacccaggaagctccctccttctggcctccctgcagctagccacaaacttagcacctgtccgccctgggcatgaggtgctctgtccacagatactgagcaagcacccactacctgccaggcagcaggttctgggccacaagaggccataaccatgaggacgctccaatctgacagtctcttgttaaatgagataaaactccattcttcagtcccatcaggaatgctccatttcaagagctcaatagcagctaggcaaggcagctcacgcctgtaatcccagcactttgggaggctgaggcaggaggatctcttgatcc

SEQ ID NO: 266122 - DNA, 798 bp, Homo sapiens
gcaccggcaggctgcgaatggttttcttccatagaaacatttcaacaactgcctggccgtcatctaatggttgtctgacatttctcgtggtgaacgtccgagaagattcagtgtttggcagaagaaacctctgtcagacgtgaacgtgtgacagaagggccatccaggaagattgcacactgggcagaaagaagacttaagaacattgcatggacagcagaaggagtgcttcgggagattgcctggtgggcgccaggaacacctgagatgatgtcatggcaaacagtggaaatgagaggacacatattgcttgtctctgaacttctcagctgcctgcagatcttcctgtttttcagctgcagttagggtttgtctgaggagaagcataacatccctccaggccaaatgctccacaaataaatgtgttgaatgaatgaacaaatgaataagcgaagtgaatggaacatcaaactgcataaaaatatatttattcataaatgagaggtgatgattgccaacatatcataatcagactctgaccttggttacttatgagtttgacaacgaagaggaaagaggatcagaagaatttcagagtgagcagtgcgacatagaaaatgaatgtgaacatattctctgagatgtgaacatattctctgaggaaagtcatgtccttaaaggcagctatttattgtgatgcaagacttcaaaatacagttaataatcataaaagtcaactagctattatgaactctgcgtagttgcccataatctatccctgtaatgtatttttatatg

SEQ ID NO: 266123 - DNA, 782 bp, Homo sapiens
acacatgacactttctacagggtgctgtctatgctttgacagtaacaggacttttgggcagggattttccaattcattgtctaactcccactacaattgtccttcaccatgcacccggcaggcacttgaagtgctggttgagcactaaaatcttggaatgctacatagccattccaacgtaaataatcattgtttaaaacattttgaaagttcttttggaactgactttttagaatttttaaatatctcagtgataagtcttcactcttcaagttagatcgtattttattttagaaacatcaaaagccatacaaaaccaagcctgtatatttgtgcattctgtcttcttccccctcaatgctaaggaaggtttctttttcctaggccaaatgctccacaaataaatgtgttgaatgaatgaacaaatgaataagcgaagtgaatggaacatcaaactgcataaaaatatatttattcataaatgagaggtgatgattgccaacatatcataatcagactctgaccttggttacttatgagtttgacaacgaagaggaaagaggatcagaagaatttcagagtgagcagtgcgacatagaaaatgaatgtgaacatattctctgagatgtgaacatattctctgaggaaagtcatgtccttaaaggcagctatttattgtgatgcaagacttcaaaatacagttaataatcataaaagtcaactagctattatgaactctgcgtagttgcccataatctatccctgtaatgtatttttatatg

SEQ ID NO: 266124 - DNA, 415 bp, Homo sapiens
acaggcatatttttataccactattagaaaataaattttggcgatggtttctgaattgcctcatcagactaaaagaaagcaagagtgcttacaggccttcccattgagatcatcattcaccctatatgtttttgagtaccaagtgccctctctctagaagcttatgccctttaaataatatattcatataaatatagcatatcattattggataatgaattatattaatatgtagtgctaatttaatctttataacaacatagccaggtcaatatcataatactcattttgcagtcagagaatttaaagtctaaagaggctgcaactttctcaagatctgagtgctcccagcgatttgtgatgtcaacatcacacccacgtacttttgtggttggctctatgatagcatggtgac

SEQ ID NO: 266125 - DNA, 755 bp, Homo sapiens
ggggcggggccgaaggggccgggaccgccgccccagctcgaggacccgttagaccggcaaaccgcagtccctgccccgcgggcttcctttactttttgggagtggggggcggtttccctgctttttccaccacagcccctcctcccgccgcaatgtggctgatgctcataaaaagttgtattaaagagctgactgcagccgagaatcgatcaacaaaagcgaccagcctctctgggtctatccacggccttctcaacagatgacttcaagttgatttcgtgctttatttcttaagaatagtgactaacctaagggatctgattcaatttattaggaacacagtgccaccttccaaaattacttacctaagaggactgagcctgctgtccctggagcagttagctaaaacagtgcctcagtacggagcgtacctgtgttaacttctagagtgctgtttccggcagctgctgaaatccacgctgaggttatcaagctcatcctacaaaataaagcaagttcttcgcaatttaaagcaaaaatctgggcttatttttagggttttgggggatgtgaaagttgtcttagataagattccaggaaagctaagaactaacgatgcaattacagtcacctttcaacaactttggggattgggttgaggaaggtgtgaaattgggaaatataataaaaggtattatattagtgactttctagagtagcccttggcagtcctgtctttaaagagtaataactgg

SEQ ID NO: 266126 - DNA, 330 bp, Homo sapiens
gcgaggggcggggccgaaggggccgggaccgccgccccagctcgaggacccgttagaccggcaaaccgcagtccctgccccgcgggcttcctttactttttgggagtggggggcggtttccctgctttttccaccacagcccctcctcccgccgcaatgtggctgatgctcataaaaagttgtattaaagagctgactgcagccgagaatcgatcaacaaaagcgaccagcctctctgggtaaaatagctgtgcgtttttcagggcactggaattgatctatacggatcagaaagaccgacagcccgctctcagcagcctcttggatacg

SEQ ID NO: 266127 - DNA, 438 bp, Homo sapiens
agatggagtggtaaactctttctgggacattaggaaagacttcttttaggaggtgacctaatgccattagcataaaatccaaactcttcccaagcctaccaggccctgtgtgatctatcgctgcctatttcactctagcttcatcttatgcctctcttgtccacgcttactgagtgctagtcacatgaaacttctttaagtttcaggaaaactctatatttagatctgtccaatatgatagtcattagctgcatgtggctgttgaacatttgaaatataactagtgcaaattgagttatgctatgcatgtgaaatatataccagattttggtaacttagcacaaaaaagaatgtaaaacattccattaataaggcttttatatcatatggtgataatattttggatatattcagtaaaatgaaatatatcattaaaat

SEQ ID NO: 266128 - DNA, 842 bp, Homo sapiens
agcatgcgcctgtttgctcggtgctgttctctcgataaatcacaacaaagcttccagagggagaggaaggatggacggcaccactgcccctgtcactaaatctggagctgccaagttagttaagagaaatttccttgaggcgctaaagtccaatgacttcggaaaattgaaggctattttgatccaaaggcaaatagatgtggacactgtttttgaagtcgaagatgagaatatggttttggcatcttataaacaaggttactggttgcctagctataaattgaagtcttcctgggccacaggcctccatctctctgtcttgtttggccatgtggaatgtcttctggtgctactggaccacaatgctacaatcaactgtagacccaatgggaaaacccctcttcacgtggcttgtgaaatggccaatgtggattgtgttaagatcctctgtgatcgtggggcaaagctcaattgctactccttaagtggacacacagctttgcacttttgtacaactccaagttccattctctgtgccaagcaattggtttggagaggtaagcctttctgggtggccaacattgttgtctgcttgtacactcatggtttcaagactttgtgacccctacctaccccagatgatgtagtaagcataaagatgcaattatgcctagtacagaaggccctaaaaaatacatagttctgttgattcaggtaattcaatgatgatcacattaaaatcttattatctaatagcaggaagttcattcatttactcatttacttaacaaatatttatttagctcctattatgcatcaggtaatgcactaagtcaatgaaa

SEQ ID NO: 266129 - DNA, 1917 bp, Homo sapiens
agcatgcgcctgtttgctcggtgctgttctctcgataaatcacaacaaagcttccagagggagaggaaggatggacggcaccactgcccctgtcactaaatctggagctgccaagttagttaagagaaatttccttgaggcgctaaagtccaatgacttcggaaaattgaaggctattttgatccaaaggcaaatagatgtggacactgtttttgaagtcgaagatgagaatatggttttggcatcttataaacaaggttactggttgcctagctataaattgaagtcttcctgggccacaggcctccatctctctgtcttgtttggccatgtggaatgtcttctggtgctactggaccacaatgctacaatcaactgtagacccaatgggaaaacccctcttcacgtggcttgtgaaatggccaatgtggattgtgttaagatcctctgtgatcgtggggcaaagctcaattgctactccttaagtggacacacagctttgcacttttgtacaactccaagttccattctctgtgccaagcaattggtttggagaggggcgaatgtgaacatgaagaccaacaaccaagatgaggagacgcccttgcacacggctgcccacttcggcctttcggagctggtggccttctacgtggaacacggggccatagtggacagcgtgaatgcccacatggagacccccctggccatcgccgcctactgggccctccgctttaaggagcaggagtacagcacggagcaccacctggtctgccgcatgctgcttgactacaaagccgaagtcaatgcccgagatgacgactttaaatctcccctccacaaggcagcctggaactgtgaccacgtgctcatgcacatgatgctggaagctggcgccgaagccaatctcatggatatcaacggctgtgctgccatccagtacgtgctgaaggtcacctccgtgcgccctgctgcccagcctgagatctgctaccagctcctgttgaaccatggggctgcccgaatataccctccacagttccataaggtgaggctctgcccagtggtcagcaggttgaggaagattcaaatggcagccttgtctgaaatctccaagtaactcaagcttgcttgaggcttgagtcctgggctaactacctctgatcctctttgaccttccattacatacctaatcctagctgtctcctcatctcatcctagtctaggtttgcttgaaattgggtgtgagagctagaatgagaaaaagagtagcaaataatttgttttgccttgtgtgaacaccagtgcactggtggcttcctgagggactgaggtaagtctgccagaaaggtgaatagtgttagacaggcatacatttgccatcttttaaacagaatgactgatctaaagatgactcagcctgctttgaaattagcttgtagccatgaaagggccacccgattttccagtttaatgaaagctaacgtttattaagtactaaaattatatttattatgtataataaataagcacactgttataagcaaaaaaaaaaaaaaaaaaaaaaaaaaaaaaaaaaaaaaaaaaaaaaaaaaaacaaaaaaaaagaaaaaaaaacaaaaaaaacaaaaaaagaaacgaaaaaagaaagaagacgcaaaacaaacaaacaaagaaccaaacacagaacgaagaacaaatacagcaagaacagaatgcaaggaagaggagcggcccagagagaaaagtaagccgaaggcgagagaagacgaagaccccccgcacacgcagcccgactgccagagaaacgaggagagagacacagtagaaaaagagaaacacaaacggagggagggcacagcgaaaacaggaggcaggaggaagcacgggaggtaagagaaaagacagatgcgaaga

SEQ ID NO: 266130 - DNA, 1351 bp, Homo sapiens
agcatgcgcctgtttgctcggtgctgttctctcgataaatcacaacaaagcttccagagggagaggaaggatggacggcaccactgcccctgtcactaaatctggagctgccaagttagttaagagaaatttccttgaggcgctaaagtccaatgacttcggaaaattgaaggctattttgatccaaaggcaaatagatgtggacactgtttttgaagtcgaagatgagaatatggttttggcatcttataaacaaggttactggttgcctagctataaattgaagtcttcctgggccacaggcctccatctctctgtcttgtttggccatgtggaatgtcttctggtgctactggaccacaatgctacaatcaactgtagacccaatgggaaaacccctcttcacgtggcttgtgaaatggccaatgtggattgtgttaagatcctctgtgatcgtggggcaaagctcaattgctactccttaagtggacacacagctttgcacttttgtacaactccaagttccattctctgtgccaagcaattggtttggagaggggcgaatgtgaacatgaagaccaacaaccaagatgaggagacgcccttgcacacggctgcccacttcggcctttcggagctggtggccttctacgtggaacacggggccatagtggacagcgtgaatgcccacatggagacccccctggccatcgccgcctactgggccctccgctttaaggagcaggagtacagcacggagcaccacctggtctgccgcatgctgcttgactacaaagccgaagtcaatgcccgagatgacgactttaaatctcccctccacaaggcagcctggaactgtgaccacgtgctcatgcacatgatgctggaagctggcgccgaagccaatctcatggatatcaacggctgtgctgccatccagtacgtgctgaaggtcacctccgtgcgccctgctgcccagcctgagatctgctaccagctcctgttgaaccatggggctgcccgaatataccctccacagttccataaggtgatacaggcctgccattcttgtcctaaagcaattgaagttgtagtcaatgcctatgaacacatcagatggaacacaaagtggagaagagctatccccgatgatgacttggagaaatactgggatttttaccactctctctttactgtgtgctgtaactctccaaggactctcatgcacttatcgagatgtgccattagaagaacattacacaacagatgccatagagcaattcctttgctttccctcccattgtcattgaaaaagtacttgcttttagagccagagggaattatttattaa

SEQ ID NO: 266131 - DNA, 1863 bp, Homo sapiens
agcatgcgcctgtttgctcggtgctgttctctcgataaatcacaacaaagcttccagagggagaggaaggatggacggcaccactgcccctgtcactaaatctggagctgccaagttagttaagagaaatttccttgaggcgctaaagtccaatgacttcggaaaattgaaggctattttgatccaaaggcaaatagatgtggacactgtttttgaagtcgaagatgagaatatggttttggcatcttataaacaaggttactggttgcctagctataaattgaagtcttcctgggccacaggcctccatctctctgtcttgtttggccatgtggaatgtcttctggtgctactggaccacaatgctacaatcaactgtagacccaatgggctctgtgatcgtggggcaaagctcaattgctactccttaagtggacacacagctttgcacttttgtacaactccaagttccattctctgtgccaagcaattggtttggagaggggcgaatgtgaacatgaagaccaacaaccaagatgaggagacgcccttgcacacggctgcccacttcggcctttcggagctggtggccttctacgtggaacacggggccatagtggacagcgtgaatgcccacatggagacccccctggccatcgccgcctactgggccctccgctttaaggagcaggagtacagcacggagcaccacctggtctgccgcatgctgcttgactacaaagccgaagtcaatgcccgagatgacgactttaaatctcccctccacaaggcagcctggaactgtgaccacgtgctcatgcacatgatgctggaagctggcgccgaagccaatctcatggatatcaacggctgtgctgccatccagtacgtgctgaaggtcacctccgtgcgccctgctgcccagcctgagatctgctaccagctcctgttgaaccatggggctgcccgaatataccctccacagttccataaggtgaggctctgcccagtggtcagcaggttgaggaagattcaaatggcagccttgtctgaaatctccaagtaactcaagcttgcttgaggcttgagtcctgggctaactacctctgatcctctttgaccttccattacatacctaatcctagctgtctcctcatctcatcctagtctaggtttgcttgaaattgggtgtgagagctagaatgagaaaaagagtagcaaataatttgttttgccttgtgtgaacaccagtgcactggtggcttcctgagggactgaggtaagtctgccagaaaggtgaatagtgttagacaggcatacatttgccatcttttaaacagaatgactgatctaaagatgactcagcctgctttgaaattagcttgtagccatgaaagggccacccgattttccagtttaatgaaagctaacgtttattaagtactaaaattatatttattatgtataataaataagcacactgttataagcaaaaaaaaaaaaaaaaaaaaaaaaaaaaaaaaaaaaaaaaaaaaaaaaaaaacaaaaaaaaagaaaaaaaaacaaaaaaaacaaaaaaagaaacgaaaaaagaaagaagacgcaaaacaaacaaacaaagaaccaaacacagaacgaagaacaaatacagcaagaacagaatgcaaggaagaggagcggcccagagagaaaagtaagccgaaggcgagagaagacgaagaccccccgcacacgcagcccgactgccagagaaacgaggagagagacacagtagaaaaagagaaacacaaacggagggagggcacagcgaaaacaggaggcaggaggaagcacgggaggtaagagaaaagacagatgcgaaga

SEQ ID NO: 266132 - DNA, 641 bp, Homo sapiens
tctctgcaggaagtatacacagacagctcacaaaaacaggaaagtcactcaggaacctggtttaaaactcctggtctgaactcatgaaattgccctgaagtcatagagagtagataccacaaattagaagtcaaatgaagagcatagtttttttcatacttcaactggtacaattctgtactttcaatcctgtgaaggcagatctagagagacttattaatagaactttttacaccaatcccttcattttggggataaagatacggagaacaaagttagataacatctagtgtttttgcctgctcaaatccatttccccttctggtaacaacccatcccatggaattctgggggctggactctttcccgactcaaggtctttttagtgtagagaggggtgatctcacctccagcttcaggggtgggcatgtatcaggcacggacaaacagggtcacattaacgcactcactgacaggtatgcgggagatctgaattgatttagtacagaaggaaaactaaacccaagaccacacagttaatgccaaagctaggactatagcctgagtctcccacctctaagaccagtgatcttttcatgctaccatgccacaaaacatacataagttaaaaaaaagttctt

SEQ ID NO: 266133 - DNA, 423 bp, Homo sapiens
aaatgctacatttctgggaacataaaagcatttgccaccattgacaatttattttacccaaaggaaagtagccacaatataatcatacattccttttggaaaaaaaaaaagactaagatgtttcagagatcaaaagctcaaaagaccaggatatccattgtcatactttataaaatttctgggtagtaaatgactaacttttctgttaatgaaaagtttacctgaactaaaactttactccaaagtacagcacaattaataaaacactgagagaattttagaagtcattttaaaaggtccatcttagaagatacaggtggaaatcaattaatacttttttggtactggcaatatagttttcttggcataatatatttcatcagaaattgccaaggtttttaagtatgctagtatctaattaaa

SEQ ID NO: 266134 - DNA, 417 bp, Homo sapiens
caggactatgttggcaaaataaattactttaatagcataataaaaaacaaccttgttaatttatacgtgcataacctttttgttgagagcataattgatgagtcttgttgctatcttctaacaggccattctgatgggaagggttggtaggattgggtaagcaagaatttgaaatcatcatccaccagctgaacttttttatttagtgattaatttatttaattctaaatgtagtgtttgcctccactgactccttcataaataatttgtttaaactaattagagtaataaattagatttaaaaaggtaaatgtattcaacatcaatgtataaatcagtgaagaaatgtggataaaatagatttggaattaatttaagaaaccattagcaaaagaaataagatcaagatggataaat

SEQ ID NO: 266135 - DNA, 446 bp, Homo sapiens
ccaggtggaccctgagccaggccgcatccagtggggagccctgcatgggcagcaggtgaagccccttggagatgcccagggatccaaaggcgacatcattgatggcaaggctgcccttcttggtctctgggtttgccaccactctggcttggagacaggtgctgcagccttcccaatgctgggctcactctggactcgtcatgaagtgctttctgccagggcaccctggttggaagtttagaagccctaaaggacagctacaattgtggcagctgtgagagagcagctgttgttgatccacacacgggccagaaggtttattccgagaggttctggaaatctgctgggagggatgactcccttgtgtggggaacacactcagatagttgcatattcactcatctacaccacaccatgaataaaacttagattccagattttaaaca

SEQ ID NO: 266136 - DNA, 463 bp, Homo sapiens
tgctttattctacctcggggctggtgttggaatccaggatgccagaccctaaagtccagctctctttccaacctactgaataatccgagagaaatcatgttctctctctgggcctcagtttgcccatgtataaaatgagatgaaggattggctgggatgctctccagagtctcttcctgcctggagttctgacgtagccatgtactcctgctcagcatcgctaaatggctttgtggtaggaccattgagtgctgcctccattagggccagctatgtaatgctggggtggctgtcactgggccctaagagccaggattggtcttactggagaaatccacatccacctaaacttaagacccaggggtgtccaatcttttggcttccccaggccacactggaagaagaattgtcttggaccgcatataaaatacactaattatagccgatgaggttaaaaaaaaaa

SEQ ID NO: 266137 - DNA, 538 bp, Homo sapiens
aagaaaggacggcagccaagccagtgcctcctgtgctccggctctggggccctggacacacctggggattcagttttgcatggaccagcattctccaagcgctctgatcagtcttacaggagaagtaggctgtgtggtctgggagccttgagaaggttccgctgtaatctgtcagacttttggacaggatttttctgccttacgtggctgatgtacgtctgcaggagggtagcacacggcaccctctcggcctgctgtgccacaaaacctttgcttttacaggtctcacggagccagtgggctgcccaatgccccagtgcagagtggagacgaggtcttcccctccttcccagcttgcctgggcggcgacgcgtctcagagacctctgccagggtcaatcctggcccatgctactagctcggggtgtgaagtcacagttgatgctgaacacctggctgggccagacttgtgcccaagaaaccttataccaccaactggttttcaaaagaaaaaaattaaaagtaattcaaaactttga

SEQ ID NO: 266138 - DNA, 338 bp, Homo sapiens
tgttaacagcagtgggaacgtgttactgttagaatatcactgaaggcatctgtttcatctctgaaactcccctactttatcttctacctctgcatcaccattactgccacccctctagactacgcaagcatgatcctttcccagggtaccataatcagcttctaaaagtcttcatggcatggcgatctcaggggaactgatgctagggaggatgggagaccagctcagtgacaattgctgttgtccctgggtggtagcaggggaagtggtgagaggtggttagattctcagtctgttttgaaggttgccaactggattggctgatggaatagatgaag

SEQ ID NO: 266139 - DNA, 572 bp, Homo sapiens
gagattatgttttatccattttagtattctcagcacagggcctagaatcttgcaggcacttagtcattaaggaatgaatactagggatgagattagctgttcttgggaatgcctctggctgagtacccagccaacattatgatcttcacaatctgtgtggcttgctaatgagacatggtcatttcttatatttcatcggagtacagccaccctaaagcttatcaatgaaaaataatctgaaatgagcatcgttagctatataaggtcaaggtctgggtctctcatgtctgctactgttcttgcatatggtgggcacttaataaattggatacattttgctgaatgaatgaaagtttgaaatgaagaaaccatcataaaacaaatataagtgtgatgatttttaggaaatctagaaaacaaattgttcccagtatcattcccatcctaccttagaggaaaaaggctaatactagaccacctagtattgcagccttcttaactcctttgtttagcgaggtctgagttcttgtcccatgaccaagaagaaggcaagcagacaccagagagtaagt

SEQ ID NO: 266140 - DNA, 510 bp, Homo sapiens
caatgtacattttttccctaaatatttaactgcttgacaatttgttcacttgacaatttaaccactgcacagtttgttcagataagctttcctttcccctgctcatttatttaagatgtctgtcttatcctacactgattaacaatctcttattcacaattctaaaacccaaaaggttccggcaaccaatttttttcccctagatttaacatcagaactcattctgtggcaaacctgacctgaaatgacacgaggctacttaacagtctttatctcatttatagtaatgttgattagtctgctgttccagactcaactggggggcatatggtgcatacatttgagttattttttagaaatccaaaatattctgatttatgaaccccagctaaccccaaaggtgtgtatgatcaaagattttggacttgtattaaatgtacacacatatatacacactatatggtatgtgtatcgtctattctgtgccactgattaaatcattataacttt

SEQ ID NO: 266141 - DNA, 409 bp, Homo sapiens
gcattatgaagcttatcaaggttatgtataatttatctggcttgagtaagtccctttattttgtgcacaatcaaaacatgattagggagaaaaattaggaaatgttttaaacattttagcaaataatttctaaatttagaaatgtagtgaattttacatttctagacaaatatcatcaaattactaagcctttgtaaatcagcctatgtttagaaagagagtaaaaatgttagatgaattcaacacttaattttttccccagagtttcatcttaaagagtattaattgtaacgatgctgatggtgttattaacagagtacttatgaatatggaaaaatgtcagacttccaaataatctgagatatgctatttttacaagtcacactaaataaacaatctagacaaaatt

SEQ ID NO: 266142 - DNA, 2278 bp, Homo sapiens
  misc_feature (1322)..(1322): n is a, c, g, or t
  misc_feature (1900)..(1900): n is a, c, g, or t
tctttatgctttcggatttctaaatgagagagtcatccagaaactcgaggggtggagagcatttgtcagtgactgtcctttggtccccaaggggctcctcagtgggtttctcctgagggtctgtgactactctcctgtcacagaagctgctcctctctggcactgtcttgtccttctccactgacctctgggattgactatccttctcagcaggggtgactgtgacactcctggctgttccttctcagtcttggctggtccttcactcctagctggtccttctccacaactgggacactctgctatgcttggttttgaactagtgacagcctctcccttccttttcggcattgatttccctggatgccctggttagcctccaggtagatcattgtggagccctgatgtcgaagtctatccgtcttccttttctggaccttgttgggttcctcagtcgtatcattctgactctcagcttcagttgcaaattaagagttcatggaattacgagaactatctttggaatcagccttaaagctgcaggcttccttttctagagaagctatttcttctagaaagggattggtaggatgtggaggggttccccctgacgaaaggaatccctgagtgctctgaatcaggcagcctttggtggcggccccgcccacacctgtgcccgaggaatgccggggaggaatgtaagagttaaagaaaggaaagaaacaggaaaagcggctcaacagtcaaagacaggtttgttttggacaataaacctgagagggccttctggccgagttaggtcagagtcactctctcttacaggctaagagtatttaagggttcagggcagaagaggttatcacaggcttggaatgtttctgtatctcttcgccttgcttatctgggagggggaggttttgtgtctgttcccatacaactccctgcagctgcagggataccccccccacctcctagtctgcttttagcttgtctatcttagcgcatttaaagggaaaggaatgtgcttattagggcctacttttttactggggcccatttttgggggcccatttacactcccaaaacatgagtgtgaagttcggtggttacccaagagacttgggtgcccagctgtgcccagctgtcttatctgtgttttactgtctactctttctggctgctttttgttagaagtgatttccttgaaacgtaagaagttagaaagggagctggaactgaaaatgggggtgtttgtccaagatgacggtgctcctgctctgtcattccagaccctatagttataaaaggaccaggggcgacgngttctttctggttacttcctgctgggtgggagaggtagagagtcccttggtctcggattgactgcgggagcaatgccgtctgtagatgttttggatagttgtctgtgaaatagccatgctcctgtcagttaagaatctttgaaaaaggttaattaggcagggtaaaaacattagtcctaggcttattattaggagagggcccaggaatgggatgacccatggtatgctttttgttcccaaaccaataattcatttggttgttttggtattcgcttagcattttagccctttgtttgagatttttagcagcctctcttacgagacctgattggttgagatagaagcaacatttctttcccaatgagaggcagaggcacatgtttggaaagacccatgtgttattttttattagtaactgttattcctgctgtaaggatagtaattaagcaaaatgctacggtaattgagattgtctgtctgatatcctaccctcagggtgctgcagtacatagtcctactgcaaatagtccagtaaagcagttcccgcaagggtggcatggtaaataatttccataaanaagctttaatatttggcttaaaaggagaggtagaaatgacaaaaagtacttggtgaggtaagagtgagactgagtcagatgagtaattgtcactcagttagttattttttatgattttcaacttaagatttcttatttctttacattgatatttaggacgttcctctgggctgttgggattgcttcctcagcttttcaggctttgacttgagtgtgatgtatgcaggggttgattcctgtaacagatgtaatttaaactgtcgaaaaccataaaaattgaaaaacatcagtcaagactagaatttaacaggtgtgctatagtttttgaaacctaattttctctctccagtttaccatttttattaaaagacaaatcat

SEQ ID NO: 266143 - DNA, 388 bp, Homo sapiens
gcacaaatgtgtaaatttgtcaaaactcgttgagatatacatttaaaatgggacatttttattacataaaattgattaaaatcaatgcatttttccccatataaaaggaaaaagataaaagagtttgcctcctgcatgtgaattgctaccacctccgtggaggataactgacaatatctactaaaattgcaaatgcgcattcctggtgccctgccaattccacattgtctgtaatggaaaaggattagaaataacctaaatgtctgccaatagggaaccacttaaataaattatgaggaattcatactctcaaaatatatgcagttacacaaatgagtgaagaagcttttgtgaaagttgtcagaatcataatcgagtcacttgagtt

SEQ ID NO: 266144 - DNA, 459 bp, Homo sapiens
taaatatcctaagacccactaaggaagtttgtggcaatatttgctcaaagacagtatatataataaatactttagactggttaagagaatggctctgaatgtctacctagctatcacatttagaaacgccccttgccttccttccaggactttcttccttaatcaggattgacttaactgttaactcctagaactgtcgttgattgcttggtgaagtaacaattagtatagacattcagcaactggcctcccatactgtgattcactgacccagactttgacatcttgggctcagccataccctggagcctccaaatcctctgctggatcctttaagtccagacatctgacaggggaagaaaaagtacaagtttccaaggagttattataggtcaagcctggaagcagtgaggtcacttccacctgcttcccattggccagaattcagtcacatgatca

SEQ ID NO: 266145 - DNA, 453 bp, Homo sapiens
tgcagtagctttcacagagggagggaatagaagacagatggaaggaactggccttcctgctaccaaaaactggctcttaaataatttgtacttaccagcctttgctaccaactcttgaatttcttcctgagcgctttgctaagctaccaccactacaatgtgtacagggcatcaggcatagggtagatagaggaggtggagaaaagagtggggtttggcacaaaatgctcaagagtctgtttaggctcttactcacgggaaatgaactaggagacccagaaaacaggaggaggttaagggtggaagtggtggagggtgatagcacacatctgcctatacccacataccggaattacaggtagttgaattagtacctttaagattgtatgtcatgaatgataaaatactgaacaaagaacatgactacatatatagtaaaacctaagaaaatac

SEQ ID NO: 266146 - DNA, 493 bp, Homo sapiens
gatgaacaggaattcagcagagggtcgagggatgagaaatcttaaaaatttaatttgtatttttggtgtggagaaatggaaacggtctagaatgtagggcagttgtctgaaaaggtctagagggaccaaatagctgggagaagtttgccccaaatggttaaggtgggtgccaaggtgccaccttctctgacctcacagttccccagctcagctctgatccccagggaccaatgaggtgccaaagggtaagggctctttggaaggaattaacgaggctgggagaaaaatagagaaatgatgggggccccttacaagagaacttacgagtataagaagaaggcagtggggactcaaaactgatcaagtcatttggtttatatgcaagtgccctcagggccactgaggcacctggcagaaatgcccatgcccagtgctttttttttttcctgcatgacagagtgagactccaactcaaaaaaaaaaacaaacaaac

SEQ ID NO: 266147 - DNA, 369 bp, Homo sapiens
tgctaggtgaggaaacagaataaagtcttccaatgaggaaacagaataaagtcttccaatctttcaatccttgctactgaaagactagaatttgatcattagatcagtgtttggtgggtttcaaaattagtgacctgggaagtcccagactggcaaccagcacttcctcactccatgaaagtgtggctgtccctttcagctagttcgttccttcagttcagcctttttgagtgcctcacctagcagcgacacaaagcagaacagttacctgaagaaattttaaatattcaaagctgcattgactatgtagaccccttgttttatttttcaagtttgaaaatatgtgttcaacagaattctctatttaaa

SEQ ID NO: 266148 - DNA, 484 bp, Homo sapiens
  misc_feature (113)..(113): n is a, c, g, or t
  misc_feature (148)..(148): n is a, c, g, or t
  misc_feature (177)..(177): n is a, c, g, or t
  misc_feature (209)..(209): n is a, c, g, or t
ttaggaggtgtcaataaggagaatcttttcacagcctgaactatgatgttgcagccaagaagagaaagaaggacatgctgaatagcaaaaccaaaactcagtatttccaccangaaaaatggatctatgttcacaaaggaagtactanagagcgccatggatattgcaccctggggnaagctttcaacagactggacttctcaactgcnattctggattccagaagatttaactacgtggtccggctgttggagctgatagcaaagtcacagctcacatccctgagtggcatcgcccaaaagaacttcatgaatattttggaaaaagtggtactgaaagtccttgaagaccagcaaaacattagactaataagggaactactccagaccctctacacatccttatgtacactggtccaaagagtcggcaagtctgtgctggtcgggaacattaacatgtgggtgtatcggatggagacgattct

SEQ ID NO: 266149 - DNA, 367 bp, Homo sapiens
gagctgcacagcctgcaattacctttattcaattaatacaaaaacagaaaaggggggaggttggaggccgaaagaatgagggtcgtgaccaactcagtataccactggaggctatatgagcaaacagcaaactgttctcatgaatgcaggatgctggcaagctgacaactgcatctgccaccagaaggaatgctgagggcagtcataccccacgtgcagtgttccttgtggttatctataggaacatctggaggctgttgtataaagaaagcaattatgtgagcctgtgataaatcaagcagctgaccaaccattacctcttcctccctgttgattctacctaataaatacaaagggctgtagaagc

SEQ ID NO: 266150 - DNA, 428 bp, Homo sapiens
atgcacaactcctggctccacctctgagaagatgaagttgatgcacttgttcctgtttctcccacaaattaaactaaaaccctggaccttacatgtaaaacaagcagcagatgattctaaaacaagaaaagaaggcagattggctatgaaccctgggacctaagaaatgatatgatgctgagttccctagatgttcatttggtctcatatatccaagactttcagttaaagaagctagcaggctgagcgcagtggctcacacttgtaatcccagtactttgggaggccaaggcaggtggatcacctgaggtcaggagttcgagatcagcctggccaacatggtgaaactccatctctactaaaaatataaaaattagctgtaatcccagctactcaggagtctgaggcaggagaacccacttgaaccc

SEQ ID NO: 266151 - DNA, 346 bp, Homo sapiens
tggagctgggcggcacaggccgacactgaagcctggaaactaccaatcccagaatgcatgacttgagcgccggtcccaggctgcggggtctgccgggcaatgtggtttgccagacgttagcgtccgggaaggaagagtttttcgccaataggctttcggcattaggttctcccgccgagcacccttcttggaatcggctggtcttcctagaaactacagtctatgactgtccttgcccgtggcttacagtggaggaatttaagggcttcctgagatatctgtagtacgtaattatagctaacaaccgcagtaacaacaataaataccattcgtggaaaaaaaaaaa

SEQ ID NO: 266152 - DNA, 539 bp, Homo sapiens
actcctttccagaggagctgactctgagaaggggattgcagacacagagaatgggtaaatgttcagaattgttggcttacagtgtgtatgaattagaatggtaggtggggaggtaaaggtagcagagataagctatagggttaatatttatcttgtaaacaaggagaaactgtagagtgaatgatctaatcacattttcattttaatactgtcattctgaaaacatcctatgcgatggaatggagaaggaagtgatgactcagagtgtgaagagtgaagagttcttagtatttgttattggttaattctcttttgatttcaggggtcaaaaatctaatgtaacttgggctaacaaaaaagaagttaacaaaagaatttattggttcagaaaattgaaaatttccatgtcagatctagctaacctcaggactggcctttgcagtccatctgtggtatctgtgttgtgttacagagttgggttcattgcaggttatgactcctgagttcacacatacctaaatgtttttcttaaaaaaaaa

SEQ ID NO: 266153 - DNA, 493 bp, Homo sapiens
cagaagtgccacataaatcaggcctgacctgcacttacaccctgatacagctaaactctgagctgtaaatgtcttttgtttctgaactgcaaatgccccaagcaaatgaaggtgggggcagggttgggggcggggggagggaaactaatctgaagataaaatacacgcactggatctagcctgcagaatttataatacagaactgtcaagtttatggaaactgtggtcatacaatatattctgatgcatattacagagcactaaatgcaagaaacatctgggcagccagcagctgtgaattttaattgatgctattcaggagaaggagaagggaatacaccactttgccttgtttcttatatccttatatcctgtagcttgcacgtgttctttgttacacacgtgttctgtatattcagaatgatcgaaaggatcagacagcacatctctggtgggaaatatgttgccttaataaaatagagatatctgaaaa

SEQ ID NO: 266154 - DNA, 414 bp, Homo sapiens
aaattatttaatatacgttatgattatacaatcaacatatttttgtgaacaatttggaaaatataaataacccttccccaattatattttgcaattaatagcaaacctaagaaaccactgtctacagatttaagtatttctctattattttaatataaaaataacaaagcaggtattttaaaacttttataagatactttcccaaatactcataatacaaaaagattatactgaagtatttaatatcatggaataatgtttgaagtatatatttctttatatatacattatataataatatataataattccaaaatgttaaacatacttcagcataatctttttaagtgatacataatatcctactatataacattagaatatattgaactaatccattacatgtggcttact

SEQ ID NO: 266155 - DNA, 528 bp, Homo sapiens
agagaggctctgatcttaattatttcataaattctaaactgagatgcttaattagagcttaaatttatggagactctgatacatgagaggtgtccacccaggtttcgtttttcatgaaggagcaaaaagtatatgcagtcacagcgggctctctggagagtctacagtgacatgggcatcaccttttcttagctggtgtaggaggcaggggagggcttgtaggcacatctctgtgttggtgtgcagaagctgactgagatccaaacatgtactaaggttgtcagatggatagaagagatgaagagatgctagtattgactaaatgaacaaacagactgaaaacaggttaaattcaaagattaataattgattttggagagcacagtcgataaatttcaagtatgaccaaagagctgctataaattgactttcctagcctaaaatattcggtaatttttcttaatggatttgttaagaagatgtttgaataacaactattttttagcttctttattggcaaataaaacc

SEQ ID NO: 266156 - DNA, 664 bp, Homo sapiens
caagatcctctctacctctgaataatgattttatgttcttacttatcttccttcaggtgaaagtaagtctctttccagctatccaaacatataacagagtggaatttttcctcactccttctgccccaggcaagatgttgatcagccccaacacaaacctgttttctgctttaaacatatcctatacctagggcaaaatttaaattatctaaaacacatttaaaaacaccccatccatacccactttgttctttcaaacaagtaaattcacccagcagggaaaagctgttgctggcagtccatgcctacagaatctcagccttgccctagcaacgaggctaattataactccggctacctggtaaccgcactagatttccctgcattggctggcagttctaaagccatctcagctctgcctgccacctcccatcctgagaagctgtcagagaagctgagaaactatgagtctcttttaagcaactatctaagctgtggtgagaacacccatgtatcatagagcttcctttctctgcgcccagagaaaggctgcccagaatcacaggacttcagaactgggagggatgtgtgcgtcaatcctggtccagcccactcatttaaacacaaagaaccagaagcccagaaaaagtgacttgccttagcc

SEQ ID NO: 266157 - DNA, 395 bp, Homo sapiens
  misc_feature (269)..(269): n is a, c, g, or t
  misc_feature (271)..(271): n is a, c, g, or t
ctctcctgccctgagctccagcacctgtatgaggcctggcacatgggacatgtacatccgcagcagactgaatgaatctgagtgagtgaatgagggagtgagtgcatgaatgagtgactgaatgaatgagtgagagagtgagtgagtaaatgagagagtgaatgagggaatgaatgaatgagggaaggaatgaggaatgagtgtgtgaatgagtgagtgaatgagtgaatggatgggagagtgagtgaacgcatgagtgactgaggctntnctgccctgatgctctcctcctaccagagtgaagcccacagagtccctccaccttcaaaccaggccctctctccagttttatcccctgcctaatgctgcgagaagcacagtctttttggccctct

SEQ ID NO: 266158 - DNA, 979 bp, Homo sapiens
  misc_feature (593)..(593): n is a, c, g, or t
  misc_feature (654)..(654): n is a, c, g, or t
  misc_feature (681)..(681): n is a, c, g, or t
  misc_feature (733)..(733): n is a, c, g, or t
  misc_feature (843)..(843): n is a, c, g, or t
  misc_feature (846)..(846): n is a, c, g, or t
  misc_feature (856)..(857): n is a, c, g, or t
  misc_feature (862)..(864): n is a, c, g, or t
  misc_feature (871)..(871): n is a, c, g, or t
  misc_feature (876)..(876): n is a, c, g, or t
  misc_feature (903)..(904): n is a, c, g, or t
  misc_feature (912)..(912): n is a, c, g, or t
tttttagaaaagctctttgtcttaaattccttggatttttttcatgttgagactatctctttttcttatatttgaacaacatcttgactgggtatcattttcttgggccacattttgtctctgaaatttgtggcatgtttcatgtttttctggcattgaaccttgcctcagagaggtctgagataagtccaattcccaactctgcttcaccccttttaggcaacttgctttattgtctggttggttgtgttcaaggaattctttctttaactttaatgtttagtgacttaactgggatagagatcagtagctaccatgctgtgtcagttttttttttttcttggaacatggtgtgttatttccatctgtaactaatttccttatttattaaagagaaatttgaaagattatttctttgaataattttctcattttcctgttttattcataaagtcctttacttcagggacattagttaactttataacagatgccatgttcttcatacctattgtcttcctcgtgccgaattcggcacgaggatatagtaccgcaagggaaagatgaaaaattataaccaagcataatatagnaaggactaacccctatacctttgcataatgaattaactagaaataactttgcaaggagagncaaagctaagacccccgaaaccagacnagctacctaagaacagctaaaagagcacacccgtctatgtagcaaaatagtnggaagatttataggtagaggcgacaaacctaccgagcctggtgatagctggttgtccaagatagaatcttagttcaactttaaatttgccacagaaccctctaaatcccntgnaaatttactnntagtnnnaagaggnacagntctttggacactaggaaaaaccttgtnnagagagtnatttaacacccatagtaagtcttaaagcagtcactcaattaatgttttcaagctcaacacccctctt

SEQ ID NO: 266159 - DNA, 270 bp, Homo sapiens
ttttttttctagtagcagtgattaagttacagggatccatctatacttctttgccagtacccccgtggccactggcaaagtttgatggactgctggctggcactgtggccatagaagagatgaggctaggctgggtgtggtgcttcacacctataatcccagcacattgtgaggccgaggcaagaggattgcttgagcccaagagttcaagaccagcctggatgacacaatgagaccctatctgtcgacgcggccgcgaatttagtagta

SEQ ID NO: 266160 - DNA, 379 bp, Homo sapiens
ttttatatcatagtaatatggtttatgtcttcataggacagagtgacttgctcagtgaaacagactgtatacaattagctcagaaacaaatactgaggtttttatctgtttgctgtatcccttgagaaagattaaagagggaaggcagggtgcagtggctcacgcctgtaatgccagcactttgggaggccaaggcagttggattgcttgcgcccaggagttcgagaccagcctgggcagcatggcgaaaccctgtctctactaaaaatacaaggaagttagccgggcgtggtggcgcatgcctgtaatcccagctacttgggaggctgaggcaggagaattgcttgaacccaggaggcggaggttgcggtgagccgag

SEQ ID NO: 266161 - DNA, 224 bp, Homo sapiens
atgtagcctttccttcttgcttaggggatacagggttctctgtatctcaagtggagagcaatggagtagaagcatgagaagctggtgctgtgctgcctgatagaacccttgaccttaatgtttcatcccatcttcaactttgccctactctcaatagtaatttcatgtgcccacactgtgacattctcagacattctcatccatttccttacttggtcagtggc

SEQ ID NO: 266162 - DNA, 1033 bp, Homo sapiens
gtgagataggagactttttctaaccaatggaaggtggcaaaggtgtgtgagtcacatccttgagtatgttttgttagaatgtcacgtttgtgattttattacgtcactttatataaggctctgtctccctaggattttttgcttgctggcttgatgaattaagccaggtggaaaggttttctttaagtgggcagcctcaagccaacagccagcaaggaataaaagccctatattccacaacctaagaaaataaattcttccaacaacctgagtaaggttggaagctgattcttctccagactcccagatgagaacacaggcaggctgactcttgagtccagccttgtggaacccagagaagagggcccagaagtatagagaagttttctgtaaaatggaaatgagtatcatgaagttttaaatgaacagtgtaaaacagaagacatcagcattcattaggtcccagacctctttgagaatctgatgaaattctggacaacctctcctcccacaaacaagatgtactagaatacctacacataaaatgttgcattcaattttggaatgtgaagagatcatttgaagccgatccagaggcctctaaggtgacttgactggtgcagtattggtggctgctgggtcagatgagctccctgctattccaagaaacaatacatgtttgcagccactaagatttgaggacttttgttattactgcctatcctgacagactcaggtgctacaactatttaagggctgaccggatctcactctggcacctagactggagggtactggcatgaactcctgggctcagatgtcctcccacctccaccttctgagtagccggaattacaggaatgaaccatcatgctcagatttcaagctccctgaagatgaaggctgaatcctacacctcgcttgtatcctccatggctcattgaacaagtgctagctagctacatggagactgctcaataaatattgaataactcacgagggactcaataaataacgattgcttaattgatta

SEQ ID NO: 266163 - DNA, 1071 bp, Homo sapiens
gtgagataggagactttttctaaccaatggaaggtggcaaaggtgtgtgagtcacatccttgagtatgttttgttagaatgtcacgtttgtgattttattacgtcactttatataaggctctgtctccctaggattttttgcttgctggcttgatgaattaagccaggtggaaaggttttctttaagtgggcagcctcaagccaacagccagcaaggaataaaagccctatattccacaacctaagaaaataaattcttccaacaacctgagtaaggttggaagctgattcttctccagactcccagatgagaacacaggcaggctgactcttgagtccagccttgtggaacccagagaagagggcccagaagtatagagaagttttctgtaaaatggaaatgagtatcatgaagttttaaatgaacagtgtaaaacagaagacatcagcattcattaggtcccagacctctttgagaatctgatgaaattctggacaacctctcctcccacaaacaagatgtactagaatacctacacataaaatgttgcattcaattttggaatgtgaagagatcatttgaagccgatccagaggcctctaaggtgacttgactggtgcagtattggtggctgctgggtcagatgagctccctgctattccaagaaacaatacatgtttgcagccactaagatttgaggacttttgttattactgcctatcctgacagactcaggtgctacaactatttaagggctgaccggatctcactctggcacctagactggagggtactggcatgaactcctgggctcagatgtcctcccacctccaccttctgagtagccggaattacaggaatgaaccatcatgctcagatgttcaagagtttctcctgaagtggatttgctggctgatttcaagctccctgaagatgaaggctgaatcctacacctcgcttgtatcctccatggctcattgaacaagtgctagctagctacatggagactgctcaataaatattgaataactcacgagggactcaataaataacgattgcttaattgatta

SEQ ID NO: 266164 - DNA, 1130 bp, Homo sapiens
gtgagataggagactttttctaaccaatggaaggtggcaaaggtgtgtgagtcacatccttgagtatgttttgttagaatgtcacgtttgtgattttattacgtcactttatataaggctctgtctccctaggattttttgcttgctggcttgatgaattaagccaggtggaaaggttttctttaagtgggcagcctcaagccaacagccagcaaggaataaaagccctatattccacaacctaagaaaataaattcttccaacaacctgagtaaggttggaagctgattcttctccagactcccagatgagaacacaggcaggctgactcttgagtccagccttgtggaacccagagaagagggcccagaagtatagagaagttttctgtaaaatggaaatgagtatcatgaagttttaaatgaacagtgtaaaacagaagacatcagcattcattaggtcccagacctctttgagaatctgatgaaattctggacaacctctcctcccacaaacaagatgtactagaatacctacacataaaatgttgcattcaattttggaatgtgaagagatcatttgaagccgatccagaggcctctaaggtatgtcttaaaactatttaaggggatccacgcaaaatgttgttcccttaaaagagggcacatctctctcacgtggagaaatactggtaagaggaaaagactttcaagtcaaccaacttgatgtggtgtgcaggtgctgcaatttacttcagacattgcatctataaaagaaagataaggtctcggctggcaagatggcctaagaggaacagctccagtctgcagctcccagcaagattgatgcagaagtgaccggatctcactctggcacctagactggagggtactggcatgaactcctgggctcagatgtcctcccacctccaccttctgagtagccggaattacaggaatgaaccatcatgctcagatttcaagctccctgaagatgaaggctgaatcctacacctcgcttgtatcctccatggctcattgaacaagtgctagctagctacatggagactgctcaataaatattgaataactcacgagggactcaataaataacgattgcttaattgatta

SEQ ID NO: 266165 - DNA, 1158 bp, Homo sapiens
gtgagataggagactttttctaaccaatggaaggtggcaaaggtgtgtgagtcacatccttgagtatgttttgttagaatgtcacgtttgtgattttattacgtcactttatataaggctctgtctccctaggattttttgcttgctggcttgatgaattaagccaggtggaaaggttttctttaagtgggcagcctcaagccaacagccagcaaggaataaaagccctatattccacaacctaagaaaataaattcttccaacaacctgagtaaggttggaagctgattcttctccagactcccagatgagaacacaggcaggctgactcttgagtccagccttgtggaacccagagaagagggcccagaagtatagagaagttttctgtaaaatggaaatgagtatcatgaagttttaaatgaacagtgtaaaacagaagacatcagcattcattaggtcccagacctctttgagaatctgatgaaattctggacaacctctcctcccacaaacaagatgtactagaatacctacacataaaatgttgcattcaattttggaatgtgaagagatcatttgaagccgatccagaggcctctaaggtatgtcttaaaactatttaaggggatccacgcaaaatgttgttcccttaaaagagggcacatctctctcacgtggagaaatactggtaagaggaaaagactttcaagtcaaccaacttgatgtggtgtgcaggtgctgcaatttacttcagacattgcatctataaaagaaagataaggtctcggctggcaagatggcctaagaggaacagctccagtctgcagctcccagcaagattgatgcagaaggcaggtgatttctgcatttccaactgagtgaccggatctcactctggcacctagactggagggtactggcatgaactcctgggctcagatgtcctcccacctccaccttctgagtagccggaattacaggaatgaaccatcatgctcagatttcaagctccctgaagatgaaggctgaatcctacacctcgcttgtatcctccatggctcattgaacaagtgctagctagctacatggagactgctcaataaatattgaataactcacgagggactcaataaataacgattgcttaattgatta

SEQ ID NO: 266166 - DNA, 251 bp, Homo sapiens
tttttttttcttttttacttaaagagatggggtctcacttattgctcaggctgttctcaaactcctgggctcaagtgatcctctcgcctcagcctcccaaagtgctggggattatcgtcgtgagcctccacaaccagcccaagtgtccttccttccttcctttcttccttccttccctctctccttgcttcctttctctttctttctttccttctttctttctttttccctccttccttcctttttttctt

SEQ ID NO: 266167 - DNA, 695 bp, Homo sapiens
cataactacagaacctactacagaggttaaactgtctccaaccacagagaagacctcaactcagcctccagacccagggcttgccataactccagaacccactacagagattggacattctacagccctggggaagactacagctcctcatccagatcagcttcagactctgcatcgaaaactgactgaagtcacaggtccacctactgagctagaacctactcaggattcattggtgcagtctgaaagttacatccaagataaggctttaactgcaccagaggaacagaaggcctccacaagcaccaacatatgtgagctctgtacctgcggagatgagatgttgtcatgtattgatctcaacccagagcagaggctccgccaagtgcctgtgccagagcccaacacccacaatggcaccttcaccatcttgtaagaatcacctttcctcaattgtcctctgtgtcctgcctgacatggcagccttttcctggaggccttcctgggccacctttatctccccaagccatagggacaactgactttctgctttcacctttgcttgtcaactcttccttctcctcattctcttttactgttaggccccttctccactcttttacttgtgattgctcagcaacatacatcttaaatgtacaaattattgagtgaaagaagtgatacagaaaataaaa

SEQ ID NO: 266168 - DNA, 587 bp, Homo sapiens
tatttagagctcagaatgagagcattatttgtcaaggtggctcagtctaacagattgtatagctgtgtaatttttcattagcaaaagtagcatggaaactgaagattaatacaggttttacaatttgaaagaaataatgaaaacagtttagagaaagtaatacatttcataaaaggattttgagaaaaatctaaagaaactggcattactttgattagagaagtgttattggggttttttaaagatgtttgtttaataatgtcaccatgagctctcactgaacaacaatagctatctgtttttgtggtctcacaggattagatatttttaggggcatccaccagaggtaggatatgagttaactctttccttgccttgagagttttcatttcaattgcattcatagagtatctaatatatactaggagtcttacttatagtatcttatttaatcctcacaatcaccctctgttagaaatgaggagactgagttctaatattctttctattttggtgcactggcttcatacccttgtacagatgtgagaaatttgagtggctataaagcataatagttccggctaggt

SEQ ID NO: 266169 - DNA, 433 bp, Homo sapiens
ggaatggggagtgagggctgatggggagggcgtttccttcccggggcatgacagtgttctggaactagatggatgtggctgcgacgcatcgggaatgaatgcaacggcactgaattgtccaccttagcacggctgagtttgttatgtgaatttcccctcaatacaaaaataaaaaaaattgcctctaattttctttccagctgtaacttccgtgtttttaaggcgtcgaacccaatccctccgttttacatcctctatgaactaatcgatgcccccaaactactaaatttcatttcccagaaagttcatgaaaaaccaaaactccaaggaagaaaaacttgagacccaagctagtctcgtgttttttatcatctgtgatttttcaaaatttccatgctgggcctgaagtactgttagtcagaacggtttattt

SEQ ID NO: 266170 - DNA, 503 bp, Homo sapiens
cacggtctccagggatcttgtctgtgcccaaactcctgagacttccctgtcctttcccacaagggccctggctctggtggctgcagaagtgggaggaggggatgtgggggagtctggggaaggccaccttccatgacgctctgccaagccaggaggagcgaaggaataacctggtccccgtgctggaccctggactccaggaagcagagcctacagccggctcagccttgggtcccctgcctctgtggagctggccctaccccagatggccactgtgcctgaggcccggcatctgaccctctgtcctccctgccgaggggccagaacagaggccccggcaacaggcaaggcgcagtgcacggagctgaccccgtgcctcggtccaggcctagcaacaggaagtgagaggccaatgccggtaaacgagatccgaaagattagaggcctcgctgccgccccaagttagaggacaagttcctggaaggaggaggaagctgccgcag

SEQ ID NO: 266171 - DNA, 875 bp, Homo sapiens
  misc_feature (99)..(99): n is a, c, g, or t
gaggctatggtgcattatgattatgcctgtgaatagtcactgtaatctagccactgcaatctatattaagaaacataggccgggcgcagtggctcacgnctgtagtcccagctacttgggaggctgaggcaggggatttcttgaacccagaaggcggaggttgcagtgagttgagatcgcgacactgcactccagcctgacaacagagcaagacttcgtctcaaaaaaacaaacaaaaaaagaaattacattagttgaggacctgctgtatgtgatatgaacaatgaggatcaactctttttgtaatagtttttttacatatgttatttcatttgtttatttcctctgtgagggtaagtattgatagtccagtcatagactggtaacacaggcacaccattaaaaataatagacatacagtatgcagtattttgttttacttatgaaactccgtattttatgtatgatgtattgagtatgaagaatagtacatactgtttccttttaactttatgtttcttgcctttgtatattttatatgaatagcacttgtcactaacatagaaagcagtagaggtggaagagggagacttgccagaataagtttttaatgtgaatcagagatttttattaggaattgggagtggaaggagagagatagtattagaaagtatgtatgcagcaaaggatggagaaactgtccttgttgttaaggcatctaaggatgctccaattactggggaaaacataccaggctcaaaatggtctgattatgcaaataccttctaatacgtttgtttcttttgttgtgcctataaaagatgccattaacttcatatttatgtcactaataaacttctagaatccatgtaaaa

SEQ ID NO: 266172 - DNA, 215 bp, Homo sapiens
agacatgagctcctttcctccccagtgaggacgcaaatgaagacacctgcagccttccagactgcttgcagctattccacccccaggaatggagctggccacttatttaaaggtgggatgggaagctattagaggatttcaggaggacttggtgcagttggattatgatttggaaggcccactccagctactatgtgaaaactgatagcagtgga

SEQ ID NO: 266173 - DNA, 308 bp, Homo sapiens
gtctgaattcttcttgaagctttaaacaaaatatgagtagagaaaatcttactgaagttttaatttaaataattataggttattattccatattagtttaaagataaaattaatgtggaagaagaaagcataacttaaagaattgtatctctttaaaaagttcttatatattttatctatttaaaaagtaaaatttgtttttaggagggtttgggttctttttttatgataattatatatattttcatgttagcgtactttaaaatgaagagctatcaatctcaagttttagttttgaagtaactttg

SEQ ID NO: 266174 - DNA, 440 bp, Homo sapiens
ctacaatgaaagatttactttgagcaactgcagacaggagttgagactgtatctcatgggctctagatagccatctgctatggtctgaatggttttgtccccttctcaaaaattcatgttgaaacttaaccccaatgcaacagtgttggaaagtatggcctttgggaggtgactgagttttaagagctctgccctaatgaatgggattagatgcccttataagagggctgggcaaagggaatttgacttttgtcccttcaacttctgctataaggacagagctttcctcctctccagaggaagaggtgttcaaggtgctatcttagaagcacagatgggatgtttaccagacaaccaaatctgcccatgccttgatcttgaacttcccagcctccagaattgtgagaaaataaatttttcttctttataattatagtttc

SEQ ID NO: 266175 - DNA, 382 bp, Homo sapiens
ggacatgcgggaaatagcatcacgattttactgaggaaaagaggaaagtcacactgtggagcaatgctttgcaccttttcaaaagaaaggactggctgggcgtggtggctcacacctgtaatcccagcactttgggaggccaaagtgggtggatcacttgaggtcaggagttcgagaccagcctggtcaacctggtgaaaccctgtctctactaaaaatacaaaaattagccgggcatggtggtgagtgcctgtaatcccagctactcaggaggctgagtcaggagaattgcttgaacctgggaggcagaggttgcagtaagccgaggttgcaccattgcactgcagcctgggcgacaagagcaaaactccgtctcaaagga

SEQ ID NO: 266176 - DNA, 660 bp, Homo sapiens
atagtagtcaacttttgactctccatttcagatttcgtcatgccctcctcaatgagctgctaagttaggcagtgcattgattattgctgcaggagagggaaggaaggagctaacgtgttttcacatgttttccttttggagatgagaaaggaggactctgccttccccctaccctgcccctttctactccaggacctctgaaaggccatgagcacaaagctgctgcctgagtcccctgaaatgcagggtacgccccaggtctctgatgtaccccaccacacttttcctctcaaacatattccaggatcacttgatttcttttgaatctatttaaacccaccgtgtcaatgtgctatataaaatgtctaatgcatttcagacaccctatacatctatacatttaaagtgttctccttctatctgtgcagggatgggaaagggcatatttctgaaagcacagatgggaagacgggatttgttccgtgtccaggtgattatggtacctctatgcgcctggccggcactggggacagaggccatgaaaatgaatacagcacagcctttgcctccaagaaacttaagacctagtagaaatggcaggctttaaaacaggttgttgggatctgatttggtgagtgcaatgacagagatactcacagc

SEQ ID NO: 266177 - DNA, 347 bp, Homo sapiens
ttttttttgttattgttctatttgggccttcaacaggttggatggtgccaacctataccagtgacaaccatctactttatttattgagtccactgattgaaatgctaatctcatgtggaaataccccaatggacgcagccagaaataatgtttactctgagcacaccatggcacaggtgagttgacgcatacagttaaccatcacacctaggaacacaggaacaatcaattctgttaaggggactcaggggaccaagaaaggaactatgagattttgagaaggaaggagacatttgcaaggctagtggggaggggcatttcaggcagagaaaacaacagtagcaagt

SEQ ID NO: 266178 - DNA, 393 bp, Homo sapiens
gggcacagtctagtcccaggctagagagaacgcaaaacatagtgtggttaatgtgtggtgagacatgtcatgggtaaagactactcatgacctcatgccataaataagacaggacacccattcacttatccgtgctccttccatcccaggcctgtagagggaagtggggacccagaaatcagtcctcagcttcaagaagctcataagaacacttggtttcctcatcaactgatcttctcttcatgtgtttatccagaaggctactgtgcatatgaagggttccggattcactcagaggcacaagagacaattgcttgttttcagctatgacatacatttttgcctcttctggaaatattagtcaggaagtatagtcatagtctttgtattgga

SEQ ID NO: 266179 - DNA, 348 bp, Homo sapiens
tgagacggagtcttgctctgccgcccaggctggagtgcagtggcgtgatctcacctcactgcaagcttcgcctcccgggttcacgccattctcctgcttcagcctcccgagtagctgggactacaggcgcccgccaccacgcccagctaatttttttgtatttttagtagagacggggtttcaccgtgttagccaggatggtctcgatctcctgacctcgtgatccgcccgcctcggcctcccaaattgctgggattacagatgtgagccactgtgcctggcctcagactttctataagagagctttgctccctcatgggctcttgtaatgccaaagctttgctttct

SEQ ID NO: 266180 - DNA, 212 bp, Homo sapiens
agttttaggaaatgtctacagtattagttttcttctcatactgctataaagacatacctgagactgggtaatttataaagaaaagaggtttaaccagctcatggttcttggggctatgcagttttctgcttctacagaggcctcaggaaacttacaaccatggtggaatgcgaaatggaagtagacaggagagagtttcagttttagtctta

SEQ ID NO: 266181 - DNA, 441 bp, Homo sapiens
cctataaaaaagtcttcagggcagggagggggctgggctctgggaacatgcaaatcagcaggggatggggcccactgggcacagctgcagggctggctcatctcagtaactcagcacaaggacagtgtcctcaggatctcaggtcggaccagggcaacacagatttgtctttaatctgtttcttgctgggggtcaatttgaaacaaagaatattttttgataattgtcgaaatttgaaatactgctgagtacttgagggagtaatgtattccattggcgtatggggattatttgggagaaattgttctctgtaggaaactcaaagtaaagtttttagagtgtggaatcagcaggtcttaaaaatactctgaaagggaggggggtactttgtggtatagttacatttctgtgagtgtgtaattgttccttcttaaaaaaaaa

SEQ ID NO: 266182 - DNA, 408 bp, Homo sapiens
ttttgttagtgaggcccctacagtagtgtcagcatttacaagaaaatcttctaaggactccttttcagtatgcattagcatagtctcattcctcagtgaaacaggctgtaaaaatcttactgtctgctcagtttggtctttgcagagcagaagagccttcctaaaagcataagaatccaaaaaagcagttaaaggaaggatttgcataaagtatcagaaacagtctaactttgctacagcatcgctggtaatgacccctattcttaaagagctactttgaagatagcagtgaaggctgtttgctgccctcttggaccccgaggtctgtcttagaggttaatatttcacatgttgtcctaattccgcactttagctgaggcaggcagaaagttcaaagaaacaaggaag

SEQ ID NO: 266183 - DNA, 218 bp, Homo sapiens
gatctcaaaagtattcctcagggtagtctccattcctgtcatttttcctcctattcatgagacggaaaaattatgaccatggtacagagttgtatcaaggaaatgaagaactagaacattgaattgaaaggttttgaaagggttcacaatttcttttcattttctattaatgtcttcttttaaattctcttaagaataaaacttttttctaatatttt

SEQ ID NO: 266184 - DNA, 779 bp, Homo sapiens
ctagctataccagagaaagtcaagtgaatggatcagacaataagaattgaaaataagcttaatagagcttcagagaaagaagggagaatgttggaaacacaaagcacaaacaagcatttgtgaattggatgttgacaaatattaatgaaataactcaatggatgggttgaatatagctggacagttcactcatgaaccggaagattagagcaaggaaggaactaagaaatggaaagcatgaaaggagagttaagaaatgtggaaggtagaagcataaatatttttctaatggaaattccagaaggggaaaaaaagaacatgtgaaagaattattgctgagaatttcccagaattgaagacatactttagaatgaaaaaggccaactctaactttgggatttctagcttcagagaaatgaaaatttagaatgaccaaggggagtgcacaggattttttgggcagtgaaactattctgcatgatactataatggtggatgcatgctattacacatttgtcaaaacccattgaatgtacatcactgagaatgaagcctaatgtatgcactttggatgattatgatgtgtcaatgtaggttcatcagttctaacaagtagaacatgctggtgcaggatgttgatagggaggctgtgcatatatgggggaggggatgaaaggaactgtgtactttctgctcgtttttgctgtgcacctaaaattgttctgaaaaaaatcaagtctattaagaaaacaaagacagttttttaaagcataagagca

SEQ ID NO: 266185 - DNA, 402 bp, Homo sapiens
ctgacttccttctcttcccttccctctaatctcctgctggtgcctgccattgtagaattcaatcgttagcatgtctgatgataaatccacagagtttcagtcccccaggatctcaaatcagggtagagaaaggcaggatgatggttctagaatagacaatgaccagtttattctatgattttaactatcataattttaaaatatgatttgttaaaaggctggtgccttctcattattactcaactttgataagctccacttaattcatgctattaatttttctatatgaagtttatcttatttttttctaaaaatttgcttcagtaaagtttgtttttgaaataactctatgcagaaaagtgcacatatcataaatacacagcttgatatttttgtatagtg

SEQ ID NO: 266186 - DNA, 402 bp, Homo sapiens
acagagtctcgctctgtcgcccaggcggagcgcagtggcgccatctcagctcactgcaagctccgcctcccgggttcacgccattctcctgcctcagcctctccagcagctgggactacaggcgcccgccaccacgcccggctaatttttttgtatttttagtagagacggggtttcactgtggtctcgatctcctgacctcgtgaaccgcccgcctcggcctcccaaagtgctgggattacaggcatgagccatcgcgcccggcaaaatgagactatttaatagcttataagtgactgaaaaggtacagaacagtctgaggtgccattctatgagtaggagatggggtgatggacagcagctatgccacgaaatacaaccacttacagtatggtatctaat

SEQ ID NO: 266187 - DNA, 400 bp, Homo sapiens
cttgatgtgtctctggtttcagcatgaataggtttggaaaaaacttagataatgtgactggaatgtaaatgtaaatttccattcctaaaatacatttttcccagagtagtaattgtttgaaagtcttaaaagcataaattttattttataagtgctttatgacttttttgaagggacatagaatagataaacttaaaaatatttaaagcattttataaatgcctttacacattcatggcaaaatgcttagtaaaatttcaggtacaaaattctctagggtattacattgttgagtgtccttaagaactataaaatttcctatccccattatttctcctgtttaatttcctgtcaccacagatgagtctgggctttgtttgttttgccaactacagagttg

SEQ ID NO: 266188 - DNA, 770 bp, Homo sapiens
aaatcaagtcatttccttctggcagcaaaactgctgggtttcactgccaggcctgccctggtcagacttgtttggggaggtggggaggactaatagcctgtggctagaaagctaaagactcccagtgttcttcctccaagttcctgccattcctctggagtaactgcctctcagtttgtttctttaatggatatccagcaccacaaaatggttagttttgacaattttgtccagctttatgctcattttttcaggataacagttgtcttatcctttcatagctaaaagttgctttaccccatattaatgtttttttgattatttaaatgatatgcaaaattaactatgacatagagtgtatttcttgtatattctagttgttgaccatagtccaacatgatacctaaaggttatttcgtaagcacgtgattggaagctttatgtgaatttatcatgagttaaagaacaaatttattattatattgtttcacacttttcattattctaatgactagatttaactaacttttaatacgttaccatgagtcaattctgtatgtgctaagcatgtttgaattagtacattttataccactcttgtctatttgttcataaattgatacttgtgaaccagatatggagtcttaactcaagctgagaaaaaagaaccttttataataaacaataaaggttgtggttaatttctatgcttgactttgtggggtttcaaatatgagctgcagatggctcgatttgcctgactagagtgg

SEQ ID NO: 266189 - DNA, 403 bp, Homo sapiens
gtaaatgcagggctagcacctgagggagtgcgtcctcccctcactctcatccttggcctgccctcatcttgcctaagagagctgtcccctggcctcagatagctccagtcactcccataacctgttgatttgcctcagagcccccccatcacctcgccgtcatcctcactactcactcggttggtactgactatatcttaggtggaacagcgcgaggcagggacgtcatgctttgcagtcactgccaagagcagtacctgtgttattcagacacaaagctaggctctattcagacatggagtgctgaataatacctgagtgagtaaataccatgtgtctgccaccctcttctccctgaggcctgcctgaatactttcccctagacacggctggctgcagtggg

SEQ ID NO: 266190 - DNA, 309 bp, Homo sapiens
ggtaaaagcagagtgaaacagagccatctgccttactcagtccaccactggcatcaaccaactggtcaagggcctaaatggaacaaagaagaggaagaaggttaaattcactctccacctgactgcttgaactgggccattggttttctcctgctctctgctcaactcttaggccttcagattacaccactggcttttgtgggtctccagcttgttgaatgcagatcatggtggttctctgccttcataatcatgtgagcccataccttataataccttataataaatctcattatatctattgatacc

SEQ ID NO: 266191 - DNA, 336 bp, Homo sapiens
acggagtcttgctctctcacgcaggcagtggtgcaatggctcactgtagcctctgcctcctgggttcaagcaattgtcctgcctcagcctccttagcagctgtgattacaggtgtgtgtcaccacgcctagataatttttctattttcagtggagatggggtttcaccatgttggccaggctggtcttgaactcttgacctcaggtgatctgcccaccttggcctcttaaagtgtggggattataggtgtgagccactgcgcccagcctattttcttacattctattactatggtcatttatttttccaaccaacatgtatatctaattaagtaaa

SEQ ID NO: 266192 - DNA, 220 bp, Homo sapiens
cacatcaccttcagggaaaagactgccgcatattactcactacctccctccacccctctgcgtgaaaaggttaatttgaataaggctgctgcttccacaaatagagcagtaaccagcacacagaggaaccgccaatgagactgtatttcaatgatgtcatacttatacctgcctcttattatttgctgagtagtgacaatgtgttccgtgaatctcacgt

SEQ ID NO: 266193 - DNA, 254 bp, Homo sapiens
actcaaggatactacccttaactattcaatgtagtgaaaaatactggataaagcattacaaattacatagaggggctctggttccagttaaggtagactaagcacactccatctgatctttcctactgattacaactaaaaatcctggactgaatatataaaatcactatcagataattctgaaaggtggatgacagaaggccaaggaagtagggagtacagcatttaaaggacaataaagcaatgaagctctg

SEQ ID NO: 266194 - DNA, 689 bp, Homo sapiens
atctggaagagtcatttttgttaggtttggaatattagctggggatagagtacttgagagagaaaagtagtaaatgcgaaagccataatcttcgtaaagtttgagatatctaagaacaagcaaattaagtcattaaagacatacaaataaaatgacttgccatatgtcttagcctgttttgtgctgctataacagaataccacaaaataccacatactgggtaatttataataaatataaatttatgggctcacagttctgaaggctggaaagtagaagaccaaacagctggcatctggtgagggccttcttgctgtgtcatcccatggcagaaggccaaagggcaagagagaacaagaaggaactgaagttgcctttcaataacagcacaaattccacctatgagggtggagttttcatggcctagtcacctcttaaaggtcccaatcccagcactttgggaggccgagaagggcggatcatgaggtcaggagatcaagaccatcccggccaacacggcgaaaccccgtctctactaaaaatacaaaaacaaaattagccaggcatggtggtgggtgcctgcaatcccaactactcaggaggcaggagaatggcatgaacccaggaggcggagcttgcagattgggccaccacactccagcctgggcgacagagcaagactccgtcac

SEQ ID NO: 266195 - DNA, 335 bp, Homo sapiens
tttttttttttgtggctgtgtagtagtattccatagtgtatatgtaccacattttctttattcaattccacattgataggcacctgggttgattcatgtctttgtgaataaatgttcactttattatgaacagagtggtgatgaatgtatgagtggatgcatctttttatacaatggcttattctcctttgggtatatacctagtaatgggattgctgggtagaatagtagtcctattttaacttctttgagaaactgccaaactgcttttcacagttgctgaactcattcacattcccaccaacagtgtatacgtgttcccttttctctgcagc

SEQ ID NO: 266196 - DNA, 505 bp, Homo sapiens
cacgaggctgggagctatttattgcgtgtttctctcaaggccctctggaccattctggaaaaatgttgaaacatgggctggagtggcatagaatgctcctccaaaagcacccatgtattcttttgctttgtttgtttgtttttttttaaatggagtctcgctctgtcgccttggatggagtgcagtggtgcgatctcagctctgcaacctctgcctcccgggatcaagtgattctcctgcctcagtctcctgagtagctgaaattacaggcacctaccagcacacctggctaatttttatatttttagtagagacagggtttcaccatgtttgtcaggctggtctcaaactcctgacctcgtgatccgccagacctggcctcccaaggtgctgggattacaggcatgagccaccgtgccccgcctctttttttttttttgagatggagttttgctcttgttgttcaggctggagtgcaatggtgcgatctggtgtcactgcaacg

SEQ ID NO: 266197 - DNA, 392 bp, Homo sapiens
ttttagcatcacaatgactaagcagtgctattggcaaccagtatttggaaggagaagggatgccaaacatcctgcgatgcacagatcagtcctgcacaatgaaagaactgtcccatccaaatacctagaatactcccaaagagcaacaacggacacaccaggatactgtatgaactggttacactggaaaaaaatacctctaggactaaaaaggagtaacaaagaacagatgaaacaagactttgcaagataatcttctatgttttaagcaagagtcttgcaggagaccccagtacttctctccaagaaactaaatctgtaatggatacatagctctaatcttttgtgcagcttatcttaaaaaaagagaatagtaaggtgatactgtacca

SEQ ID NO: 266198 - DNA, 433 bp, Homo sapiens
gacttcatgtctttaaaaaaattaagctaatgaaatgacacctaggatctaagggatgcccggaagcttcctcagtccttctctagcttggtgccatttcttgtagacagagaggagagctattaagacacacgacagcagattgttctgtaatgatgacattcttgcttcatgtaaatagccatttagaagcctcagttgggactttgcagaatggaatgcagttcttggataatcagaaaatgacttattttgggaattcttcatttgggaattagagggttttctattctgtttaaccattgcattaccatgcctggattctatttttaaaatcttacctacgttttaaaaaatgagtattatttaatggaagctttcccccaattgtaaattaacctgtgcattcattatagaaaattagagaaagtac

SEQ ID NO: 266199 - DNA, 602 bp, Homo sapiens
ttaagggcaaaaataataaaaagccctttttacctcttttaacctctgtaaaattactatagttatatgcctttctctgaagtgattggatttcttcaaaggcagagctacttaaggccaggtggctatgctaatggtcatctagggaacttttatgagagcatatgtatatcttacaagtaatgatttattcttaatatggctgtccttagctggaaaagtctttataggtcaaagaaccgcatgaatatttaaaaagctgttaccaatttttctaatcttggtggtgtttcttgatctcctttgccatgaaatcctggtatgtgtataaggaacagatggagtagttaatagaataatgacaaccagattttcttttactacagagcctaagtatataactaaaaaaaaaaaattaaactagtattcctctcaggacataatttaaatttatttatcttaattgtttgattgctaggtttttccaggaatgtttattatgaagattttaaaacatctgattgggccagtgaaacatccatagaaaatttttggtcctacgggaggagatctgttctcattataatagatactgatgagat

SEQ ID NO: 266200 - DNA, 229 bp, Homo sapiens
cacaaggaaattcctggtgagctccaagatttctgccctaaggtgttcctgttaaaatttcgccatggtaatgtaaatcgatagcttgtctttacaggtgcagtcatccccctgcctaccagatacaaatgcatatctgattgttcccctgcccttttgttatgttttgtctatgttaccttatgtaataatgcagattcctctgccccatttgtctgtcatcttatgt

SEQ ID NO: 266201 - DNA, 483 bp, Homo sapiens
gtgaccagaatttactgtgtactcacataaccatctagggccaccattgtcaaagattgtgttgtatttttctcctcatgagcaaccctaagatttggtttggttggttccagctctgaacagtacaagtgatatggtttggatttatgtccccacccaaatctcatgtcaaattgcaatccccagtgttggagatggggcctggtggaaagtgatgggatcatgggggcaaatttcccccttcagtgctgtgctcatcgtagagttctcacgagatttggttgttcaaaagtgtgtagcccctgccccctgtttctcttcctcctattccagccatgtaagatgtgcccattcctctttgccttcagccatgattgtaagtttcctgatacctccctggtaaccaacaaatgccagcatcatgctccctgtacagcctttggaactgtgaaccaattaaacttcttttctttataaattacc

SEQ ID NO: 266202 - DNA, 464 bp, Homo sapiens
atatagattaatctcaaaatacttatgttgggtgaaagaagccaggtcaaaaaacagataccatatgattctatttatttgaaattctagaaaatgcaaactaatttgtagagatggaaaacagatgagtgtttgccttaagagtggttgtgagattgggagggtggaagggaggaattagatgctctaaaggaaacattttggagtgatgtgtatgttcgttttttctaatcatggtgatggtttcatggctatttattacatgtcaaaacttatcaaattgtacatttaaaatatgtgcaattcattgtatttcaattatattccaataaaggcattttttaaaaagtaaaataggaaagaacagtatgacaaaaggtagccaagtttggacatataacagttcactaagcagatgctggtagaaaccaaataaacatttggggagctaaagaaaaaaaaaa

SEQ ID NO: 266203 - DNA, 614 bp, Homo sapiens
ccggaattgaattatgaagtcttcaagagtgttggtaaagcagttccataaggttcatctgtagaagtctgttgactttaaaacttggtgggaagccttattgtatgtaaagtttaaagattttagaacacaggaatatcttcttacctgagtttatcctatttgcctttgtatagtaggatgtaaaggggctctctaaacctaataaaaattaaatcctcaggctgggcaaggtggcttacatctataaccccagcaccctgggaggccaaggtgggagcattgcttcaggccaggagttggagacctgtttaggcaacatagagaaaccccagaattagtcaggcttggaggctaaaggtgggaggatcccttaagaccaggaggttgaggctgcagtgaactatgattgtgccactgcactccagccttgggccagagtgagacccctgtctcgtaaaaaaaaaaaatagtctaagaatttattgtgcatgggattttggctacttagactgaacctaaaggagtttttgagacagtttaagtctaggatgacagccattcctgtatatctattgattgtataaggagagctaactttcagttggcagttg

SEQ ID NO: 266204 - DNA, 448 bp, Homo sapiens
actggcctaacccaatcatggaagttccattttcagtatttgatctagacaaagccatgtgacccacaactctgaccagtaagatatgaagcattgttaaagaaattgctgcttctgctgctgaatgctatccaggatgcatgtgatggctgaaaatagggccataaggggcattagcctgaaatacatgctgagaatggcagagagacatttgatgacataactgaatcaatctgacactgccttaccatctatgaaatattataaaaacatcctgaaaactctatgctttcagaagttctttaaaaaacttagcctggcgtttggtggcatacacctgtagtctcagctactcagtgggaggactgcttgagcccaggagtttgaggctgcagtgagtattgaatcactgcattccagtctgagtgacagagcgagactctgtctc

SEQ ID NO: 266205 - DNA, 415 bp, Homo sapiens
aaaaaaatatttttgagataggatctcactgtgttgcccaggctagagtgcagtggtgtgatcatggctcattgcagcctcaacctcccagactgagtatccttctacctcagcctccagagtagctgggaccacaggcaagtactgccacacccggctaattttaaaattttttaggtagagacagggtctccctatgttgccctggagtttgagacctgcctggataacatagggagactccatctctacaaatatatatatatagcctggcatggtgatgtgcatcccagctacttgggaggctgaggtgggaggatcaactgagctcaggagatcgaggctgcagtgagccattattgtgccactgcattccagcctgggctacagagagagaccctgtctgaaagaaagg

SEQ ID NO: 266206 - DNA, 352 bp, Homo sapiens
cattaatgtatggtgatgaataaataatacgtttaaaacacgttattgataaaatactcacaagaatatgtatttccctagaatgtatccctatacttgatttaagtttcctattcatttgtatatgctcagtcagaaaggaatattgggcactttctataaaagatgtatcataagttgaatgtttgttctctgaagtatttcagggttaaatttaaggtaaatcatttaactaactatgcagtagaaaaatagttaatataattttaatatttggaaaagacttattgatatccttggctaggaaagaacattagaatgaaatgtatttttcacacgtaccctagaactt

SEQ ID NO: 266207 - DNA, 336 bp, Homo sapiens
cccctaaacacaagatacgagcttaagataagaaactatgaggactaaccaagctcattttatttttttatttttatttttccaagctcatttaaaaaataaccaaatacaacttgaaaaaataaaaatgtaataattaaaaataagagagtgaatgaatttatgaataggtaaatccaagctgcatagaaaattaatcaaaagaatttgagccgggcgcagtggctcacgcctgtattcccagcactttgagaggctgaggcaggtggcttacagtgtcaggagttcgagaccatcctggccaacgtggtgaaaccgtgtttcttctaaaaatac

SEQ ID NO: 266208 - DNA, 280 bp, Homo sapiens
agagaaaaaaaatctacaaaaaagaaaacagaacatcagtgagttttgagacaaaatcatatattctaatattatgtacttagagtctatgaagaggggagacaaaaactatttcaagacataatggctccaaatttttgaaatatggtgaaaactataaacacacaaatccaaggagcatgtccagctgagctcatggtcactcctattcccttttccttagcctcctctagatacatgtgtgccatccctttcctccacaccctggccactggatttc

SEQ ID NO: 266209 - DNA, 446 bp, Homo sapiens
catgcttagtgtagcctactctaggcacaggaagaggcagggctcacagctgccactgatgtatatgcagagtacgtacaaggcgagtggagcagccaagagaaccagactgtagcaggttaattggctggggctgacagattccaagtcaaactggcccaagctcatgtctgggattctaaagcagaaggaagagtcaagagagagggaatggacctggatgactgcaagaggaccaggtgcagaagccaaaacataccatactgaggcagacaggagcaggtggttaggggactaaggcaattactgaggagagaggctgatgaagacggaagtaaaagaaaaacaggttggagtgctgcagctgaggagccctgctggctgcagtaccactgtctacattattttaaaaactatttcttcttttttataaaaaaatcaaacta

SEQ ID NO: 266210 - DNA, 219 bp, Homo sapiens
tagaggctgttatggtagctagtacgagggagattatacaaatttcaagaaatttaggatttcctatctctagctctattcttttccaaaaggagacaacattttctgagttatgtttgatacaatatgtctatgtttctatcacagtgacttcatgctgtgaatatatacatcagaggaacattaaactctaatgaaacccttctaaaaggctgtaac

SEQ ID NO: 266211 - DNA, 431 bp, Homo sapiens
cctcccctgtccacagtctaaattggtgtgttgcctgggtgaaaaacacattgttcctctgtccacccctgtctgctctcatcaggagagtgagcctgcgcgggtctgcctgagcctgctctgtagacaggagaccactaaagcacttagtaaaggaaatttgcgatccagagcagagaggtttctggggaagcgaggacaagggcctgactttgcatgctacgaagagggcagcaagacgaatatgttacagataaaaaagggcagtttgcagaggcctgtggtggcacacacctgtaatcccagctactcagaaggctaatgtgggagaatgatttgagcccaggggttggaggtttggaggctgcagtaagcaatgatcaccactgcactccagactggacgacagggtaaaaccctgtctcttaaaa

SEQ ID NO: 266212 - DNA, 910 bp, Homo sapiens
gggttccaacatgaaccccaagtgaacactcccagggtaggtgctgtacattgtggccttctctgcattcaccacccacagcttatcacttcggcagtgactcccagcctgtagccttgttttctaatacacaaaatctgaacacaaaccaagtgcccatcaactggggactggttaaattaatcatggtatgtctttacaatggcgtatttgcagttattaagaatcatattgtgattgagcacggtggctcatgcctgtaatcccagcactttgggaagccaaggtgggtgggtcacttgagggcagaagtttgagaccagcctgtggtcctaagggaacttgggagactgaggtgggaggatcgtggctacagtgagctctcatcacgccaccacactccagccttggcaacagagtgagaccctatcttttttttttttttttttgagacagagtctcaaacaaacaaaaaagaatgatattgtggttcatgcctgtaatcccagaaatactggaggccaaggtgggaggttcgttgagcccaggagtttgagagcagtttgagcaacacagggagaccctgtctctcccaaaaaataaaaataaaaaaataattagcctgtggtacatgcctgtggtcctaggtacttgggagactgaggtgggaggatcgtggctacagtgagctctcatcacgccaccacactccagccttggcaacagagtgagaccttatcttttttttttttttttttgagacagagtctcaaacaaacaaaaaagaatgatattgtggttcatgcctgtaatcccagaaatactggaggccaaggtgggaggttcgttgagcccaggagtttgagagcagtttgagcaacacagggagaccctgtctctcccaaaaaat

SEQ ID NO: 266213 - DNA, 751 bp, Homo sapiens
gcctggagcggcgctccatctccctgtgaaacgactcactggctatttgtcctgataacaatcaccccaccccccaccccccacccccagcacatcctgccggccggcctaacgcagatacctaattggcgttattggaaaaaatagaatgagggtggaggaatgaactgtccacagctagaataatgcactccccaccccaggcttcagccccacaggatccagactgagtgaggtcttcggacctgagattcgccctgtgccaaaaatcattctcaacacaccggactgcactgaagaagctggctgttaggtgactctttccttttctttttaaaacaaatatactttggacaaagcagtagcaaatgcttaacgtttaattgttttgtaagatgagggggtgagccgctcatctctaaggcaacatccagctgaaatttcgtgactttaccattctgtgcctgaagaaccaggggttatcctttcctttttttttttaaagagaagctccgtaaataattatggggagtggggggagggcagaatatgtacacgcgattcataagtcttttcaatatattaacaagtttttttcttttttttaagctgtgcaaatgatttggaggccggttttagtttcctgggcccccttcccccatgtgttgtcgtaaaggctggtggctgagctgggtgtaagtggcactgccagagctcgggatcaggcaagcagagtgaggccaggggtgca

SEQ ID NO: 266214 - DNA, 403 bp, Homo sapiens
taggaggtcccagactcggaccattcaattagtttttaaaaataacaatttctttaaatttagagaagaaaataaaaggatgactgtccccaaactaatatttgaaacctacaaccccaaattcagaattcaatcaaatgccaccatctccatgaacccttccctattctccctggccagaagtcacattctggatggtttctgattatgagtgcgtcttctatgaccctgctaaatacagctccaagaaggtacgggctgtcttattgatctctgggttccccacagcaccccatgcaggtcagaagtaaaccccgatcattaagtgagtcaagggatccagtcctggctgggtgtgagggcttatgcctataatcctagcactttggggaggctgaggcag

SEQ ID NO: 266215 - DNA, 198 bp, Homo sapiens
cttggcctcccaaagtgctaggattacaggcataagccaccatgatggccaggcccaggctctcagaattcaaacagatgtgcttcccaggcccatgctccaggtctgccctgcctccccctcaagctctccttcccactccctcatcacatctcccattcagtaacttgttccaagaaccagtttccacttcctccc

SEQ ID NO: 266216 - DNA, 328 bp, Homo sapiens
ggctcaccgcaacctccacctcccggattcaaaactattctcctgcctcagccttcctgagtagctgggattacaggcatgcgccaccacgcccggctaattttgtatttttagtagagacagggtttctccatgttggtcaggctggtctcaagctcctgatctcaggtgatctgcccgcctcagccccccaaagttctgggattacaggcgtgagccaccgcgcccggcctgtttgcttattttaagagaaataagattttatgcaacagttttagttaagcagatagttaacgaaatcagatttacatttttaaaataccactct

SEQ ID NO: 266217 - DNA, 356 bp, Homo sapiens
cagttgtatctgtgtattggtttgctaaggctgccaaagcaaaggaccactgtctgggtggtttgaacaacagaaatctattttctcacaattttggaagctagaaggccaagatggtgtcaggagggtttgttttcttctgaggcctctgtttgacttgtagatggccattttcttctccctgtgtctttgtgtccggaatttattccttccagtgggttcttggtctcactgacttcaagaatgaagccgcggagcctcgcggtgagtgttacaattcttaaagatggtgtgtccagagtttgttccttcacatgttcagatgtgtctggagtttcttccttccagtgggttcg

SEQ ID NO: 266218 - DNA, 343 bp, Homo sapiens
aagccggaagaggtcctgttgggctcccaaatgctgatctgtgaggacccccatcaagctctgccaggggcccctaatcttcagacctaagtctgccccccaggccccagctcagccactcaccctgcctctggcctcacctcttccctttcctgcacgcaacgcgccctctcggccctccctgtccccctcctctgtctcgtctccccatctggtctggaacctgtttgcaagtgaagcaatatctccgtgttttgtatatacaaccgctcttgtagcctttggtttttgttaatgtagagaaacacagattctttatacactttgtaagatttacgccaaa

SEQ ID NO: 266219 - DNA, 388 bp, Homo sapiens
ccccaagagacgagggcgctgagctcccggtatcctctaggtggcgcacaattctctggggaaaaggagaattccaggtgaactaattccacgggaagaagggttggtttgggaggggctaagccctgcctacgggctcctgtaggggaatcagctccccatccccctgctccctccagagcagcgcccagcattcaatcattcgctcgcatttatttgtctcccgcctgcctgtggccaagacttgccatttgtaggtcacagcacaaagcggaggagggcagggttgtctgacttggagctcaggaaacctcggcttggggctggttttgcatctgagttgctgtaagacttagcacctttctgggtctcagtcgttccaacagtt

SEQ ID NO: 266220 - DNA, 327 bp, Homo sapiens
aaaatgactttattgtatagtctttgttgtaaagggtatttaagtatatgaaagttaacaagatagagaagaagagtagggataaacaaaattaaaataatgtaatctaaaaacaatgagaaggatgtttccacatgaatttcctactgtgatctttcactcaactgtgcagctcaatgaaagcaaaaataatagaaatgagatggtgggaaaatcgacctggaacaatttcttcttgagacaatttgttggcctggcatgttgactcacgcctgtaaccccagcactttgggaggccagggtgggaggatcacttgagcccaggag

SEQ ID NO: 266221 - DNA, 245 bp, Homo sapiens
agagtacatattcatgaaaaacttgtctgatttttttaaaaaggagatttttctagccctgacagaaaaaacttcagctagattaagcaagagtgataatatgtgaagaaaagcactaagcaattcttagctagactggtactattatataattaatgtttgcatgcaaaatagttttccattacctcaacatatttgtgtctttgtcattcaaacacgtcttttgtacacagcataaaactggg

SEQ ID NO: 266222 - DNA, 439 bp, Homo sapiens
gaaaagatggttgccaaaggctgggaagggtagtagggagcttggggtgggaaaggtggggatgattaatgggtacaaaagtaaatagttgggaagaatgaataagacgcactatttggtagcacaatagagtgactatagtcaataataacttaattgtacattttgaaataaagattatatttgaaatgtttgcaactcaaaggataaatgtttgaggagatagttaccccattctccattatgtgcttgtttcatattcaatgcctatatcaaaacatttcatgtaccccttaaatatatacacttatgatgtacccacaaaaaattaaataaaaacaaaggattaatgaatctaaataaaaacaaagcaggagtgccttgttgtctataaagatgggttttcttaagtaaaaacattttaaaatctctttgtgtt

SEQ ID NO: 266223 - DNA, 5311 bp, Homo sapiens
  misc_feature (1257)..(1257): n is a, c, g, or t
gaattcctagactcccgagtcttggaatcttagaattacagggtcgcaggatcgcaggatcgcattctttagatttatggaatcacgttagccccgtcgtccagaatttaaaatctagatatctgaatctcagaatcttgaaagttactgagagccacgaaatcccgtattaaaaggtgcctataatataatccagttaaaaattttaaaatttgaagtttttcctcctttgtaaaaacgaaacagacgaaatctgggcgttttgcttctccattacttgggaagaaggaaaccaggagttttgtttagcgagtgtaaagcccctctcccttcgttcgaccaaccctctaccgcagaaggttgtcaagcaaagcgctttgagcgtttccacacaccgggtcgacggagcaaggatctgggctttgcctcgctcttccgaaggcagctgcccaacgcttggccgggcttagcctgccctcagctcaccgccacgaagaacgcgactaaaaccctccaaggcatgccacccgttaccggccagaacctctcgtcttgggatctcccacactcacctggcaccaccctccgcgcggctctgcacccacagccccggcccgcccccccccccccacaccggaaagctgcgtccgggctggagcactggaacccgcgcccaaggggggaatcctatgcgtcaggggcctcggagatcagcacacgcccaccagctatttaacagagtagaaccctgaggccctgcgaggggacaaggacaggccctggatctcccagtgaatggccagggaacgaacccggcgagaggggcgcgcgcaggatctcaggttaaggaccaagttccggctcagggacagcaggaaaggaactcagaaattggacaccatgaagcaaacgtgtgtcccgactgcccgccccttcccccggagacgcccacccggccaccgttctcttcccactcccccattacccacagccctcactcccctgcggaaggggtgcttggctgcctctgggggcttcagagctaccctggtcccgggggattggaggaggaggttacctctcctgcgtcgttctttcaatccgtgcaccactatccatcaaatagagacagatcctgggcctctcaaagacggatgattgggggtggtgattggcctatccctaaatatctaccacgcaaggactcttgagagatccagaccccggtacagtcgagggacctggggcccaaaaagnggaaagcggctacctcttaccacacagttgggaagcgcagtcctaaaggagacgcaggttggagactccgctaagcggagaagccgcagtggggccatggaaagtcaccttccctttcggttctaggaattactcattcgaaagatggggggactggagtgccgagtggctgtggcagccacgattggggtttggaaaccatcctgaaaggcccggggagccagtctcctggaacttctccctccctattcccacaaaaaccaagcgccctctcggccaattctcaccctctcaggacaaaaaagtgagatgagcccgtcctttcacctgcgatccaagcccttggcagaggcctgaaaagtccgaaaactccgagttcgggcggtgaggtctcccgagccggttcctgaactctccgggcctcagtcgatcggggtgggacccccccccccccgcccatctccaagcgccctccccaccctgacgttgtggggctcctaccgggcgccacagctgctcctacctggggaggtgcgccgggccccaggggggcggacaagtcggggggcgggcagggaaccggttccgccccacgcttcgtgtgcccctttaaggaggggaagccggccgagggaggagccggtccagtgtgtgcaggggagcgcctcgccagcggtccgcggggctggagacccacgccgtggagaggaccagcctcaggtcgccccgcctgggcccgcgccccgacctcgctgcccccgcctcgcctctctgcccgtggcgcttaccgccaccttggcctcgggggcagggcatgggcggcccccgccagatcgcccagcgccagtactaactgccctcgctctggccttcgagcccgaagcctcttctgcgcgcacaacctaggcagtaatcctaaactagcgggcaccacagaccagctgcagccaccccaacccagggatcacttccggacccctcgaccgcccggcaccagcgcgcaagggacccttcagccggagaccagagtccagtcccggtcgcgaggccaccgccgctgcccgcctcgagaagcacaacgcgggctgagccgtcggctagcgggtcactcccgagcctctgtctgcaccgcgccagccccagaccacggacgctgagcctccagcgcgcgccagcctgggccgctgggctctccgggccagcccgcgacgatcccctgagctctccgcagaagggccgagcgtccgttccggggacgccaggcccgcccccgccccccgacagccgcggggatccagagcccgggggtgcgggacgcccgcgccatgactgccgagagcgggccgccgccgccgcagccggaggtgctggctaccgtgaaggaagagcgggcgccgcaagcgccccctgcagcgcgggaagccgccctacagctacatcgcgctcatcgccatggccatcgcgcacgcgcccgagcgccgcctcacgctgggcggcatctacaagttcatcaccgagcgcttccccttctaccgcgacaaccccaaaaagtggcagaacagcatccgccacaacctcacactcaacgactgcttcctcaagatcccgcgcgaggccggccgcccgggtaagggcaactactgggcgctcgaccccaacgcggaggacatgttcgagagcggcagcttcctgcgccgccgcaagcgcttcaagcgctcggacctctccacctacccggcttacatgcacgacgcggcggctgccgcagccgccgccgccgccgccgccgccgccgccgccatcttcccaggcgcggtgcccgccgcgcgccccccctacccgggcgccgtctatgcaggctacgcgccgccgtcgctggccgcgccgcctccagtctactaccccgcggcgtcgcccggcccttgccgcgtcttcggcctggttcctgagcggccgctcagcccagagctggggcccgcaccgtcggggcccggcggctcttgcgcctttgcctccgccggcgcccccgctaccaccaccggctaccagcccgcaggctgcaccggggcccggccggccaacccctctgcctatgcggctgcctacgcgggccccgacggcgcgtacccgcagggcgccggcagtgcgatctttgccgctgctggccgcctggcgggacccgcttcgcccccagcgggcggcagcagtggcggcgtggagaccacggtggacttctacgggcgcacgtcgcccggccagttcggagcgctgggagcctgctacaaccctggcgggcagctcggaggggccagtgcaggcgcctaccatgctcgccatgctgccgcttatcccggtgggatagatcggttcgtgtccgccatgtgagccagcgtagggacgaaaactcatagacacatcggctgttcacacgttccccgcaacctgagaacgaacaggaatggagagaggactcaactgggacccacgtggaaaagaccgagcaggccacagaggctcggtctccccgcgcacagcgtaggcaccctgtgtactctgtaaacgggaggaggtggggcgaggcagccagagcccttggactggcacagggaccctcgatggagcgaagccctcaaacgggatgctttctggcattctatcggggagggtccttggcggtaaccagagggcagcgtagtgtcaacaccagagaccaggatccaaattgtggggaatcagtttcagccttccatgtgctgccggaactcgggcctttttacgcggttcgtcctctagtgcctttaactgcgttactacaataaaaggctgcggcagcgcctttcttcttaaagtgaggaggacaaatttgcaaaagaaataggcttttcttcttttttaaattggagaaatctctgctctggttgacctgggctggttttccctgtctctgagaacttgagacctagctccgagttgaactgtgcgtcagcactccagtcccatcacctgaaccttcagtctcccccatctgttacactagagggctgcaggactctatccaccgcccccgggttatcattcagggccccatcatcttggatgctgccctgcgtatttggcagcaatggtgggccacccagggcctctgagtagccacccaaagcctagccgctgttctagggaacggaaaagagttcatggccaagcgtctaacctaaagtcccaggattggctccaggcagcaattatatcataacttattgaacttttgagcaggacgtgctggtaatttcatggctgttactgcccagtcataaatctgcttttccattataaggcagagagaagtacattcgttcatttgtccactgtttcttgtcatcacgcagccctggacccaaagggtgaactaaagtttaaggagatgagaggattcaaggagcccgttggtgacgcctttcagtagctggggagggctcttccatccccagcaccccctgctacacctcagcagcctcccccatgcaaaaaggaaagagaaaaattaagttagggcagtcagtaaagtgagctttagaaagaaactggaattttaacttcattttgtatcttgcttaagtagcaggctcactaaaattagagaaagtccaataactctccccctttcccttgagaaatctttaagtttcgattctggagcaaaaactttcagcattaaatatttcagaggctccattcacagctttcagataaactggagtgttcagatggactgttttaataaaaatctttgagcaagtgagttatggcaagagaaactcagcctctttctgtataaacttaacagggaagggctggggtgtgaaaaagaagattgtatgaaaaccattggtaatttttattttttatttttgggactgcactatcctgttcacgaagacatgtgaacttggttcagtccaaatggggatttgtataaaccagtgctctccattagaaatatggtgcaagccacatatgtaattttaaatattctagtagccacattaataaagta

SEQ ID NO: 266224 - DNA, 5373 bp, Homo sapiens
  misc_feature (1257)..(1257): n is a, c, g, or t
gaattcctagactcccgagtcttggaatcttagaattacagggtcgcaggatcgcaggatcgcattctttagatttatggaatcacgttagccccgtcgtccagaatttaaaatctagatatctgaatctcagaatcttgaaagttactgagagccacgaaatcccgtattaaaaggtgcctataatataatccagttaaaaattttaaaatttgaagtttttcctcctttgtaaaaacgaaacagacgaaatctgggcgttttgcttctccattacttgggaagaaggaaaccaggagttttgtttagcgagtgtaaagcccctctcccttcgttcgaccaaccctctaccgcagaaggttgtcaagcaaagcgctttgagcgtttccacacaccgggtcgacggagcaaggatctgggctttgcctcgctcttccgaaggcagctgcccaacgcttggccgggcttagcctgccctcagctcaccgccacgaagaacgcgactaaaaccctccaaggcatgccacccgttaccggccagaacctctcgtcttgggatctcccacactcacctggcaccaccctccgcgcggctctgcacccacagccccggcccgcccccccccccccacaccggaaagctgcgtccgggctggagcactggaacccgcgcccaaggggggaatcctatgcgtcaggggcctcggagatcagcacacgcccaccagctatttaacagagtagaaccctgaggccctgcgaggggacaaggacaggccctggatctcccagtgaatggccagggaacgaacccggcgagaggggcgcgcgcaggatctcaggttaaggaccaagttccggctcagggacagcaggaaaggaactcagaaattggacaccatgaagcaaacgtgtgtcccgactgcccgccccttcccccggagacgcccacccggccaccgttctcttcccactcccccattacccacagccctcactcccctgcggaaggggtgcttggctgcctctgggggcttcagagctaccctggtcccgggggattggaggaggaggttacctctcctgcgtcgttctttcaatccgtgcaccactatccatcaaatagagacagatcctgggcctctcaaagacggatgattgggggtggtgattggcctatccctaaatatctaccacgcaaggactcttgagagatccagaccccggtacagtcgagggacctggggcccaaaaagnggaaagcggctacctcttaccacacagttgggaagcgcagtcctaaaggagacgcaggttggagactccgctaagcggagaagccgcagtggggccatggaaagtcaccttccctttcggttctaggaattactcattcgaaagatggggggactggagtgccgagtggctgtggcagccacgattggggtttggaaaccatcctgaaaggcccggggagccagtctcctggaacttctccctccctattcccacaaaaaccaagcgccctctcggccaattctcaccctctcaggacaaaaaagtgagatgagcccgtcctttcacctgcgatccaagcccttggcagaggcctgaaaagtccgaaaactccgagttcgggcggtgaggtctcccgagccggttcctgaactctccgggcctcagtcgatcggggtgggacccccccccccccgcccatctccaagcgccctccccaccctgacgttgtggggctcctaccgggcgccacagctgctcctacctggggaggtgcgccgggccccaggggggcggacaagtcggggggcgggcagggaaccggttccgccccacgcttcgtgtgcccctttaaggaggggaagccggccgagggaggagccggtccagtgtgtgcaggggagcgcctcgccagcggtccgcggggctggagacccacgccgtggagaggaccagcctcaggtcgccccgcctgggcccgcgccccgacctcgctgcccccgcctcgcctctctgcccgtggcgcttaccgccaccttggcctcgggggcagggcatgggcggcccccgccagatcgcccagcgccagtactaactgccctcgctctggccttcgagcccgaagcctcttctgcgcgcacaacctaggcagtaatcctaaactagcgggcaccacagaccagctgcagccaccccaacccagggatcacttccggacccctcgaccgcccggcaccagcgcgcaagggacccttcagccggagaccagagtccagtcccggtcgcgaggccaccgccgctgcccgcctcgagaagcacaacgcgggctgagccgtcggctagcgggtcactcccgagcctctgtctgcaccgcgccagccccagaccacggacgctgagcctccagcgcgcgccagcctgggccgctgggctctccgggccagcccgcgacgatcccctgagctctccgcagaagggccgagcgtccgttccggggacgccaggcccgcccccgccccccgacagccgcggggatccagagcccgggggtgcgggacgcccgcgccatgactgccgagagcgggccgccgccgccgcagccggaggtgctggctaccgtgaaggaagagcgcggcgagacggcagcaggggccggggtcccaggggaggccacgggccgcggggcgggcgggcggcgccgcaagcgccccctgcagcgcgggaagccgccctacagctacatcgcgctcatcgccatggccatcgcgcacgcgcccgagcgccgcctcacgctgggcggcatctacaagttcatcaccgagcgcttccccttctaccgcgacaaccccaaaaagtggcagaacagcatccgccacaacctcacactcaacgactgcttcctcaagatcccgcgcgaggccggccgcccgggtaagggcaactactgggcgctcgaccccaacgcggaggacatgttcgagagcggcagcttcctgcgccgccgcaagcgcttcaagcgctcggacctctccacctacccggcttacatgcacgacgcggcggctgccgcagccgccgccgccgccgccgccgccgccgccgccatcttcccaggcgcggtgcccgccgcgcgccccccctacccgggcgccgtctatgcaggctacgcgccgccgtcgctggccgcgccgcctccagtctactaccccgcggcgtcgcccggcccttgccgcgtcttcggcctggttcctgagcggccgctcagcccagagctggggcccgcaccgtcggggcccggcggctcttgcgcctttgcctccgccggcgcccccgctaccaccaccggctaccagcccgcaggctgcaccggggcccggccggccaacccctctgcctatgcggctgcctacgcgggccccgacggcgcgtacccgcagggcgccggcagtgcgatctttgccgctgctggccgcctggcgggacccgcttcgcccccagcgggcggcagcagtggcggcgtggagaccacggtggacttctacgggcgcacgtcgcccggccagttcggagcgctgggagcctgctacaaccctggcgggcagctcggaggggccagtgcaggcgcctaccatgctcgccatgctgccgcttatcccggtgggatagatcggttcgtgtccgccatgtgagccagcgtagggacgaaaactcatagacacatcggctgttcacacgttccccgcaacctgagaacgaacaggaatggagagaggactcaactgggacccacgtggaaaagaccgagcaggccacagaggctcggtctccccgcgcacagcgtaggcaccctgtgtactctgtaaacgggaggaggtggggcgaggcagccagagcccttggactggcacagggaccctcgatggagcgaagccctcaaacgggatgctttctggcattctatcggggagggtccttggcggtaaccagagggcagcgtagtgtcaacaccagagaccaggatccaaattgtggggaatcagtttcagccttccatgtgctgccggaactcgggcctttttacgcggttcgtcctctagtgcctttaactgcgttactacaataaaaggctgcggcagcgcctttcttcttaaagtgaggaggacaaatttgcaaaagaaataggcttttcttcttttttaaattggagaaatctctgctctggttgacctgggctggttttccctgtctctgagaacttgagacctagctccgagttgaactgtgcgtcagcactccagtcccatcacctgaaccttcagtctcccccatctgttacactagagggctgcaggactctatccaccgcccccgggttatcattcagggccccatcatcttggatgctgccctgcgtatttggcagcaatggtgggccacccagggcctctgagtagccacccaaagcctagccgctgttctagggaacggaaaagagttcatggccaagcgtctaacctaaagtcccaggattggctccaggcagcaattatatcataacttattgaacttttgagcaggacgtgctggtaatttcatggctgttactgcccagtcataaatctgcttttccattataaggcagagagaagtacattcgttcatttgtccactgtttcttgtcatcacgcagccctggacccaaagggtgaactaaagtttaaggagatgagaggattcaaggagcccgttggtgacgcctttcagtagctggggagggctcttccatccccagcaccccctgctacacctcagcagcctcccccatgcaaaaaggaaagagaaaaattaagttagggcagtcagtaaagtgagctttagaaagaaactggaattttaacttcattttgtatcttgcttaagtagcaggctcactaaaattagagaaagtccaataactctccccctttcccttgagaaatctttaagtttcgattctggagcaaaaactttcagcattaaatatttcagaggctccattcacagctttcagataaactggagtgttcagatggactgttttaataaaaatctttgagcaagtgagttatggcaagagaaactcagcctctttctgtataaacttaacagggaagggctggggtgtgaaaaagaagattgtatgaaaaccattggtaatttttattttttatttttgggactgcactatcctgttcacgaagacatgtgaacttggttcagtccaaatggggatttgtataaaccagtgctctccattagaaatatggtgcaagccacatatgtaattttaaatattctagtagccacattaataaagta

SEQ ID NO: 266225 - DNA, 958 bp, Homo sapiens
agcggatgcgctcgaagggaggtggaggcgcaggtccgggcgaagggcgatacggtggccgagagggcacggagaggaggacggtggctgacgagatccggcatggagcatctggagcgctgcgagtggttgttgcgggggacgctggtgcgggcggccgtgcggcgctacctgccctgggccctggtggcctccatgctggcgggctccctcctcaaggagttgtccccgttgcccgagagctacctcagcaacaagcgcaacgtcctcaacgtgtattttgtcaaagtggcctgggcctggacgttctgtctccttctgcctttcattgccctcaccaactaccatctgaccggcaaggctggcttggtcctgcggcggctgagcaccctgcttgtgggcacggccatctggtacatctgcacctccatcttctccaacatcgaacactacacgggcagctgctaccagtccccagccctggagggggtcagaaaggaacaccagagcaagcagcagtgccaccaggaagggggcttttggcatggctttgacatctcaggtcactccttcctgctgaccttctgcgccctcatgattgtagaagagatgtctgtgctgcatgaggtgaagacggaccgaagccactgcctccacaccgccatcaccaccctggttgtggccctgggcattctgactttcatctgggtgttgatgtttctgtgcacagctgtttatttccacaacttgtcccagaaggtgtttggcaccttgtttggtttgctgagctggtacgggacatacgggttttggtatccgaaagccttttccccaggacttcctccccagagctgtagtttgaatttgaagcaagatagttacaagaaataaaagagtaacagaggggggacagaaggacaatggctaatctatttttcaaatatatattttgcttagt

SEQ ID NO: 266226 - DNA, 876 bp, Homo sapiens
agcggatgcgctcgaagggaggtggaggcgcaggtccgggcgaagggcgatacggtggccgagagggcacggagaggaggacggtggctgacgagatccggcatggagcatctggagcgctgcgagtggttgttgcgggggacgctggtgcgggcggccgtgcggcgctacctgccctgggccctggtggcctccatgctggcgggctccctcctcaaggagttgtccccgttgcccgagagctacctcagcaacaagcgcaacgtcctcaacgtagacagagtctcaccatgttgcccagactggtctcgaactcctggggctcaagtgattctcctgtcttggcctcccaaagtgctgggattacaggtgtgagccactgtgcccagcccaggaattacttttgattctctttacctcactcccaaccctcatgtaaattcctgctcattttatcttcaaaatacctctcaagcccattcacacctcaccatatccactgcaaccatctcagtccacgccaacatcatctctcacctgagctgctgcaccggcctcccctctgtctcccttgaaatccattttcacgcagcagttggaattctctcaaatataaaaccggaacaactcagccccatggagactgcaaacagggccatgagttcctcccattcctgtacacatgccactttgcaatgtgtgcatcttgatggctttgctgctcctgccatctaagactcatagttttttttttctaagactgcaaactccgtgagagcaagaatgacatctggattttgctcattaatttatccctaggacctagcatctaggagatgttcaataaatatttgaaaaaatgaatgaaaaagaatg

SEQ ID NO: 266227 - DNA, 686 bp, Homo sapiens
ccagggtggagtgcagtggcacaatcttggctcactgcaacttccgcctcccgggttcaagcaattctcgtgcctcagcctcctgagaagctgggattacaggtaaccgccaccatgcctggctaatttttgtatttttagtagagctgtcttggcctcccaaagtgctgggattacaggtgtgagccactgtgcccagcccaggaattacttttgattctctttacctcactcccaaccctcatgtaaattcctgctcattttatcttcaaaatacctctcaagcccattcacacctcaccatatccactgcaaccatctcagtccacgccaacatcatctctcacctgagctgctgcaccggcctcccctctgtctcccttgaaatccattttcacgcagcagttggaattctctcaaatataaaaccggaacaactcagccccatggagactgcaaacagggccatgagttcctcccattcctgtacacatgccactttgcaatgtgtgcatcttgatggctttgctgctcctgccatctaagactcatagttttttttttctaagactgcaaactccgtgagagcaagaatgacatctggattttgctcattaatttatccctaggacctagcatctaggagatgttcaataaatatttgaaaaaatgaatgaaaaagaatg

SEQ ID NO: 266228 - DNA, 297 bp, Homo sapiens
acgtgagacatctatcacatgaatttctcactcacatctcaggcaaacacactaaaatgaaatacaaaagtcaggctgtgggggaggaaaagtattttaaagcaagacccaaggacactctgcctggtgaagatttaccgcctatcatttttaccatatccacccattttcaatgtgaaatgcagagtttacaagctaagtttgccgtgtactgtttatttccatcattttcaaaaaagaatccatgatcactttctcagactcaaatagcagttccatgttgaatatttagctaga

SEQ ID NO: 266229 - DNA, 539 bp, Homo sapiens
cacgagggaggccgaggcgggcggatcacttgaggttaggagttggagaccagcctggctaacatggcgaaaccccgtttctactaaaaatacaaaaattagcctggtgtggtggtgaacgcctgtagtcccggctactcgggaggttgaggtgggagaatctcttgagcccgagaggcggaagttatgagattgttttgccagatttttagaaaagagagatgaacaccttttaaactctgaggaaagaaatgggctcattggtatggagcagaacagaatactagggtaatgaagattgtatggtgttggcatcagtggaccaatggatcaatggaacaaaatgaagagttcagaaataaatctacacatctacagtcaactgattttcaaaaaatggctgccaagatggtgtcagaagtgggatccgaattagagctttcagtgacccccaggagcatcaagtgaccaagcgaggtacctgcagggcccattgtgtccattgctctttcacagcaactggggatgatggtaagttc

SEQ ID NO: 266230 - DNA, 674 bp, Homo sapiens
aagtgcaaaaaacaaacaaacaaacctatcaaccagaatgttattctgtcaaaactgtccttcaaaagtgggtgcgaaatgaagacattctcagacaaaaaaaaaagctgagaaagttgactaccattagacccgtcttgcaagaaatgataaaagaagtccctgcagggtaaaaataaaaggacactaaaaagtaacttgcagccacataaagaaataaagacttcaataaaagaaaatgcaggagcaattataaaagtatcattgtaaaaacagtctgtaactgcattttttgtttgctctgtgatttaagagactaaactttctctaaaaatttagtctaaaaggtagtgctattagttacaatgccacattttgttttctacatggtttaagaaatgaatgcactaatctcttattagttcattattactttatgtttttgagcacacaaggtataaagatgtaattctgtgacatcaacagtgaaaaaggtggtgcctgaactattagaggaagagagtttatgtagttaagctggtataaattcaggctgggtgcagtggtttacaactgtaatcccagcactttgggaggccagggcaggcagatcatttgaggtcaagagtttgagaccagcttggccaacatggtgaaaccccgtctatactaaa

SEQ ID NO: 266231 - DNA, 488 bp, Homo sapiens
agagacagcttctgattcatgttcgtctcaccataatccatttccctctctgcagatacttccaaaagttacactagatgttaactgagcactaaggacactacgtgaaagactggagtacaaacatccaaaggactgaagaatttgaagagcactgaatgtgggagataggacagaggaaaggagtcaaatgtctccaagaaacgaagcctgtgtgccctggagaatgaagaagcatcatcaaatcggggagactgaaggaggaatcggttttcagagaaaaacaatttatattgtcttagctgtgttaggtggcatactattacattcaagtgaagctgtgtaatagacagagatgacaaattttattcatttatgaatgccccccaaaatatatatatagtttttgccctcatgtctcttattgggatgacagacataaatcaaagaattccataaataaatattaaaatacaatttgtgataaa

SEQ ID NO: 266232 - DNA, 443 bp, Homo sapiens
ttctgatacattgctacatctgctgcaacatggataaaccttgaagacattataactgaaattagccagtcacaaaagaaagaaatactgtatgattccactcatctgaaatacatagagtaaccaaatgtatatagaaagaaattagaatggtggttgccagggactgggagagggagggccaagaaagggaatgaggaattaatgtttaatgggtacagagtttcaattatgcaagatgaaaaaaaatttgaagacgaacgatggtgatggttgcaccacaatgtgaatggacttcatgccactgaatcgtacacttgacaatggttagaatgataaattttatgttatatatgttttaccataattttagaaatttgttttaaatatccttaaagtaagaggaggaaaactgaaaccaaaaaataaagaaggaaaaatga

SEQ ID NO: 266233 - DNA, 444 bp, Homo sapiens
agattgtctcctagagcctccagaaaggaatgcagtcctgctttcattaaacttgtgctaattaaaattgcaaatagtaattgatatatttattttagcctaatgagacacattttatatttctgacctccagatgtgtgttaaatcagtaaatttgtggtaatttgttacagcagccatagaatactagtacaacactctactccaaacaaaaatgcttcagaaagtcaaaactacagctcattacttttttaaaaagtaaattattaaagtagaatgtatttatttatccttaattgagaaataaaatttgctcattcacaattatatctttgtaccttattaaatttcagatgtcaagtttaacacatgtttctgggttgcttcaaacataaatcataaactattaaccatgtaagaatcatcttaaatttgagttattat

SEQ ID NO: 266234 - DNA, 386 bp, Homo sapiens
ttttttttttttgtagagattgtggtctcacaatgttgcctaggctggtctcaaactcctgagcttatgtgatcctcctgccttggcctcccaaagtgctgagattccaggtgcacacacacgcacacaagcacacatatgcacatagacacacaagcacatgcagacacacacagacacatacatgcatgcaaacacacatacacgtgcacacactcatacacaagtccacacaggcacttcctgtgatctccaagcctgaggctttatgcttggtgggtggggtctgcctccaccctctgtccagaccaaggaccccctcagcctgcagagcagtgctgcagcttcgggaatgtgctgtgtgagctcccttctgtcttagaccc

SEQ ID NO: 266235 - DNA, 179 bp, Homo sapiens
aactaaaatatttaatgcatactagggtaaattagttgtctgccaaagccttgtatgtggaatatctcacacttcatggatgcctggccattgagccttactgtggtcactttcacattttcagtagaccggtatgtgtacaaggctttgtgatttcttgttgaaggatggagattaaa

SEQ ID NO: 266236 - DNA, 879 bp, Homo sapiens
aggttaaaaataataattatattttcttgtcctctgggtaaaatgagatttctttttatttgtatagaagaatgacagttgtgtcatctaaaatttaaaaaactttcagattatcttgcatctgttagtttttttggaagaattaatttagagaagatatctctgatcctggaaattagggaaaaatagcatataaacgtttaagtgtgtaccttctggttaagattatgacttctatatttcgattaataggttggagtttgtcttaatctgttttctgttgctgtaatggagtaccacagactgggtaatttatgaagaaatgaaatttatttcttatagttctggaggctgggaagttcaaagttgagccgaatctggtgagggcctcttactatgtcataacatgctagcaggcatcacagagcaaatgcactacctcagatctctcttcctcttcttaaaaagccactagtcccatcatgggggccctactctgaagaccttatctaattctaattggaaatagggtcttgaagccctcatcactagaggtaacctttaacaggaagagagaatttataaaaattataatgcagcaccaaatccctccctacttgtgaatagtcaaggtcatttcatttacagacttgttattaaagaaacaggttaaacaaatagattgagaggaaatgtggttcatgtctgagatcagcaaacttttttgtccagaagtccagataataaatattttagctttgtgggtcatgtggtctcagttgtagctacttgtctctgctgctgtacctcaaaagcagccatggataatatgtaaatgaatggggatgactgatttccaataaaactttatttacaaag

SEQ ID NO: 266237 - DNA, 251 bp, Homo sapiens
gcgtcgacaatataaacagggactatgaggtatgtacaggaaattaatagctgaagaatattttaccatgttcaaaaactaaattcttcatgtggctgagagaagaaagaaaaaaatggtatgtttgtgttccatttgcaggtattacataaacccattttaaatgaactaaaatgcctaggatttgggggggaaaaattatcttgtgctcgcatttgaaggttcttctcagaaataaactgtttaaagag

SEQ ID NO: 266238 - DNA, 894 bp, Homo sapiens
tatgcagttattttgtttgttggagggcaaaacatgtccttcttacatgtcagaattcctaagtgaaattggtggtctgtctagttcaataagatcatagttttgccaccctgcagtgcttatcataccctttgttacgtagaatcatgtcaagtttgggggtacctgataatgtatataatggctttcgtcccccgttaaacatggtaatgggaacaaacccgaccagaaaacctggctatgggtcaaacagtgaagctggggaagggaagtggagtctcttcaaaagctctaggattttgagtagctctcattcatcagaatatcagaaagaggcagttggtgtgtttttagcatttgttgaatggataatgttgttttcagtgaacataggcttcaaaggtaaaatcaccaactagtgatcttagactctggattccatgttgctgccccacgaaggcctgtcctcctaggtttccagacttccccagttggtggtagagatcgccatcttcccatagctgtttgggagcatggacgtgtgtgtgctcctgtgcaaatatcaatgtgaaagacacatgcagagttaacaattcacattccaggcaccactgtggcaatgaaatgctccacataaccgtattttccaaaaattcaaagtctgtatctttaatttgttgtgttctttaggcccttggtttcttaaacagagcataataaacatccctttttatgatgagaactttttctgttatgaagcttcagcttaaagttgataaagttgttacagttattgatatttgaccactgtgtgtatgagagagtgtgtgtatataagtataaacaaaatgtgacttactgagtaactcctagtggtaacataattagtggaaa

SEQ ID NO: 266239 - DNA, 622 bp, Homo sapiens
catgattatatatgttatgttagagggtagtattggtgccagtttaatttgtctgacggggtacctattattcattttatatttgttttattagaatcattctccttcccatgtattctctttgaacttcctttgtgttgttaatatacagctcatcatgatctgacatttattgatgatttatgactagtttctcttgctcctacttaattgtgaactatttgattcttattcatagtacttaatcactactcactaaatacctgaaattttctactgagtagtcaccaacttgtagtagtcactacaagaattagttgtagaaaaagtagattggccagccatggtggctcacacctgtaatgacgacactttgggaggccgaggcaggaggatcacttgaggccagaagttcaagatcagcctaggcaacaaagtgagaactggtctctacaaataatgaaataaaacattagttaggcatggtagcaaacgtttatagccacagatactcaggaggctgaagtgcgggaatcgattgaacccaggcattcaagactgcagtgcactgtaatcatgccactgctctccagcctggacaacagagcaaaaccctgtctga

SEQ ID NO: 266240 - DNA, 247 bp, Homo sapiens
acaacacactcctgaacaattaatgggtctgagataaaaacttaggaaaacaaaacctaaaaagggaaataaaaccatatcttgagacacaaaaaaaatggaaaacgatgttagggaaataaaatcatattttgagacacacaaaaaatggagacacaacatatcaaaacttacaagtcttcaaaaacagttctaacagggaagcttatagcaataaacagttagattgagaaaaaagaaaagatct

SEQ ID NO: 266241 - DNA, 295 bp, Homo sapiens
ggcggaggcagagctgacgatggagagctctctcctccgtacagttcacttcccagagctggggtcagggtcctcgccccgcacccgccacagaagacgcatctccctctgcgctgattcctggcggcgggtggggagatgtcggagccagcaatgcgagatgtttgggcgttgggacccgagagtgggctggaggccagcctgggttggtcgagagtgtgggtgcgcgctctgtcgcgggcaggtgactccctgaccgcagttgacccaggcagtgcctgcgctcctgcgctgc

SEQ ID NO: 266242 - DNA, 421 bp, Homo sapiens
taggcagggtgtcattttagctctggaagtagggagaggaacttagggagatggtcaggggagggacttatatgatttggatctgtgtccccactcaaatctcacaccaaattataatccccaatgctggaggtggggcctggtgggaggtgattggatcatgggggcagtttcttatgctttaacaacatcccccttggtgttgtcacagtgacagtaagttatcacaagatctggttgtttaaaagcgtgtagcatgtccctctgtctctcttcctcctgctctggtcatgtgaagatgcctgctctggctttgcattctgccatgagtaaaagtttcctgaggactccccagccatgcttcctgtacagcctgtaaaactgtgagccaattaaacctatgttctttataaattaccca

SEQ ID NO: 266243 - DNA, 282 bp, Homo sapiens
cggtcttgaactcctgacctcaagtgatccacctgccttggcctcccaacatgctgggattacaggcgtgagccaccatgcccggccgatacttgtttagatgtgtcctcatacataccactttctcagttcacctttgtttctggcactcccagctgttcctgctggcacagtttacttcttactgaactcagtggtaaacttagccttcttttttctccccaaaacatctttatttcactttcttgaataatagatcatcagagtagaaactctaaatcg

SEQ ID NO: 266244 - DNA, 132 bp, Homo sapiens
atgtggtatggagactgaggagacctgggttccagaactccttctggcactgagtaactcgcaatgtgggcagagaactcaagctcttaagggctcattcatcccctctaagttggaaataacggcacgtgc

SEQ ID NO: 266245 - DNA, 509 bp, Homo sapiens
agcttttcattttcattcctgctagcagttcatgagcttagagcgatgggatgcatttacctggccttaagatgctcctgctgcaatgggaagtgaagccttggatagctttcctcctcctgtgcaatactttcttgtcattttcccacctgcactgagtcccaccgccagtcagggctgttttcaggtgtatgtgaattcatcccagcagtgtgccttctgctgccttttcctagggaactgaacatgttaaatcacagacgcgatgtggcactgattattgttcctcaaaagaaatgcgtgtctgaagatagcctcttacagattcctcacgggagtctctgttcagtgtcattgtaagtttctcagaataatcgcaggcgctctgatgcagcctggtaaagaagactcagtgatttctgggaactgcaaatgcttgccagctttccttctgtctgtggaaacactgaataaatgtattcatttctcctttccagcaaaaagttagt

SEQ ID NO: 266246 - DNA, 485 bp, Homo sapiens
atttggaacctcaaacaaagcttgatagaaggaagacaaaaaagcttccgtttacattccattttggttccccatttgacttcaaagaaaggaaagagaaggaggaaattcacatttttgtcattgttacagtcactttaattatgcaacgttttgttatgaaacacagttttctttttatgaaatagtgcagccctttggaagcagtgaaaatgctaagttcagaaaaattttacatggcacaccattgatctgcatgatgatagaaggataattaagatgctgtatcttaattatctggtagcagaaatatgagtctcctagtctcaagacttcaaacagtaagcagtggactgtacaagatcacgaggcagtcatcccctctctgctctgttccctctcctctacaatccttggagaaagctgtataggttgggttgtcctcaaaaccttagacatatgtgaaatacacaggattttggaaa

SEQ ID NO: 266247 - DNA, 465 bp, Homo sapiens
tattttaaattgtggtcagtgctatgaatgaagagaccaggatgctctaagagatcacattctagtcacaggaaaagactagggaagacctacatgaagttgggacatgaatgaaagagtgaatgaatggaaaaccagtgaggctggaggcagtgagcagtggggatggggttggagagagagatgaggactagctcttgcacagccttgcagaccatgttaaggagtttggtttttattctaaatgcaatgggactatatttataggttttaagcaggagggtgatggaatccagttcagctttctaaagattcactagctattgggtgagaatgaattacagaaagtggggtggtaaagagatgacaagtcagaagccttgtgctgcaggccagtcaagagctggtggtggtcccttgggccaaggggtccctgataatagagaagttattctccaggacaca

SEQ ID NO: 266248 - DNA, 282 bp, Homo sapiens
ccatgtatagattaccttttcagggagaaaaaaaaaaacgactaaaattggaagagcagagaaggaactgccttgagttgggttgagaccccacaaactctgagatgacagcaaaggagccatggaaaacaaggaaactatcccactctccaagcccctgccagagaactttaactaaaaacagtctctttagaacaactactgacaataccaccctggactgaaaaccactgaccttcaggaaaactcagtaataaaattcctcaagttaaagtccaagaa

SEQ ID NO: 266249 - DNA, 1059 bp, Homo sapiens
  misc_feature (6)..(8): n is a, c, g, or t
  misc_feature (48)..(48): n is a, c, g, or t
  misc_feature (218)..(218): n is a, c, g, or t
  misc_feature (460)..(460): n is a, c, g, or t
  misc_feature (839)..(839): n is a, c, g, or t
  misc_feature (953)..(953): n is a, c, g, or t
  misc_feature (964)..(964): n is a, c, g, or t
  misc_feature (993)..(993): n is a, c, g, or t
  misc_feature (1039)..(1039): n is a, c, g, or t
ggccgnnngcctgcgcaggggacagaggcctccggcggcgccccccancaacagcagggcggtgccacattggtcctgagccaggcctggccgccggagacggcgggactctctgggaggccggcggtcctcgggtgtagagggagacagctgcccgggggcacgggcgagcgcctctgggggtcctggatccgagacccgcggccccggggtggcgntgacgcctggagtcatgcgggcttggctgggccgggctcttggggcagccaggcgccgctgctggcgtctaggccacaccaccctgaacgcgcccggctcgcctctgatctgttgaagctaagcagggtcgggactggttagtacttggatgggattccgcctggtaatagcggtaccgtaggcttttggcttcccgctccctccttctttcccccttttgtctccgtgcttcccaactgcnccccgcctctgctccccgttgaccgcccccgtgccccagccgaagcccaggacctcctcctgaagatccgccactgcagcaccgccaggcagcagcatcccacctcttccgactcgcggcagccccacccaacccgggcgggacgggaccgaccccgagggtgcaggcgcgggttccctgaggtcccgggtctcttcacgctccccggactcccaggcaattgtattcattcattcagcgtcactgcaaccgtccaagccggtgggaggggcgagcaggggcagcgggtgccacagaccccagccaagacctccgctccagaacccgagggctgctttccccagaggaaggacattttcttcgccagccacgaggaaanccgtccctgtgcaccctgtttcccaatgccaccgacttcgtgtaaactccagtccggaggacaggagagagacccaggcctcgccccgtggacaggctcggcgccacggctccngccagacacangagcacactctacaaatctcggggcccancgcatcaaggagacagaaagaagcaaacgaaggaccttatgaaacncacccccaaagcaaccaacc

SEQ ID NO: 266250 - DNA, 889 bp, Homo sapiens
  misc_feature (147)..(147): n is a, c, g, or t
  misc_feature (389)..(389): n is a, c, g, or t
ggcgtttacagtcgtaattatcaggtgtggcagctcggtctgggcaatgccggcggtcctcgggtgtagagggagacagctgcccgggggcacgggcgagcgcctctgggggtcctggatccgagacccgcggccccggggtggcgntgacgcctggagtcatgcgggcttggctgggccgggctcttggggcagccaggcgccgctgctggcgtctaggccacaccaccctgaacgcgcccggctcgcctctgatctgttgaagctaagcagggtcgggactggttagtacttggatgggattccgcctggtaatagcggtaccgtaggcttttggcttcccgctccctccttctttcccccttttgtctccgtgcttcccaactgcnccccgcctctgctccccgttgaccgagaaccagcgccgccgccctcggccccgcggaagccccgccgcgccatgtcattcgccatcccgaagggaaactagagactaaagctggacagccgcgcgcgtgaaaagctggtggaatgccgaattgttgcagaaaacacgccacatacagggagacaccaaagaagagacaagaccaagggatgaccaggaatgggaacaagcccacaggtccacctaaaacccactgtatcaatctctggggcgtcatcgcccgggggtgacgaaagattttcccccccggcgaatgcaccaggtggtcacccagaaaagcagaatgtcttcacatggacgaggcattcttccccagaaaccaaagacatcaggagccacggcaaataagcctgagtcaccagcctgcccaatgccggctgatgatgattcctgacagagaaacaattgcaactattcgtggactaagaacaggcttcttca

SEQ ID NO: 266251 - DNA, 363 bp, Homo sapiens
aggtttccaacctgttcaattttaacctgccaccttttatgtccaaaggagtcctttctgactcattatctccgggcagggtgggactattacagggtgccatggggtgctgtgagctgggctgtacttgcccctggaatgttgtcacgtctcctccctccctcccagataaaacccaagcataagcgagatcctggaggtgatgcgagccatcttagacatcccagagagccccagcctttgcaccgatgttattaacattatgatttactttcctgctgtattttttcatcttagctgcagctgcttcccaccccgcctcccaccactagaagactgtttaaagtaaatccttctaaaatt

SEQ ID NO: 266252 - DNA, 357 bp, Homo sapiens
ccctccacacccacattaaattctttattcttgtagcaacaaaattagaaaattagctaggagcttggctatttgctttaaaagcatccttccaaatctgagattctgtagttttatcaatgttaggctaaaccagttggtttgtgctgctagcaaggatggaaaaaaccatggggcagctttcgaggcagatgacagcagctaatcagacactgagagcaagggccctggacttctagtcctttagttctggagtgttcagaaagattcttaagaaataatagtgaccaaaacggaacacttctctgatgcctaactttgtactttgcctctgaccattaaatggaggttttcact

SEQ ID NO: 266253 - DNA, 630 bp, Homo sapiens
cgtgtggataatataaaataaaatttatcatttaacagttttaagtgcataattcgttggaattaagtacattcaccatattgtgcaaccattaccactatccatctccagaaggatttcatcattccaaacagaaactctgtacccattaaacaatcactccacatcttcccctcaccgcccccaggtaaccactattctattttctatctctaagaatttgttaattctaggtacctcatataagtggaataatacagtatatgtctttatttttttgaggtggagttttgccctgttgcccaggctgaagtgcagtggttcagtctcagctcactacaacctctgccccccgggttcaagcgattctcctgcctcagcctccagagtagctgggattataggcgcctaccatcatgccctgctaatttttgtatttttagtagagacaaggtttcaccatattggccaggctggtctcgaactcctggcctcaggtgatccacccgcctcagcctcccaaagtgcagggattacaggtgtgagccaccacacccggcctgggttgcttttttctttcgttgttgattttagtgcagttttaagaaactttttaaagccttgtttatg

SEQ ID NO: 266254 - DNA, 418 bp, Homo sapiens
tggggaaaccagctgctacatcaccatcagccttgtgaccatgccacatggtaaggagctgaaatctcagcagccacacgagtgagctcggcagcggatcctttaggccccgtcatgcaatcctggattgcagccctggacatccacttaactagcaagactgagccagaaccacccagatgagctgctcctggattcccaactctcaaaaactgtgagagatgttcaacggtggttgtttgaaactgctgagtctcagtataatttgttacacagcactagctaactcatacacgtcacgtttctgcagcagaataccttggacctggggagagctggagataattactcagtaccacccagtacatgggaaagtgattactgacaggctcagaaatgttaagaagatgcttaaaag

SEQ ID NO: 266255 - DNA, 432 bp, Homo sapiens
ggcagttttgaggagtaccagtcaaggattttgtacaatgtccagggacacctttttgccttcacatttgggtgtcatgtgggctggtagcaggtcactctgagatccttgaaaactctgactcagactggcattgacagattggtgttttatttccagagggctcaaaaccttcagagaatttctctgcacctcctgtgccttggtgatattttgcaagttaaaaagaatttgtcctttggcaaaaccccattgctacaaaaaataccaaaattagctgggcgtggtggtgtacgcctgtggtcccagctactctggaggctatggtgggaagatcgcttgagcccagaagaccaaggctgcagtaagccaagatcgcaccacagcactacagcctgggtgacagagcgagaccctgtctcaaaaaaaaaa

SEQ ID NO: 266256 - DNA, 676 bp, Homo sapiens
gcctgttggtggtctcttcacacagacgcgtgtgacatttggtgccgaaacccaggacaggaggactccttcgggagaccggtcccctgtcctcaccctcactctgtgaggagatccacctgtgaactggggtcgtcagaccaaacaacccaaggaacatctcaccaatttcaaatcaggagaatgccacggactgggtaatttataaagaaaagaagcttcactcacagttctggatgctggtgagtccaagagcatggcactgtcatctggcgaggcctttcttgctgtgttgtaactgcagaaaacatcacataatgagagggcaagagcaaaagagtcacaaaccttgcttttttaacaaagccactcctgcagtaacaaacctattcttgtgatggtgacatcaatccattcatgagagtcgatctctcattaattcattaatccattcacaaggaagagctgacattaatccattcacgtgggcagagggattcgttttccaaaacatgaacttttgggaaatacattcaaaccatagcaattggtatacacttatgtttttaaagttctgtaattctatgacctgagaatgtgcaatatttctaagagatgctggagcacttaagaacatttgaaaaatataattctgatatttgctatttaagaagag

SEQ ID NO: 266257 - DNA, 481 bp, Homo sapiens
gaaaaactgagcaaaacaggcctcagagctgattctacgaacgttgaaccagagaagctgcatgactgtgggtagggtggtgagggtgagacccaggtccgtcagggccagcatggagagaaacagatacatgcgctggtggacagatggctctgtgcgaatgacagtgaggatggtggtattgcccatgatggagatggtgtagagacagcagacggggatggagatccagatgtgggaggcctcaaatccagggatgtccgtgaggatgaagtagatgccttcttgtgtggtgttagtcacctgggacatgactgatgaatgtgtcttcagattcaggatcttcactcagggagaaaaagaaacattagaaataatatctctttgccccatttaatccaaattctacacaaataaatgttcagagttgttgagggtaactaaagcaagatttaagaacattgtgatatatgatatcctt

SEQ ID NO: 266258 - DNA, 91 bp, Homo sapiens
aaccccttaatgtctgttctgtgccactagcttggccctgggccttttatttatacccgagtcttacaacgaagagtgtcctgagcagaca

SEQ ID NO: 266259 - DNA, 363 bp, Homo sapiens
ggggacacagccaaatcatatcaaagcttcagtagctttctaaagactacttctagctgtcctttttcccttcatacaattcagttcatctcacctctagaagagtaatatagatagatatcctactcataatttatttccaccagcccaaatcataaacttacaaaatttatcaaagacttactcagccctcaaataaatagtaagttcaatattagagtttttattatcataacttagcagtccactcgctctaactaatgagtagagcccaccattaacaacattactatggctgagcttccagcatcatccagaccaccatctctgatcagtctgaaatcttacaaaataccatttatt

SEQ ID NO: 266260 - DNA, 422 bp, Homo sapiens
caaataatgctgaaataatctggatatccaaatgcaaaatagtgaagctggatccttatgccatatatattaactcaaaataattaaagatctaaagccacgaaacttctaaaagaaaacatacaggaaatatttcaggatattctcaggacttgagaataatttctttaacaggaaaccaaaagctcagacaacacaaccaaaaataaacaaatgagactaaatcaagcttaaaaagttttgtgcactgaaggacacaacagagtgacaaggcaacctgtgtaatgggacaaaatatttgcaaatcatatatatgaaaaagggttaatatccaaaattatataatacataaagaagtcctacaattatacaatatataaagaagtcctataactcaacaacgaagtatcaaataatcaaag

SEQ ID NO: 266261 - DNA, 686 bp, Homo sapiens
ttcgaggagaaggaattgatggaggtgtcgttttctagaggatacatttaggcagaccttgctctaacaattgttcagatttttaaaaatctttttcttattgtctttcctccaacagttgttcagatttttttaaatttgagaattttaaaatcaaactttattgattcctccgtattttacctatttgtgctaaagtactgcaaatcaatatggtaattattgcagagcttggatggaggaacgttgacctctgttagctgggtttgggagccttcttttatagcgttgtatttccttaattgaagcagtggtcttcggcaattgcttacatgtctccctcaattcatcccccaaaacaccttgcagctatagttttttaaagcctcactttgactttgagctctaattattcattccttgcctctaatcttaccttctgttctggtctctcaccctgctcagaatgagttcacttcctgtcttatttctgttagagtctgaggcagccattgtgaaattgcagggttggtgcaaacttacctcagtacaaaagcgtagtgatttatttatagaataccttattagatagtttttggagactgtgaaagaatgaaacgggtgttcttattgtatcttcacacttttttgagattattaaagatgggaatttcaatacaatataa

SEQ ID NO: 266262 - DNA, 609 bp, Homo sapiens
catgtgattgcaccaggaggtgcagtggtggctttcctcttgtgccctgattgcattgaaaatcagacaggttaagaggacaaagccttctgaagagtggcctcggaacctgggttgtgtggaatctgggtaaataagattcaacctaaatgtaacgtcccgatttacagacgtttattaaatttatgttatttcattactctcccatcgtctcttaagtagttaggcatctctcaattatacattgcttctgcttacctttgttttttaaaaatcataaagttatagcagtttgactgcttttgaagttgatctttgccaacagaatgtagtgtgttattcttggtgctgattctgatataataactcaggaacttcagagtttattgactgtctatcagactaacaaaggagttgaccactctttttaaaaataattttttccttatttgccacctacttttgatattgatttacatgtattttcctttgctttcagatcagcattcaggactgtcatacagcctgaattggtcagaagtgacagggcaaagaatatgtactttgttgtggtttgtgagcagaggccctggttctttgtgatagcag

SEQ ID NO: 266263 - DNA, 402 bp, Homo sapiens
tccatttaccaagtgagttactctttatctctgcttctttagtttctgtttattcttaacttggatctgctgtaatttcccgtgggcccaatctatggattggcctctttctttctgtaattggttgggatttacattcaggtctttctgcctcaaaagccactatactagactgactcaactgcatagggctgcctcttctgtagtatctgtggcagggtagattcacttaaaagggactgacctgtcgagttagagttacagtcctgtctttaaagagaactatcaaaccctaattcattgaagttcatgatgtttggttccaagtggtaaaaaggatgggttttttaatgatccttgttatgtgactgtaaagcaaataaactaattctactagtaata

SEQ ID NO: 266264 - DNA, 330 bp, Homo sapiens
accagcgccaacgaggatcctctcagccacagcggccctggtgggagaggggtgggaggacctcagcagccttccccacctacgacccccgcaaaaagagagtccttggagttgccgtgtggtgaggggatggcctgtgagcgcggctgtggtttccacgtggcgtctgggatgggagagggagtcagataagcacatctgccggcagcggctgaggaagcccgtggccaacaactgtggtctacccaggttagatgcctccgttagatgcagaaacagaaaccacggcccacgaaactttgttttggtgcaggagaggggctctcatga

SEQ ID NO: 266265 - DNA, 462 bp, Homo sapiens
ctgaatcatagttctcctagcttggattgaattcaattcaacaaacttttgttgagcatctactctggagccaggtggcctgagtgtggttcttggttctactattctacctctctatcagtttcctcatctataaaacagagatataatagtagtctttatcttctgtgatttttttttttaggataaacagaattttaatgtatgtaaagtacttagaacactgtttgccacttttgcacacacagaaagtcaactgaattagagaccggaaactgaaaggtgcttatactgtcttagtgggagagacagataagaaacccaacaatttcagtagtattttctgataataccaataacatgtttatcaaaaggttgctatgggaacccaggaattgaagaaaaaacgaccttagggggatagttttctggaataaaattcaaaaaaggctttcaatagga

SEQ ID NO: 266266 - DNA, 320 bp, Homo sapiens
tcaaatgggcttaagtaaaaagggatttattggctccaaacctggaaggggctgaggtatcactaaatccagtgactccggtgatgtatttgtgtatctctccctttctgcaaagggccagtaacccctcagttccctatctactttgcgactataattgcaagcctcattctgtcctgttacagtcgtgcggcaattaggctgagggactggcgcgcccgctcccccgactgtgagcctaggcggcgggtgtcatgcccctccccactcccgggcggaacagttcagcaagacgcttccagttacttcctgctcttaaa

SEQ ID NO: 266267 - DNA, 443 bp, Homo sapiens
tcaaatgggcttaagtaaaaagggatttattggctccaaacctggaaggggctgaggtatcactaaatccagtgactccggtgatgtatttgtgtatctctccctttctgcaaagggccagtaacccctcagttccctatctactttgcgactataattgcaagcctcattctgtcctgttacagtcgtgcggcaattaggctgagggactggcgcgcccgctcccccgactgtgagcctaggcggcgggtgtcatgcccctccccactcccgggcggaacagaatattgggacatgttggtgattcttagctgtatctcactattccattgacatttcaaccagtgtgacacaaaatgtcagttatgtatgtgaatgagaagtaagatcttttgaatttaatgaattcagcaagacgcttccagttacttcctgctcttaaa

SEQ ID NO: 266268 - DNA, 615 bp, Homo sapiens
tctactgagtgcttcttaagtgtcaggcactgctctatctgctttacgtaggttatttcacgtaatccttacaataagccaatttactattatctccatttcacagaagaagaaattgaggtgcagagaggctaagccattggctaactagcagatggcgatgcttggaaatgaaccaagtctgaatccagggttcccgtgtgtaatctctgcattgagcggcaattagtgaatgaatgaataaacagaatgaagttaaactcagggaggaagaaatcggagctacacgagggaggcaggcagcgttatttcagaaccctcccagggccactgatgataaagtagaaagagaactggtatcccaagaaaaccatatctactacagcaggccagatgaccctggagacaagctgaacaaagtccagtgacaatctcccaaatgccagtcccggccaaaccccacttcttcaatgcctccggccaatctcaagagtttccagcctcagtgttcacatctgtagacagtatgcgcccagggccaggcacagtggctcacgcctgtaatcccagctactcgggagactgaggcaggagaatcgcttgaacctgggaggt

SEQ ID NO: 266269 - DNA, 590 bp, Homo sapiens
gctgactgtgagggagctatggatgtatgcttctgcgtcagaaaaccgaggccctgagcagctgagtaacccactcagaggaagaagaaattgaggtgcagagaggctaagccattggctaactagcagatggcgatgcttggaaatgaaccaagtctgaatccagggttcccgtgtgtaatctctgcattgagcggcaattagtgaatgaatgaataaacagaatgaagttaaactcagggaggaagaaatcggagctacacgagggaggcaggcagcgttatttcagaaccctcccagggccactgatgataaagtagaaagagaactggtatcccaagaaaaccatatctactacagcaggccagatgaccctggagacaagctgaacaaagtccagtgacaatctcccaaatgccagtcccggccaaaccccacttcttcaatgcctccggccaatctcaagagtttccagcctcagtgttcacatctgtagacagtatgcgcccagggccaggcacagtggctcacgcctgtaatcccagctactcgggagactgaggcaggagaatcgcttgaacctgggaggt

SEQ ID NO: 266270 - DNA, 632 bp, Homo sapiens
cccagctactcaggaggctgagacaggaggattgtttgagcccaggagttcaaggctgcagtgacctctgatcaccactgtattccagcctgggtgacagagcaagaccgtgtctgaaaaaatgaaaactgatagacaagaagaggcaacacaatgtagcctctaggacagagcactgagctaaatgcttttcttgaggtttcaggtttcctaatcatcctaccagctcccaaagctagtcacttgggttagtcaatctctctattcattcatagaatgggcgtgatgccagtcaaaggctgtgctatggtcaggacagaggggactccagccagcatgccctaatagaagtggggccttctgctacccagtcaatgagtggccctcctcttgagaggtcatgaaggtcatctttgttgttcaaaagctccagcttattaaaaaaatacaattagactttttttttctcccccaagacagagtctcactctgtcccccagactggagtgcagtgccactatctcggctcattgcaacctctgcctcccaggttcatgtgattctcctgcctcagcctcccgagtagctgggactacaggcacgcgccactacgctcggctaatttttgtatt

SEQ ID NO: 266271 - DNA, 464 bp, Homo sapiens
aaatacttatatttgatattgtgagcttgaaaacttcccagcacttgaggactttcctggtgagattggtgatgttgttaaccagtgtgattttgtatattggataatgaaatgtgttagcatttggagtactacataaatcagggcaccaatattttcaaaatgaccactgcatggtggcacaaaatcatggttaaagatccaataacagtacaagacacgcttggactttaacataacaggtatgaaatattaattgctgtggcttcagattctgcattgcagccagtctttaagaagtggccactttttgattattagtgtagtatcgaagaatatctaaaattgtttgaaaagacaaagtacttctttttacaactacgtatttatttggagtcagatttctttcatgtgtttcagtcaaaaaacatatcgagtgagactccatctcaggaaaaaaaaaa

SEQ ID NO: 266272 - DNA, 873 bp, Homo sapiens
acccaatccatatcacagagaggcagcatgggtgcccctagcccaatggccgggctatttgctactgcaataataggtttcttataaaccgtcagcctcctgagtagctggcaccacagggacaccacaggctattttttaaaaaaatttatgtagaaatggattctcactgtgtttctcaggctagtctcaaatttctaggctcaagcagtcctcccgcctcagcctcccaaagtgctaggattattggtgtgagaggaatccctttcaacccttgaaaataaatcaagcggtgatgaactccctgagcttatatttgcctaggaaggtctttatttctctttcatttttgaaggacagtttggctggacatagtatgtcttatttggcagtttgtccccttctgcactgtgaatatattatgtcagtcccttctggccatctggcaaggtttctgctatgaaatccactgttttatgaaggatctcttgttcatgacaagttgctttttgattttaaaatgactcaatgtggatgtctttgggttcattctagttggagtcctttggaattctcgaatctggatgtctattttctaccccagatttgggaaattttgagccattattttttttaaagaagctttctgtccctttttgtatttcttcttaaattcccatagtgtttatattggtccacttaatggtgtcccagaagttccttagactttcatcattttaaaattattttccctttttgatccactgactggataatttcaaataacctctgagttcattctttcttctgctttatcaaatctgctgttgaacccctctaataaatttttcaatttattttattcttcactgc

SEQ ID NO: 266273 - DNA, 377 bp, Homo sapiens
gttcttatgaggatgaaatgcgattttggatgtaaaatgcttccatccagtacctgctaaacaaagtgctgagattacaggcataaaccaccaggcttgcactattgataattattatagcataaagtttttctgaggactaaatggggcaaaatacgtaaaacactaattataattattggcaaatcccataatgcttgttgttattagtatacttagaattattttaacattaaaaactgaaaactgaagctctgagagtctgtgtgactttgaggattaaagaactgaaaaatggtagaagtagaatttgaactaagaaagtacggttattgaatgcatggatttaatccctattaaatactttatcttccaaa

SEQ ID NO: 266274 - DNA, 380 bp, Homo sapiens
ggcaagaaacttgagacactggaacaagagtcaagtcaataagtttaatagtaaggctttaagaaactgggattacaacccaaacaagccaggcgggtcctgcagagcaatgagaaaccagagttgactttctagagccaatatctttgctgtatttggtgtccagatatcacttataatgtattcctcagaaatggctcactctcataagaaatataattaccttttctaaacaccaagatgatagaagtcttaggagttgatctgagtcatgatttaactatacaccatgtgacctatgaccttgcgtatgtcactctgtctccattaaccttcttttctttatttgaaaaagtaggggtaggaatactagttttacc

SEQ ID NO: 266275 - DNA, 878 bp, Homo sapiens
caaaattactaaagagtaacgccatcctccccaactcaaaccagggaaagtaagcttgcctaggaacttaggctgaaactcaccacagtgccaaaaacctgttttcttgaaaagaggtagtgcagatagtgaatccactgagccacatagggtgggagtttgctttaagtgcttttcttcttgcccacaaactagcgtaggctgtgactggctccagctgatccttatcaaggcagctagttctgagggcttggttaagaagctcttcgtttacttaagggagcaaagagaagacacgtgaattggaaaaggatatctaaaatgtcccctaaggcttcataaagttgacatctttcgtcatgacttctacagttcaggaaaccagcaggagactttgattaaagtgagaagcagccaagattccgggaagcgcgtctttctcctgtctcctccccaagatgtgcgggtgtccttcccccaacaccatggaagaaggggtccaggaagaaaatgtcacacttgcctgtgacccccacctggtctgcagaaaggcagagaagacctgcttatggaggaaaaagacggcctctgtctggagcttctatgaattacataacgaataagtgatttcactacaaagcagtgaaatttttaaaagttaaccagtggcagaagtgtcaggacagtctgcacgggcaagaatgatacctaaatcactactcaggcacaggagagagcaggactggcatggctggcaggaatgagctatggaagatgggagagaagaatgaggatggatgactaagagcaatgaaagcttacaaagaaacccaagaaggcgaaatatttgcttatgaataaacaggaagggaagaaat

SEQ ID NO: 266276 - DNA, 787 bp, Homo sapiens
caaaattactaaagagtaacgccatcctccccaactcaaaccagggaaagtaagcttgcctaggaacttaggctgaaactcaccacagtgccaaaaacctgttttcttgaaaagaggtagtgcagatagtgaatccactgagccacatagggtgggagtttgctttaagtgcttttcttcttgcccacaaactagcgtaggctgtgactggctccagctgatccttatcaaggcagctagttctgagggcttggttaagaagctcttcgtttacttaagggagcaaagagaagacacgtgaattggaaaaggatatctaaaatgtcccctaaggcttcataaagttgacatctttcgtcatgacttctacagttcaggaaaccagcaggagactttgattaaagtgagaagcagccaagattccgggaagcgcgtctttctcctgtctcctccccaagatgtgcgggtgtccttcccccaacaccatggaagaaggggtccaggaagaaaatgtcacacttgcctgtgacccccacctggtctgcagaaaggcagagaagacctgcttatggaggaaaaagacggcctctgtctggagcttctatgaattacataacgaataagtgatttcactacaaagcagtgaaatttttaaaagttaaccagtggcagaagtgtcaggacagtctgcacgggcaagaatgatacctaaatcactactcaggcacaggagagagcaggactggcatggctggcagttctctatgtagcaggcgctgtactttgg

SEQ ID NO: 266277 - DNA, 790 bp, Homo sapiens
gtatttaggtgggaaagctaaaacccaactgtgcgttttctttgaccgatgaaatagcagcttaaatagactaatgtcaattacatcttgtcaatgttgtagtcttattactttatatgattttagacccattgggaaaagtttttaattgtacacttttagaataaatatataataaatataatatttttaaaagagcaactgccctttttaaaaaacttaactccttaaattgcagttgtacaacatgatgactaatataccttttcaagaatatttaatttggggctgaagaataaaaagaaattttcatgatcacaagtaaattcgctgggtgctaaaagattgaagaaagatttaaaataataactacagtaaacttctataataattacacttctgttttattgtctgattttaggaatacatagccattttttttcacaatgcttttttttacataaatactgttaaattttagcttcaaaaattttctatagtttctattaatgtttataaagaagtctcagaactaatcattaaaattatatttaggaccctttctggttttttaaatatgtttttatttataagcctcactcatagttaattttgccctgtacaagtttcttgatacatataataggtatactactttaaatgtttgcttcctccgtcaggctccttattcatgaacaatttattacttgagattttaattttatatgccactctctaaaaaccaaagatctctctttaacaaagcaaggtaatcgtgaaaacatgtctg

SEQ ID NO: 266278 - DNA, 1106 bp, Homo sapiens
gcccgggcagtcctgctgcatctgcatggcacatgcgcttggcctggtctgctcagtgtgtctccctgactgggctgtcagttcctggagggtagggatctgtcttcccttctctatccccagtgcctggcatgtagtagacactcagtaactgtcaaataaatgaaagccctggctcatcaaacaaagaccagatgtgatttaaattccaaggagccatactttttacaaaaatgctaaaatgccaagaagtactttttcattaaaacaaaacaaaactgttttagctatgtaagggtggccttttagaactctgactgctttagatctttcctctaggtggcatagagttgtggggtttggcagaccaccatgggaaaagaacagatgcatttgtcagaatctctgtggccatcagacgtcactccaatgaagccaaagctccgaggtttaaaaataattaagggaaataactaagcggagagacagaaaagaccacttcttagttgattctggaaaaatgaaccttttctttctaccaaccggcaccgaaattcagagtatcctggacacagctgagagactactcagggagagccactgcagtcacaccccacctccacttaggtctccctacactcactctaatcttctaaatcgtttaatcagacacggcgctgcctctgaggcttcaggactttcaggctgtttttttttccccgggcttaaagtctttctctgctgctgactcacatgttaattattgctttgcataaagtagaattagcagtgctcctgcactcacctgcctgcgtgttatacaactgttttatctgctggacagaactgagtgtgcaggccggcctgccatggtgtcaccagcggccctgtcttcagctgccagggcaatgagcatcgcacagaaaccaaccattgctttagaggctctggggaagaggctgtggggtgtgctctgcttgtcccaggaaaaagagggttaagtgccaagttttgaccaaaatcttataagaatggtccaggagtttcagttccctgtcacctgtcagtgttaatggacagaactggtgtttcacagaaaaaaaaaa

SEQ ID NO: 266279 - DNA, 450 bp, Homo sapiens
cacgagggccactgcactccagcctgggtgacaaagtgagactctgtctcgaaggaaaaaaagtctagaggatttacagtgaaaaatcctaatagtggtcatggccaatgacacctctgcatcttgtgtccgctccatgctaagtgttttacccaagttctcccatcgaatcctcacggtggccctaagacagttccgtgatcccattttgggagctgggattcaaacttgggcccgactctgggaggtttgctcctaaccaccgggccccactgcacctgtgctgactcattcagaccagattccaacacagagtgatgccctggagaggggcccatgcagtgcaagtggggccagcagcaccgctccgtcggaggccccaccacttaggtttctgaagtcttgtcttcccagctctaaaggtcaccgatctggggatcactgagatga

SEQ ID NO: 266280 - DNA, 536 bp, Homo sapiens
gcaggcttttttattattattattagattagttaaattagggacattcaggctgtgatgcttatgataatctcaatgtgaaatatgaatttgggaatcattatagattcaacccataaaaacaattaagattacccaaggagagcaagtggagggagaagagaaacaaggagggaatcttaaggaacatgaatatttaagctatggaaagaacagaggcaatgtggaaaatcaaatacagagcagactgtcaggttggcatactctattggaggcaaaaatcagaaaaacaaattccagtagatgggattttctatttcacatatttcagctaggtcaagtaacttgaaaattgaaatgcaattatagaagttggtaacgcttgggagctatggattttctaatgctcagaagatgggcttagaaaatccaagttaacgtgtccaagattaaacagccaaagtgttgacaattattaattttagctaagaatatttgatttctcaatcttaaacaatacagtttaaataaagtaaa

SEQ ID NO: 266281 - DNA, 403 bp, Homo sapiens
tttgagacagggttgcgctctgttgcccaggctggagtgcagtggctcaatcttggctcactgcaacctctgcccctggggttcgagcaattctcctgcctcagcctcccgagcagctgggactacaggcatgtgccaaccatgcccggctaattttttgtatttttagtagagaaggggtttcatcatgttggccaggctggtgacctattcatttttcaataaaatattgtaattgccatattccaagtataaatctcattaaatttctaaggatattcatcaatcacattaatttctatgttatttctaaggtcatctcattttttcctcaaaactgagtgacatgtagacaccccaggaccaaatactaagtaaacttgaaaataagaagatttataga

SEQ ID NO: 266282 - DNA, 353 bp, Homo sapiens
ctatatctatcactaataaacaccctgtcttctcaaaaaagctaggcatttttagtctgcttctggacttctctgaatgtgcatatattttttaaaaaacaatactgctttgggaggccaaggcaggcggatcatgaggtcatgacatcgagaccatcctggctaacacggtgaaaccctgtctctactaaaaatacaaaaaattagacgaacgtggtggtgggcgcctgtagtcccagctactcaggaggctgaggcaggaaaatggcatgaacctgggaggcggagcttgcagtgagccgagatcgtgccactgcactctggcctgggcaagagagcgagactccgtctca

SEQ ID NO: 266283 - DNA, 300 bp, Homo sapiens
tacaatattattaactcaactatagactttcttcaattgttacaccagtttttctcccagtatgttctctgtcccagaacctcacactgctttcagaagttatttctccttagtctccactaacctgaaacatttcagtcttgccttatctttcatgacagcaagtatttcataatgctccctttactacactgaagtgaaatccatagataatattagtgccttccatgaggctcatttgctgaaactgtagatatacacgtacgcatatataaatgtgaaataaaatttgaacgtaaa

SEQ ID NO: 266284 - DNA, 458 bp, Homo sapiens
ctgtgatacatcagtgttttcaaagttctggtccatgcatgcagccccacttggatattttatgttgactcttgtatattttgttctttctagaaaaagagacccaggtgtttcagggcattgggctattccatttcagagcctaatggaagtgctagtgttttcataattggaacagacaactgccatgctacatatggtgctgtgaccactgagcagcttgttcacaatgagaaaatacattgaagttgtgaccatttgagccttgaagaaactgctgttgaagttttgtttggctccagctccatcctggaatggatggagtcatttggaattattctgaattccagtagtggcaaaaaaaaaaattgtgtaacttgtatatagatggttttctgtttgattaacagcattgttcaataaaagatgcattgttttaaatcaagaatacggtgcca

SEQ ID NO: 266285 - DNA, 293 bp, Homo sapiens
cctcccaagtagatggtattacagacgcttgccatcacactcagctaatttttgtatttttttttgtagagatgggactcaagtgatccacccacctcggcctcccaaagtgctgggattacaagcatgagccactgtgcctggcctagatttttaaagtgaagtaagacaccaattcacagtatcccctcccccagttgtgggggatatagtctgtgctctctcggtggccttagtaaagtgtccctttcttgatttaaggtgaaaaaagaagtaacctgcctcctcttggc

SEQ ID NO: 266286 - DNA, 1647 bp, Homo sapiens
gtgaagaagcagcccggaagggaaagagaaaagagtagaaccaagggacctccagatgggagcggcggccggtgagtagtctagagccaggggcattgtagcagcctggatacatgacctgaacacgtcttgacctttgctttctacgtgtgggtttcaacacccatgtggctttttcttgtattctttaaatatgtatctggcttaggatcacctcatagaagagaaagaattcacagtgaagcagaaacaagccactgaccagcgtactcccaacctgaaccttctttttctcaccctctccctcaagtaaacatcttgctgacttgagcagtgtgattgccgtagcaaagcagagtggcccccagggatcccgctctgttgggcccacaggaggagccgatgaagctgatccaaggagtgaggacaagcgctgcagagggacgttcgctaaaagccttctaggggccgcacatgctctaacacggacataaggatgccctgaatttctgcagctgaggccatatagtctggtgaccaagtatttgggtcctggcttcagtctttggttgaaatgtctgcttggctacttattaccgcacctactaccaaaatatgaccttgagcagtaacttctttaagcctcagttttttcatctgaaaacgggaatgataatctaaatcacaaagttaatggaaggattaaatgagggtgatgaataggaatgtatagcgtctggccctggtatggctttataaatgttagctgtgttggagctgtgcttttcaaaccattggtcacagccattcatggtttgcaaccagcatgtttttcaagaaaaatgtttaatgcattacatattgcaggataagtattgttttatgaagcttagggagttgtgtgtatatgtgttctggaatgcaacagaaaaatgtttcctcttgtgggttacaatatagaggtatgaaatctctgatgaggagagacagtgttatctggcccgctatgaagagacacatttgcataggctgctccctgaggctctggctttctacatctgatgatacagggagcagggaacagcctgttctcgttctgtggggctcagctgagtctgttctgcacagactcttccttcctcgggagccttagtcctaatacattcattttggagtgttggtgagtttgttcacagatcacagctcatgtgtcacccagactgacctgggccaaaaggcccatcacacaccctgcaagagcttctggtgtcgactatgacccccttaccaggcatcaaccatttttgttcgttctcttgagcctgaagctactattactgctcctctgcaaacctcaagcttaagaactttgcctgcaggatccctttaaatccacacaaaactcaaaattgagtcctaccaggaaaaagcagccctcagcccatttttatacatcggatttgtttgcaatattttctttctagactcaaaagtcaacactccctgaaagtttgtcgactttactgctgaagacctctggtagacaggccaggctctgtctggaatactttatgaggttggtgaggaggttgagtataatccaagagtgcctatctgggagcatgccacatgaatggcaaataatca

SEQ ID NO: 266287 - DNA, 271 bp, Homo sapiens
cacactggaaccacaaagaaaaacaagtgccacctctgttgtcaggaagctcacagggggagacaggtcatagaacattacaacaaagcaagggtttctccatgatagacagatgctactgtgtggaaactgcaagtgaattgaggtggccagcggtttcaagactcagagactcaagctgggtgttgtccagtattgtccagcctctggtcccctcttgccaaggagctcagttctcacattaatgaccttggtacaacagacccaaata

SEQ ID NO: 266288 - DNA, 424 bp, Homo sapiens
tgactcttcttgatgtaatgacacccaggtttgttccatgttgtgactcaccttttttcaacatgtgacttccgaggttacttgcttgtctgcctcaagccaatggaagagcaaaaaacattgagattcatgcgttaagagatttttagagaccaggcttggaagtggtgctcatcactttagctcaaacagcattggcgggccaggcacggtggctcatgcctgtaatcccagcactttgggaggccaaagcaggtggattacttgaggtcaagagttccagaccagcctgtcaacgtggtgagaccccgtctccaactaaaaatacaaaaattagccgggcatggtggtgcacacttgtgatcccagctactcgggaggctgaggcaggagaatcgcttgaaccctggaggtggaggttgca

SEQ ID NO: 266289 - DNA, 421 bp, Homo sapiens
ctgaatatgaagaagacagttcaacatctagtagttgtttttcactctagattatacaacttcctaatttttgcaatctcattgcctacttaaaataggtacagtgaaaggaggactaagtgactaggaagaagacaattcaaatgcagaactgaatagagtttcacaacttggaatataaaaagtgctgcaccactgaggccataagacccaaatgagcacatgctattagacattctataaatttgtccaccatactcatctggctttttaatagaagtcagatcttgcctccacaatcctctgctacaggttactaaggatatacatctgggagctaccaaatgctgcttctcctttcaataaaaacaattgatttgatgttaggctctagtggaaacagcaatcatcactaatagaa

SEQ ID NO: 266290 - DNA, 353 bp, Homo sapiens
accaatatgttattctaaaaacagaaacaacaaaaagaatgaatcaagtgtttatcttgcccttcctggaagaactgcacctcagggtaacctaagggaatagttgatgcgagaaagtttgtctataagaaatattgtagttaataaatgaagaagaattggtaaaattaaaatatcacctgtctgcaactcataatgaaatcttgggtccaggcaatggtgattaattcttgctgacatcacagaaagagaaccaaccttatgtgtctcctgatttgatgcaatagtgcaaacaatacttcccatgacatattcctgctttaaataaaattgaaactgagttgaatcaaaaa

SEQ ID NO: 266291 - DNA, 254 bp, Homo sapiens
acgcctccaggtgttcaatcctataaaactgtagtttcttgctcttagaaataacaagcctttctctccctaacctgccatcatgagaaattaaaatgtcctgtattttctgtacggcaaatgattcaaaatgggagtggtggacgtttttatacccaactgcaacaagggtaatgagataaatatcagtttccttccctcagattattcttatatgtaaaatttactgtataaaaatacttaaaatttgcata

SEQ ID NO: 266292 - DNA, 281 bp, Homo sapiens
ttcttggattcattgaaaatcaaaaccatttttgcatgttgctcaacaagttgctctaatattggatgtttgcagataatattcaaactggagaaattttcgattgttaaaggcagttgggattggaagagataagaaaacaaattcccaagtgcctcctatgataggaggcactgggtctgatgctttcattactattatcttgtttcatcttacaacggggaaggaagattcaaatgcgcagtcttgcttcagagtcagtactcttaaccaatatgttg

SEQ ID NO: 266293 - DNA, 388 bp, Homo sapiens
agagtagaaattccccactgcagttactggacgcaccaattaggattcttttcttataagtagcagaatccaattcaagttaagggaacaagggagatacaaggatacttcaggaaatgcaagggcaggaacgcagccaggcctccagagctggcagtgtcttctctccatggactgggaagcagagagattgagttgcacaaaggatgatcccccaggccgcctcctccactcaccagtgtttcagttttcttagaccaacccaaatggaactggaattttaattccacttccagattctccatagagaaagatctgattagtccagcttgatttggacatcgaccctagtcctgtgaactgtaaccaaaagcacaaggtcatgtaa

SEQ ID NO: 266294 - DNA, 608 bp, Homo sapiens
ggaaaaataagcaccttggtttggggaaattttaaaaatcattttattgataatctctacttctttctttttttgagcatctgttatatggagattgggcttcctgtattggccttcttagcttcctatcttcttctaaaaaccttttgtcattttgttctattctctggaagatttcctcaattttatcttccaaatcttatattaggccaggcacagtggctcacgcctgtaatcccagcactttgggaggtcaaaggcaggcaaatcgcttgagctcaggagttcaagaccagcctgggcaacatggtgaaatcccctctctaaaaaaaatacaaaaattagctgggcatgatggtgtgtgcctatagtcccagctactcaggaggctgagatgggaggatgacttgaacccggagaggggcagagattgcagtgagccaagattgtgagatcgtgccactgcattccagcctgggcgacagagccagatgtgtctcacgaactcttttttcgcccccgcgacctccctcattcaggcttcctcctcctgtcctcttctcatctttttgccccgcgccctgtctcgccccccgccctcccgcccc

SEQ ID NO: 266295 - DNA, 496 bp, Homo sapiens
aggttttgtgtgtgtgtgtgtgcatcctcactattgtaaatggtatttttaaattttatttttccctggttcccttccttgatctagatattcagcaaccctgggaacagtgttatttgctcagccatctgtattcccatactacttgtttttttattgttatagttttatcattacataagtaatgtatgaattagttattgatgtaaaagatttaaaaactgtcttttccagaagtaaccactgttaccagtttgaagtgtattctcgtagatttatacttctcattgtggtagctacttccacatgtggctattgagcatttaaaatgtgggtagttttaattgagatgtgctgtaaatgtagaataagctctggacttcaatgcttagaatgaacaaaaagaatgtaaagtatctcattaattttttatattgtttaatgtagtgataatattttggctacgttggattaaaatgtgttattaaagttaatt

SEQ ID NO: 266296 - DNA, 485 bp, Homo sapiens
tagagttccagcaggagtgaacaggaacaggaaaacaaatggcagtatccctgagacagccacttccggtggttgccagccacctggggatgtgagtcttggctgaccaggcttctggggacagggggcccaaggggcaatagagggtaattcttaagattgtggatggactgctgggtactggttaagaattctggctttagccgggtgtggtggcccatgcctgtaatcctagcacattgggaggccaagacaggcggatcatgaggtcaggagatcgagaccatcctggttaacacggtgaaaccctgtctctactaaaaatacaaaaacattagccacgcgtggtggcgtgtgcctgtagtcccagctactcagaaggctgaggcaagagaatggtgtgaacctgggaggtggagcttgcagtggccaagattatgccaccgcactccagcctggtgaaagagcaagactctgtctcaaaa

SEQ ID NO: 266297 - DNA, 362 bp, Homo sapiens
attcaaaaattgcaaatatccaggtacagaaaggccagagaacaccaaatagatttgattaccccaaggcatataataatcaaactctcaaaggtcaagaacaaagagaggatcctagaaacagtaagagaaaagaaggaaataacacttaaaagagctctaatttacctggccacagacttctcaatcaaaaccatgaaggccatacaagaatactgtatcaagcaaagctattattcaaatatgaagaagagataaagtttttcccaaataaaagcagagagaattcaccactaccagatctgtattataagaaatgctctcttgaagaaagacagttccagagagttcctcaatccgga

SEQ ID NO: 266298 - DNA, 384 bp, Homo sapiens
tcccagaaacaatttcagaaagcattattttgttttgttttctgggatgggagaagagagaatctacagatttgtatttagttaaaaatcaaaactccagcaataggaaataggcagttcacatagccggccaacatttgaggtatcatcagtgtgagacaaggtcccggtctgttcctactggcctagctgacgctaacaaaatgggaggcttatggctctgcacagcaaattccagcaagataagatgactttaagcctgtattcagagccttagaagcagggcactactgagaatgtaatatttagaggtaaaaatagtgcaagagcccctgatggtacccctctacctgctttgtccatgcagcctgatcgtaactgcct

SEQ ID NO: 266299 - DNA, 349 bp, Homo sapiens
tcattttttattattagaatcaagaagagtacctctaaacccttgctgttgctttagggtagagagctctggtctagaactcaagttatgaaactgtgagtcccagtgtagctacttaagtttaaatacaagagctgtcagacatttccactacagcaacgaaatctgtagcatccattttgtactttgaaaacttagtttttggccagcctctaggaagaagaagagggtccagaactgggcatatgggtagggatggcaaaagaaaccggctggatgcaacagggaaagacgaagggatggagaccccaggaagagccagtcctcaggcttggggcctgggtctagg

SEQ ID NO: 266300 - DNA, 457 bp, Homo sapiens
ctcatcttgaattgtagctcccacaattcccacatgttgtgggagggacctggtgagagataattgaatcatgggggcagtttcccccatactgttttcgtggtagtgagtaagtctcgtaagatctgatggttttataaaggatttcccctttcacttgattctcattgtctcttgcctgctgctatgtaaaacatgcccttcaccttccaccatgatcccacgtggactgtgagtttattaaacttctcttctttataagttacccagtctcaggagtgtctttatcagcagcatgaaaatggactaatacatatctactttcttactgaagaaattatgtatttgcattcttttttactcctttttttgccagtcttaaaaaagtatctattttttaataatcttttcaaaagaatttcacaagtagaaaaatcacatctattttgttcatctc

SEQ ID NO: 266301 - DNA, 317 bp, Homo sapiens
actctcttcctacttagatctagaataacattctgtcttctatttactacatttgcatctttaagaaaaacagtacttactggtttttgaaaagtaccatactcttcaaaaagtgttgtgaataatatcacttgtattagactactgagtcatttattttatatgatacattgtggtgagatactgtctttgttttatgtctccattgcttactttactgctgtcccagacagatgtataggggaagcttttaaattaaatatagaattataaatgcagatgcatatgtcatgtatatgcatgcctattgtcagttg

SEQ ID NO: 266302 - DNA, 387 bp, Homo sapiens
gttagcagttattattctaccatcactttatttttaggaggtttcaaaagggtagttctttgtgaaagataattgtgaaggacttagaaggataccaaagacacattttatttacttcccaacatggcctaggtccaattctggtacaatctacttacaaaatctaggtggcaatccctctcccaaggttctttcctagtaaggttcttttaaaaaagttgtttacacaaattctgaaagtctgcccatcccccacccctcattcccttatgtaaatcttaataattgattgatctgtggcagagttctatttttctgtaaaagttttataagatagagatttataatttgtttttcagaagaagattgttactaaattggtttaat

SEQ ID NO: 266303 - DNA, 289 bp, Homo sapiens
cttctttcctgccctcctccttcttgaattggacaccatccctgttgccgcctcctgagtcaggaaagggatagaactttcccagggaggtgaggggtgtccccgtggcgatttcccggttacttcctcccagcagatatccctgtggagaggaaacgttcccgacttccctccccgcgacctcctccctagaaacgagcggagacgtcaggctgcttctgggtttattttgtaaacccagacagtcaactgcacttggcgcaggcaaagcctccttggcccttgcccc

SEQ ID NO: 266304 - DNA, 474 bp, Homo sapiens
cacgaggactgacccaataaagaacagtgacagagcagcaggaaaggtggggaaatggcttcatcaatgatttgttgagcccagggcaggccaggaattagataggcatgagaagaaagaatataatttacccaaaggttattttttgagtacctactttgtcccaggaactaggaatacagtggaaaacaagactgtagtctctacagtctaatgggcaaggcagccagacaggcagtgaaagtggaatgctcctatgtgaccttaaggagcacctgactcagccttggataaggaaatgggggaaatggcctgaaggatgaggaggagttagccaaggtggtactctagggaagtggtaccccagtaaagaacagtagccaaaggccagaaacaaagtgtggagcattccttgagttcctgttgtagtgaggtcttgtctgtcagagaagtctgggtctggccagactctta

SEQ ID NO: 266305 - DNA, 337 bp, Homo sapiens
agtttccttgttcctctttataatccggccctcttgccatccccatcctctacactccaagcaaccactgatctgctgtcactattgatgagtttgcattttctagatttatataatggaatcatacagtatatactttttttctggcttctttcacttagcataattattttgatattcttatatagtacgtatcaatgttcatttaaaaaatataactgaagagtatgtattgtatgaatacatcacaatgtttatttattcatctgtggagggatgttgaagttgtttccggtttttggctacttcaaataaagctgccacaaacatttgcaaa

SEQ ID NO: 266306 - DNA, 567 bp, Homo sapiens
gaggctgaggcaggagaatcacttgaacccaggaggcggaggttgcagtgagccgagaccgcgccactgaactccagcctggcaacagagcgagactccgtctcaaaaaacaaaaaagacaaaaaaaacctaaatacttgaaatttttaaaacccttttctaaatgtctcacgactgaatggaaataaaaccgggattacagacactcagtaatgaaccacagtgaaaatctgtatatcagactcttggtgaggacaaaatgacattgagggcgttatataatttactgagaaatcaggctggatgcagtggcttatgcctgtaatcccagcactttgggaggctgagtcaggtggatcacctgaggtcgggagttcaagaccagcatggccaacatggtaaaaccccgttctccactaaaaaagaaatacaaaattagccaggtgtggtggcacatgcctgtaatctcagctactcgggaggctgaggcaggataatcgcttgaacctgggagatggaagtttcagtgagccaagatggcacctccatcctgggcaacagagcaag

SEQ ID NO: 266307 - DNA, 581 bp, Homo sapiens
ttctaattgagtagaactgttgtaaaacatcacacaattctattgctctgaaaatattaatatgatcctccaggatacaaatgcaccttcactgaaataaattatgaactaaaagtattcttgattattttatcttacaaagtgaagagactgtatattttatatttatattttccatgcacagtggtctgttcttccattatcttttcttatgagaggcataatgacaaataagtccaaagaatgtgtagcattattatggcagatcaatcaaatggctaattacccctcttatctaagtggcattatcttgctttaaaggtgatgaaaataacaaatgaagaagtgatttcgttttttaaaaacaattctgtaaggaaccagtctatcactgatgggcatttgggttggttccaagtctttgctattgtgaatagtgctgcaataaatatacatgtgcttgtgtctttatggtagaatgatttataatccttggggtatatacccagtaatgggattgctggaataaaaattattggattatggggggagaaaatacatacaaatggccaacagataga

SEQ ID NO: 266308 - DNA, 630 bp, Homo sapiens
tgactttgagcaatggatagaagcagattttgtgggtttgctttctttttacatcactgtcacagataatgcaagatttctggtgttagccagtgttccggtttagcctggctacatgttttagcctcttctctgagattgaagccccatggccccctagtgaaaacgatcttcactggagtgactggaaaccttttcggattggtcggagcccagacacacgtggttgcagttaagcaaagtacaggagcatgttggagcggaaagggaccagggaaaagagggatggggcagatgtgggactggactccaacttagaccaggcaaccttgggcaagttcaccaggattttctgaccttcagattcctcatatggaaaaccgaagtgacagtacctttcctccttcagtgttgctaagaggactgaagagttatgcaatgtctgcttggcccacaataagtatgcagcaatgttacttttttccctttgtcttttaatcttcatattttatacacaagaaaactgagtccaaagaggtaaaattatatcatacagttagtagaaggtccagaactctgttatgctgccttcattatagtagtagaaagttgtatattataactagggct

SEQ ID NO: 266309 - DNA, 388 bp, Homo sapiens
taagcccggctaatttttgtatttttagtagagagacggtttcaccatgttcgtcaggctggtctcaaattcctgaactaaggcgatccacctgcctcagcctcccaaagtgctggaattacaggtgtgagccactgcgcccggccagaattcttaattatttcaaatagaaaataatattaattataaaagtaatacgtcctgttggtgaacatacaaacacagcaaagaagtatgtaaagtaaaaaatggggggtgataattcctcatggaccatgccacagatagcaaaactaatgcaaattaccaaagcttttataatctaaagagaatgatatttatgttaataaataacttacatgtaagtcatgtaaagtaaggtagggta

SEQ ID NO: 266310 - DNA, 257 bp, Homo sapiens
tgtttaatttcttgaggaacgaggaaccaccatatttttttttacattcctgtcagcaacgaagctgagcatccaacctctgcacatcctgacaacaattgctgttttctgaatagtggccatcctgatggatgtacccaagactgctctttataagctgacattttactttggggactaaaaatctcctttttttttttttgcagtggtgtcacaaattttaattcaaaataggcactctgaaaacaataggtaaa

SEQ ID NO: 266311 - DNA, 488 bp, Homo sapiens
atattccaaaacaaaaccatcaggtccagatgggttcactggtgaattctaccacacattgatggaaggaattatatcagttctctacaatctcttccagaagatagaagcagatagaatactctctaactcatcctgtgggaccagcattaccctaaaacccaaaccagacaaaggtattaccacaaaactacagaccaatatctctaatgattctagatgcaaaaaattctcaacgatttgtgaaaaaattcatataccacaaccaagtgggacttatctcaggtacacaaggctggttcaacatttgaaagtcagtgaatgtaattcattcacatcattaggctaaagagggaaaattacacaatcatattaatagatacataaaaagcatttcgcaaaatcgaagttttttattcataataagaactctcagcaaacgggaaatagagggatattttcttaacttgataaatagcatttacaaa

SEQ ID NO: 266312 - DNA, 627 bp, Homo sapiens
aagtgaaataatctattgctaaagtgattatttaatttcccgctctaacaggaggtcctccaatggatgcaaaaggacaggagagacatttcatcctatgcactgaatatattgggcaaacatatttcgaattacgggcttcttttccaccaccctcttctaattgtctctccttttcccagcattccctcacactgaaatttacattatagttcagaatagtaaagtgcattttgaatatgaacacaaatggattctatagccttccccttttcctcagccttctcgatgcacaggtgggctttattcgaacaggttctactttctaaggacatgcaggatcagaggccaatgactgtcagaactggaatctatgcaattttaatttgtaaaaaaagttattggttgctaaccttgggggagattgtgcatctctaagaaaccaaatctttgagtgctctccctgggaaatgacgttacacatgagcagaaaaatccaggcaagaaaggctaattgaatgaagagagagaattaggttaagtgtcttcaagtcgccagtgttgccagagtgtttagatgttggccacagatgggaacacctattgaaatgtgtctgaagaagatta

SEQ ID NO: 266313 - DNA, 394 bp, Homo sapiens
catttatgtacgaagctctgcctctgttcttttaatattattctacatttaaactaccccttagcttaaacacattatattcaccaaggcacaactctctatgagggcaattttgccctacaagggacatttggtagcatacagagacattttgattgttacaaaatggaagaaggaatactagcttctagtaaacagaggacagatattctgctaaacatcctaaatgcaaggatagagccccatgacaaagaattaccaagtccaaaatgtcagtagagtgaagattgagaagcacagccaaggcaaataccaactgtgaacagtcaagtcctacttgagtccttggttataagtggttatctggatgatccaaaatatgcttatatcaatt

SEQ ID NO: 266314 - DNA, 480 bp, Homo sapiens
gtttggagctgggcataatggtacacacctctagtcccaggaactcaggaggccaaggcaggaggattgtttgaggctgacctgggcagcatagtcagaccctgtctcaaaaaaaacaaaaatcaggtttggaataggtttctgaagtacaatggacatgacttagtgaccaattgttgcaggtggggaaggggagaagactgtgaaggatgtcagaagcttttagttttaaaaactgtctagatagtgataccattcatagagatcaggactaatacgttcacagtacatgataaatttaggttgattacatttgatatattttcaagacatctatgagtatatatctaagagataaaccacaagatgtacctggaattcgggaagaaagtaaacaagtaaacatttagaattgattagctcacagatagttgaagctatggaagcagaatgagatcttccaggaagaatgcagagaat

SEQ ID NO: 266315 - DNA, 421 bp, Homo sapiens
cttcatccaactttggttgctgttcttcatgctcaggaattctgcaactgctgtagcttttgctgttgttatgtctgtaggtatggactcatttctaccattctggaatgaaacattatttcaagggaagcttctcattgtaaaaggtccacacattcagaaggaaactgggagtacattttctcataggcctggagcattaactgactatgcatctttcccctcagtgttgtcatcatgttgtaaggggatgagtcatggacaacattttcacacacatacgtgaggtccattgaccagtctttaggacaactagaaatcttttctttctttgttttaaaaaggaagacaagtcaagatacagcaaataaaaatgctcagcacatttgctgaaatcttagcaaaatcaaattactagtaa

SEQ ID NO: 266316 - DNA, 566 bp, Homo sapiens
ctggttggtatcttttgtttctgcaagaaagctaaaacaataactgccattaagcactgactgaaaccaaggcttatttctaggtttggtcctaaagaggtgggagaatccagttacatggcctttgaccaggaaatgaatgaaatccctactagtttaatgaatgagtgtttgtaactccagtatcaaccatggggcaggagcccaccactgtcagtatgaggtcttaggggctgaaggacaaagtgaagaaagtaagtagagttgcttgagagggaaagagtgaatgaggacaaggctggggattggtggagaggaagcagcagatagggtgagagagaaaatgaacctaccattcaaatgaacctgaaatgtaaactccctctcacacacatacaaaaaaaaaaaaaaaaacccacagagaaatttaatactagggaggatttccacaaactcaaccatcagaagataaactcacttcagattgaaatggaaataaatgagcaaacgtcttgaaaataaatgtgtttagaattttctaagagagaatggaagaacaaaaatgg

SEQ ID NO: 266317 - DNA, 433 bp, Homo sapiens
gtcagcaggggtgggacaatcagtatactctaatgcttcatgttatagaatccctttgttgttcaaacagatattgtaattagagcatacttttaaacttcatagggcagcgattcataaagtttttcaaaaatccaaaacaaatactttgtttctcaaatgttgagattatttttttactttgtagttttacatcactgtatacagtggtttcaaaaatgaaatggaagttgttttattggttggaaatacgcattgtatattaagatctaattttagttttaacaacctcacctattcgaaactttaaagactagaggaattttatgtaagtgaaatagctacagatttatcctttttgtatatatgtatcattgtaatttgataggtgagtctctcatttagggagaaagcatttttctccctaggtgca

SEQ ID NO: 266318 - DNA, 352 bp, Homo sapiens
aaaagctaaagggaacaaaaaaaagattctggatggactttgcaaccataaatggtaaaactaaccctgttccactgccagctagaagaacagccgagtaaggttttgatttacaggaacagctcagcaagggccttgtagagagcttcatgcctgctataaaaatgtgattagctataaaacagagagctttaacaagagcatttaagcataggcaacagacctgctcaaaaataaacaaaaacagatattgctgcctgagtgtctaacccaacttcataaagatcaggtttaggagaatttttttaggcttgtgatataattaataactttttacttttagagtcgaaaa

SEQ ID NO: 266319 - DNA, 626 bp, Homo sapiens
agtgaatcaacaaatttttataagatactaactatatgtaagctcccagtagaagacacttcagatttaccttcctatatcttttctcatttttccataatcacaaatccccatttctggatagtcctattggaactcaactaaaatcttacttttcctagtctcccctgcaatggatgtggctgcatgactaaattctgcctattgagatctaagcagaaatattgtgcagtgcttacattttttaaaaaaatcatgaaaatgaaggagatgcacccttcttatcgcttctctccatcctattacctgaggcatgatgatgtgatgactggagccctttcagccatcttggaccatgaggaggatagctgtaccctgggaataacataatagtgactgggagggagctggctccttgacaactttgtcaagcctccacgccaatcctggattgctcatttccaaaattattttgtgtaagctgctgttttatttaagccactattatctaggttttactgttatatgccactaattctgatactattgatacaataataccattgcagtttaataaattctgatactattgatacaataccattgcaatttaataaactatattg

SEQ ID NO: 266320 - DNA, 448 bp, Homo sapiens
tttttttttggattttggaatactggcatattcctaatgaacccaagcttaaacacaaaattcatttgtttcatatataccttatatgaaacaactgaatttttataaatgattttatagtctgatggtaattttatacaatagtcttaataattttgtgcatggaacaatgtgttaagtacttaagtgtggaattttccacttctggcatcatgtcagtgtacaaaaaccttcagattttacagccctttagattttggactttgggattagggatgctctatctgtggtgccagatctctccttgcatctgctcttttaagtccagccttcgaccatgtggttccaacatatcatactgttccttacttttcatttccttcctaagtgacagagtagatcagcttaggtccaattaatgtccagatgaggtgaaagactcgctgct

SEQ ID NO: 266321 - DNA, 228 bp, Homo sapiens
atgtccaaggtggggctgcagggcctctttgctgctgccaccactcagggcccaggctgccagtagtgtcctctcagcagtggcttccttgatcatcaggacattgggaaggtgaacatggtgaattacgcactgctttctacccagaagggtcacatgtcattcctgctcaaatttcattgaccaaaaagagctacataacccaaatcctaccaggtgccccaaagg

SEQ ID NO: 266322 - DNA, 229 bp, Homo sapiens
cattcaaataaggtatgtagattaaagttttgtagcaatgctaatttcctggtttagataattataccatggttatagaagattttaacatttggggaagctgggtgaaggatatacaggaactcttggtttttgcaacttttctgtaggtttaatattattccaaaatttaaaaagttaattgcagcagttttaaataagtgaaaattccatgtactcctatcagtat

SEQ ID NO: 266323 - DNA, 239 bp, Homo sapiens
agaagatggagttgaggatgatggtgatcatgagcactgggacggggcagccctgggagctggaaggagcccctgccatattaaaaggagtatgatgtcccagtcaaaggagctgagaaccctgttctctcctctgagctggtcaagccccattgggggttccatctgggaatgtctctttgacagggacatggacactggagtgggggttggaaaccatgttctaagagaatgatctg

SEQ ID NO: 266324 - DNA, 327 bp, Homo sapiens
cctgggacgtgggggaaatagggagatgtttggtgtctgttaggaagaatgaataagctctggagagctaatgtacagcatagtgactatagttaatagaaccgtattatatacttgaaatttgtgaagagagtagatgttaaatgttttcactaacaacaacaacaaagataattgtgaggtggtggatatattaacttgattgtggtactcatttcacagtgtatacatatgtcaaaacatcatgttgcatactgtagatatataccatttttgtcaatcattcctcaataaagcaggaaaaattattgcattttccacatcacc

SEQ ID NO: 266325 - DNA, 548 bp, Homo sapiens
cttgctaaatattcagattcttgggcccctccttagacctacaagatctgggtctctgggcaaagcatgggaatctgtgttttaacttgctgcccagagatttctgttgcaccccttccctccacccgatcccagggctctggtcctggttcaggctttattgtgttcagctgtgctagaataaacacctttttaatggatcctccttcaatcctataacctgattctccttcaatcacctcagccgaatgacatctctcagaaatcttccctgactgtccaggcggaattaatggttcacttccctgttcctctataccttgagcatccctctacaattgaatgctccttcattccatttcattgcaccagcatgtatcgagggtctactgttatctatcgctgaagagaatgattgcaaaaaacttgaatgaacatggaaaatgctgatgatcagatttccattgaaaagaaaggtgtgctccttggggtgggggtgttgttgtaattgtcagaaaatgtttaataaaagaaacagaaataacaat

SEQ ID NO: 266326 - DNA, 356 bp, Homo sapiens
catatcatctaaggtggccctgaccaccaaggtggcctgacctaaggtcacctgaccagtagacccccccatttctggtttgtttccttcatcccacgacgatgtcatatgtgtttacagcactgttcccagccccagaatgtctagggtggggctcagctaagttcccaggagaaccccaatacccagcaccgtgcagggctcagagaggccctcaggagggatctgttgaattaatggggatacatcagtggacaaatcgaagtctcccgccctcctggagcctacattcccacagggggaaacacactgtaggcaaacaaaataaatactaataaattaatgaaagaataaaa

SEQ ID NO: 266327 - DNA, 427 bp, Homo sapiens
tgtggtgccctgcctggtgctatgttagcaagaaggcggcgccccgtttgatgggagctcagtagtctgtggggcacttgtggctctgaggccttgcctctgcctgccgcctgctgctgttgtccatgcgtaggcacagggactctgtgccagcttccctgtgtttactgctctcagctggaaactgtgggctccctggaggtggaaaccatgacggatgtctcagaaatccctgcctctgggacgagcgctggtgcacgtgtggccacagggtggcagcctcgcgacaccggatgggcgcttgtcagggagggacacccggggcggggagcctttccagagacctctgcagggctgcgtgccaagtgcacgttttattttattctagacactcgtccttgcgttgaggagcacccaggaccgcaca

SEQ ID NO: 266328 - DNA, 346 bp, Homo sapiens
gaatgaaactggatcctcatctctcaccttatgcaaaaatcaactcaagatgtatctaggacttaaatctaagacctgaatctataataaaaattctagaatattgtaagaatccttttagagattgtcttaggcaaggatttcatgaccaagagcccaaaagcaaatacaatagaaacaaagataaatagctgggacttaattaaactaaaaagcttttgcacaacaaaaggaacagtcaacagagtgaacagacaacccacaggatgggaggaaaatctttacaatctatacatctgacaaaggactaatacccagaaggtacaatgaactcaaacaaatcaac

SEQ ID NO: 266329 - DNA, 430 bp, Homo sapiens
attggttataccttccagtgctgacccctccggcacacagctgagggcacagcaccagctcagggcctcatggccatgtccccaccttcaaatcagtcttcctacctccacgctctttcttatccaatgtgccttatgtactgccgtaagggttaccttgcttctttctttttgtcctgcctctcctgtgttcacaagctgtgggtggctcttcattgcattcagaagaaagcacaagtatttaagcctcacatttgaagttctcaacactgtgaccttatcaaactttccaggtttccttccagcacaactttttctcaactgctactcctatccccatgcctaatttgcttgctgaccaatttaataattacctttctctggtttacctttaagaggttctgtcttgctacaattgccttttctacct

SEQ ID NO: 266330 - DNA, 415 bp, Homo sapiens
cgctgctttataattaagcatttaagttcaatatttagtttcctcagaatagtaagagttgcgtttgacacccttttaaatttttttctgattatacagtaatacatgtttattaaaattctagcatttgccaaggcatagtggcttgcacctgtaaccttaacactttgggaagctgaggtgcgaggatcacttgagcccaggagttcgagagcagcctgggcaacatagtgggaccctgcctctacaaaaaaaaaaatttttaattagctggatgtggtggtgcacacttgtggtcccggctactcaggtggctgaggcaggaggattgcttgagcccaagaagtcaaggctgcagtgaaccatgattgtgccaaggcactctagcctgggtaacaaagtgagaccctgtctc

SEQ ID NO: 266331 - DNA, 390 bp, Homo sapiens
cagtgacggagttcagtaaatatttgatgcatgaatcagtgaagacctgtcaaaaaagggcacgggaggctatcagggacttatcacaaccttcccgcgacccaacccctttagcctccaactgtcaattatctgtgctccaaagggcatggagatacacagaaaaatttctcccattgtagtcttcgtagtaactgctcgtttttaacaaagtaccccgtaggctatgaaccctggtgggaagaccagtctctctgagcagactgtaaaacttctggggagcaaggactgtgtttggttcactcttgtatctccagctcctccagtgacttcgtacatagtaggggctccataattatctgtggaatgaataaataaagaggaatggta

SEQ ID NO: 266332 - DNA, 271 bp, Homo sapiens
gagacacaatcctgacttgaaatcaagccaaggaatcatttcatgactattttggccatatctacaatattcttgcagggaagtaattaaaaattactttcataagactgaaatgaaattggggccttggaggggtggcaggagataacctgaaaactgcttggggatgggtgagcataaagtataaagcataacacaattctaggaggtaccatttatgttttattctatgaatgtccagcagtactgatgaagggcgagagagaagaag

SEQ ID NO: 266333 - DNA, 565 bp, Homo sapiens
cctcttttgttttccttacttttttccttccatctcttttcttctctttactggcatttatttattaaacatttgcatagcacttaatatgtagtaagcactgttttaagcactgtaaagtattaatttatttaattctaatagcaaccctatgagataggtattatttatatcatccacattttaaatctgagatggaaacattgacttaagaaacatgtccaaggccatggagcttgcatttggactcaggcatctggtcccagaatctgtgcttctcccactatgatattctgcttcttatttattctgctctccctgaagatgcacataatggaaatgaggtctcttcactgcatctctccatattgatttatgttctccagtttaaatttaattttgggggtgcttaccccagtgagttagcctgctttggtgcagagacaaaccaacctcgaatctccgtagctgactgcgaacacgtatttcttggccacttacatgccagcagtcataaatcacccgtggaggctctgttctatttctcttctcattctggcgggaa

SEQ ID NO: 266334 - DNA, 214 bp, Homo sapiens
gtggatatgtaaactgagccagagagtggtcaagcatcttctctggagacgaccccagaattctgctttttctactcggcttacaggacattttcttgggtcaatttctgtttctaaggtctgtctggtaggtgaaactgacttatttggaaaggagagcaaggtgtctggaaataaacaatagaatttattaaaaacatcgtgactatgaata

SEQ ID NO: 266335 - DNA, 423 bp, Homo sapiens
gtggttttgttttcagtaatatattcaaacaatattcctcacagtttggcatatataaccctggtgttgtgtaagatagtttcaggtagcactttttaatttttatagtaatgtatttactttattatgtatgacattataactagcatattgagccttatttcatgggtagtgttgcctaggatatacagtaatattttaaataatttacattacaagtagacatgatgaaaattggaaagtgatatgagaatgacttcagttttggaaacaataatttaagaagttcctgcactgcaggaataataatttgcagagggtacagaaatattttggaagatatctgcttgcaggtttagaatttaattctaggccagcatgaagcaacacattcattaaatagtctttgaagcattggtcatc

SEQ ID NO: 266336 - DNA, 447 bp, Homo sapiens
ctaaaaagctaggctgagcttatattcatatctggctctctggcagcacccctgatcaacaagcctcactaagtttaccaagggatttgtaaatgcagagaagccatttttttttctaaagatggtcaagtaattcatcattcaccatatatttatggagtacctattttatgctaggcatagggatagagggaataagaccaacacagagcctacttacagagcttgcaagcagtcaaggaaacaaataggttgagagagaaggactaaggaggatttactctaattaaggtgattatggtttactttggaaggctttgctgaggtgacattttatttgataactaggaagaataggctttaaccatgtgaaattaagaagagggggaaaaaagcagtgtgtgcatagaccacaaggtgaaaaattgtgctgtgttcaaggaactg

SEQ ID NO: 266337 - DNA, 321 bp, Homo sapiens
catggcctccgaaatagtgcctgacatggaagaagccagatgacactgcaagacttcatggataggaaatttctgggagaggcaaaacggtagagacaaaaagtagatccgtggttccctgaggatgcgggtggggattgactgccaggggtacagtgaagctttctggactgatgtggctgccttagaactggattttggtgatggttgcttaattatacgtttactaaaagccatccaatgccatctttaccatgggtcaactgtatattcattataatcctataaagctgcttttaataaaatcattgtccaaatatt

SEQ ID NO: 266338 - DNA, 593 bp, Homo sapiens
cagatgaaaaagaagactaatatcatagcaataagtgagaaatgttagcctttgaatacagctgaggtcattgtgccaacctttcatcttataagaaatgatgggtccagagaacttaagggtcaggacccaggtagttaacagcagaagctgaattagcaggtggggatttgacttccaatttaatgctctctgtcctatactaagcctgtttccatctctattacttctcaaaaaatctgtcagatagttagcaaatgttcaatgacctaaggtgagtgtgtgagactaatgcactgctggaaggtgagggaagctaaatcctcaagtgacagacgacggggttgctctgtcacaaacgctccatgggtgttgtgggcaggcaggaaggaagagttgaagaaaggggagaattaagcacatcagcaggtaagcccttcctctgcagtacgctggaagtgaacagtgtctcaaacctaagaagacaatttttccacaattgccccaggcttctcagcagggcagctggagagaacaggataaagaagaatttctaaaatttttgggaaaggatttgaaggcataccaccaaa

SEQ ID NO: 266339 - DNA, 432 bp, Homo sapiens
attcaagggggtgggcttagcccctgctcagacacttgcggcacatccagccagcctagggaaatttcatctacttctccacagtccccatcccctcttcggcacccccatctcccacctaggtcctaacggcatgtggcactcagcgagctccaactctcgctggacagtgggagttgtaaagggagcaaggtgcccctgcttgtccctggcagagagagcccagggaccccacgaggggtctagaggtctagaaacaggcatgcaccatctcctttctgggccagggccggagggacacacacaaggcagctgagggggtcgaggtcaccttcaggccacttggggatggtctggagcctgtcctgctgtgtccctcagccccctccgtgcctggaactggccctaccccagcagccccccattcctaga

SEQ ID NO: 266340 - DNA, 423 bp, Homo sapiens
aagagatctttctgaagaaaagaaaaagaatttcaaatgaatcttctaatccttcatatgtttttctacaactagtcctaacttttttaacccttttagttttattttgaaataaaatgagtaattggcatttagagtccttgctgaataaaacttcatgcctttgtgtatctctgagaagcagacaacaatctgatggagaaagtaaaagccatcggctcctcattaacttgagttgcaggcttattattgtgcgaggcactctttgacatttacagtcttcaagttaaaccctggttttaactttttcttttcctgagcattttgtttgatagtataatgttttctgatgctttatctacaaatccttggttaatgtcttcttgtttaaaaagatgtgcatattttttatggaaaattttg

SEQ ID NO: 266341 - DNA, 377 bp, Homo sapiens
cagccttctgagtagctgggataacaggcatgcaccaccacacctggcttttgtaataccctttataataaaccagtaatggaaccagattggaccatggatatctctgcctgcaaaacctcttgtgctttcaagttgaaggtaacggaaaagtatcagagtaactttaaaagtgtacaatgtctatgtaagcacaacaagaaagcaacttaactgcctgcagcatcagaccaagttcctggatcataagtttgaaagcagcttctagatgacgcttgtggatatttggaataatatctactaatttctgttaagcagctatgtttcaactccacttcaataaaaacagccaaatttctctcctggaaattcttaaa

SEQ ID NO: 266342 - DNA, 285 bp, Homo sapiens
gtgccccgaacgccggccctgcgaagagttaaatacgaactacaaacctggtgtacaatgtctatgtaagcacaacaagaaagcaacttaactgcctgcagcatcagaccaagttcctggatcataagtttgaaagcagcttctagatgacgcttgtggatatttggaataatatctactaatttctgttaagcagctatgtttcaactccacttcaataaaaacagatgcggccaatcccttcctttttttacactaattcaattagaaaaaagaatttggcac

SEQ ID NO: 266343 - DNA, 253 bp, Homo sapiens
  misc_feature (68)..(68): n is a, c, g, or t
aaggtgcattgatgaggatgacgctctccaggccaactaacccaaaaagctgcatggcactgtcttgnacttcacaggaaacaacttaactgcctgcagcatcagaccaagttcctggatcataagtttgaaagcagcttctagatgacgcttgtggatatttggaataatatctactaatttctgttaagcagctatgtttcaactccacttcaataaaaacagccaaatttctctcctggaaattcttaaa

SEQ ID NO: 266344 - DNA, 372 bp, Homo sapiens
gcacaaaccagatggcccagcttatgcccagcaactcagggtcaccagatcttgtctcatcaagacactttcagcccaccacccaaacctgtagcccacatgaagagggcaataatcctggacactgtgaaaagtaaaagcattacatccaaagaggcatccccaggatggagcagaaataagaaaacataatgaagacacaattttgcaatcacttctgcctatattccatggcctacaaaccactcaaatagctccacatgtaagagaagccaggatgtgctgtcctccagagcatccagaaagagataatgggactgataagtccttggccattttctagtaaaatctattaatttagtcaaaagattt

SEQ ID NO: 266345 - DNA, 383 bp, Homo sapiens
tgccatcatgcctggctaatttttgtatttttagtagagacagggtttcaccatgttggtcaggcttgtctcaaactcctgaccttgtgatccacccgtcttggcctcccaaagttatgggattataggtgtaagccactgtgcctagccttaggtcttttctttggttaaatttaattttattatttttgatgccattgtaaattgggattgttttattttcttattgttcattgatagtatgtagaaatataagtaattatgggggacaataatttttttgaaacttttttttatatcctggggattacccctgtaagtatatttggctaaactcaaatgtcaaagggtaaggcaagaatttataaatgtgtaaatttgac

SEQ ID NO: 266346 - DNA, 308 bp, Homo sapiens
gcctcatgcttctgatgcttcctgctccggctccactatagcagatgcgagcaggagtaggagagagggaggtaagagtcagaagcttatgttggactagagcttttcccagtgacatctgggaagggccagtctagaaggtgaaatctccgatggcagacaaactttactccccactgaaccctcgcgggtgcctaatcctccctgtggaacacattagacattcatcagacaccaggaaacctttccttctttcccagaacaaagagagacgtgggcgtttccatcaagatcaacacccttggtgt

SEQ ID NO: 266347 - DNA, 436 bp, Homo sapiens
caagactcagcttcatgaaaaaatttttagggaattcttttctgtaatatcttatgatggattataggtggtttcaaatagattatcaggagagtgaatgatgggaagtatgtaaagacactgtggccaggcacagtggctcacacctgtaatcccagcaatttaggaggtggaggtgggaggatcacctgaggttaggagttcgagaccagcctggcccactaatgtcatctctactaaatgacatctctactaaatgtcatctctactaaaaatacaaaaattagccaggcatggtggtggatgcctgtaattccagctacccgggaggctgaggcaggagaatcgcttgaacttgggaggcggaggctgcagtgagcagagatcacacctctgcactccattctgggcaacagagcagagactctgtctcaaa

SEQ ID NO: 266348 - DNA, 320 bp, Homo sapiens
ccagagacaaaatctcactctgttgcctgggctagagtgcagtggcatgatcacggctcactgtaacttcaaacctctgggctcaggaacccttctgcctcaacctcccaagtagctaggactataggtgtgtgccaccatgcctacctaatttttttttttttagttgcccaggctggaatgcagtgaagtgatctcagctcactgcaacctctgcctcccaggagaatcgcttgaacttgggaggcggaggctgcagtgagcagagatcacacctctgcactccattctgggcaacagagcagagactctgtctcaaa

SEQ ID NO: 266349 - DNA, 257 bp, Homo sapiens
gcaagacacactggccagaaagtccctgcccactgaagtcaccgtgcggcgccgtaggaaatcacagtgtaccgtgtgtgcatgtgcggccgtggtggcattggagacaggttgtgggtaaacagacggggcccccacacggttcctcatggcccagctccttccagttctggggctctcgcaagccttcgtggccaggcctgacagtgagcgacctctgaggccatgacacagatctaagtgctctgggtgtggag

SEQ ID NO: 266350 - DNA, 524 bp, Homo sapiens
ctccaagaggattcttttcaggttttccaacaggtaaaggaagaaggtgacagaggcagcgacttcctcaaatgtccttccagctggccaaactcaacctgtcaagatctctcccccataagctgtgtgtgtgtggtgtgtgtattgtgtacattgtatgtatgtatgtatgtatgtatgtatgtatgtatgtatgggacaggtactctaggagtgaggggttcaggcagatgacaggctcagacctcaaggagtagccaggtttgtgggggaaatttatatataaacagaaaaatgtagtgatgtgcacatgctatcagtacatggaagtagccatccatttatttatttatttattttctttttagagatggatgggggtctctcggtcttttgcccatgctggagtgtagtggtggaatccttgctcagtgcagcctcaaacttctgggctcaaataatcctgccacctcagcctttggactataaactacatgccactgtgcccagttaatctttaaaat

SEQ ID NO: 266351 - DNA, 465 bp, Homo sapiens
ttttgtatttttagtagagacagggtttcactatgttggccaggctggtctcaaactcctgacctcaagtgatccacccgcctcggtctcccaaagtgctgggattataggcatgagccaccacgcctggcctttgtttgttctttttacatcagaatacctttagttttcctaagtagtgtttgtatcaagtgcagtgactggtgccttcagcctgatagtgctatataagttacctaatctacaatataaaattcaattgatttttttggtagcatagcatcctatatatttgttcatgttctcattcccagcccttctttggaaatcaactccagctattctgaaactgtgaggggtgaaggtaatttaattctctgggctctaattcctaaaggagagtttgcagtatgttattactgatgacatgtaggatatgatctcagcataaggcttagtatgtga

SEQ ID NO: 266352 - DNA, 508 bp, Homo sapiens
ttatgcgatatatagtagtcaaatatagaagataatgcaaaacaatttaaagtgattgtagcagtttgctgtattctacagcagcagattgtagcagattactgtattctacagcagcagcatgtgagattgccagttgctcaaattcgtgccaatacttggtattttttatcttttaattttagacattctggagagtgtgtagtaatttttcatcttggaaaattacattaaattagtatccatttctctaattttgataacattttcataagtttattgttattagatattttctttattttgaagtgcttattgtccattttacattgggtcatctgttattgaattgtaaacattccttgaatatttaaatatgagtgcttggtcagtttttgtcacaaatatcctcttttttcactttttgcccttttattattctgaaaatgccaattgattaaaattaattttactattgttcaatatatcatgctttgttttttaaaaa

SEQ ID NO: 266353 - DNA, 475 bp, Homo sapiens
gataaatcagtagaaacttttcaagcagaaatttatagaaaaaaagagaaaaacgtaatatccaagaacttctgggcaaattcaaaagttgtaacatatgcacaattggaatgccaagaggagaaaaagaaaagaaaaaatatttgaagcaagagtggtggagaacattataaaattggtgacaattaagaaaccatagatccaggaagccaataagcaccctccctttttataattaaaaaaaatgtaaaaacaggacataggataaataacaaaaaatgacacctatgcatggcaaagtcaaactgcagaaagaaaaagaaaaaaaaaaggaaattctgagaaaaaaacaaaaacaaaaaaacaaccttacctatggaggaataaggaaagataaacattacaggaaagttgtccttggcagaagtcctgtcagcaagaagagtgtgggatgaactatatcaagagtagaaag

SEQ ID NO: 266354 - DNA, 592 bp, Homo sapiens
aaaaaacaaacctaatatatatataaatataaaatatataattatatgtatgtatatatgtaatatataacatataaatacatatataatgtaatatatattttatataaacatatacatatacgtgtatataaacaaacatgtatatacacacacacatatctacatacgcacacatgcttcttaggttaggtttccccagaagtataccctaagacatagattcggggtgaatatttcatttagttggtgatcccaggaagtactggtataaagtaaatacacagcatgttaataagcaggctaatgttggaacaactacagctcagtactgttagggtggatattgtagtttgagttgtcccaatagaggaatggagaaggcagggtattgatccactagctcttaactgccaatgattgaaggtccatcctctgggggggtataaatgcttagcactcccagcttgccctgtgtctgcctagcatgttctggtaagcagagagttgcacatgctcaattactaccctggaatggtggatgccagtggccacacctggacactaacacctactacatatgccatctagc

SEQ ID NO: 266355 - DNA, 510 bp, Homo sapiens
ctctcagtttcctactaatacctaagaaaacccagcaaagggtgggagctcacactgtgccccacagaatggacatgaaaggtaaagtgtcgcctgtccctgctgtgtccccacctaaaagcaggggaggatcttggaccccatcgtgcctccagttctgaaatacaacattggtaccagccagaaatgggcatcatcctccactgtgtgcttctgacttctgaggctgccaaagcattgtgatgtctcttgtcattctccaggcaggaagggaggaaatagtaaaaagcctgcaggggaataagaaaaatgtgtaaagaaacaaaagctataatgctgggatgaagaataaagaaaaggactcttatgagagaatatttgtattcatggtcatttttcaaacccctcccaggagtcaccaaatttgaaggttattatagtcagttaataccacacacacacacacaccacattcatagcactatgctgaatggtttggattagatttgg

SEQ ID NO: 266356 - DNA, 326 bp, Homo sapiens
cactcttgctttggctaacttctgctcatgctgtccgtttcttcctcttttcctcatagaggatttccccgacattcccctgccccacgatctgaatcaggctccccttactatgcactctcaatgcctctattttttttccagagcatttatcacactttgtaattagggatcattttgaggaattctttgcttgatgtctgtctctcctagtagactgtaatttaatttcatggggttagaaatttcatttgtgtctccagtatctagcacaatgcctgacacatagtaggctcaataaatatttacttaataaatggatacaa

SEQ ID NO: 266357 - DNA, 1319 bp, Homo sapiens
cagagcttggatttggactctgagcctatgctcttgacatccatacctaggaggaaacaaagagatgtgagacacgtttgatgttaatagtaaagtaaatttgattttctgaaatactccaaaagcttaccaaagttacagtctcagttttgtatttccttattagtggacctctagcacaaactctctgtggctgagtttttctctctgcacaatttgtatgatatatcccgtccatcaaattcatgaggattagaagggttcacacaaactgattaaaaatgaggattcactataatctaagagaaatatagttcaacgctttccaactcctaatttttttagtttttgtttttttataacaaatggattaaatgaaaagtaggggcaagctattaattgattgctaatttctccataggagaattagaaaactcagtaaagacgccattgtaatgtgagcttttcttccaggttccattattgtgtagagacctttttattctaaaataattctatgtaatgacagtaataacaactaaatctgtttaaatgttttatgcatgtttcatttaattctcacaaaaactctaggagcaggtgtcctattattatttccattttatagatgaggaaattgaggcacagagaggttaaagaatttacccatggtggtctggttccaccgtccaccttgttcctcagaacactatgggataattctgatttgcagtgttctctggtttttagaagcaatgggatatgatggaaaggaccaggaatcgggacgggatgcttgagtatcaccaccgtgtaagaagtctcactggaggttttgataaaatattaagggaggaacatggggtcctgtagagaaggaggcaccaaaggttagaatatggggtgtcagattagactgaagtaagctgtaaggtgttgggtttaagtagatgagctggagtcagtgtctgaagatctccctgggataggatggcacagacaaaggctgaatgggagtcaaggggttgcgggtcaggaacaatgcagtgtatgagatcacaaaccaagggagaccagcgtttagaatcagggctgagtgtggcctgagttctgatgtggggaaggacatagtggtatattttcccttagattagggccagaccatgcagacactatgaccggccctgaaatgcaccaggtggttaggtcctctgggatatttgtagagatccagcagttggaatttcctgtatagagttgcccatgtaaaattatccctgtttatacacatttgtggattggtcgtgttttaaatatat

SEQ ID NO: 266358 - DNA, 1066 bp, Homo sapiens
agcatatagtgaggacacagtatacatttgctagatgaatgaagcagatttctcaaatgtaataatttatatggaaaagagtaaaacttgtgcatattaactttgaaactggaatgttttcaggttcctgttagtggtattttatcttacttgcccaggttgagcttaaagtaaccaaaagtttagtagcaagttgctttctgcttggcagatcgctgttgctgctgctgctagtggtggtgggagtttgaaggataggaggagtatatattcaaagcccagactatagtattatgtcttctgaaaaattgaaaggaaactttctgcccctatagggatgacataatcagtatcatggcaaggagctctgggccccacatggtcttgtgacccatgggaagtccagaatgcatttgctgagagtgagcgttgttgaacactgcagtattcattgaaaggatcatatggttgactttctggaggtctttaagaacagtagattatcttatgtctgaagagacttgagtgcatgtcttccctgtcctcgctcatgcacttttttttagatgatacttgctttgtcattttgttaccatataggttctttttgtttatatttagattatcaaattaaatactattgtaattaatacataataaattagactatttaattttgactttttactttattattggctatgtttaagtgcctgtattgaacatcatctctctttttcttatgtagaattattttctgagttgagaaacttcttgagtttttgaaaaatggttggatgtcttctctttgtccctaaagttttgcttaacacccttgtctctgggatataagaccctggcactcagtttacgctcagtaaatgttcattgaatgaatgacagctcccctttctttcagactaacaggtgggcaatttgtgatcttttcttttgagagaaatgcatattttacatttactaccctagttagtattcctttccctgattttatagtatatttaaaggggatagcatgtaatttagcatttaactcattcttttttta

SEQ ID NO: 266359 - DNA, 617 bp, Homo sapiens
agcatatagtgaggacacagtatacatttgctagatgaatgaagcagatttctcaaatgtaataatttatatggaaaagagtaaaacttgtgcatattaactttgaaactggaatgttttcaggttcctgttagtggtattttatcttacttgcccaggttgagcttaaagtaaccaaaagtttagtagcaagttgctttctgcttggcagatcgctgttgctgctgctgctagtggtggtgggagtttgaaggataggaggagtatatattcaaagcccagactatagtattatgtcttctgaaaaattgaaaggaaactttctgcccctatagggatgacataatcagtatcatggcaaggagctctgggccccacatggtcttgtgacccatgggaagtccagaatgcatttgctgagagtgagcgttgttgaacactgcagtattcattgaaaggatcatatggttgactttctggaggtctttaagaacagtagattatcttatgtctgaagagacttgagtgcatgtcttccctgtcctcgctcatgccatcggatacatggacagatacacagatgcacacacggatacactgtcctcactacatggcat

SEQ ID NO: 266360 - DNA, 338 bp, Homo sapiens
tacttactgtttaaaattttgagttgaagccatcagttgtatttgttcatgtaagcgcagaagataaacatgaagttctgtagggtatgatgtataaacatggcagttgaaggcatggtgagcagtgaattccatttcagagtgccttgatgcaggatggaaccatatctatacttgagaaattaggcaacaacccatgatgacaaaaatctttggtggtagaagatgaatagagagtttgtggcgactatatttcacatttgagcatctacaacatactacatcctatgtgtctgaggccatgttgaaataaaatagaataatgcagaatgttaaac

SEQ ID NO: 266361 - DNA, 679 bp, Homo sapiens
gtaacacagaaaggaaaaccaacagcatgggcctcttggcttggaggaagccaaagtgcacatttcttcagtcatactacatctgggttcatctagccacctctgccatgctgcccaagttcaaccccaatgagatcagtcatatacctgccaggtgccctggtggaaaactgggtaccatgtctgccctagcccttaagatcaaccctctggacctgtctccaaaataagttggtgatgacattcccaaggccacaggtcaccagaagagtcaaaggattacaatgaaactgaccattcagaacagacaggctcagactgaggtggtactttctgcctctgccgtgagcatcaaagccctcaaggaaccagagacagaaagaagcaaaacaatcaagcacagtggaaatgccatttttcatgacactgtcaagattgcatgacagatgcagcaccaatccttagtcacagaactctctgggacccgtaaagagatcttggagactgcccagtctgtgagctccaatgttgatgggcgccagcctcctgacatcatagatgacatcaaatcaacagtggtgcaagtaaatatccagctagctatgaactacgaaggaaaaaatttcaataaaggatcatttgacaactaaaaataaaaacacagcatggttatgacata

SEQ ID NO: 266362 - DNA, 545 bp, Homo sapiens
ttttagaagctgactccaccagagacccgattcttgaacttttaatgcacatttggaaatccacgtgtttagttggcttagattataaactgcaggagaacaagaagtgtatcaattatgttccagtttctaggatgtactcttctagtggatccacaagcaaaagggaagaggggagtgtgaaggcagagaaaataaagcacagcctatgaaattatagcttgcagttttgccagaatgatgctctattaatgctcagtgcctcttaacttctcacttaaaacccaattgggaaaaatcaccaactaatagaggctattccgtatacttactagaatatatgagttttacaaattggaatgataggcattgatattgacacatctggagaaggagtgatcaaagagaagtggccctggagctctccccatgaaaagattaaatttttaagaagatgctgctcacctaaaacttatcaataaagtcaactatagtttccaattggtaaatcattgtatgaaaaaacaataaaactatgaaataaa

SEQ ID NO: 266363 - DNA, 511 bp, Homo sapiens
ttttagaagctgactccaccagagacccgattcttgaacttttaatgcacatttggaaatccacgtgtttagttggcttagattataaactgcaggagaacaagaagtgtatcaattatgttccagtttctaggatgtagggagtgtgaaggcagagaaaataaagcacagcctatgaaattatagcttgcagttttgccagaatgatgctctattaatgctcagtgcctcttaacttctcacttaaaacccaattgggaaaaatcaccaactaatagaggctattccgtatacttactagaatatatgagttttacaaattggaatgataggcattgatattgacacatctggagaaggagtgatcaaagagaagtggccctggagctctccccatgaaaagattaaatttttaagaagatgctgctcacctaaaacttatcaataaagtcaactatagtttccaattggtaaatcattgtatgaaaaaacaataaaactatgaaataaa

SEQ ID NO: 266364 - DNA, 448 bp, Homo sapiens
aaaaagaatgtggatctttttcactgggaaaaaaagtcgccatgtatcatcttaatcatgttttcctgggatataatctatacgtgacgcccatttaagccttcattgcatctatgcacgtggtttgctttcctcttgtgtgaaatagtgttggaccacacgggtttgggccacagcccaggaagacacaatcctgaacgtcataatcccaaatgttgaagtcccataagatctaaatctgtacagtctaaaatcctgaaaattacaatcctaaaaaaacaaaattctcaaaatacaattctggaaaaaaattattaacacattctttaagaagcatttattgggcagcacatggtggctcatgcctttaatcccagcacctttggaggccgaggcgggtggatcacaaagtcaggagatggagaccatcctggctaacacggtgaaa

SEQ ID NO: 266365 - DNA, 393 bp, Homo sapiens
tggagcttccaggctcaggacagctgcctcattccttcctactaagaaatctgtatctgctggttagagctatcaaactgtagaagacttagttcatgtcccagcaagtgtcccctaaaatgaccttcttgtttttccctcttctgagaaaagcatgcaggaataagaacttctatggtagagagtacttgctcttccgctctcagatggcttggttgactgatgaactgatgccctgaggaggggaaagatccagggaagagcctgtgctgggtgactctgtgttttcccagctgtgctgtttgtgtgcaaatagtggaacccccaagaaatcaggtgatagacagacagacactgcctaataaaattgtctgaatttaaataggatttaaa

SEQ ID NO: 266366 - DNA, 276 bp, Homo sapiens
ctacattggccagtctggtctcaaactcctgacctcaagtgatctgcctgcctcagccttccaaagtgctgggattacaggcataagccactgcacccagcctgttttgtttcaattgcaaataagaattgcacatatttatggggtacctagggatgttttgatacatatgcacaggttgtatgtgcaacctcacagatgacgttccccatgaaacgctctgagatggattgagcaagcaggatatttattaagcagtgcccttgaaggccaggc

SEQ ID NO: 266367 - DNA, 421 bp, Homo sapiens
ggtaagtattacagttgaggtgcaagaaaactgccctgggaatcttaaatttgcctgttaagatcaacatttgagaatgttttacattggaagcaattttgtttttcaagaatgaagagggatttgtggcctgttgcagtggcacatgcctgtaatcccaacactttgagattccaaggcgggtggatcacttgaggtcaggagtttgagaccagcatggccaacatggtggtgaaaccccatctctactaaacacaaaaaaaattagccgggtgtgctggcacatgcctgtgataccagctacttgggaggctgaggcacgagaatcgctggaccctgggaggtggaggttgcagtgagccgagatcgcatcactgcactccagcctggttgacagagcaagacactgtctcaaaaaaaa

SEQ ID NO: 266368 - DNA, 470 bp, Homo sapiens
gcccaaatgaggacttgtgtgaaggcagtttatgtgagacatgatgagggagtggaggcgagggagtgggcgatgcaacagggaaggagggaaaaccaaagaggtcagttgtcaagatccctggtgtgggggaggccagcttgatgccactgggagcagcacagagaactgtcagcagaggggtcagggactggagcatatattaatattaactgcccctcggctcccgttggttgagcgtcaccccagggggcattaattccccgcacttctggactgtttttgagctcaggccaagctgtctcctgtgggattagagaagttctgggcagaaagcataggaacgtgcggcatgctcttgaaatgacaggtggtcagcctgcagtcatcatctgagctcgtgtatgatcagctgccacaggtatggccgagatcagagacgggctgaagggatgtgacagctccaccag

SEQ ID NO: 266369 - DNA, 257 bp, Homo sapiens
gcccactccaggatgagagtactgaggtgccataaaagaccaacaggcaagatgttggagggttcaggagctgccaaggttgtgttcatgctgacctgttggcatagcgtacagcagtgccagctgctctgctaaaccgaggagctgagatgctgtgttgatttctacatgttccaggcaaatacttcctgaggattgtcaggatttacataatggattggccctgggaccactgagccagcatctatctttgacag

SEQ ID NO: 266370 - DNA, 711 bp, Homo sapiens
ggcggtgtttcttatttactgtcagcaaactgacacataagaaaacaaatgaaatcaacagcattagtaggtctaaaataatatggttatcaatgtttagctttccacttcctcccattggtcaccttactccacagcaagaatgactgtcagaacatgtgcagtaaaaggcactttcaagtcatgctatgtgttgtacaaaaagaattattaaaaagaaaaatgtaccagtcagatctctagatgtttgtcttcttcatttagagaaatattatctggaagaaaatgtcctaagtttctcaaagtcagaaattatttctatgtagtccagacctgactccagataaatataaaagacggcaaagaaaggaagaaaaatgggtcatagaaatagaaaaagcatagtaacatggtagatttaaccttaaatatatcaataattatgaaacctttaataggttaaagtatgcaagtttaaaaggttgtcagaatggattaaaaaaacaaaatccaactatatgttgtttacaagaaacacatctaacatacaaggacaccaaactcttaaagataaaagaatgaaaaaagatgtatgatgcaaaaactaacctaaagaaaatcaatatagccatattaatattaaaatacactttaagaaaataaacaagaatctttataaaagttttataaagttattaataataactcaaa

SEQ ID NO: 266371 - DNA, 560 bp, Homo sapiens
agagaggggagaataaaatttcagtgcaattgtaatttcctttaattcatgcaaatcttagcatattttatcatattcataaactttccttgggattcagttaattcctaagttgccaccttagatactatattgtaaggccctggaaactactactgtaaacgtgtttcagaaacaatctaacacataactcctactttaaaattattcagttttgtctaagagaaatatatagtcctttgagatatggcttttggcctccagggcaaaggttttatgacagtaattttttaggcttaaggaaatcagatgtggctttcttagaacaacagtgttttgggtgatgaaaagacgagttagtgggtgcagcgcaccagcatggcacatgtatacgtatgttactaacctgcacaatgtgcacatgtaccctaaaacttaaagtgtaataaaaaaaaaaatcaaagtgaaaaaaaaaaaatcaaagtcctttggagcccaattccttctttgtgaattatgtaatacatgcataggaatggaatcctagcatgagcagtaaa

SEQ ID NO: 266372 - DNA, 231 bp, Homo sapiens
ttttctgtcagtcactgggagcctcagccttcagatgtttgaccttcatgcagaagtctctagctatctatcttctgtcctacgccagcctaatgctttgtttcctgttcccaatgtatacagaccaatactacacaggctttagacccctcagctaggcagacatccccagggcccataccagccaacctcagagtttgtttacctttctagcttaatgagcactatcct

SEQ ID NO: 266373 - DNA, 555 bp, Homo sapiens
cacaatttgtccacagggaaattccttatgggcctcaagatctttaccttaaaacagttgtgctgaatttcaccctggcaatgtaaactgatagcttatcttcacaggtgcaggacaatagacagaactcaaagtcatccctctgctcacctgagacaaatgtgtatctgattgctgcttctgccctattgtttatgcaaaaatgcagatccactgagccagactaaggcatcagtgtgactattcctttactccccactccatgtaaattgtgtattcagtgaaaggctgatcaaagaccccaaaaaatgcagccttttgtctcttatctacctatgacctggaagcccccacttcgagttgtcccgcctttccagactgaaccagtgtacaccttacacgtattgattgatgtctcatgtctccccaaaatgtataaaaccaagctgtgcaccgaccacctttagcatgtgttgtcagaacctcctgaggctgtatcatgtcatgagtgtgtgctcaaccttggcaaaataaactttctaaattgattgagac

SEQ ID NO: 266374 - DNA, 615 bp, Homo sapiens
cttacttatatatcaaagtttccctcataatgtctgctctgtgtcactatgtaccctcccctgtcctccattccccacaccaagagtattatgagtattaaatgccacgtgggcaggttccccaggcaatgagggggtgggcctgtcaaatgcaggccatgcagaatgccgcagggcgggagacgggtgagccaagggagccgagagttccagataacagagtgcacagcaaatgccatggcccgcgtccagcaaccaggagaaacagaactgctgagctcagaataggccaaggccgcgtctgctagcagggagcaagggcacagcctgctgtctggcctcttctgccccatccctccaccgggacatggcccagatgagaaagagctgccagacggcaagtcaagcgtggggcgggagaggacaacgttttatgcaagagtggattctcggagcctctgcactctccatcagggctgctggcatggaaaacacagagaaaccatcacctaggacttgattgaactactggacttcccagaagagtccaatttaaagcaaagaggtccagagaaaaaagcattctagtgacatttttatatatttaaaaactgg

SEQ ID NO: 266375 - DNA, 513 bp, Homo sapiens
gcatgccattatgcctggctaattttttgtatttttagcagagatggggtttcgccatgttggccaaactggcctcaaacttctggcctcaggtgatccagccgtctcagatcaaagtgctgggattccaggcatgagccaccactcacagctcgctaaggccttttgccaagacaaattagctcttagagaaccacaggattcctcttgtaatgtattacaaactaaagtcttacctgctcttgaagagtagaaaacatgaaaaagttctgttagcccttagaataattaaaaattcataagctctgaaataaatacaggtaataaaggtaataaaattattgcctatgacaaaacaaaagtttaaattggcgtttgtaaactctgcacgaaagccaggtttctcactactagaaaaagaaaaaaagttataaataagccaagaattccagaatgaatcctgtggtgccaaatatatgttaactacaaggaataacagtgaccttacactgg

SEQ ID NO: 266376 - DNA, 473 bp, Homo sapiens
taggaaagcagatactctaatccagacagtccagttgtctgaactgtctaaatttaaaaattcttttgtttcctttttaaaaaaatacaataagctgaacatgtttaaaaggtacaatttgataaattttgacatatatatatacacctgtgagaatattaccaaactcaagataatgcagatattcatcactcccaaaagtttccaagggcctggttggaatcccttcctttcattcctcaccaatccttcccccatcttatgctcaggcaatctgatttgctttctgtaacaataaattggttgtcaccttctagaattttaagtaaatggaactatacagtatgtgcaatttgtcttgcttttgtcacttagcataataattttgagattcatcaatggtatgtttgttaatggctatgtctttatattgatagatagtatttccttgcacaaatttttccactgtttgt

SEQ ID NO: 266377 - DNA, 350 bp, Homo sapiens
acccattagtaatttatcaaaagagcaaatgtcattatgcaggaaactaagggaactattttgcatttgatttctggttttgataacattactattgatttagtattctccagcatgacatgggctagacaaaacatatcactgtatttttgaactgtcaatcacaaatgatccaaagctttccaaaagagtagaaggtccatgtcacagcctgaaaactgcattttatctgaaattcctcagtcccaaaatatttagtaaggatctgctttattactattaaaaatatttttaaatgaagaaatctcaatagttacttccaaaaagtaagggaatcatgtaattagtac

SEQ ID NO: 266378 - DNA, 449 bp, Homo sapiens
aaacacaacattgattttggagtcagacaacctaagttcaaatctagcctttgctaattactggctgaaatcattgagaaatctacttaacctgcctgagacctcagtttccttatttgtaaatggaatagtagtgcctcaagtgagataaggtgtcccgttcagagcatccagactaatggacagttaaggaaacgacccaacagctattagggctcccttgctattgccaagcttgttttcatgctgcaggtggtactgaattatataacacatgcgcagctaaacaagcaaagaccctgcatgttcaccacattctctctcctctgaactctgaggttaataccagttgtcaaactggcttacgggaaggcactatacctgctcacagcttggctaagaatcaaagagatgtttgttttgaaagaataaaatcctttacaccaaaa

SEQ ID NO: 266379 - DNA, 510 bp, Homo sapiens
tttttctcatcaaggtgctgtgagcatttggcagggtaattcttcactatgtgggtctgtttctagaatagcaagcattcagcatccctgagcctggcatttgaaatgccagtagcaccctccaatcattgtgacaatcagtgtccccacatattttcaaaagctcttgtggtaagtgttgccccttcccctccccgtgacaaacctgccccttatacctttactgatgtttctagcctatgtggcctacaaaaaaagtgtgaagggggaaaagctatgttgttcacattaaaaagagataggttttcatttctgctttttgtaagccattgctgaagttaaatttaattgcaaaatactaaactcttgaaccaattctaggacaggtttgcagaatgattttcttaaaggacctttataatctattaccctgaaatgaatttctgagacttaacattcgtaacactagggcatgattaaatatatgggagcaagattgggaacattttg

SEQ ID NO: 266380 - DNA, 614 bp, Homo sapiens
gaattgtaaaggggatacattgtaaagcataaaaataagatggaggcagggcacattggctcacacctataatcccagcactttgggaggccgagttgggtggatcatctgaggttgagagttcgagaccagcctagccaacatggggaaaccccgtctctactaaaaatacaaaattagccaggcatggtggtgcatccctgtaatcccagctactcaggaggctgaggcaggagaatcgcttgaaccaacctgggaggcggaggttgtggtgagccgagatcacggcattgcactccagcctgggcaacaagagtgaaattccatctcgtatggaaataccagtgcaagcttgcaatctctgtttccacttgatgcattaatgctggtatgcaggctttctcttcccctaatagctttctagggccagtgtggtatttctgtatctgtggactaaaattatgatgctgaagatttctagttgttcagttatataaatgaatgaagtcaaaataggtaagactgatttgggaagataaatgctaacagaacctctctcttcctctgtgaatagatttttttcatgctgccccacccctgcaagcttgtaatct

SEQ ID NO: 266381 - DNA, 354 bp, Homo sapiens
ttggttcttcccgtaaaaaaaccttttgtgtatattgcaaatggaactatttgaacaattttcagttttgaacacaaatgatcataattataatattgcatatccaaataaacattacattaagaaaaataagtaactacaggtaggcttattattggtattatcaatatttttgtaagtaataggtggactagagcaataaaaaataataatgtttgaactaggaatatgtattttcatgcttataactataattaaaatgctgcttaataactggaagcctttccataagttcaagcctcacatcctttgttaataagatgaggataatgatgccatcttgttttatagatt

SEQ ID NO: 266382 - DNA, 231 bp, Homo sapiens
ttaaaattcagaactgggacaaaacttccacccacttttacgtacttatgctctttgcatctcaattcataggtggttttttagtaattaaagggaaccagttgctgggcatgctggctcatgcttgtaatcccagctacttgggaagctgagttgggatgattgcttgagcccagcatttgagactaatctgggcaacatagtgagatcctgtcttaaaaaataaacaaa

SEQ ID NO: 266383 - DNA, 950 bp, Homo sapiens
  misc_feature (289)..(289): n is a, c, g, or t
  misc_feature (365)..(365): n is a, c, g, or t
  misc_feature (526)..(526): n is a, c, g, or t
  misc_feature (632)..(632): n is a, c, g, or t
  misc_feature (645)..(645): n is a, c, g, or t
cattttatgtttgctttaaactttttttcaaggaaaaaatagaaaagtatatccattggccctgtgtgcttcttatacgttattgtcagatcttcatctgctaggtgcctggatttttagtgtagagattacctgtcattctttgtttgcctatagccagtgaacttcaggaataattttttcttgtcttgaaacaagaatgaagctatatagataatggtcaccattatttagacatcaaagattaatatgaaaatattttctgataaacttagaaccatttttgttntatatcaggttttctagataaatatttcaactttaattagacttttcaaatgtccattattttgtgattttaaaangcagtgttacgtaaaaactattaatggaagagtcagagaagtcgttatatgaaagtaaaaactttgaggtaacttgctaatatttttgtatattttattgcaatattcttgcatttttaaagttggggttcttttacaaattttgtatcctactattttancattaatacatgtacatttcttcatttttctaaaatgatgcataagtgtatttcttaacggctaatatcccattgatagaaagtaatttaaccattcctctattgnacatttagattgntccctaattatgtgtgtctattatatatttaaactggagagacatgtatttgcaccaaaggtaggttatatgatctacttacgcaatgtgcaagtggaaaatggatggcagaaggattgttcttccttccttgtttgtttgtaccagaactcttcattgtttacatacattttagccttggtgccattttcagaagctttatttgtctcacttacttttttggtttggataagacttaaatataaaatccatctgtgaagcatattgtatattcacattgaaggctaaaaacccttttttaatta

SEQ ID NO: 266384 - DNA, 661 bp, Homo sapiens
tgaaaagaccgcttacctgatttgaaattggtgagatgttccttgggctggttggtctgaggacccgaggtcataggtagatctcttcacagagtgagggtgaggacagggtactggtctcccgaaggtgtcctcctgtcctgggtcttcggcaccaaaagtcacacccgtccgtgtgagaccaccaacaggctttgtgtgagcagcaaggctatttatttcacttgggttcaagtgggctgagtccaaaaagagagttagcaaagggagatggggtggggcagttttataggagttgagtaggtagtcgaagatttcagttaaagggggttgctctcttgcaggcaggggcaggagtcacaaggtgcttggtgggtagctctggggacttattgtccaggagaaggaatgtcacaaggtaatgtcattgggtaaggcaggaatgagccattttcacttcttttgtggttcttcagttgcctcaggccatctggatgtatacgtgcaggcttgggctcagaggcctgacacgcacctcttgaatcagtctatgcccagagatttagtcaaataaagagcaatgtatcccataaagccttggtgaagaatgtctgtctccctgtagcttttcttgaagtctgtagggacgttagagggcaaa

SEQ ID NO: 266385 - DNA, 650 bp, Homo sapiens
ctgagggaggggagaatcttgacaggacttggatccaccgggcactgtgcttggtgtgggccttggctctgtctggagaaacacgaaggaagtttttccaaaagggcaaggttgtccagaccagtggaactgtccagagagccaccatctgggccatgccacattcctcaaaggcagtgaaaccactttgcacatgtgccttgctggggtaacccaggacatcctatgcaatctctattgcttgaggggagtggcttgagtgcacttctgctccctttccataggcccaggggcagaggaagggcagagaggtgaactggaaaaatctgcaggtggttaaggctagggaaacctaaatgagcctttggagaaagggatactcttgcagactgaagctgagctcctgaagctccctctcttccccagccagactgcaacagataccagagcggcccctggctcctgctgagggccgggtcagccagaggtgggggacagcgtgtccagctggggcagatccagcctcagcctctacctcagacttatgtgccagggaagaaaccatgtctttacccttttgtatctacctctcaaccctttgcccagcataggtgctaaataaaagagcctgttggctaaaagaaccctct

SEQ ID NO: 266386 - DNA, 853 bp, Homo sapiens
ctgagggaggggagaatcttgacaggacttggatccaccgggcactgtgcttggtgtgggccttggctctgtctggagaaacacgaaggaagtttttccaaaagggcaaggttgtccagaccagtggaactgtccagagagccaccatctgggccatgccacattcctcaaaggcagtgaaaccactttgcacatgtgccttgctggggtaacccaggacatcctatgcaatctctattgcttgaggggctggagaagggaggcgcctcatgcttccctattccaaaccccttccgcatagccctgtgcctccctccttccccgcagcacttgggcttcactcacctgcttgcccccatgttcttcctggagagaggagtgattcagaccaggccccggcctgacctccacgcagggcgctttccttcctttgttctcagcttctccgcttgagtggcttgagtgcacttctgctccctttccataggcccaggggcagaggaagggcagagaggtgaactggaaaaatctgcaggtggttaaggctagggaaacctaaatgagcctttggagaaagggatactcttgcagactgaagctgagctcctgaagctccctctcttccccagccagactgcaacagataccagagcggcccctggctcctgctgagggccgggtcagccagaggtgggggacagcgtgtccagctggggcagatccagcctcagcctctacctcagacttatgtgccagggaagaaaccatgtctttacccttttgtatctacctctcaaccctttgcccagcataggtgctaaataaaagagcctgttggctaaaagaaccctct

SEQ ID NO: 266387 - DNA, 629 bp, Homo sapiens
cacttatgggaaaaatgatgtagtatgggagtggtgtctgggcatactggagcccccagttgcccttgccctggttcatgggatgaggatttcataagaacaaaggaagcatgccaaagatacctaaagatgctgccctcttcttatccactgagtgttcagctcttcaactggggtgtcatttagaaagaagctcgccattttccctgtcccaacgccaaacactgggttaatattttgtctgagaaaacaagcaagccgtagaacagagaacttcaaaggccactttaaagaaaggaacttcatttgtagcaaaatgcaaaaaagtcaggcactggagcactctcaggaggacatctaggtaagaagctagcttgttggaaagaaatggagaaatagacagcttgcaagagcccttctggtgtcagaacaaatctcaaacactgacctttggaactacaccttcaagtagcctaaatttgattggattagtgtgtggaacaatttatgccctgggatattactgtaaacagtagagcaatgagccagcaattgctggagcttaacatctggtgtggtaaggagagataaagagagtcctgtcgaacctagaataactctgggcttac

SEQ ID NO: 266388 - DNA, 698 bp, Homo sapiens
gtcgagcctcagacatcatagagtcctgtctccttatctcttggctctggatagagaaaggttagtatagaacgtgtcagacatggttttccccaaagaagggatttttggcacacaccaaataacatctcactataccaattaacgaaatcagtttgtgctttgtggaagattgccagttgttactcaaaatgtctttcccttcttccataataatagtgttttacttgcatatgatcatccagaataaaagctccacttaccagcttcacttgcagctagatgtgcccttgtggctaagtttttgccaatataatgtgagtggaagtgatacatgccatttctggatgaaatgcttaagaggaaattcatttccctcttttctcccctcctgtggactgacactgagatttgactcagctccagccctgtaggtgaagatagtacccctaggagatataggagcaacaagatagaaggaacctgggtctttgaatgaccttgtggagtacaactgtctcactaggctcaccattctagattaccagtactgttatgtatgatactatacatttttaataaaaatttttattgagatcattgtagatccacatgccattgtaagaaataatacagagagctcctgcatactctttgctcagtttccccaaatgataacattttgcaaaactgtagtg

SEQ ID NO: 266389 - DNA, 169 bp, Homo sapiens
cacaaacatgcagacatatatatgtttacatgtagatagctgtttatacagaagggtaagtccaatttctgttatttaaaaatggccaggtgtggtggctcacacctgtaatcccagcaccttgggaggcttaggtgggcagatcacctggggtcaggaactcctgatg

SEQ ID NO: 266390 - DNA, 457 bp, Homo sapiens
ggtttcctcagctgtaaaatggaaacagtgatagaatttacatcacatagctgctgtgaggattaaatgaggttggtacctgacacacaaatgcctaaaaacgatagttattgatataaaaagaacaaccataatatgaccttctttttacctgtcatgttttcaatcagggacagctcttatttgaggtcttgccatgtgatatggacaacgataacatgaacaggtaccaatatttagaggtcctaggatgtctcaggtgctgttctgcgcatcttgttcacaagcactgtctcatcagtcctcacagcagcctgtgaggggaaggaagtgttgcacgatgtaggaagtggtggagctgggattcaaaccaaacatgcgtgacttcaaatgcttgctcttgaccacgtggaacgtcagcagccttcaaaattctttgaactgaacccacagtaaa

SEQ ID NO: 266391 - DNA, 557 bp, Homo sapiens
actatgttataagatatttttgtcacccaagaatgcttagcaggctgagtaaagctggcaagtgtgataggaatagagggaggggtggtaataatcttagctataatacacaaggtgttgctacattcccttaataggtagaatctcatttaatccttaacagtaatgctatgagataggcattattggtatcctcattcttgagatgaagaaatggagacgcagagagactgagtaacttgcccaaagttaaacagctggtatgtgacacacagaacctatatttgaacttgttctggttccacagctcatggtcttaaccactaccctgcagttagcttgaaacactagtttttaagtaaaggacaaagcattaggatgagtccagctttaagggcttaaagaaatgcacagtggaagaaaaatcccagctaaaggcattggaagtgctagctggagggtggttgaatgataccttacgtgatctcaacataattaggaaagaaaaaggagttgtgtgagggtgaagatatggccagggtatatctgatttgagt

SEQ ID NO: 266392 - DNA, 713 bp, Homo sapiens
caatgcaaacaatttctgaaccattgaaatgcaaatgaatttcctgtgaaaaagatcccattaattattgtcctgtggatattgattacttttaaatggattagcaagtttatttcagtatttctgattgtctatatagttgtgatctttggattctcctttgaaatagtttttaaaatatcttattggttccttcattggtaactgagttccttaaagtatttgaaccgatagatgtgtatgtgtttaggtaaaaatgagaatatttatctggagctgttggaactgtattttattctactttttgaatttgagtaaataggcagtatgttcttatttcccaagtgtataccataggaatagttttaggagctgaaaaatgtaacaagaagttattacccatgaaatcaatgaaggagataataaaaaagcatccaccaatcctaaatcaacaagcatggtaagggacattgtcatgagtccatgtgagtgaacacgccacaccttggctgctctctctctctgtgtgggataaagggtcacaatattaaagggtctcttggtgtgtgggcccaccccggagtatcctcatctacaaagcataaaatagggtccctccttgctgacacacggggtgtgttggggacttaatgacccttgtgaataagaaatactacgacaaaaaatgtatatttacatccctttcaatgact

SEQ ID NO: 266393 - DNA, 1063 bp, Homo sapiens
catcagccgcgaggctcgacccccagcccccttcttccatcacaaacaagtggttaggaagaagaagctggccccagcccttcccgctccgagccggcggcctcgtcttttgggtctgggggcgtggggaaggagaaggccgcgcgaccccagtcccatctccagaattcagcaccctgctctcggctcccgctagccccgggcctcgcggcgccctggtcatcgagatgtcctcggagggcgccgcccgcgccgcgagaaagatggcgcccgccgagcaactgcgccaccagccctggcgacaggccaggcccagcgccatcttagcgccttccaaccgcacccccccacccaatatcccgcatttggggcgactcgggggggcgcgaacagcataacgcccgcgcgcactcggccaaaaatgcgccgtcccagccgcacatctcttctggccggcgcggcgaacagcgcgggcctcgcaggagacgcccggctgggccgccggtcctccgcgcggctgggggctcggccggacgcggccgcggatcctcggcggtgcttcgaaaaggcagcgaggcggctgggaaggggcagtcccgcggcaggtgcgcgccgccgccgcgggctcggagcgggagcgggaacggggccggggcgactcgcctgccccgagctctccccgccgcaccccggacctgctctcctcgccgcggccgcccgcagatgcggcgggaatggggaagccaggatgaaaaataaaccccgtctccgccgcctccctccccaccctctcccctccccctccccagacgcggggtccattttgccgagaagaaagaaaatgtgattcacaccctagagcttccgagagagaaaagaaacgagggggggaaaacagaggggaggagattggaaaagcttatttttcttcctcgcccgccgtcactccaggccctccctgccccctgctcgcggccccgccgcgccgtcttcccctcgccgagccctgctccctccttcccggctcccggcggctccggggggcggaaaacacactcacact

SEQ ID NO: 266394 - DNA, 466 bp, Homo sapiens
caaagcctaagaagaaggttggaaagaggacgtttctcaccatcaaagtgcccacagtttcctcttaagtcaggcactatgcctgactaaacaagatggctggcaaacccactatgataaagatacagtattattggcatttaaggttcagctgaaaggtgtcagcatttttctggtagtggtactttgccttccaaactgtaacaactggatattgatcacaataagtattttacagctaattgaaagccagatgtgatacccatagtttattatctaaaaattacttgcactcctaaattcagtaaattaatcagaatgggaatattctgagctaaatgttaccatcaccctgaatctgagcaacaatattgtatgtcttattgtatgtcttataaggtagaaaaataaaaatctcaatacctactgtttaaataaaaatctcaatacctactgttaaaaaaaa

SEQ ID NO: 266395 - DNA, 427 bp, Homo sapiens
tttgcttctcaccagcccatggatttttaaaaactcaagttgaaccatattctgtatttttctatttttcaatgactttatttcttaaagaaatttaacaatctgatacatgttaatacatcttgatctaccttgttttttttttaaaactcatctacacaatattccagggtgttgatgtctcccttatttctctctcttctctctctctctctctctctctctctctctctctctgtctctctctcatcttccttttgccacccaggctggaatgtagtggtgtgatcacagctcactacagcctggattcagcacacaggaatcagagtcagaatcagaaaaaaaacaaggaggaagctgaggttccaagaggtcacccaggcagctgcgaccagaacggtcccccgcgtctctgggcgcccca

SEQ ID NO: 266396 - DNA, 220 bp, Homo sapiens
gcgctcttattcatttagtggaatcttttatgccagtcctggcaccaccactttgttgagtgatcctgggaagatgcttctctgcgcctgtttcctcatctgcaataaaaagattcttaccgttttgctaagaatcaagtgagcttatttgcataaattgcttagaatagttcctggccgagagtaggtgatcaataaatattagctattattactgctt

SEQ ID NO: 266397 - DNA, 527 bp, Homo sapiens
atgtaccacattatactacaggtattttagccaaattgcttttgatttttgaaatgtgcagattgcctttgttgcaggaactgttggcatgaggatgcatatttgaggcttgttaaggacgctcgttacacaggagagagtgatggaattgttctagctgcgcagggaagcacagaggcgaatgtgactatcagctcccggagcttccgtatcatttcttacgtacggcacaggacctgaggactcagggtcccctccacctgcttctgaaagaaaagtcttcatttggctgtagttgaataacctcccctcgccgagactcttctgtatggcgaggctcgaagccgtttccaattaacctttcccaagaatgcataggggcccagccaagtgggccatttgtgattcttttctttagctgcttttactgtgaccatctcagataagagaaatgaattggagcaattctacagtgagtcttaggatggattttctgttacgaataaaatttgctgtcaagctaaaaa

SEQ ID NO: 266398 - DNA, 685 bp, Homo sapiens
accagcctgaccaatatggtgaaaccccatctctactaaaaatacaaaaattagtcaggcgtggtggcgtgtgcctgtaatctcagctactcaggaggctgaggcaggaaaatcgctggaacccgggaggcaaagattgcagtgagccgagatcgtgccactgcactccatctcacaaaaaaacaaaaacaaaacaaaacctaacactactgcattggctgagacataccaaagggcgttagaactagtctcagtcaggagttaatccagagactcaaactttctcatcagtatttgtcttattcttggcgttttgtttggctacattttcacctactgaatgcagcagtgggaaacatggctgcaagctgctccagcctccttccagctctctgactccaaattctcaaggcaaaaggaccttcctatttggctttccctgaaaacaactccagatgctggcaggcccagcctggatatttactcttccctagactaatcactttgactaaagaggcaactttacttgtaaaaacctttgtggcttttggccaggcatggtgactcacgcctgtaattccagcactctgggaggccgaggtgggtgaattggcagctcaaccaaaacctcaaagaatgagggagaggagtggctgggcgaaggggtgtctgctctaagaagggg

SEQ ID NO: 266399 - DNA, 215 bp, Homo sapiens
agcagacttaccactggtctggccctttgaacatgcttaaagctgctgttattgcctgggcccttggagggaggtctttctctggatggtattatataagagactctggtcttgaaagccactccctaattttctttgggccttcatttcctcacctgtgaagtgaaggggtcaggagagacccccttctatctctgaaatgatataaagggagg

SEQ ID NO: 266400 - DNA, 874 bp, Homo sapiens
tcttcttggtccaaactggcctctgccaggaagaaaggagctacttccttatcataattgtggtggcccttcttctggcaattaaaggatatggagaggggtgtgtatatttctactcagcaactaagcatgagcaaccactcaagagcaaatgggggataaatccatcatctgtactttgtattacacaccagttttcccaacctccctgccaaccacccccccccccgcccccccgcaatagaaatctacactggggctgggcgcagtgactcacgcttataatgctagcactttgggaggctcaggcgggtggatcacttgatcaggagttcgagactggcctggccaacatggtgaaaccctgtctctactaaaaatccaaaaattagccaggcatgctggcgtgtgcctgtaatcccagctacccaggaggctgaggcaggagaatcgctgggacctaggagtcggaggctgcagtgagccgagattgcgccattgcactccagcttgggtgacagagcgagactccgcctcaaaaaaaaagaagaaaaaagataaaaaaagaaatccacactggttttccagtttcctgtgacctcaagaaatttctatcctccaaagagggatgtgccccttccacaggtattgaccctggggctttcttgaagagtgccctcgttgggtctgccagttaacagaagccctgtgccacccgagttagctcagttctctcctgtgacgggtaaagggagccgagactagaggacttgctggggctcacaggccattatgaatgtgccttttgggtgaggggagtgaaaagggcccttagggaaacaagaagcaaagggtcagtgatgtggcctcaggg

SEQ ID NO: 266401 - DNA, 636 bp, Homo sapiens
ctattaatatgtctgttgacatctgtatagcccctctataggaacatctattcaagtctctcagctgtttttaaattgcactgtctgctttttgaaaattaatttgtggcctttctttttatttaacctcatgattactgaatatgattctgttttggagtaactccctgtggctaaattaatgcttttgtacccagaagttcatgaacagtgtaaaagtttactgattttgtcaaggagacgaaatgtacatcagcagtacaataagttaatgacctagttctgcataacgagaagggtcgctcactgaattgttcattaaatgaaactctagctcattctcctctaccttctctctcaccattcaagtttgcagaatggttcctcccattggccatgggtcctatgaagatgtgagatcattttttattctctactactctggtgcactgtcactgtgatgatggatatgttctaattggagaggctgaagtcacctgcagaaattcacattggtcagctccagcccctcaatgtaaaggttaactccaaacttactgagggcccttgctaagaaggtagagcctctatgaaaggtcaaacaagagtctcctcctagacaaaggcagcacttag

SEQ ID NO: 266402 - DNA, 410 bp, Homo sapiens
acctcttaaatttatggctcagaataggatctgtcttgggaaacttctgtgcatgcttgagaagatggcttgttctgctctggttgggtggagtgtttgataaatgttaatgagatcaagttggttggttgtgttgttcaggtgtattatatccttgttgattgtgtgcctacttgtatcaattgttggggagaggggattgaaatctgctgcatttgtggttctctttctctttgcaattttaccactttttgctttatgtattatattagatacataaatgttcaaggttattacatcctgttgattaattaaccactttatttatgtagcattcttttgagtaatgcatgcatggtatatcttattccatccttttacttataacgtatttgcatctttatatctaa

SEQ ID NO: 266403 - DNA, 1145 bp, Homo sapiens
caggaaggtgaagaagacatgaggctaggtgtagccttgggtgaggggagggcatccctggtcctttgaaggttctccccaccccagcacacgccacccctctgttctctcttcagctccacctgccactgatcctgcaacttgcttctttctattctctgcctctgtttagaaatcttcacgcaccactgaggcttcttgacttgccccttgtgacttgaaaccccagctcagatacaaattttcacctgccagccctgcctcctcctttctcccttttcctagacacaggactctgacaacttcatcctccttgtttagatgacttcccagtttccagtccccatttctccttctatcacttttcataaaaaaactcaggaaatatttgacatatcttccatttcaaattcttccattttatgcagatatcttgcccttcctataagctctcctcaaagctcaggaaacctggtctgctctcctgcatttagggaaggagaacccctgccaagacctttgctcactgcctgagaccccttccttagagagcacctcctttgctggtcagacatggagcctgcagttggtcacagatgatactgctttatttcagtttttacagttgtcttcttaagattcccgtcttataaatggagtacagggaacctcaagtagtgaagtggaaatccatgtgtaaggctttgtggcttcaggtaccagtggctaaggtagttttaaagactttgttgattttagaaaaagtccatcttccatcccctacatggcagttaatacccttctatatggtaaaaccttagagattaccttaatctgctaggaacagaagcaagaaaaaccatggcgtaaacacccccagagtttttgttcatttgtttcatctttcttgataaagcccgaaggtagcccattcagggctgttgtggttggttgctccatcatgtcatcaatagcccatatcttttcttttttatcttccttagtgtaacaccaaactacctctctgatagctggtgttcatgaaatattttaccttcaaatgattgtacctttttatttgctttagagttctgaaataaaatgaaattccactgtaataaaactgtcaaatgcatggtgtctga

SEQ ID NO: 266404 - DNA, 846 bp, Homo sapiens
tcactcctttatttcccaagctctgttctgcgtagacaatgaaacctcactgagattcttgctggtatggagtgggtggagggattgatgcctaactataatcagggccgacttcctagcagcaacaatacaccagatgacctggaaataggggagggttgtagagtgaagggtgtgttgcagatgggactaggggactagcataaagggactaatgaactggtttgcctgggctgggtggagggcaaggattgccacctattggctgctgaggtaggtaggtctgcattaagcaggatgctcaagagacctggcccaatgcaagatactatctttaaaactatgtcaacatttgcatcttatcagaagatacatgacatttatgtagttacatggtgcttgatttttgagattcattttattcattcttgagagtccatcagcctcaaaatccctaagcgccccaagaccaattcagtgggccataaatgtaaacagaatagtttaagtctggggttaagaccccgggaaggctgggttggggggactgtggaggcaattacagatttttacagatttttgttgatttctatccccttgattataaaagttatgggtatgtattataatttctaaaatgcaaataaatataaagaaaataaatataacccataattccatcactacagataatcattggtaaacttgttggtgtgtttcttttctacccatgtatatcacataagtaggaccatactgtgtatagtgttttgcatccattcttttacctaactttatattgtaaacatttccacatcattaaacatttctccaagaaaacaattt

SEQ ID NO: 266405 - DNA, 263 bp, Homo sapiens
cagtgttgacaagagtttcaaaatctccagagacaccaaagaaatgtgactcaattggaaaaaatggagtttttgacacaatgttagagaaagtagggtatgtagttctcaaaggaaatctgaccaaaccttcctgttttttacaaatgtgatctgcttcctatgtccagggtggacaacactatgatccttagctagagctttcttctcttattctttcaacatgtattcacggggtacacactatgtgccaggctcggtgc

SEQ ID NO: 266406 - DNA, 544 bp, Homo sapiens
cacgaaccccctccagcatgaccctataaagcttccttccagcccctgcctttttggagacagtcccttttctgctgtgctgcccgttgcttccttgcaacatactttccttctaataaatctgcttttttttttttaaaacctatgactgccttggcaaattcctttagcactcatgatccccgctctagtcatcacacctgcaacaggccctgcatcaaaacaggtgactgagctgttccaagtacatcaagcccatccttcagtgccttcaatgcctcctatgactcagattgtgtgtggatccagccatgtgcaagaccctcagcccctgctcgggaagaccttttgactgagcaggcattttctcagctttcttatggtcttaatgtatattatcatgtgtaaattaacataattatgcacatctgtatctcctttagtgaaattcaatggaataaaataaaataagtttgctaaagaaaagcagcacatatttgcattacatttaaacttctgcataattgagaatatatctatgttg

SEQ ID NO: 266407 - DNA, 921 bp, Homo sapiens
  misc_feature (811)..(811): n is a, c, g, or t
ggcttcagttactagctaggctactgagtttagttctcagtttggcaccttgatacctttaggtgtgagtgttcccatttccaggtgaggaactgaggtgcaaagagaagccctgatcccataaaaggacaggaatgctgagttccgccagaccatgcatctcttgctagtaggtgaggcgagtctctaactgattgcagcgtcttctattttccaggtcaagtacttgctgctgtcgatattggggcttgcctttctgagtgaggcggcagctcggaaaatccccaaagtaggacatacttttttccaaaagcctgagagttgcccgcctgtgccaggaggtagtatgaagcttgacattggcatcatcaatgaaaaccagcgcgtttccatgtcacgtaacatcgagagccgctccacctccccctggaattacactgtcacttgggaccccaaccggtacccctcggaagttgtacaggcccagtgtaggaacttgggctgcatcaatgctcaaggaaaggaagacatctccatgaattccgttcccatccagcaagagaccctggtcgtccggaggaagcaccaaggctgctctgtttctttccagttggagaaggtgctggtgactgttggctgcacctgcgtcacccctgtcatccaccatgtgcagtaagaggtgcatatccactcagctgaagaagctgtagaaatgccactccttacccagtgctctgcaacaagtcctgtctgacccccaattccctccacttcacaggactcttaataagacctgcacggatggaaacanaaaatattcacaatgtatgtgtgtatgtactacactttatatttgatatctaaaatgttaggagaaaaattaatatattcagtgctaatataataaagtattaataattt

SEQ ID NO: 266408 - DNA, 737 bp, Homo sapiens
  misc_feature (627)..(627): n is a, c, g, or t
atgacagtgaagaccctgcatggcccagccatggtcaagtacttgctgctgtcgatattggggcttgcctttctgagtgaggcggcagctcggaaaatccccaaagtaggacatacttttttccaaaagcctgagagttgcccgcctgtgccaggaggtagtatgaagcttgacattggcatcatcaatgaaaaccagcgcgtttccatgtcacgtaacatcgagagccgctccacctccccctggaattacactgtcacttgggaccccaaccggtacccctcggaagttgtacaggcccagtgtaggaacttgggctgcatcaatgctcaaggaaaggaagacatctccatgaattccgttcccatccagcaagagaccctggtcgtccggaggaagcaccaaggctgctctgtttctttccagttggagaaggtgctggtgactgttggctgcacctgcgtcacccctgtcatccaccatgtgcagtaagaggtgcatatccactcagctgaagaagctgtagaaatgccactccttacccagtgctctgcaacaagtcctgtctgacccccaattccctccacttcacaggactcttaataagacctgcacggatggaaacanaaaatattcacaatgtatgtgtgtatgtactacactttatatttgatatctaaaatgttaggagaaaaattaatatattcagtgctaatataataaagtattaataattt

SEQ ID NO: 266409 - DNA, 405 bp, Homo sapiens
cttacttctacttcctgcctttcctctgacaggaggattcttctacagccagatgattccttacagatcttggcaccagtggaagcagatgtgggtttctacacttgcaatgccaccaatgccttgggatacgactctgtctccattgccgtcacattagcaggattatgttgtcatactgtactccagtcacacatgctacccccttgcatatctgtttagcaacagtattcctgcccccatgacttcaggctgatctgggaagggacccttagcaggcggctttgcggggaagatcaaagtcaacaatgaagaaggcaatttaaggagccctgggccggattaaagactgatattattaatgcctattttttgtgaataaaacatttgcttttcttctaaaaa

SEQ ID NO: 266410 - DNA, 419 bp, Homo sapiens
gcaagatctcagcggcccagcagctctcagcctcggaggtggtcacccacctggggcagacggtggccctggccagcgggacactgagtgttcttctgcactgtgaggccatcggccacccaaggcctaccatcagctgggccaggaatggagaagaagttcagttcagtgacaggattcttctacagccagatgattccttacagatcttggcaccagtggaagcagatgtgggtttctacacttgcaatgccaccaatgccttgggatacgactctgtctccattgccgtcacattagcaggaaagccactagtgaaaacgtcacgaatgacagtgatcaacacggagaagcctgcagtcacagtcgatataggaagcaccatcaaaacagtgcagggagtgaatgtgacaatcaac

SEQ ID NO: 266411 - DNA, 565 bp, Homo sapiens
tgaactcctgaactcaagtgatccacccaccttggccttccaaagtgctgggtttacaggcatgagccaccaccccagtctggttgacgtttttcacctccttctctttacagcatattcagaaattttaaaccagtaatacgaaatacatatattggttgatttttctgttgtattttaagcatattgactttttaaatcggatcatatttttgcatgcaagtactatggcttttcaaggtcattctgatttgaaacaacacatttcttagtcaattcattggctctttacccccttttaaaattttttattttttatgagatttatttatttacttatttttagtgatggagtctcactgtgttgctcaggctgggctcaagcagttcttctgcctcagcctcctgtgtagctggaactacctaaggatgtgcaccactgtgcccagccagatcttcaccttttccaaaaaaagaaacatctctttccgcggatatcatccaaagaactacaagtactttgggttcatcaccaagcacctcgccgaccacgtgtgccgacatg

SEQ ID NO: 266412 - DNA, 407 bp, Homo sapiens
gttacctgagaagaaacccgtgttttcatgttcatctctttaacatggggcaggtccttaggtacaaaacagatctgaacttcttgctttctgttactcttaatttaactggctaaatcagtaatatgactttgcttttagacagttatactagacagatattttattgagtactctttgaatttagaaaaacaagggtactaaaatatgcccagtgatgtaggaactatgtgcagttggaaggactctttgccaaaactctaaggaatcttgtggattccttacaatgtgtttcataattgctacctgggttacatttgtactaaaatcctttcttcataggaatgatcttagagttaaataattttctattagtcttttaactacctcctctctataaattttta

SEQ ID NO: 266413 - DNA, 554 bp, Homo sapiens
  misc_feature (493)..(493): n is a, c, g, or t
  misc_feature (497)..(497): n is a, c, g, or t
  misc_feature (513)..(513): n is a, c, g, or t
tccaggacccctaagtttctaggccagagctgacggctggtgggtgcagtcagccaggctccagggaaggctgctccaggcagggctgagtcttcacggttcagcttttagaactggccaggttggaattctggctgggggcagacagggagggcaaaccacaaacacttctgcctgatctggctggggaatccacagagaccaccagctgggactggggtgagcctctcagagcccctagcaccagcccaaggctgcatgggctgactgtgtgggcggatgctgcctaagtcatgtgcagagccgtcctgagctgaggcagaactataagacatgaactctgttttcaagacaggtgacaatgacaaacagcaataaaagccacacaccatagctcaggataacaagggctgagatgcgtttggacaatgagaagaaaataaaaattaaaaaaaacagctgattcaccaaatgaagggcacagtcccagctnctanacctgattatccagcnaattccacacctggcggcttactaattgatccaaccgtaca

SEQ ID NO: 266414 - DNA, 402 bp, Homo sapiens
ataccttaaggttagagttatttagcccaattacttggcttgaaataaacaagattgtattgccattttcagatggggaagctgaggaccaaagaggttatgagatgtacctgaagattgtgaattctggccgggtgcagtggctcacgcctgtaatcccagcactttgggaggccgaggcaggatcacctgaggtcaggagttggagaccagcttggccaacatggtgaaacctatctctactaaaaatataaaaattagccatggtggcacgcgcctgtaatcccagttactcgggaggccgaggcaggagaattccttgagcctgggaggcggaggttgcagtgaactgagatcgcaccactgcattctagcctggtaacagagcgagactccatctca

SEQ ID NO: 266415 - DNA, 191 bp, Homo sapiens
  misc_feature (181)..(181): n is a, c, g, or t
  misc_feature (188)..(188): n is a, c, g, or t
ataccttaaggttagagttatttagcccaattacttggcttgaaataaacaagattgtattgccattttcagatggggaagctgaggaccaaagaggttatgagatgtacctgaagattgtgaattctggccgggattataggcatgagccaccatgcctgtccattatttctttatagtngacctanttt

SEQ ID NO: 266416 - DNA, 170 bp, Homo sapiens
tggtattgtactgagtcattgcaatatacaaaagattggcacctggtaaatccatgttgagttcaatttttctgctattaaataaaaaatgttcttcaaatgccctaataatcctttaaaagcatgagctcatcaatagttttttaaaaaggaaaaaaaaaaaaaaactg

SEQ ID NO: 266417 - DNA, 443 bp, Homo sapiens
accccagagggaatttcttatgaaatgtggccacctggagagagacaccaagttcagatgctgttgctgctgcttcttggctgtgttatcctgaacaagggcttaacctctctgagtctgaatatccctctctgaatacaaagtggagataatgatatttaaggaagaaacaactggaggttgagtggcccagagcagccatttttaaatttgtgggtggaaaattcctcctgttcttgggcctgaagtctaagtcccctctggactttcctcacacagttcccattttggaggacacaaatatcctaggccttcatgtgcaggagaggcagggaggaagccaagaaaaggggtaaaaagaagaagaaccatctcccccattttcctctaagctttaaattcttttctttctcattccaacttaaatacatgcaggaagatta

SEQ ID NO: 266418 - DNA, 870 bp, Homo sapiens
cacagcgggtgagtggcacgggataaggctgaggcagacagaggccagattacagagtgccttgccagccagagcttaagctctgggtttatttttcttttaacgagatgccactgacaggttttagcaaggaatagtatggtctaatttctttttcttatttttttaagagacagggtctcactctgtcgcccaggttgtgagctcaagtaagtctcccacctcagcctcccacatagttgggactacaggtatgcaccaccaatcccagataatttttttttttaatttttgtagagatggagtctatgttgcccaggctggtctcaaactcctgagctcaggtgatcttccagcctatgcctctcaaagtgctgggattacaggcatgagccactgtgcctgacctaattcatttctttaaaagatcactctggctgctgtgtgaagaagatattttgggaaagcctgagtgaaatgagggagaccactggagaggccagtgtagcaattcaaacaaggggtgttagaggcttgaactagaacagtgaacttgttgatgggctagatgatgaaggataaaagaatacaactctggaatcattcttaagtttctatttgagcaagcataagacaactttgctatttactgagaagtggaccaactaggaaggaacagattgggaagaagacaaataaaaactgacagttctgttctgacctagccactcagagacatcctgagtgaggatgtcaactaggcagctggtgatctgaggctgccactcagaggaaggggcttgccatggagctataaacatgcaagttggtataaagatggtatccaaagtcaaaggataagatagaata

SEQ ID NO: 266419 - DNA, 467 bp, Homo sapiens
catggggcctatggtgatggatgtcatgaggcccaggaaggagccatcatggtgggaagagttgagagcctgcatgtaagactcagactcgaaccaaacctaagtgcaaataacaaggaaaaaaagcaactccgcgcacctggctggtaccctgcttggaaacaaaccgtacctccccaccctcccatctcaaagctagtagagcctaggggcacaccattcctttggcttccctttagcttgacctgggaatggcgcagttaagcatatcaggaagctgagatgcatccactactcctcacttcccctggcgctgggctcagcttggctgaacttgccgttcctgtctttttagaagagctggttgtgttcccgaagcaggatcgcactgtgccgcctccccaggggtccccagctattgatttttaatatccgtattcaatattgtgtattaaacattgaatcca

SEQ ID NO: 266420 - DNA, 411 bp, Homo sapiens
tttttcccacctcttaaatccaggaactcaaaggagtaaagtgcggctggctggtgacattggacgtggaggaaggtgacaaactgtatataaactgtgtaggaacctcatctggggccagttgccccactcagatctagccagtggttgccatgctggaaacccagccccgaggggtggattttctgctgaccggagggaaagcctcacacgtttccttcaccatgtgttccttgctcaccatgttcatccagcgtttgtgtcatctgtttaaatatgctgtctggggccgggtgcggtggctcatgcctgtaatccagcactttgggaggctgaggcgggtagatcacctgaggtcaggagttcaagaccagcctgaccaacatggtaaaccccgtctctactaaaaat

SEQ ID NO: 266421 - DNA, 1726 bp, Homo sapiens
tttagaatgaatagcccttctgggttttctttttgacaattcttggacttgaggtaaaacaaggaggattgtggccggatttcagatcccaaagccagcctccatcttaggcctttgcctcattgtgccttttaggttttcttacccaccgtctcctgttttgtcttttttttcttttctcctacccctatcttgggacattcagaaactgcctgggtggtttgagaagagacaacccagtttgatctgcaatacaaggatccattcgtaatctctctctcactgatgttattcccccatctgccgtcttggttcatctcaccacagaagggcatttagtcctacccagccatcggctgcgtatgacagcaggatggcacttcccatttctctgtggttagtgctcgagtgaaaacctctttcagctgagtcctctgaggttctgctgttgagtcctgggtggctgatggaatgattgaggaggtctggtcaccctcaagcgccgtcatcgccttgtttccatgggcttctgtcacacaaaatgaagaacagaaatgttaggacttaagagaatgtttggaattcacacctctttgcagtcctttcaaggctgctgctctgtgctgtgtcccatgcatgtgaaagtagagctgtgatggctgctgggacgcttgcaaagatcatgtgtgagaattgagcacaagaccacaaattattactgcttgatgcgcttgttaaaactctatctgccaggaaaccaaattttcttttcttttctttttttttttgagacagggcctcgctctgttgcccaggctggagtgcagtggcgcgatctcggctcactgcagcctccacctactgggctcaagtgatcctcccacctcggcctcccgagtagccgggaccacaggcgtgtatgactggctacgcctggctaatttttgtatttttaatagagacgagtttcaccatgttgcccaggatggtctggaactcctgggctcaagtggtctgcccacttccgcctcccaaagtgttgggattatggccattagccactgtgcctggcacaatttttttttgtaccctcctttatgccaagaatcagtcctaatttctttactatgtgaagtaacttttaaaggtaatagaaaaggccaggcacagtgagctcatgcctgtaatcccaggcgccgtggctcacgcctgtaatcccagcactttgagaggctgaggcgggtggatcacttaaggtcaggagttagagaccagcctgaccaacatggtgaaacactgtctctactaaaaatacaaaattagctgggtttggtggcgcacgcctgtaatcccagctacctgagaggttgaggcaggagaatcgcttgaacctgggaggcagaggttgcagtgagccgagatggtgccattgcactccgacctgggcaacagagcgaaacactgtctcaaaaaaaaaaaaaaaaagtaacagaaaaaagagtgaaatatattagctatcttttattctgagccaaaacttgacagatgtgggaaatcttcatatagtgtatgaaaatttcattgtacagggaaattattttcctctgtgtcttttcttttactataaagtgattcagaattttactgttactataaaattatgcaaagtattgtgacaaaactgcatcaatttgttgactattaaagtgctccttgaacattatat

SEQ ID NO: 266422 - DNA, 1068 bp, Homo sapiens
tttagaatgaatagcccttctgggttttctttttgacaattcttggacttgaggtaaaacaaggaggattgtggccggatttcagatcccaaagccagcctccatcttaggcctttgcctcattgtgccttttaggttttcttacccaccgtctcctgttttgtcttttttttcttttctcctacccctatcttgggacattcagaaactgcctgggtggtttgagaagagacaacccagtttgatctgcaatacaaggatccattcgtaatctctctctcactgatgttattcccccatctgccgtcttggttcatctcaccacagaagggcatttagtcctacccagccatcggctgcgtatgacagcaggatggcacttcccatttctctgtggttagtgctcgagtgaaaacctctttcagctgagtcctctgaggttctgctgttgagtcctgggtggctgatggaatgattgaggaggtctggtcaccctcaagcgccgtcatcgccttgtttccatgggcttctgtcacacaaaatgaagaacagaaatgttaggacttaagagaatgtttggaattcacacctctttgcagtcctttcaaggctgctgctctgtgctgtgtcccatgcatgtgaaagtagagctgtgatggctgctgggacgcttgcaaagatcatgtgtgagaattgagcacaagaccacaaattattactgcttgatgcgcttgttaaaactctatctgccaggaaaccaaattttcttttcttttcttttttttttgcaacagagcgaaacactgtctcaaaaaaaaaaaaaaaaagtaacagaaaaaagagtgaaatatattagctatcttttattctgagccaaaacttgacagatgtgggaaatcttcatatagtgtatgaaaatttcattgtacagggaaattattttcctctgtgtcttttcttttactataaagtgattcagaattttactgttactataaaattatgcaaagtattgtgacaaaactgcatcaatttgttgactattaaagtgctccttgaacattatat

SEQ ID NO: 266423 - DNA, 1016 bp, Homo sapiens
tttagaatgaatagcccttctgggttttctttttgacaattcttggacttgaggtaaaacaaggaggattgtggccggatttcagatcccaaagccagcctccatcttaggcctttgcctcattgtgccttttaggttttcttacccaccgtctcctgttttgtcttttttttcttttctcctacccctatcttgggacattcagaaactgcctgggtggtttgagaagagacaacccagtttgatctgcaatacaaggatccattcgtaatctctctctcactgatgttattcccccatctgccgtcttggttcatctcaccacagaagggcatttagtcctacccagccatcggctgcgtatgacagcaggatggcacttcccatttctctgtggttagtgctcgagtgaaaacctctttcagctgagtcctctgaggttctgctgttgagtcctgggtggctgatggaatgattgaggaggtctggtcaccctcaagcgccgtcatcgccttgtttccatgggcttctgtcacacaaaatgaagaacagaaatgttaggacttaagagaatgtttggaattcacacctctttgcagtcctttcaaggctgctgctctgtgctgtgtcccatgcatgtgaaagtagagctgtgatggctgctgggacgcttgcaaagatcatgtgtgagaattgagcacaagaccacaaattattactgcttgatgcgcttgttaaaactctatctgccaggaaacaaaaaaaaaaaaaaaaagtaacagaaaaaagagtgaaatatattagctatcttttattctgagccaaaacttgacagatgtgggaaatcttcatatagtgtatgaaaatttcattgtacagggaaattattttcctctgtgtcttttcttttactataaagtgattcagaattttactgttactataaaattatgcaaagtattgtgacaaaactgcatcaatttgttgactattaaagtgctccttgaacattatat

SEQ ID NO: 266424 - DNA, 604 bp, Homo sapiens
gctttctggaaaatgtcttccttttggatatggaaagctcacacaatgcctgctttttatttcagagactcataggcaaaagagactgtagccttgacccagatgagactttggactttgtaactttgagttaatgctgaaatgagttaagactttgggagactgctggcaaggcatgtttgtattttgcaatgtgaggacatgagattcatcgggtcaaggacagaataatacggtttttgtctatgtccctaccaaaactcatgtggaattatattttgtaatgttacaggcaaggtctaggtggaaaaagatttagtcataaaatggtgcaggtagatacttcacgaatgataaagaaccatcaccttgatgctatcctcctgataatgagtgagttcccacgagatctggttgtttaacagatctcatcctcctgctcctgctttaggagacatctcattgtcccttggctttctgatataatgaggaggcttcctgattcctcccagaaacagaagacactatacttccttcacagcttgcagaaccatgagtcaattacacctcttttatttacaataatacagaaaattagaactgc

SEQ ID NO: 266425 - DNA, 287 bp, Homo sapiens
ggcctggtaagtactcaagccaccaacaaatactggtcattattattcgtggggagaaaaataaaatccattagcaggtgctgtgggctactcagtttccatcttaccctagactgaaagccaaggcaggtcatagaccatgagaccctgctggacttgctttctgtacctgcttatgggaagctgaggacacggccctggtatctagaataggcttcccacatatatccatcatgttgggccttcatttttcagtttcagtgtggcctttcctgcccaggaactta

SEQ ID NO: 266426 - DNA, 446 bp, Homo sapiens
aatactcttaaatgaaaacatctcacttgccctacaaatgcattttgacagtcttggaaaaagactccctctgcaagacggagttggcatagcctagggaacaactgggcattgtctgatcaatgccccctagcacaccctcctctaccccacgtagatagttctactgaaagcccctctaaaatagaaattttgcaatagctgcttggaagttcaccaaccctgatgctacttccttgtaaaaatccaacataattcattggaatatcagaaaatggagaaattaaatgagtggtacattttattcagtaaatcctcataggatgaggatggtattttctcttttcttttttttttttttaaatgattcccctttgaattgcagcaaagaattttatgacatgcattcaaataaactggttttaagaagttcaaggtattagttg

SEQ ID NO: 266427 - DNA, 647 bp, Homo sapiens
  misc_feature (538)..(538): n is a, c, g, or t
  misc_feature (568)..(569): n is a, c, g, or t
  misc_feature (647)..(647): n is a, c, g, or t
gtagagatgaaaatgatgaatattttatgaataagggagaaatgctatgttcaatagctaattgtagattagtaataaaggaataaatactggaatgtcaattaagaggttatattctgatttctaataaccatccaaaaataccatacaaatattttccatgtttttaattccccatctgtaaattcatgaaagtgatcatggaaaaaagcatcagaacacaacggggcacaaagtcctttcttgtttaccatctggccctagaaacctggtctatgcactccaccttctaagcttcctttcctttagtctatttaattcaacaactatttattgaggaaatatatgggctacattgacagataacacaaaccacttgctatcaggaaatctattgtcaatattgctgtgatgaatttacaggtccatgtgtctttttggaagaatggaatgaataaataaaatgtagtcatatacaccatgaaatatgacacagtcataattatcctgcactaaagcagcttgactatctctacanacctacaagacattggaacactatacctanntattcgcgcatgagctgggagtctaggcacagctcttaagccttcttaatcgagccgagctgggccaaggcggccccn

SEQ ID NO: 266428 - DNA, 381 bp, Homo sapiens
cctctttcccttccagtccactgcccccatggctgccagattgaccttcctgaagaactgctctgatgacttcacttttctgccagaaaacttccactggcccccaactggttcatgtacctactggggccagcaggtatcacaaatgaaggaagtggctacactaagtgaaacaggcacccttgggatctgaaagccaggaaacgtgtaacttctataaggaaatgtgcttcttcccatttatcttgaaaacgaagaccttctggatctacaattggtttcctgcctttagtcaaggcttggtacaagaagtaactcactttcctctttactatgtaacaaccaaacgattgtattaattagcatgttggtttgatcgct

SEQ ID NO: 266429 - DNA, 586 bp, Homo sapiens
aaagaagcacctctggcatttagtagatgatcaggaaatgttaattacctttaccagcttgaaagcaaatagttgcttaatattagaaaataataacgaaagcaattattttcattctttctataagctaaagttatataactccaaaaaaatattcaaccactatcattgtcagttttaaaatggcgcatctccatttggtctttctgtcccaatctgcatgctctgccaatatgtaagcctctgttaaccatcttgaatgtttcatagtgactagaaagggtttgggccagagctgggtctgctgtttggcacacccttctacactgtgcagtaagctggggaataagccagcacatatgctgatcagctacggtatggcaagggctaaactaggagctttcacatttccaatctcactgaatctttgtaacaacagcagaggcaatgttaacccccatttatagttgaagacaataaggttctgagaggttaagcaacttgctcattatcacacagatcatatttcaaaacctagataattttctaaattagtcttttgttcacagaaacagggtatgtttaa

SEQ ID NO: 266430 - DNA, 456 bp, Homo sapiens
caagtctctcttcggtgccaccggcgggcgaggccggattaatcaccgctgcttcggccgcccatgtgtcctgatgtcctgggacccgaaccccgtgccccgtaccttgcgatgctggcgcctacggagggcatccgaaactgccctacagagcagtcgccgggcagttgaagatcagctaaagatatgtggccacaggagggatgctgatgtctttgagctgttcctttctaaaaaaaataagagatccaactactccaggccacatcaatcaaatggaccaactatcctcagacagtgccctctcccaaacccacatctgcccctttgatgagtgagctgccttagcaacaagaaccaagaccacttggataggtggaatctcacacagttcaagagaagtgggtaatattttaatcctataattaataaataaagggagaataaagcacttca

SEQ ID NO: 266431 - DNA, 821 bp, Homo sapiens
cttagggttctcagaagcacatgtagagcactctctctgttctccaccatgtgaggatccaacaagaaggtggccatctgcaacccacaagaggaccctcacaagaacccaatcacgttggcaccctcatctcggacttccagcttccaaaacggcagttgaagatcagctaaagatatgtggccacaggagggatgctgatgtctttgagctgttcctttctaaaaaggaactgacagaggtcattgatctttctaggtttaaaaaattaaaatacttatggcttcatcataacaagtcttggggagttctttatagcagtgtgaaaatggacgaatacagagaattggcactggcagagtgggatactgctacaaagataacctgaatatgtggaagtaactttggaactgagtaacaggcagaggttggtggaacagtttggagggctcagaagaagacaggaagacatgggaaagtttggaacttcctagagacttgttgaatggttttgaccacaatactgatagtgatatggacaatgaggtccaggctgaggtgatctcagatggagatgaggaacttattggaaactggagtaaaggtcactcatgctatgctttagcaaagaaactggtggcattgtgcccctgccctagagacctgtggaactttgaacttaagaaaattatttagggtatctggtggaagacatttctaagcagcaaagtgttcaagacataacctggctgattccgaaagcattcagtcatatgcattcacaaagagattatctgaaactgaaacttttatttaaaagg

SEQ ID NO: 266432 - DNA, 1077 bp, Homo sapiens
cttagggttctcagaagcacatgtagagcactctctctgttctccaccatgtgaggatccaacaagaaggtggccatctgcaacccacaagaggaccctcacaagaacccaatcacgttggcaccctcatctcggacttccagcttccaaaacggcagttgaagatcagctaaagatatgtggccacaggagggatgctgatgtctttgagctgttcctttctaaaaaggaactgacagaggtcattgatctttctaggtttaaaaaattaaaatacttatggcttcatcataacaaggacggacatgatgggagatgactggatcatggggatggttccctccatgttgttctcatgatagtgagtgagttcccacaatatctgatggtttttaaagtggcacttcctccattgctccctttcttacctgccaccatgtaagatgtgccttgcttccccttcaccttctgtcatgactgtaagtttcctgaggcctccccagccatgtggaatggtgagtcaattaaacctgtcttctttataaattacccagtcttggggagttctttatagcagtgtgaaaatggacgaatacagagaattggcactggcagagtgggatactgctacaaagataacctgaatatgtggaagtaactttggaactgagtaacaggcagaggttggtggaacagtttggagggctcagaagaagacaggaagacatgggaaagtttggaacttcctagagacttgttgaatggttttgaccacaatactgatagtgatatggacaatgaggtccaggctgaggtgatctcagatggagatgaggaacttattggaaactggagtaaaggtcactcatgctatgctttagcaaagaaactggtggcattgtgcccctgccctagagacctgtggaactttgaacttaagaaaattatttagggtatctggtggaagacatttctaagcagcaaagtgttcaagacataacctggctgattccgaaagcattcagtcatatgcattcacaaagagattatctgaaactgaaacttttatttaaaagg

SEQ ID NO: 266433 - DNA, 1237 bp, Homo sapiens
caagtctctcttcggtgccaccggcgggcgaggccggattaatcaccgctgcttcggccgcccatgtgtcctgatgtcctgggacccgaaccccgtgccccgtaccttgcgatgctggcgcctacggagggcatccgaaactgccctacagagcagtcgccgggcagttgaagatcagctaaagatatgtggccacaggagggatgctgatgtctttgagctgttcctttctaaaaagactgggtaggactccaattattttaccacttcctggaatccacagttttctattggagagacaagatactgaaattgattaaaaaaaaaaaaattatggagacaggctgtttgaatcccagctctgtctcttccagctgggtgatcttggggaactgacagaggtcattgatctttctaggtttaaaaaattaaaatacttatggcttcatcataacaaggacggacatgatgggagatgactggatcatggggatggttccctccatgttgttctcatgatagtgagtgagttcccacaatatctgatggtttttaaagtggcacttcctccattgctccctttcttacctgccaccatgtaagatgtgccttgcttccccttcaccttctgtcatgactgtaagtttcctgaggcctccccagccatgtggaatggtgagtcaattaaacctgtcttctttataaattacccagtcttggggagttctttatagcagtgtgaaaatggacgaatacagagaattggcactggcagagtgggatactgctacaaagataacctgaatatgtggaagtaactttggaactgagtaacaggcagaggttggtggaacagtttggagggctcagaagaagacaggaagacatgggaaagtttggaacttcctagagacttgttgaatggttttgaccacaatactgatagtgatatggacaatgaggtccaggctgaggtgatctcagatggagatgaggaacttattggaaactggagtaaaggtcactcatgctatgctttagcaaagaaactggtggcattgtgcccctgccctagagacctgtggaactttgaacttaagaaaattatttagggtatctggtggaagacatttctaagcagcaaagtgttcaagacataacctggctgattccgaaagcattcagtcatatgcattcacaaagagattatctgaaactgaaacttttatttaaaagg

SEQ ID NO: 266434 - DNA, 1086 bp, Homo sapiens
caagtctctcttcggtgccaccggcgggcgaggccggattaatcaccgctgcttcggccgcccatgtgtcctgatgtcctgggacccgaaccccgtgccccgtaccttgcgatgctggcgcctacggagggcatccgaaactgccctacagagcagtcgccgggcagttgaagatcagctaaagatatgtggccacaggagggatgctgatgtctttgagctgttcctttctaaaaaggaactgacagaggtcattgatctttctaggtttaaaaaattaaaatacttatggcttcatcataacaaggacggacatgatgggagatgactggatcatggggatggttccctccatgttgttctcatgatagtgagtgagttcccacaatatctgatggtttttaaagtggcacttcctccattgctccctttcttacctgccaccatgtaagatgtgccttgcttccccttcaccttctgtcatgactgtaagtttcctgaggcctccccagccatgtggaatggtgagtcaattaaacctgtcttctttataaattacccagtcttggggagttctttatagcagtgtgaaaatggacgaatacagagaattggcactggcagagtgggatactgctacaaagataacctgaatatgtggaagtaactttggaactgagtaacaggcagaggttggtggaacagtttggagggctcagaagaagacaggaagacatgggaaagtttggaacttcctagagacttgttgaatggttttgaccacaatactgatagtgatatggacaatgaggtccaggctgaggtgatctcagatggagatgaggaacttattggaaactggagtaaaggtcactcatgctatgctttagcaaagaaactggtggcattgtgcccctgccctagagacctgtggaactttgaacttaagaaaattatttagggtatctggtggaagacatttctaagcagcaaagtgttcaagacataacctggctgattccgaaagcattcagtcatatgcattcacaaagagattatctgaaactgaaacttttatttaaaagg

SEQ ID NO: 266435 - DNA, 342 bp, Homo sapiens
ctgtgggttctctaaaaagaatactacgaccgcagagctgaaccttgctggcttcttaaacatcactgtacacacagatcttctgaggatcttgttaagatgcagtttcagattctgtgggtctggagtggggcctagaattctgcatttccagcaagcccccagacaatgtggatattccttttcaggggaccacagtcaggggggatgctgatagactatatctactgggccaaaataaaaattaaaatcttatacacaagctactaactcttcctttctcattgacaaccactattataatgtcttattcattctaatgaacatattttttaacttcta

SEQ ID NO: 266436 - DNA, 444 bp, Homo sapiens
acagcacaggaagacccgccctcgtgattaattatctccaccggtccctcccacaacacgtgagaattatgggagctacaagatgagagttgggtggggacacacagccaaaccatatcagggagatagtgcttaatggatacagagatttagtttaggaagatgaaagaagttctggagatggattatagtgatagtgtacaacaatgtgaatgtgctttaatactactgaactgtacacttaaaatggttaaaatagtaaatttcacattatatatattttaccacagaaaaaaggagtttttaatgtttggttatgaaatattttaatcatacagaaaaatacatatcagccacttgtgtaagtctttggatttaatagacacattttgtcatgtttgtttcttttttttaagaaataaatcatcacagatgcagctaaac

SEQ ID NO: 266437 - DNA, 416 bp, Homo sapiens
aaaatttattcaagataatatttatcatgtgtctttatgtaccaggaatgagaatacaatggtgaacagacagaaaagtctctggtttcctgtagtgggcattccaggagcagaatggcgtcataattcatttactctataagtcagagagaaaaatgatggcacgaactgcaagggatttgtgtgtaaaatttgtgacagtaagaaaaagaaactggaagggaatacgcatttgccatgttctataatatgccacagacattgtaacaaaatatttcatgtcagctacttccatttaggaaatacatgttcattattttcttcaaactaagaattactttatccctcttttctttgaagttatcttaaatctgttattattcagggtctctatccaacttctcatcaaattaccc

SEQ ID NO: 266438 - DNA, 401 bp, Homo sapiens
acctcatctaagaggtgtctcctgagagctactcttggaagcaccgaagtccttttcacaaagactgcaaggtccttgaaaagatacactgtgtaacttcagtgtacaatgagcagctgggagtgttttgggcgaagttggtataaaagggtagctttcaggagacacctcttagatgaggggcagaaacccggacacatggtccgcatgcggccgaatttcgccctcacttggccaattggacctatagtgagtaggattataattcattggacgtcgttctacaaagcagtgagtggtaaatacctgggcgttacccaatttaatccttggtgacacaatctagttttgaagactgccttataacattgaggctcagcggatgatctatccttggcgtc

SEQ ID NO: 266439 - DNA, 254 bp, Homo sapiens
ttaagtatataaaatgttttgagaatttgcatcactgcttcaaataacgatcgatttctgaatcagaaggaaaaggaaagccaagcttctccatcatactcccatgctattatacatacatcttgctagaaattctcagatattattaactaaaaaattagtaacaaatatgctttctacataaaaaaataaagtttaggataaattctaatgccaagactaaactgcaataaaacattttttatctatataat

SEQ ID NO: 266440 - DNA, 405 bp, Homo sapiens
tccacccacctcggcctcccaaagattacgagccaccatgcccggccttttccttagatatgttaatacccttggtgagtttagcggcaaggctggatcctggagagtccgatctcttgtgtgatctgcatgtctccacttggatctgttgcttgttttctattttaactctctgagtgcagagttatatttccatttctgagttcttgagaagtgggaggggaacattaactttgccttgcagtggagctttcatcagttttgtggacagagcagacagacaagacacaggacacaaatcatccttttaaaagaaaagagagggtctcatcttttattgagaaaagaatttctgaaaagggaggcgctggcaaaaattgatgagctgactttgctcctggccta

SEQ ID NO: 266441 - DNA, 409 bp, Homo sapiens
accaacaccagttgcctggaagccctttggtggtcaacagattagctttgataaactcctagtttctggtgacccttatgatactttggttctcaagccttaggtgctatagctgcttcttttagatcctatattgttttgcgttattaatacctgaggaaccaattatttacattaagtgacttatgtttgaaattcctagcatgatgtctatgttttgaatgtgccttacctgatatggaaagcattgagatattttgcccataggggtggcataaagtaatgtacttttaaaagtataattttatggtttgcagtattaacagaatgtacaataatctgactaatgatgttcattacgaagaactattagtagtttaggtaaagataaacagtctttattttttcc

SEQ ID NO: 266442 - DNA, 575 bp, Homo sapiens
cccagcagaagtgggggatgggaggatccttggtcggtgaatagagcactgggttgggagtcccacagcatgaccagagcaagtccctcccctcgctcagcccccttggtgggtgtgagattggttggtaaaccataaaccatacccctgctgctgcaaagccactttctaagctggctctgacctcactggaaagtggcattttaaatgttattgtcttttatatgttcacatgtctgtctccttcattaaactgaagttctttgtgggaaggaacctcgtagaatgaatctgggtttccctgacacctggctttgagtacacatgcagggaccctgtgtgtagctgtaaaattattgaccatgtctacacatcatcgcctgagtatcctggtagaagaggccaagtacctcagcagccacctccacttcccacggcagtccttgggtgctttggctttgggaggccgtgaccactgagagccttctcagcctcgtgctctgaccgactcctggtgcggctgtagcatccccctgatcctccattcccaaaggggccctaagggctttgactgg

SEQ ID NO: 266443 - DNA, 363 bp, Homo sapiens
ccatagtggctgtactaatttgtatacctacgtacagtgtaaggatttccttttctccacatcctcaccagtatttgctactgcctgtcttttgaatataggccactttaactggggtgagatgataactcaaaaaaataaagaacatagcaattgtaataaggatataatgacagatgaaaataagactacagttgtaagggagaaaaattattttaaattaaataaaatatatattatttatattaattatattatgtttacaagatatgtaatagcatatgctaccagagatgattttaaaaatgtatgaaatctaaataaaccaatttactttaaataaatggaaaaattagtcaatga

SEQ ID NO: 266444 - DNA, 409 bp, Homo sapiens
gacttgcattatattatcttctctcaattctttatctccgtggagttttaccttaaaagatgttcattcatatacttttattcactaggtataactatgaggaagctgataaaaagggatgtttctcattagtcttttgtttatctaagatttgttgtaggttctgatacattagcagaataatataatcaatactttgatttgtttatcagatctatctaggttcatatgctacctctttgtgttcttgaacttcttcgagtctttgaggattaaatgaaagaattgatatcaaattaaaagcacagtggttggcatgtggtaggcaccaataagccactaataacagctcttgaaatacgtcatatcctttcattgctcctttacaacattgagtttataacaggga

SEQ ID NO: 266445 - DNA, 477 bp, Homo sapiens
cacgagggcaatttaaatatgtaggcataaggaagaaacaatatcacagccaattaggaaagtgagtaagcttttgaatgtcattatgctttgttgtttttgttgtgaaaattaggggcatcaaattaattgattattaatgtcagttattttagatggtgaataaagacaaattttctttagatatcatctcatttattttcccttaattaacagtgaagggatagtttgcagaatattagacattaataattttatgtacaaaagagaaaataatacagtgttcataattctgtgattgaggatgtattatatatttacataaaacaaggctgtaaattctaaaggaacaatacattagacgtagtttacatttggctttttaaaattatattttaagttctgggatacatgtgcagaatgtgcaggtttgttacacgtgccatggtggtttgctgcacccatcaacccgtcatc

SEQ ID NO: 266446 - DNA, 129 bp, Homo sapiens
cagaaacgcaaaggcagcagaggaagcgtagtggaaccattacagaatcacaatgcagccgacactctccagaccagaaaagggagcataaagaaagggtattgatccaatagaagaagggaagggtgg

SEQ ID NO: 266447 - DNA, 499 bp, Homo sapiens
gccaatctaaaatgtcagcaacacagtcctgatggggatgagtgtctctaatagaaactccgcaccaaatcattttacctggtgatagcttgctgcagtaagtttgcaggcatgttgcttcgttgttctgcaatataaccacactcgaagcaacaggagaggggccggtaacccattctgcattgactccagctccctatgactaggaagcaatgagccactctatctaaagggctagaacacaaaacagacaaaacctcttcttccttgatcatttttatctcagctgccaaaatggaaattttctgtgatttcctttgagacttgaagaattacacctggtctccaaccattattcttatcaccgtatcggttcagtgctctcaaggcacaaagcacttggaattcactccatgatcttgcaactctttttgagtgcttttcctgagcgattttaaactctacccgtaagaaatttcatctgcaatttctgtaaaaa

SEQ ID NO: 266448 - DNA, 675 bp, Homo sapiens
ctatcagctatgtttctttgcatcctgggcaagccgccatcattagcattttgtgtagggcttgctgacgcttgttcatttgtcgtcttctttgctaggctctaagtttattaaaggcagagaccatatccaatttgcccttatatctccagagcctaagaacatacctgggactgcagaaaaaaatggatgaacaaaggaataatgattagcttccaaacgaaggaatcatgctaaaatttgtctagcacaaagggtttcccaagatgagggactttcaatgctaaaaccaggaaagtccagattaaatcattttatggtaaatgaaggttttgaaggttcatctagaaacctgcttaccactgaccatttcattttttaatataatttttgatgaaatatatgtttaaacttccaaacaagcaattttgacattcgaaacatatctgcaagttggaatctgcttctactgttaatactttcagtttattgagagatgtctctgccagacattaagccaaggaattttcaaatatcaaacttaacattttcacagtgaaggaaactgaaatttttaggagctgagctacgtgtgcagggtctcatagctcataagtgataagtttggaatcaaacctccgtctttgtgacacccagcttttggtcttgtgtttt

SEQ ID NO: 266449 - DNA, 471 bp, Homo sapiens
ttgtgattctcttaataccttcagatgtttgctacctaggtcggcaagtaggtctgtcagtatgacttgcgtatgaaagagaaagctcttctgtgtttagacaaagtaatgctaggaacagggtgtgggaactgattaggatcctgttctgtgggaaattggtccctaatggtaagaggggacaagcaacttctctggagtagtagtctaaagctcagaagagtgacaatcaggcttagtggcaatcaggctttgtaagcattctcaagaatccttaggtgcattggggagagaattggctaacttacagacacacaggctgaaagcttgaggtattttgtttggctcttaaaggctagcaatttggagacattggcttgcttatacccatatcataaaattctgttcacttaaaatattgatgttaattctattggttgtaataaactctatcatgtgcttctgcccata

SEQ ID NO: 266450 - DNA, 423 bp, Homo sapiens
caaacatgcaaaaggtgaataattcgttagagcaaatccactgaagagattttactcaaggcaataatcaagttttcactaaagaaaattccctggagggtgaatggcaaaccagaggagagcaagaacagaagtaaaaggaccccaggacgagctgtcagcctgatcccaaggagacatcacaaaaccctggactgaggggcggcaagggtggggaggcgggctaaatcctggagacgcgcagatgggcttttggggatagtttggatgtggagtgttttgctggttgaaagattactaggcagtatgtaagcaagagatgaccgcatccacatcactgcctgttctaagaagctcctgagcatggtgtgtgagagggagggagaaacggctttaaaatttgagtgtacaactcacagcgct

SEQ ID NO: 266451 - DNA, 510 bp, Homo sapiens
atggggactgcccaaagtttagcagcagtggaaagctatttccactcctgtcctctaaaggcatagtgagacggcagtggtttccaaggagacccatagctgtagaagacagctgctgaacacgaactatgaccttcaatagggaaaggcagccactgacaaactgcagtcctgtggaggaagccttggcctctctcctctagctctctgagctagttccccatatggctggatccaagggagttcaggtgatgcagtctataaaggttagtttcctggggaacagtactgcctctgacagttggcagagagtggatctgaagagtccactggagaataatgagcagaaattgttagtcctgatggggtgaagcaaatatatcagaattgggggtggcgaatgtgtatcatttgcaagagcattctagaagaatgtaaccacaccctcccccaaaagattgactaacactgattaaactgaataaaaatacaataggagaatgtcaaata

SEQ ID NO: 266452 - DNA, 437 bp, Homo sapiens
tcctgagacggagtttcgctcttgttgcccaggctggagtgcaatgtcgcgatctctgctcactgtaacctccgcctcccaggttcaagcgattctcctgcctcagcctcctgaatagctgggattacaggcacgtgccaccatgcccagttaatttttatatttttagtagagacggagtttcgccatgttggccaggctggtctccaactcctgaccgcaggtgatccacccgcctcggcctcccaaagtgctgggattacaggtgtgagccatcgttcctggccagggaccaacaaaactttataagaaaatgaagcagtatgtacaatagctgtttatagtgatatcttcaaattatgaggaaaagttaaattacatggacattattctgtgcacctactatttaagaaggtatatagaattatacaatgtat

SEQ ID NO: 266453 - DNA, 234 bp, Homo sapiens
agcccagatacatgatgtctgctacttttctaatttgaggttagtctgaacgtgtactgaatgcactgatagtgtgggttagtcctaactcacactgtctctttagtgatccactttagtatcttgtcttggtgtcaaacagcatttttcagcagcttgcagagtctgtcacagtctcaaattcaggtctacaggtgtccctcattttccatcattatccatgactttttaaaa

SEQ ID NO: 266454 - DNA, 368 bp, Homo sapiens
tcctcctgcctcagcctcccaagtaatagggaccatgggcacaggcacacaccactgtctttttttgtttgtttgtcttacttctaataccggaatgcttcgtatatctgaaatgccctaagaatatgcatgtcaaatacactaagcattctgaaaacctgtaattctcccataactccaggaatatgaatctgtcagttcacccagttaaattttttcatctactttttttttagtctctactaaaaaaataatgcaaaaatcagccgggcgtggtggcatgtgcctgtagtcccagctgctggggaggctgaggcaggagaatcgcttgaacctgggaggtggagatgcagtgattgcagtgagcc

SEQ ID NO: 266455 - DNA, 495 bp, Homo sapiens
gataagaaggcacgtgcattttcacttttttttttgagatggagtctcgctctgttgcccaggctggagtgcagtggcgcaatcttggctcactgcaacctctgcctcccaggttcgagcgattctcctgcctcagcctcccaagtagctgggattacaggcacactctaccacacccagctaatttttgtatttttagtggagacggggtttcaccatattggccagactggtctcgaactcctgacctgaagtgatctgcccacttcagcctcccaaagtgctggaattacaggcatgagccaccacacccgggcctgcattttcacttttgataacagttgatagagaagttgaatgatttccattcccagcaataatgctggtttttccatgcttttgccaagttgttttgtgtttgctaatctgatgagtgaaatatgatgtctcatttttaatttctctttatgaataaaattaagtattctcatagac

SEQ ID NO: 266456 - DNA, 374 bp, Homo sapiens
aaggtaaatgaagtcacctgaaccctactaaatatataatcctgatgaaggatatctaaggtaagtggtctattatgccgtattctttgcaaaatttaatttagcataatagatagattcatctactacagctattgaaaaaaggtggcttaaaaggaaatctgaaacataaagaataaataaattgtgcatttacatgtattatgccagctgacctaaatacattgtcaacagtgttcatggcaccgacctgtttagtaattgagtaacataaatgatattataggctcataataaaacaattttttaatcattgggaggcagctaattggcaagcacaacctttacattgggaagcattattattgaaaaac

SEQ ID NO: 266457 - DNA, 396 bp, Homo sapiens
cttatttccattaccagatattcaattatggatgcatcttggactcaacacagtcaattacattttcagttgatattcaaacacacataaactttgactctttctggtatactgtccctaacacagccaaattccataaatttggctcatgttttttctttcccttgcctacttgccatcaccctaagctgagaatttctttcttctcacttgaactactaccttggtctccttcttgtgtctctcaaagcagccaacaggcaaatattcctaatgttccaacctcactgagttactctccagcttaaaaaccttaaacggctctctaccactcaatcaccgaaaaaaaaaaaaaaaaaaaaaagctgaaagtcccgtttaactcatacgaacttg

SEQ ID NO: 266458 - DNA, 446 bp, Homo sapiens
aagggaacatcgccgtttggaaagtgtcgtgatatgatacacaagttgtgctgcctctgtggctctaaggcataccaccttcagaagtcaacctgtggcaaatgtggctcccctgccaagcgcaagagaaagtgtaactggactgccacggctaaaagaaaataccacggcgactggttgaatgaagcacctaaacattgtatactgcagatttaggcatggattctttgcaggaacaacacctacacccaagagggcagcagttgtgtcatccagttcatcttaagaatttcaatgattagtcacacaataaatattccggtttttaaaaatgtatatattttaaacatatatatgtttatatgtatatgttatatctgtattacatatatgtgaaaagaggcagagattgtcagattggattaaaaagctgtctgtaagaaact

SEQ ID NO: 266459 - DNA, 762 bp, Homo sapiens
atagtttccaggcgtaatttcataggtcctatgtacctcaaatagaaggtttgaaataccttactcagcaagtatattacctcatagtttaatgttcagtgttatagtagaatctaggtggtgggtatatagttcacagtttacagtgaactctaattcaattttctgtatgtttggaaaatttcataataaaatattgggagtggggagtaaatgtgatgatagaagctatctctttaacacacttagggaaaaatccgaaaacattttctaatgagagaacatcattaaaattttcaggatgttacacattttgctattcatgctatttgacttagcctttgtgggggagggttggaaaaaaagtcacatcctctaacactattttggaatgataaggtgaagattataacaatagtaatttagtgcccaaagtctggtttttcttctttatggtcactcttgtaatcagcttttccttcctaggcagtgtaattctgcagtcctattttcaaagaaaagaaagtgttctttctcactgatctgtactatggctgaatgcaagcaaatatttgaagagatgaatcattgattcctggaccatttgtcagagagggttagactagttggccagatgtctccatggtgagctgtttatgatggtagaggtctgtgttttataaagacagtgagtaccagaaccttactgctttaacaccaagcttaccaagaccctaagtttgattatttttttttgtctca

SEQ ID NO: 266460 - DNA, 694 bp, Homo sapiens
ggtggtggggataaagcaagtttagtaaaatgttagtagtagaatctaggtggtgggtatatagttcacagtttacagtgaactctaattcaattttctgtatgtttggaaaatttcataataaaatattgggagtggggagtaaatgtgatgatagaagctatctctttaacacacttagggaaaaatccgaaaacattttctaatgagagaacatcattaaaattttcaggatgttacacattttgctattcatgctatttgacttagcctttgtgggggagggttggaaaaaaagtcacatcctctaacactattttggaatgataaggtgaagattataacaatagtaatttagtgcccaaagtctggtttttcttctttatggtcactcttgtaatcagcttttccttcctaggcagtgtaattctgcagtcctattttcaaagaaaagaaagtgttctttctcactgatctgtactatggctgaatgcaagcaaatatttgaagagatgaatcattgattcctggaccatttgtcagagagggttagactagttggccagatgtctccatggtgagctgtttatgatggtagaggtctgtgttttataaagacagtgagtaccagaaccttactgctttaacaccaagcttaccaagaccctaagtttgattatttttttttgtctca

SEQ ID NO: 266461 - DNA, 639 bp, Homo sapiens
accctgcattccaattgtgggtccccccgagccatgcctaggagggggtacggggaagaggggactccctcaccaagagcacaccccgcacagagcatcttcagcacaggggaaggggccgcgggatgcaaagccacggccccactctcaactgcccatagatctgttggaaagacaaagcatgacacacaaaagcgatgagaagtggccactcccagaggacaagtgctcactctctccgcagtggcctctcaatattcacaccatcgctgtgctcactcagacaccacttccttcatttattttccacacatatggtggaaggaaggggctgtgctcattcctgctggggaacatctgggtcagacagtggaatatgtggatgaatcaaactattcagatgcttagtgttgtatagataacttatctagagcattaactaaactttcccttcctcttctagatgattggtctttgtagacataactccaagccttaaccgtctcactggaaagaggatgacttcaagatgcagaatagcggaatggtcctttgaccatcctggaaaccaccgaaactggattccatcttgaccctcccaataatcatccgtgtggtcctgagtaagttagtatctct

SEQ ID NO: 266462 - DNA, 702 bp, Homo sapiens
gaaaagtatcaatatataaattcctagaagaggctagctaattcgagtgctcttgtcgtatagagggaagaaatatgacatgaagttaacatattaaaacttaattgcctccataacaactcacctaaattatttaatttggaacattttttttctggtactggtaaacacctcagtatgaaacagtcattttgctcaattgttttgtagatacaatagagcttcactctacagaatccttgaaatgtgagtcattaaagatgacatgtcttcagaataacagaggggttacctatttaagtaccaaatatagtgcatacagatgtgtctgtgtgtgtgtgtgtgtgtgtgtgtgtatacatatatatatattaatttaacattttgacagaaaatcattctaaaatgtattaaattttataaggcttccttaaaagcacattaaacataatgcaattttctttgatggcccaaagtcaccattgtgaatattaattattatactgtgctataataaaattatgtctgtgaggccctcaaaaatgggtacgctctattgcctctagaattacacaatgtcagaatgaaatgggacctgagagcttgtccagcattcccaattacagatgggacactaacatcaagagaagagtgatgtgatttaattaagcggacacaacagttatctaccccaggtctccc

SEQ ID NO: 266463 - DNA, 421 bp, Homo sapiens
aatctttgggagctcaactaagaaactattctaaaaacctagagataatgaggtattttaaaaatgtgcatggacctgggagccagaagacaagggctccagacttgacttggctactcatgatggttataatcttggtcaaatttaacctcttttgcttcccttctagcaaatgaacaagctgaattatattgctaccatgagtatgtgtaagaagcaacaagaatgttgttttcatttttgttctccactcttcccctgatataaatattcactgccagtgaaaaagctattgtggctgacttttctcctctagctggaaatggacctgcgaatcaacacaaaatagtcctgtaaacaccagaatcctgcaggacctcatccagcaaacatacctggacccagggactgggggaggttg

SEQ ID NO: 266464 - DNA, 486 bp, Homo sapiens
gggccctctctggggtgcaccgggtctcctctttccagctcatgtctcccggggggctgggctgtctcctgtcctgcagccgcagcacttgatctcagcaggtggaatgcagagcagaggaatccgccagacattacagggatctatctgagtataaaacgggactgctctttccactaaattgcttttggagaataaagttaagtgaattaaaatttccccagtctcaattgctaatatggtaaatattcgcagttacaactctcattaacaaaatctcttaggagtcctcagtaatttgagactgtaaagacgtcttgatactacaatgcctgagaacgagttctctggatcttacctgcccctcttacatgaggaggcaccctgatgtctgggtggcttaccctttggcctctggcgggcattcagcatgagtgaacggtggctctcgagttgctccttactctcacagtgtcattcccatct

SEQ ID NO: 266465 - DNA, 425 bp, Homo sapiens
actggaggtcattatattaagggaaatcaggcacagaaagagaagtgtctcatgttcttactcacatgtgggagcgaaacacattgatttcatggagatagaatgatagcagaggttgggaaggatgggaggggaggtaaagagaggtaggttaatgggtccaaacataaagttagatggaataagttctaaggtttgatagcagagtagggtaactacagttaacattttgaaatagctaaaagagaggacttgaaatgttcccaacacatagaaatgataaatactcacggtgatggataccctaaataccctgacttgattatttcatactctttgcatgtatcacaatatcacatgtaccccataaacatgtgcaaataattatgtatccaaaaaatgctataaaacaatgttaccacctg

SEQ ID NO: 266466 - DNA, 261 bp, Homo sapiens
gttataaagctctataatggccctattagtaaaatgaggctcaaattctatggcatgggcacaaacgtacatgtatatgctcagaagtctttctgtaacacaaagaacccatgtggtacacaaacccaattctgtactcaacctacataaaatgaaaatattggttataaattttaacatgtaattaattgcttgccttcttacagtttaaaggcttgtggacagatgttttgaataaactaagcttcttaatatatataa

SEQ ID NO: 266467 - DNA, 457 bp, Homo sapiens
agataagcatgggattttgtttttaattgaaattttattgagataattaatagattcacatacagttcataagaagtaatagattccctgtacccttcactcagttccctccgatggtaatgccttgcaagactgtagtacaatatcatgaccaggatgttgatattgagaaaatccatagatactattccaatttccctagtttttttttttgttctcatttctctttgtatgtatttagctctatacaattttattacatgcgtagatttatgtatccaccatcacaatcaagaatcagaacagttctgtcattacaaggatccctcattgttttataaccatgcttacctcccttctgttgtcccttcctcccccctgctaccctgttctccatatgtaaaattttgtcacttctaaaaaagttatataaataaaatcagacagcatacaacct

SEQ ID NO: 266468 - DNA, 440 bp, Homo sapiens
caggattaagtgagttaattatgtaaagcacatagtaagtctcatttaaatgtttactgttttccttaacaataagaattgcttttctatgccacgcagaggtaaaaagtgccaatgagctcactggtcctttctcttgtaaaacaaatgttttccacttccatagaattttgcaagttgcaaagcactagcagaaaatattaaaatcatgcactttggtgtgagttagttttataattttgtctaggctctgtcacttagaattgtgtgatactgagcaagtcacttagcccacgacttagcctccttatctccaaaaatggttttgataataatatctactccatagaactgctaggaaaattaaagttcaatagaaattaactgagtgtgaacagtactgactcatcaaaattcataataacaacatgaataataaa

SEQ ID NO: 266469 - DNA, 331 bp, Homo sapiens
gatgactggatttttcttcaaggaaaagcaagcttacctgttctccaggatcatgcatactccctgtggtcttttctgatgctaggtaaatttgttccaagtttcccatgctctactaagagtacaggatcaaccagagctgggcatccacatcatcctcgtaaagtggagtaccaattctcctagtgcaattagagaggaaagccccagtggcaatactcttgcaggctttatggaaaggtaagtgtggaggaagcctaacactaaatgagaaatccatacctttcctacatgcctgcctgaaccaaataaaccttgtgttactatacaa

SEQ ID NO: 266470 - DNA, 695 bp, Homo sapiens
atttctacacaaaattgtaaaattaaccaggtgtggtgacacacacttgtattcttagctattcaggaggctggggagggaggatcacctaagccaggggaggtcaaggctgcagtgagctctgatcgtgacactgcactccagcctgggcgacagagtgagacactgtttcaaaaagacaaaaacgcccatagtattttaaattttacaaaagggctacaaagcggtcacaaatataaaacaaacatgtaaatataaatccattgtgaaggatctcagaaactatgcagcagattttttacaatatatctttttgaatggaggtggtattttctgtcagtctacagtgttcaaatttttgttgtgaatttgatgcttttgtaattaaaaatgtattaaaacatttttaattaaaggacttgtcaggatataaattaattactgcccatatgaagtatgatacaaatttttacttttctaaaacaagcacaagtcccctttttgcctctgaaatatcagctttattcaacacctttggctgggactcagaaatgaaggggataacacatttttctttattctgacatgcatttccattaattacatgttttcgcttgggttcatcaacagtaaacttcagggtaagtttttcctaccaatttcagttctgcatggccaattttcaggtctgtcaa

SEQ ID NO: 266471 - DNA, 334 bp, Homo sapiens
tgtcatcaaagtctccctctctgcacacacagcacttgacttcatccactctgtcagtcccattcctactaccacaaatctaaagcagcctttaggaaagtcccagagaagaggacctcagtctattagaacacggaaagaataagcataggaaaaatggagatgaaatcaaaatctggtataaataaagaagactatacattccgagacaaaatataaccgtgcattcattcaacagattttaatgccctgcttgtgctaaactaaagctgtggatatgtcactgaagaagaaaactataggtaactaataaaacacaaatgcatttaaaaat

SEQ ID NO: 266472 - DNA, 417 bp, Homo sapiens
gaaagatattttttcttattcatataaaaccaggcacttgcttaagggatttgctaaaatcactggaggtcaaagcaagattgccctcttttctgtagatgtgcataatttataagcatcaagcaaacaagtatggaggatctgtctttcatatggcatatgtgagccacagcagtcttccaggtagaagctgaagcaggctagttccatttttagtccacttccctcagccctacctctacccgaagctgtttgtgtgtaggtttgctttccctaggagcccttcagtgcctcgaagacagaaaatagaagcttaatttttgtggtaggttgagcctgaagcagagtgacaggcacagagtaggtgcttagatatgtacatttcaatcaatgtttgtttaaaaattcccatgcatg

SEQ ID NO: 266473 - DNA, 382 bp, Homo sapiens
gcagaatgaagtttgagatcatcccaaaagatgtatgtctgcaccacatttttcttgacaggagaaaaagtgacaagagctaattaaaggaaaacagaatgttcttttttgatggcccaacagacaattcttttcagtcacactttattattattagtttatcactaccctatttcttttaggtgtactcaaggtaacattctccctacttcctggtctactagttcaagaaaaacgtttgttttgagtgccacacggcgaacccattttagaagtgtttctattactaataaaacatttgcatatttggatagtaatatgtatcattcatagtttactttagttatttcacgatcacatttataaaagctttccagttaaa

SEQ ID NO: 266474 - DNA, 298 bp, Homo sapiens
cagattttcccaattccacattttggaagtatcaagagctgtttcatgagataagctggcgagaggaaatagactactctggtaggaaactagagcaggtgtactcaaggtaacattctccctacttcctggtctactagttcaagaaaaacgtttgttttgagtgccacacggcgaacccattttagaagtgtttctattactaataaaacatttgcatatttggatagtaatatgtatcattcatagtttactttagttatttcacgatcacatttataaaagctttccagttaaa

SEQ ID NO: 266475 - DNA, 290 bp, Homo sapiens
ctactgttcatagggaagatttttcacacaaaccaatgagaaaattcacagtaacgagaagaaagtactcaagtttggatcctggttaaaccttacacagcctcagtagatcaacttggtctgtctaaatcaatggtactgaaggtatgtattaatgagataatacatttgaaaatgattttaaactaaaaataaaaggatcattcagttatcttctagtcaggagctgccaggacacaccaaaacaagtaaaacagggttcatctgtttattcatctttgaaatgttac

SEQ ID NO: 266476 - DNA, 425 bp, Homo sapiens
cttaagttggaacaaagaaaatcaccccctgataattacaaaaagacaatatcatgtagttttaatatagttttatactcttgtgagtatacagacaccctactagcttgaaattcaattcaatgactatttttgtttgtttgtttttcccttttttaccaccctatctgtgacgggcactgtgcacataagtcagacactcagaggccagtttttcccactgtccatattctgacccaaagtgctcacaattttctactttgtcctttggatgaagtgccagaaaaatgatgaaagacaagagaacactaaaaacaaaacaaaacaaaacaaaaaattaacatggaaaaaattggaggtatgaaaggcagtttaataaaaaaccaaagcctgtattttgataagatttaagtaagtaatgaagt

SEQ ID NO: 266477 - DNA, 377 bp, Homo sapiens
gtactaatgtactaattattttttcattaacttgtcaatttagcagatattcattggccctttgcttctaatactcccaataccaatactgtgtttgctattttaatattaaaaaaacctccgttttgtatcttgttctccaaaaagacaaatgcaaaacatattgtataactgtagttcaagataaaaagtgaaaaatgttaccaagtctaagagactacttctagatccgggtgaggaaagggaaagctttgaaaagacagggaaagcatttgaaagtatggaaatggggagagtggtattcactccaagctggggttacaacatgatcaatcatgagaaggctggaaggagcacggatatgtgaaagcaactgg

SEQ ID NO: 266478 - DNA, 630 bp, Homo sapiens
tattgacttatgtctgttcaaataactggtgtggtttctctctcctgactcaaccccgaatgacacattcccttgaaggggcagaacatcccgagacaagatgcaacggtacacctaaataaagacataaaatcttcaaagaaagataatgtccttcagaaaagggtttgtcagccataggcgcctggcccagggagggtcagagaataaaccccaggatgacatcctcagcagtgacaagagaacagaccaccaccatccatagcctggatgactgtaaagactcctgctatagactggataactgcttcatgtgccccctaccctccaccccactgcccattcatatgttgaaaactaatccccaatgtgattgtatttagagtggggcttttaggatgtgattaggtcatgagtgtggaaccttcatgaatgggattggtgcccttaaaaaaagagacttcagagagctcctttccccttctgccacgtgaagacacagtgagaagatggccatctgtgaactaataaggcagccctcattagacatcaaatctgatgacactttgatcttggacttcccagcccctagaactgtaagaaataaatatttgttgtttataagccacc

SEQ ID NO: 266479 - DNA, 141 bp, Homo sapiens
tgccatgccgcagatagccgcagtgccaaccctgtttagatggtttggatctgcttggatggccccagcccctcttgcttcgatctttggggaagttccctagggaaaggagaataaacaaagtatttctgcccagaggca

SEQ ID NO: 266480 - DNA, 259 bp, Homo sapiens
gtggttaccatctaatttttatacactttagagataatttttttcaagaaatatgtttttaaacatgtgtttaaagaaaagtcaataatcacacagatggtatatggagaacaaaattcatgaaggaggaacatgaggttttataaacatataatgcttaattattcttggttttcaaagcatcttacgtacattaaaatatttgattcctacaaccacctcatgaagctcatagggattatgatccattttaaagatg

SEQ ID NO: 266481 - DNA, 475 bp, Homo sapiens
gagggatgcagagattaggcagaggagaaaacttgtaccaagcctgggcatggatccctcttttttttttccttcttcccattctggtgtttctccagagccctgttccagttgctgagaatgctagaggaacaggggtgatgtgtgtatcgcacctttatccactgacacctcctattcctgggtcccacctgtccttctgggtattgttggttttccccaagcaccctctgcttctgtggggcagggctgtgccatgccctgtgcgtaccccaagccccgtgtgcagcctggcataggagtgctcagtgagtgagtgtgcactgaagggaccgtggaaggagcctgtgggttgagcagggacttgggctgggctggcctgtgtggcatgtcctgccaccggttgtccttctgagtgaggggtcttccctgtgaggggcaccatggagacttagtgctgcctgagcatttggtg

SEQ ID NO: 266482 - DNA, 429 bp, Homo sapiens
gcagggacctggcacctaagttatctttaacttcccaaacaagtctgaaataaggacacttaggctcagaatgaggcccaaggtcacaccgatcgtgaacatgacaggtgcaaatttgaacccagtagtgtctgattccaaagctgaatatacggatatgttaggatgcccacctactatgtcacctcacttactccacccttgagatggaaccatctctgtcaagaaataaggattaaaccaaatcaagtacaaatgaaaacccagactgcaagccatcatagaaagtaagattcaatgtgtgtatgtatttgcatgattaagcacatgcagagaaagaatacatctagatatcaagtggtaattttgaaattttctcctttatacatttctgtttttctcaaatattaaaatagatgattcttatta

SEQ ID NO: 266483 - DNA, 346 bp, Homo sapiens
agaatagcttacagtaagttttcatactgccttcatttcctctttaaaaaataatcaattttaggctgggtgcagtggctcatgcctgtaaccctagcactttgggaggacgaggcaggtggctcacctgaggtcaggagttcgagaccagcctggccaacatggcgaaactccatctctactaaaaatacaaaaattagccaggtgttgtggcatatgcctataatcccagctactcaggaggctcaggcaagagaatcacttgaacccgtgggcagaggttgcagtgagcagagatcgcgccactgcactccagcctggccaaaagagcgaaactgcgtctcaa

SEQ ID NO: 266484 - DNA, 138 bp, Homo sapiens
cccaaggccatcagaagctggaagcggcaagaaaataacctactctagagccttcagagggagcagggtccaccgacactttgattttgtactctggcctctagaaccgtgagagaataaatctcttttgttataagc

SEQ ID NO: 266485 - DNA, 424 bp, Homo sapiens
ccactggaaaggagagtagaaacggaaacagacccgtctggacagaatccaaagtgcaaacaggaactgtgcccagagagaggaggaggtggcagaagcatgaaggctgcttagatccctatgttctaagaaagaccgctctttcctggctttaacttccttggctcagaagtttaggatttgctcaaaatcagaaaaagcaactttgggggaaaaaaaaaatctggatgtggaagaaactggcggtgaaagtcatattgagtgattaatgataaaaattatttccgctccttggttcttgagtcggtatgaaacgctggcagcctctaattaatcatcaccatgatattaacaccactgacttttcattgcttctgctactttctttctagacatctgtatcctctaagtaaatattatccgc

SEQ ID NO: 266486 - DNA, 338 bp, Homo sapiens
gccagggaaaataaaacctttatgtacccacaaaaaaaatttcaaaaaattcaaaaataaaataataaccatagtagataaatacataaaaccttgggccctatgcaatctcttaaggaattctgagtttacaggtgcagggatttggtggggtttttagtttgtgggaacttttcttggagtttttttctttttgccagcaaagtgtaagttccctgggcaagctcaagaccgtagtcctgtataatgaataatgttcaacatatatatcatagttcagtgcatgctaattatgccctgcacttacccaaaaaatggcatgacatatctttagagga

SEQ ID NO: 266487 - DNA, 377 bp, Homo sapiens
caaggggaaattagaatggatagtgaaggaaggagatagtgaataccacttatggcctagagataacctcagggatgggaaatacagttttttttggaaacctcccttttctaagtttctcttcaggaagtgaggcccactggaaccctggagtagctgcatctggacaaatgaagaagtgaatccatgtgacacagggtgaacaacagcacccacgggtgtatatcactccgattatcctgcaaagaaaagagttggcaatcagctgtttcactgtctgaattaagaattataaggtcacagctagcagggaaaaacagggggtatgatgttgactttatctgccttttcggatccatggaaggccctggattatc

SEQ ID NO: 266488 - DNA, 526 bp, Homo sapiens
agacagagtcttgctctgtctcccaggctggagtgcagtggcgcgatcttggcccacagcaagctccgcctcacggttcaagggattctcctggctcagcctcccgagtagctgggacttcaggtgcccgccaccatgcctggctaatttttcatatttttagtagagacagagtttcaccgtgttagccaggatggtctcaatctcctgacctcgtgatccactcgccttggcctcccaaagtgctgggattacaggcgtgagccactgtgctcggcctgagaggttgcgtcttatcttaaatcacatatgcagtgaagtcctttgtcacttccaaacactgctcctgaccattgttctgtacctcatggctgcctttgcatgtgtaattggcaagtcctagctataagacagcatgtaatgattaaggaggattggaaacctagtccttgtatcaccctttttccttcagtaactaaaatatctttttttttttttttgagacggagtctcgctctgtcaccca

SEQ ID NO: 266489 - DNA, 702 bp, Homo sapiens
aagacagttggtaactgacaaattgcaggtgtgatcattactctctgtgactccctgtttctcagatgcactgttgcttacatctttgtatgcttttgcattcctgctgattgattcaaggtgcaacgtgcctgcttgtcaggtatgctgttgatcacattatttaagaagaaataaagtcgttcccgcagctccacctgcagtgatgggctttaatgttttgtgcttcccgaggaaaacctgccgatgatgtgaagtgacattcaacccgccgagagctgatactggcagacaaatttcatgtcctgtctcctgatcaccagtttgctgcctccaagttgttagggatattaaaaacaggggtgggaagtccccacttgacaggttcaatttgtaatgtgaaaggtgctgagaaacaaagcaaggacccaggcagctttctgccaaggctgctggccccacactcagcaaggcaaagagaaaggggatctatctgctagtagcatgagtgtgggagaggagggggctgttgtagggtgccgtggaggactcatacatgatcctgggaagagcgctgctgctagcccagggccacaaagcgtcaaggacgttgagctcctgtgcatgctcctgtagccttgtgtcatctgaagaagcacagaagtggcaggaatggccttttcatagggcatgggatgctgt

SEQ ID NO: 266490 - DNA, 393 bp, Homo sapiens
aatcagagttgatttcctctttttaaactaaaacaaatatttgctttcattatataacatatatatatcaaaatgagaagaatgtctaaaataagtttgaagctaaagattaaaatcttaatatgcattttacaaacatgtggccctataggaatagtagtttgtttgtttgtttgagacggagtttcactcttgtcacccaggctggagtacagtggtatgatctcagctcagtgcaacctctgcctcccaggttcaagtgattcttctgcctcagtctcccaagtagctgggattacatgtgcacaccaccatgcctagctaatttttgtatttttagtagagacagggttttgccacattggccaggttggtctcgaggtcctgacctca

SEQ ID NO: 266491 - DNA, 217 bp, Homo sapiens
ggaagggagacagacttttgggcaaggaaatagcaaaacagatgcgtgcaaacagaagaccgtcaggaggtgggggaaggctggggagtagggggcactgagagagagaggcagggtctgtggccccaagagaagctcaggccaggcttaaggacagagagcagggaagctggaggccaagggggtttgctttggaagagtctggggacaggacagg

SEQ ID NO: 266492 - DNA, 221 bp, Homo sapiens
ttacccacctcatttccttgagaaccaaattctaaagctcttgccagccttatagatacccaatggaatccctgctcatatgcatactttgggttcatcggtgatttttgctcactgtgactaatccttccagtgtttgtagcctttcttataaggagaacttctatttcagctttgttaatttggcttcacaaagtaaaataaggggccccattgttttg

SEQ ID NO: 266493 - DNA, 461 bp, Homo sapiens
caccccaccagatggtccccttaatacaacaggctgccccacaggcctcagcactagcccaccagccactccagtcctggctccgctgtgtcccacacgactaccccaaaggctacagacatttcccagcaagccaggccacctgcagctttactttccactgaatcgtggctccgtctggcggcttctttctcactgtggaccgcagcacagtggccctctctccgcacccaccccagctccagtctccagcatgcccttcttcccacttttcctccctctttccatgggtgctcggctcacaaccttcctccagacgagtgcctgaccctcccacatcctctgaggagcaccagggccagcacacacctttcctatcgtcgtgtttgccactgttggatcggaggttttctcattttcattctgattcttctctgtcccaacagttttttaggactgtg

SEQ ID NO: 266494 - DNA, 289 bp, Homo sapiens
cactaactcgtcatctagcattaggtgtatctcccaatgctatccctcccccctacccccaccccagctccagtctccagcatgcccttcttcccacttttcctccctctttccatgggtgctcggctcacaaccttcctccagacgagtgcctgaccctcccacatcctctgaggagcaccagggccagcacacacctttcctatcgtcgtgtttgccactgttggatcggaggttttctcattttcattctgattcttctctgtcccaacagttttttaggactgtg

SEQ ID NO: 266495 - DNA, 433 bp, Homo sapiens
aaatgacgagttaatgggtgcagcacagcaacatggcacatgtatacatatgtaactaacctgcacattgtgcacatgtaccctaaaacttaaagtataataaaaaaatgattctgtgtgtataaagatcaaaagacagccaaaacacatctatggcagtgattatttttgctgtacagcagtatgaggcaaggatcatcactgatctgggtggtgtttccagaggtatgttcacttccctttctgtatggttaaaaagttactttaaaaattaacacttaaaaatatgtttaagaccatattttagacctatgaacagtttccttatactaccggagcatgctatgatttgcaacttaagtgaaagcatatatatatgtatatatacacacacgcacacacacacacattcactctaaatgtcttttttaaa

SEQ ID NO: 266496 - DNA, 460 bp, Homo sapiens
tttttttttgagatagagtctctcgccctgtcacccaggctagagtgcagtggcgcgatctcggctcattgcaacctctgcctcctgggttggttcaagtgattctcgtgcctcagcctcccgagtagctgggattacggccatgcattaccacgcccggctaattttttctacttgtagtagagaaggattttcactatgttggccaggctggtctcaaactcctggcctcaagtgatccgctcgcctcggcctcccaaagtgctgccatgtgctttcactacctttttgatcatggccaattaatgaccaggctcccctgagattgtttagtcatctgtgcagaagtaataaatgacatccacctcacaggactgttgggacaattcaagggggaaataaacctcaagaatctgagaacagagcaaggggccaactgttagctccctcacacccaacc

SEQ ID NO: 266497 - DNA, 497 bp, Homo sapiens
gatttggaggaatcgcacaaaccaaacttacagtcagtgaaaaaaaagtgcaaaagtatctactactgtgtgtatactaccttttgtgtaagaaagaaggagaaataagaaaatacgtatgtatttgttcattggggcaaaaacaaaacacaaagataaattggaggttgataagattgatttcctagaggatgggtaaaaaggtatatggtggaaaggatagagggaatgggggcagggacccttctgaggatacctttctgacttttgaaaccatgttaatgtttcacatactgagtatataagcagcaaacacaccaaccaaatcaactgatgacaaataaaaacaccttaacagggagtacaaatagaaacaaatgaactgaaccgtatttcaaatgagtaacttaactacactgaaggagtgaaaaacaactaatttaggtaacttttgatcctagtatttgaactctgtcctcaggataaagacaaaaaga

SEQ ID NO: 266498 - DNA, 489 bp, Homo sapiens
gagctagcaagtttgatgtccttcttctgttccctattctaggtctgggcttgatgttcaccgattttccctcagctccgactgtggctcctctcagctgactctgaccctgctctcagccgggctgcatctgcccatctcagcacatcaataaacagcagagggaaactaccaccttggaaggagccaggcagtttctgctgggtaggccgcagcctggaacatggaagtagcttcttccatcctacactggaaaccacccagcatcccgggccctccagagaagagccagactcccttccctgggaagagactatagtcctatctgtatcctccgtggtcattgcccctcagtcacagcaatgaagagcaaattacctgttttctgtatgttcctctgacaacaactgccacagagtaaatatgaaaggttctggatgattccttgtcagcttttattaaaattccacatacttggcaaaacttagc

SEQ ID NO: 266499 - DNA, 700 bp, Homo sapiens
gtcttccgaagttagcttggcccagtagcccaggaataattaagggaaaggcaagataggggttgggttagcttagcttactaagtttctcactgatacaacttttgcaagggtggtttcattcacatagctgccgtgccatttcttgtcagtttgctcctgcttaacctgagcagctgtattcagacctttgctttgctcttgcataatgtgggtgaattctccctgatgtccttccccacctttttttggaaacttcatctctccccaccttacatatagcctgagctacttatgaagaactgacttgtgtgtacttgattgtgggctgagcgtgcaagacatggcagggaaggctctttgggggctggatgtgctccttgttagaagccttgtgctgtgctgttagatgtcctgggccagtgcctacccatccatgcaggaggtttaacagtccccagttgagcaagaacctcaggaactgggaagaatgggtagtacttcctaccttttttgagattctagaagtttttttattgacttttctccagtctgcttacttagccctttagattacttctctacaaatcaggatactgcagggagtgtgtggaagtgggagcatgctaggggaacaggtagaattggcaaggtattttgacaattctttaagggtttataaaggaatctttcctcattg

SEQ ID NO: 266500 - DNA, 587 bp, Homo sapiens
gtatgtgaatattcatattaactttatttgtagtagctccaaattggaaacaacacaagtccatcaacaagtgaatggacagtgtcagatccatacaaaatactactactaagcaatttacaggaatgtactgatatctgcaataacatagatacatctccaaataattatgctgagtagaagtaaaatgaaaagtacatattatatgattccatttatataaaatcattaaaaaactataaactaatctatggtgaccagtgcttgtctggagttggtgggtggttggtgtttggggaggaaaggattacaaaggagcatcttttgggagggatgaatatgtagattatatcttgttacgatttcacaataaatatatttgtcaaacaccaaattgtacactttgaatatgtatagtttattgtcaaatataccttaaagctgtttaaaaagtttagtaaagatctatgaaaagctattttgtttcaccagaggaattaatcaaacatatctctcaatttacctctttgaaatttggttttacacttttagatgttaataagtcactatataagctcccattttga

SEQ ID NO: 266501 - DNA, 326 bp, Homo sapiens
tctagatttgtggctcttggcttttttcctagctctagccttcgatggcccaaggtggctaggtgagctaaaagtgtaaaagagaagggttcaaaagtgatagctgccactgattttggaagtggacttttgtataatttcaatatttcactttattattattttgcagaaaagttattacaccacagacagtagaatatccagcattcttatccccagacctgaatgttactgttgggactccagctgtgcaatcctccaaccagccatctgtagtgcgacttgaaaaacttcagcaacaaccccgggaaaggtaaaaaaaaaaa

SEQ ID NO: 266502 - DNA, 896 bp, Homo sapiens
agcggagtagcgggccgtcggttgggcgcagacaggccgcagaagatggagagatggagccaccccaagagacaaataggcctttcagcacacttgataaccgcagcgggcaggtccaagtcctgtccgccaccccgctattgcagaggaatccctacagcagcccggatatcatgcacattaaagggtcggaggcttcttcggtcccttacgccctgaaccaggcacgacggccctgcctaagaacaagaaccaggagggcaccgggcaccggctgctgaacatgctgagaaaaactcttaaagagtctgatagtgaagaactggaaataacacaggagacaccaaatttggtgccatttggggatgtggttggctgcctgggcattcatataaagaactgcagacattttatgcctaagatcagtttacaacattatgctaatttattcattcgcatctctataaacaaagctgtgaaatgtacaaaaatgtgtagcttgctatccaaaaacgatgagaagaacactgtaattaagttcgatgaagtgaagtatttttctgtacaggttcccagacgttatgatgataagcggaataatattttattggaactcatacaatatgacaatagagaaaaacgtgctttcttgttagggagtgttcagatacatctttatgaggtaattcagaaagggtgcttcattgaagaggtccaagtgttgcatggaaacatatttgtctgcaggctggaggtggaatttatgttctcctatggaaactttggttatggattttcacatcagttaaaacctcttcagaaaattactgagccatccatggttatgaatcttggcaccacctccagaaagaacagatcccgtgacaagtgtttta

SEQ ID NO: 266503 - DNA, 485 bp, Homo sapiens
agatgcacttaaaatatagttatccaaaagctttaaaagatttaaaaaatatggtatcctgggactagcttgtaccacaagagccagttttgggtgtctctttccaaccccttattcatgttggttgcttgaaatcaatcatggtgcatatatttatttcacagaaattgaccagtcatggtgggctcatgcttgtaatcccaacacttttcaaggccaagacaggatgatcacttgagcctaggagttcaaggctatagtgagctatgattacaccactgcatttcagcccgggtgacagagcaagaccccatctctaaaaaacaaaaaaacatatccgtaccaaaaaatcaacaaacattacaagtcatgctcttcccccaacatccaaagaactgatttaccagcacacaactaaatatacatcagataaatgctaagaaaaagaagatatagcaatattattccaagacaaaattaatggc

SEQ ID NO: 266504 - DNA, 402 bp, Homo sapiens
acaaaaggtttctactttttttcagcatgatccttcgttttttactataacatgtacctgtaaggtattatatgtaagtttcttttgaaaggtaaaaagacttcaccaatgcaaaatgatttttaaaaatatcctcattataacagcaaaggctaaatacattccagaaatccactgttcatatagtttatctcctggggataggggaaccaggaagaacaggagtaacatgtcctgaatgttgcaaagcataatctatgctgatttcataaagtttttagctaatgtatcagaaatcctttcaaagctttggtagttgtttgtggcaggaggcagcgttgtctgtataatttatgatgttcttatattaaatggaaaaaaattaaaagaaattaccaatat

SEQ ID NO: 266505 - DNA, 396 bp, Homo sapiens
gaggaggacgacgatgactccgattatccggaggagctggaagatgacgacgaggacgccagttactccacggaaagcagcttcagcagcactccaggatcttcatgacattcaatgagtagcaaaatttgaagataacttctggaatttcatctaatgtgtactcatctggatcttaggggaaataacctatcaggttatagggaaggaggacctttaataaccaagctaaatgtgtgggctgtttacctctccctcttatgcaaaggtatcccttgcacacactgaaaacttcatagaccaaaagcattatagctctagtttgccttgaaggaagttgtattgtctgtagagcatgtgggccattttctgccaataaaatgttcaaatgttctc

SEQ ID NO: 266506 - DNA, 404 bp, Homo sapiens
agctggtgcaatctcggctcactgcaacctccaactcccttgttcaggcgattctcctgcctcagcctcccgagtagctgggattacaggcacgcaccaccaagcccagctaatttttgtatttttagtagagacggggtttcaccatgttggccaggatgatctcagtctcctgaccttgtgatccgcctgcctctgcctcccaaagtgctgggataacaggcgtaagcatcgcgcggggccgggtggcatttttataaagagtttatttccctttttaaatttaagctacactatgcctatgatctgctactctttcttatggaggtaggggtgtgtgcgtgtgggtgtgagagagtgtgtcttgttcttgttgttgcttctgttgttgttaaagaaattat

SEQ ID NO: 266507 - DNA, 393 bp, Homo sapiens
gtatttggtactcttgacttgcagttgtagatgttagatttataagccggacccaggaggtcatataacccagacatgcttgttgtacagatgaagaaccgtggataggttaagtgctaacttcgtgtagcttgaagtcattgaacttcttggctatatatgaactttgggttcaggggtagttccctaacccatctgtgtccccattggcccattagtgtattttttggctcagttaaagttgagccacagaagccttaactaatagaaatacagttcttagttggtggatttgtatgtcagttaaccagggtctttggaaagtatattgtcttttctataaaatgcttgggtcctttagatgattataaataaatgttcaaaatcaaaaca

SEQ ID NO: 266508 - DNA, 371 bp, Homo sapiens
ataataacattttactttcaaatttgttttagtggttaaaaaaaagtacacatgcaacatgcttgacactaggagagttatcagaaatggatagcctctcaaattctgtcaattttgaaatggaaggtggttctgatcttatttgtgtgaatctggaagcatcagaatacttcacattcaatttttttagttagttagttactcccaatttgataaaatgagttcatagcattttggggaatgagcttacagccttgacaacagagcgtccagggagaaatgccctctagtggacgttttatccccactcggaggatacctgggaggatctcttaagtgtctcatttttttctctaacacattttacaagt

SEQ ID NO: 266509 - DNA, 701 bp, Homo sapiens
gttttttagtaaatgtaaagatgttgtatattaatttcatagttttattattatgaaagttatacatttgaaattcagatatcaaattaagtttctggatattaatgttttaaatactgtctgtgttgaattggtcaataggtataaaagtaatttaagacttctttgtctccattctataagatttggatttcatatttctttgtgaattattgttcttgttattcctgctatttgttttgattctatctgtgcagaaatgcatggaaatctattgaaaggtgattcagcaagtgctgtctcgcattacaaatgtcagctgctcaccacagcatgtgtgtatttttatttcatctcaaattttttaatcagaatataaagaaaaaaatccagcattattttgggaaaaagagaaaaataatttagatttcaattaagtatatttatcctctcccaaattatatgctctcctttttaaccttaatttaaatttaaccacacatttatctttacttatttatttttatttaggtaaaatatacatgtacaatttaccatatttgccatttttcagtgtatagtttagtggtaataaatggatttatattcttttttctcctccatatcccccctttcccttgcacttagcatgtatgtatttttaattttaaaaggagatttctctttctacccccacagct

SEQ ID NO: 266510 - DNA, 405 bp, Homo sapiens
ttttttgagacggagtctcgctctgtcgcccaggctggagtgcagtggcgccatctcggctcactgcaagctccgcctcccaggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggccatatttaatactttttatgtgaagagaaaataagtaaggataaagcaaaaaaattcccaaccaatgttttgctgtttaacgttcctctatttgaagataaacctaaagccaaaaaatg

SEQ ID NO: 266511 - DNA, 375 bp, Homo sapiens
agctgcctcagttgtgacagttctaccagaccataaattaagctattattagtatcagctgttacttattatttaactcagtagtgctgcactgtaattctacaactcttaacttggcaaacatgttgtaatggagccagctgtatgaaagagtctatataaaattaactttactattcttgttattatagtttaggagtcaccctaccaagtgggtatgatgatgaaggtgagctgctaagaaagaggttgagagacagctgatgtttgtttcaagcaaatcttctttaacccgaggcaccaggagcagagggccagtgggtaaaaaggttaagtaggatggaatctacaataaagccaaatgtgtgggttcta

SEQ ID NO: 266512 - DNA, 627 bp, Homo sapiens
gtcagacagggcatggagcctcctgtgagtgccagctgctcgtggctagctgaccctgtggccagaacattagaggagctcccagcagctgcctaggcacctttgtttcagggaacctccctttcttttcctgccgtggcatctgctgcttccaatgctttgctgataaaaagaaagtgacattttgaagaagttgacaaactttggaactgagttgttggtgtgcacccaaccttcctctgcctcttctggggtgttgctggggctctgctctgtttagacttagctgctggcatcaccatttaggcatttttatgcatttgtacttgtgacacactcagggctttgctcacatcgactcaatcatctaggaggacaggttaaaattaagatatgaaatgtggaactctacccagacccgtatggggatttgtttggaagcaagctgtttgtatacatttgtatttgtttgtatttgtggcatcctcagggctttgctcacatccaactctgtcacctggggggccgttttgtgatatttgtgtttgtatgggccctgatctctctctttccccttcttccaacttcatcctcttgattatcttggaagctacccacagccttact

SEQ ID NO: 266513 - DNA, 380 bp, Homo sapiens
ctggctaattttgtatgtttttgttgagatggggtttctccatgttggtcaggttggtctctaactcctgacctcaggtgatctgcccacctcagcctcccaaagtgctgggattacaggcatgagccaccgcgcccagctaaaatgattttaaatgtagtattggtgcttataactgattgtttatagatttagattataattgtcttctattatacttgtttaaactttgtgaagtgatattttatagaaatatatagcatttatatataacacagaatattatgccaatatagaattatatagtattctatactatacattatatatacttctgccgaggtgggcggatcatgaggtcaggagattgacaccatcct

SEQ ID NO: 266514 - DNA, 452 bp, Homo sapiens
ccaaaaggctgtgtttagttttttggcattagactcacatcatctgtgaaaatctttctgcaaatgtctttgcttgcttgtactcacatttttgtaggacattatcctaaaatggttacatttccacttaaaatgattaaggctgggcatggtggctcacacctataatcccaggactttggaagaccaagtcaggcagatcacttgagcccaggagtttgagagtgacctgggcaacacggtgaaaccccatctctacaaaaaattatccgggtgtggtggtgcgctcctgtagtcccagctactcgggaggctgagacgggaggatcgcttgaaccctgggatgtcaaggctgcagtgagctgtgattgcactgctgcactccagcctgggtgacagggagaccctgtttcaaaaaggagaaaaatcagattaaaggaggtgtacattta

SEQ ID NO: 266515 - DNA, 402 bp, Homo sapiens
agataatatatgcaaaatactgtgaaaactactagggcaagtataaggaattatcatctaatttagctggctacagatacccaatggttcatccagaagtttgttccagctaacagcagttgtgcctctttcatgagacttatcatcctttggtggactagactagacttatttggaacatggagacctaagagtttcaagactgaaagcaaatgattaggacatttccctaaggtctaaccccagaagtcatatagctttgctgtgctgtattctttgggtcaaagaaaatcacaaggtcaggccaggttcaagggaaagggaaaatatgctccaccttgtgatggcagatttggaaataatcacatacaaataaaataaaaattaaaacatggtcaagaa

SEQ ID NO: 266516 - DNA, 557 bp, Homo sapiens
  misc_feature (95)..(95): n is a, c, g, or t
tcacggtgaggaagccccgatgctcccgggacgcagacagggtgtgcagggccgtagctcgggcctgtgtatgcacctgtgcgtgtgtgtttgangccaggacaaggcggcggtgtgcgcggcgaggaggctgcgacagctgtatagaccccagctgcagtgaaatggccatcaaaaagggaagggataatcgagtggtggaataaaatctgcaaacagaaaaaggacagacctgttttcggaacgaggcttttcgagttaccaccatgactgaaggctaagagcaacttgcttgcgcattaaagatcacttggagagagaggtccagtgagcaacaacggccagaaatttcagggagaccatcttgaaccatccagcctccaccaggccaacagctgacagctgtcacatgaatatgatcagcagaagaaccactcaggcaagccaagcccaaattgccaagccccccaaataataagctaattgttttttgttttaagccataaacttttgaggtggttatatagcaataaataactgaaacaggtgtttaaatt

SEQ ID NO: 266517 - DNA, 354 bp, Homo sapiens
gagacaaagcttcaggaagtcttgcagctttttctcttccccttttcctgccctgagaccaccatgactgaaggctaagagcaacttgcttgcgcattaaagatcacttggagagagaggtccagtgagcaacaacggccagaaatttcagggagaccatcttgaaccatccagcctccaccaggccaacagctgacagctgtcacatgaatatgatcagcagaagaaccactcaggcaagccaagcccaaattgccaagccccccaaataataagctaattgttttttgttttaagccataaacttttgaggtggttatatagcaataaataactgaaacaggtgtttaaatt

SEQ ID NO: 266518 - DNA, 233 bp, Homo sapiens
gctggcaaggtccaattggaaaagcattcagaagacaagaaggtgaattagcgaagtggaaagagaggttgaatgaaaatgtatacaattttttatgacaaactgggtgtaaatcatagtttatgtataattctaaagacagaggattgatggccctacatcaactttagtgccagagtaaaactaaaggagatgtgtgccactggggtctttcctaaaatacaaagttaaaa

SEQ ID NO: 266519 - DNA, 423 bp, Homo sapiens
aattaacccaattgcctctagagggcaaataattaacagaattgcctccagtttctccatggctttctaaagaggggtcaagacttgctggatgccagatgttttccagggatcccagagaattggtctatggaggcagtgctttactgtattatggaagaggaattaatcacactaattgcttactctgtacttttgcttaatgatacaatataaacaaatacaatgagaaatcattttaaagcaatcaaacgggcttcaagttattaaagctcctgaagaatcaaacattacctccatatatagaattattatactaggtgcaattaatgatttgatttatagatgtttttacataggtttgatatgcaacaagtctaggggtataaaatcaataaaatctgccttctaataagcagtggt

SEQ ID NO: 266520 - DNA, 603 bp, Homo sapiens
tgtgaaatgaggatgggaaagcacctgagtagtgggtggggtagtgagagcatcagtgcctcagaacagcaggcaggacttccttccaattcctgttctgacattcgccctctctacaagcctgagtaagacactgccttatctgtgccttcatttctctctgatacttggtggtactgggttgacttctccctgggggacccgaaaaaagaagtcatctgaaagaattttggtgacagaaaaaaaagtgagactttcatttcatattcactaaaagaaaggaccgtcttcaacatgtgaaaattaaaacagactacatctccaacgctttctatgcccacttcctgggttgcaactttataatctaatagaccttggaaaaggaattattttgcctttcgagggccaggttttctcaaatggatagagacacgtagctgacttcactgaccccaggacccgagtgcctcaagggcacagctacagaacagaaggctccagatcgcccaagtcagggagacgctgaacagccgtgtaccaaaaggtggccagttctcattatttttctcaattaaaataaaccatttattggaaatggaaaaa

SEQ ID NO: 266521 - DNA, 373 bp, Homo sapiens
tgtgaaatgaggatgggaaagcacctgagtagtgggtggggtagtgagagcatcagtgcctcagaacagcaggcaggacttccttccaattcctgttctgacattcgccctctctacaagcctgagtaagacactgccttatctgtgccttcatttctctctgatacttggtggtactgggttgacttctccctgggggacccgaaaaaagaagtcatctgaaagaattttggtgacagaaaaaaaagtgagactttcatttcatattcactaaaagaaaggaccgtcttcaacatgtgaaaattaaaacagactacatctccaacgctttctatgcccacttcccagctggctcagaggggtacggagctcg

SEQ ID NO: 266522 - DNA, 612 bp, Homo sapiens
acaaagaaaagttcaagcttttttgaagtatattcatgactcagccacctttattttgatcatgaaaatgacatcttaggttttctaaatatgattactctgtttagtcgtgatttgttttgtgctttttagcacatactctttgggagggattgtacataatctttgtgttcaatggctgtgttttcatttgtggacatttttaaaatatagcaatgaaagtttcttttttttttcccaaaaagatagttggtggaaattgttcagaagacaattgtatttcatttgggcttctgttttatttcacaaacagcaattaagtgatttttttaaaaaaatacattgcaaaaaatagaactttaactaatatggactttagtgttataattcccaacatttctccttcctcaacaatctagctatatatttctcctgttttttttttaacatggatgatctgcatgttttgtatatagtttttttagcccgagagggctgatataccaccatactcaaataaatttggacaaactcagaagatagtgtcattctcactctacagagacttcaaagcatagaggaaatacttttttttaaagaaagctgtgaatt

SEQ ID NO: 266523 - DNA, 232 bp, Homo sapiens
agaatcaattacaaactaagagagttcagtaaggcatgagaagtggcccctgacagctgagaacaggcattaccaccgggctgctgtcatctcctgttgaacataaacacttaagcagaacacaaacatcaatcaaggccactttatctcactgatggatcaggacaaaacccaaatttctctgtaatcatgtctgaacccaaaagaagacattaaaagtgaccaaacgtgc

SEQ ID NO: 266524 - DNA, 744 bp, Homo sapiens
gagtggaaagctgatctttgattacttattttacttagggctgaggagttcatggacttcgcaaaacctccttgaatctaaattgcatcttctttcctggtttctgggctgatacatgttttttcccatcttatatacccttggtcttttcattggcgattaagactagagaaagttagataccttgtccttttatgctgtcattttgtttaaaggctttctatgtagtaaaactatctatatagacaaaatagagccttgagttgtggtcttgaatttgatcaacatgatttaccacattctgtactggatatttcttcacctgctgctactgtaaaccattttattcttggatcttctgtagagtatattatcacaggtactttttacaggggtgtctaatcttttggcttccctgggcacattgaaagaagaagaattgtcttgggccacacatcaaatacgctaacactaataatagttgatgagctaaaaaaaaaaaaaaaagcaaaaaagtctcataatgttttaagaaagtttatgaacttgtgttgggcctcattcgaagccatcctgggccacaggttggatgaatttaattgacccaaaatcataagggttctactaacagttgtacttaacagtatctgggaagatagaaacagggccatctgccaggtgtggtggctcatgcctgtaatcccagcacctaggaaggccgagtagggtggattacttgaggtc

SEQ ID NO: 266525 - DNA, 473 bp, Homo sapiens
cacagctacttgggatgccgaggcaggagaatcacttgaacccaggaggcggtggttacggtgagccaagatcacaccactgcactgcagcctgattgacaagagcaaaactgtcttaaaacaaaaaaagaaagaaaaagaaaaatctcaaccaagcaagggacactgagtgcagaagcgatgaattaaccacagggaggactaacaaaggctccttggagaacgggacacttgagagcacctcagcagatggttagagaagctcttacattagaaactactgaaggagggaggggtgtccaggcagaggcaatggctgaagcaaaggcgcagagctgggaaaggagaggtgtgtgggagtgctggggcccgtcacccgctgtgcgaggacgccctctgggaaggtcactgagtccaggctgaagagtatggactttatcctccaggcactggctagcccctgaatgtgctag

SEQ ID NO: 266526 - DNA, 537 bp, Homo sapiens
gacagaccaaaggcaatttaattttggttataattgaggatgttgaagaaagcattgaatggaagacattgcagaagaagaaacagcagaaaatcaaggaaaaacttagaataagaacaaaagcagctgtaaagatccaggcctggtggcggggcaccctggtgcgcaggacactgctgcatgcagccctcagggcctggataattcagtgctggtggcggatgacgctgtcgagggtgctggagaagaaacggcaggcagctctgatcgcctacgcaaccagagagagggcagtgatcaagctccagtctttggtccgtatgtggcgtgtccgctggcgatactgccaggtgctcaatgccatctacatcatccagggccactggcaatgccacaactgccagacctgcgctctcctccagggccactgtgtggtcacagccactcacctgcagttccacattgagatcatcaactcctaagggctggcaagaagggcactgtgtctctgtccctattaaaggaaaaacctggaaa

SEQ ID NO: 266527 - DNA, 451 bp, Homo sapiens
tatagtcagtcccctgcttttatctattgtctgctgttatataggacaggcaaaactgggtcaacactgtctctgctgcttactagtttgtgactttaggcaagttaacttctcagagttttaattttattatcttaaaactggagtttataatagttcgtactttatagcattgttgtaaagatgaggtctttttaaaacataacaactagaactactctcaaagttccaaatacaaatgctattttctgtttctagtaattttcctgttaactactcaacatttaggtgactgttatagctgcagaagcacagtacgcttagagctttaggaagtgtcactaataaactatgatatctctaattaaatgtctgtaaattataaatgtctctaataaaaataataaagtaaatcttataacttacaatctaacaaattataagttatatg

SEQ ID NO: 266528 - DNA, 675 bp, Homo sapiens
atcaggctgctttctccaatagtataatgttgataaatcagagcattgttcactcaagaactgtcgattccataaagtcttactttgggttgtctactctgagatcgatggagtacatttgacccaaataagctgtcctgtcttacatatccagactatgctaagttcagaacttctccaaatgccttggagaagctatagtttttgcaaggctgggccttaagagaggatgttgtgctccaggtgttggtatttaaacatctgcaccctttggaaatctctttttgtgttggtgagttgttctataaatatgtttgtctattgtcatttgtaaatactatttactcattcattgttttctgatgaaggaattattaaattactcctaagtatttctttcatttgaaacttattttattattatgtttctagcattttgtgcaatgggttactttatctacttttttttttttgagacagagtctcactctgtcacccaggctggagtgcagtggcatgattacagctcactgcagtctaggcctcctgggcttaagctcttcatgcctcagcctcctgagtagttgggaccacaagtgtatgccatcatgctggactaattttttttttttccccatagagatggtatctgcctatgtcgcccaggctggtctc

SEQ ID NO: 266529 - DNA, 1685 bp, Homo sapiens
gtgggtaccctttaagagcctagctcagtaccaccaaccttaggatagctctccttgatgagttccattttctgatgactatgtttattactcagtacattctgtgtacagttggcactttgtggatttggacttaacttctcttatttgtacattgcacaaacttaagtctgttttgcctgtgtctcctaactcctcaagattgtatgtttcctaaggacaagaaccatgcctgcaccttaatatatgcctcaaatgtcaaagcatttctctgtaccagtaaatagttgttaactgttgataagggtaaatatggtcataaatacaaagatctctgagtcatttgggaagcatattaagtataagtccattttatactggataagcagacttttcatagaggtgaagatcccctaaaagtcatgattttaagatgtgacacagagacacttgggtttttaaaaatgtgcagagacattcatactaaactgccccctaggatttatttagtttcattcttaattatctacaggtgatatactgggcagtctgactttttacttcccatggaccttatcagcatctctgctaacccctactcctgagtgcaatcttgtagttcaacaatagctaggaggaaaagcctttgaaaacaaatccatgccttgccttttgtttctttccccaccttgtgaaggaatgaagtaggacttaggagaacagctccctttggatccctctcaaaggtgataccattggctcccagcttagagtaagaagctctgagaagttgaatgaagggtgagatagagatgctgaacccattcttccagcttcttctagtgttgttatttccagaatggccaacacccctacattgatacataaacacattccaaggccttgtgtaatacaaagttcaccgtcctcctggaataggagccctgggttctagttctcactctgccactgggggaaaatccaattaaagtctggtttagtcagcttgggtcaccatagactgggtggcttaaacagcagacatttatttctggtagtttctggaggctacaaatctaagagcaaggtgccagcatggtcacattctggtgagggccctcttcctggcttgtagacggctgccttctcaccgtgtgctcacatagcctttcgtgtggtgtgtgtgttgtgtgtgtgcgtgcgtgcaagcttcctgatgtctcttcttagaaggaccaccaaccccatcatgagagccctactctcatgacttagcctaaccctaattaccctccaaaggccccatctccaaatgccatcacattggagggtagagcttcaacatagggattttgggggacacaaacattcagtccataacaaaggctgtagtccttagtttccttgtctgtgaaatgagagtgttgagattctttctagcctttatcatttataattctgtgagatgtagatttgcattattttcgagttcgagttatatgaaatgtttccctctacattttcttgggcaactgagaactgaatagggctaggtttaaatagagttaggcagttaggcttattcttttatttaataagcatttttggagcatctacggtgttccaggaactgaactgttgtaaacattggagctgtaacagagaacaaaagagacaaaaaaaaa

SEQ ID NO: 266530 - DNA, 531 bp, Homo sapiens
gacatagtctcactccgtcgtccaggctggagtgcagtggcgcgaccttggctcactgcaacctatgcctcctgggttcaagcgattctcctgcctcagcctcccaagtagctgggactataggcacatgctaccacgcctggctaattttttgtatttttagtagagatggggtttcactgtgttagccaggatggtctcaatctcctgacctcatgatccgcccgcctcagcctcccaaagtgctgggattacgggagtgagccaccatgcccagcgatgtttagatgtttttgcggaagcaaaagtttcttgccctaaagctttagaactccattaggtattgaagatgactctttggggctataaaataaaatgcagtaaacatactagttttatattgcatgcaaagtccaaatagttgagaaatgtcctctattagatttcacaaaacagaaagaattctgagccaggcacaatggctcatgcctgcaatcctagcacaagagactgaggtgggagagaatcact

SEQ ID NO: 266531 - DNA, 586 bp, Homo sapiens
gaattaccttaagtagtcaaatttacagaaacaaagtagaatggtggttcccaggggctgggagaggcggggaatggatgtgtttggtgttgcttaatgggtacaaagtttctgatttgcaagatgaaaaagttctggagatggatggtggtgatgattgcacaacagtgtgaatgtacttaataccactgaactgtacacttaaaaatcgttaaaatcgtagaaataaacaaatgcagctcatatttaaagggaaaaaaatttcaaattaaccatcatatcacagatctcttcagaattaaagggatgctttatatgttaggtattttgtacgtttgttctggtttgtccagttgcagagagaaatacacaaatatgtcaacattgcttaaatgctaagcagttatggggaacattttgtaagaacagatacaatattggttaaattccatgagggggttgagtgagaactaaggaaatttgaaattcgagcttgaaatctccatttggatgtagaattgatatctcaaatttgaaatgttctaaactgaattcatgattgccccaccccaaaatcaaaacagag

SEQ ID NO: 266532 - DNA, 489 bp, Homo sapiens
ctctgcactggaacaggagattcagatttacagtgaagtaccattaaaattaactccacagttctttagtggtatacttttctgtggtatagaagccagcagtatctgacacttaaaagtacttttattttattgaacagattttttaaaatacattgacattgtataaaatttgaaagttttacaaaggtactcagtgggccgggtgcagtggctcacgcctgtaatcccagcactttgggaggccgaggcgggtggatcacagcgtcaggagatcgagaccatcctggctaacacggtgaaaccccgtctctactaaaaatacaaaaaattagccgcccgtggtggcgggcgcctgtactcccagctactcaggaggctgaggcaggaggatgatttgaacccgggaggcggaggttgcaatgagctgagatcgctccactgcactccagcctgggcgaaagtgcgagacgccgtctcaaaaaaaaa

SEQ ID NO: 266533 - DNA, 431 bp, Homo sapiens
ccgccttggcctctcaaagtgcgtgggtaagccaccgctcccggcccaacatatcacttctttaagaatcttagccttgcaagttttaggtgtattttggtaacttgtagctacttcaaaataattatggaagcattttagtcatatatatgttttttttcctgagggaatgtccagaatttgttccacaggcaccatccttagggatgatatctctgatagttttcctggtcttcaaattctagcaaaatgtacacattggtggtactgtcttcaacatgcggagctaccatggagttaattaatttccgaattcctccaagaatcaaaacaaagacatggacaatgataaaacttgtcacaaggtgctgcttaactgatcactaaactcggggtaccagaatattgaacaaaagtatgaactaggaaaa

SEQ ID NO: 266534 - DNA, 291 bp, Homo sapiens
ccaagatccatggaggctcctgtgactcagatcaactgccctgcccgggaaacctggtctctccggaaaccttgattaaactgctttttctgacacctcttcctctacaacccttgattctatcaccattgaaacttcagaaccaactctaaccatccccacctccaggtgaggggactaatgagaattactgacagcctgatggctacccccaagtcagtttcccttcatactttactacaaatctgaccatgttcccatatttactgagtaaatttgatgaaatttacc

SEQ ID NO: 266535 - DNA, 573 bp, Homo sapiens
tgctgccgctgccaccaccaccacgaccgctgccccagaagagctacaggtaggtttagcaaagcttgtagattatcgacccactctgataatctacaagggagacagacctgagaactccaacctggaagaacctctcaacatcagacttcataaaaaagactctgagagaaagatacctcaccaatttctcagggtgaaaaacactttgcttggaaatcacaacttactgagcaccaaaagattcattcagcagaggaacctcacatgtgttgtggcttgagagaagctttcttagttcagacctttatagacactaacatttccacacaagggagaaaccctaaaatgtgctacattttatgaaaagcattttgacagtgtgttttcagaattgtaagatatttctccccagtgatcaagaaattcctcatctgataaactattccgaggggaaaacaaaagagcaaaacaaaattaaatctttatttatacactcacacacacagagaacctccagtgactcagtgactctctattgcactgataataaagcaataaaccactctacag

SEQ ID NO: 266536 - DNA, 461 bp, Homo sapiens
aaatacttaacattgtgttacaattgtctgcagtattcactatagtaacatgctgtacagacttgtagcctaggagcaatgggctatagcatatagcctagatataggctataccatctaggtttgtttaggtacattttatggttttcccacaaggaagaaataacctaacaacacatttctcacaatgtatgcctgtcatttagtgatgcatgactgtatttattctgagaacaaaaggcttggtgcaaatgaacctttgaagcaagtctgaattataagaataagatagtcaaggataaaataacagtgttcaagtagttcaggtgcttcagtatcagaaacaaatttattatggatgaatcttccttaggaaaaccactggttgtgtaagatgaagttctgtgtatgacggtggaagaatagccataggccagtatccatgaactgttgcctgcacg

SEQ ID NO: 266537 - DNA, 400 bp, Homo sapiens
acaaatgttgactgaagatagataaaactctaattaaaaatttaaaaggttaaacactgtattagaatgggcaactaaaatattcgtggtgtcagtttaattagtgtcaaactggcaagtcagagttttacaacctactagtaatctatgccgggtcttgttgtttgtgcactgtgttttgctttgctttgttttggtttttaaacagacttacctgtaaagttatcttacggaattattctttctccatatcttttaaggaattattctttctccatatcatcttttaattcctgttattagttttggaagcttatccataagtttccaaagacaagatgatataaaagttaaaaagcattcctctttacttatatcaaattattcttgtctttcaaaa

SEQ ID NO: 266538 - DNA, 519 bp, Homo sapiens
ataaccaaaaatgtaaatgttctatcagaaagggaaggaagaagtaaaaaagcttgttttccagaagaaattagaaaagagcgatgacatgatatatatatacccacatttgacccttaagacgaacacacaccaagcatacgggaagaagctagaaatttgaatcactttaataaatatatatggcatatcaattctgcacaaaactgcattaactggtacaatgacacccaaatgaatgtacaccatatactatccccagggcctcacagggataaagaagaggagtgtacatatgcttaatgatcaaaagaaaagagataatccaacctgaacaacaactacagttgaaactaaggggaagagaatctgacatagataacaccacacagaagcaaaggaagtcaaggaactcacattcactgcttgcccactatttgccagtcactctgttggctggccaccttcatttcaatgctacagataagcagcagggtggggagagcagggatggacaag

SEQ ID NO: 266539 - DNA, 373 bp, Homo sapiens
aattgattcctttgaggcaactcaaaaaattaaatccaacagcataagaaaaacagaagaaatagagttaaaggagaaaattaaaataagataaaacaaggcttgggtgaggaccacacccataccccatgctctaaagcctgtactcttgctagaaatgggcttagttgtggctctggctttttagcagccaaaacacaaaggaaagtgagacctggtgcccaatccacatgggtcacagtgaaaccaacaagaagctcagaggtgtggcctgagagtgatttgtcccaagggctcagactgaaagaatgcaatgtgagaggtatgccacatcttcataaataaagcacaatccatatgcctacaaagtctg

SEQ ID NO: 266540 - DNA, 340 bp, Homo sapiens
aattctttctgaatacgtcagtatttatatttattagatcttactgttcaataagtcattcaaatcatgatcaaaagtcgttattttattattaaatacaaatatttaagttgggttttttcttatactagcttaaaattttattctattccatcaaaagctatcatgctcagttttctcacgatcatactcaaatttcaatactatcataacttatttctctgaattatatacatatggtttattttaatgatttgtggcatttaatgaatgttatacagttgttcattgttatttcagaacaatgtaagtttagaaaattaaaatgttcaaaagttta

SEQ ID NO: 266541 - DNA, 473 bp, Homo sapiens
gcaagctggaggagcctgagctaaatgcccagatcagacaggaagaaatagagaggtctttcagaaagttctcagaatggcagacaggaataaagggagaactggaggcttcatggagtagcactgtagagagagggaaaccctggggctgaacacagagaagtatgacttcagaaaagcacgatcctggtgagaagagaccctaatctcttgctctcatctttctttctttctttctttccttccttcctttctccttccttcttctctacttttctccctccctccctttcaatcgcactcatacacacacacacacaaatgtctaatacatatctttctttctttcatgaaattccatgtgctatgtaatatagaccctctctggccaactataaatcatcagtaaagtctacatttttcacgaatgcctgtagtgtgagttttctttttaagggatacaagaaaatcct

SEQ ID NO: 266542 - DNA, 413 bp, Homo sapiens
cagatatcaagtattactagaaactgtaaaaattaaggtagcatagaactgtcacagaacaaactaaaaacacagaataggaagcccagaaacacatccaaacatatatggacactagatttagacagaaccagtgctgtagagccttgagaagaaatagatggacaataaataggactgggatgaccggttatctacatagaataacataagttaattggactgctgcatcacagtatgagcaaaaaattacctctagctggattaaatacagaaatggaaaatgcaaaactataaaactttcggcaaaataattttttggctttgaattaaggaagattgcctctgtgtacaaagcataaagggaatgattgataaatatgaatttattaagattcaaaacttgtgttctt

SEQ ID NO: 266543 - DNA, 724 bp, Homo sapiens
gaaaataagagccacaagggaagaggatatgaactgcaggaacacaaatgtccagtgcagtgaaaagtagtgtcttggcaaccccagggggccctgagaacatcattgagtgagaaggaaaattaagacacaccctcatgaagggcacggaacacctgctaagccccggtggaagcagcagcatgctgcagtctctgcctccagcagccccagcccagagtttctcctaagtgaggccacctgcagatcccacaataccatgagtcggagcctggcaggacatcaggagaatgttccctcctttagtcttggggctgggggctaaggtgttaggactgtgttgtattgaaagatgtggagacaacataaggggtcacctgggtgtgctgtgaaaacgttgctgcttatttagttagtatgggacaggggtgagttctacatttctcaagctcccaggtgatgtgatgctgctggtccatgggccacattttcagttgctaccacagaggtggcataacttccctaaattatccccgaaggggccaggtacccacctcctaataagggaatcgagtttaggcccccatggaaggaactggaaaggaggcctgaagcatggaaaagcagatgcctcggcgtcagggacaagaggtgccagcctgggaagggtctcgcccgcctgcaagcatccagaaggagcagatccactccaaagaataataat

SEQ ID NO: 266544 - DNA, 687 bp, Homo sapiens
acaaaacaaaaaactgaaacaacgtgaacatctatagtaggaattgacaatactctcatggcggactagtctccatttagggcagcagtccccaatctttttggcaccagggactggttttgtggcagataattttccatggatgagggtgggggacagtttcaggatgattcaagcacatgacatttattgtgtactttattcctatccttattacactgtaatatatcatgaaataattatagaactcaccatcatgtagaatcagtgggagtcctaagcttgttttcccgcaactaaacggtctcatgtgggggtgatgggagatggtgacagatcatcgggcattagattctcaggagcatgcaacctagatccctcgtgtgcacagttcacaatagggttcaagttcctatgagaatctaatgctgctgctgacctgataggaggcagagctcaggcgataatgcaactgatgggaagcagctgtcaatacagatgaagcttcgctcactcacctgccactcacctcctgctgtgtggcctagttcctaacaggacatggtctgtggccgaggggttgaggactcctgatttaggaaaacactacaacagacagctctgaaaagcttcgtaagaaagaggcagcacactgggtgatttataggtacaaatatgatccaactg

SEQ ID NO: 266545 - DNA, 723 bp, Homo sapiens
tgagatgaacccggtacctcagatggaaatgcagaaatcacccgtcttctgcgtcgctcacgctgggagctgtagattcggccatcttggctcctccccgactttgtttttcgattgttttgtcccttgagattttatcttagtttgacgtggattttttttcatagaatcattgcccaggtaattttttaatttctaaaaagaaatcattgagattttgatagacattatgtcaaatctgtagatcccttttggtaatattgacttcttaacaatattatatcttccaatctatgaacatggattggaaaggatattctacttaagggtgtcttccttaatttctttcaccaaaatttgtagtttgcagtgaacaagtcttttgcctctaaggttattcctaagtattttatccctttgatgctattgtaaataaaattttgttcttaatttccttcttggattgtttgttgttagtgcatagaaagacaactgatatttgcatgttgattttatatcttgtaactttgctaaattggtttattagtttcaacactgtttttgttgggatttttagggttttctacctataagaccaagttgtctgtgaacagagataattttacttcttcctttccaacttggatgccttttatttcttttccttgcctaatttctctggctaagacttctagtactatgttgaatagagtgataaaaaga

SEQ ID NO: 266546 - DNA, 376 bp, Homo sapiens
gttgaatttcaaagataaatatttattgatgtaattaattacttatacatagtattaatacttaattcagagggcagttcatgactaataaaaaaaagagttggctattagatggtcatttaggagcaattccttccaaatagcaaattttgctaatttcaaggctaaggcacatgcatttttaaatgagattttcaaagaaagttaaaacagcacttgaattaagtagaggtgattgaagtgataatcaagtaaaacctttatcaagaaaataaaattgacccatcccccacacattccacctacccaactaattttttgtagtttttagtattccaaaaagttgtacaatactcacaactacctaactccagaa

SEQ ID NO: 266547 - DNA, 488 bp, Homo sapiens
actatatctctttttattcacaacactatattctcagtgcttagaatgaggcctgacagactctcaatgagtatttattgaatgaataaatgtgtgagtaaatgaataagtaacatctgatctaaaaccagagccagattctttctgaccttcagcctaataatactttacttactataacctggagattcccattttgtaatgtcccctctatgaggcttgtcttaacaggtagatatgaacgaattgaagacacccacaatgccagctattgttttctatggcaacactgcccatctcagtgctggttcctggggcacatgacaagaatatctggttgagtccacaggagacagacctcatgggaagatgacacgatcatgaagcctgctcatctcctctactgtccagtgaacttgggcaaagtcactttaactctttggactttaatttcttgtttattaaacaagtgaatatcaaaaaaaaat

SEQ ID NO: 266548 - DNA, 320 bp, Homo sapiens
acaatgctctttgaaacaaaaggctgtccatggaggccaacagccttcttgtttcaagcaacatttgctccaaacaaaatttcagtgtgaattttttaaaaaagcagggcactcctggagagctcactgttaacaagaagcaatctgggccccgagagggctgggctgcacgctgcctccttgcatgcacttacctgcgttcagaagtccagcgacccactgatcaggcatcagctcactgctcccagctcccacccatgccccctctgcagcatggagcccaggccaggctgaggacccagccatggttaaccatttcc

SEQ ID NO: 266549 - DNA, 384 bp, Homo sapiens
ttggagaagcaggagggcattggcttaaccaagccgaaggctgctggctgggctgcctagcccagctaagatcttccttcagcccacctcaggatccgggcttgagggctgcagggcctgcgtgcgctccctcccccgaaatcacttctcagggcaaaggagccccaggcatctcatgctttgcccttcttagggctcaggttcttgccttagcacatagcttctgggagcttttttgaagcatttcataagggccaaggaagtggggcagggcttttctgatccaaagaaaacaaagtttctctggttacccctcttcccttgttatctaagctttcctcagttgtcatctcttcccagctctttggtccaagagggggctga

SEQ ID NO: 266550 - DNA, 538 bp, Homo sapiens
tcatcattttttcctgagctttcaggttctcctcagctcctgatacttaaataattcccatttaaaaagcatttaattgagaggagcctggaaactcaccagctcagagaaaaattcagtccatcaagaggttctgagagtctttgggtttaagtctttctgatcttttactcctcaatcctctaatcctttttgtgaggaatctttcacaatccttgtttttagttcttatttctcaagtttccctttgaaaagcaggattcccatcacatctcaaaggtgaaggcagcataaagcctgcttccaacaacactactgcggttacataaagacacgagtcatttctgctgctggaggctccagtggagtgttcccttggatttgctcatttctttgcttggtcctccctgtgatcttagaggattgcagtatttatgaacatcatcttgttactttccatttagtacatttctgcctagtcattggtttttaattttgtcctcgtaccctccatttacaaacagaaatgtttaactaa

SEQ ID NO: 266551 - DNA, 285 bp, Homo sapiens
aaagttgttaagtattcatttgaaaacatagcatttagtacctattaatttgcgaagacctctgctatttgatttattttgaattatacctcttcaacaccctgaactccaataattctttgatctcaaaaggatctacaactcactattgatcttgcctacccttcaatgttcattatccttcttaagccttcactccgaccttattcagcttatatttccagttcagctttagaatcacttattgggatatctctatattcccttgtacatgtacctgccacc

SEQ ID NO: 266552 - DNA, 399 bp, Homo sapiens
tatcattgataattatgaccaaatgtttgttgaataccaaccatatatcagatggtaccaggtgcttggaatccattatctcaaaatgtaaccactcactgaagtaggccttgttatcatcccaattttaagaaagaggaaagtgagaatgcagaaagttttttcatcatggccacataatggtgtacaaagcctggtcacagtccagagccacttcaactgctgcattctgacattttacatttatatgccacctatgtcacatagttaatatctagatataagcagtatgattctgttctgtgtttctgagctaacatgagtgttatgccatactttccatctgtccctgcattttcaccttacagtattatcttatggctcatctgtcaccttttg

SEQ ID NO: 266553 - DNA, 81 bp, Homo sapiens
atgtctgagatttagcatgcatccttgtatttgcaaataaggaagaaattgacaatctgatgtctccagtacaaaaaaaaa

SEQ ID NO: 266554 - DNA, 194 bp, Homo sapiens
ctgccaacacaatatgaagttaataccagtgtgagacaggcacagtcagtgtcacttcagtaaccagaaaatagctactttgaaccttattactcgtttatgcctcctatattaaaatgtttcaattaaacaatcatttactggacccctatttgcaaagtaccatatttgtgacatcactgagcaaatactaa

SEQ ID NO: 266555 - DNA, 313 bp, Homo sapiens
ttcatgcgaatactaatatcattaaacattcattccaaaaggaaatgtgatgataaaatgttaacatatctccatgaggggtacatttgaactccgtactgtttttgcaactgttctgtaagtttgaaactacttcaaaataattttatttaaagttacattctctttaattaccttctcttccatgcaaccaggttcactaggcagcagccatacctcagtcaataagagaggacaatctctgcccttgttgagtttatatcctagcaggcaagggcaaatattaatcaacacaataaatatgaaaattgtc

SEQ ID NO: 266556 - DNA, 724 bp, Homo sapiens
taaattatatatgtgtttgtctctataaatatgtccccaactttgctcctggcttatcttccatattttttggctgaatttcagtggttgtcttatcttgtgaggatgaatagtcattgaaataatcttaatttcacaatgagtttaattataaatctatacttcctttgtgtgagagaaaatcttttgtgaacaaaatttaatttttggaaagctttataagtccatatttttccttttaaaaactgcgattgtggtaaaaacacataatgtaaaatttaccattttaattctttttaagtgtatatttcattagcgttaagtacattcacatagttatgcaaaagatctgtagaacttctatgtcttgcaaaactaacattaaatgtcttttaagacaattgcccattttaccatctcttcagtccttgacaaacaccattctaactatttttttcctatgagtttgtctacttaagatacctgattatgaatggaatcatagactgtcactttgttcctggcttatttcagttaacgtgatattctcaagaataatcatataatgtgactttttaaagactgaataatattcgactttgtgtatgtgccacttgttattaatctcttcattggtcaagggacagctgggttgtttctgccttttggcttgtgttagtaatgctgcaataaatttgggtgtgcaaatatctcttccggatca

SEQ ID NO: 266557 - DNA, 389 bp, Homo sapiens
ctgaataagctcttcaggtgggccttttctgaccacccaatctaaagtaaccccctgtaattccctcatatcaccttggattttcttttttatgattacttttaccagtactcattttcttgttttgttttggtctctttttctcactagtctcatctccgtaagaggaaatgatgtctattcatttcaaccagtgtcttttcagtaaagaatgccttttatatgctaggtactcaacaaacattgaattaatgaattattgagcttgatgccaattccatgcaagattgtcgactagattaaaaggatggtttgtgagcataattagacatccctgaaagtcccccaaactcatacttgagtttgctaagaccacgtgtcaaactaat

SEQ ID NO: 266558 - DNA, 406 bp, Homo sapiens
tagttgaggtcaacaaagggatcattgatggcaacaatatccactttgccagagttaaaagcagccctggtgaccaggtgaccagtacaactaaattcatttaccctggccttcaccttcaccatggtgtcccaggggtgcagctggccctgcacaagaagatgctgttgtcaaacgggaggagcagaaagcctaattttcaaaatatttatttgaaaaattgttttatacattggtggactttagactgttttatattaaaatacataaatacatgaataaatttatgctaataaatttgacaactgaaatgacatttcttgagagacataaacaaccaaagctcacccaggaagaaaaagataactggagtagtcctatgtcttttaaagaaatttaattaatg

SEQ ID NO: 266559 - DNA, 445 bp, Homo sapiens
actctgaatattggatgggtttagacttaaatagatccttgctattcaaataaatcagaaattacagcacagcatgattcaacatgtggtctctgtaccaaccaaatagggatctccaagcagctttatagaaatgtcaaatctcagcctgtaaataagaatctgcattcacacaacattcccagatgattcttaaattcagtaaaaattgaacagtactgctctagtgaggagtcgtttcattctgttattctaaatcatgtttataactagcaatacatttttaacagaaaccatgtaagaaatggtagttaggagttcagtccagcccctgggggtttaaatgcttcataatttgaaatattctgtgagatctaatgttgaggttccaggtggggcagtaactgttgcaatgaagaagagttgtgtcttgtttagagaagag

SEQ ID NO: 266560 - DNA, 400 bp, Homo sapiens
tagcccactgtggtgttagttggtttccctcgtgagaaatgttgagtgcttttcaggtgcttctttgccatctgtctgcctcctctgatgccttgtcccagtctcctgcctgtgtttccttaggccgcttgcgctttgctttgttttgttttgagagttctttctatattctggagatagtcctttatcagatatgtgatttgcaaatactgcctccaagtctgcagcttatcattttttaatgcatatcccttaatctaaataaaagagagggggaccaggtgcagtggctcatgcctgtaatcccagcactttggcaggtggaagcaggaggatcatttgagcccaggagttcaagaccagcctgagcaatatagagacaacctgcctctataataaa

SEQ ID NO: 266561 - DNA, 460 bp, Homo sapiens
ttttcttttttggcaagaacattttattttattcaaactattttttttaatttaatttaagttctgggatacatgtggaggacatgcaggtttgttacaaaggtaaacatgtgccatggtggtttgctgcacctatcaaatcatcacctagatattaagccctgcacgcattagctatttatcttcttctttttttttttttttttttttcagatggagtttcgctcttattgcccaggctggactgctgtggcacaatcttggctcactgcaaccccctcctgggttcaggtgattctcctgcctcagcctcccacgtagccaggactacaggcatgtaccaccacacctggctaattttgtatgtttagtagagacaggggaaatggaaatttcagtttgggaaactcaatgtgtagttttaacctaacataagtatgtcaaatactaaaatgttacc

SEQ ID NO: 266562 - DNA, 304 bp, Homo sapiens
agagttgtaagtcaatatttgtaataggtgccgtgggccctgccgaagtccctctggccttacaccttctgtgggcttcatctgactgtgtctgcaccttgtggcctgtggggtaataacacattctgggagcagctgtcaaccaatcatcgatgggaatttgataaacaccaaattctccatctccccatgtgtggaaaactctgaagcatgtgttttagtttccagaggttccccatgaattgcacacaggcactcacccaaggtagatacctcattgggtgacttcccttctgtctcttcc

SEQ ID NO: 266563 - DNA, 744 bp, Homo sapiens
atacagagcaataattgcagaaaagatatttcaaactaagagcttcaataactgcaggggcacaggtctatctttttttataccacataaccttatgccagtttaggttgactgagtagctatgtcctcaaatttcatgtatgataccccccagcaaagatggatttaattgtgcagaattgatatatatgtgtgttccagttactaatttaaagtgtatagaatattttaatatataatttttgtaaagaactgggatttttatactacagtatttgtaattaatgtgtctcactaattaagtttctcttgaagaaaatatgcaaattgttagacacataatgagtggtttccaaactctaaagataaaataaatgcactactatggtgttgttagaataccttttttgtggctgtatgaatctttactctttaaatgtgtactttacaatgtttacaaggagcttctctggtttgttatcccagcaatgcccttggtgagagcttcattctgcatttgtttaattcatatgctttgcttttggcatatgcttgctttttgcactagtagaattttaacttacctcattattatgtttgtaatcatttgtctagcttctgtaatgtatctgatataggctaaacaaatacttaaccaaagttaaaatacatggtaagcaattttgcacatattaaatattagggtttgttgtgtatatgtgtatacttaattataaaagaata

SEQ ID NO: 266564 - DNA, 384 bp, Homo sapiens
atttgaaatcaatggaatattaaagaaagtgactgtgcatttttactgccatacagtataacaaagtagtacagcctgctttaagttaatttcagtatttaagaatgtgaattaaaacaactcagaaaagtgaatttgaaaagagcacacgaggatagcactgatgctgcctgcatcagtaaatgaaatttgcaatgattttgtctggaatattatactagcatcaacttccaaatgtgtccagggtgtttctggaattttaccctgtgcccttagcttttactctgatgccatctccactggcctctcatataatatggtttctgactcatttacttttcattattgcggatgtgcaattgtccaatatgtccctggtttcag

SEQ ID NO: 266565 - DNA, 383 bp, Homo sapiens
gccgtcgcccagcgtctggcccaagacggggcccacgtggtagtcagccgccggaagcagcagaatgtggaccaggcagtggccacgctgcagggggaggggctgagcatgacgggcactgtgtgccatgtggggaagatgaaggactgggagcggctggtggccacagtgagctgcagggaaatgggcacagagccaggaggtggaaaagggagccagcctgagcctccttccctgctttcctggacagcattggtgagatccaacgcagtgatgttaactaaaacataacagtgtgttctgcatacccaaccagcccaccagcacgtttttattgtgtgcctttctattatgtccatatattaaagttggagaataatccc

SEQ ID NO: 266566 - DNA, 349 bp, Homo sapiens
attaaagtattaatcatagcattaatcgtatgcatagatcagatcaggggctggaaaactgtggcctatgggccaatctggttgtcacctacttttttaaataaagttttattgaaacatgcccaggcacattcatattcatattgtctatggatgcttttgcactagaatggtagttaaatcattgtgatagaggctgtattaattgcaatgcttaaaatagttactaacgagccctctacagaaaaagtttgccatccctgacacagattagcactgtccaacagaaatacagtatgaaccacatatgtaattttaaattttctagtacacattttttaaaagtaaa

SEQ ID NO: 266567 - DNA, 483 bp, Homo sapiens
gtcataagcaggctgtaagtgtagcgtgttacttaggagtgagttggatgtacttatttttatcatatacagtgttttcataaattgaccattatatataagacactacatcaaaatgtgctttgaatctttcaaagcctgttattgtttgtaacttttgcaggagggctattagttcattatttagaggtcaatttttctgtttttaatgtattctcttaaacagtgattggtatgtacaccacagtcaggtatgtacaatttaattaaacaaccactactggccttaatgattttaatagtttgaggtggtttttgtttgtttgttttcatttttgatacagcttttttttctagtacagtgcatcatgggcctgtgtatgattcagtgagatttctaaatcttaagatttcaacacaatgtagtactttctgttcatgctgtaaaaagtatttctgtattttaaataaagaataaaattt

SEQ ID NO: 266568 - DNA, 436 bp, Homo sapiens
cttctgcagtcccagaggagttagataaattcaacagggatttataataattgcatgcctactttgtatctagccctgtgatcacgaaaatgggcaatcagagattcggaagaaagatgaactaaggcgtcctttgacaaaggtgtgatcttaaagttggacagtgtgtaatgagaggaggaaataaattcctcactgtggtgaagggttaaacattttttaataaatctaataaaggattcacatacattatttcttttaatatttgcaatcgccctatgaatagatactaatatctccattttccagatgaggaaaccaaggctcagaggttacacggcttcccccaaagtctgacacttgatagagtcaggatttaaacctctgattctgaaggccatgttatgagattgtaccttatatcttgagggctatt

SEQ ID NO: 266569 - DNA, 819 bp, Homo sapiens
ttcaggaccgttggcaccgggctaacggttccaccacgtccgccgccctggacgcccgcggcctgcccccccctgcctctcctgcgccgatacacttcgagtggattctggccatttgagcattctctccaactctccaatccccagtctgcccccacgggggtctcccccactctcccccgtcccacagcctaaacccctcttcgccctgaacctcccttttcctcatgcggtgaatgggcactggccccgctcagactcccaggagcaccagagctggccctgagccaagccctgccccaccaggacctggggacacgggtgactcagacgtgactcaggaaggctcaggtcctgctggcatccgcggagccccaccagcatgggcagcctcggccagagagaagatctccaagatgaggacaggaactcagcattcacctggaaggtccaggccaacaaccgtgcctacaacgggcagttcaaggagaaggtgatcctgtgctggcaaaggaagaaatacaagaccaatgtcatccgcacggccaagtacaacttctactcgttcctgccgctgaacctgtacgagcagttccaccgcgtgtccaacctgttcttcctcatcatcatcatcctgcagagcattcccgacatctccacgctgccctggttctcgctcagtacccctatggtctgcctcctcttcatccgtgccacccgggacctggtggacgacatggggagacacaagagtgacagagccatcaacaacagaccctgccagattctgatggggaagaggtgaggctggggctgcag

SEQ ID NO: 266570 - DNA, 1049 bp, Homo sapiens
ttcaggaccgttggcaccgggctaacggttccaccacgtccgccgccctggacgcccgcggcctgcccccccctgcctctcctgcgccggtgagcggcgggtgctcccactgctgtgcgtccccgggagcccgcgcaccctctctgggctccacccaggctgagagctggggtcgtggcggcgggggtggagagcgcgcccctagagatacacttcgagtggattctggccatttgagcattctctccaactctccaatccccagtctgcccccacgggggtctcccccactctcccccgtcccacagcctaaacccctcttcgccctgaacctcccttttcctcatgcggtgaatgggcactggccccgctcagactcccaggagcaccagagctggccctgagccaagccctgccccaccaggacctggggacacgggtgactcagacgtgactcaggaaggctcaggtcctgctggcatccgcggaggtgagacggtgatcagagctgggatgggagactccccaggcagaggggcacctgagaggaggcacaaggcccagcctggccgggctaggaagtatgaatggagaccagaaggccccaccagcatgggcagcctcggccagagagaagatctccaagatgaggacaggaactcagcattcacctggaaggtccaggccaacaaccgtgcctacaacgggcagttcaaggagaaggtgatcctgtgctggcaaaggaagaaatacaagaccaatgtcatccgcacggccaagtacaacttctactcgttcctgccgctgaacctgtacgagcagttccaccgcgtgtccaacctgttcttcctcatcatcatcatcctgcagagcattcccgacatctccacgctgccctggttctcgctcagtacccctatggtctgcctcctcttcatccgtgccacccgggacctggtggacgacatggggagacacaagagtgacagagccatcaacaacagaccctgccagattctgatggggaagaggtgaggctggggctgcag

SEQ ID NO: 266571 - DNA, 304 bp, Homo sapiens
cccagaagcacagctgcctagttgacaggctcagctgagaccagaagaatggccccaccaagcccagcctaaatggctgaccatcacaattatgagctaagaagttttggatggtttgttatgctgtaagagctaactaatacgtgcacccagtgcagataggatgccaaaaattaatggcaagttgattactaattacgttctaacagtgggcaccctaaaagtgctgacttttttcccctgatttaaagttagatgttttgtaatactgagaaatgaataaatacatgtagacatgaaaaaa

SEQ ID NO: 266572 - DNA, 347 bp, Homo sapiens
agagtaaatcagaaaatactgtaaagaagtgaaatacacagatcagctagattttgctgctttctattaacagctgttttgcaatataattcatgtactgtaaaatccagctttttaaagtacacagttctctggtttttaatatgtttacagagttgtacaaccatcaacactataattttagaacattttcaaaatgttcaaaacatcccccaaacaaaccttatacccattagcagtcattccccatcacctctccttatgccataggcaagcactaaaaagctttctgtctttatggaattgcctgttgtgaacatttcatatatatggaatcatacaatatg

SEQ ID NO: 266573 - DNA, 330 bp, Homo sapiens
ttgcactctaacttattttttcccaatcctttattgaaaagcacatttgagccaggcgcagtggctcacacctgtaatcccagctctttgggaggccgaggcgggcggatcacaaggtcaggagttccagactagcctggccaacatggtgaaaccccgtctctactaaaaatacaaaaattagctgggcatggtggcaggcgcctgtaatcccagctactcgggaggctgaggcaggagaatcgtttgaacccaggaggtggaggttgcagtgagctgagataccgccattgcactctagcctgggcgacagggcgagactccacctca

SEQ ID NO: 266574 - DNA, 446 bp, Homo sapiens
caaagtgagaccctgtctcaaaccacaaaaacaataacaacaacaacaacaaacaactttgcatcaggccgggcacagtggctcacgcctgtaatcctagcactttgggaggccgaggtgggcagattgcctgagctcaggaattcaaaaccaccctgggcaacattgtgaaaccccatctctactaaaaataaaaaaattagccgggcgtgatgacatgtgcctgtagtcccagctactcgggagaccgaggtggaaggatcatttgagcccaggaggttgaggctgcagtgagctgtgatcacagagcaccttaggggcacagaacagggcatacttcatattttctcttgtattaaaattattcatggaaaaacttatgcatgtacatatccccttcaggattttgagcttcttgtatatgcttcattctcacattttcctca

SEQ ID NO: 266575 - DNA, 166 bp, Homo sapiens
ttgacagtgatttatagttcttttcttctgtataaattttgaagtgagtttgtctaattccttcaaaggaatccaactagattgattaggataaaaatgtatagattaagttagaacaaactgacatccaccttgttagcttgctctattcatgagtatgttatat

SEQ ID NO: 266576 - DNA, 308 bp, Homo sapiens
gccttcccatttttttcttattatttctgaaaatgtcatgggttagaagagtcaagaaaaatgtccactagcacaatattttttgttgatcagagatatttacctgtgggcactgaaactatggacaacagctttttcatactgaactcaatgtgtgcgcttttggagtaaagcactctgtgtaatcctttgaattacaatttttttttgataactggtataacattttcaaggctagtccaaaggactgaagctcaggttttcagagactcttctccataaagctgcatttaaaaaatacttactgt

SEQ ID NO: 266577 - DNA, 417 bp, Homo sapiens
gctttttggtgccttgttcttggttttccccgatagaaaatcaagcaaaatctaaatgaggcaaaagggcgcttggtgggccaggtgacaggcacctttccaatcctgtaacatttatctcctaagtcacagttcgtcctctctgggggaaaaatattttttaacacttgtaccttccactgaccaccctctttctattccagttcccggctaccgagaaaaacaaacacagtaagtcacattgttggtgcggtccttccagacccaccgcagtgtcttgcgtcgtggggtcgtgagtctctgaacctggttcttctcagagttgacatttggacgtgggggtaatttctccggtgctctgttacatcaaaattatcaataaactcgcctgggcaattagtgtccccaactaacagc

SEQ ID NO: 266578 - DNA, 435 bp, Homo sapiens
tacatggcaaccctttaacaacccagtagttagccatgatcattgtattaggctgcttgggttgctgtaacaaaatgttaataccatagactgggtggcttaaataacagacctttatttctcacagttctggaggttgggaagtccaagatcaaggtgctggccaattctgttcctgcctctcttttctggcttatatatttctgcctttttgccgtgtccttgcaaggcagagaaatatcttctcctactccaattcttccttctactccttctttttcttcataagccactaatcctatcatgacagccctattctcattacctcattcaaccttaattatctcccaaagggcccacatccaaataccgtcatattgagggttaaggcttcaacatctgagttttgggggagacacaatttggtccagagca

SEQ ID NO: 266579 - DNA, 511 bp, Homo sapiens
cagttcacactgcgagttcagattcggatcgcagtcccgattatcctcccctccagcctctccctttctcgttgaagggttaatacagcgtcctctcccctcgccacccgacagaggcgcctacactggcggtaggtagcccctgggagagggggagtggggggaccccgccgctttcgccgctgggcgacccagagccccagcctgccggagagggcagcggctcgggtttgacatcccagctgggtcccgggccggctccctgagcctcctcccgggttgctctctatcaggaaagcaatcggaagtcaggccggcttttgcttttgttctgccagctactctacggaatcgtaggtgaagccggggtgggcggatgccccgggagggggctgtggcgggagttccaggtgcgtccccgaaatgaccattggaggcggcggctgtttcccgcccctgggtggggaatggattccgatcgctaatcgataccctggagccagcagtgggt

SEQ ID NO: 266580 - DNA, 492 bp, Homo sapiens
gtctcccttttcttggaggagtcagggaacgctcagctccaccagcttcttgtgggaggctggatagtatccaggcctgcctgcagccatccggaggcctaaacccctccctgtgatgctgtgcttcaatggtcacgctccttgtccactttcctcctgtactcctggtccctctttgaagttctcagaagatagcggtagaagaaatagtgaaagtcttaaagtctttgatctttctgataggtgcatagaagaaaacgctgacgtatactgccttccctctctgcttcggctacctataagggaagggccccctgtcctatgatcacgtgacttgctcgaccttatcaatcacttggacgactcaccctccttaccctgccccccttgtcttgtatgcaataaataacagtgcacgcaaccatttggggccactacccatctccgtgtcttgatggtagtggtcccccgggcccagctgttttcgcttta

SEQ ID NO: 266581 - DNA, 496 bp, Homo sapiens
ctggttctagtcgttttaaagaatgaagtaatgcttgagatgttctgtaaactcttagtcatattagtacattatggagtccttttattagcattttttcaagtatttcacttaaataaaaagcccttattgcacactctgcattgtaggcatgggaaaatctgacttttagccttaccatcaagtcaacattgacctttaagattcctgttttggccgggcgcagtggctcacgcctgtaatcctagtactttgggaggctgaggcaggtggatcatgaggtcaggagatcaagaccatcctggctaacacggtgaaaacctgtctctactaaaaatacgaaaaattagccgggcgtggtggcgggcgcctgtagtcccagctactcgggaggctgaggcaggagaatggtgtgaacccgggaggcagagcttgcagtgagccgagattgcgccactgcactccagcctgggtgacagagcgagactctgtctca

SEQ ID NO: 266582 - DNA, 469 bp, Homo sapiens
caccactgcactacagcctgggcaacagagtgagactctgcctcttaaaaaaaaaaacagaactgaaagaagaaatctactagtatattctagtatttcaggggtatggttttttcctggaccattttaactttctaggcctgtgatctctcagtgtgaaaatgagaaatctctaacactttttgggaaactccatggtttagaaaaatcacttcatcaaattttcaaacttgttaaaagtcaagaaattgcttgaattatgaaataagtctaaggaaaaaaacaattccctgaaaagtttataactgctctccatcactatgataaaacacctaaaataattctagaaaagccataattttaaaaaggtttctctaattcttatgaaaagcctactaaggccaggtgcagtggctcatacctgtaatcccggcactttgggaggccaagacgggtggatcacttgagg

SEQ ID NO: 266583 - DNA, 777 bp, Homo sapiens
ccagtggctcagaggctcaaccatgaagggaaacagaaatggttcccagtcccaggagctgtgcctcagtctcctccttggagggagagagtgaaagctgctgagcttggaggagactggcaggaatgtcacacaacctgagttcaggttgtagctgaggtggaagggacagtggggatgccctggttacccttctttcccagcagctttgtgattgtctcttggaaaagaggaagcagctatggaagcagtgtgggtggaaaggaaccttggcccttgtgatgctaagaccaggagggttggagggggcttaatgacatggtggcactggtcaaagaccagctatgccagcgggacaagagaacctcatgctgggcaaggggctctgttctcttcttgtaccaacaaatctttctcttgtttcccattcacagctaaaggcacatctccattcctgcttcagtatcttagggctctgagaagtggaattcaacagacctgggtgtagattccaaatctgtgattgatcagttacataatctaactgaatctgactttcatatataaagtgagcttgatagtcttctgtctcttaagttttttggactctaatcaaataacacatgtaaaattttcagcactaagagtcatgcaataaagggtggccgccaatattagcattattagcagtaattactgattatatctctgtaaccttggtaaataaggccatctctaggtgcacttatccctctgtccatcttacatgaatatacc

SEQ ID NO: 266584 - DNA, 423 bp, Homo sapiens
ttaaccttaatctaaagcagattttcctccacaatatggtgggcctcatccaatcagttgaaggcttgaataaagcaaaaggctgaccctttctcaaatatgaaaggattagcccgtttgaatgccttttgagtgaaacatcagctcttcatcagctctatcacagctactggctgttggacttaaactatgacattggccctgtagatcttagacttggccttcctaatgacatgaacgaattccttataataaatttctttatatataggatatacatataaaatatagaaaatttatatacaggatataaatatatatatgcgtgcacacgtgtgtgtctatagaggatatatatacataggctacagatagaatatatatagattgtgtttctctggagaaccctatagtatactatag

SEQ ID NO: 266585 - DNA, 706 bp, Homo sapiens
aaggaggagcgcctggcagagcgggatcttcagggcagcgggcaaccccttggcccaggaagcctggaacgcaaggaccggagggcgtgggctgggacgcccctacgttggtctttcagggaaaggccttggaaagcagtcgttgcgccagacagcccagggaagagcggcagcctgaggacctagggccacctgctgttccctgggattcatgtccttctggggaggagggaggacccaggacaatggctgctgttcatgatctggagatggagagcatgaatctgaatatggggagagagatgaaagaagagctggaggaagaggagaaaatgagagaggatgggggaggtaaagatcgggccaagagtaaaaaggtccacaggattgtctcaaaatggatgctgcccgaaaagtcccgaggaacatacttggagagagctaactgcttcccgcctcccgtgttcatcatctccatcagcctggccgagctggcagtgtttatttactatgctgtgtggaagcctcagaaacagtggatcacgttggacacaggcatcttggagagtccctttatctacagtcctgagaagagggaggaagcctggaggtttatctcatacatgctggtacatgctgggtaagcaatgatagttaagcccctggtatcagaggtgattatatcattgtaacctctaacatttgt

SEQ ID NO: 266586 - DNA, 649 bp, Homo sapiens
ccctcacagaacccccccaagagcgcccccaaaagaccctgcaataatttttgacgaatattttcaatgtttttgaaattacctcaaaaattaaggtaatactcaaatctcagttaagtctttgctaaatactactgggaaagaggatgaagaaacatcaaatgaatattaaccaaaaatcttatgaatatttcatcaatcttagtttaacagcatttatttatctatttatttattgacatgttaagtgctgattttatattacttttattgagattgtttctggctagcaaaattgtgtcatttatattattaaattaaatgtcttgtcattttattctccaaagtgcattgtacttcccaaatacatttaaaaactcggctgtgacactcatgctttgttttgcaaatatttgatactggaagattatttcaaatgaagagcagatgaagagggagtagagttgaggtttcatttgtccatagatagcttatataattattatttatctctttttaagaattttcaagaaatgattcctgcctttggaattttcagactgctgatcatcatcctgataagtaagtgtgttttgtgaatacttcatactgtccaagtgaaaataaaatatagagacaaatctctaaa

SEQ ID NO: 266587 - DNA, 1831 bp, Homo sapiens
aaggaggagcgcctggcagagcgggatcttcagggcagcgggcaaccccttggcccaggaagcctggaacgcaaggaccggagggcgtgggctgggacgcccctacgttggtctttcagggaaaggccttggaaagcagtcgttgcgccagacagcccagggaagagcggcagcctgaggacctagggccacctgctgttccctgggattcatgtccttctggggaggagggaggacccaggacaatggctgctgttcatgatctggagatggagagcatgaatctgaatatggggagagagatgaaagaagagctggaggaagaggagaaaatgagagaggatgggggaggtaaagatcgggccaagagtaaaaaggtccacaggattgtctcaaaatggatgctgcccgaaaagtcccgaggaacatacttggagagagctaactgcttcccgcctcccgtgttcatcatctccatcagcctggccgagctggcagtgtttatttactatgctgtgtggaagcctcagaaacagtggatcacgttggacacaggcatcttggagagtccctttatctacagtcctgagaagagggaggaagcctggaggtttatctcatacatgctggtacatgctggagttcagcacatcttggggaatctttgtatgcagcttgttttgggtattcccttggaaatggtccacaaaggcctccgtgtggggctggtgtacctggcaggagtgattgcagggtcccttgccagctccatctttgacccactcagatatcttgtgggagcttcaggaggagtctatgctctgatgggaggctattttatgaatgttctggtgaattttcaagaaatgattcctgcctttggaattttcagactgctgatcatcatcctgataattgtgttggacatgggatttgctctctatagaaggttctttgttcctgaagatgggtctccggtgtcttttgcagctcacattgcaggtggatttgctggaatgtccattggctacacggtgtttagctgctttgataaagcactgctgaaagatccaaggttttggatagcaattgctgcatatttagcttgtgtcttatttgctgtgtttttcaacattttcctatctccagcaaactgacctgcccctattgtaagtcaattaataaaaagagccatctggaggaaataaaaaaaaaaggaagactctatgaagaaacagagaagtctcagaaaaggctaacaattttatatagaggacaaaacagcattaaactcatcagttgcaaagattgcctataaaaggaccttaggatttaaggaaggggcttcttaatgtagaaagggaactacaaagatgagaaattaccagaagcctcgccttttcctaagcaccagcggaaggagctgtgccccgggatggagtgagggtggagggcgcgtcagccacgggtgggccttgtgtcgcctcgtatcggcccaggtaggttgttggcctcttacttgggctgacctgacccccgaaagagaaacagacaactctgttctcaggattggggatggacggcttcggccaagcgttttagcctcattcactcaggccccactcagcactctgccagccaagaccattgatttggaaaatccggtccccacccgctaatgagctgttgacactgttgttccttgctgaattggattgttgacttgtagttcagaggcgtacaactagttggcgattagacttgttatgtgatgttaccagcctgaaatgcgatcaccccgtaggaaataaagcaggcatctctggacctc

SEQ ID NO: 266588 - DNA, 1532 bp, Homo sapiens
ccctcacagaacccccccaagagcgcccccaaaagaccctgcaataatttttgacgaatattttcaatgtttttgaaattacctcaaaaattaaggtaatactcaaatctcagttaagtctttgctaaatactactgggaaagaggatgaagaaacatcaaatgaatattaaccaaaaatcttatgaatatttcatcaatcttagtttaacagcatttatttatctatttatttattgacatgttaagtgctgattttatattacttttattgagattgtttctggctagcaaaattgtgtcatttatattattaaattaaatgtcttgtcattttattctccaaagtgcattgtacttcccaaatacatttaaaaactcggctgtgacactcatgctttgttttgcaaatatttgatactggaagattatttcaaatgaagagcagatgaagagggagtagagttgaggtttcatttgtccatagatagcttatataattattatttatctctttttaagaattttcaagaaatgattcctgcctttggaattttcagactgctgatcatcatcctgataattgtgttggacatgggatttgctctctatagaaggttctttgttcctgaagatgggtctccggtgtcttttgcagctcacattgcaggtggatttgctggaatgtccattggctacacggtgtttagctgctttgataaagcactgctgaaagatccaaggttttggatagcaattgctgcatatttagcttgtgtcttatttgctgtgtttttcaacattttcctatctccagcaaactgacctgcccctattgtaagtcaattaataaaaagagccatctggaggaaataaaaaaaaaaggaagactctatgaagaaacagagaagtctcagaaaaggctaacaattttatatagaggacaaaacagcattaaactcatcagttgcaaagattgcctataaaaggaccttaggatttaaggaaggggcttcttaatgtagaaagggaagaagaagagagaaaagaagggtagtaaaaactagagattggggccaggcgcagtggctcacgcctgtaatcccagcactttgggaggctgaggcgggtgaaatcacctgaggtcatgagttcaagaccagcctgaccaatatggtgaaaccctgtctctactaaagaaaatacaaaaattagccgggcgtggtggcgtgtgcctgtagtcccagctacttgcgaggctgaggcaggagaattgcttgaacctgggaggcgaaggttgcagtgagccgagattgcgccactgcactccagcctgggtgatagagcgacactcggtctcaaaaaacaaaacaaaacaaaacaaaattagagattgggtctttcccaggcatatggtattctataaaacagacttactctccttggaggatatattttggagaatgcttcataaaatctatgaatactgtacaatgctgataataaaaactttttatacctgtgtcagactcc

SEQ ID NO: 266589 - DNA, 997 bp, Homo sapiens
acgcttgtttaactgtgacggtatttgtgtttgaataagagagatgcaactgaaatacacaattagcattgtcttcacttatttccattttccctccttttctcccaaggtgtcttttgcagctcacattgcaggtggatttgctggaatgtccattggctacacggtgtttagctgctttgataaagcactgctgaaagatccaaggttttggatagcaattgctgcatatttagcttgtgtcttatttgctgtgtttttcaacattttcctatctccagcaaactgacctgcccctattgtaagtcaattaataaaaagagccatctggaggaaataaaaaaaaaaggaagactctatgaagaaacagagaagtctcagaaaaggctaacaattttatatagaggacaaaacagcattaaactcatcagttgcaaagattgcctataaaaggaccttaggatttaaggaaggggcttcttaatgtagaaagggaagaagaagagagaaaagaagggtagtaaaaactagagattggggccaggcgcagtggctcacgcctgtaatcccagcactttgggaggctgaggcgggtgaaatcacctgaggtcatgagttcaagaccagcctgaccaatatggtgaaaccctgtctctactaaagaaaatacaaaaattagccgggcgtggtggcgtgtgcctgtagtcccagctacttgcgaggctgaggcaggagaattgcttgaacctgggaggcgaaggttgcagtgagccgagattgcgccactgcactccagcctgggtgatagagcgacactcggtctcaaaaaacaaaacaaaacaaaacaaaattagagattgggtctttcccaggcatatggtattctataaaacagacttactctccttggaggatatattttggagaatgcttcataaaatctatgaatactgtacaatgctgataataaaaactttttatacctgtgtcagactcc

SEQ ID NO: 266590 - DNA, 1237 bp, Homo sapiens
aaggaggagcgcctggcagagcgggatcttcagggcagcgggcaaccccttggcccaggaagcctggaacgcaaggaccggagggcgtgggctgggacgcccctacgttggtctttcagggaaaggccttggaaagcagtcgttgcgccagacagcccagggaagagcggcagcctgaggacctagggccacctgctgttccctgggattcatgtccttctggggaggagggaggacccaggacaatggctgctgttcatgatctggagatggagagcatgaatctgaatatggggagagagatgaaagaagagctggaggaagaggagaaaatgagagaggatgggggaggtaaagatcgggccaagagtaaaaaggtccacaggattgtctcaaaatggatgctgcccgaaaagtcccgaggaacatacttggagagagctaactgcttcccgcctcccgtgttcatcatctccatcagcctggccgagctggcagtgtttatttactatgctgtgtggaagcctcagaaacagtggatcacgttggacacaggcatcttggagagtccctttatctacagtcctgagaagagggaggaagcctggaggtttatctcatacatgctggtacatgctggagttcagcacatcttggggaatctttgtatgcagcttgttttgggtattcccttggaaatggtccacaaaggcctccgtgtggggctggtgtacctggcaggagtgattgcagggtcccttgccagctccatctttgacccactcagatatcttgtgggagcttcaggaggagtctatgctctgatgggaggctattttatgaatgttctggtgaattttcaagaaatgattcctgcctttggaattttcagactgctgatcatcatcctgataattgtgttggacatgggatttgctctctatagaaggttctttgttcctgaagatgggtctccggtgagttcagtttctttcttttataaaatagaaattagtttactgtcaaaaagggttatcaaataggggttacaacgctgtgatttagggcagccaaatttccatttggaagttaagaaaatttttaaggaaatcagacttttgaattgtccttcccacttaactctctcacagccctgatcactggctctacttcactgcacctgccatattggtagctattccaaaacaggagagaatggccaggcgtggtggctcat

SEQ ID NO: 266591 - DNA, 581 bp, Homo sapiens
gtgaagaagtgtatttcatgtcaccttctggcactatggtgtggcccacttgagagctgaatcatctgaaacagttactgcccacgggcttggatggggcccctctctggagaaggtgtggttaatactcatgtctgctccctccatcagctggcagtgtttatttactatgctgtgtggaagcctcagaaacagtggatcacgttggacacaggcatcttggagagtccctttatctacagtcctgagaagagggaggaagcctggaggtttatctcatacatgctggtacatgctgggtaagcaatgatagttaagcccctggtatcagaggtgattatatcattgtaacctctaacatttgttgagtgctttattattgataaggcactttcatgtccataatcttcacagcaaccctaaggggtaggtattgctcccactgttttatgtctgaggcataggagatgtagtcatggaggctgaggtgggcagatcacttgaggtcaggaattcgagaccagcctggctgatatagtgaaaccccatctctactaaaaataaaaaaattagacaggcat

SEQ ID NO: 266592 - DNA, 1865 bp, Homo sapiens
aaggaggagcgcctggcagagcgggatcttcagggcagcgggcaaccccttggcccaggaagcctggaacgcaaggaccggagggcgtgggctgggacgcccctacgttggtctttcagggaaaggccttggaaagcagtcgttgcgccagacagcccagggaagagcggcagcctgaggacctagggccacctgctgttccctgggattcatgtccttctggggaggagggaggacccaggacaatggctgctgttcatgatctggagatggagagcatgaatctgaatatggggagagagatgaaagaagagctggaggaagaggagaaaatgagagaggatgggggaggtaaagatcgggccaagagtaaaaaggtccacaggattgtctcaaaatggatgctgcccgaaaagtcccgaggaacatacttggagagagctaactgcttcccgcctcccgtgttcatcatctccatcagcctggccgagctggcagtgtttatttactatgctgtgtggaagcctcagaaacagtggatcacgttggacacaggcatcttggagagtccctttatctacagtcctgagaagagggaggaagcctggaggtttatctcatacatgctggtacatgctggagttcagcacatcttggggaatctttgtatgcagcttgttttgggtattcccttggaaatggtccacaaaggcctccgtgtggggctggtgtacctggcaggagtgattgcagggtcccttgccagctccatctttgacccactcagatatcttgtgggagcttcaggaggagtctatgctctgatgggaggctattttatgaatgttctggtgaattttcaagaaatgattcctgcctttggaattttcagactgctgatcatcatcctgataattgtgttggacatgggatttgctctctatagaaggttctttgttcctgaagatgggtctccggtgtcttttgcagctcacattgcaggtggatttgctggaatgtccattggctacacggtgtttagctgctttgataaagcactgctgaaagatccaaggttttggatagcaattgctgcatatttagcttgtgtcttatttgctgtgtttttcaacattttcctatctccagcaaactgacctgcccctattgtaagtcaattaataaaaagagccatctggaggaaataaaaaaaaaaggaagactctatgaagaaacagagaagtctcagaaaaggctaacaattttatatagaggacaaaacagcattaaactcatcagttgcaaagattgcctataaaaggaccttaggatttaaggaaggggcttcttaatgtagaaagggaagaagaagagagaaaagaagggtagtaaaaactagagattggggccaggcgcagtggctcacgcctgtaatcccagcactttgggaggctgaggcgggtgaaatcacctgaggtcatgagttcaagaccagcctgaccaatatggtgaaaccctgtctctactaaagaaaatacaaaaattagccgggcgtggtggcgtgtgcctgtagtcccagctacttgcgaggctgaggcaggagaattgcttgaacctgggaggcgaaggttgcagtgagccgagattgcgccactgcactccagcctgggtgatagagcgacactcggtctcaaaaaacaaaacaaaacaaaacaaaattagagattgggtctttcccaggcatatggtattctataaaacagacttactctccttggaggatatattttggagaatgcttcataaaatctatgaatactgtacaatgctgataataaaaactttttatacctgtgtcagactcc

SEQ ID NO: 266593 - DNA, 355 bp, Homo sapiens
tttaaaacaattacatagaaaactttattttgggccatttaggaggtttagatcattttgatcatcttcagctgtcttctcttcacatacaggaaaggccttggaaagcagtcgttgcgccagacagcccagggaagagcggcagcctgaggacctagggccacctgctgttccctgggattcatgtccttctggggaggagggaggacccaggacaatggctgctgttcatgatctggagatggagagcatgaatctgaatatggggagagagatgaaagaagagctggaggaagaggagaaaatgagagaggatgggggaggtaaagatcgggccaagagtaaaaaggtccac

SEQ ID NO: 266594 - DNA, 420 bp, Homo sapiens
aaacagttgtatgtaagagtgccttaaaatgatactctgcatcttaaaatttatagttataagtgcctatatttaaaaagtatacttttcaatcaattacctaaccttccacttaagacaatggaaaaatgggccaggtatggtggctcacgcctgtaatcccaggaccttcggaggccgaggctagcagatcactggaggtcaggagtttgagaccagcctggccaacatggtgaaaccctgtttctaccaaacaatgcaaaaattagcctggcatggttttgtgtgcctgtagtcccacctacttgggaggctgaagtgagacaatcacttgaacccaggaggcggaggttgcagtgagccaagattgcgccacagcattccagcctgggtgacagagtgagaccatgtctcaaaaag

SEQ ID NO: 266595 - DNA, 489 bp, Homo sapiens
tttttgaaatccagcatgagaaatacagtacctgctatggcaaaaaatacacataaaatgcaacttttcagcttatttgtacattagtagagtttaacattttattgtttgtttttttaagtgaaccagtgattttaagtaccactatactaaaaaggaaaataaaatatagaaaagggggcccagcctgccatgcaagtgcacctctaaagtgcctagtttctgtgtccatgtaaaaccagtaatatgaggagcaatttcaacatatgggagtttgattaaacctctatgctaaaaaaaaaaaaaaaaaaaagacaatgccacatcctcccttttctcccccaggcgtccttaaatcccattatctacttcctctattgcccatcaaagagagaaaagaaagccaccaaaataatatcgtaaaagcaacttcaagtataagaaaaaaaaaacacttaaaggtaacttgcagagagcatcaatatgtgc

SEQ ID NO: 266596 - DNA, 1046 bp, Homo sapiens
tgacctttcagagagatgataaaagaagggtcttttcaacaaatgttcctgggaaaacagaaattctatataaaaagaacaagttttgattcctatctcacatcacagcaattcgtaaatcaatttcaagtgaattaaatatttagatgtaaaagacaaatatagaaagctttggggagtctgggcatgatggtgaagaatataaaagcaaaaagccccattcaaaagacaataactttaaagattaaaggaacatcagcctacacaggtgagaaagtgcgagtgcaataactccagccactctgaaagcaagagtgtcttcatacctccaaatgatcacactagctccccagccatggttctcaaccagactgaaatgactgaaataacatagaattcagaatctcaatgtcaaggaagctcattgagatacagaaggttgaaactcaatccacagaaaacagtaaaatggttcaagagttgagagaggacatattcattttaagagagaaccaaactgaacttctgaaatgaaaaattagcacaggaacttcataatgtaattggaagcattaatatcagaatagaccaagctaaggaaagaatctcagaactcaaagaccattcttttgaatcaatacaagcagataaaaataaaaaaaaataattttaagaaaatgaacaaaacctctaagaaatatggaattatgtaaaagagaccaaactcattggattcttgaaagagattgagagagagcaagtaactttggaaacatatttaaggatattgtccacgaaaattttcccaacatctctagagacgtcaacgcacaagttcaggaaattcagagaacccctgtaagatattatgcaagatgaccatccccaagccacattgtcatcagattccccaaagtcaatgtgaaagaaaaaatcttaaaggcagctagagagaaggggcaggtcatgtacaagggctaacagtggacctcttagcagaaaccttacaggccagaaaaggttgggggcctatattaagcatcatt

SEQ ID NO: 266597 - DNA, 354 bp, Homo sapiens
ttcaatcttttcatggaacttccagagaagaagccatggatagctttcctcttttcattggaagagaaaaagtgatgtatctgattattttatgtatgagaggccaagacagacataggtatggatcgcagtaacagctctcttacggggtaaagctctcttatgaggtgaagctggactggataagaaaagaaaacgatgaacattcccctcccctcacaaaatgcacacacattaaccttcagcagactagttgctttcttagaaattttgtagatagaaatttatgtcatccattaactatgataaatgttctctagcacatagtctctgctaattaaataattatctgcc

SEQ ID NO: 266598 - DNA, 521 bp, Homo sapiens
tttcttttttctctcagatgtcagaggtgatgaaacacgctgatgatatctcctatttgtcttggagtctcttctattttggaggtcgggtgaacacatgccattgacacatgctctgtggaatgcttcacaaaggacttggtataaagaactgatggaacaccacctgttcgacagtcatgccatcggcagcaggcagagatccatgctggtgccaaagttccttgctgtggctggtgtgaagtggaggtggttgtcagggaggaggcaccatgcactatagcctgtctgcagtgggcaccctgtgtgaccttagaggctctcctgggggacccactgctgctgctgctgctgctcctgggacctctggccttgggacctggctaagaaagcattgttttgggggaaagttctgcacctcctgcttttcaatggtacaactggctgcaaagtaaagtccaaagtagagtccaaaaatatgagcaagtgattgaattcaataataatatttttgttagata

SEQ ID NO: 266599 - DNA, 241 bp, Homo sapiens
gtttcacctctaacaagaaaagggtttgaaagttatcattcccatcttaaaaaaaaaaaaaaaagatgagcaattgaaaaatcagtgagttttcttgcatgcatcagagtattgcgttgctttggatctgaaaaaaacaaactgaatacaaagaaacaaacctcagatcaggttacttagaagaggccctgatagaactataaactgggacatttcaacagtagtcaataaattgttggag

SEQ ID NO: 266600 - DNA, 457 bp, Homo sapiens
ttttttttttttgagacagagtctcgctctgtccaccaggctggagtgcagtggcgtgatcttggctcactgcaacctccgtctcttgggctcaagcacttctcctacctcagcctcctgagtagctgggattacaggtgtgtgccaccacaccgggctaatttttgtatttttagtagagatggggtttcaccatgctggccaggctggtcttgaactcctgacctcaggtaatccacccactttggcctcctgaagtgctgggattactggcatgagccaccgcacccagactgttaatgcattcttttttccttaaccaataattcatttatccttttagtggagaaattggtcatcatttttcgtaagtctagaacatttatctaagtctaagaacattttcattaaccctctccctagaactccaaacccattaaaagtcgttccccatctt

SEQ ID NO: 266601 - DNA, 498 bp, Homo sapiens
tttaaaacaaaacaaaaaaatccttccaaagttcaagctgcagtgagacttaattttatagttattatttacatggtaaaattcccctcaagtcaccagtccctggtatgggaatttttaactctgaaagcctttgaattattactaggaaaagcatctggtgttagtgaaaccagtgactgtgaagctggtatcaaaatgaaagtgccttttgggaaccaaaattttacaggtctttctgctgaactctggttcactgacagtgattgcttaagcttgtctaaaatatttcagctttactcttatcaacatgatttgtgctgtaattgtttaaaattttcctttgtaaaataactaaccaaattatctgattatagtttgttgtaacagatgtgaatcttattccacaaactcaggtgtgcaagaaacaatgcattactttattttcagaaatccaaattaaatttgatgctgagctcccattccaccaggttgcca

SEQ ID NO: 266602 - DNA, 180 bp, Homo sapiens
ccagatctgccattcccatggggcctccatccacagaagccagagatgcccagatctgccactcccacggggcctccatccacagaagccagagatgcccagatctgccactcccacggggcctccatccacagaagccagagatgcccagatgtgccactcccacggggcctccatcca

SEQ ID NO: 266603 - DNA, 295 bp, Homo sapiens
cagagagagacaaagagtgcagtgccagcctggggtgatggggcacaaaggcagttttgcccccttagccattctgatgcaaaaaagaacctgaaagaaagtccaggcctgagcagagggactgaaatgggaagctctggggttctccgttcactcagcactcagcagcccttcccaggaagtcctctgcacaccacctcctaccagaagccctcagcccaggtcaagctctacagagcccatgctcaagaagtaacctagaagcacagatggtggagaggctgtgaaggagggg

SEQ ID NO: 266604 - DNA, 195 bp, Homo sapiens
gttaacatacagaaaatataaagcagtcgcaacaacaacaacaaaaatcaaatacctaactaaaagatgggcaggccaggtatggtggctcatgcctataatcccagcactttcggaggtcaatggggaaagactgcttgagcccaggagctcgagaccaggatggacaaaacagtgagaccccacctctaaaaa

SEQ ID NO: 266605 - DNA, 414 bp, Homo sapiens
gtgcctataatcccagctactcaggaggctgagccaggaggatcgcttgaacccaggaggcagaggttgcagggagccgaggttgcaccactgccctccagcctgggcaacagggcgagactccgagactccgtcttaaaaaaaaaaaaaacaacaaaaaacaaaaaccaaaaaaaaaaccccaccatagattgttaaaaggtagtaaccgcatgaaaaaaggagaacagggcaggggagattgggaatattggggttagagatgtggttacaattttaaatagagtggtcaaggcaggcctcattgagaaggtgataaccagaggcaagggggtgagccatgtgtaaaactggaggaagagcattgcaggcaatggaaacagacccagcagcagaagcatgcctgctgtgctt

SEQ ID NO: 266606 - DNA, 322 bp, Homo sapiens
aaactggctctaaagtgtatggcatcttgcccaagttctgacacttagcagaggcctgagtttaaatacagcctcgtcttgctcttcgacagcctcagcaccacatgccctgggtggcccacgcagtgagtcactgacagccctcgtggttggcccgtggcacagcatggagcgaaatggtccagtgaccttttcagacactcgggcaatgcgtggtatagtgtatgtggtcactcccagtgagtcctattgttcagtttaatagaatatctaattctatgtttattctgaataaagggagatttcttgtggtttttaagaa

SEQ ID NO: 266607 - DNA, 538 bp, Homo sapiens
acccctgttggtcctcagaatcacctggcctatgcacactcccgctaaaccactgaagtccaatttctgggagctcagccagggaatgtgtatttttaaacaagccccctaggttactctgataagtgcaaagtcagagagcgctgctctcatgcactgagcctgagcactcttctattaataaaaaaggagaggagaatcctgggttgggtgcccttcgccttctggcggcagaagagcagagccaggctctaagcacctgcacccaccgctgggctcaggagctgcgctggagaatagaagggctaatttagtcattcatgcctttttagagcaaattacatgtggagagggtggggcacactgaattttattttagccaaatgccccttatctccttatgcaattgatatttttatattgaacattagaggattggtcatttgtcatcaagtcgtctgtaatacagaaaacgataaatacaacctaacagttcaaacatgacgagttaaataaatgatggttaaaaataaaaaaa

SEQ ID NO: 266608 - DNA, 380 bp, Homo sapiens
ttttttttttttgagacataatcttgctctgtcgctaggctggagttcagtggcgcaagctcagctcgctgcaacctccgtctcccaggttcaagtgattcttctgtctcagcctcccaagcagctgggactacaggcacgtgccaccatgcccaggtaatttttgtgtttttagtagagacggggtttcaccatgtcggccgggattgtcttgatctcctgacctcatgatccatccgccttggcctcccaaagtgctgaaattacaggcatgagccactgcgcctggccagaaattcttatttatccatacattcactcagaaaacacttatattgaacaactaccatggcttgggtactattattggcattaggaac

SEQ ID NO: 266609 - DNA, 283 bp, Homo sapiens
aaaatctcaccagccaggatgaggtacccagagataccaggtgagaagagaggactcctgacatgcaaagaccaagcggaggaggcaggcagacaggaaggaggaagttgagagactggagcagtctgtattattatcatcatcatcatggttattcttgtttagaaacagggtctctctctctcacccaggctggagtacagtggcccaatcgtggcttattgcaaccttgacctgggctcaagccatcctcctgcctcagcctcccatgtagctaggacta

SEQ ID NO: 266610 - DNA, 354 bp, Homo sapiens
attactcttttttagaagtccatgtgatcagtgtcacatccttactttgtagatatttattctaataattttcaggataagaagtcacatgaaataatctgtaaaattcctaagttgactttttcaccttttggggacaattatgtttcttatattctcattactaatagctagatatgcagcaccataattatctagtttgagtggcatttgtggtaagatgttccttctcttacattttaatttaactgaaagtaaactcttgcatgccaaaatgtgatttatattagctatttttaagtgtttctaagatacatcttttttctccccctagagacagtcttgctctgttgc

SEQ ID NO: 266611 - DNA, 327 bp, Homo sapiens
gttatctgttatagcattatttataataccagggttatcagaagcaacataaatgtccaacaacagggaatgaaattatgacatatgaccattaaaaataaaggtctagaaagactattaacatagaaaaatacctatgacttaagaaataaaaggcaagttataaaacagtgtgaatgatatgatcctgttcttataaaaatatgcatttatatatatgtgcacagaaaaatgtctagaagaatatacaccaagatgttaacaagggttatttctgtgttttgggattataggcaatttttcttctttttgcttttcactgtttcc

SEQ ID NO: 266612 - DNA, 191 bp, Homo sapiens
cgttcctgcagcagttaaagctgtgaaagacaggcactctgacatgcaattccttgtgatttttctttttcctttttggagttggggtcttgcgctgtcacccagactggggtgcagtggtgtggtcatagctcactgcggcctcagactcaagctcaagcgatcctcttaccttgcctttcaaattgctg

SEQ ID NO: 266613 - DNA, 150 bp, Homo sapiens
cgcatcttggcagaaagttcactctgtttgatgcggctgatgagttcccgagccttgtcctccagtgtgtttccaaactccttcagcttatccaaggcactggagacgtctggggtcccctgggctggggctgggcctgccaggaagatg

SEQ ID NO: 266614 - DNA, 383 bp, Homo sapiens
tatcccagaagtgtgctattatcacattttaatgcatgccttgccctctgtttttgcatccttataaaagcttatgccagctgaaattagcctgtgcaaccactaacatgtggaagcattacaagttcactggacttaaaatatttaaagaagctaatcctgttggaggaacttccagtctgtagcaccctagtcacttaacattaggtttttgaacttcttttttctttgtttctatgatgttgtgcatcaaatgattgagatccctaaacttttgtgttggatggttttctgaacttcaacttgggaaaggtcaagttttatgtgaaagttatcttttaatttaaacaaataaatgctgatactcttttgattcgatatgt

SEQ ID NO: 266615 - DNA, 204 bp, Homo sapiens
agagagacagagagagacacagagagagagagggggcgagagcgagacacagagagagagagagagagagagaaaacgagcgagggagagagcgagagggcaagagcgagagagagagaaaacgagcgagggagggagagagcgagagcgagaaagaaagaaagaaagaaagaaaaagaaagaaagaaagaaagaaaaaaaaaa

SEQ ID NO: 266616 - DNA, 179 bp, Homo sapiens
gatcacataagccctgggaggttattggtggggctttggcttttactctgacttagatgggaactgcgggagggttctgagcagagaggcgacgtgatctgtctcccgatttaaaagcattctctggctgctgagttgagaaagactgtgggaagatgtgatagaagcatgggggccaa

SEQ ID NO: 266617 - DNA, 390 bp, Homo sapiens
taccacagcatgctgcaaactgatggtgtgagaagctggagtagagattgggctggggggaacatgcatggaaactccctgtactacttgcttaattttgctgagagtctgaagctgctctaaagtctattaattggaaaattttaaagtttaaaaaatttaaataacaaaaacagaaaaaccttgtacttaagagaggttacataacttgcttaaggcctcacagtttgtaagtggtgaagccacattatttctgttctttaagttaactattccacaaaggctgtatgattacatgctacatttcagccatttcactatgccataaaggacctacataccgtgatgcatataatgaaataaaaatgattgacataaagatttaccacc

SEQ ID NO: 266618 - DNA, 649 bp, Homo sapiens
gccaggtgtagaattttccacttgtagtatcaggtcaatgcagaaaaagttttggttcttggagcatttcagatttcagacgttcatattagagatgcccaagttgtttatgagtttggaagttaactattttgtaaaatacaagtcagctgataagctttcctgctacttaagccaaatatgcgagttatagtatagccatttctgattattcattgtttttatgtttgtcatgtttttgagacagagtcttgctctgtctcccaggctggagtgcagtggcatgatctcagctcactgcaacctccacctccccggttcaagcagttctctgcctcagtctcctgaatagctaggattacaggcacccgccaccatgcctggctaatttttgtatttttagtagagacggggtttcaccatcttggccaggctggtcttgaactcctgaccctgtgatccacccgtttcggcctcccaatatgctgggattacaggcgtgagccaccgtgcctggccttttttttgagatacagtttcactctgtctcccaggctggagtgccatggcgtgatctcactcactgcaacctctgcctgctggcttcaagtgattctcatgcctcagcctcccaagtagctgggattac

SEQ ID NO: 266619 - DNA, 445 bp, Homo sapiens
agtcaagactcagctaaggaaattcatttttgggttgaataggcagacaggaccgatgctaaaaacacgagaatgggagcaaaagggggttcaagtcactataaggctggcagaggccagggttctgctccaaggcaacccctgggaggtggcgagactttatagggctgcagctgggtggctatgcaggagaaccggctccatgatgcacggcccagggtgcctccataaaggtcatggcaccacccaactgatgtgaagcacaacattgcataataggtggccaacaacaaacctggtgatcctcatagacaaagaaccaagcctgtctgttgcctgccttccctttcagtccatttctaccccacctggaccccgagaccataagaacaaatcatccagcagtctgaaaacttctgtaataaaacgagtctaccatgttaga

SEQ ID NO: 266620 - DNA, 413 bp, Homo sapiens
aattggtgtgtgaattaaagggatagattctatttaaatgggtaagtctgatttcaaagaataggtacgatttaaagggttcaatttttgaaatgcatagcttctgggggagaaagaaacaaaaaggagggaaggcgtttcctttggcaattggataatgaagaggaaaagaaggaaaagggaaaaattaaggccctgtgagacaaaatagaactacacaggtggaggattcataatatgccccctaatgaaaccaaccacttcattaaagtatatagcatggattgactggtaggaaagggtgacattggactagaaatattgtaaaacagcccaatgtcacaaaaatgaacaaaatatttctaaatcaggaaacaaatttgcacgcaaacctaggaaaattctttttcccc

SEQ ID NO: 266621 - DNA, 686 bp, Homo sapiens
tcactggtcaataagggaagaagaattgcacttattcttgacaatgtgattggaaaacacaggagaggcacaaagtgggaaactcttgagaagcactgacttcctgtaactgaaagagttcaagtctggaaaatgtagccacttagtgataatgttgaaggagaccttcaggcaaacaatggtttattacctccctaaagtcctttcaggctctttttaagtgtgggattatatgccccaaaatatctacattacatcagaagaaactgctgcagggtcagaagcagaatgggagaggcattaaaaatatatgaagtccaacttcttaatattttacataaaactgcatgcagctcctggtagaaaaattctaaattttatctatctattaatattatttctctccgaaagtttgcaagcaattcaaaaacagtttaacctaacatgtaattgtagaatgtaaattatgaaatcaaattaaggctcaaatcccagtagtacaatgccacttcagaaagtgatatgcaaaagcatgtgaaactccaggtaatgtaaaattagaatatggtatagataccaatgtgattgtgagcaggattaatctacttcatttgattgattgattgaatggtacagttgacttatatttttagtataactataataactagtgtgctatatagtct

SEQ ID NO: 266622 - DNA, 274 bp, Homo sapiens
gaagggcgtggcgaggggagaagcaacaaccacaggacccgtgacagtggccaagccttagaggccccgcatgcctgccaggctcccgagcccacgcagtccaggtttccccatccgggcgggaaccagctgtttcccctgcacgggcgagggcgctggggtcacctccgccgacgccaggcgtgagctccagaacccgctcccaaccgcccggtcccgtgagcgcggggagcctggctctcgcctgacaataaagaaatcatcacggacagaa

SEQ ID NO: 266623 - DNA, 434 bp, Homo sapiens
cagtagcttcaaccccatgtttctactcagcattgctttactgggggcctgctgcagtggccctgctcagctacaagcttctgactgggaccacaggcttttgaagacatcctttgaaatgtatgtggaggctgccaaacctccagctttcttgcttcctgctaggcagcaaaatccgcaccacatggacactgtcaaggcttatgactttaccttctggaactgtggcatgagccccacctggagctgcatcagccacagctggggtagccagggagcactgtgctgaggtgtggagggtagagtcctaagatggccctcagcttcaagcccaggaagagcagctgaggtctgtcccttggaatcattctgccttcctaggcctctgggcctgggattgaaggggaaaccttaaagatatctgaaatgctttc

SEQ ID NO: 266624 - DNA, 423 bp, Homo sapiens
agatggggtgaggaaaattacgatactgtgaaaaattattatttggtctttaactgtgtttcctggcatacaactctttaaatccttagaaactccaaagtgttatctggtagcccctaggtagcttctggatgggggctggtcaccaaaccaaggcatgattagagagttggaactttcagccctacccccacaacccctggggaggggtgaggggctgaaggttaagttgatcaccaatgaccaatggcttaatcaatcatgcctatgtaatgaagactccataacaatccaaaaggacagggttcggagagcttctggatagctgaacatgtggaggttcctggagactggcactcccggagaggatatgaatgttctgtgcccatccccatgcctttccctctgcccctcttcaactgc

SEQ ID NO: 266625 - DNA, 342 bp, Homo sapiens
ctcaagcaggtccttaagtggatgtttgtgatggtggggaattggaagaaatctgaatgtcctctactgtgagcaaaagatggaaggtaaaatagggagggtgcacaccacagaggatgaaatacatgagagctggaagcagcagaccatgttgcacagcagcatgggtggatcaaaacaaagtaccaaaccaaagacacaagtaagaagttttacataattaaagacacttgcacaaaataaaatatatattttacatgaatttatacaaataatacacataaaacattgtttaatatttacctgtggttgaagagaggactagagataaaagggatttac

SEQ ID NO: 266626 - DNA, 295 bp, Homo sapiens
aaaatgtcattttagcaagatgaggcttaatttaatcaattcatacccaccaaaaatagcttaatttaataaaactacataatcttagagataaccaaacaataaaaaatgggaataacgtacactggctactatagtagtccccaatttatctatgggtcttttttttttgagatggagttttgctcttactgcccagctgggttgcagtgagccgagatcatgccattgctcttactgcccaggctggagtgcaatggcatgatctcggctcactgcaacctctgcctcctgg

SEQ ID NO: 266627 - DNA, 573 bp, Homo sapiens
tgctccaggggattgtaaatttgtatttatttattctttgaaagctccctagctcttccccaaagtattcttacactaaagaggggtttattttattcatgagtttactttaaattctccctttattgttggagacttgcatttgttttcctgttatatactttacaaaaagcaacgcttctaaggcgaaatggtaaatgtgtccctccattttttttgacccttgtttcacctgccacttcatctgtgtttaccctcttgtttcaacacctgtttaattgtgacctcagattttaaacagtttagatgtgtataagaaatacctggaaattttatatctctgaagaattttcccagaacattatgggaattctttataaatttttctttctaaatatggagattttaccttcttatacatattatttaatttgtacacttacaatgaaaacaacacaactcaaattgttttgtctgaacatgtcacaaagtctatgttggatgtcatttttgttagaaccaaaattagctttattcagctttatttgattccaacgtaaagctaaaaaaagt

SEQ ID NO: 266628 - DNA, 435 bp, Homo sapiens
aaaaaaaagtcttgtgatgacattggcccacctagtaatctgagataatttccctgttttaaaatctttaatttaatcacatttgaaaaattccttctgctatgtaaggcaacatactcagaggttacagagactaagatatggacatctttggagaactattagtaagtctacttcatctaccataagtaaaacctttgagctggtaaagagaggaaagctaacagaactttgagagtgtggtgttggagtaagtctccaggaaaactctctacttcccatttcaagttataaaaatatctaggcaatttggggcacctgagaatagagaacatatgttctcatttcttgagtggagcccaagaaagcaaacaagatttgcttgatataataccagtgaagtttaaagaggaagttgacattttaggcatagct

SEQ ID NO: 266629 - DNA, 569 bp, Homo sapiens
tattgcgagatacccgctttctagggtgctaaagaaagactactttaaattgttattaaaaattacagaacatagaagatatctgcatcttgaactctgcataaaactgatttttctgtgtggttaaattcagactatactttttggggggcaatatctcagtaatgatgctgtgttcttcggtgtgcgtcagcacatcacaaaaatttgtccttgtgcagttgattttaaaatttacttcaagagctctcggaaatattcatttcactgtagagttaattatttttctcctcattattaagtatctttatgtagccaaagaagagctgtgcataaatcatcacatttaatctggcagctgcctttctttcttaggttttctttgcatatgtctatctttggaaaatgaagactcttatctttgtttacaggccagaaaaatggggtaaaacacaggctcttccacttactggatgtttgacaaaatgttctttttgggcgaaatacattggcattactagtgagcttgttagaaattcagaatctcagactttatttcacatcttctg

SEQ ID NO: 266630 - DNA, 587 bp, Homo sapiens
ctgttttaatcttttttgatatctttattctacctacttatattgttcgctgtcctattatcttcatggccaatgttcaagtggtagcctagtaattttcgatcagggtgcatatgagaaatttacagattaggggctgaggtatgttatatttgaaaacaacatatagttttgtagtataaactatattaaattaaaataaacaaatggctttgctggaacaaatatacagaaggtaaacttgaatatcgatgatggttggcaagtagcaaaaggaacagataggtgttcctgggttaagggaagcatataggaatcttggggttagtgagaggaatataccatttcaatatttatcaaatagaacatgggtattaaaatgttaaaagaacattatttgagtctttttttatctagctgttttttatctaaggtttcaatactataacctaatctttaccccaaatttagtacttctagctaagttttgttttaacaaagaaaagtaacatatattatcagtgtaggttaaaatgcattaatccatacttgttggatcaataaataaggcatgaattaaaaaaaaa

SEQ ID NO: 266631 - DNA, 665 bp, Homo sapiens
aggggagggaggctgatccagggactgggaaggttgaagcggggaagatgcgtagacctggagggaggaccagtacgcgaaatatgggccaggagtacaacctgggcgacagagcgagagtctgtcttaaaaaaaaaaaaaagaaaaagaaaagaaatactcaaccaaacccctgcccttccccttcttcactcttttcccaaatgtagtcccaggttggaaattcttttaattaacaaacagccaatactccctggaaagtttccaagtgcacagtggtctccacactttcattttatttgatttaatcacaccttatcccagcatggaagagcaagtaaggagaaggtggaactaggtgaggaaggggaaagaaagaaccaaagaaggccaggcacagtggctcacgcctgtgatcccaacactttgggaggctgaggcaggaggatcacttgaggtcaggaattcaagaccagtctggccaacatggtgaaaccccgtctctactaaaaatacgttagctgggcatggtggcgagtggctgtaatcccagctactcaggagactgaggcaggagaatcgcttgaacccgggaggcggagattgcagtgagccaagattgtgccactgcactccagcctgagcaacagagaagattcagtctc

SEQ ID NO: 266632 - DNA, 556 bp, Homo sapiens
atctctcacaaccaagtaccctgccttaatcgtccccaaacaattaacagaaaggtaaaaccaaacataagactgcacacattttaggactgaaagtaaaataactaatggaacaacacaatggagtccgaagagaaagtactcagggaaggggtgacaaggacatgctctagccaaagacgtttatttcatttcctagttctcctgatactatggcgatgggggcataagggacactcacctgtccaccagagcacatatggtgctgactgattttccccatgggacccaggtgaagatctcgccaggatacctcagcttgggtggacttaactgccacaaagggtgggtcctgcacagggggggcctgtaacccactggtcggccagtcagacaggtgggtgtcacataaggtggtgacactatggctgccctgccagtaggctcagctgccgcagtgggaggggcctgcactgtgtcagtaacccaccaggctgcaaattttctgaacttttatactgtgcttcccttataaaattgaatgcctttaaacaat

SEQ ID NO: 266633 - DNA, 396 bp, Homo sapiens
tcagactaaataaatacataatcataacttccagctcagctttagcttttcaggtatacatccagaaggcctgaagtaactgaagaaccacaaaagaaagccagttcctgccttaaccgatgacatctctccattgtgatttgttcctgccccaccctaactgatcaatcgaccttgtgacattccttccctggacaatgagtctcatgatctccccaccctgcaccttgtgacctccacttctgcccaaaagagataaccacgtttaactgtgcttttccactgcctacccaaatcctataaaactgccccgcccctattctccctttgctgactcctttttcgtactcagcccgcctgcacccaggtgattaaaaagctttattgctcacacaa

SEQ ID NO: 266634 - DNA, 389 bp, Homo sapiens
ggttcagtttgtggttactgaacctttaagcttcatttgccagcaggtatacatccagaaggcctgaagtaactgaagaaccacaaaagaaagccagttcctgccttaaccgatgacatctctccattgtgatttgttcctgccccaccctaactgatcaatcgaccttgtgacattccttccctggacaatgagtctcatgatctccccaccctgcaccttgtgacctccacttctgcccaaaagagataaccacgtttaactgtgcttttccactgcctacccaaatcctataaaactgccccgcccctattctccctttgctgactcctttttcgtactcagcccgcctgcacccaggtgattaaaaagctttattgctcacacaa

SEQ ID NO: 266635 - DNA, 628 bp, Homo sapiens
gaagtaaggaatagtcttctgaagaggctgtctcctgtttttcaagaagatccatagagtttatctcgttcctgaaacctcagggtggataacagagcctggactgcccttcagtttcatgcacatattcagcacgttagcccaagttaacatatgtcctaatcatacacagcaatgcatatgtatgtacctgtagaattttagagcaggaggatatctatgaagaaccggaatatgtagataagaggtttcatggaggggaaggtacttgtgttggaatatgaagactgggtagaatttgctaaggggagtagaagtagatctatgtgagaagaaattataagaaaaatacagaggtggaagtgagtatgctgtgcttgtggattcttgaagagggataaggcttattggaatatagaatataatggaaagaaaagttgactagataaggtgagatggccatattacaggaagtatagaatattggagaaaatagtttagatttgatatgagagaaatagggtgtacaactgtaaattttagaatagaggagtgatatatgaacctgctttggaaagatttccttgatagctttttacaggataaattgaaaggaaggggagagacc

SEQ ID NO: 266636 - DNA, 365 bp, Homo sapiens
cacacatacatttctttctccttataacagctctaatgaaggagagtaatgtatgtattattttaaaaaggtttccaaacttgaaacaaactttcagagtggaaggaagatcccaacctaggattaacataaagtgatagacgctttttcttataacgaaataataaaaatgaataaaataatgcttaaataaaaatgtattaggggaacttaatggctttttatagctgctcttgggatgggtggattaatttaacattaagagaaaacagcagtacagaaaactctttgcaatctatattgctccattctgttcaattaatgataattattttaaagcatgaaagaataaaacatatttgaaa

SEQ ID NO: 266637 - DNA, 623 bp, Homo sapiens
cgtgccactgcactctagcctgggtgacagagcgagactcttgtctcaataaaataataaaataagatgtaaagagacaatgctggcatcataacagtgctgagtcttgcagcagacacccaacctgctcctggctcatggaaagctctgctcagacgcatctgccagcaggatgggtttcagctatgacctgcgtaagccagggcaaatttttcacaaattcaaaccaggaagcgtttagttacactcagctctgggtaagatgctgtaggggtaaaaaaagaatataaaatatacttcccaaagcaaagactattcagaaacgaggggaaaatacaatacactgtgaggtcaaacatcaaataaaacagtatcaacattaacagtgactacataaaaacagagatgcagcaaagggctagaaaacaaacaggccgggcacggtggctcatgcctgtaatcccagcactttgggaggccgaggcgggcggatcacctgaggttgggagttcgagaccagcctgaccaacatggaaaaaccccgtctctactaaaaagcaggagaatcgctggaacccgggaggcggaggttgcagtgagccaagactgcgccgctgcactcc

SEQ ID NO: 266638 - DNA, 389 bp, Homo sapiens
atcttgcctgttaccttctttttatttaatgacctttaactcaaatcaacttttggttgcaactttaatagttttttatttgacttgcatttgtaaacctagggttttatagactcaggaagctattaaatctctgggggttccccttctcactctgcattacaacatagtgtgtaatttaactatttaatgtcatccttatgttttcagtgccttttgctaagccaaatcttatctcagccttaaaaaaaaaatagtccataaactctctgtggtgtaagtcaagtgtttgcacagtacagccatagaatgtactgataatcggaaatttatcttttttcaagacattgttaatgggatacctctcataattacacctttcagaaaga

SEQ ID NO: 266639 - DNA, 271 bp, Homo sapiens
  misc_feature (79)..(79): n is a, c, g, or t
  misc_feature (134)..(134): n is a, c, g, or t
  misc_feature (195)..(195): n is a, c, g, or t
  misc_feature (204)..(204): n is a, c, g, or t
  misc_feature (211)..(211): n is a, c, g, or t
  misc_feature (214)..(214): n is a, c, g, or t
  misc_feature (262)..(262): n is a, c, g, or t
gtattgttcatagttttcttttcttgcaatgcctttgtctgattttgctatcagagtcatgatggattcataaaatgangttggaaagtatcaacttatattttctgaaggagtctacagaattatattatttncaatttaaaaattttactgattttagcttctacatttattagttccttcttttacttattnattaaattncaaattngtntgttttttctagtttatgaagtcagaagcttagattattaatgttagntcttttttc

SEQ ID NO: 266640 - DNA, 424 bp, Homo sapiens
agtacttccagtagtgatttttcttcccctgctttccttgtcactccattttagtggtaaactttttgagtgctgaggttctttgttagatctcatgctctgtccctttctcagacgggcattcagtctggcatctttcatttaggggatgaaacatgacaaattatttctcagtagccgagacgaaccagctttttgttggtaattcaggggcttctgagggaacagctagtgggtgtgtggtttccatgagtcctctgaattcgatgagagtggccaatgtgtggcagcaatgagtcaagacacctgtgcacctagcgtagagaacaggtattttgctggatttgattgaagatattcttccatggcaccttatgtttatattttctatatcgattattaatgaaagataaagatctgtaaa

SEQ ID NO: 266641 - DNA, 433 bp, Homo sapiens
gattgagaggctacacttaggttcaacaggaaagaatattaaggtcaataagtattgtgagccacggtgcacaatagaagcattctgcccatttaacctttctgaccctttcccttgaggtttttctgtacaatgagcaattgaactaggactgttgtccagatgtctttgtttccaatctggaatttttccctctacctcatatttctgtattattcagtgagaaaagattcggattattgacttggggaacattaaggatgatgtatgcgctattccaaaatcttgaattttgtttaaatcatagaattacttaccattcctactcaccccatctaagtttaaagtttatttaaaacttcagaaattattttatttgtgtaaataatttcaacttttagattcagggagtacatgtacaggtttgttccat

SEQ ID NO: 266642 - DNA, 464 bp, Homo sapiens
tggcttactctgtcagtagctgctaagctattttgtgattcctgaaactattgctttgataccagcactggacacttaaaactctcttcagctgtgctctgtgtggtttgtgattatacttcttgcctgaatttccaaatcttgatgacattttatttataaaaatataattaactagttatcagagtacttaccatttcttagtatcatagaaccactggactatagcttattgaattataaaggggtcttgaagatactttagtgagttccaatcccagatcccaccaagttagcaaaggagaatgatgtgctgttttcaaaaattcaaaatcctaatgaatactccaaatgtactcatgttaaaactacatagaaatgccaactgtgggctaccctctttgggtcacctccctttgtatgggagctctgttttcactctattaaatcttgcaactgcaaaa

SEQ ID NO: 266643 - DNA, 268 bp, Homo sapiens
tagaggtgcttgaaaagtcaacttcaaggcaacagctcctgttctgtggctaggaagaggcagagaccacacgaacgcaaccatgccctacactcctggtgttaagaagccaaagcttcctccaaaaaatggcataggatgacgagcttcagcgcagaacccatgaaaacctctctgatgaaaggcaactgcgagggaatgctagagttaatccaggtgcaggtgggaggctcgattcggcccagacaaacagagccaccaagcagag

SEQ ID NO: 266644 - DNA, 323 bp, Homo sapiens
ctgcaggctgcctgcgtcttgagtaaggaaggaacaatccagggatctgccaatgcctcacaagtgtgcaaatcagcaaatattctgagactatacactgtattgaaaaagaggatcgtcagcttaataccattagagtactgtgcttttgttctgtacagcaccaaaatgcagttttcattcaggattaatttattttttcaaactatatatgtacttttctgtttaattgtaatcctaggagagcagctatattatctgcattgttgttatattcccaaaacccagaaaacagatgttcaataaatgattttcaaatgaaa

SEQ ID NO: 266645 - DNA, 764 bp, Homo sapiens
gtcccaactccacccagtccggcctggcctctgtccccgggtgaccgcggaatgggggggcgggagctagcgagcaggccctcaagcgcgtctggccgcctcctttgtcttgatgcccacgtctggttaggacccctgctgtccattttattaaaggagctgtagaaagcggcctggggcccagcgacctgcccagggcggacgaggaggcgcgactggcccgatgccgcaggctctctgcccagtgtgctcaggtgggagggcggggacatgaatcgagccacagagtgccctgggcacggacccccccccccccccggccccgggccccgagccccgagccccgagcccggccaccgaagcccgtgccactcgccagctcctgcgagacgagcctttcgagcgcagctcaggcatttggttcagggtcctactgccggagtcgtctgaggcctccatccgtctgtcgtcacgaaaaaggttttggggggactaataagcacttcctgaatgcacatttgctccacgcccctgctgtagggagagggtctgcagacacttcaacaaatagaatcctaggaccttacctgtgagtacaagagctggaatcttcccaccaacttcttaaaattcaatcctatacttggtccatttagcttagactggaaatttcccaaggcagtttgttttgcaatcttttgcatgattttagctctgtatagtttagtgaatgtttatggtactgaataaaacagtctaaaaac

SEQ ID NO: 266646 - DNA, 1028 bp, Homo sapiens
tatttgatccatactgaatgtatttgctagagtgcattgtacagatggttcaggtgtgttagatttgtctctgtaaatgaattggtcagtagataaaagaacatgactcaaggctgagcagggttcagcaggccccaagcttcatcattaaaaatcgggtgttttttaatatgaggctggctgtgtaaagcagacctcatgaactcaggggtctgagaggccaggccagattatcagttgggatgttttcagtcccaattagcagacagcgcagttcacactggcttaaacaataaaggggacttactgattcctgaaagttaaagtccagcggttgggtggacttcagggttggtttgaatcaacagttcctcagtgtcatcaaagatgctgtttctttctggctgtctactctgccttcagtggcatgagcctcatcctaaggctggctcccccttgtgggcacaagatagtgccagcaactccagaggctacaaatttcctcctgccccattcagagagcaggagaatggcttctagaatctctgtcagaagagccaggaagcttctttcccagaagcccccccagatttcatgctttttagtctgaatggatccaacgcctactagcctactgtgctgcttcatgtcagctgtgtcccccgctagaaccttgtgtggagccaggttcctcctaagcacagaggtggtatgggccaaacgaagctgcctaaatgaaaatggggaaaggtgtcaagagaaggaagacttagtgctggcaaccaacagtatttgttgcaatcaatctcttggccatcctcattcatacacaccttccttcccacgcatacacctcccaaaatgcccacacttagggaaaacctatttacccctttcccaaagggatccaactccaatccggaaaccctaggtgatgtgtcatcctctgaatttggtcagtatatagctcttcatgtttcagggaccactggtcaccatgctcaccttggcatagaaagtaagagtgc

SEQ ID NO: 266647 - DNA, 415 bp, Homo sapiens
aaagaatgagtctgagtttgtaatcctgggaaattaagtgaatgttagtgctttcaacttactgagaaacagaaagctgtaaagtcttgatggaattgtccaaaaagtatctggaaatatgaatctggggtgcagacagtttggagtcaaatgaatgaatggatggatggataaatgaatggatggatggactgataaatacttgtatacctattcatccattctccctttattctttccagtcttctttctttagtttctaataaatcaaatggcataacttgttgcctttaaaattttatttgcttcattttatattactttaaattatttaatatgttttatttttcttttgaatttaattcttttccttacacactctgcttgcatttcttcctgaagcttttaaaacata

SEQ ID NO: 266648 - DNA, 470 bp, Homo sapiens
cacgaggggcagaactgcctcggaattgccactgtgggtactctgcatgtggggtagccctgttttgcaaggagcagcacctctgctcctgttgtacactgtcccttcaataaaagttgctaacaccaccaccttgcccttgaattctttcctgggcaaagccaagaaccctgttggcctaagccgcagttctggggttcgcctgccctgcatcaccagcacagtggaaggccacaagctcacagcattttcatccgtaaacaaagcttggcaatatctctgatggttaagagcttacgtgtttgcgccagtgagacttgcactcagtcttctttgagtgagacttgaactcgattctgagtctcctccttcctagatggactcattatttacttatttatgtattcactcatctattcattaatttatactcttagtttgatatcaacatctgtaaaatggggatggta

SEQ ID NO: 266649 - DNA, 572 bp, Homo sapiens
caagttcagcttgcagcttccggggaaatgcaaccgacctctatgccatctctagctgggtaatcttcgaggccctgaaatgcaattttctgaacctctaagtcacttttattttatgtcatgtgataaagacacaagtagtcacgcactattggaaataggttgggagggaggtctttaagatcgcttttaaaatagtttccaggacttgtctaaaaatgatgacaaactttgaatccagagggcctgttggtcaatgtgttggaaaggacatttcaggccggcagagtaattggataattcacaggcatagaggtgacttttggaaaattcattctcctatccatgctgaaccaggcttccacgactgggttctacccaggccagtgggaagactctgggaaacttcaggccagccttgattggaagaacttccaggaggagccattgctgagatccaggctcactgtgattcactgaaaatgtagcgaaagggctgtcactggatattttgctatcccaaactctcagcctctgtgaataaagttgttttttcattaacctctcagtga

SEQ ID NO: 266650 - DNA, 473 bp, Homo sapiens
cagagtaaggtgataccttattgcagttttaatttgaatttccctgatgattagtgatgttaaccatttttttaacatgcttgttgtgggtttgacatttaaaaagactcatattcctcagataagtttttttctttttcatccccacccccactctccccgtcccagttgagcctccatcatctctcacctggactggtgcagtcttctccaagaccctaggcttcagaagcagacgagggaacgagcagaagaacagaagaacagcagaatggcatggcagagagaagaaagggaccatctgaacgccaagagaaattcagctgggggaggtcagagaggagatagactgcaggacagccaagctccaggggaagatcatcttcccactccatcccctttccagctccccatccatcccgctgagagccacctccaccactcaataaaaccctgcattcaccatcaaaaag

SEQ ID NO: 266651 - DNA, 513 bp, Homo sapiens
gaatggaagaaaattcttctgtttatgtgatatatcatcatacttttctacataaattgagtgcagaataactccaggaaataacaggaaagcaaactaaccaagttgagaccccccatgtctaccaaatggtttgtatgtgttaactcattcagtcccagcagccaccatctggcagattctgagcactgtgcttcaggttacattgcttaaaaattgaataacataaggattgtgaagtatggagcccagtgcacatttatcaaaagcatctgattcaagattttaatctagttccacctttttcaaagttctttatattctcttgtagtattctttcctaaattttctcagtaatgtagcaagatgaggaagatactagatagaattgtccttaaactgcctgctatatagttatctgtgaagaagcaaaagggaagcagtgtggtatgttgaaaggaactcaggattggaggtgagatttggggttcttgtctttgtcttaaaaaaaaa

SEQ ID NO: 266652 - DNA, 446 bp, Homo sapiens
ctcattttcatttctcctttttatctacttgtgagcccaaaacaccctcccactgaagcagcctcgttgtctggggtgacacctgaggtttgctgtctgacggccacagagatcaaggatgcagacacacaaagagtgaggttaagatcagaaatttaacaggtgaaagaatagttctctgctacagagaggggtcttccaaggactcttttgccctcactatctgcctaaataatctctatctcctgtatcactatcagctatcagactgtaactataagctttaaaaattccaaacttgttttggtgttaataaatttttagtaaaaactggtgaacacatttcccggcatcttttcatttaaaggaatgtgtcataaccaggtcacttttactgtaatttgatgcattaaagaagtaatcttacaaatgtgactgatgacatg

SEQ ID NO: 266653 - DNA, 417 bp, Homo sapiens
ccaggggaactcactggggaaaagctagctttcttcaataatggtactgtaaaaattgggtaaccaaatgcaaaaaattgaacctcaatcctttacactataatcaaaaattaactcaaaatgggccaaaaatgtaaatgtaagacctaaaccaatattattttaaaatagagagtataagaaaatctttgaggcgttgagttagtccaaaactgcctaggttaaatataaaaagcacgtatcataatagaaaaggatgataaattaaaaagtattagtctttaaaagataacattaagaaaattaaaagacgagattaggagaaaatatttgcaaaacatgtcgataaagtatttgtattcaaaatatataaataactcctaaaactcaacaataaaagaaaataaccaactttta

SEQ ID NO: 266654 - DNA, 339 bp, Homo sapiens
gaagaatctcttataaagaggttgctagtgctctttttgccttatacaaagccattatcttcattatcctgatcagaaaacacagcttcctcttgccctgatataagacactcttgctgtcttccaagattgtttgctatacaaacattcttaaaaagattgtccggacctaaggctgtttattccttagtggacatgaagaaatgcaaaatacccacggagaattatctcccaagagcatccaagagcaggctgctcatcaatatatcaaaaggatgtttaaatttcttcaagatttactaacagtttgaaaaaaataataaaacaagtatacttatc

SEQ ID NO: 266655 - DNA, 829 bp, Homo sapiens
gggtgaagcaaatgcagaacattggtgttacttccattctagctgtagaattgagaagaaaataaattaatttcttaagttatgacaggaaaattttctatagaatcctgctttttttcatctgtgagaccagccgcatcattccagtttctaaattatcggcatttctaaagatgaagtaacaggggaagtgatgaactttataaatagactccctaaaatatttggcatgaggggtcaagatgtaggcgaagctggaaaaagactttagtttgggtattagccagaggccaacagttgttaaattctctaaatttccttaagaaaggaaagagaatcccttgaagaacattttttttttctccaatgtgtagtcagtgaaacccagagggggaaaaatgtacctttcaagccagaattaggtcatgccaaccacagcaaattggaagctctacttaaactgtagtcttgcaggattgctatgtatcatcttaatgtcatgcatgtggtggggccaacacttccagatcatagctgctaggctctgctgagcggggcagctctgctgggtgaatctgaccaccccattgggctgcatttggcacacagacataacctaagactgtctgaaaggtaagccctggaatatggcattttttaaagtgaaaaaaaaattacaatttctaaaaacaaaatatttcattttgttttatgattttagaggggggaaatgtcaagggaaatagagaatggacaaatccaccattatgaccagcaggcacagcttcctggcaattgagacaaggttgccaaaaacctaccttaccat

SEQ ID NO: 266656 - DNA, 439 bp, Homo sapiens
ttataaggccaattacttatctaagaaagagtaagtagaataaggcaaaatacttacaaggcaaagctactgctgcggtttcaatgcgtcttccaaaagttcacatgttagacacttggttgccattgtgtcagcgttaagaggtagagcccttggcaggcaattgtgttatgaggggtccaccctcatgaatggattaatgccattatcttgggagtgggttagttattccaacagtggctttgctataaaagtgagctctctcttgcacccactatcttgcccttctgcctatctggcatatattgacccttgctagatgctggcaccatgctcttggacttcccagcctccagaaccatgagccaaataaacttctttatacatttcctactctgtggtattctgttatagcagcagaaaatgaactaagacaaat

SEQ ID NO: 266657 - DNA, 387 bp, Homo sapiens
atgaagaaaactgagggtagggtagagaagcaccatagggagagaactcaagaggacagtttgggacgtgttaagcttgagatgtcaagcaggtggtcagaggagctgaaccagaagcatctcaaattcaacatttctgaactaaattcatttcttcccaatcaaaactgcaactcctcctgtattcaccatctcactagaagatatcaccactcaatcagggtgcacaagccagaaacctgaaagttctcaggatcaacccctaacacaaatacacacactaaagcagtcacctgcccagtgagtttccctgtttcttctctctctccgtatttcttcacctgggagctcctactcatcttccaggcttgagtctggaaatcactt

SEQ ID NO: 266658 - DNA, 317 bp, Homo sapiens
gatgaactacaaaatgagagtgagctcctcccattagtccatcctgatatgtgatttcccttccagaaaatgggatagattctgatggtgtgagggatgattgtggtggtaagttgatataggtaaaataggtcccttttttaaggctcccttcatagctaagaatttacaaatgtgatttcttttctttttttgaaatcgagatagggttttgccatgttgctcaggccggtgttgaactcctgagctcaagccatccactcgcctcagcctcccaaagtgccgggattacaggcatgagcaaccacacctcggcc

SEQ ID NO: 266659 - DNA, 724 bp, Homo sapiens
agccaatgttacaggttgaaagaatgaatgagcgacacaggatgaaagacagcaagggaacaggctactggggagatacctgtaacaacatcaccaaccacagttggggtaatggagaatttgtaaaaaaaaaaaaaaaaaggccttactactttctgatcatatcttagatatgtcataagccaaacatcctactttgagtcaactcaagtcaatggggtatatcatctataagaaaaatgtgggatatttgggaacatctacagaaacactataaagtagaactataagatgaatacccctgaactacatgaaaagttaaaattatactctcctgtaccagaaagagagctacgatcaagaggactttatttatggacagtaacattactacttattctgaggtcatgcttcctgaacactgcaatcaaattaaaataaccttaaatagcacttggaagggcaaataactcacaaagcccaacagactgtcccttaagagaggtagaagaaaactgaataactgaagcaatcaccagcaggttccagcagctagacacaatgatatcaattagaagtaaccaataaaaatacagaaatgaaaaaaagaaataacagaaaactaaactattcattcatttttctagttttcagcagcaaaccatctgtagttattttgtcatagaggcaaatgacactctttgaggactcaattgtattataa

SEQ ID NO: 266660 - DNA, 625 bp, Homo sapiens
agccaatgttacaggttgaaagaatgaatgagcgacacaggatgaaagacagcaagggaacaggctactggggagatacctgtaacaacatcaccaaccacagttggggtaatggagaatttgtaaaaaaaaaaaaaaaaaggccttactactttctgatcatatcttagatatgtcataagccaaacatcctactttgagtcaactcaagtcaatggggtatatcatctataagaaaaatgtgggatatttgggaacatctacagaaacactataaagtagaactataagggtacatctcaagtctggcctcacctttcccagtgaaagtgacagggagacccaaggaatttcacatccaaagaaaactaagcacatgcaacaaccaataaccagagaaagttcttcatcttgggtagaagtctgatataactgtaagaagccaaagtactcctggctcatccatttgagaaccttggattttaggggcagattcatctagatatagaggtgtctggcttggagtgaaaatctccattgaatcattgcagttctgttttgttttgttcctcctgtgatgacacacgcttaggtataactattaaagaaagggttattaatttcc

SEQ ID NO: 266661 - DNA, 418 bp, Homo sapiens
gattttcctaaactcacctagctacttagtggccaggccatggttagaacctgggtctcctggtgtactctgtgtttttcaatcctacatggttgcctgacaataaatgcacacatagttaattctctagtaatgtgctatattcattcataacttagtcaataattatttcttcagttggaaatttgacattagacaactcatcactgatacataggattcttataagtcaagatttaattaaaatccattttgttctttttaagctgtaagagatggaaaaataaatatgcaaagcagtggattctattatgaatcaattaggccactattctatgtgttttgttatccatggtgggtttcattcattcttgttcagtttgtgagctgtaataaagtgtgtgttttgtcattgaca

SEQ ID NO: 266662 - DNA, 426 bp, Homo sapiens
aattctatatggtcttagacaatacggaggcccaagaaaaggggaagagacaagggaacggccagtaggttggaggagtcaacacacacatttattaagtttgtggttgcatatgtgcatgatttgtggtgccccaaaacaattacaatagtaacaaggatcactggtcacagatcatcatcatagacataatgataatgtaaaaataatataattatgaatagacaatcatatattaatatatattaataatgaaaaagtttgaaataatgcaagaactaccaaaatgtgacacagagacacaaagtgaacacatgctattggaaaatggcacgaatacacttgctggatgcagcgttgctacaaatcttcaatttgtaaaaatgtgtatttgtaaagtgcaataaagtgcgataaaatgagcta

SEQ ID NO: 266663 - DNA, 223 bp, Homo sapiens
cctttctccccagtcttttatttttaaaataactgtgttaatcagttagtgctttatttataatgaatttctgatagtcgaataatttctaaatctcctgcaagttagtacttgagaaatttgaaattaattttcaatattaacatttaagctaatataaaaattttaaatttcaataaaaattaaaaattatgtaagctacaatgtaactggcaagtttccg

SEQ ID NO: 266664 - DNA, 816 bp, Homo sapiens
agcggggtctgagcgcgcggcgcctgcggcggcgaacggacggacggaccgcggacggacgtactgaccccaacccgcgagccccgggagccgtcgatctgaggaggggccgcttcgccatgtcgccgcgcacctgctgagcccggagcgtccgaggatgtccgcgctgaggaaggctttctcgccatccgaggcttggccctagccctgcgcggcttccctcgcggctgcgaaccctctgcctgcgcccagcccagccacaatggggactgctcggttttgcctggcattctgcagaagcattgctgtatcttaccagacaggaatacaggccgtctccaaactatagtcctattggactggtgcaccaaatatggatttggggtgtgcgtaattcagtccatagcacccaccaaaccacagaagctgccccgagctgatgtcccgctatcggtgcggctgcaggacactgtcccattgctgcatggagcctctcgctgtctgagcctcacctgaagccggcccacaccattttcttactctatgcattggagcgaaaatgtttaattgactacgatgggtgattcctaaagttatatttgactcagaaaaaaatgcattagtaaaactccctgtttgaatgtttctagtattcacagcccgggtcactgtctttctataacgattggtatctgaaataagaacatgggctgcaacttacagccttgctctttctactatataaacttccctaatcaaatatttttcattaaaaaaatgtgtttttggaaataaacagttacaacctggttccca

SEQ ID NO: 266665 - DNA, 824 bp, Homo sapiens
accactgggcagaccttgctggccacggcctccacgtgcagtgaccgttctcttggcagcgtctcaggctgtctggaccagctgtcacagtctcgctgtgggtgagtcacctgaggcactgtatggcggatagaaggattcattgccctgggagggttttgcctggcattctgcagaagcattgctgtatcttaccagacaggaatacagatgaagacccccaggcccagggaattcgatcactggctgagaactcacagctaaggagggggagcctgggattccttcctggtgctcacacccgagacccttttgtcactgtgttcaaaggcactgctgcacagacgtgattcttctttcaacgaacatctccaggacttcctccggggtctgtgacctcatctataattaaagggaacagagatcttcctgagattagcccatttaacttgtttaactagatgcatgctgcaaaaactgttttcaagaaatgaacaattgactatttaaaaagagccaagccttaaaagaagaccaggttttaatagggaaaacattcagtaaaatattattctgcagtaacttgtggaatgactgctgtacacacagctctgggctgggtacctggaagctcacgagcttgtctggcctccctcctggacacaggaggtgtcaggctggtgggcagccagaatctgacccagctggacactggagtgggacgacctgatgcgcgtcgcctgcgaaaatggcgcccactcgcagcgccagcatccctcaacaccctcctgacacggcccacaccacaacgcacccacctcaca

SEQ ID NO: 266666 - DNA, 879 bp, Homo sapiens
agcggggtctgagcgcgcggcgcctgcggcggcgaacggacggacggaccgcggacggacgtactgaccccaacccgcgagccccgggagccgtcgatctgaggaggggccgcttcgccatgtcgccgcgcacctgctgagcccggagcgtccgaggatgtccgcgctgaggaaggctttctcgccatccgaggcttggccctagccctgcgcggcttccctcgcggctgcgaaccctctgcctgcgcccagcccagccacaatggggactgctcggttttgcctggcattctgcagaagcattgctgtatcttaccagacaggaatacaggcaatgctgtgaagcgtcagagggaattccgttggttactttcccatacggtcttgttcagctgcttgttctcagaaaagtgtgtttgttggtggaggagaatgcgaccaaggagaccatccttttcatgaaggcacaaacgtgaatacatatgtgacttttaagcctttaaataaaaacccaaagcacaaaaaaacaaaacaaaaaaaaaacaaacaaaaaaaaaaaaaaaaaaaaaaaaaggggggggggacacaaagaatctccccaggggggcccacaataaaaagggaacacacagctcaggtggaaaaagggggcccaaaaagagagaggagaaaaaaaaaacaaaaacgagggacaagagaaaaaaacagcgagaggaagaaagaaaagacgaagagagaaaaacaaaaaaaagaggacagacaaacaaagagaaagagagaaggagggagaaaaaaacagaacaagaaggagagaaaacacaaaacaagcaaaacaccccaaaataaaaagaaagagaaagaaggagaaaaaaaagcaaa

SEQ ID NO: 266667 - DNA, 590 bp, Homo sapiens
  misc_feature (577)..(577): n is a, c, g, or t
accactgggcagaccttgctggccacggcctccacgtgcagtgaccgttctcttggcagcgtctcaggctgtctggaccagctgtcacagtctcgctgtgggtgagtcacctgaggcactgtatggcggatagaaggattcattgccctgggagggttttgcctggcattctgcagaagcattgctgtatcttaccagacaggaatacagggcctctgaagagcaccggcagcttccttcttagcagaggagaaaatctctgccatctcgtgctcgcctacctcgactcgccagacgccctggagcagaggaggagcagtggtcggcagcggccagccgtgcaggtgccacacctgatggtccacctgggagaaccaggcaggaagccggaaagagtcgcagtgcacctctgcggggagccggaagatacagacagcccaactaaatccttgaaatgcagcgtggcgtgaaaatggagcggcattttagttaacgagggtctggatgccattcacaggaatgcagtttctacagggttctgctttgcagagacctctcctgataataataataaatntactcagaacaaa

SEQ ID NO: 266668 - DNA, 1080 bp, Homo sapiens
gaagaggaagagaccaagtactgtcttctatgggagggcatggcaggaaggcaccatctgagcccggaagtgggtcctcaccagacactgccgtcacctccgcgctggacctgcagcctccagaactgtgagaaatgaattctgctgttcatttatgggccccccagtctgtggcttttgttttatcagccccagctgactaagacaagtggtgtctcttaatgaattgatgaattctttgtgttttgaagagtcttcatggatggtacttcagcccgaggagatgcgtgtgctttgtaagagatttgaggggtgaagtcgccccaagttttacatctgtaacaggctttgaatgactgttcttgcctcagtgccaccagagtcagtggcgcaagggagaatcatcggaggaaaccccctcactggtgtggaatcggagcccccttcctgcgcttggagtgggggttcagcagcagggttttgcctggcattctgcagaagcattgctgtatcttaccagacaggaatacaggcaatgctgtgaagcgtcagagggaattccgttggttactttcccatacggtcttgttcagctgcttgttctcagaaaagtgtgtttgttggtggaggagaatgcgaccaaggagaccatccttttcatgaaggcacaaacgtgaatacatatgtgacttttaagcctttaaataaaaacccaaagcacaaaaaaacaaaacaaaaaaaaaacaaacaaaaaaaaaaaaaaaaaaaaaaaaaggggggggggacacaaagaatctccccaggggggcccacaataaaaagggaacacacagctcaggtggaaaaagggggcccaaaaagagagaggagaaaaaaaaaacaaaaacgagggacaagagaaaaaaacagcgagaggaagaaagaaaagacgaagagagaaaaacaaaaaaaagaggacagacaaacaaagagaaagagagaaggagggagaaaaaaacagaacaagaaggagagaaaacacaaaacaagcaaaacaccccaaaataaaaagaaagagaaagaaggagaaaaaaaagcaaa

SEQ ID NO: 266669 - DNA, 817 bp, Homo sapiens
aagtccagttgttttttttttttttctgtgagcatacatctcaaatttaaaagacagtggaaaactaagattttatttaagtcctaggtacaactttccagaactttttggaagcacaggagggaacaatattcttcaacctccaaaaaaaggtatagtattttaacaatttatgccaactttgagactttgtcagaattggaaaatatctctaagataatgggagatctttagagatgtttcataccaggataaagatcaaatgccgctgtagcctagagttaatatgtttggtggttatcaactagatctaaggcatagtgaggcaaacaatgtctactctttgatgcatacattctttttcatttttgctcctttcagtttttcctctgccccattgcagctagtaacagtttggccctatttcatttgtagtcaagagctctctctgtaaagaaccatggttccctcaaacagtggtaccagcaataaaactatgataggggacttagaaaaccccctgcccaaaagaaatattcatagtaataccgagtgtctttcagttcaaatatttatataagaaaagcttaattcctttttctgtgagaaaccatttcaaataacttgtttaaaaatactttcaaatttggaggtcgaacaaatgtgttctgtgtatagaaactaataacataggccgggcgcagtggctcacacccgcaatcccagcactttgggaggccgaggcgggcagaccacgaggtcaggagatcgagaccatcctgcccaaccgagtgaatgcccatctctactaaaaatt

SEQ ID NO: 266670 - DNA, 428 bp, Homo sapiens
gtctggggaggggtgatctggataatgtgaaactgttctttctaccctcttcaatgtatcttttcttgtttctgtgctctaaccaggtactgtaatctctcacctggatttcctagctcttgtagagatatttttatgcatggatagtcattcaaattaaagtttctgtgagagaatgagcactggaaacccctattctatcatcttgctgatgtcactctgccaataatatttctcttttaaccttgaattccagtaagctctgagacaaattttaatttcaacttttgcagttgtgtttttatttgtttctttagttttacctctcattgtttcataaatatgagacatccatggttgaatttcatactattattttttctagttttctactaatatttttcatgattataccttttctaatttta

SEQ ID NO: 266671 - DNA, 442 bp, Homo sapiens
  misc_feature (10)..(10): n is a, c, g, or t
  misc_feature (25)..(25): n is a, c, g, or t
cactaaaaanagactttttgaaaanggattaaaaaccatgttgtgttaagcagcaaactgatgttacatcctgggcacgaggaaaatctgtgtgttagactgtgcctagcatttaggtgccatctgcaattgttcggctgtttgcattttcatggttccttttgacagtagttccaaacagctcctaatttttgttcacagagataagtgctaaggattttagtacagtgctcctggctgtcatatttctaaaaaaatcaagtcagcagctggtggcaaataaaccagtgctctctctttcactacctgtaacttggtatgattgtaattgttaataactggtgaaaatacagggataagctggctgtgagccacccagcagaggtggactcagccttgcaaaggaagctctttgaaaggagggatactgttctagtcaaaa

SEQ ID NO: 266672 - DNA, 409 bp, Homo sapiens
acttaatttgtggtgtaaaatatttttgttatagaattgttccgcctcttaaaggagatccgtggggaaagacctggctggacagccttttacatagccccagtgaaaacaatgcaggaatctgaaaaggtcattaggaaaataaaaacttaaagtcctgaaaagctttctgacaattgtccaaggccatgcagtcctgaggacacagaggacaccagccatccctcagccacgacccacgagccaacccaatcagaccacatcttgtctttcaggaaaatgcactgaattttgtaccatgcccccaaaagcctggatcaaattaagagttttaatactcaaagtcatttatattgtgtctctaaagcatatacaataaatgtacgcatcactcaggatatattaaaat

SEQ ID NO: 266673 - DNA, 370 bp, Homo sapiens
taaaaaggaaaaatagttcacctaataaaaaacctttgggaaagaaccccctaagcattcccattaatggaaacctcagatcctctcctactttcctaaaaacgtagctgtctcaggtcattcactgcagctgtcattttacaaaagaaaatttaaattccctcttggccggggcaaatagagggcgacagcccctcgcccctgccgaagtaaggcagggcgccagccctctcgttactagaaggcaagctaaagctccttttaaacggtctccggatgacgacgcattcctaacgggtttcgaaggcatgtttaaatcgcccgcttttttgtttgctctcagcattcaccggcgccgggactgcggccg

SEQ ID NO: 266674 - DNA, 325 bp, Homo sapiens
gagatctgacaactgcctcctttggggacgctgcagccccatcacatctctgaggccccactcagagtggaaaacatgtctcacccgaaacctggtagggcaggacgggagcctgggcggcccgccccaggaggaggcccaaggctgctctccctcctttgggacgtcaccagcctcctcctgggcagctgataccttctcacgaccaccttccatctcctgccctgccctttgctgcactgtgggtaacacccctgtgttactttctggagaggtgaaaggataaggcaagatcccccaaggcctaagtgctgtgtctcatctt

SEQ ID NO: 266675 - DNA, 647 bp, Homo sapiens
gacagagtgagaccctgtctcaaaaaataataatgaggtcagacaaggtgctgggattacaggcgtgagccaccgcgcccagcctcaaaactaggatcttaaaaagctaagctagatggtacagtttgctagacagcattacctgctggtgaaggtagcgttgcaactcagccctgtaagaagctatcatcaccccaatgacaagtacagagtcacaaaaacctcaggtttggtgaacttcatgagggcagagacaatgagcggaagaaatgaaacagacttcatcagtgctttaagatcctatgtcttctcccagtattattctgccagcataccagaagtctggtcactcccttgactcctatttcttcatcaagctttccattcaactactgcatgtgctttaacagattcattccatataaaactctgaaaaaatatatgtattctacaaaataaaatttacctatagaattacaaaacaattgtttgtagattacagagaaatatgcaagtataagaacagtgtgggcctggtgcagtggttcacacctgtaatcccaatacttcaggaggcagaggcaggaggatctcttgaagccaggagtttgagaccagcctgagcaacacagcaagaccccatctct

SEQ ID NO: 266676 - DNA, 583 bp, Homo sapiens
gcttttctacttttcatgacatgacattgcttcgaaggaatctaatgtatatctttgaaccaatgccatattgtttctgctgaaaaaataattctaagaatattatgtatcttcatccaaattttggtggcaagtgtttaatttgtattttccttccaggtcatgttttgtttgttttgttttcatttttgtttttgttttgagacggagtctcactctgtagcccaagctggagtgcagtggcgtaatctcggctcactgcaaccttcgcctctggggcttaagcaattctcctgcgtcagcctcccaagtagctgagactacaggtgcatgccaccatacctggttaatttttttgtttgtttttagtagaggcagggtttcaccacgttgccctcggtggtctcgaactcctgagctcaggagataccgcctcggcctcctaaagtgccagctcatgttttaacgacacagagaacatctttacaaactgcctattccaatgcaaagaaaaattcattacaaaaaaagttagtaaataatttttattccctgaataataaagttggataaaatgtttact

SEQ ID NO: 266677 - DNA, 324 bp, Homo sapiens
ctggcctggcacagtggctcatgcctgtaatcccagcactttgggagatgatggtgggaggatcgcttgaggccaggagttcaagaccagcctgggcaacgtagtgaggaacccccgacctccaccatcccccccgccccccaccaaccccctcacttcaaagttttttaaatcagccacgcatggtggtatatgcccttagtcctgtgtactcaggaggctgaagtgggaaagtcctttgagcccaggagttgaacgttgcagtgagctatgaatgtgccaccgcactctagcctgggcaagagagctgaccctgtcacttaa

SEQ ID NO: 266678 - DNA, 400 bp, Homo sapiens
caaagacaaggactgtccatgaccatggtagaagagagcctgtgtctgctgagacatttaaatcagttccattttaactaatctaacatttatgaacagctctgtggaaattagtctttatgttaacaggttcaagccagcatcaaaacctcagctaaaattagctcttgctaactgataaagcctcctgattggcctagaaatggctccagttagacaaaatgtcgtatttcaacaagttttgtttggcatttgtcacctgatattggtattggtttgttcattgaaccaacatgttcatgagcttatttgctaagcattcattctttccacggacatttcttgagtgcctgtagtgacctacacactgggccgggggtagggagacacctgtgaccag

SEQ ID NO: 266679 - DNA, 421 bp, Homo sapiens
tattagatgaggctttaacagaaaaaaattaaaatgaaaatatgctataacatttttcaaaacattctcggcctcttgcttattttcctgtatctttctttgaatcttttttgtattttcttttctgtccctgcccttcaacctagaagactcactattctcatttatattattcaataaacttctacatgaagagtaatgatcaacttcatgaatatagtattgctgaatgatcacatcatggctgcatcacattaattgtctttattttcagatgaatatattccgaatcagtgtcttttgagtttttacaaaaagacaaaaatttttaaatgaaggtaggaagatacatagtattgagaagtaaacgtcccctttaaatttacagctaggaattattttaacaactttaaaaaaaaaa

SEQ ID NO: 266680 - DNA, 542 bp, Homo sapiens
agctggagcccttcaattgagcttgatttgattgcttaggggagtggaccatgctggttagctcaaactaaccatagtccactcctggatgtgggggtagattcatcttcttccaaagtatatggactgtggggagttgggagggcaccagaacaaaaggctgccatcaggaaataggaggaggtaagttggagaggatgttaaggtaaatggttagtattcatacctcttaagcatttttactgtaactcttcatcagatctcaactacaaagaaaacacatgaatttcattaattaattcatgtatttaatattttttagagagagcctgccatgtgtcaggtactgttgaggatatagcagtaaataacagagaaataatctctgctctgtgggcagtggggagggaccatcccattttgccaagaggatgtgcgatagtattgttggatctcatatgatgtttatatgtgaacatttacttgatacagcttgtaaatgatgtgttgaaggcccttgtgtatacaaaggtgataagaag

SEQ ID NO: 266681 - DNA, 467 bp, Homo sapiens
agcatatctatcgttctagaaaattttacgagacagtgctgctctagactttaaaagtcaagtactctcagaaagttaggatttaaaattataagcttccatccatctatgcaagaagtccggatccagacaatatccaaaattaaggtccagggacagattataaatccatttagctaatttttctaccacagtcatatctatcatcattgtgtttatcccaaatagtttgtggtcataagagccaagtatctttcaaagtgcatccgttactgacatgaaaatggatccaaattacagcagcatttctgtcttcaaggaggctttggacacaacaatgatcatgtgtttttcacacatgtgatgaagctacttccaaaagtaggccttacaaattcccagttcattacacagaatctaaaatggcagctcatttctgcatcctttccacacaagaaaaatgaaaa

SEQ ID NO: 266682 - DNA, 81 bp, Homo sapiens
gactccagactctggtctccctgtttgcagagtcttaaaatggggagccactttgggttctttctacaagattgctttttt

SEQ ID NO: 266683 - DNA, 463 bp, Homo sapiens
agcatctctcatgattcctggcctcttgggacaggaagcctcaccttgagctctgacactgtctgtttccatttagttccagcaccactgtttggggactgctgtctttccctcttcagctttaaatatattagcaatatgtatgaatctcagcgacctcttggagaattacattcctatgattacttaaaagaaatcagttctgcatgatgaagcgtttacttctgttttctgcccgtctgtgcacctgaagaatgattcttattagattagaatttgtctaaggctgtattcgcattgagtgttttctctgctctttctcgtgagaggagtgctccctcccacgcaccgtccacagctcatttccaagtctgcatatctcattgtgcatctgctgctgctctgctcaggcctgagtagccgctgacagtgattggcagaaaagggtttccaagaatattaa

SEQ ID NO: 266684 - DNA, 421 bp, Homo sapiens
tattttgataatttttctgaaacaactgatagagaggaaaatcactctttgtaaaccaggatgaggagagaatcatagtgggtgttttgtatgcagaaggctaaatgttcagaggagggagaaattaagctgcccaggccaactcttcccaaggacagtgaggctgatgtgaatgggcaatggggtttctgtgctgtggcagggcaccagcagcgtagtgaaggagaagcgtgagcacagagccacagtgcagggaaagctgggggcatatatggggaattttttttgtgtgtattggttttttgtgttttgttttgagacggagtctctcattctgttgcccaggcaggaggttgcagtgagccgagatcgcgcccctgcactccagcctggacaacagggcgagagttcgtctaaagga

SEQ ID NO: 266685 - DNA, 534 bp, Homo sapiens
tacaaatgattatgattttgtataacaactgaagttaggtgtgtgtgaagttttataattgctggtcttcattagataaattaaattataattaaatgatctgttttatttttgctttttatttggtctcttattaataggcacaatactggcattagctataacacaaaccaatggcactaaaaatcttcagaacctttttggatttgagtttttgaaagatattttgtggagactacagatttaattttaaagtataaatatgctcttattttaaataaatggggtttatactttgtgttctaatgattgagataacttttttttttgagaacttaaattaaaattcccagtcttctctagttctgtcagatttctttgttccccctcccagtggttgagttcttatgggatttgtggcttatttttaaaatccaatgattaaaatgaagttttctggcaatattaatatttgtgtgaatctggatatcctcctcacttaacttctaaggctttttcttcatctgaaaatga

SEQ ID NO: 266686 - DNA, 367 bp, Homo sapiens
ccaccaccgtctcaacaaatgaccttgttcaagtcatgcctctgccaggctttggcatcaccaccagcctcctctgtgcccggctcccctccccatcaacctcgctccctggtctgtggctggagagttgtaaaaaagcttcaggggatggccaggggtcctagaaataccctaacacctctcaagttcctagggtcagcctatggccagagccacctgtctgcaccttggcgggccctggcttgtacaggacatgcagaatttccagaacctcaggattggcaacttgcaaacttttttgactggacccataggaataatatattttgcatcatgacccagaatacacacagagaaaatttttact

SEQ ID NO: 266687 - DNA, 466 bp, Homo sapiens
catggtggcgggcgcctgtagtcccagctactcgggaggctgaggcaggagaacagcgtgaacccgggaggcagagcttgcagtgagctgagatcgcgccactgcactccagcctgggcgacagagcgagactctgcctcagaaaacaaacaaacaaacaaacaaacaaacaaaactcctaacatcctttggcccagatatatggtgggggctggtgaaatttgggcaagccagcgttgaagaggagttttgttttgttttgtttcattttttgagacagggtctctgttgcacgggctagaggacggcggcacaatcatagctcactgcagcctcaggttcaagtgatcctcccacctcaggctcccgagtggctggtactataggtgtgcacgccacaatgcccagctaatttttattttattttttgtagttagagagtctcactatgttgcccaggctggtg

SEQ ID NO: 266688 - DNA, 445 bp, Homo sapiens
taattcccctcctcacatatcttcagtaaatggtattggagaaggattacattgtttaatgctatatctacaatttaagtgaaatgtttttggtgttagtatttctctggaccacttgttactgcctctcttgtctggtcctttatgctctcacttctagttggtgacacatctagaacaggtctgagaacttactgctttaccctacataatactgccattcagagcctgagaatcttttctctgctactgcgtttttctccttttgctccctgtactcaggagtgtgtgtcatagggcaggctgagtttcagttagctcctaatgtggatattggaaaccccacctgcctgccaagtccttttggctgtgagcaaagtggaggcttggtacttgtcattcctttgcagcagttgagctgaaggaatgctgcatggcttgttgg

SEQ ID NO: 266689 - DNA, 576 bp, Homo sapiens
ttgcagagatgggatgcaaattcagttccatttgactccggagcctgagcttggggagattatgagatgcagtcttctttcatatcacctgtgttccctcaatcattctggctttcccagtcaggggctcactctccaccgaaccccgggcccagagtacttactttctccaaatcacttcctggtatttttcatggacacagtttgtctctcccctgcattttcaggatcctgaagtagaggccaaggctttacctctggaagcaccaataatacccagctaaatgccctcactagtcatccctgatactagttatttgctcctttctttttgtgagcctcaccagaagtatatcaactttattagctttttcaaagaacctgctattggctatcttggccctctctaaattacatttattattttattagtagcagctttaatatttattattttctttcttctactttctttgggttccttttctctttttctagtttaggtggatgtttcagtgcactaatatttgtccttccttcacttaagtctctgcattttcctccactgcttcagcc

SEQ ID NO: 266690 - DNA, 457 bp, Homo sapiens
gagtaagagaaggacatgctttttccctttatgaagcacttcactgaagctgtgcacaccacttctgcttatatcccatagccaaaacttactcatgtggccacacccggttcaaggcaggctgggatatgtggtctttattcccggcagccatgtgcccagttacagagttctcttagcagcttttactaaggaggaaacaaggggaacactggcagttgtgtctggctcttctgctatttagctaaccagcagtgtttgctcccaggagcccccaaaattgtgatgttgcagttcactcatggcccagctactgaggacattatgtaggtatccccataatgtcatgagatataaaagaattgcctcccagcactttgggaggccgaggcgggtggatcacgaggtcaggagatcaagaccatcctggctaacacggtaaaaccctgtctgtact

SEQ ID NO: 266691 - DNA, 470 bp, Homo sapiens
ggttattttcaatagtttgcattcaatagaacatattcttacaaataaaatctgtccatgtatccaaggatagttccatttgttttaagttttgattttatcactattacatcactataccaaatatcccccaaaagattataccagtaaatgtcttttaaaatataataataaataccagccgggtgcagttgctcacacctataatcccagcactttgggaggccgaggcaggcagatcacttaagctcaggagttcgagaccagcctgggcaacacggtgaaaccctgtttctactaaaatacaaaaaactagccgggtgtggtggcgggcgcctgtaatcccaagtactcgggaggctgaggcgggagaatcgcttgaaccagggagtcagaggttgcaatgagccgagattgtgccactgcactgcagcctggctacatagcaagacttcctctttaaaaaaaaa

SEQ ID NO: 266692 - DNA, 542 bp, Homo sapiens
ccctagaacaagaatgcttatgaaaactggcatgagtgcttttccgtatgctaatgctgtagatctttgaagtgtcgtaaaacagtaaaggtgaactgttttgctcattggtgggtactactttgccttttttcatgttcattatgtttcccccaatgggtcactgtggaatcacctctttccagaaatactgctccacactgtggcttgagtttagtatctgaaagttatcctgggtaggctagatcatctaagaaggaaataggacattatccaggaaagttagttccttaatattggtattatatctgcctgtagtgttttaaaatatattaaaataatcatctggttatactgtatattctgaaagcctgtgaactcatcagaactaaccaaattgcacagaatattaaattttagtgctgtattttaagaaattatctgatggttcaaattctggctttgccacttgccaaaatgtttgaatttgaacacgttaacattttttaaccccagtttactcatttatagaaagaaaagaa

SEQ ID NO: 266693 - DNA, 289 bp, Homo sapiens
cacgttgtggcccctgttggtgccttgttcctttttacagccgagccatgtgctgctgcgtggagatgccacatgtgtgtcttttcatccgctcacaaaccaggcttggcttttgtgacttggccaagttcccaaagccagccggtggcatcactgggacgagaccccacaggcggtgggcctctgagcagggggccacctgccggccaccctggcctttgaggacacagcctggcgggggcggtgcaggcaaaggcttccttgaagccttctggtctgacctgtggct

SEQ ID NO: 266694 - DNA, 318 bp, Homo sapiens
acagagctgtcaatgtcctctttcccttccttctcatttgctgtttcaatagggcttcatcagcctgagttctttattagaattgacctgcatcaatccagtgcccccctcataccacctactagggaaggctgcattctacattacggtcttcagggatcctctctggggccccacatgcttccctttttgtttacctgtgtctcggggcaattttaatcttagtcttatacttttcatttaagcaggttaggctacactatacacttacagattttgccagtagaagctttgagacttcacatcttgtaaaataaa

SEQ ID NO: 266695 - DNA, 478 bp, Homo sapiens
tgaaatgggttggaatcagaaccaatgatcggcgatgttcaccagctctaggagactgtagttcatagcctttgaggacagcgggtctctggtgtggcgggggctgggggactgggcctaggaggggcggcctgctgtctgggaggcttcctttaggaatggggttgattaggactatgaaaaactagtcacaggtggccaggtgaagagggaagtgcggacctggaagggagcacgatgccagtcaatgtgtggaggtattgtggggtaaacacaaatttttaaagatcgaattttccctggtgtcaaaagagaaagacgtctctcttagagcatttcctttagaaaacttgtaactgtaaaattttctctgtccctttgagatgtatgtaagtccttttaaaagctaaatctcttgccagttttacatccccggaatgtttttcttaagagccttgtagccatctctttgaaatgt

SEQ ID NO: 266696 - DNA, 272 bp, Homo sapiens
gtaaaagtacttaaaatagaatagtacagtattttaaaagctatacaatacgtctctcaagtgttatgatgcacgaaggcaaatgtaaatgaagaggcaatctgaaatttgggtacaagaactcagtaaaagaaaaggcagtctgaaatttgggtaaagtttaggtgaaattatatagtgaatcacttgaacccaggaggcagaggttgcagtgagccgagattgcaccactgcactccagactggtgacagagcgagagttcgtctaaaca

SEQ ID NO: 266697 - DNA, 360 bp, Homo sapiens
aaggaaggaaggaaggaaggaaagaaagagagagaaagaaagaaagaagagagagagagaaagaagaaagagaaagaagaaagaaaaagaaagaaagagaaagaagaaagaaagaaaagaaagaaagaaaagaagaaagaaagagaaagaaagaagggagggagggagggaaggaaggaaagaaaaagagaaagatgaaagagaaagaagaaagaaagcaaagaaagaaaaaagaaaagagagaaagaaaaagaaaaaaagaagggagggaaagaaggaaggaacgaaggaaattgttcacaagaaggtaaaccataaatcttggtactattattgttcctttctcattctgcatttgct

SEQ ID NO: 266698 - DNA, 307 bp, Homo sapiens
acatctgactctccagtttttttattctcccaggattttatgtttttatgactcactgaaagggcacatgttttcctgtgacaaaatccaaaccttctatactgtctgtgagtgataagttaataatgcatatttaagtatatcctacacagatgcttagtaatggtaaaattgtattaaggtaaactacacacttcctattctggaagtttcctgcaaaaggaaaaactattccaacaatgtcaagaaacttaggattatgtacatattcaaacattgctataaatcaatttctaatcactaaacg

SEQ ID NO: 266699 - DNA, 483 bp, Homo sapiens
ctcatcccactctccaccctgaggtcgaccccagtgtctgttgtttccttctttctgttaatgagttctcatcatttagctcccacttataagtgagaacatgtgctatgtgtttttctgttcctgtgttagttggctaaggataatggcctccagctccatttttgtttccctctccagcatctgtttttttttttaatttttagtaatatccattctgactggtatgagatggtatctcattgtggttctgacttgcatttctgtaatggtcaatgatgttcagcttttcttttcatgtgcttgttgcccacatgtatgttttgttttgaaaagtgtttgttcgtgtcctttatccacttttcaatggggttgtttgcttttctctcgtaaatttgtttaatttccttatagatgttatgacctagcagctgtaccttttttaatttcaagacattcaataaactaagaaccaacagcaaa

SEQ ID NO: 266700 - DNA, 391 bp, Homo sapiens
acacctaacatgtccgattaatgtcatggaagctgcctttcttgacaatccaccacaggcagaaccccaacgtgaaaaggccataaaacaacccaaagcctttactttattccttttctaagtatgttttggtagcattttaagttccttgaaggaaacaccatagaatcacaagctctgtggtctgaaatgcctttgagattttcattctctttcttaattttgtgaatgtcactgtcagaacccctcaattctatcttgcgattctattgttacaatctctgcctgttggaattgtttttttttcatgtacgtacctttctgtgtcatccacctttggccaactctggcaggctgatggctcttaagtgctggtctaaaatttggtgtc

SEQ ID NO: 266701 - DNA, 397 bp, Homo sapiens
gtgttttgaaggtgattaggtcaggagggtggagcgctaatgaacgaaattagtgcccttataagaagagacagggcagctctctctctctgatctctgtcacattaggacgtagagagaggaaggccagcagtaagtgggccctcaccaaaatcaaattggcagcaccgtggtgctggacttccagcctcctgaatggtgggaaatgaatatttgatgcttaagccacacagtctacagcagcccgagcttagacagagcggacgtttcagttcaagtccaaaggcaggatcaggggacgggaccccctttgtcctattcaggctgtcaactgattggatgaggcccacccatattagggaggggaactgctttacctggcccactgttccatgtg

SEQ ID NO: 266702 - DNA, 450 bp, Homo sapiens
gtgttttgaaggtgattaggtcaggagggtggagcgctaatgaacgaaattagtgcccttataagaagagacagggcagctctctctctctgatctctgtcacattaggacgtagagagaggaaggccagcagtaagtgggccctcaccaaaatcaaattggcagcaccgtggtgctggacttccagcctcctgaatggtgggaaatgaatatttgatgcttaagccacacagtctacagcagcccgagcttagacagagcggacgtttcagttcaagtccaaaggcaggaaaaagctagacattcagctcaaaggctggcaggcaagaggaattctatcttactcaggggacgggaccccctttgtcctattcaggctgtcaactgattggatgaggcccacccatattagggaggggaactgctttacctggcccactgttccatgtg

SEQ ID NO: 266703 - DNA, 419 bp, Homo sapiens
gttagttttatggagacaagaagggaaaggtgataaaattatttctaaactacatacttatctgaaaccactgccagaaaagctagaccgtcctcttactaggtatcactgcctcagggtaatctgaattttctatctcaagttagagattactcttcaccccttcccaagcagatattaaagtctcttattctgtttttttcctttaaaaagtatcagatctgtcaagagttgtttcttcagaatcttctattgccaaaaactgttcttataatctattttatcattcactcactttgtcactgattaacatattagcaccaaagttcaaccaatgcttacctttataaaatgaaaatttccccttatttaaataaattttatattaattgcttagctgaatgggaatgatagtaata

SEQ ID NO: 266704 - DNA, 481 bp, Homo sapiens
caaactcttgtccctggactggccacattggagtccccctgagatctgattagacatgcaaaatcccaggccccactctagacttcctgtgccagaagctgcgttctaacaagatccccaggaggttgagaaaagccctgccctaaatgattctaacagtttgctgtcaagacacagtgacagtaggagggatatatgacaggggagacagggatggtagggggagattttggcctccctctcatgaatccatgcagagagcatcctcttctatctgctttcctcaagtgtgaaagaaaagtaagaatccaggtcccgcccctgttgcaggcctgatctgaggtttgtgagggcagtcgccgtgcaggtgagaggtatgactcgcagagcattcaggagaaggactctaacacttggagggtcatggggggtgcccataagtgggatggccatggagatcagctcagagacagaggacgat

SEQ ID NO: 266705 - DNA, 448 bp, Homo sapiens
ctgaggcaggagaatggcgtgaatccacgaggtggagcttgcggtgagccaagattgctccactgcactccagcctgggcgacagagcgagactccgtctcaaaaaaaaaaaaaaaaaaaagtcttttgaacataagttcttaactttgataaagtcaaaattacaaacttttttcttttatggatcataattttggtgttacatcaaataaatctttgcctaatccaaaatcacaaagatttttctcctttgttttcttctagaagttttaaattttatatttaaaacttgaaagctttagattttacatttagattttacatttagatataggatacattttttagttaatgtttatgatgtgaggtatggattgagttttctttcccacatggatattgaattgtaccagcacagtttattaaaagatgtctttttttctactga

SEQ ID NO: 266706 - DNA, 89 bp, Homo sapiens
tacttaatgttgtaatgacaggtgtaagattaactttgttaggtgtctagccactcatgcaaactaaattaaattaatggaacaaattt

SEQ ID NO: 266707 - DNA, 629 bp, Homo sapiens
agccatgcatctctacttcaggccatttcttacaagtagccattcctgtgttctgaagagcagatcaagaaagaagatggttaagtggtgttacctttgtgcaggatagtgcagtctgccactgaggggatgcctgtatacctgctttcctggtggggtggttttctctggggctatcagggtgcattcagctgcagcagagtctatgtcttgatgtttcttctggtagtctgagtctctaatacggggaagtttttgtacttgtaagaggttggagtcagttattatcagcgtcattatttttctttgatgaaaacataaaatttgaatcactttcttattgatttggctttgagctacattttttttttttgccttttaagttagcaacaacaacaaacaaaaaaataacaaatatatatataaaatataattaaattatacaatacttaatataaaaaaattaaaaaaggggataaaaaaaaaattatataaccttgttgccgcttggcccaatcaatttataattggcaagtttatcttgcgcccgaattcaggctcctttggccaattcccctatatgggggcgtattacaattcactgcgcgggtgtttacaccgttggtggg

SEQ ID NO: 266708 - DNA, 326 bp, Homo sapiens
atctattaaaatgcaaacaataaatagtccccttttctgcctttagatgttagtgtgaagatgtctctcctgaagtaccttagtcttcttatgactatgaaagaagctaaggtaatatgctcaggatggcaaagcaaaaagatgggaaggacctggatccttaataaaattgttgagctatctaatcaactacctcttgcaccaccctatcttagaacgttttaacatgtgaagtaataaattcttaatggtttatatcaactgtccaaggtttttatttttttgaagtcaaaaatatcttaactgctaacaacaacaacaacaac

SEQ ID NO: 266709 - DNA, 588 bp, Homo sapiens
gtggcaggtgcctgtactcccagctactcgggaggctgaggcaggagaatggcgtgaacccgggaggcagagcttgcagtgagcggagatcgcgccactgcactccagcctgggtgacagagcgagactctgtctcaaaaaaaaaaaactagacactaccgttcattaattgcagtaccaataacatcatctcagagagaaagtgatctccaatacaacagtagtcaaagaacagaacttcccagaaactgacctccaactggatttacgatgctatgattcttctttgataaaaacacatgacacagccaggtgcggtggctcaagcctgtaatcccagccctttggtaggccaaggagggaggatcacctgaggtaaggagttcgagaccagtctggccaacatggcaaaaccctgtctctactaaagacacaaaaattagctgggcatggtggtgggcgcctgcaatcccagctacttgggaggctaaggcaggataatcgcttgaacccaggaggcgaagcctgcagtgagccgagatcgcaccactttactccaacctgagtgacagagtgagactccgtctc

SEQ ID NO: 266710 - DNA, 412 bp, Homo sapiens
catcactttgtactccagcagtgacattttaatttacaagccaagaatgcactgatcgccaactgcaaaaattgatttggttgttcatctgattcaacccatgtcagagtttgaaagtaattatgatagtggggctgataggcaggcaattacatttttgttctcttgctttctggctccttctccctctctttcccttcccacacctccacctgcaaggttgttcttgtcaggaaggcaatgtaagcaggagacgagagagtaatctttggagatgtggtatatggactcttgtggcagaggctataataaataatagtatggctggttctttatcctaatttttgttagcctcttatgaactctaaccagataaaagatgcaaactattttgtctccttctttaaagtac

SEQ ID NO: 266711 - DNA, 333 bp, Homo sapiens
gaagaaaacataaaggaaaatctccttgacattggtcttggcaattatgtcttggatgccacactgaaagcacaggctacaaaagcaaataaataaataaatgggacttcaaactaaaaagcttctgtacagcaaaggaaacaaccaacaaaatgaaaaggcaacctagggattgagaaaaaatattttcaaatcatatatcagatagggattaatatccaagatttataaagaacttacacaactcaaaatagcaagaaaacatattactcaactaaaaactgggcaaaggggcacagtgtgatggctcatacctataatcccagcacgctg

SEQ ID NO: 266712 - DNA, 580 bp, Homo sapiens
gtcttttttactgacaaatggctaagtgaatgctgtttgtttgagggatgaaatatttaaatgagaagccaactcaactcttcctcttgatcttagagtcattctctcaagtgtaactcccagtgcaaagcatcacatcaacttatcaatcgactgtgatgtcaactacagcctctgcaccagaccagccctcctctgtgggacgaagaactatcctgtggtcctgccaggactgcctcactgggacaacgcactgcattaggatctatcccttacgatggctcagggttttccagtctctaaggcaccttatcattatcttacctaaacttcctaataatcctgtgagggaggctggacatctgctttcatcccatgttacagatgagaaaacgaaggtccacagaggtcaatgacttgcctaaggtgacctggcacagaaagttgtgtggcagaaggggaacttctgtttcctaacttctggataagcgccctcctaggataggagaaatgaatgactcttgctactccagccaccacttccactaattaaccactaataaaaatgtaaaaatcagta

SEQ ID NO: 266713 - DNA, 496 bp, Homo sapiens
tgagcccagggagctcaaggctacagtgagccgtgactgtgccactgcactccagcctgggtgagacactgcctcaaaaaaaatgagagagagaataattaaaactcacttttattttcttttcattaatttaatataggaagttgaacagacaacttcattttaaattacttgaaaacatattttggaagataactttatattttgaaattatcattacagatatcaactaaaatattttcatataaaaataataattatggtagaaataaaattatagtgatgacagtattctaaaaagtgatcctcttttatgaagtaccataagtaatgcaggtaatagataagaaatgagttccataaattgatagatcactaagatatttttaaaagtaaataatattaaatttctttaacaaacaaaatgattttatttccttaagaaaaatatttgttatagaagccccatcattaagagttctccagcctgggtgac

SEQ ID NO: 266714 - DNA, 390 bp, Homo sapiens
tcgatcatagagaaataatccttctctctgggatgtatagttttgaaatagtctagaagaaaaacacaataggtttaagaataacatggggcaagttaaaataatgataatacccaccattacaacatgatctaacaggaaaagtatggacgttgaagtcactcatatgtagattcaaacctcaagtctgccatttacttatctacagattcacatggcatgatggttatgattggtgagacagatattttcaaaatgttactcctttcaaccccagttgattattatacaaatactatgatatccattagtttcttttattaaccacaacaaactagaacaaaaatgtaccctatgtagtttagagtattaccgaataaaactaataat

SEQ ID NO: 266715 - DNA, 423 bp, Homo sapiens
ttttttttttttgagacagagtcttactctgtcacccaggctggagtgcagtggtgcgatgtcaggtcatagcaacctccgccttccaggttgaagtgattctcatgcctcagcctccctaatagcagggatcataggtgtgagccaccacactgggctaatttttgtattttttgtagaaatgaggtttcaccatgttggccaggctggtcttgaatacctgacctcaagtgatcaacccacctcggcctcccaaagtgctgggattacaggcatgagccactgtgtccagccgaggttattttaatctagctttgcagaccagaaagatggtgacaatgaactaatattaagaatacaggatcactgagaatataaaatacaaggagagagatggagaaaaataacaaattccatttagat

SEQ ID NO: 266716 - DNA, 592 bp, Homo sapiens
tttaagctgttatcaaacaattatttggtacatagcatacctttggaacatgtgataagattatattttgtttcctatttctttttcttagggaaacctcaaagagctcttttggaaagttgattgtctccatatattgacctactgaattcagtaggattacattctgtttcttctttaacgtataggtaaaggcatcaaggactatgatatcttaggtatgttgatataggtgagctaattttggatctgccgtggactctatttttttcccccactgatgaagtataatagtaaaggtatggagatttggatgggagatgagtttttaaaaatatgtctttattatgagtttccaaacatagtacatctgcttaagttataaggacatttggggtagtttggggtagtttcatcatttaattaaaaaaaaactgcttcaaatggagaagattagtagtagggaacaatactagactttgtcagataacccaaattttttggctagatggactaagaaaaaagaagactcaaattaccaaaatcagaaatgaaagtgggtacattactactaattctacagaaataaaaa

SEQ ID NO: 266717 - DNA, 516 bp, Homo sapiens
atttttataaaatattcttttatccttgggttattaatatctaattttttataatgcttattaactcttacaaaaatcataattcttaagaggtaatacagatgtattatagaatgttcaatgccagtacttttttcaagctaaatatatctgtaaatatttgtttatcgattcaaactttttaaaaaacaaaaatgccattttaaatagtagatctcttggagcttaccgaagctattgttgagcatttggaattgcctagaaattgacaatagatttttctaataaaaatgtgactaatgatgtaaaaccttctcacttccaaaattaatctgcagttcaatgtaaagaccacaactttaggaaagagtataactctgcaactggccagcaaagttgcttatccttatcgatcacatgggattaacagtatttattcttagaatttttgtgaggattaaatgagagtacatacttaaagtttccagcacagaacctaacctggatttgattctt

SEQ ID NO: 266718 - DNA, 484 bp, Homo sapiens
caaaagaactatatcttttatgtctgagaaaaagttttaaaatcagcacctacacagcaataaatggtttaatgatagccttttaagtgcaccatcagagcccttttatagaattttgtgaaagacatactagataatttccatggaagttggtctcatttaaatgatactatcctaaggaacatttcatataaacaactcatattttctttaagtttcttttaaaggttgagctgacagtcacatcaggatttgataagtcagagcagtgctgatgttattacaaggtaatacttttgcaatcatcagcaacaggataggactgcagaactgtaacagactttgcatgaaaaaatacaaaataatatcatgtttgggcagttgtgataataaatgatggcatatcagtgtagaggtagtagtgaaacaaatgaattattaaagaatattatttttaagtatattaaagaatataaagaatata

SEQ ID NO: 266719 - DNA, 918 bp, Homo sapiens
ggtcttgaactcctgacttaggtgatccacctgccttggcctctcaaagtgctgagattccaggcgttagccacggcacccagcctgtcttttttttcttttcgagacaggatctcactctgttgcgcagacgggagtgcagtagatcagggctcactgcagtctccacctcccagcctcctaccctgttgttactgaattaggagagtcctttgtgaacctcatcagatggatgatttgcaggtgttttctcccatcctgtggctgtgttttcactctctcgggtggccacaaaagttttaattttgatgaagtctgtttttccattgtttgtcttattgcatgtgcttttggtgtcatagctcagaatccattgccaaatccgaggtcatgcagagccgccccgtctattctaagagttttgtcagtttagctcttacattgagacctttcgtctactttggattaatgtttgtgtgtggcatgaggtagggtctgactgcatttgtttgcaggtagacgtccacctgcacgtttgttgaagagactctcctttcccgatggagtggtctcgacacccttgtctacgtctccagggcagggcacattcttgttcactcttgtgtccctagcacctggcaaattgtctggcatgcacgtggcactcattacattcatcagaaaaggcttatgtgggctgatcgctgtgtgcaaacagacatctccaagaaacaggggctgcaggaaggttgttccgccttgacagcagcttctgggaagaggcccatcccgccgggtaccctgagtcccctggggatcgtagacatcttgcatccttccacctttgtcaccaaatggcttatttctcttcccacttcattttaaatactgttgccaaatgaatattcctcaaacaca

SEQ ID NO: 266720 - DNA, 385 bp, Homo sapiens
tcgtgaagagtcttcatttaatatcggaactttgtttactgtcatttaaagatcattggtcatcttacattataaaaataaaatttaaagattgattcagttttttaagcatgtaagtacatgcttgtttgatggctctcaaatctttcatcatatgttgccagtcctgttagatcttgtgccttcatattgctctggcccacccatctatttactacagattgtagagaatgaattaaagtttgggcccaaatgctatttgacagaggccaattgatgaaaattctaagaaagagattttaggagaataagtcttcagcctatttatagatttagagggaggaattagcatgaagttccgttgagccgtcgggtcctctagccg

SEQ ID NO: 266721 - DNA, 706 bp, Homo sapiens
tcgtgaagagtcttcatttaatatcggaactttgtttactgtcatttaaagatcattggtcatcttacattataaaaataaaatttaaagattgattcagttttttaagcatgtaagtacatgcttgtttgatggctctcaaatctttcatcatatgttgccagtcctgttagatcttgtgccttcatattgctctggcccacccatctatttactacagattgtagagaatgaattaaagtttgggcccaaatgctatttgacagaggccaattgatgaaaattctaagaaagagattttaggagaataagtcttcagcctatttatagatttagagggaggaattagcatgaaagcgaagttgaagatgtaaaagagaaaggaaagatgaaagaaagaaacttttaaaacaaatttggagccaggcacggtggctcatgcctgtaatcccagcactttgggaggccgagacgggtggatcactccctgaggtcgggagttcgagaccagcctgaccaacatggagaaaccctgtctctactaaaaatacaaaattagctggatgtggtggcacatgcctgtaatcccagctacttggaaggctgaggcaggagaatcacttgaacccgggaggcggaggttgtggtgagccgagattgcgccatcgcactccagcctgggcaacaagagtgaaacttaatctca

SEQ ID NO: 266722 - DNA, 886 bp, Homo sapiens
ctccagctctgccagtgcgggccctgtgtgggaggtgaaccctgcctggcgactctccccctgcagtgctcagtaacctgtggcaacggcacccaggagcggccagtgctctgccgcaccgcggacgacagcttcggcatctgccaggaggagcgtcctgagacagcgaggacctgcaggcttggcccctgtccccgaaacatctcagatccctccaagaagagctacgtagttcagtggctgtcccgcccggaccccgactcgcccatccggaagatctcgtcaaagggccactgccaaggcgacaagtcaatattctgtaggatggaagtcttgtcccgctattgctccatcccaggctacaacaagctgtgctgcaagtcctgtaacctgtacaacaacctcaccaacgtggagggcaggatagagccaccgcctgggaagcacaacgacattgacgtgttcatgcctaccctcccagtgcccactgtagccatggaggtgcggccatcaccaagcacccccctggaggtccctctcaatgcctccagcaccaatgccacagaggatcacccagaaaccaatgccgtagatgaaccctacaaaatccatggcctggaagatgaagtccagccacccaacctaatccctcgacgaccgagcccctatgaaaagaccagaaaccaaagaatccaagagctcattgatgagatgcggaagaaagagatgctcggaaagttctaataaaatggaaagatagcaaaaaaagcatttttttcttgcttatagagatattccatgggatagcaaatcctgtgtcatggagatgaagtcaaaattcctgattccaaaaggttttgagaaaacaaagagggggaatgacgta

SEQ ID NO: 266723 - DNA, 549 bp, Homo sapiens
tgggtgattagaggattcggcgttgtagtgtgctgtgctgcaagtcctgtaacctgtacaacaacctcaccaacgtggagggcaggatagagccaccgcctgggaagcacaacgacattgacgtgttcatgcctaccctcccagtgcccactgtagccatggaggtgcggccatcaccaagcacccccctggaggtccctctcaatgcctccagcaccaatgccacagaggatcacccagaaaccaatgccgtagatgaaccctacaaaatccatggcctggaagatgaagtccagccacccaacctaatccctcgacgaccgagcccctatgaaaagaccagaaaccaaagaatccaagagctcattgatgagatgcggaagaaagagatgctcggaaagttctaataaaatggaaagatagcaaaaaaagcatttttttcttgcttatagagatattccatgggatagcaaatcctgtgtcatggagatgaagtcaaaattcctgattccaaaaggttttgagaaaacaaagagggggaatgacgta

SEQ ID NO: 266724 - DNA, 452 bp, Homo sapiens
cactggggcttccaagggggccagcaggagttaaaacgcttaagctactcaaaagccttatataaatctaataagtgtttcacaacacaggaactgggaatcccaacgcattttcggacaacccaaaaggtctgaaaaacaaactcgagcagtcccctccaaagcagctgttggctcagcctccgagcttctcagcccgcagcctgttttcaaacttcaccatccctgacggatgaaagaccccgacctccgccgcccgagctcccagcgcctctcggggtttcgaggtgcccgagcctgcggagaagggaaaggaaacccgggccgggttcggcggaggagaggagccccgcgcgccccgcagcccagacaaagctgcgcccggagagcggcgctcttcccgccctgtctgcggagaagcgcggcgcgggccccgccacacgtgcggccgc

SEQ ID NO: 266725 - DNA, 435 bp, Homo sapiens
gcaattgttgaattcattgatgggagatatatagaaaagaagtgtgttcaaattgtcattaataaaacctcaaaaggccccttcaagcatagaaaggggaacccagactttccacacactccaccctccacacttgtggtgaaccatattgttcttagagaagaatgctaggtacgcacctaccatctcggatgaagcatattctttctggccaatcaccctgaacaaggcctagtttgggttttattaataagaaaggcaagatattaaatagatcacaaggtgcaagctactagtagagggtataaagcaaaatcacaaatcagattgatggactgtggtgactgtttttctctttggcccaaacaaaaatgcggggcctacacaaagcactttattaacctatcaaaaaaaaaatcattaaaaaaaaaactg

SEQ ID NO: 266726 - DNA, 426 bp, Homo sapiens
ctctgcgaaatgggttgtgctgaggattgaatgaattaatgcatggaaagcccatagtacatagaagttgccaataatgatggtgcttctaatgctgctagaatttgcgctggtgacaccctgaaatttctccagctgctggtcagcaggactgaacgggcccagtggttgagaccagtgtagtttggaaagcggagtgggcctgtgctgccccctgctgggcagccgtcccatagcccctgcagccgagactttccagcccagagggactttttcagtgttggccctagggagagttttgggtaactttcaggccaagttggtcatcaaattaacagaaggtgggggtgtatgaaaacccagcccagacagtccctacttttacaatggttcgatttatgatttttcgactttacagcgggttta

SEQ ID NO: 266727 - DNA, 550 bp, Homo sapiens
agaatgctcccctgtgagcaagaccctgtgctagggacagcagaagacctgcccctaaggaggttttggccttgagaagatgcacacataatactgggaagaaagtcatcaatgtcccgagaaagggactctgtgaagggagagtccgtacaattattaggacaatgagaggttttgtagaggagaaagatgacctttgagccaggtcattcattggctcaggaaaaaaatttacttggcccctgttatgtggtaggcactatgctaaaagctggagaaataaaaacaaataagatatagctttgccttcaaggagcttttggtctaatggtagagacatataaacagataattatagcatgaggaatgtggtagttaaaataagcatgaggtgctatcagagtataaggagaagcttctaattcaaactgggtggtgtgaatgaagtagtggagaatcagtgaagaattctttttgtttttttgagcagtgtcgctctgtcatccaggttggagtgcagtggcacaatctcggctcactgcaacctccg

SEQ ID NO: 266728 - DNA, 447 bp, Homo sapiens
tttaatatccttacatgactaacatttttagagaaatagtcctttgaaattaataggaggtgatgtgacagtggaaaaaaatgtaaaaatcaatcagacttgattttcaatactggtgctggcacttaagagctttgggattttggaaattgaattaaataattgatcctcaatttctttgtctgaaatataggaataaaaatacctttaactcagggttattatgaggtttggtacatacgtatatttatatgtaactatatgtatacacacagacatacacatcacacctatagacagagaggaaggggggaagagaggatatgcacgcgtgtgtagtcttggcacatagtaaaaaaactggccgggcgcggtggctcatgcctgtaatcccagcaccttgggagacagaggtgggcggatcacctgaggtcaggagttggaggg

SEQ ID NO: 266729 - DNA, 443 bp, Homo sapiens
gtagttgacacatgagtaagcaatgagtctgggtgaggaaaagaggctgagtctctccccttgttctgtgatggctccatctacaaacctgtatctgggacctgcctcatcccattcccatctaagtaggaccttttttaaaaaatatagaggccaggcgcggtggctcacgcctgtaatcccaacactttgggaggccgaggtgggcaaatcacgaggtcaggagatcgagaccatcctggctagcacggtgaaaccccgtctctactaaaaatacaaaaaattagccaggcttggtggtgggcacctgtggtcccagctgctcgggaggctaaggcaggagaatggtatgaacccgggaggcggagcttgcagttgagccgagatcctgccactgcactccagcctgggcgacagagcaagactccatctcaaaaaaaaaa

SEQ ID NO: 266730 - DNA, 467 bp, Homo sapiens
aacaaagatacatctcctgttccatcttcagtaagacagccacaaaaattgaccacagattaggccacaagagaaatatcaagtttcaatcctgcgaaataatacagaggaaattatgctgtaatgccataaaattagaacttgagagcaaaactagaaaaatgaagtagctaaagttcagaaatgaaaacaaaacaacacaaaacctacctcttctaaagaactcttgaataagagaggaaatcaaagtctagcaaatgatcatgaaaatacagatcagaataactacaagattcagcctcagcactactcagagaaaaagttttagtcttaaatacgttcatagacaagaaagagtacaaataaatggctaaacttctcaaatccaagccaaaaaataaaaaccacaagtgaataattttctaggaaattataatttacaaaaactgatctaagaattaaaaaaa

SEQ ID NO: 266731 - DNA, 409 bp, Homo sapiens
gtttgaggagactcagagtcactgtcaagtcgtcaaggacctgggtcaccctgcatccccatctggggctccttctatatcagttttcctgaagcttagtccaacttcttgaagtgggccaagaaaaggctgtttccagaattggatattgcatctctaaaacacaagcttcactgatgtcgtggagtctatgagacacaaactttatctcatatggtagaatccggaatgatcagccatcgcttcacacccaaggaaagaactgctgtccagtgccaggcccagagcttcatggtttgtggcaagtctttggaaagataacgtctaacttcattcattttagctgaaaataccccatggtggcatttttctggtctccctactaaaaaagtgagcatgacacacaaaa

SEQ ID NO: 266732 - DNA, 1417 bp, Homo sapiens
actgcactccagccgtgtgacagagcaagacccctgtgtctttaaaaaacaaaaatctagaatggtagaaatgataaccgaaaaaagcaagttccaaaattacatgcattacatgccaattgtagctttgcaaagtgtaccgatgatgatctgaacatgaagcaaaagatggtaaagagctgttagggtggcaggcttccgcctttcccttgaaataaattgtttgactttacctttacccaaaaatcttggggagatttttttccccctaggcaacagactgatttttattattaaagaatattcaaaatgataaatggctgtcacagactttcctaatattagagaagcagtgagatgtggttttagcgtgagctgaattttcttgattaatatctgaattgtgtaaagtcctacgaaatatttttggagatcgttattttctgcatctgtaaaatgaaggagttggactagatggtggaaggtttctgcggtgactccaaatactatgaaaagagctaacctgtgctaaaaacccaggatgaatcccagtgctcagaggaatgaatgtgctacctttaagagtatgcaagcagcctgggcaacctagtgagaccccatctcttcagaaaacaattttagccagacatggtgacatgtgctgtagtcctagccactctggaggctgaggtgggaggattgcttgagcctaggaatttgaggctgcggtgagctactccactgcatttgagcctgggcgacagagtgagatcctatctggggggaaaaaaacttactcatggaggttaatgggctgaattgtagcccccaaaattcatttgtctaactcctaacccacagcacctcagaatgtgactgtatttggacaggtaattaaggtaaagtggggtcacatggttggaccctaatccagtgtaagtggtatccttattagagattaggacacagatggggagaagataagacagatggagaagatgagcatccataaatcaaggagagaggccatcagaagaaaccaactgtgctgacaccttgatcttggacttctgcctctggaacagtgaggaagtaaatttctgttgtttaagccacctattctctgatgctttgttgtggcagccttagcaaaagaataccgggggaaaggatgtttctttcagtaaatggtgctgaagcaaatggatcagaatgtatcatagaactaaatgtaagagctaaagctacaaaacttctagaataaatcagaaaatctttgtcaggttagttaaagattcttagatataacaaaagcacagtccataaaaaattgaaaaatcggactttatcaaaattaagattatgttttttcaaaagatgacaccagaaaaaaagtacttgtattcagatatttaaa

SEQ ID NO: 266733 - DNA, 1431 bp, Homo sapiens
taaaaattaatatttgataatacatatgttcttttttatagtccaacaaacgcatttacatatttacatttttatttgaccaccactctgagaataattcatatattttaatacataggctattgattatttctaaatagattataattttagtattgattttattttaaatcaaggaggtttcctttgttgcccttgcctctcaaatgtatttgtaatagtgtttagttcctcaatggatttaagataattttgttatttttaatgcaccaaattttgtaatcttactgttacttcttttattccatttgcttcaaatggtatcacacctctgaatattgttccttaaaatttattagttacatataggcttatgtatatgtgtagtcattatatatgttcttatagggaagagattttatcatttttgttcatcactaaacccacaagttcaagaaaaatactgatagagggtagatccacaaacattggtggaaatgtaaatggttgccaaaaatgaaaaaggaacacaatgcatacaggaggtattccaaatttttaagtgtgtcttggaagtttgtatgagatttcacagaggtaacaccccaaaaaaattttacttctatattatgacttcttttgcatctactttttccaaaatgttatttttttctaacagagttctaaacattgaaaatcatttaacacattgcattcagtatttctgatcatttttatctaaccagttgctaggatcagtttctaaaaaacagcatgagagagaaaacttgttcaaagtaccctcctaaaattattaaggtcttctaaatttatgtgacttattctatcaggtaaatattcttattatcccagatagtgttggcaaagctaatactgcacattctgtctgtacagtttcgaaatttataaaactaaggtttcatttctaatactctcccctgccataacaagatgggcattttccgctgctctttaactcttatagtgctaaacttgtactttttgcagcagtggtgatcagtgagggttttgaatatctctaaaaataaatggctttcttccctgtgctaccagtacatcatacaatactaggcgtatatattttattgaagtattgtttttatgagcttgtttttccaaaagggaataaaatatctacaaagcgttagtgataacatctgagaagtttctgctaactctgaaaatgccgtaactatttacacacaatgttaattttctcctattttagagcctgaggttaatacacctcattcttgtcttacagaatttctataacttgaatgtttatgtctcttctttgagcctctttctctcttttatgtataagttctgagatatgaatagaatgtgaaattaaataattttatttcattatgattcccagtccag

SEQ ID NO: 266734 - DNA, 116 bp, Homo sapiens
gcaatctcccccgacttccctgaacccccttcacttttccaaaatgagcagagattgagagagcaaaagaaagcccctcccttccccctcagagtgatgagtctctggcactgtct

SEQ ID NO: 266735 - DNA, 152 bp, Homo sapiens
tgatccacttgtaggggacctgaaccgggtacttgatgcccaaggcttcccctgtgggtgagaggcagggtcctgcccgtcaggagtgagaggcagcgtggggtgtgtgtacatgggattgcgggggtgtgatggaaagacatgcgtgcagg

SEQ ID NO: 266736 - DNA, 497 bp, Homo sapiens
gaggggtagtttcccataaggagagccctgggagcttagccgctggtttcctaaatctgaatatctcagccttgggaatctctgctgtctgcacaggcttgcaccctgcctggaggagatattttgaatatgttgaataaaaagcaaaaatgatcaccaaaaatgggaaaaaaaccctagcttattgttttaaattagaaaacaatttaagtgttcaaagtaggataaacaagtaaatcataaccttacagtagactattagccactaaaatattcttgagaaatacttagtaatatggaaagcacgcatgatagaattaactgaacaaagttgattgcaaaatggcatgttcaggatgaatccaattttgtttttgtggcaatgtgcaaatatttgccactatgtgataccaaaatagagtggtttgttttccttttgtgtttttctgtatttttacgtttgcctacaataaatattttttgtcatcagaaagaat

SEQ ID NO: 266737 - DNA, 285 bp, Homo sapiens
caatttttaaaaataaagtaagagtcaaaaattacattctattatgcttctaaggatttatatccctactaatcaaagagtttatagcaaacatatgttaagattaatgttttggaaatccaaaatgcatcaagctttccatagttgtagttgtagacatttacatcttatttccttgtctattctagtaattcataaggcctacattatatacaaaatcttcacactaaaatctttcatgatttgaattttcaagaaataaacctaattgagacatagtttata

SEQ ID NO: 266738 - DNA, 431 bp, Homo sapiens
ttttcctgcttcaatgccatcaacaagcaagaaacatatataataccaatacaggaaatacagctagttgctcctagagcatcatttaaaagctgctaattggctaagatgccttttattgagaagtctaagaaacagaaataatgtgttaacccagtttgttaaatgggtttgaggaatcagtttcctccttcctaatacctaaatccatctccataataagtattctctatcaccatttaaaaatcctgatctcttactagtgtttttattgtgcttttcaatctattagagtaaattttttaaaacctcaagagagaacacagaaaactgtcataatttttcaaaggctaaaggagaataaactgaaaatatcagtttgaacacgtgtatgtaaaaagaatggatggtaataaaactaacaactgaaa

SEQ ID NO: 266739 - DNA, 339 bp, Homo sapiens
caaatttcttcaaatctttcaaatcagttttctgataatgaggcactgaagagaatctagtatggccaatgtcaccttggtgacaggatttcttcttatggggttttctaatatccagaagctgcggattttatatggtgtgctcttcctactgatttacctggcagccctaatgagtaaccttctcatcattactctcattaccctggacgtaaagctccaaacacccatgtacttcttcctgaagaacttatcctttttggatgtcttcctggtgtctgttccaatcccaaaattcattgtcaacaacctaacccacaacaattccatttccattct

SEQ ID NO: 266740 - DNA, 347 bp, Homo sapiens
accacacctggccaacaatattcacttgtatctcttcctcctgcattgcttagcatgtgggaagtttgcaaaaatgcttgctgaaccaaactgaatattgtattttaaaatttgcccatgtgttgtcatgatgtagacacattgtagactttgctattgttcaaatgttgtcttatttgatgaatacaaatacaaagggtttggctgagaacttgagctctggtatcaggtaggcctgggtctgagcctcagattctccactaactaactgtggcacaatgtaatctctctaaaaagcaacataattagatttgcatgctcagatgagataaatgcccacctggaat

SEQ ID NO: 266741 - DNA, 337 bp, Homo sapiens
aagatggccagatgtccattttcgctctggtttctgacagcctgagagacacggtgagtgagagagtctgatcccctgaacccaggcctggttcccttccagccacaccactgtcgccttgctatgaatgaagaaacaaggtgtctgcttttgataaattgactgaggaggagttggctaagggaggaaggacaggagctacccataggacatatgggcaggaacacaaggacagggtaaggccgtgatcagcatcaaggacacctgaccagttgtgcacaccattgtgctggcatgggctgccctcacctgcctgctacacgcccatgcccactcc

SEQ ID NO: 266742 - DNA, 431 bp, Homo sapiens
ttttagagacagggtctcactctgttgcccaggccggagtgcagtggcacaattacaactcactgtagccacgacctcactggctcaagtgatcttccagcctcagcctcctgagtagttgagactataggcatgcgccaccatgccttgcaaatttttaaaagaatgttttgtagagacaaggtctcactatgttgccaaggctggtcttgaactcttggactcaaatgatccaccacctcggcctcccaaagtgctgggattacaggcatgagccaccactggggagtagtagaccaatttacaaatacaagatttaaaagataatctttgtcactgagttgcttaagctcacaaaagatgtggaacactacagatgcattctttcaaagtgcagtctgtcattatgttgctattttaaaagtaattat

SEQ ID NO: 266743 - DNA, 436 bp, Homo sapiens
accctccgtggcatttctgtggggtttatagagggtggaaagccaaaagaggaattggaaggaacacgagcagccaggaagctgggttcagcccctgttactgacacctgtgtagcttaggcaagccttttccctttttaagcctacttctcttcatctacaaagtgaaaggttgggtgaatggtggaggcccttctccatgtaattaatatctttggtttctggcttttgatccttctacttcctctcactttttccccccctctccttttcctctaccttacaaaataatgtgtccaagcagctcctaccaagggctcctctcctttcttccttgcagtgctgtctggtccagagaggaaagactccctcccctccctgcatccccttggctcactcagcatttctgagcagattagaaagaatacttatctaa

SEQ ID NO: 266744 - DNA, 604 bp, Homo sapiens
aatatctttgccctcctgctggacattaccatagtacctattcattctggtcactccttcttgaatcacatgctctctttgcctagcatgttagtgatacctcatttttataaccccaaactagtcaccattatattgttttgggatcaatgcctgtttagatttgcctttgtatttaatatttaccagtctctgctcctctttgcttctcacttcctgtgccttctcccagagaaacggagcttttggaattctttcagcagggaactgtgagtagtaatttatttaaatctgtgcttgcttgcctgatgatgtccttattttgctctcagtcttgaattttagtttagctgagaatagaattctagggtgtcagttatttttcctcagcactttgaagttgtctcattacttgtttctattgttgctatgaagaaatcagctggcagtttaatttacagttttacaaactttgtttgattttacattcatataagtaaaaccaactttgtgctcatcctctagaataagtattttacacctaaatttatctatgtattaatgtactaatatgtacataatacaacatatgtaaaaaaaaaaa

SEQ ID NO: 266745 - DNA, 414 bp, Homo sapiens
tcttcatgcatctattataaaatacagcaaaatacactatattttaaattcctatatctttccctctatcatggcagggacttcccaataaattctatactcattgtggccagctgaacgcctgacatttagtagactcctcaaaaatgatttttgaatgaatgatgactgaccaactgaatgaatgaccaatcttaaagcaccagtgaatgtttttactgtcttcacagagctcagaatagatccttggaagccattctggaaaagggcaactttccaaggatgttttcaaaaagaccaacatataagcacgtgtatttggttgaccctctttgccaccctaggatataaattaaatcacatccattttaatacttaaagtaatttctggaaaactttgtatgccaaaaacaa

SEQ ID NO: 266746 - DNA, 225 bp, Homo sapiens
gaagcagaatgaatgatcataagtaaggaatctggaaaccgcaaggaaatccagaaaatgaaattagcagtttgttcagaagaaaaggaaaaagatttaaatgagcaagtagctagtttgtgtcacactgttgtttctatgtctctgtcaactgcaataatagtttacagttgatcatataaaagtagagatgaataaatttttgcaaagttcatgttaaacaat

SEQ ID NO: 266747 - DNA, 1121 bp, Homo sapiens
ctatataatctatatatttttcttataaactcagtattttagtgccattgagaggatatgctgttttcaaataaattgatataattccctgtatttcccttctacctgcaccccttttggagtcagcaccacttgggtggaaaggggaggacagtagtttccgctgagaaagtgtcatccttaaatgctggaacatggaaaactggctacattatgtatcttgcctcctcacatttttatctgaggcctgaccttatgtccccttcgtttcctatgaaaaggcccttcgaacaggcagttctccaattgaactttaaaacaatccagttaatatagtttcattactctagcttctcttactttgaccaaatccattctttatttcacttctcagagaagtgaagaaatgcttttttatgtttcttttcttaatctaataaatcattcttggtaatgcttcattttcccatttaggcctacctgtatgtacattgtattttatctgattgtgcaaataagtctttttaatgtaactcttatgaaagtctcccttgttaatcaaattcatcttttctttcacaaaagttccatgcttcagtattgtccacagctacctgaaggaattagtaatgtgtcatttaagtgtccttcagtatttctaaatacccttataataatgaaggtaaaattaaatttaaataaatgatcaattagattaactttgtaagcatctgacttaattggatgagaacatttccaaaatatttaatatgtaattttaaaattcctgaaggacttatgaaattgcttgttcttaaaacatttaaagaactttaccttggctgggcgcggtggctcacgcctgtaatcccagcactttgggaggccgaggtgggtggatcacgaggtcaagagttcaagaccagcctggccaagatagtgaaaacccatctctactaaaaatacaaaaattagccaggctcggtggcaggcgcctgtaatctcagctactcgggaggctgaggcaggagaatcgcttgaacccgggaggcggaggttgcagtgaaccaatatcgtgccactgcactccagcctgggcaacagagcaagactctatctca

SEQ ID NO: 266748 - DNA, 424 bp, Homo sapiens
gaatgttagtgaggtgaaataatctactggtaccgtctacttgtcaagggtttgaagacccaataatctcatcctgcttttaatgttcccaatacaccatcagaactgtattaagggtccacaagatgttatctgttgaatgcccttctcaccttgccccagccagtatcctggttgaatcattcctggctctgttctcctttttctctcatgtatcctcaacatggcttaaacccatctatcaggaacttctggacttggtcttatgacagcccctgaacatggccagcaagatgcaacacaaactcactccaaattcctcttcctgcctcatggtcctctttgcaccaacaattcagcacccttgacaccagcattttcatgcctacatgccccttgctctttatgctccaaatgccatctc

SEQ ID NO: 266749 - DNA, 249 bp, Homo sapiens
agatagagaaggggaccctggggaacagtcttagaggacgcaaagtctatgcagataaaccagcgtctggtacttggtatcagtcaggtggccagtgaataatgactacgtggaattactgtggacagcattttgagatctgcagattaagccattttgacttcccagaagcattttcttaaatcagcgtagagacagaagatgaaagttaacctgaattgctcgccgcaagcaagctctgcccgggtc

SEQ ID NO: 266750 - DNA, 369 bp, Homo sapiens
ttcaattgctaaatggacctgtggatctacccaggtgccaggtatacatactgcttttctggtgtttattgtattagagggtatctaatgcactgtgtatccttgttattaattatcaaagctatctttaattttggtacttttttgggaaactagtgtattaccatattaaatgtatggaaaatacattcttatctttgaagcttatgctctctgtaagtcatccacttgtttcaagaaaatattgggagtagccaggcacagtagatgacgcgtgtaatcccgggactttaggaggttgaggcggatggatcacttgagcccaggagttcaagactagcctgggcaacatggtgaaaccctgtctct

SEQ ID NO: 266751 - DNA, 121 bp, Homo sapiens
cctgcccataaggggtattttgacatatctttggacccatcaattcattgatgggaccttgtctcctatgagctttgccctggaccatctgcacaaaatagagaacgacttatcactgagc

SEQ ID NO: 266752 - DNA, 422 bp, Homo sapiens
aatgcataacatagtatacattttagaaaaatgttataaaatgtataacattggctagaataaaagtaaattctcagtaaattatatctgtaactattaaggtagtaagcctcataaaaatataatttatttataaccataacaaaagtgaagtttactacagcaaaggtttgtgccaataaattaagaaatgcaatttcctagagttttctcattgggtaattatcagaaaaccacatttctggaaggaaggttctcctgatttctgttttttctttgtctatagaacaggtgactaaattagtacttatgatatttttaatgctaaattttataaatactagacttctgatgatcccaaatcactcatatctatctctttaaacttcaacagtataagctagaaaatgtgttactagtgg

SEQ ID NO: 266753 - DNA, 372 bp, Homo sapiens
tgtcacctggatatacgtcttcaccagcctgggtgacatggccaattgggttgggagggacagcttactggcgggaagaagactacctacacctgcacagttgtcttgaaagttatcaggccatcattgaccttgccatttacaaagcacttttgtagctattgatgttcacagtaaacacatgaagccacgattacaccccctgggaccccacagcccaagggtgaaggaggagattatgatcttggtttatccagcacttaactccgagtttattattcttgccagtgcactacttgcaagtgcttatttagtgggtgataggtgtgcagatggataaacaacaatcaaaaagaaccaaaagtgtcctca

SEQ ID NO: 266754 - DNA, 384 bp, Homo sapiens
cttgagtttcagcttgcttctgacagggaaggtgagtgtaagttttttccagcttctaagatggcagagaacaatcaccagcctgagacttatttccaggtaagtagctgaattagagttttgtcttaaaatttttccttaatgactaaaatttaagattactcaccagctgcttttaatttctcgttaccattagaacactcagtaatcatatgaattgtgcatttgtttgttttgcttaactctttttgtttgtttatgtttggggttttgttgttgttgtttcacttttctcccatctcttcctgacttggtgaaatccaaagaatgctccaaattgtggggaacaaggcttctgaattggctaaaactcatgtggctgca

SEQ ID NO: 266755 - DNA, 521 bp, Homo sapiens
gacctcttaagtataccctataatatgatttttaattcaaaagttattaaaattttgttttgaagatttcataactaaactctaaccgatccccaagatgactagaaaagcctcttggttttacaaaactagtttggatagtgctgttctgaaggtataatagaaattggtgaaattatttgtggcctgtctttgtgttcttgctgtatcaatatttgtatcttatcagatacctttacatatgtctagccttttctttctatctgacattaacttattcaacaaatatatgttgaacacttgctccactatcgttatagctgctaggtgcagctagaagtgacagctgatagagcaatttctttagagtagtttgtgcagtttcagttgaaaaatcagcgcctggtttccattcaggccctgctattgtgcatgggaacttgaatcaccttggaacttttgtattgatttccataaatgggaagttagatgaattgcttaataataccatatgtttgcag

SEQ ID NO: 266756 - DNA, 173 bp, Homo sapiens
gaaagttgaatgactgtcagtgccacggtcccccgggatcagatttacacacgttttgattcctgagccttaggctgccaacaaatctttgtgggctttgaagttttttggtgttttgttttcttttgttgctgtgactaggtgcaaagggtgactctgttgagcttgttttt

SEQ ID NO: 266757 - DNA, 363 bp, Homo sapiens
caatggtattggggcagaggatcgggcagtgcaaacaccagtatgtaaggggaggctgtctgcatttcaggggggctggaatatatggtgcaaggagtatgcatgggacatgaggctggacagtcaggcagagtccagatcatggaggtttgttaatccaggcctgcttagatgtgggtgtcaagataagactgctcatatatggagtttttttttttgtttgtttgtttgtttgttcttgagactgagtttcactcttgttgctgaggcaggagaatcgcttgaacccaagaggcggaggtcgccgtgagcagagaatattccactgcagtccagcctggtgacagaatgagactccatctc

SEQ ID NO: 266758 - DNA, 497 bp, Homo sapiens
cacgaggaaaacaaccatatcctgagtcagaatcagaccccgacttcctgtagacttccatcgcttggcatccaggagtcacttttgatgccctcctgtatagtcaatggactctgtaaaaagatattccgtgagattaataacatcatgtctgttgtgatgaacttcgccgtttctaaaaagaccacgaagccctgagagtaatgaaaaggttcctgaaattgaggtcactgtggaagaaggaaacgtgtcatgtaccagctatccatccaatgactgcccatcagttccatattcacccttcactgcctgatctgcaaacatagaggtgggttccttaaatgcttcttctgtcagctggtacatgattaaatgttgtcagtacatagtactagagggaccttgtaagaggcttttctttctggttgtggtgtgcgaatctccacaggcactgagcttctccagtaccgggctcttgccctgcacggtgctcagca

SEQ ID NO: 266759 - DNA, 295 bp, Homo sapiens
tctctctcttctctctcttccctttctttcttggtagaaggaaacgtgtcatgtaccagctatccatccaatgactgcccatcagttccatattcacccttcactgcctgatctgcaaacatagaggtgggttccttaaatgcttcttctgtcagctggtacatgattaaatgttgtcagtacatagtactagagggaccttgtaagaggcttttctttctggttgtggtgtgcgaatctccacaggcactgagcttctccagtaccgggctcttgccctgcacggtgctcagca

SEQ ID NO: 266760 - DNA, 990 bp, Homo sapiens
tcacgcccgtaatcccaacactttgggaggccgagccaggcggatcacctgtggttgggagtttgagaccagcctggccaacatgtgaaacctcgtctctactaaaaatacaaaaattagcagggcatggtagtacacgtctataatcccacctactcggaaggttggagcacaagtatcacttgaacctgggaggtggtggttccggtgagcgaagatcactgatttttcataagtgtgtttgatctcctccatgcaaatataggattctttatagtcgtcttcatgtcttgttcatttctcttccccagcagccaaggcagtacctggcacttgcaaccaaatgcactctagcctggttgacagagcaagactctgtctcaaacaaacaaacaaacaaacaaactagcatggagagggacacaagagagaaatgtttatggtccttgccttaccctaaattactgtgcaaccttttggcaagtcacttcctctctattctgagtttctttatctattcaattgggttcttagatttggtggtctctaacactctcccagtttttcaatttgatgttacattctacccagtgaccaaattcatattccagaagcatagtatgctatgtcataccgcaaatcttgtaaacgttcctgatatggtttggctgtgtccccacccaaatctcatcttgaattgcagttcccataatccacacatgtaacgggagggaccaggtggagctaattgaaccatgggggcgatctccccccacctgttcttgtgatagtgagttagttctcatgagatctgatggttttataagggtctttccccttcactgggcactcattcttctgcctcctgttgccacatgaggaaggacatgtttgcttccccttctgccatgattgtaagtttcctgaggcctcccagctatgctgaactgagagtcaattaaacttttttcctttataaatttcccagtc

SEQ ID NO: 266761 - DNA, 776 bp, Homo sapiens
tccatcttgagtaaaactgtaaaggttcttcacggttcaaccttacatttggcagatctaacatatttctgttctattcaacattttaaatagatatagctaatctccccatatgctctaatgctgcttcttatgaactatcaaatgccttggcttttgggaaaacccggaagcatgcatttggtttgcctataaataaataagacatgtacagaatattttcctggaaaagtattacttatcctcgtgacaagtcttaacacctggtaagacttgttcacttaacattttttaagtttggttgcttttttcccctgctggctgttgaatttgaatcctgaaacagttgtagtatatcttgcttgcctgcttgcacgcttcctctctttccaccttttgttccatcttaaagctaatttaggaaaagtctggttataaactagtctttatataaaaattatcttttatcactaatgtagttttttttccagaaccatcagctaataggaatataagaccattgctctccataattactggattacttctacatctttcattagtatttaaagagccaaagagctaacaatatattccagattttttacgtggacatgccttccttttggactcatcataaattcataggactgtaaggacagttgagtatgatggttctgggcacctttaggtaataacatcttcttcctacttttctctctatctctgcttatgctccttttcctgaacctgcttttggctttcttcaactgctc

SEQ ID NO: 266762 - DNA, 266 bp, Homo sapiens
aatacttggccaagagaagtgaaagttatattattggtttaaccaatattttatccttcaggactggacacatcaataccctgaatgacatcaagattctgttaacagtgagaaaggggaaatgggccaccaagtgagcagctaattatattggacaaagctacaatatctacttttgcttctgctatagctaacctctctgacctccatcttcactctctggcttttctttctcagagtgccctctaatgaacagctatttctcc

SEQ ID NO: 266763 - DNA, 497 bp, Homo sapiens
atcaaagtgtataatgtgctcacatagataacaaagttaatattcccctttcagaatctggagtttagcaatgcaagaattgaaaaaatgatctggctggtgtttttactccatttttttttttcttgtgtggtggaaatgacccaggtcttatttctgtgtttaaggcatatgatacaggttagagtttaaaattgagaaggttggaccataagagaacataccaaagcatgcctttcttcatactttaaatggtgtatttggaattaaaatgtgactcttttgtaatcccgggttttaaagaattgcattaaaatgatctgttatgactgtagtgatctcaaccaagctttggcatatgtttggtagaaacaatgagttgtagtttgtctctctttgtcttgtaaaactggccatatttgaaattaagctaaaagattttttttccttggagatagaaaaatcatattttgaacttctccctattctggtctctc

SEQ ID NO: 266764 - DNA, 464 bp, Homo sapiens
catcttaaattaatgtaattttcataaaatttacagtttgaatatattctatatgctattttaatttttttctgagaaagaactgtctgctgagaaatagtgaaatgaaactcttcattttgatgactgggaaaagagatgggagtagtgtctccactgccagacagactgcatctctgctgccagacgtcctgggatgttgctgtgggtttttgacaggcttcttgcactattgaagtcaaattctttcctagtagcacacacctttccaacactaatctatgtgaaaaataagaaaacctttcttcctgttgttggctggagcacccctgcatctttgaaactattatttcgtttgttaggcagaagctcctgggcagctgccagccttctctatggtgtttgagcactgacccctgagcacggtatgtgacatattattaaagaattattaaagaccaatg

SEQ ID NO: 266765 - DNA, 408 bp, Homo sapiens
ctccaagtagaggcgtggtcttcagtcacccagaggaggtgttccaaacaccactgtagcaccagcctgcctggggctgcctcctgatcctgctgcatcctagctcagtgaactgcaacagaatgggggaccgatctggccttggattctacatctgtaaaattcatggggttttggtgagaactgagtggtcaatacaaatgaagcctttcacatagagcctggcacgtagaaagacctcaaaaatgatatttgatacagttattcattgcaattgccattgttgttgctttgttaggaagatgatcattcaagaggcctgaaggaagacttgtgttggagcctaaggtagaaatataaaggttttgaatgttattattgttggaaatacaattaattttccccaaa

SEQ ID NO: 266766 - DNA, 430 bp, Homo sapiens
gatgacattttatctttgccaagctgagttttagggtggttatatgaaaaaactaccatgcaaaaatgaatgtgcagaaggaaggatgtccaatgggagtcaaacgtttgaggagtacgtgaaatcagaaaagcaatcctgaaccacacttccttctaaaaatttagaaaaatcaatttcacatgaagagaataaagaatagaacaatatcagacagtgaaagcatgccagaaatgtgcccaggaagcaaatcaaactgcatcctattgcagagtgagctaagtctttaagaaaatgatacaaggctgggcgcggtgtctcaagcctgtaatcccagcactttgggaggccgaggcgggcgcatcatgaggtcagaagatcgagaccatcttggctaacacagtgaaaccccgtctctactaaaaaatac

SEQ ID NO: 266767 - DNA, 470 bp, Homo sapiens
gatggtctagatctcctgacttcgtgatccgcccgcttcggcctcccaaagtgctgggattacaggggtgagccaccgcgcctggccagtgatccagttctattacacctgggtgtggactcatgccacgactgatttgcttctaccctttagcttttctagtgccttagtttccttgcctagaatatcctgcctgccatagctgattcgttttcttaaaacccgtactcgctcattcattcaggaaacctcttcctgaaaattccacaaaaatctaattattctttgtattctagcattacccgagccatagttttcaataggtgtttgcactttttaaaaaattgcattattttctaaaaattattttgtttgtttttgtctgtttacttgatttaaagacaccatttttgtttaccatgtctagtacactgacacagtggatactcaatacttggtttgttgaaagt

SEQ ID NO: 266768 - DNA, 531 bp, Homo sapiens
cccaggacccaggcaaggggcacgagtgtgacccccccaggccttcccctggttccgtttccctccctagcccggtccccacgatgggtggggacagtgggctgtgacaatggatcgcgactgctgtttttacctggcggacgatgcgcccgaattcgctttaaccagatgcccctcttcgcctggagccctgggagcagtccccctctccgctcaacaataattagccttcgatctgattacctaccaggaatggcaagtggcctcgctgaaagtctcggctctttgagaaatgagagatgggagccctcactgccgatgtttcttccacacgctttgctgggttagaggcaagctcatgaccgccttgaaaagccattttagacaaatcttcctttgcattcttgctggagcccttctcttatgcccttccttggacatttgctctttcactccctcccccatgcactcaccccacccatagtgactgcgctcctcctgcctgcgacgctggcaacaggcagcacagtc

SEQ ID NO: 266769 - DNA, 169 bp, Homo sapiens
acaattacaggaaaagtcatagctctgccctggaacatcaagcaggagctttatctgcttatttttcatggaaaattcaagcctttgttaacatcactttgaaaacttctttctttggaaaagttaaaagcctccagcagctttgcaatttaagattattttcccctta

SEQ ID NO: 266770 - DNA, 392 bp, Homo sapiens
catctcactgtcgtccttagccaaaaaaaaaaaaaatcactctgctttccttgcataaacagcatttgatagcatgtttatcagtttgttatgtcagagaatataaatacaagcacttttatataaggttaattcttagcacctatcatcatctgagatatttccatattagagcaaatcaatgaaccatctaattcagtatctggtctttgacagtaaccaatgttgagtgcgttcaaatcagacatcagatcttcgtaaatgtacttaatcaggcagcagtaaagcattgggtttaagttattggcccagtgacttaaaagcctctacaatttgatcctagcatgtgttattgcaaataccaaatcttctcattacatttttgtagaaaa

SEQ ID NO: 266771 - DNA, 430 bp, Homo sapiens
tccatacctcttggtaggtttgctctaaacccaaaaccttgatatccagcttttggaacatcttgttgccttctttcttagagagcttccttcatgttcataatgtgagctcttaaaatgtagcagacttttcttcaaaattctatagctgcatctctacttgtttttctgtatttccatttgtatgtctctccaagacctttcctgaagtctaagctcaaacattttatcttttgactaaaatctgcatctgtctgtatttcagtaatactactgttcattttttttggcaatatgctttatttcagcctcttctccccttatatctggaaccaaggtgcttgtgattattctttcatagtatctgtgtctcacatccattctttcttgtttcatctgccattactcatctcagcacacttaggttaat

SEQ ID NO: 266772 - DNA, 438 bp, Homo sapiens
gcctcctctgcaaggactcaagagagtcgagagcaaaaccgtgccatagttccataaggagggcaaagagctttatccacgctgaggaacaggcggatcatgcggctacagcactggtctttaccttttaactgcttgattcgaaacattccagccaggaacagtggctcacacctgtaatcccagcactttgtggggccaaggcaggtggattgctcgagctcaggagttcgaaaccagcctgggcaacctggcaaaacctcatctctacaaaaaaatacaaaaattagccaggcctggtgtgtgtgcctgtggttccagccactcggcaggctgcggccagaggatcacttgagcccaggaagtggaggctgcagtgagctgagatcgtgccgccacactccagcctgggtgacagagccagacattgtctctaaa

SEQ ID NO: 266773 - DNA, 405 bp, Homo sapiens
ggtcaccaggtgtttagtcagacattattctgggtgtgtgtgtgtgatggtgtttctggatgagattaacctttgagttagtagactgagtaaaactggttgccctccctcatgtgagtgggcctcatccaatcgattgaaggtctgaatagaacaaaagcttgaataagagggaattcttcctgcctaactgccttcaagtgggaatatgggtttttttcctgccttccaactcaaatggaaacattggctctccagggtcttgagcctgctggcctttggactagaaccacaccattggctctcctggatcttccgcttactaactgcagatcttgggactttttggtcttcataattacatgagtcaattccttatgataaatctgtttccatatatgtata

SEQ ID NO: 266774 - DNA, 403 bp, Homo sapiens
ttgcctccacaatcccagcacactcatggccatgacccattcatcacacaggtgacatacaggccgagcacttcacttcctgcaggtttacagcaagaacagaatcccatgagataatgtaagggggaaaggcgtcctggcctgaatgtctcctcccctcagccatagggattggctctgggagagacacgtgagccaagcacggccaatcagagtgggccctggacattttgctgcaatttctgacggaaacagatgggtggtaaggcagggggactgctgaggacttctttgccacctgagggtgagcagaggtggggcaggaggaaggggccgagaattaagttaaacctgagaaaggcagagtctggaaataaagaggggtaaattcctgatgagaaaa

SEQ ID NO: 266775 - DNA, 483 bp, Homo sapiens
ttccccaccctcccagcccccgcccggcccattacctcttcttcttgtctctcttgtccaagccagggtccctgagcatgagaatgagctccactctggggactatgcccctccaggcagctctgtggagatcgccaagatcttccaggcagacgtcgtacccaggctccaggaaggcgctgtcattgtgctcggctccacagcccacgccgtcctcgctgctcctccttattcaattattaaaactagtgaataaattcagcaaagttacagcacaaaatgtcaacacatggtaatctgttgtatttctagacactagcaacaaacatcagaatgtaatgatgaaaacgattccaggcatgaaccaccaaacttggcctaccatttactgttatcagaaattaaaacaagtcaattcttctctctcacttgctgtcactctgaattatttgcttacagaataaacataactttgtgtccaaa

SEQ ID NO: 266776 - DNA, 502 bp, Homo sapiens
cagcggaacaagcaacacaccaatgggacggtagtaaatgcagcacccagggggaggcacctaacacagtgggggattaggggaggcttcttggggagaccagaggatagctgatgagtttcaggcaggacaagaggcttaaaccaaggtctgcgaggtgggagtcggaggatgtcattgtcgcggggtcaggtacaggctgagctaacaagacacacaggaccaaacccctcaaggtcagcctcacagagcaggaactcaggaagaaagcgtttttgtttgtttgtttgtttgtttgtttgtttgtttgaaatggagtttcgctcttgttgcccacgctggagtgcagtggcaacgatctcagctcactgtaccttctacctcccagtttcaagagaaagcgtttttttgtttgtttgtttgtttgtttgtttgtttgtttgaaatggagtttcgctcttgttgcccacgctggagtgcagtggcaacgatctcagctcac

SEQ ID NO: 266777 - DNA, 460 bp, Homo sapiens
agacataatggctgcaagtttctcggagatgaaaaatatccaagcagtacaatatttcccaaacaggataaatataaatgtatgcgtagaaccattgtgaaatggcaaatcaccaaagacagcattttgaaactatccagagaaaagggactaaatgtctataaaggaaagacaccagctcacctctcaattgcaacaatgcacgtagtggaatattaccttcagagtgttggggaaaaaaaggttaacctagaattacataaaaataaaataattttcgtaagaattagggcatataatatgttttaaaaggggaatgcttgctgctttaatggacgttctgaataatgtgcttgaagtaaaaaaatgatcccagaagggtaacacaagataaaaaaaggtttgtgataagtaaaatggcaaacacctaggtaaatctaaataaaccaaagagataaaa

SEQ ID NO: 266778 - DNA, 296 bp, Homo sapiens
aagacccatgggctactttctcactggaaggacatgttctctgcttggctttgcaaagcatccaaatggagccctgtttcaggaaggctaagaactccacaatcaaattattgaaagtcagtcttcaatcccagggttgagaaacagaactcacttccagcaaccaggtgaatcatcagctgaggctgggtctgctgaaaaagcggaaatgacttccaatcagtcagggctggggagaggaagagagggaatggaaaatgagaaaacagtgagcaactactccatggtgaactttg

SEQ ID NO: 266779 - DNA, 501 bp, Homo sapiens
tgggaagcgaagatccccccagactagttcctctaagacctcttctttccatttacttctgcttttccttcctccttttgctttggtcttctttcagttcccttgaattcttgatatgccacctttctcccttccctctccagaacctcaattactggaactttaggtctccggctctcaagatactcagagactcctgaaagtaaccacttgaggctaaaagagagaaagaaaaatactatttggaaacaaaaaatggatgtttgtctacttagatgggctttggaggccgacagccactagatgtctcctcagtcactcacctaaaattagtccatagcctccataagattaacctctgataatagacaaatatgcctccaaaacttgcattctttttctgtgccattgagttgtaaattttctaccctgtcttctttagaacctaatagttacctttgggaaatacaaacttcagggagggaattgtcatcagaaaaa

SEQ ID NO: 266780 - DNA, 381 bp, Homo sapiens
cctcgtctacacaaaaagaaaaaataaccagatgtggtggtgtgcacttgtagtcccagctactcaggaggctgaggcagaaggatcgcttgaacccaggagttcgaggtaacagggatctatgatggcgccactgcatgccagcctaggtgacagagcaaaaccccatctccaaaaaaatagtagttgtgggcacagtattggcaaagctgttgcttattgtataaataaacatcaaggagttggggaatggctgagtgggccgtttgcattctgcatctcccctccccttggataccactctcctcgatctgggggttccatgcctactttaaagacaccagcttctatttcctgcaagtttccagctcttaaaaaaaa

SEQ ID NO: 266781 - DNA, 380 bp, Homo sapiens
tgtaagcagcacctgggctgggggtggggactggcactctgtcaccccctgataaatatttgttggatgaatatacagattttcttacagagctggctgtaatgtgtttgttttagccttggcctttgacagggggcttgatgttacaaaggaaaatagactcttatgactatagcaatagaattccaagtatattttaaataggctcttgagaatgaaaatgcctttttgtaatgtgataaattactgactttcatttgtatttggttagttttatattgcatttctactagtaactgatgaaagcttaaatgttgaaaatcattttatttgccattctgttgatgcgtggaaataaatggtagttcggttgacaatgt

SEQ ID NO: 266782 - DNA, 310 bp, Homo sapiens
ggaagaggcagggcaggaacaggcaggctctgaaagctagcagtgatggggaatgcagctgcgctctgtgccctttagaggaataaaaacccatgagtagaagtggcaggaaggcagctggcagctgtgtgaggacagcttcctccttggaactgtctcagtcaagatgagccactatgagaggcggtaagctccccgtcctcagaagtatgcaagccctggctggaggagatgctactcagaagataggcggggtgctggtgaggcacagtgaaactccagtactcagtgagggcctcccatgatctcc

SEQ ID NO: 266783 - DNA, 487 bp, Homo sapiens
attttcccacctcacactggaaacacaacttcttaatgagaaactggtgaggggatctaagctgagaatgaggaagttgatttagtggcttctgagggttctgctctcttgacagtatgtgaataagattacatgcttctgcatgaacggatcccataacacaggatgctgtgttcttcattccaccataagagtgaacactaggccaggcacagtggctcacgcttgtaatcccagcactttgggaggctgaggcaggcagatcatttgagatcaggagttcaagaccagcctgaccaacatggtgaaaccctgtctctactaaaaatacaaaaattagctgggtgtggtggtggacgcctgtaatcccagctactcaggaggctgaggcagcagaattgtttgaacccaagaggcagaggttgcagtgagccaagattgcgccattgcactccagcctgggcaatagagtgaggctccctctcag

SEQ ID NO: 266784 - DNA, 291 bp, Homo sapiens
gaaagtccaacctttatttggattgttttaggtttctttaagccccttaaaatagaaaaatgtttcatatggggaaaatgtaatgttcacattgtagctatatagttggaactctaatacatgagtgaaaatggtttaagctaactcttttcttgaacatatgcttactggactgacaatctcttgaggactttccacctgtaataccttaggcctcttctgttctctggtttgtttcccttgagaccgttagcagattgctcagcctgacccaccctggtgccagatgtt

SEQ ID NO: 266785 - DNA, 389 bp, Homo sapiens
cagtttatttatacccaggcatgtctgctgtctgcaaattggaagctttttgtgtactttttggagaaaaaaattggattttgagttaaaaaaaaaaatcttgggccgggtgcggtggctcattgcctgtattcccagcactttgggaggctgaggcaggtggatcacctgaggtcaggagttcgagaccagcctggccaacatggtgaaaccctgtctctactaataatacaaaaattagttgggcgtagtggcacatgcctataatcccagctactggggaggctgaggcaggagaatcacttgaactcaggaggcggaggttttagtgagtcaagatcacaccactactctccagcctggatgacgagagtagaactccgtcttag

SEQ ID NO: 266786 - DNA, 505 bp, Homo sapiens
tgtctcaaaaaacaaacaaacaaaaaacaaaaactattgcattaggggagagagattgaacttaattcctttgaaacaaaaggtgggaatattttaagcattaaggcgagctagagaaaaactatgagacaatgttaaaagggacattggtcaatgtgattatgccatctatgtttgctgattggcactttgagaagctgggcttccaccctcccacagagactgatagttagagacctctgagttttgtttgtttgtttgtttgttttcggtgattacacttcacagtaatggctcctaggtcctcaagaaagacatacctggatctttattagatttacatttcaaaggggcagagaaataatttacaattcaaagtcttctaaagtaaatgctctaagaaaaggaaagtcagggacctaagtcaagaagcttatctgaaatttagtcaagctgaggaatgggtaagatcatcttggccactacaaagctttcctatttccct

SEQ ID NO: 266787 - DNA, 377 bp, Homo sapiens
cccaggctggagtgcagtggtgcgatctcagctcactgcaagctccgcctcctgggttcacgccattttcctgcctcagcctcccaagtagctgggactacaggcaccggccaccacgcctggttaactttttgtgttcttagtagagacggggtttcaccgtgttagccaggatggtctcaatctcctgacctcgtgatctgccctccttggtctcccaaagtgctgggattacaggcgtgagtcaccgcgcccagtcttttatttttatttatttatttattttgccttagtgcaatgcatctacgccatggtatacactaagaagtgaaagctcagattgaaaggcaacattgatgagtgcaacccattaaaaa

SEQ ID NO: 266788 - DNA, 1312 bp, Homo sapiens
ctttcttcccatgcaccattccgaaatgtcagccggcagacaagcagacagatgtccttatgtggtaccccagaaaagtcatcctaccgacagttgtccgtgtctgataggtcttctattagggttgaggaaatcatccctgctgctcgagttgcaatacaaacaatggaagtaagtgatttcacttctactgtggcttgcttcatgagattgtcatgggctgcggctgcaggacggcttgatcttgttgggagtagccagccaattaaagaaagtaattccctgtgtcctgctggaattcgaaacagactcagcagttcaggaagcaattgcagctctggaagtgaaggagaaccagtagccctgcatgcgggaatctgtgttcgacaacagtctgtatccaccaaagactcgctgattgcgggagaggctttgtctcttcttgttacgtgcctacagcttcggagccagcaactggcatctttctataacttgccctgtgttgctgatttcatcattgatattctgctcggatcaccaagtgctgagattcgccgggttgcctgtgatcagctgtacactcttagtcagacagacacatcagcgcatccagatgtgcagaagccaaatcagtttcttctaggcgtaatcctcacggctcagctgcctctctggtctccaactagtattatgagaggagtcaatcagagactgttatctcagtgtatggagtattttgatttgagatgccagttattagatgatctgacaacttcagaaatggagcagttaaggatcagcccagctacgatgcttgaagatgagattacttggctggataactttgaacctaatcgtacagctgaatgtgagaccagtgaagcggacaacatcttactggcagggcacttacgcctcatcaagacccttctttcactctgtggggcagaaaaggaaatgcttggttcatcactcattaaaccattgttagatgacttccttttccgagcttctagaattattttaaatagtcattctccagctggcagtgccgccatcagtcaacaggactttcatccaaagtgtagtacagcgaatagccgattggcagcctatgaagtccttgtgatgttggctgatagttcaccttcaaatcttcaaattattataaaagaactgctttctatgcatcaccagcctgaccctgctcttaccaaggagtttgattaccttcccccagtggatagcaggtccagttcagggtttgtggggctgagaaatggtggtgcaacttgttatatgaatgcagtct

SEQ ID NO: 266789 - DNA, 304 bp, Homo sapiens
gcccacctcagcctcccaaagtgctgggattacagatgtgagccagctcgcctggccttaatgatagttttttaaagatctgtaaagtgaaagattggggcttgactttgcttactttaattcaggactttgactccataaagggaaatccttctttctttgtaatggattttttttttccttcttagcttcagaaatggagcagttaaggatcagcccagctacgatgcttgaagatgagattacttggctggataactttgaacctaatcgtacagctgaatgtgagaccagtgaagcggac

SEQ ID NO: 266790 - DNA, 570 bp, Homo sapiens
cagatattttctatgtcaaggccctaaagtagatatattctgtgtttaaagcaaaccatgtattttagaagaaaatgagctcattgtaaggttggcatatcctactgtagaaactcagaggactactgtgagacaaagctagatggtatttttgtttgtatattggtgggcttatttaaaaaatatatttttttaaagttgagtatgttacaacaagaaacgaatggtaagtccctcaatggcctcaaagtttatggccattaataggattttagcctggagagtttttagggcaggctttactagttgcccagtataatcatagaaaaagcacagcattctgaaaggagtcactttgctgattatgaacccaactcgttttgctgcagttgtgaagaaatttgatatatatatcttaacgttgtcagcagttatttgaaatttgcaaggatatcattgaaatttataattacccaagtttccaaggatctggcatttgtatttttaagaatctaaaacttaaagtataataataataataataataataataataatctcaaaaaaaaa

SEQ ID NO: 266791 - DNA, 887 bp, Homo sapiens
  misc_feature (838)..(838): n is a, c, g, or t
  misc_feature (846)..(846): n is a, c, g, or t
ggacaggccaggagggtggccatggaggaggagcgggggtcggcgctggcggccgagtcggcgctggagaagaacgtggccgagctgaccgtcatggacgtgtacgacatcgcgtcgcttgtgggccacgagttcgagcgggtcattgaccagcacggctgcgaggccatcgcgcgcctcatgcccaaggtcgtgcgcgtcctggagatcctggaggtgctggtcagccgccaccacgtcgcgcccgagctggacgagctgcgcctggagctggaccgcctgcgcctggagaggatggaccgcatcgagaaggagcgcaagcaccagaaggagctggagctggtggaggatgtgtggcgaggggaggcgcaggacctcctctcccagatcgcccagctgcaggaggagaacaagcagctcatgaccaacctctcccacaaggatgtcaacttctcagaggaggagttccagaagcatgaaggcatgtcagagcgggagcgacaggtgatgaagaagctgaaggaggtggtggacaaacaacgcgacgagatccgcgccaaggacagggagctgggcctgaaaaatgaggacgttgaggctttacagcagcagcagacacggctgatgaagatcaaccatgaccttcggcaccgggtcacggtggtggaggcccaggggaaagccctgatcgaacagaaggtggagctggaggcagacctgcagaccaaggagcaggagatgggcagcctgcgagcagagctggggaagttgcgagagaggctgcaggggagcacagccagcaatggggaggaggagcctgagacggagccggtggganaggagaancattcgacgcagaacaaagggggccacggacccaaggacca

SEQ ID NO: 266792 - DNA, 781 bp, Homo sapiens
ggacaggccaggagggtggccatggaggaggagcgggggtcggcgctggcggccgagtcggcgctggagaagaacgtggccgagctgaccgtcatggacgtgtacgacatcgcgtcgcttgtgggccacgagttcgagcgggtcattgaccagcacggctgcgaggccatcgcgcgcctcatgcccaaggtcgtgcgcgtcctggagatcctggaggtgctggtcagccgccaccacgtcgcgcccgagctggacgagctgcgcctggagctggaccgcctgcgcctggagaggatggaccgcatcgagaaggagcgcaagcaccagaaggagctggagctggtggaggatgtgtggcgaggggaggcgcaggacctcctctcccagatcgcccagctgcaggaggagaacaagcagctcatgaccaacctctcccacaaggatgtcaacttctcagaggaggagttccagaagcatgaaggccatactgcatgtcgtttgcccactcatctatggatggacctgtgagacgtcaccaccttttggctgttgtgaatcgtgctgctgtgaacatcgtgctcaagcttttgtgtggacctatgttttcagttctttgaggtctctgtctccagcctgggcaacacagcgagactcgcaaaaaaaaaaaaaaaaaacaataacaacaaaattgctgtgccctctctctgggcctttctccgtatgtttgccatattggcttcttggggctgtcataataaatgacccacaaattgggtgacca

SEQ ID NO: 266793 - DNA, 731 bp, Homo sapiens
ggacaggccaggagggtggccatggaggaggagcgggggtcggcgctggcggccgagtcggcgctggagaagaacgtggccgagctgaccgtcatggacgtgtacgacatcgcgtcgcttgtgggccacgagttcgagcgggtcattgaccagcacggctgcgaggccatcgcgcgcctcatgcccaaggtcgtgcgcgtcctggagatcctggaggtgctggtcagccgccaccacgtcgcgcccgagctggacgagctgcgcctggagctggaccgcctgcgcctggagaggatggaccgcatcgagaaggagcgcaagcaccagaaggagctggagctggtggaggatgtgtggcgaggggaggcgcaggacctcctctcccagatcgcccagctgcaggaggagaacaagcagctcatgaccaacctctcccacaaggatgtcaacttctcagaggaggagttccagaagcatgaaggcatgtcagagttgacaactacacaaacactgcaactggctttgctttttgtcctgatggtatctcacaaggcttccctaatgcaggcagtcttgttttctagacaatctaccaaccctagcccacaacacccttctggtgccataataagggaacactttgtaaattaaatgtgagtgaaatcaaaaaggtttcctgcaaggttgttttctgagacttgggaaataataaaattctgtactggaaattc

SEQ ID NO: 266794 - DNA, 486 bp, Homo sapiens
tgttcatggcttccaggcttacccccctgctttgatctgagagctggtgccaatagcagggagaagccaagctgcagaggcaagcacttccgagcctgcaaaagcaggcccccaaaagtgcagggatgcctgagtctgcacccgcacccaggagggtggagatcttgcctgctccaaggctgcagccggaatgatagcaggctgactggagcacctgccaccatcattagttcaagagtttatgcagatttaagttgtatacggtatatgaatgtgtgacagttttccttatggttgtgtggccttctgtaagagcctacgcctgtttgttacaccggtagagtgctgtggaatgtaaactttccctatgtcacttatctcctttatctctccatacagaggagggcaagaaaccttgttacttgaactttagtaatgttaagtgatcaataaatctataaataaatgatagcagaaaaaagttac

SEQ ID NO: 266795 - DNA, 1097 bp, Homo sapiens
caacaaaaggagaaaatatatcttttgaaaacacggccatctacttggaacattccatagtgtgacatagagtaactctgcttaggattatttcattgatccccagggtccaattgcccagtgctcagtcaaagcccaaggtggaagacaagtgcttccctgatgagctgatgagctggcctctctgcagactgctccataccctgtgctgtcctgcctcagatgcagagagagcacaaggctcccgctctcctcgtcctcggtgcgcctgtgttcttgctaccatcacagctgaatgcaatgaaaggcggtcctctgagaggagcagggtggagatgctaaagtggaggccccctcccattgctgatagatcctcatctggcatgcgctccaccctccccattctctgctcccacatatcgtagccccatcacagaagatgcgacatggaaaaaagcactgtgtccaccctagttcttaaatttgggcagggatttggggtgtatgttaagagtttttcaaatttgccagattggatgcctatgttgttaaatacacagtgaatctctggtatgatagcagtttctggataaacattacttgaggtcctaaaatgcagaagggaaaaagcaacttttgtcagatgcctactttgctttcatttcatctctaatattttggatggggaatcagccaaagcttctgactgcatgaaggtcaagtgtgccagtgtgcagctgggtttcttttccagaattaaaagtattttgggtggtggtgagggtcagaggaagaagtaaagattgtgagaaagtggaagaagcatgggcttggggagaacccagaattggggccagaagacctggcactaggctacagcacttagcacctctgatcttgtttttcttcatctgtaaaaggaggttaacaaagcttttctgcccacttcttggggagaagggaataatataattggttaaacacacaaacataaaaaaccgttttgacacaaatacgcacaccctgacctttatgtaacccaaggcattattaattctccaccccatatcctggtagatacctgttattcaactatt

SEQ ID NO: 266796 - DNA, 584 bp, Homo sapiens
ccaagcgtgatagtcactgcgcctgcgtcaggttttccagcctgaagaaattgatgatgcagacctgtttgcttgtcttcctaaggattattcacccctttccgtgggaggggcagcgtcactgagaaagttacgggttgcaagcttgagtgtctaagaaccgcctggcgagcttcttaagcagatcgccaggttccatcttcgcagactctggttcagcaggtagcaggttagcccgagaatctgcatttctaacaagctcctaggcgtgcccacgctgtcagtattggcagcccaaccttttttggggggtgggggggggagtttttctatgttgccggtctcgaactcctagccttaagcgatcttccctacttagtctatctattctttctttatttacatcctactttcttttttttttttatctctctttcaccatacacgtttcttatttatttgttttcgtttaccactttcctctcaccttccttcttcatccaccaccgtccatccgtctctgaggtttcttcttcccttatacctttttctttattctcctatcttctttgtttcctcttctt

SEQ ID NO: 266797 - DNA, 679 bp, Homo sapiens
agtgagatacagcttgggcactggaccctgcactgtacttgtttgtttaagcctccaggcctttgcaccactcgtccccctgctgaaatgccctttcctgcccctcagtggctcagggccttatccttttgggctcaggtgcactctaccatgcagttcatgtgcattcgcctctcctagccctgctcgtgctatcttgaggttttgtgtccctgtcccttaccactctacttggcggaacctctttggggcagggctcaggtctggttcaccgccggtctcccaccacacagttgcacacaggtctggcacacagcaggcttcagagaatggtgaaaggatgaatggaagggcagggcagggtgagatgtgggaggcacccagggtacatagtatctgcaaatgcagcctagtcctggccacgtggaagggtgcatggctactcacggaaacccactggagtaataatagctactatttttttttttaaagactagtcaaatgcagtagtgagaagggggaaaacagtagaacaaggagttcgatctgtaacttactgtgaataatcaattgagatcactcactacatttggaccagccaatagctactctttttttctgttttgagttagtctcactctgtcacccaggctggagtgcagtggtatgatctcagctc

SEQ ID NO: 266798 - DNA, 292 bp, Homo sapiens
tcatttcggaagactgaatgaagcaaagcttatagtgtttgctgtttccatggcagccaagtgaaggtcttgggatgactccctgtgttcctcaagctgtactttggggctctctctgcagtattaacccctttctgcttggtggtactctgtacctgtgtgtgatagtcacttttgcatggcttctgtgtctggcttgtggcatttagggatagggtgttataaagtatatcaaactctttatatgctaaattctaaggaaaatttatcatatgacttcttacataggaca

SEQ ID NO: 266799 - DNA, 307 bp, Homo sapiens
cacctcagcctcccaaagtgctggggttacaggcgtgagccatcatgcctggcctcttgagaccttgtctctaggagaaaaaaaaaaaaaaacccacacacacacaaaaaacaactccatctggcagagtaagagggtgagaggccaggaatgggatgtggccacctctgacccccagagccccagcccttagtgtcttggggggacaaggcatgtctggtacaaggggcaacagccagcagggactggggtgggcactgctggttccgctctcatccctctgatagtgccctgggccctgtaccca

SEQ ID NO: 266800 - DNA, 317 bp, Homo sapiens
cccttaaatacagttgcttctcaagaaaaccacacacaattgatgtttgaatggctttatttacaaacatctcactctgtaagcctctgcaggtatttctagcctccctgggaggccactgtcccgtttcacctgtaatttggatcacaattctgtttgttgtcacacacatcatacgagctgcttttcatgctacttttatccacaaagctttacaaactttaatggcagctctatatatgacaactttaaaaagatctgccaaaaggtatgatgccaagctttggttttattaaactattagctattagcactga

SEQ ID NO: 266801 - DNA, 472 bp, Homo sapiens
  misc_feature (382)..(382): n is a, c, g, or t
  misc_feature (395)..(395): n is a, c, g, or t
  misc_feature (399)..(399): n is a, c, g, or t
  misc_feature (408)..(408): n is a, c, g, or t
acacaccaaaacaaacaaaaaagccaaacttccagaagggttaaagagatacaccgatttttaaactataaaagagcacatggaagaaaaatacatgtaagaggccgggcgcagtggctcacacccgtaatcccagcactttgggaggccatggtggacagatcacgaggtcaagagattgagaccatcctggccaacatggtgaagccctgtctctactaaaaatacaaaaattagctgggcatggtggtcgcacacctgtagtcccagctactcgggaggctgaggcaggagaattgcttgaatccgggaggcggaggttgcagtgagccgagattgcgccactgcactccagcctgggtgacaagttagactctgttcnaaaaacaacgacnaaanacctctgtnacatacagtgtgtaaaagtaacctccaatcagtgagaaaagacattcaaagttacatatacgat

SEQ ID NO: 266802 - DNA, 383 bp, Homo sapiens
acacaccaaaacaaacaaaaaagccaaacttccagaagggttaaagagatacaccgatttttaaactataaaagagcacatggaagaaaaatacatgtaagaggccgggcgcagtggctcacacccgtaatcccagcactttgggaggccatggtggacagatcacgaggtcaagagattgagaccatcctggccaacatggtgaagccctgtctctactaaaaatacaaaaattagctgggcatggtggtcgcacacctgtagtcccagctactcgggaggctgaggcaggagaattgcttgaatccgggaggcggaggttgcagtgagccgagattgcgccactgcactccagcctaccaatagagcaacactccatctca

SEQ ID NO: 266803 - DNA, 464 bp, Homo sapiens
gagtctttctgtgtggcccaggctggactgcagtggcatgatctcagctcactgcaacctctgcctctgaggttcaagcgattctcctgcctcaacctcctgaatagctgagactacaggtgtgcaccaccatgcccagctaatttttgtatttttagtggagactgggtttcaccatgttggccgggctgacctcaagtgatccaactgcctcagcctcccaaagtgctgggattacaggcgtgagccaccatgcatggcctgttcatatatattttaaatttttctttctttttttgaaaaattttagattcagagggtacatgtgtaggtttgttacatggatatattacatgatactctggttagggcctctaataaacctgttgctcaagtagggaacttcgtacctaatagtcttgcaacccttttccccactctctcacaccccattgtaatacccc

SEQ ID NO: 266804 - DNA, 442 bp, Homo sapiens
attaatgtttttttttcttagatgaggaggagctaacaatatagaagtcattataggtaagagggagaggcctgccgttacttcatttgcaaaacagatgattgaactatagtcaatgtttccaaaggttttgttttattttgaaaataattctataagattatctttcttcattgtaatatcttgggtacagtgttaaggaacaaggttatagaggtggagttctccccaaaagtctactctgccagtaaagcgcaggggatctgctaagtcaagagcttaggttagataagagctcgcctatgagttgtgcagttgtaaatctgaccacatgaaatattctattacttgtttaaaagaaaaaaaatgcatttgaaacaaattgtttttgacttttcagtatgcacctatatttaaaataaaaatgccatagtaaaacaat

SEQ ID NO: 266805 - DNA, 399 bp, Homo sapiens
gtcctttcatatgacaattcaagactcaacctcctctcacatggctctgatttattctaaagctttgaagacttatgctcagggaaagagtgtaggaaaataataactgcccctcaaccaaccaagaagataacatttattcttagaaccaatgtcagtattagttgatgcctttatctagcaatcaaatagctaatggcttttatgtgaacaaaatatactaaatatacataaatatactaatccataatggcagatccttgaggtcaagggctttgtgttttgttcacctctgttatcaatcttactgttgcaattttcttctctctatatatccttttatccagtcaagaccttttggccatcctgcctcacataagggaggggagagagagctta

SEQ ID NO: 266806 - DNA, 163 bp, Homo sapiens
ttttcttttgtgtatctatacagatattttcttagtagtgtcttggggattacacaaaacctctaaaagatccaacaatatgtttaaatgaggtaaaaaattaacttcagttgaatgcaaaaattcttcatgattacatctgccttcaactttgttattgatt

SEQ ID NO: 266807 - DNA, 351 bp, Homo sapiens
ttttttttttttaacaaggtcttgctctgtcactcaggctggcaattgtagctcactgcagtctccaactcctggccttacgcgatcctcctgcctcagcctcataaatagctgggactaaaaggtgtgcagcaccatgcctggctaatttatttaaaaattttttttgtagagatagaggctcactaagttgcccaggttggaaggtagggtcttttaagacgtataaatcagattttgcagctggtgtagttaaaagccctcaatgcctccctaagactattcatcttagaataaaacccacagtccttaccatagcctgaagtcagttccccttctgtgcaccgtgac

SEQ ID NO: 266808 - DNA, 454 bp, Homo sapiens
aatgagagcaaaaacagacaaactaaacttcgttgaaattaagaacttttgtgcatcaaaggatactgtcaagaaagcaaaaagacaacttagagaatgggagaaaatagttgcacatcatgtatctgataagggattaatatgcagaatacataaagaacttcgaaaactcaacaacaaaaaacaaacaacccatttcaaggatgggcaaaagactcgaataggcatttctccaaagaagatatacaaatggccaagaagcatatggcaagatgctcaacatcattagtcattagggaaatgcaaatcaaaagcacagtgaggtatcacttcacatctattagggggtctataataaaagaactcagaaaataatgaatgttggcaaaggatgtggagcaactggaacccttgtgcctgactgatggtgacagagtgagacccagtctcaaaa

SEQ ID NO: 266809 - DNA, 317 bp, Homo sapiens
agggagaacctttaggaaggaggtaggcagctgtctggatagtgtttaagcagcagctgtgtggtgctccttgagggaggctgggattccacatctctctcctgttaaaaccattttagtgtgaagtgttctcctgagttggacaaagcatccaatctttccagtgtacagtttttttggggggtggggtcttgctctgttgttcagactggagtgcagtggcatgatctcggctcactgcagcctctgcctcccacgttccagcgattctcttgcctcagcctcccgagtagctgggactacaggcatgcaccacc

SEQ ID NO: 266810 - DNA, 423 bp, Homo sapiens
cacgtgggagaactgcttacttgctcttttgtatgcttccggcttctttttcctccaaacgtaggccttctccgcgctgaagttttccccagcagcgtaatactgtattctgttatagcagcagaaaacagactaagaaaaatgttgtgcttgtaagagattgggacacggacacatacagagggaagaccatgtgaagacacatggagaacgctgccatctacaagccaaggagactgaccttagaagaaatcaatcccaatctcaccttaatgttggacttctagcctccagaactgtgaggatatgggctggatggtttcttagcctcctcatgacctgtggtgcttcagaggtccacggaatgaaggataagatggagaagccaggctaaggaaggattgggatttcctaaaacagtat

SEQ ID NO: 266811 - DNA, 1059 bp, Homo sapiens
agcccatggccagggtagtagaaatactgtgcatctggtccaagttttctatgcttggctcatattctttcataagatgcatattctttcataagatgcatatcatgtagtcaaaagctttctgacaaccaattatttttcatatgtttcacttatagtcgaagaatacaaaggaacaatcagaaatagcagcttttaatgaatattttctatttattggttgctgaactgttaagggatttgctgtgtggtaattttacttataatagaaacttgcttattttagtggttgaggtgcttctgttgtcctaaaactacttctgaggtttttaaaatgtagaaccatgtttttgattagtgtcttaaaagattactgtggtgctcagcaaatcttatcaagtcgtgcaggaacccatatgttaagaaaatgagctttgtagtcaaaagactcatctaatttgagctgagtggagctcagctgtgtttgacccacatcctcccaatttgttctgtatttaggtagttatttatacaagagtctttaagtcattctaaatattttttcttgaaagttttaactaagtgagaaataaggtagtcttcaaaatcttggtcatctgtttggatgagggaaagtacctcatgagttgcacattacttctacaacagggtgtgtgtgtgtgtgtttgtgtgtgtcagtcatcttcaaaggcagattattagattccagcaatctgaaatctattattccagcagtctgaaacctaaatatgttatattggaaatcatgactgtgagactttattgtcctctaggatggatgtatattggagaagggtggttagcacattcatcagacatctgcttatgctgtggtcaaggccagtcatttttaatttatatcagatttatatcagaccctccaaaaagtatttgaaatatattacagttataacgtacaagtacattacatgtatattacaagtatattacatgtaaaacaggacaatttaaaaattttaaattttaaagaattaaaaattttaaaaatttaaatta

SEQ ID NO: 266812 - DNA, 580 bp, Homo sapiens
acatttaagttatcaacgagttgggtgccactctgacggactctcagctcctcaagggcattaagccatttcttattcatctttgcattcttgtgacatgcaaccatatccagctcagagtagacaggcaccagagctgcaatgacagcaggtatcatttacttgtaaattgaaggggttaaggccttatctgaacactataagatgttttaaacacaatatggtgggtgattaaatacgagtcagtgacacagacaaatctgtggtaagggcaattcttcaaggccttcattagaagacttcaagcaggagatcaaacactgaattgagatttgagtgatgcatcacttttggatccttggaagcatacttcagaaaggagtcagagaacagagaaggggagaacatatttagaggcagtaaggaggctattctggctggaggggaagaattttgtgtgtgcgtgtgggtgtgctttttttctcgcgctcacacacacacacacacacacagagtatagggcagaagctgaaaaaaccagtcaaggacagggtgttgagaaacttgaatgccaagaact

SEQ ID NO: 266813 - DNA, 738 bp, Homo sapiens
caatcattttgcgtttcttttctttgggggggtgggaaacaggaaagggataaagaatccaattagtgttaacaaatcttatcaacatgtctccaaatttagactctgccacacatgtggctggaaagcagtggccacccaaaacaactctctaaaaagtaaaacatgtagctctgaaaagtcagataaagcaaacccatgccctcaagaccccgcaggaatgccattagggggcaggaggcctgaatttggctgtaggaatttagagaatttggaggttctcttccattcaaattttttcctccaagtggtatatactttaccataattttcatcataagccaaaagtctgacattagcctgaaggactgtgtgaccattaaagttagtaaattaaactaacttattctttacaaaagagtaaatcattcttttatccaaagagtgactgaggtctacactgcactcagcactgaggggagcgccacggtggaagggaacacacgtgggtcacagtcaccgcacacaaggtacttatggtctagctggggatgcaacacagccacacgccaaccagggagtgaacaagacagcatgatacatagtaaaataatgttccaggttaaccaggaaagaagcaagtgcgactgtgcctttggttactatgtcttttccaactgatgacatgaactatactgtatatttttctgaataaaaatatttttctttaaaatcttc

SEQ ID NO: 266814 - DNA, 506 bp, Homo sapiens
ttaagaaagacagtcattttaacctattgaagtcacagaatgaaatgatgaagtaatcgtatgtgttcccagtttagcatatatgtatatatatgcattgatgaataatatgatttgttgtaaacaaatgaaaaactgcagaaacctgtaatttgtacattattatttcagatcaccgtaacaaatattaccaggtttttaattttctttaaaaaaatgcatttctagggctgggcgtggtggctcacgcctgtaatcccagcactttgggaggccaaggcaggaggatcacgaggtcaggagatcgagaccatcctggccaacatggtgaaaccctgtctctactaaaaagacaaaaattagccgagcgtggtggcacgtgcctgtagtcccagctgctcgggaggctgaggcaggagaattgcttgaaccagggagtcagaggttgcaatgagccaagattgcggctgcactcctgcctggtgacagagcgagaccccgtctga

SEQ ID NO: 266815 - DNA, 489 bp, Homo sapiens
cttttcctgataagcctggtgattcatataaacagggatgtggcagaagtatgccattggtcctagggtacttgcttactcctatcgctgttaaagttctagttatatcaccgttgtgttttttgttgttgttgttttttaagcaacagggtctcactttgtaccccaagctggagtacagtggtgtgattatagctcactgtaccctcaaactcctgggctcaaacaatcctcacacctcagcctactgagtactaggacaacaagtgtgcactaccatacccagttatttttgtgtgtgtgtttgttttggtacagatggggtctcgctatatagtccaggctggcctcaaactgttggcctcaagcagtcctcccacctcagcttcccaaagccctgggattacaggtgtgagccactgcacctggcctgtcactattagttttatttttaatttttcccccccacagattgtaaccaaagaaaat

SEQ ID NO: 266816 - DNA, 705 bp, Homo sapiens
gttttaagacattggcttttgtaattatggaggctggcaagttcagaatctacaagatgcgccagcaggctggagactcaggaaagagccaagcatacagttcaggtccaaagaccatcagctgcaatgtccacctatttaaatgttaatctcatccaaaacaccctcacagaaatatccagaataatgtctgaccacatatttgaacagcatggtccagccaagctgagacataaaattaattatcatagtatatgttcaacttttgtaagtaacactattttccaaagtgactgtactaacatagagtcattatgggtggggatcttcaacttctcattaggatatggttgacactgataagcaccctattttattcctatagaatgagtagccccccaaaactcccagaggagtgggggttctgaaataaggccttgactcctgatgctcagtggctaatataattgtcaagtctttctgtcatcaacaacaggccagctttctactataaaaactgacaggatggggtgcctgtgtctgagtgctggcacttctgcctgtattttccatcagcaaatgatgtcacagtccaccgaatagcacaatcagaaactcaggtctcgtctctgactctaccacctgtttatagctaataactcatcagtttctattgactctgcctcccatgactctgtcaaactc

SEQ ID NO: 266817 - DNA, 429 bp, Homo sapiens
gaaactaaagtgacatgaaatctaaatgcaacactgtgattctaaactagatatattatctgcaacagaacaattgttgaaatgtgaatagggttcgaggattagatatatcaatgttatctaatctcatggttatattgtggttaaatgggagaatatctttgcaagaattacacaaaaaaagtacttgagctgatcagcatcatgtcaaccacttactctcaaatgcttcagggtaaataagttttttataccgctcttgtaagttttctttaaggttgaaatggtttcaaattaaaaagattcagggttgccagacacagtggctcatctgtaatcccaacaatttgggaagctgaggctggaagattgcttgaacccaggagttcaagaccagcctggaaaacgtagtgagaccttgtctctaca

SEQ ID NO: 266818 - DNA, 548 bp, Homo sapiens
  misc_feature (531)..(531): n is a, c, g, or t
cctctgctatgaaatcttcccttggctttgcccttgccctttgagggggccaatgcccttctcgacattcttgcattctccaggccattaccattaatcaataccaagttctccttcatctcagatcataaatcaccaagctctcccagtgttgccaggtaatggctctgatgagctaattcacaccaaggtgtgaatgaataatgatggtttcataagttttccacttgggagtctgtttgggttttaagatgggctataaacacttctccaatgaagtgtgaaatgtggagatttttaagactatttccagctagattaagggagaagtattgtttggtcaagagaaatgtaagcaactttcaaactgtttgatgtgccaaaaaaaaaaaaaaacaataaaaaaaaaaccttgtggcccgcttggcccaatcggattttgaattgggccaggttattcattccgcccgaatttcggcctacttggcccaatcggcctaatggggagcggattacaattcaatggcccgncgtttaacacggtgggg

SEQ ID NO: 266819 - DNA, 536 bp, Homo sapiens
gctataccggagtcccgttgaattgggtatcttattgctacagagagtctgttttgtcagtctaggatctctgtttttattttaatgttggtcagttgtgtctaaattccagagcggggcaggtataatggggcatcccgagccctccttcccattcatggcctgaactggtttttcaggtttctttgggtcccggtggctgcaaggggatgcactcagttggctgggggacttagaattttagttttggtttacagcaggatttgatgggcatgcatatttatcaatgtgaaagtgttgtctgtgggcggcggagggcttgggccgtgtccaggccacgcactgcaagggtgcagcccccacacacggtccctgctcctaaagctgttgcccccactgcaagagtggagtaggttgaggtgtagccatgacattctggaaactacatttttattccaattattcaagtttttgctgcacagtattttcaaatgttttattttcaagtcgacgcggccgcaatttagtagtagtag

SEQ ID NO: 266820 - DNA, 759 bp, Homo sapiens
cagaggatccttcaaacgtatcagaatctaggatctctgtttttattttaatgttggtcagttgtgtctaaattccagagcggggcaggtataatggggcatcccgagccctccttcccattcatggcctgaactggtttttcaggtttctttgggtcccggtggctgcaaggggatgcactcagttggctgggggacttagaattttagttttggtttacagcaggatttgatgggcatgcatatttatcaatgtgaaagtgttgtctgtgggcggcggagggcttgggccgtgtccaggccacgcactgcaagggtgcagcccccacacacggtccctgctcctaaagctgttgcccccactgcaagagtggagtaggttgaggtgtagccatgacattctggaaactacattttttgtaatagtcattttgaaaataaaacatttgaaaatactgtgcagcaaaaacttgaataattggaataaaaatgttcagtttaatgtcattgcttgctgccaccgttttctgattgtaaaactaacgtgattattaggtactattttggtaatgtagaaaactttaaagatgaaaatagatatcacttataactccacatggagaaatagttgcccctccaatttaattgatttacttttgggccacaggggcccagaatttgattcattgtactccttggttcatgccagtgttcctgcacccagcactgaagctgaacattgacagtgatttgcccctg

SEQ ID NO: 266821 - DNA, 524 bp, Homo sapiens
  misc_feature (507)..(507): n is a, c, g, or t
tactactactaaattcgcggccgcgtcgacgtcagtctaggatctctgtttttattttaatgttggtcagttgtgtctaaattccagagcggggcaggtataatggggcatcccgagccctccttcccattcatggcctgaactggtttttcaggtttctttgggtcccggtggctgcaaggggatgcactcagttggctgggggacttagaattttagttttggtttacagcaggatttgatgggcatgcatatttatcaatgtgaaagtgttgtctgtgggcggcggagggcttgggccgtgtccaggccacgcactgcaagggtgcagcccccacacacggtccctgctcctaaagctgttgcccccactgcaagagtggagtaggttgaggtgtagccatgacattctggaaactacattttttgtaatagtcattttgaaaataaaacatttgaaaatactgtgcagcaaaaacttgaacatttttattccaattattcgtngacgcggccgcgatttt

SEQ ID NO: 266822 - DNA, 768 bp, Homo sapiens
tactactactaaattcgcggccgcgtcgacgtcagtctaggatctctgtttttattttaatgttggtcagttgtgtctaaattccagagcggggcaggtataatggggcatcccgagccctccttcccattcatggcctgaactggtttttcaggtttctttgggtcccggtggctgcaaggggatgcactcagttggctgggggacttagaattttagttttggtttacagcaggatttgatgggcatgcatatttatcaatgtgaaagtgttgtctgtgggcggcggagggcttgggccgtgtccaggccacgcactgcaagggtgcagcccccacacacggtccctgctcctaaagctgttgcccccactgcaagagtggagtaggttgaggtgtagccatgacattctggaaactacattttttgtaatagtcattttgaaaataaaacatttgaaaatactgtgcagcaaaaacttgaataattggaataaaaatgttcagtttaatgtcattgcttgctgccaccgttttctgattgtaaaactaacgtgattattaggtactattttggtaatgtagaaaactttaaagatgaaaatagatatcacttataactccacatggagaaatagttgcccctccaatttaattgatttacttttgggccacaggggcccagaatttgattcattgtactccttggttcatgccagtgttcctgcacccagcactgaagctgaacattgacagtgatttgcccctg

SEQ ID NO: 266823 - DNA, 793 bp, Homo sapiens
gctataccggagtcccgttgaattgggtatcttattgctacagagagtctgttttgtcagtctaggatctctgtttttattttaatgttggtcagttgtgtctaaattccagagcggggcaggtataatggggcatcccgagccctccttcccattcatggcctgaactggtttttcaggtttctttgggtcccggtggctgcaaggggatgcactcagttggctgggggacttagaattttagttttggtttacagcaggatttgatgggcatgcatatttatcaatgtgaaagtgttgtctgtgggcggcggagggcttgggccgtgtccaggccacgcactgcaagggtgcagcccccacacacggtccctgctcctaaagctgttgcccccactgcaagagtggagtaggttgaggtgtagccatgacattctggaaactacattttttgtaatagtcattttgaaaataaaacatttgaaaatactgtgcagcaaaaacttgaataattggaataaaaatgttcagtttaatgtcattgcttgctgccaccgttttctgattgtaaaactaacgtgattattaggtactattttggtaatgtagaaaactttaaagatgaaaatagatatcacttataactccacatggagaaatagttgcccctccaatttaattgatttacttttgggccacaggggcccagaatttgattcattgtactccttggttcatgccagtgttcctgcacccagcactgaagctgaacattgacagtgatttgcccctg

SEQ ID NO: 266824 - DNA, 593 bp, Homo sapiens
cttaaaaaacatttactttttctttttcctgtgtgttcatgtcttacttagctccttagaaatgaaaattcaaacttttccctccttcctttccaccagccaaacaaccagcaagcactgtcagcttagctaagtatacgtttgtttataaattaccaaatcttgaaccaaagtaagaatccaccagaattctcctccatagagagattgtctcaagacatcagttaatccacaacctgactctgtccccagtgatgctgggcaggctaacgaatgacccaagactagagataagtcatccatcgagtcatgcagatcctgcacctccacaccccttctgcatggcctgcttccaatatttcttcttaaaaccctgttttcttcgtagaaaacttatatggttcctttagatacgaatccagccctcccacattgctaagctcgggaataaagtgactttctctttttttttttggagacggagtctcgctctgtgccccagtagttgggactacaggcacacgccacggtgctcggctaatttttgtatttttagtacagacagggtttcgccatgttggccaggctggtct

SEQ ID NO: 266825 - DNA, 851 bp, Homo sapiens
  misc_feature (817)..(819): n is a, c, g, or t
  misc_feature (824)..(824): n is a, c, g, or t
tgtcagttttctgttttttctaactatctcattacaattggtgcacaatgaactggaaaatataaaaagtgacactttaggcaaatgtgatggcctccgagctgaaatgaaggaactggcaatctttccaaagtggcagccaaggccccactccctgtcctactcaatctctgcagggaaaaactgtgggataggatagcagccagctggggacacacagaggaacattcaacaggaaggtcccgcctagggaaaaggccacagagcccaggcctcttgccgattcagggatccttggatataagtggattagaggagagggaggaaagctatcatttcagtggtctccaaatcaagtagaaatattactgggaggtatcccacttaagcctgaaccagcagacatccgaaagggtcactctagagtcagaaaggaaagcaggtcccccagaaggcaacacattgataggaagtggaggccacagaaaaagaatgtgcccacttgataattacttaagacttctatttaaccaaaagaacattgaaatactttgtaaatattcatattgttgaacctttcataatcaggaattcactatgtactatactgtaagtcatagttcgcctataatttactagtatatctccctctaggacagatagtaaaatgtgtactatgttgttacagtggtgcaaaaatgttttaaaagtttatcacttgttttgaagactagaactttctttacttttctatattttcttagcaattcacagatatgttctctttggatttagtactttaacatatgtacatttnnncagantaaaaataagggtatttcacaaaaaaa

SEQ ID NO: 266826 - DNA, 340 bp, Homo sapiens
gcttgcagtgaactgagattccgccactgcactccagcctgggcaagagcgagactccatctcaaaaaaaaaaaaaaaaagagagagaaaaaaacttagctggatgtggcacacgcctatagtctagctacatgagaggttgagacacgagaatcacttgaacctgggaggaagaggttgccgtgagctgagatcacgccgctgcactccagcttaggtgacagaaagagactccatctcaaataaataaataaacaaagcatacattcttatgagcatatagtagcatacttacatatttccatactaaattacaagctctgtgaaggtgggaatgttg

SEQ ID NO: 266827 - DNA, 309 bp, Homo sapiens
acgcttgtcaaatatccattgagcatatctgtgtgggcctatttctgggtcctctgttacattccattgatctgtatgtctgaccgtctgccgataccacactctcttgatgactatagttacatggtaagccttaaaatcaaatagattcttcccactttattcttctttgtcaagattgtataactagggcctgtgcatcttcatatgtattttagaataagttttggctatgtctattgtctatgcctgtaaaaaatcgtactgggattttagtaggcattgcattaaatctatagatcaattcta

SEQ ID NO: 266828 - DNA, 377 bp, Homo sapiens
gaagctattataacgccatagctttggcagctgtctaaagccagacacaatctctactccctctctctttcagctgaaattttccaaatatataaagacagttgtgtaagcttcctgaaatagagtacctgatcaataaatgttgtttcctttattcccctagtgttctcttgtccaagtaaaaattccgcattgcaggtcatcttcttccagatgccctctaccaggtgtataaatgcctctgcaaacaaactccccacactgaagagagtttcacagatgtgacgaaatgtgcaataaatacacaagaaccataatccagcttgacctagaaacagtagtttcctaatttggtggatccctttttttcaaatata

SEQ ID NO: 266829 - DNA, 701 bp, Homo sapiens
taggctttttcaaggatggaacaagacaaagttttctacagtgctgccaagaatgggtctctgagtgcagatgatttaattcatcttcagcgtgctaaggccatcctcttctgaaggaagaaatgaggagtaatgtaacatctgaacccctcatcaaaaaagacaggaaaatatcacctctcctgctaaagaactagaaaagttggtattttcaaaagaagaaacacctcaattcaagttaactcaaggacaactaagattgcacttcgtagtaaagaatgggaccttgtcagggcaacaacacactcttacactcttctgtcctgtttaatgtaaacagagttataaaaaccacttcaaagtgaagactcctgcccacgtacagatatttgcttaatgtgtgggctgatagctgtgaactatgtaaggcttttaaaacaatagtttaactttttagattttaaagataacttttctgtttcttttatgtttttttcttttccccaatattcctgcatatgcatttggaatcagtgcagtatcactgttaaaacatgggagtctaacaactcctaaagccactaggagcagtcccagcattgtcaggtatggaagggctctttcttcctacttttaccatggaagctacagttactggcgatcatcaagcaaaagctgccaattaacatttgccattcgta

SEQ ID NO: 266830 - DNA, 257 bp, Homo sapiens
tcgttcttgtttctctggttacttcaggtgtgactttagattgtctgtttgtgctctttcagtctttttgatgtggccatttaatgctgtgaacattcctttaaacatcacttttgctgtgtccttgaggttttgataagtcatgccacagttattcagtttgaagaacttttaaatttccctctggatttcattgtcgacccaaagatcattcagaagcagttatttaatttctacatatttgtgtaatttcatgg

SEQ ID NO: 266831 - DNA, 310 bp, Homo sapiens
aaggcgccaggaatttggggatgggaaggggtaagggggagagaaaggagacacaatctccgtgggatttgggatgggggcaaacaatgctagtgggaggacatggagtgcaggattttttttcccccctcagatttcccactttagttgaaggctaagcctttgcccaggggatgcaaactaatttcagtattagtttaagccagaaataattgggaaggtaaaacttgcaaaagagaaaccacgccacatatttcaaagacaaattgaaacaatttctggattatccccagacctttcttctgtctac

SEQ ID NO: 266832 - DNA, 901 bp, Homo sapiens
agatacaataaaaacatttattacatctcatgttttattttgtggaaagtttgtgataccatgtactaaaatacatcagtcaagggatatggttattatacctaaaggctttatatattttcatgggttttctagttcatgttttaaatattgcaaaatctgtgagatttatgaagactctttcatagggaaaatccactttaaacatctctacagtttcgctaggtatcttcaaatagaatagaatttcagtgtgataaattagactccttagttccatagctgacgtatagctggcatatcccattgatgttctaatatgtgatatgttcaaatatgtgataacacattttgatttcttataatgcttagtcccatatggtcctaaactattacgacctttgtcatgcttgggatttgtggaaatttcacagtggtaagggttgtgacattacacgctgaattactaaaatcacgcagcgcaaagtgacttgcacatgaaaagtgcaccttggtgctgaatttcctatttttttctacttgaaagtgtatggtcttatttataaagtaaagtatttatatgctttacataacaaagtctcttcttttaccacatttataaattagctgagtcatatttaacaaaaagactggtctaactttctaagtttaagtcaattttaaaatctgaaattgtatatgatgaaaatgagacccaattcagtatcaaaaacaggtggccaaagtcacaagggaattatgcggaaagggtagatatgatgtaaagaaagacatgtgttatcttccaaaatactatcactactaataaaaagccattgcacaagccaaaaaaatatattaatctgttttgaagaatgtgtctgataataatgagattcaa

SEQ ID NO: 266833 - DNA, 422 bp, Homo sapiens
aacagccaaagtgcaaatcacattcttcaagagctgccgcttacgatttgttagtagagatggtaaaggggtctgttgagaactacaggctaatacacaactgggttatggcacaacacatgcagtcccatgcaccttataaatgggattactggcctcatgaagatgtccgtgctgaatgtagatttgttggccttactaaccttggagctacttgttacttagcttctactattcagcaactttatatgatacctgaggcaagacaggctgtcttcactgccaaggtagaattttcctcactttaaaaatcaaaattataaaccagattttaatattttgttgataaatttttatttcaatgtagtaaatgtttgaaaaaataatttgtgaataaaagtaaatttgattacaaaaaaaaa

SEQ ID NO: 266834 - DNA, 544 bp, Homo sapiens
atgcgaaatgttattagacacaggcacagcatagcagtagaaacatcttaactgagaacttggaactgaaagagaaagcaaccaacttaaagggcagacaagacacatggttatgtaacacagcagtgggtattcacagtgatgacacaagacaaaacaattacattttcattctaaaagtaatttttaaggaggcaagggcatttataaaacattttagaaactatttaataaaaatggtaaaattaaagtgtttgtttatgtactcaacaaatatttatttggaaagtgcatgcctgggggcacatctcgttaatgaggtgatcctgtgtttagaactgaaggcagtcctcatccattctctcaaaaggtgaccttctttgttcttcttatagcctcaccacatttaattttcagaggttttgatataaattaaaaacattctttggtagattgtattgtatgaaaacaatcttcaaaagtgtaagcattgatatctggaatatctgggaaaatgtacaataaagacatctcttctggtctt

SEQ ID NO: 266835 - DNA, 430 bp, Homo sapiens
ctttctttgcttttaagcccagcccttggggttttttgttttgttttcttttttttttttcctttttctctgttctctacaaatcatttgggtctacatccagcttctcccagcatttactcaatatgaaacttccagttatagattaatttgaattctttgcactaattgtttaaaagaccataggaacctcagaccatccctcttcatggtctcaagagctcccagaatcatcctcttggtaagctaagtagttattagtaaggcccagggacaggactgagaagtaacatcttctattttttatttcagttttcctttaatttggaagcaaacaaacaaaaaacccttcagcttagggttttttcaattgttaaagtaatactgagcttcagttaaggctatgaaagaaaagaaaaaattttaaaaa

SEQ ID NO: 266836 - DNA, 496 bp, Homo sapiens
gattttcatatcaagggatttgaggagacacttcaggattccactgacagtagaatcacattttgtttttaaaataagttttgatttaaaattcaaatcatatttaaaattgttacctatatataaatatgtatttatatatacttaagtatctgatgtttaaatatgttacacatcaacattttaacccgtgagcgccattaacatggcactttatgctgctacgttaacctagtttcgtgcaggccttggaataaggctctcctgccatctctcactgacaagtgtcctgtgctggtaaggttcccctttgcagcaatcacccgcagtcttcttccaacacatctctcactttttacccttatccagtggagttagttcgctatctggcagccagggtcatcgtttaaaaaacagaagacacctgattgtgtcgctaaactgctttttaaaagcctccattccagaagatcacagcagataagcaaaaaataaa

SEQ ID NO: 266837 - DNA, 1650 bp, Homo sapiens
ccgggccgctgccgaggggccctgcccacccctgcccagcccggagcccaggcgagccagcgcggcgagcctcctcccctcccgcctgggtcgtcctgagtccgcgcccgctccagttgctgcagctgctgctgctggcggctgcggggagcgcggggcgcgcgccgaagaggcttgggcggcgaggacggggacgaggaggagtcggaggcggcaaggaggaagagcgagcggaggccgaggggctcagcggcgtggcgacaggactagggggtcccgagaacatgggctagcaggcggccacgggccggcggccggacgcggtgaacctgccgcggccgggcgcgcactggcgcggcgagccggagccgagcgcagccgggggaggagggctggcgcaggggcgcccgggcggagggggccgattatccattattaacgagttaccacctaataagcggagagcggctcgttagccgcgcgggaggcgctcggggaagggggtcaccggccgagcgcagcgcacacccgtggcgcacggcgggcggcgcggcgccgaggacacccgggaccgcgcgcggagccggggcgggcccgggggcggcgcagaccccgggcgcgggcggcccgcggcgccccctggctctcggcgctcggggccagcgcagcccggggcgagcggggcgcgggccggggagggggagctgcccgcgcactccatccccctcccccccgggcgggcggcggcggctcgctgtatatatctcggcgcaccccgccaggtcgcgcacagcgccccgagcccaggcgcctccccgcccccctcccgcgctccgcggcggcggcggcggcggcagcagtagcagcaatatggctgttgatgggtgtttggggtggcgctggcggcgggaggagctcccccgagcccctgcgccggctgcccgttgctagctatggcaaatggtggcggcggcggcggcggcagcagcggcggcggcggcggcggcggaggcagcagtcttagaatgagtagcaatatccacgcgaaccatctcagcctagacgcgtcctcctcctcctcctcctcctcttcctcttcttcttcttcctcctcctcttcctcctcgtcctcggtccacgagcccaagatggatgcgctcatcatcccggtgaccatggaggtgccgtgcgacagccggggccaacgcatgtggtgggctttcctggcctcctccatggtgactttcttcgggggcctcttcatcatcttgctctggcggacgctcaagtacctgtggaccgtgtgctgccactgcgggggcaagacgaaggccacccactttgggtccccggaaatgccaccagcagcgcggagctggagcgggagtccgcctgaggccgcggttttacgcggagcgtcttccctggcgctcgaggtggctagatgtcgtcggctttagctattcctggtgcagacgcccaccggcactgaggctggcgacaccttcgatgtatggttgctaggctcactgcctggtctgtagtcgtgtccctagagatgtcttcccttccccacagccactggctggagtgggggacccgacactgatagaaaactgcagaataaaaaagaaagaactggaaaaaaga

SEQ ID NO: 266838 - DNA, 2399 bp, Homo sapiens
ccgggccgctgccgaggggccctgcccacccctgcccagcccggagcccaggcgagccagcgcggcgagcctcctcccctcccgcctgggtcgtcctgagtccgcgcccgctccagttgctgcagctgctgctgctggcggctgcggggagcgcggggcgcgcgccgaagaggcttgggcggcgaggacggggacgaggaggagtcggaggcggcaaggaggaagagcgagcggaggccgaggggctcagcggcgtggcgacaggactagggggtcccgagaacatgggctagcaggcggccacgggccggcggccggacgcggtgaacctgccgcggccgggcgcgcactggcgcggcgagccggagccgagcgcagccgggggaggagggctggcgcaggggcgcccgggcggagggggccgattatccattattaacgagttaccacctaataagcggagagcggctcgttagccgcgcgggaggcgctcggggaagggggtcaccggccgagcgcagcgcacacccgtggcgcacggcgggcggcgcggcgccgaggacacccgggaccgcgcgcggagccggggcgggcccgggggcggcgcagaccccgggcgcgggcggcccgcggcgccccctggctctcggcgctcggggccagcgcagcccggggcgagcggggcgcgggccggggagggggagctgcccgcgcactccatccccctcccccccgggcgggcggcggcggctcgctgtatatatctcggcgcaccccgccaggtcgcgcacagcgccccgagcccaggcgcctccccgcccccctcccgcgctccgcggcggcggcggcggcggcagcagtagcagcaatatggctgttgatgggtgtttggggtggcgctggcggcgggaggagctcccccgagcccctgcgccggctgcccgttgctagctatggcaaatggtggcggcggcggcggcggcagcagcggcggcggcggcggcggcggaggcagcagtcttagaatgagtagcaatatccacgcgaaccatctcagcctagacgcgtcctcctcctcctcctcctcctcttcctcttcttcttcttcctcctcctcttcctcctcgtcctcggtccacgagcccaagatggatgcgctcatcatcccggtgaccatggaggtgccgtgcgacagccggggccaacgcatgtggtgggctttcctggcctcctccatggtgactttcttcgggggcctcttcatcatcttgctctggcggacgctcaagtacctgtggaccgtgtgctgccactgcgggggcaagacgaaggtaacgcgcgccccgggcgcccgccctctgcgccagccccaccgcttctcggcgtcccctgcagcccacctcctcgctccgcgccgcgccgtgcctccctccatccccgcctgccttcccctcgccgccttcccttccctcggctctcccggtgctctcggatcggggcagcgggcggcgcgccgggggtgaggagttgcccccagccagtgcgctccgggacgcggacgctcaatcctgtcctcttgtttattgtagggttgttggcggctgcggctggggccggggtcggggactcacaggctcgggtgccgtggtgcggggtggggacagccaactcagcggggacggaggaagctgggggcagctgggtgcgtgttttgcaccgctcacctgccggggctcggctcctggcggtgggcgagagggagcacatccgcccatactttaggaacctgttggggagatgagttcgtggggtcagaaagaagggaaaaatcctttgggcaagggagagaataattttgcacaagggaatcccgggggaggagcatggcccgagataacagggggacttcgaggggcgagagaagttggggagatccatcccactattgggggtagcccacggggctgccacttttggaatgtgtcgaggtcgcatatctgatgtaacctcccactccgtcccttaggtgctctagtggaacataccccaagttcttcggcctctgttcctttgcccccaggccacccactttgggtccccggaaatgccaccagcagcgcggagctggagcgggagtccgcctgaggccgcggttttacgcggagcgtcttccctggcgctcgaggtggctagatgtcgtcggctttagctattcctggtgcagacgcccaccggcactgaggctggcgacaccttcgatgtatggttgctaggctcactgcctggtctgtagtcgtgtccctagagatgtcttcccttccccacagccactggctggagtgggggacccgacactgatagaaaactgcagaataaaaaagaaagaactggaaaaaaga

SEQ ID NO: 266839 - DNA, 1704 bp, Homo sapiens
ccgggccgctgccgaggggccctgcccacccctgcccagcccggagcccaggcgagccagcgcggcgagcctcctcccctcccgcctgggtcgtcctgagtccgcgcccgctccagttgctgcagctgctgctgctggcggctgcggggagcgcggggcgcgcgccgaagaggcttgggcggcgaggacggggacgaggaggagtcggaggcggcaaggaggaagagcgagcggaggccgaggggctcagcggcgtggcgacaggactagggggtcccgagaacatgggctagcaggcggccacgggccggcggccggacgcggtgaacctgccgcggccgggcgcgcactggcgcggcgagccggagccgagcgcagccgggggaggagggctggcgcaggggcgcccgggcggagggggccgattatccattattaacgagttaccacctaataagcggagagcggctcgttagccgcgcgggaggcgctcggggaagggggtcaccggccgagcgcagcgcacacccgtggcgcacggcgggcggcgcggcgccgaggacacccgggaccgcgcgcggagccggggcgggcccgggggcggcgcagaccccgggcgcgggcggcccgcggcgccccctggctctcggcgctcggggccagcgcagcccggggcgagcggggcgcgggccggggagggggagctgcccgcgcactccatccccctcccccccgggcgggcggcggcggctcgctgtatatatctcggcgcaccccgccaggtcgcgcacagcgccccgagcccaggcgcctccccgcccccctcccgcgctccgcggcggcggcggcggcggcagcagtagcagcaatatggctgttgatgggtgtttggggtggcgctggcggcgggaggagctcccccgagcccctgcgccggctgcccgttgctagctatggcaaatggtggcggcggcggcggcggcagcagcggcggcggcggcggcggcggaggcagcagtcttagaatgagtagcaatatccacgcgaaccatctcagcctagacgcgtcctcctcctcctcctcctcctcttcctcttcttcttcttcctcctcctcttcctcctcgtcctcggtccacgagcccaagatggatgcgctcatcatcccggtgaccatggaggtgccgtgcgacagccggggccaacgcatgtggtgggctttcctggcctcctccatggtgactttcttcgggggcctcttcatcatcttgctctggcggacgctcaagtacctgtggaccgtgtgctgccactgcgggggcaagacgaaggtgctctagtggaacataccccaagttcttcggcctctgttcctttgcccccaggccacccactttgggtccccggaaatgccaccagcagcgcggagctggagcgggagtccgcctgaggccgcggttttacgcggagcgtcttccctggcgctcgaggtggctagatgtcgtcggctttagctattcctggtgcagacgcccaccggcactgaggctggcgacaccttcgatgtatggttgctaggctcactgcctggtctgtagtcgtgtccctagagatgtcttcccttccccacagccactggctggagtgggggacccgacactgatagaaaactgcagaataaaaaagaaagaactggaaaaaaga

SEQ ID NO: 266840 - DNA, 578 bp, Homo sapiens
tgaagatctgaactacctcggaatctctttattcaggtgttccttaactctaggatgcaggttccgtagtgggcggaccttccagcaaccagagtttggagaagcgaaggggacactggtggatctccaccatgaaaattggcgctttgggaatgtccaaaatttccagggcaaccgtccgtcgcccctccccgaccccgcctccttttaaaggagaaacggagtcccaaagaggcatgcagcaaggtgcagcggtagcccgggtttccttcggcttttgcggccttagcattatgtctaggtttgaactgtgttcagtctcttttacctccccctattcgatacgcagagcgaattcgatttgagatctgagggcagacccgaaccaggaaagcaactcagacgctagggccccgaggggcggagcgaagcggtacccgccccctggcggccggagccaatcagcgcgggcgttgagccggccaattagcgcgtgcagggggcggcctgccaatgagctcggggcccctcgggaggcggagctccgagcgccaccgggagggctacgcggcggccgc

SEQ ID NO: 266841 - DNA, 714 bp, Homo sapiens
cttttctttttgtttgtttttgttttttaaagacagagtcttgctctgttgcccaggcaggaagtcagacttcgtctcaaaaaaaaaaaaaggttataatggtgttctcattagaagaactacagaccccagagctctcaaatcgccggaaggatttctgcggtaggcctgtgcatgatggacagaggacaggtggtaaagaatcacggacacctagtaggacaactaggcatggctttgtcccggtttcagagcaccgacacagcatttagtcaccatttaccttcttgggaggtgggttaggcagcgggcacactagtcctgctttgtgggagcagaagtgaagtctcagagaaaacaggtgacttgcccaagaagccttattaattaccagccaggacagcgtattttctattccgtgtgttttgggataacttagtgccgtcccctccgatgaaccagtgccttcgaaagcccttgagatttgggaaacaggcggcacagatcttggaggttaccttgttcttaatcagtcctcaggcagtcgcctctaacgcgagcgaacaccggcttcccgaggccgtcgctcggcagaggaggggccaggcgcccgatcccagatcccctttccccgccccgccgcgccccgcctgctctggcacagccgcactcccgcaaatccctcccgcggaacccccactcctgcctgcgcgg

SEQ ID NO: 266842 - DNA, 246 bp, Homo sapiens
atttaagaggcctatagaataccaagcaagatacatgacaaaggtttcaaacttggaatacatcaaagtaaaatttcagaattttagattttattggaactttagatgtatttatattgagaaaataacaaaacaagattgtctacaaaagaaagaatcagactggcatccacctcctcaccaattaacattgcatgcaaaaaagattctgcaatgtctaagagaaaataattttggctgggtaca

SEQ ID NO: 266843 - DNA, 337 bp, Homo sapiens
aaaattataagattagtcgtattacaattagtcatgtatcaaacattttaataactttgttcctttaattcactatgttttgattatatgaaaccaaatatgttttacttcaactgaccatctggggtggcaatctaccatctgattacatcattgtaacattacattcagtgttatctttcattgagataattcagctattactagtctctctttgcagatgggaaaactgaggccaaagagtggtttgcctaaaagtcacaactttaaaggggcagagtcactgggttttctggctctcagtaaggtgctatttgcagctctaagactagacaga

SEQ ID NO: 266844 - DNA, 670 bp, Homo sapiens
acccattattataccgcgtatttcctctagtcaatcgctaataacagcttgacattaattttcagattcaacgttaacttacaaaaaaggcatatttccttaaaaacatcagtggacattcttttaaattcacgtatctagctttaagattttaaagtgtgatatacatggtatgctgggggcccaatacctactgcgcgtgaaaattatctctatctttcatgctttaaaagcaattactaagcaattaaattagaggactctttagatgcattaactctcatttcctagaaaacaacacatttttggacctgtttgaaaactcatgaaaacaattaaaatgagtattttaaatctattaaatgcctaagatatgaaagtgtctatttagtttttgaaatgttgttaagaatcctacgatcagcaaatgcaaaattccagaccattcctaaaatgtgatttgtacaatcacaaaaaaaaaaaaaaggcttaagactgtatataccagatttgtaaaaacataatcttgatgactttactgcagatttaaccacaatcctaaagcaccattttattaagaagtactaaatgtcttcctgctccaatataaattacatgcatcgactgtcttgatagtaatagaagtgttttcaatgtcaggcaaagaaat

SEQ ID NO: 266845 - DNA, 255 bp, Homo sapiens
ttccagcaatgatcagcccttgcctaattgcaaatagatgggtcttaggattgtttttttgttttaatgttgcctgcaaaaattacactggttagtgtctctggagccctaaaagataccaccttttacacaaagctgaaagcagtagactttgggctgcagtccagtagtttcttttgtcaccgttttctgtttctttcctctttctctgctccgttttctctccgcccttctgtcgtcttctcgcctgctgtc

SEQ ID NO: 266846 - DNA, 326 bp, Homo sapiens
tatcatataagcaggttaatgtgttacagcacagaagtagtcagccatgtaaaatctcagcattgcagttgataaatcatgaatactgtaaaagtgctgagatccttctttttataacctacttcacgtttctttttattctagcactaacgtgattgaaaatcctccaaattttggcactagagttaaagggataagttgaattagcattctggaaagatatgaagatttaggaaaatcgttaaatataaaaagaacaaggaaaaatttagcttaaaagatgaacccaaagattgaaatggtcagttaagctgctatagttaaac

SEQ ID NO: 266847 - DNA, 147 bp, Homo sapiens
ggccaggctggtcttgaactcctgacctcgtgatccacccgcctcagcctcccaaagtactgggattacaggtgtgagccactgcactcggcccaaatgcttttatatgcattacctggttacccatgaagaaggccctctgatctg

SEQ ID NO: 266848 - DNA, 778 bp, Homo sapiens
tgcttctagggctccgtggggtttggggcttgacattcatccatttacaagcatttcctgtatgcccctcctctgcagggcactgggtgtggggatgcagggaacacagagctgatgcttgcctctttgccttcaatgagatgaccttctagaaggaaagaccatggagtgtgaagctcagtgggcaggttgaaatgataacagtccctttgtgtgtgcggcttcttagggttatcatatttgatcctcagcacacattcaggtagtcaggtcagagacgattgattccttagtctccagaggggaaagctgtggttgagtttcattaattgagggaatagggccagagtgcagtcagggtgtgctgattcctgctccaaggatcttccaggacgccaggctgcttctcactacagaactaagtgctacatcatgtggggctaactgactgtggtggagggggatcgttttgtttgtccccagagatatttgcagactcacttgcagtcagagaggaggctggaatgggggagtctgatagcacattcttcatgaaccgcatgccacctctgtctatgcagctgggccttcatgggcatattgttgggttcgaactcaacctcttcattcttggcttgttataagacaccatggcaacagagaatacgtaggacatgtttctgccctcagggaggttgcagagggtggaggagacaaaacatccacagaggaaacccccagagaccagtaacttacatttgtaaaatgctgagtgtat

SEQ ID NO: 266849 - DNA, 377 bp, Homo sapiens
tggaagatgagtaacagtccatcagggtggtcctgtgtgcacctttatgaaccgaggcatctttatagatctcctttggactgcagatggtaatacagattttgctacaaggagtttgctgaaataggtcccaataatacgttggtaaaattaaatccaaggctgtgctattcccaaggttaaaaatacattcttttttcttttaccgatttcaaattctgttcatacatgttgtcatttgttacagtttgccattggttctgcagtaagaataaatgataagaaaataagcatgatgtgtaacattttaaaaaaataatacatggtaacatggatgcctcaataatgtcgaaattaaactctaaagttatattatc

SEQ ID NO: 266850 - DNA, 509 bp, Homo sapiens
tttttttttccaacgatatgttctttccaaccctttgagttttgacccatttttaggcaggagaatagggtctggagacaggcagccttcacttcagcctctgattggtcatgggccaagtcttcatttgcgtaggatgtaacttcagcctctgattggttgtaggctgagccttcacttcagcctccaattgatcacgggctgagccttcacttcagcctccgattggttgtgggccaagtcttcatttatatagggtgtaaccgataggaaacctctaatgggtacttaaaccccggaagatttgcaactagggctcttgagctgcttgctcaagcctgctcctgatctgtggagtatacttttgcttcaatacatctatgcttttgtcttctattgctttgtttgtgcgttttgtccaattctttgttcaatatgccaagaaactggacaacttgtagtcaagaccctccactggtaacatatcttggcaagtcagccaggaggta

SEQ ID NO: 266851 - DNA, 198 bp, Homo sapiens
ctaccctgccatacacaatgtctggggacttgtttttcaacccacagtgctgtgacattgctgacacttgtttatctctttgcttaacactgtggatggttcatgtgttgcctgctgggtaatattctgccattcttcatgtcctcttctgctgatgggtgtctgggctgtggccaggtttttgttactgagaacagg

SEQ ID NO: 266852 - DNA, 597 bp, Homo sapiens
tttgtcatgaatgttgattttttgaggaaatgctttaaaatgtactgatgcccatgttgtggttgtaaggaaacaaagcagctctgtgaggccaaagcatatttcagttcaatagtgaggctttcttagaaagaatgactcatagtcactcagagttgagtcgcacagaaacaaccgagagcagacagcaaggaacggcagggcccagaaggtccagcctttccctccaggctgaagggttagggaagatcgccaaccttaaagggggtgtgagaggcctgggcccaggtgagattgtactgaattccagtaaacagtgtacagtcattccaggacagaggacaggaacatgtttactaggtgtctggagtgcacctctataatcctcatacacactaatccagataatcctgggatgctggcctcacgcaggattgttgatgagaatgcaaatcccaacattgcaattcaggattttgcttctactgaaagcattttgtcaatgttctcttttggggttagctgggtgacagttctcccttgctggattcccagtacttaatagcgtttctttgactcagtggatatgtggaacat

SEQ ID NO: 266853 - DNA, 812 bp, Homo sapiens
gcttttctgtcttacaagaggtttgtaaaaatgcaccaatcagcgctctgtagctagcaagaggtttgtaaaatgcaccaatcagcgctctgtaaaatggaccaatcagcaggattctaaaagcagccaatcgcagggaggatggaaaaaagggcgttctgatacgacagaaacggacatgggaggggacaaataagagactaaaagctcccaccccagtcagcggaggcaaccggctggagtgctctgccatgctgtggaaggtttgttctttcgctcttcacaataaatcttgctgctactcactctttgggtccgtgccatctttaagagctgtaacacagtgaaggtcggaggctgcattcttgaagtcagcgagaggatgaacccactggaaggaaccaactcaggatacaccacttacttgggaggctgaggtgggaggatcctttgagcccaggaggtaaagactgcagtgagatatgatcgcaccagtgcactccagcctgggtgacagagcaagactctgtctctaaaacaaagtgtcttggttgatgtcaagctgctggtgatttgcaacttgcataaaatgagacgatcgcttgagaccaggagttccaggccagcctgagcaacatagagaggatgtgtctccatataaaaataaaaaattttttttgagagggagtatcgctcgggtcaagcgattctcctatctcagcctcccaagtagctgggattacaggcgcgtgccaccacacccagctaattttttgtatttttagtagagacggggtttcaccatgttagcc

SEQ ID NO: 266854 - DNA, 313 bp, Homo sapiens
gaccaggcttagtgttacttctgccattctctattggcaaaagcagtcaggcagcccagacccacaaggattggaaataaatcccacctcctagtgggagaggtatcaaagaatttgtagccatctttaatctgctgtagcccatcctctagcccctaattatttatattcctgccacattcaaagttcactcaccctctcccacaacccccaagattctcatctcattacagcaacaggctcagactggaggtccaggatcgcattttctaaatcatgtcttggtgcatatgaagctatcaggtatgtttct

SEQ ID NO: 266855 - DNA, 472 bp, Homo sapiens
agaggacatgataaacaagattttcattctccacaaagggaaattagctgaattttcaatgagaagaaaatatttcctgcctttaggagtaaaataaatttattttttgggagtcctcctataggtgctatccttacctaaactcctatataaatgtatcaatagatgtttttgtagttgtgtcttaatatatttattttagatttagttatgattcactggcaaaggcttcgagtgcagaagtctcagattctccatagcttttgctatagtttcagggtttgtggggctgttcccttaaagttgtggggaacccttatttaagttccccaacttaaagtcatttctttctctgctcttaaatgtataaagtcattttactatttttttcctggctcaagttatgtataattggtgtaaacatttaaaacaatataataaaggtaaaaaatttaaaaatgaaatggccttt

SEQ ID NO: 266856 - DNA, 364 bp, Homo sapiens
ggcccccagctcgcctcttcctgcgaccctaaacttgggctttgattccccgccggtcgcggtggtccgggccacccggcggcggctgacagctgagcgcaaaggcgccgcggccaaggtcctcgcggagcagcccgggatgcgcacgccgagggttaaggaggaggccgcccggcctggagctgggatcgcaggctgggggccgggacacccgggcctcgccgggccgggggcagggccgcgggtctgacagctgctgcggctcgcgcggacgcgcgcctcctgcagcccgccctccccatgcctgacttattactctctgctcctcctccctctgctgttccaaaacacccttcgacgccag

SEQ ID NO: 266857 - DNA, 451 bp, Homo sapiens
tcatcaacaaggaagccaaagcggaagactccccaaggaagtggggctctcaaaacacatgtgagacaatgccaagatacccccaggaatacctgaaggagacttgcattgaaggtcctacggatccacgtgggaacacaaaccagtgaaatttgcgtgatctccactgactagacatcatttgaaccctcatgctggcagggtctgaagacatttcgtaatctgtctccacttttgatccctactgtagctcccctacaaaacatttctacagattgctaccaaggtaatcttctaaaattataactccagtggtattctgggctggctcatataggctcctgagagcagactgggaaattttcatcaagattgggaaattttcagcaattttgtgagtcagttgttaaacacataaatcattaaaaattaaaatattaaaaattgaaaa

SEQ ID NO: 266858 - DNA, 187 bp, Homo sapiens
tctctgtcccccattactgacacagagctcctaatcccttagacttgcctaggtgatgggagcatcttttgttccaatgaggcagctcttgctgggctcctgggtagctccaggatgggggctggtcgccagcaagaccaagccacgatgagcagcttgacacttctggcctcacccgccatgctct

SEQ ID NO: 266859 - DNA, 275 bp, Homo sapiens
taactttattttaggttcaggggtacatgtgaaggttttataggtaaactcgtgtaacggggtttgttgtacagattatttattcaaccaggtactaagcgtatacctaatagttattttccgaagtaaataatagcttgtgttccagattaaaaaaacaaacaacaaacaaaaccaaactcttttaatggctaggatgtgtatccttcaaaatacatctgaaatgacctacgaatatttggctattgtcaacaaacacaataactttttttgtc

SEQ ID NO: 266860 - DNA, 185 bp, Homo sapiens
ttcatcaaaattacaagcttctgtacttcaaggacagcatcaagaaaagacaactcacagaatgggagaaaatatttgcaaataatatatctgataagaaacctatatctagaataaagaactattacaactcaataatagacaagtaatccaattaaaatgggcaatgtatttgagtaggcatt

SEQ ID NO: 266861 - DNA, 521 bp, Homo sapiens
gagaatagttttagttctgttgggaaactgtggatgaaacgatgagaggatgatgaaatgatgatggatgaagttttctcaacttaaaaaaaaagttgaaaaaatgtcaaaggcagtattttttccagagaaagagttgtacatggaaataaatattatcattgtatgctgtaggcttatccctgaacaatatttattttatcataataatgtaaacacgttacactccttaaaaaagaataataaagctatattgagattatcagggaagaaaagtgtatgtatgtgggcagaagcagggtatgtacgagcaaactccttattttccacagttgaaaataaatagataatatctaaaactaaaaaatattaagaaaaatcagtataaagatgttattgagaggccgggtgtggtggctcacacctgtaatcccaacaatttgggaggctgaggcgggaggactgcttgagctcatgagtctgagaccagcctgggcagcatggcaaaaccccatctctac

SEQ ID NO: 266862 - DNA, 730 bp, Homo sapiens
taggcgcagaggaggattacaatcagtgcaggacatggcctgggtcaccctggacactgcagccttgctgggcagacagtagctgggtttcgagttcccgtatgtggaagatcaaacagtgagttattgcgggggcgcagtaatcagaggggaggcaaggagctggcagcaggcaggtaaggaagagagagagaaagcacgagaggcagcggggtggagtgagaggcaaaatggactagtcaaaactgtctgcagattcaattattctactaaacacgatgggcaaatagaaaacagctaagacgacacacatgggcaggcagcattcagtggggaaaagggccgttctcatctcagctcccctcctttcagccctgcgtgcactcgagaaaggaacccagcagccgcgtcctgcctttcctgttttgcgcaccatcctcctagtcacccaggcttgagacctgcaagttcccggacacctcccatctagagagccacctggcccaccatcccttcctttcctcatctttgctgctaccacaccctaggttttgaccacataaatgtaggccctgccagcctcccagctcatccttctgctccagacgcctcctcttaacactgtcttgtaccacaccaccagagtgttcttccccagacacccactgctctgttcaaaagtcttcaatcaagcacatattctcaggatctcctgagggctgtgtcaaaa

SEQ ID NO: 266863 - DNA, 415 bp, Homo sapiens
ttccgagcatccagcaaaggagggagaatgcggtggtgcccggtctcatccggagcctgcctggcccatctctgaccgtggtttgtttttttgaatacctcacagttcacgtgatacagaattctagaagtacaggccgggcgcggtggctcacgcttgtaatcccagcactttgggaggccgaggcgggcggatcacaaggtcaggagatcgaaaccatcctggctaatactgtgaaaccccgtctctactaaaaatacaaaaaattaggcactacagtggcgggcccctgtagtcccagctactcgggaggctgaggcaggagaatggtgtgaaccaggaggcggagcttgcagtgagcagagatcgcaccactgcagtccagcctgggtgacagagccagactccgtctcta

SEQ ID NO: 266864 - DNA, 807 bp, Homo sapiens
tgcattctctccggctccagatcatccagtgtgacagagtcttaatccgtggttctgcccatcagcacattcaacggacttaggatttctcaccacgtgcccttattttggaaaactgttcatttcaagaccacaggcaaaggggatactaagaataatcgcagaattaacatcggcaaggtatgatcaggatgaggacgtgagaaacgcagggctaagagttgggagtcctgggatgaacttcccacctcaaagcccagcacgagggtccctggacgctgtcggccccggacgtgggtccccgagactcgactgcagctcagagtggccacatctgccctgccaggctgccgcggagacaacacggaggagcacctgtgagaacacctgctacaccaagctcagggactcgtgcgtctccccgtccggcactccttctccttgtatttgaatcttttgatctctttttggcaaaggccaatcatttaaactttctgattttcagtttctttgtatggaaacgacagtaatttcattgattatatatgtaccataaaacaattttactaatttttagtaaataactagtttactaaccatcaagagctgcacagacaccgtttgctctctgcggccctcagctacatcctctttgtctttctctaaaatcctgcctgggtgtatccttgtttgtatgaatatgaaataatacatgaattttgatttgtactcactaaatcttggaaacaatacatctcattagattagtatatgcaccaaatactaaatacagatgcacactccctc

SEQ ID NO: 266865 - DNA, 350 bp, Homo sapiens
cgccagtttcaaattcagtggcgtttgccctgattcccggggcctggctttcagcgtagcaattctgccggcgaagaaggtgagcgcagtgctgtgtggcagcagaggtccttaggacgaggaacagcgggacgaggaagggcagactggtgaaatcgcaaactgggcgtctgttccggcaccggacccctgtttgcaaaggtccatggctaatgaaacacagaaggttggtgccatccattttccttttcccttcacaccctattccatccaggaagacttcatggcagagctgtaccgggttttggaggctggcaagattgggatatttgagagtccaactggcactg

SEQ ID NO: 266866 - DNA, 370 bp, Homo sapiens
aatggtatgcaaagtctgaatatagaaagatctcacaccttaaacaaaaactaactcaaaatggatcatggacttaatgtaaaactataataaaacctttagggagaataaaactaagaggaaagcttcagcttacagggctaggcaaagagttcttgacaccaaagaattaataccagatgtgcaatgtataaaggaaagatcgatgaatttaaaacttgctctgggccagacgcagtacctcatgcctgtaattctagcactttgggaggccaagggaagaggagccattgagcccaggagtttaattaagaccagcttaggcaacatagtgagaccttgtctctagtaaaataaaaagtaagtaaat

SEQ ID NO: 266867 - DNA, 412 bp, Homo sapiens
cgttggtttgattaatggtagaaaatcagaaaggtaaggaatgaggaaaacaatttatgactgtgatttgtccaggaatcatcacagcgctccattttgaattataggtactcagaaagtgagattcaggccaggcacagtggctcacgcctataataccagcactttgggagggcaagacaggatgattgcttgagcccaggagttcaagatcaatctgggcaacataatgagaccctgtctctacaaaaaataaaaaattagctggatatggtggtgctgtgtgcctgtgatcccagctgagaggttgaggtgggatgatcacttgaccctggggggttgtggctgtagagagctgtgattatgccactgcaccccagcctgggtaacagagcgagagcctgtctcagac

SEQ ID NO: 266868 - DNA, 311 bp, Homo sapiens
taacagtcattgcttttcatctgttaccttccctgtaaaactgagacgtacgaggggatagagtccaggttttcttgatgattgtatttctagcatctagcctagtaattccatagtttttaaaaacccggttctgcatagccccagggttccagaaaggtgtcctaagatcacccggtaggggcaaagagtgggcagggacccaaggaagaccccttccccacaatctgtgctttggtcaggtaggttttgatttgaactcttctatatattgggattcatgtaattcttttaaaaaggattcttctaga

SEQ ID NO: 266869 - DNA, 313 bp, Homo sapiens
atatcttcttgtggccccaggaaaggatttcttcaagctctgtcaccaaagatgggattactggctcttggtatctgtacacttaatttcactgagtctagccagactcagatctcagatggctgcattgttcacactctctccagctgtacgtgtgaattcctctttcaccacatttttttgtcaagatacgatactgcctttctctctgacttttgctagtcaaatggggaataatgtgctacttcatggtgattttaagttattgtcactcaccattagtaattttgaacaaatctttaatatacttagt

SEQ ID NO: 266870 - DNA, 400 bp, Homo sapiens
agagagctcaagtgcttttagaaaagaagttttgaattactactaataaatataaaatctcacatcaagtagtagaaatataaggagtaccttggtgaagaacagaaacatgttataattctgatgagtggaccaattacctatggcagggagagcccctcctttttagacgtgtccctgcaagtcttagttccacgcctgctctgggctgccctactctctccctccagatccttccacagtgtcggtctagaactgggcgtgtaataggcaactgaagtgatccgtggctccatgatataaagctccatggcactgtatgctgcggttgttaagtggagtgttctagaaataacatttaaatcttgttggttgatggttttgtccagttattccatac

SEQ ID NO: 266871 - DNA, 420 bp, Homo sapiens
cagggcacccacttgaacctgcctgcatggctggagcgtagcacttttgaaagcccttcctcaaggcacccccactctccttggggttaccacctcactcgccccagaacatctgggtctgtaaccagagactggacctggaatcaggactcttggctcaaaagggatttaactccccgggcctcagcttcttcatctgcacagtggatggtcagcctttccttttattgtcattgtggtgattctattatagtaattaccttaaaataaagaaatccaagacaaaacctgcctcacctaaacaacctcttctctcatcaaatccatgttgtcatgtgtccacaggactgtctactccttgcctatttgcatattcagtttctacctgtttgcagtcataaactagtttcatgcactgtg

SEQ ID NO: 266872 - DNA, 568 bp, Homo sapiens
cagggcacccacttgaacctgcctgcatggctggagcgtagcacttttgaaagcccttcctcaaggcacccccactctccttggggttaccacctcactcgccccagaacatctgggtctgtaaccagagactggacctggaatcaggactcttggctcaaaagggatttaactccccgggcctcagcttcttcatctgcacagtggatggtcagcctttccttttattgtcattgtggtgattctattatagtaattaccttaaaataaagaaatccaagacaaaacctgcctcacctaaacaacctcttctctcatcaaatccatgttgtcatgtgtccacaggactgtctactccttgcctatttgcatattcagtttctacctgtttgcagtcataaactagtttcatgcactgtgttttcatagcatctgtgttttccattttgcttcagtcttttttcttgctttctagcccccatctcaaatgcccttccagcccttccaaccagataatccggtttgaccccctggagtgtggccttcccatgtccttctccaggttcaa

SEQ ID NO: 266873 - DNA, 254 bp, Homo sapiens
aagtttttttttttaagtttgttgaacacctaccataaaccacatattcgctctatgctaaagataagatgtccttggacaacagtctcagttccttctttctagttatcaatatagagagtgtctcttctttgggtgatagtgggagtgtaaattagacctacccagagaacagggtaattccttaagagaaaggtggtgtcagtccactgcatcgatgacttaagcaagtgaggttattcagggcaagggaa

SEQ ID NO: 266874 - DNA, 180 bp, Homo sapiens
tggttgcctcagacaaacccaacaaaaatagcccaaaaatcagtataaaatattctttaaatctgtttaaggctatcagctaccaaaagaagtctttctgtgaggggcaaagaccttcccccacctcaaaaagaaaagggaagagtttttttcctttgaggcacttggtgattagtatcc

SEQ ID NO: 266875 - DNA, 303 bp, Homo sapiens
tctgttttccttgtcaccagactgtgtctgcttttacgtcgatgtagaagataaaggaagctgacttcaagacaactgcccttcctaataatgatgatgggatttggttgagtcacatgctacactcatattgcctctaactcccccaggatttatattcctcgaaactacatacaccgtcatatgttcatagtgtaattttgtcatttctacactttgtgtccgttcctgttctatatcttaataatttctggaagacactctctactttcttattaaaagtaaatatatttggcccaaaaa

SEQ ID NO: 266876 - DNA, 469 bp, Homo sapiens
acacaataacttaataaatggcatatttactatcatcgttttattcaaaatagttttgggatttaggctaacccggaaggtttaaaaaacccaaaataaaccataataatataaatgcttgggaaagggggcaattcattttatttgcaaagacattattatacctagaaaacccacaaaactgtattagaacatgttttaaaataagagaattaggtaaggtggcaagatataagataaatatacaaatataatgtaatttgtactagctacaactttgttgtgtatcaaaacaatcataccacagtggcttacaagagcaaacgtttatttctcactaactttacatgagggctgatggttggtgttgggaaactctcctccatatgttactctttttcctacacatcttgctgggtgtgctaagcatgcaagggcctaatcatttcctacccagccttttctcagg

SEQ ID NO: 266877 - DNA, 566 bp, Homo sapiens
gaatatatttgatatttttcaatccactgaagttattatacttgtcgatgctcaaattttcccatctttaaccagtgggaacctatttaagttggctcccaaatccttttgacataaccctactggcctttaaaacttccctgctttccgacatgataagatgttccaggctttctttacgtttcctaatccgacccaggcctggggttagccatttttccaaggcagaggttctcaaagtttggcccaggtcctcttaagagtccctgtgatccttttatggggtccgtgatgtcaagattattttcatagtaagagttatcactcagtatccatgtccccaaggatactgagggtcccaggacccctctcagatacccaaatccacagatgctcatctcccttgataaaagaaaaactgtagacaaattaaatttaacaaagtttaattgatcaaggaaaaagcaattcgcaaattgggccctcagaatcacagcaaattcagagagttatttctgcacagttggagagattttaagaatagaaaaaggaaactgaaatacaaa

SEQ ID NO: 266878 - DNA, 154 bp, Homo sapiens
accccttctccaccatcatggtgtgtgctgttgattatttctcccaccatcttctcacaaaatgtccaggatcatgcaattcctggccaagaaacaaaagcaaaatcgtcccattcaccagtggattcagattaaaactggtaatacagggctg

SEQ ID NO: 266879 - DNA, 446 bp, Homo sapiens
ctgacgtgtagaggcatgatcatagctcactgtatcctcaaactcctcctgggttcaagtgattgtcctgccttgacctgctgagtagccaccaccatgcctggctcaaaatggatttgatgtaccttaacctaccatgaacctcatagcttagcctggcctaccttgaatgtgctcaaaacatttattgaacaaattatcatgtatcgaaatatccatattgctttcacgccattgtgaagttgaaaaatcacaagttgaccattgtaagtcagagacctgtatgtctttatttcagctgtgacccagaggattgagataactttatggctgggtgtggtggttcacacatataatcccaacagtttgggaggcctaggcaggagcatcacttgagcccaggagttcaagatcagcccgggcaacatggtgaaacctcatctcta

SEQ ID NO: 266880 - DNA, 464 bp, Homo sapiens
attgtacatacaaaaaaccaggacagtgtgacccatagtccagagaaaaagtagttaatagaaacagcacttagatgatccagaagctggcattagcaaagactttataacagtgttcatactttgttcatgggcaaggacatagaaaaccaccaacagtttcatagtcaaactgctgaaataaaagataaagagaaaattttgaaagcagtcagaactaaggtcacatttcacataggggaatgatgatatgaatgatggttaatttcttatcacgaacaagggaggccacaagatatctttaaagtactgtaagaaataaaaatttcaacctaaaattctatatccagccaacatatacttacaaaatgaaggtaaaataaagacactttcaggcaggaggattgcttgagccaaggagttggagaccatcctgggacacatagtgagacctcatcgctacc

SEQ ID NO: 266881 - DNA, 1374 bp, Homo sapiens
ttttctgttttctcgccgctttgctctctgctttgttgcggtgcttgtgtcttctgtttctttatgttttcttgcgtgccttttctttcttcttttctcttttgtcttttcctcgtcttttgtttttggtttgttttcctttttcctccttctgttgcttgtttgtctctgttctctttcttttttgcttcccgcgcgttctgtatccgcgccccggcgcactgttatcgcgttccctggggctcctcctgttgctacattcccctggttgcccctctcaaccctctctttggaattttttgccacacctgcctcgttctcccccgcggctgtcttttaatgggtgggagatcccggcgcctgtgttctgcccccgcggtctctccttgggtccccctttcccccagtcaccttaccctcgtggcccccgcgccccaaaccaatgtctcttaaaaacctttcttatgcccaaccccccccacaaatttttttctctcttctctctctctttttttttctaggaaaaagaaaagaaattttattaatattgacaaccttggggattacaaatagactggatagacgtggaggcgttcttagtctcttaatgaaggacacatgatttggattgattacactaaattgatgggagggtcctttgatttccaggctataccatgtgctgatcacacttttgatcccgagtagctgggattacaggcagccaccgccaggccggctaatttttatttatttacttattttttcagacggtgtttccctcttgttgcccaggctggagtgcaatggcatgatctcggatcactgcaacctccacctccctggttcaagcgattctcctgcctcagcctcccgagcagctgggattacaggcatgcatcaccacgcccggctaattctttgtatttttagtagagatgggatttctccatgttggtcaggctgatcttgaactcccaaccttaggtgatccacccacctcggcctcccaaagtgctgggattacaggcatgagccattgtgcccggcccatttcatttatttttatgtgtgctgctgaagcaagcacttatgtgtaggaattgttcttcctgtgagcatatgttggccagcctggaccacataccaagatcccatctctttaaaaacacagattacgtggcacctggcacctggtcccagagacttcatttgggttggtcatttgaaacactagcctcccatcaatttagtgtaatcaatccaaatcatgtgtccttcattaagagactaagaacgcctccacgtctatccagtctattttgtaatccccaacggttgtcaatattaataaaatttcttttctttttccta

SEQ ID NO: 266882 - DNA, 987 bp, Homo sapiens
gggacttaaagctcataagggagagtggaatagctaatattgttagataccgaactagagctacagatgctgctgctgcattgtggagggaacagatcatactgggtggaaaaatctctgcttggaagggaaacactgtcaaagtctgtacattgtttatgtggtatgtggaatttttttttttaatggagctttcttgatgaaggtgttagagttggagaaagtggttgtctgcattatgatacattgcagtcttggtgtttttgttttaatatttcagacccgtaattagcatgttgctaacgcacttgttttctgaccacttgatggtgaaccagtgtaggatgtagtgcagtgggatgagtacatgagcagcaagaaatacatcctgtaatctgtatgcattgggaggaatatgctcctgcactcctcccccaggtcaagccagctgctgcagaaactgacatcctccagcaaatcctgaatgaatgaatgaaaacaacgtgatcgccctaataatgaccacaactgaacacacatctttggctgtattttatagaaaaggccaccattttctaacagattaatgccatatgcaactcctttgcacattttctagaactgtatgaaatgagaagtaacagaacgaacagaaaacagttacataaattttttagtgatttcgcttcaacagtgcacaaattgagttttgggattttcttgtagggactaagaggcataaaataagcattgcagattgtgtacagagggtctggtgggtgtgagtaagagaagtttcggcaattgctgcaacaacataatggccatctagtacctcctccccttttgtatataaacactaacatcttacaacggataatagtacaacttgtttttctgcatccttcaaaaggcttaatggcctaggaattacatgctccatcatcaagcagttttaataaaatttgtgatctggcttaaactatt

SEQ ID NO: 266883 - DNA, 441 bp, Homo sapiens
caaaaacaaaaaaaaacctttgttctgtaagacagtatagaaagttgggagaaaggtctactccaggatcaagacctcctgaaagggtctcgaggaccccaatggttcctggaccacactttgaaaactatggatctgaaaataatttaggattgcattttcctgtaatgccgcgtcttagcaatgtgaccttgggaactggaccaacaggacccaagggagagtatcaaaggcaaaacaaaggaaaatgaggacaacccaatactcagaaaaaaaaacgagtaattcatggattcacaacgggcaacaaactagatgactattaggaagagaagagcaaaccttatgatctcaaaatgatttcttgttcatttgcatcctcgcatcaatctagactttaagaaatatgtgatttttaaataaatgggtatatctgcataa

SEQ ID NO: 266884 - DNA, 477 bp, Homo sapiens
tgagaccatcgatcttaacatatagtaattgtcatgcataaaattttattgtatcaggcttgactgatgggactatcaaataatatattaggcagcattctttgtaataacaaaatattgaaaataatctgaatatccagattttctaaataagcaattgggggtgtagataaaatgtcatatttgtatgatggaatattatacaggcagttataagaaataaacttatctgtatagaacaacatagctctttttaaaatgttgagtgaaaaatgaaagatataagacatgcactattttttttaatatatacacttataccagaaacagttatttttttcattcatttttaggagtgggtacgtttgtattcaagtctaaaaagatgctgactaaatccatcaatagaagggaataagataagtgtagtggttaaaagagacattgttttatgaaaaggctagaatgaccaaaaaa

SEQ ID NO: 266885 - DNA, 332 bp, Homo sapiens
atcaaaagtatttatagaatgccactaggtgccaggcactgcatttggccttatcagctactatgattaattcttggttctcctctaaattattgcctcaatctacaaatacagattagagcacatcctatttgtatgctccacaactaacataatgcctggttcttagtggaaacttaatgtcgctgaactgtgttataataaaacatccagaaggcaggccgaatacgaaagcagtagcttcgcattaagaaaactacccctagccaattttcttagtcaaccaggccactacagtattaatgaaatcgaaatctgtcaccaataccaaa

SEQ ID NO: 266886 - DNA, 278 bp, Homo sapiens
aaaagaaaagggaggactacagatgggtatatactactccagcaatcccagagtctctgcttgggggatcagggcccacatcccatcttttgtgacatctacccacttgctgggacatactatggtgtgtggggttggagtgttgctccctgtctgccaagtggcagtcccatctgcacagccaaacactgctatacaaccctagagccttcttccccctgttcccactcccacccccagatcacatggaagagagcaatcgaggccagagctacaga

SEQ ID NO: 266887 - DNA, 428 bp, Homo sapiens
caggcttgagagcctctggcagtcctctggggtctgtctctttttctctcttctcctaacaaacctcgcctatcccatgccccattccattgtctctgatcttatcatatggctctgagacattctctcaggagagatagtttggccgagcattgtttggccatactcaaatctcacataaacctctgacaagtcagagtcaagtctacagtgtattaacttaataaactaatccatgctcatagatggctgggtgtgggggtgagataagaacccatcccagagttcttgtcccacaaagagcaaggtggcagatccttaccgtgaggatgacgtcacccacaagggcattctctaagacccttgtgctatatggatcttgggggaattggggccggtgttcattgacatcagtgatgttgaccatg

SEQ ID NO: 266888 - DNA, 454 bp, Homo sapiens
ctcttaaatagggattgtttctaaattaatctcaaaacagtcattatttactatttatggaattttttttaaaaaaaggagcaaaagtctcatttcagtgggaacttaacttggggctacagtgttttatttaacttttaccccaaagttgcaaagtgttttgaaatttttccctgtaaaataattattttaattcaatttaaataaaacccaccaaggagacttcaagctttaagaagtctagcttcctgtgaaatgtgagaggaagtcagcactcatttcagaaatctgattataacaatagctccatccctaaatgaggtgaatcttggaatctcttccattttattttattttatttttttgagatggagtttctctcttgttgcccaggccgagatcatgccactgcattccagcctgggtgacagagcaagacactctctcgaggata

SEQ ID NO: 266889 - DNA, 452 bp, Homo sapiens
gcctactactactaaattcgcggccgcgtcgacagaagaatcaacaccaattcttctcaaactcttacaaaatgtttaagagaaggaaacatttcctaattcactctgtgaggccagtagtaccccgataacaaaaccagacaaagacactaaaagaaaactaccaaccaatatattttatgaatattgatgcaaaaatcctcagcataacattcagcaacacattaaaaggattacacatcaagggccaggtgcaatggctcacgcctataatcccagcactttgggaggccaaggcgggctgatcacctgaggtcaggagtttgagactagcctcaccaacatggcgaaacccgcgtctctactaaaactacaaaaattagctgggcctggcagcgcgtgcctgaaatcccagctactcatgaggctgaggcaggagaattgctccaacc

SEQ ID NO: 266890 - DNA, 477 bp, Homo sapiens
ctaggggagaatctctgcgtgggaatgtcagaggtgacatgccttctgatgcttctcatctgcccaggtcaaacttactgacttgcttctaacgaatagaatgtggcggaagtgatgacatgtgtcttctgaggctagatagagaagacatctccctgctgccttgctctgtcttggctctcttactgtggcatgccagcggcatgcagtgaagacgcttcagcaggctgcagagaggtctgcagggagaggaaccaaggcctcccaccaacagccagcaccagtgtgccagctgtgtgagtccaccatcttggaagcattttccagccccagtcaagcctccagatggctgcagccccagccagcatatgactgtaacttcatgaaagaccataagccagagccacccagccaaaccactcccaaatttctgttctggtgtgagataataaaacactattgtttgagctgctaaat

SEQ ID NO: 266891 - DNA, 442 bp, Homo sapiens
cctccctccccactcccacgctttacttgctatgctaccccaaaagaaactcgtattagtaagcctcaggagctcaagggaaaggcttatttggtgactttaatttgtcactccttttgcatttatcacaaaatgatctcatcacaaaaaggactgaatttcacgcttttgctggcttgcaaacaagccagtttcttccctattgctgtccaacacagagaaagctctttatgtttctatgatcagataaaatctgtattgacgtttcttttcctgtgggtgtatttcccttctaggtatggagatttaaactatctgggcaatgctgtgtgtttgcagtttctctgtttcagtaaatgaaaagctccttggggaaggagaacatatcttttccagtaatgaagaaatatttattttcattttaaaatgatacatgctcatt

SEQ ID NO: 266892 - DNA, 517 bp, Homo sapiens
cacctagtttttgtaggaaaaaaggttacattacttgccgaagtgatgcagttaaacagtggcaaagacagacagaattagaaccaaaggattctggtctagggttaattccttatcttcatttctttacatagatgacttagcagtttctttttaacattagtgcaggatttggagtcagcctgcctaggtttcaatcttggtttcactatttgctgattttagataaattagcatctctgaacctcagtttcctcatcttcaaaaccaggataattagagcaactacttgcctgagttgtaaggataaagaaactatagaggctggcaaatagttaacacttagcgagtatactattattttctcaacactgcagtttttgcagaacttcaattttttactataatagtataacctaataatagtataacctttacagacactagaaatctgtaataatataaccaaaggtagaatataaaagactggaattctgatgtcaaatggaaataaatt

SEQ ID NO: 266893 - DNA, 162 bp, Homo sapiens
gtgggagggaggacaggtaggaggatgggtgggaggagagatcggagaagagatggaaaaatagatggcaggacaggagtgagggcaggtgggaggatggatgggaggacaggcgggacgatgggttagaggatgggtaagagaatgagtgagaggagagaa

SEQ ID NO: 266894 - DNA, 400 bp, Homo sapiens
ttagcttctctgttgtcagcccctgcagtttagctctgacagcaaacctgcacattttactcagcaaaaccaaggcccgatccctgcctcgccctcttgttggcagtccatgcagtggacctgctctcaaagatctcacccttcctcaggctgcagggcctcacccaaccacgattccttttaacccacagaagactttatgccgaggagtcctggaatatctccttttctccatcttgggacatctgtggggcggtttttccccctctagatgggggcatcaaaaactgccttgctttcctgaccttaacccatctcagtgcccatggggttgcgctaaacatctccagagaaatgtctttaaataaacagatttcatacttgagaggagaccagaaat

SEQ ID NO: 266895 - DNA, 435 bp, Homo sapiens
gaaacccaagacattacctgttgccctaagcctagttactagagcaaacatctattttgtagggagttgaaggcctgtggatcatgaccaactcagcattccactggaggctatatgatcaaacagcaaactgtttatcatgaatgcaggatgtgggcaaacttgcgactgcacctgccaccagaaggtttgctgggggcaatcactccctgacgccgtgctccttgaggttatctgttggaacatctggagactactgttcagagaatgcggtcgtgcagcctgcaccaagtcaagcagctgactgacaaccacctctttctccctatctcctttactcaataaatacgaatggagctagaagtacagggcccttgttcactagaagcaaggagccccctgatcccttctttcaaatatactcttttgtcttta

SEQ ID NO: 266896 - DNA, 139 bp, Homo sapiens
tcagttaaatgcacatgttgaaaatccttatttggatggaaacacaacagacatcagctagtccagagacagaaatgagatgggagcacattagcggtgaattgtgagactctgcatgatcccttcaggagactgcagc

SEQ ID NO: 266897 - DNA, 439 bp, Homo sapiens
agtgcactccagtaggaaaaattagttaatgcttgttgtccccaatattaaaaatccactttggccttcacatgtggtttttatggaaggttcctgccctcctaaatcctgactattaatctcaagctgtgggtatttgtcgatggtgaacacaggctttttttgtgagatagtcctgtatgtggtgagaatggagctttagtgatattaattctaaaccagtgaggcttaggaaaatcacaggcagtttaggatatttgtagcacttatgtaagagttggagctttcaatcagttcaaaatgaggaaaggatgattaacagttagtctactgtaacttttactcagccctgaacctcgattggaccaagaagttttttacatttccactttttgctgtacttttcttttgagaataactattaaagttatcagtttct

SEQ ID NO: 266898 - DNA, 562 bp, Homo sapiens
ctcaaactctctcctgctgtgtctgggagactgtgctgccagcagccagcttctgcatgactgacgatgccctgcccttatgccagggtgcccttgggggctccttgtcttcaccattgcctcacatttgccaaggagaagtcacacaggaagagaaacactggctcaaggtgttgccaatatttctccctcactttaatatgattttaattatgtgttttgaataaagaagacgggaaatgacccaggtagagctagctctgtgggtgggcagtgtgagtaaaaatagccagagtttctacttattgggcacctactatgttcactgcacttggctgcattaacttttcaggactggctgacagcagagcctggcctccattcattgcttagtgttgtgccaacaaattgtttacttaagagaggaatataaatattgaaacgttggggtgccatttagtatactgctcaggcattttggaagaattaatttgtcttccacatcaccctcaaccaaccccacaccaaagtgttgactcagccgttctgaagcccggattcc

SEQ ID NO: 266899 - DNA, 374 bp, Homo sapiens
tgaacccgggaggcggaggttgcagtgagctgagattgagccattgtattccagcctgggcaacaaagtgagattccatctcaaaaaaaaaaaaaaaaaaaaaaaaaagaaagaaaaaaaagaaaaagaaaaggacttcttggagggcaaagtttgagggaagagttagctagctagagaccttccaaactgtgctcaggcatttggattttaccctgtgggtgatagggaactattgaaagttttcatttttttctttttggagacagagtcttgctctgttgcttcaggcaggagtgcagtgagccatagtggctcattgcagcctggaccccctgtgctcaagcaatcctcccacctcagcctccagagta

SEQ ID NO: 266900 - DNA, 463 bp, Homo sapiens
atttaaatgagatcataaaatacatactcttctgctattagctttttaaaaatttaaccatatagtcagcttttcttataagtacatactatttttaatgactgtataatattgatcataatttaacaatcctctaaatgaacatttcagttatttccagctctttaagaaaagtatttaatagggccgggcgcagtggttcacgcctgtaatcccagcactttgggaggccaaggcgggtggatcacttgaggtcagttgaagaccagcgtgaccaacatggtaaaaccctgtctctactaaaaatacaaaattagccgggcatggtggcacatgcctgtaatcccagctacttgggaggctgaggcaggagaattgcttgaacctggtaggcagaggttgcagtgagccgagattgtgccattgcactccagcctagacaacaagagcgaaactccatctc

SEQ ID NO: 266901 - DNA, 372 bp, Homo sapiens
gaggtagctatccctgtggtggtatgagatagtccccaaggcatactgttgattgtatgtatgtgctgggagaagcaagatgtagtaacgggtgtatagaatgcttctgtgtgttgggggcaactcagggagtcatatatacctgcatgatgtatccctcgccctagtctacctctggaaggatatgcaagtaactgataatgtttttgcttttagaaaagggactaggggttaggcgggggaaggagactcttcgttgtatactcctttggacttttagaattttttttaactatatgcatgcatgacctattttttttaaaagacatcttttatgtaataaataaaagagctgcagtgcgacagattatt

SEQ ID NO: 266902 - DNA, 402 bp, Homo sapiens
aaatattgttatgtaaatgaatctaatgtgtctctaaattcattaagtgggttggagggttactagccctggagggccccagcgaaattggcagagacattttcactgtctaggttgtggttgttgaccttttcttctgtcttgcttaccctttcctagggaggaggcaggaactcgaggggcttatcggagtggcagaaggaaagcccccactgaaaatgcctgttatgcgccttctgggaaccgtcctcctctttcacttcctcccagccccagctggaattcccaaatgtagcctaaaccagtaccatacctgctagacaaattgtataaattagacatccctaagagggaggagaattttggatggggagcaaataaaggaaaaggaagctgccaaaa

SEQ ID NO: 266903 - DNA, 573 bp, Homo sapiens
gctgtatccatgaggaaagatggcaagttttactgtcagttgggtgtggatatcactgtcacaatctcacctgtgcgctgaaccccgttaggacatttaatactacccaagatcattgtagactaggaatgagagccacaatttgccccgagacctttatgctgctccctaagcccaggtagaaaagttaatatttctcggattaactgggccagacagaagagtcctcacttgtctatgagctgggtttagaaatgagtcaccatcccaactttggacaggtgtttacatttgacagtcaggaatcaaactgtggattgcatctgcatgtgagacacaagacctcaccaatggtatgagaggaaacacttcctgtatgttgagtctaagtacgtgattcacagtctcaacagtggactggagccacgcgtgaaagcctcaatccgtcccgcagcctgtctccttagcggagtcacagtctcacgagtgtgctgagtcttggtctgagagtcaccaacccacctgtggaccggattcacatatgagagtcaattttccaactttcaactgctt

SEQ ID NO: 266904 - DNA, 553 bp, Homo sapiens
aaaggattcagcaggatgtaggttgagaagcaattcacattctcaaggattggacaacagtatatccttacggtcttgctccagggcaatgtgaatcctgctccgtgttacaatatagcctttctggaaactctggaatacattacattcgtccactggattgatgacagtatgttcatgggcctgataagtgagaaatatagactattctgaatgacttactaaatcacaaacactgcaggtggtgggagagaaacgttacaaagattcagagatatgccatataggtaagctgtcaggggttcaatggtctggagcatgtcagtgtatcccctccaaagctccaagctattgcagctcatacctcctaccacgaagaaactcagagcttggtgggcctcctcaggttaggagaatcaccatggttgacattctgatgaatgtgattctaggctttgtaacgtgtgtgtgtttgggagacagggagtagggaggcagtgggtataccatcttaataaataaaaaatgcttatcaactttttacacttaaaaa

SEQ ID NO: 266905 - DNA, 601 bp, Homo sapiens
acacacgcaccctgttagataaaatttatagaaggtcattggtttggattgagctcctgcactaggttcaacagaccaaaccaaaatggagacactcatgctaaagttccatgcttccaagccaaaactaagttgatatctgatcttctgagatatcaggagagagataatagccaaatccccaaacaacccagttttagcccacctgataaaggaagtcccctctactttaacctttaacttagaaatttaatcaagttaatcaatttaatcaactagctttttgttttccgtttctgattttctcagccctttgtctctgaaaacaacctctgctcagctcatcggaacactcacgctattttccataattagatgttgtttgattgtagattcacgaataaatgccaattaagatcttctcactaaatgtgttgcaattttgtcttttgacaatccttaagtgtcatgatgcctacgatttgttttaatctctttaagtttaaaaaaatacagcaagtatggcaaaaataatcattggtgatttgggtgacaggaattcctgtattcttctctcacttttatatgtgcaaacgaattt

SEQ ID NO: 266906 - DNA, 448 bp, Homo sapiens
cggctcattcccgcggcgaggcatatcccttggcatggtgccactgcagcccagctcccagcccccccgccatctgtcatcagcgctctgcctactgtaagtgtgccgacacagtacacggaggctaacaagtagcaaatggaggggaagaaaaaacaaagccactgcagtcagtgggagaggtggctagggctttgacataaactgacaaaaagctgggaaatttaaactgaaagtttgccctcaagactttcagctgtgagggttggactggggaggagggaagggtgtacggtgagggaggttggcagggagcagtctgcaaaaaagctggtgagatagagttaagtaggccggctttttccagactctatgaataatatgagacattacttaaaatccattctgactgttcatagattgcccaagaaggctttcccttacaaga

SEQ ID NO: 266907 - DNA, 414 bp, Homo sapiens
catcaaggatttgaatggaactgagtctggaatgaattatgccacattgctaaatttaaaccaaacagttgatctttgggagctgtttagctatcagttaataagaccattttaaaatggaatacctatcaatacgtggcccccagacaaatacctatgaacttttagtgcagcatagcagtctttagagcacacatgtcttgagaactgactgaggaaatgaaattctgaaaaaaatgtcactaaagtccagagaacatatactgtgaaaaatacacttcagtaaatcagaaaatagtggaaggacagcttcatggctttcacggaattgtgaacatgagcagttgtgttttttcacaatggttaaagtgttggattaaagctatacgtaattgagaacctgtattacagcta

SEQ ID NO: 266908 - DNA, 306 bp, Homo sapiens
ggaagcaaaggcacagaagagctgaagcgatttgcccacagtcacaagggcactggactttaagggccaagagtgaagaccattttgtcctgttctctggcacacagtaggcactcgacaactatttcaaaactaaaggaataagcaagtggcctcatggctactgaggacagagtctggaactgaatgcagggcactctgaagctggagctcacttctacattattgcctttctcatgctactagcaggcactgaatgtgtcagtgagtgaatgaatgaaaccaagatctcaggatcccagtcaa

SEQ ID NO: 266909 - DNA, 298 bp, Homo sapiens
aaaaaggaaggaaattctgacacatgctacaacatgaatgaaccttgaagacatcatgctgagtgaaataaactagtcacaaaagaacaaatactgcatgagatcccacttgtatgaaatacctggtgtagccggagtcatagagacagaaagaatggtggttgccaagagctggggagttggtgtttagtgggtatggagttcctgttgggtaagatgaagagttctagagatggatggtggcagttgctgtccgtattgcaaacgtgcttaacacgattgaattgcacacttaaag

SEQ ID NO: 266910 - DNA, 496 bp, Homo sapiens
ctccattgcactgactctttcccacaaaatgggctagagatagcagctctccttatgtatttaagaaagaatggtcaaaaaatacaattcacattttattctggtatataccattttgacagtgtttcacaatgtaggtaatatgaatgggagtatttaaacacaatcctgtttaatattcttagccagtacttattaaatgcctaccaagcctggcattgttctagagacctcaaaatacacctttaaaaacatattttattgacagttgtataaatgaagaaaacaagtctcagaaaattaaagtgacttgcacagatacacaagctagaaagtaataaaactgaattttgaacccaggtttgtcagactctaaagtccatgattttctgctccatgtggccaacccagttagaaaggttataaaaaatcttaacagtttttcagcccttctcacacttagctttaggattaaaagtattggtcatgatttgca

SEQ ID NO: 266911 - DNA, 594 bp, Homo sapiens
atctctgtttgtttttaaagactgtttcaaagattaaatctatacaaccacttttatgaccaaaaaagttgttgtgtcccaagtgtcctaattagaaaggcagctggctctcctgcagctcccaggcttgtgtagtcaagtgcagtgaactgggcagtaatcagctcaggaccattggctctttcctcctctttcagctacagacacatgccctggcttttgcattgaccttgctttgttagttctagactaatttatccttttgtcagacactttcccttttttaggatactcacaacagagtccactttcagctattggaatacattttaccataaagcccccaaggctttctacccataacaccaacacaaaaaaccaattaagttgcagaggggggaaataatcacaaacttttggcaacctgcttaatgctagacgctctgttttcactggttattctgagtgtcatatgcagatgcagatccaagggagacagggctaaatggtggtgtcaagaattcctcccacaccccaaaaattctttccaatatttgattattaaaatatctatcatttctccacaaagtgtct

SEQ ID NO: 266912 - DNA, 895 bp, Homo sapiens
tgcaggagggagcggcgggggaggagggggtggccaggcgcgcggggaggtgactccgtcagtcacagctgctgtttcggcgcggggccgggccgctgccgcgacgtgtggaggcaggagagcgatgattgccgcaggagaagtgcgggcgcccttcacctggggcccctcccgaaccgcccccgggcccatgcccctccagggcccaggagcgagccagcgggagggcgagggcgagcgctcctggcgaggacagattaaggcgaacccccagtcagcggacatttgagcggctcctcgccgcgtctctgcccccactccaaaccggactcgacgcctgtcccgggccgtgacgcacgcaccggaggaaaaagtgcttctcggctcgctccctctttggggaagagagctcactccccatgcgggcgcgggacactccatctctgttcctgccggtcgggtccgcaaacaccggggatcccagctgcggcgcccaaagggttaacgcaggcgttcggccagtgcaaaccggcctcgcaggatccgcgcttaaaatccgggtgttttcattttgggtttgtttcttctactatgccaagctggtggctctcttttaattctcttgtaacatctcaaccctgcacccatctttcctgaggggaaaaggaaacgggataacttgcggtatttcgatgctcaaaggtaaccggcggctctgctccaaccttcaagagattttgcaagttgaaaaaaaaaaaaaccatccttcgtaacattctaccttaaaaaaaaaaaagcaagtttcccttcttgtacacgccttttacacagtaaagatgtgtatcttacctaagataccgcgcttcatcttcatctaatctttatttgaactcac

SEQ ID NO: 266913 - DNA, 843 bp, Homo sapiens
tatagcaggctgtactggtcgggattctaggatggccgggccgctgccgcgacgtgtggaggcaggagagcgatgattgccgcaggagaagtgcgggcgcccttcacctggggcccctcccgaaccgcccccgggcccatgcccctccagggcccaggagcgagccagcgggagggcgagggcgagcgctcctggcgaggacagattaaggcgaacccccagtcagcggacatttgagcggctcctcgccgcgtctctgcccccactccaaaccggactcgacgcctgtcccgggccgtgacgcacgcaccggaggaaaaagtgcttctcggctcgctccctctttggggaagagagctcactccccatgcgggcgcgggacactccatctctgttcctgccggtcgggtccgcaaacaccggggatcccagctgcggcgcccaaagggttaacgcaggcgttcggccagtgcaaaccggcctcgcaggatccgcgcttaaaatccgggtgttttcattttgggtttgtttcttctactatgccaagctggtggctctcttttaattctcttgtaacatctcaaccctgcacccatctttcctgaggggaaaaggaaacgggataacttgcggtatttcgatgctcaaaggtaaccggcggctctgctccaaccttcaagagattttgcaagttgaaaaaaaaaaaaaccatccttcgtaacattctaccttaaaaaaaaaaaagcaagtttcccttcttgtacacgccttttacacagtaaagatgtgtatcttacctaagataccgcgcttcatcttcatctaatctttatttgaactcac

SEQ ID NO: 266914 - DNA, 823 bp, Homo sapiens
tatagcaggctgtactggtcgggattctaggatggccgggccgctgccgcgacgtgtggaggcaggagagcgatgattgccgcaggagaagtgcgggcgcccttcacctggggcccctcccgaaccgcccccgggcccatgcccctccagggcccaggagcgagccagcgggagggcgagacagattaaggcgaacccccagtcagcggacatttgagcggctcctcgccgcgtctctgcccccactccaaaccggactcgacgcctgtcccgggccgtgacgcacgcaccggaggaaaaagtgcttctcggctcgctccctctttggggaagagagctcactccccatgcgggcgcgggacactccatctctgttcctgccggtcgggtccgcaaacaccggggatcccagctgcggcgcccaaagggttaacgcaggcgttcggccagtgcaaaccggcctcgcaggatccgcgcttaaaatccgggtgttttcattttgggtttgtttcttctactatgccaagctggtggctctcttttaattctcttgtaacatctcaaccctgcacccatctttcctgaggggaaaaggaaacgggataacttgcggtatttcgatgctcaaaggtaaccggcggctctgctccaaccttcaagagattttgcaagttgaaaaaaaaaaaaaccatccttcgtaacattctaccttaaaaaaaaaaaagcaagtttcccttcttgtacacgccttttacacagtaaagatgtgtatcttacctaagataccgcgcttcatcttcatctaatctttatttgaactcac

SEQ ID NO: 266915 - DNA, 811 bp, Homo sapiens
ccaggcgtggtggcaggcacctgtagtcccagctactcgggaggttgaggcaggagaatggcgtgaacctgggaggtggagcttgcagtgagctgatatcgtgccactgcactccagcttgggtgacagagcaagactccttttcaaaaaaaaaaaaaaaaaaaaaaaaaaaaaagataaaaaacctgtcttcctagaaagtttcttctttgtggctaactagggtgccctgattttgatgcattcttgggtgaataaggggtaaatggagtaagtgccccctaagaggtcaaccaattgaaaatatgtttgagaaaaattacgagagcatttaaaaagagaaaattaacacctatgtcaccaatactttttgtgtggtttgcttttattctctttatacattaatctaacacagttgtacgcagttgagtttataatataatagagttttgtgtcctgctttttaatttacttttcatgagcatcgttccatgctactagaagttctttgttatcattttaatggctctttgtcagtatctggtaccatactatgccataaatctcactggttgcagttgaataaagaagtttatgaaggctcccccctactctggaagaggcttcctcacagcacactcatgtccttaggtatcactgggggcaggtagcatcgatctccttgtcccatttcttcccactcctcttaaaaacacagagtatagtttttctgtatctgtaccatcagatgccactgagatctggccatgatgttccgttacgctggaatggaattggggtaccgagctcg

SEQ ID NO: 266916 - DNA, 467 bp, Homo sapiens
agtcggtaccaattcatccagcgtacaactgtggtttgcttttattctctttatacattaatctaacacagttgtacgcagttgagtttataatataatagagttttgtgtcctgctttttaatttacttttcatgagcatcgttccatgctactagaagttctttgttatcattttaatggctctttgtcagtatctggtaccatactatgccataaatctcactggttgcagttgaataaagaagtttatgaaggctcccccctactctggaagaggcttcctcacagcacactcatgtccttaggtatcactgggggcaggtagcatcgatctccttgtcccatttcttcccactcctcttaaaaacacagagtatagtttttctgtatctgtaccatcagatgccactgagatctggccatgatgttccgttacgctggaatggaattggggtaccgagctcg

SEQ ID NO: 266917 - DNA, 444 bp, Homo sapiens
ccagccaaaattaaattttaaccagttagcagtttcctggcactttgcccataacaattttaaaagttgtggttgagcactgcatgctagtggtatattacaaaactccatgctgccaccatagatgaacccaggagaagttctccttaatcaagtttccattttcccctcctaagtcctcgaaagagcaagacgactccatgctttgctccttcgtagtctagtagtgactctggaactccaggaacacagcttatagactttagccccagctccccacataagggtctggaggctgagtataagaagggccaggatccatgctgggaaactgcttggtccatgatggtgatcctcaaggcaataaacaggactgagacctgcagaggagctggcctgactgcagaggacaaaagcaggggtgtgagcaggtaaagtggaggt

SEQ ID NO: 266918 - DNA, 407 bp, Homo sapiens
atcatcacttcatgcaggaaattagcctcctgtccgtggtgcatgtgccattaggaccatgtgtcactgagtggactggcatgggggtggcggatcaagttaagagtgtggatggaggccgggtgcggtggctcactcctgtaatcccagcactttgggaggctgaggcgggcggatcacttgaggttgggagttcaagaccagcctgaccaacatggagaaacctcatctctactaaaaatacaaaattagccaggtgtggtggtgcgcgcctgtaatcccagctactcgggaagctgaggcaggagaatttcttgaacccgggaggcggaggttgcggtgaaccaagatcgtgccattgcactactccagcctgggcaacaagagcgaaactccgtctcaaaaaa

SEQ ID NO: 266919 - DNA, 417 bp, Homo sapiens
aatgttggtctttctttctatctggaaaacttggtgtctttggaacacagtattttcattatagagaccaacaacaatacaaaactctttaaagtttaaaagcagggagatttattataaaaggaaacagggaagctcaggaagccctgtcacaagctgtgccttccaggaatctcaaagttgtcactcaagcacacactcccacttctcttccaacccacatagtgtctcatccttgttttgcttttctatctgcttcattctcaaccctcgagggaagtagggcaagtattattacaccagtttacaaatgtctaaggtcagataactgctaaatttagaacttagatgttgttaattgaaactttatgctcctattttgaccccatagcagtgttcaaaatgtgatggagaatg

SEQ ID NO: 266920 - DNA, 363 bp, Homo sapiens
tacatgccaccacactcagctaatttttgtatttctttgagagatagggtatcgtcacgttgcccaggctggtctcaaactcctgagctcaactgatctacctgcctcagcctcccaaagtgctgggattataggtgtgagccaccgtgcccggcctaagttcattagctttctacgctcaagtcttttggagaagtttgagatgtgacagcagcaggcatcagaggctagcagctctcccccaccatgaagaatttttcccattcagattccagcttccccctctcacaccaccccagagggcatggagaagctggctttgctcaggaaccacaataaagtgtagtttgttatgtgtgaatg

SEQ ID NO: 266921 - DNA, 176 bp, Homo sapiens
ccaaacacgacatttcctactcttgtttttgaagagttctaacacttcatcagttttcaagtgtcagtagagagtgggcataaaaccacaatttcaggagctgcattctctgggtccagatttcatctttgctacttattagttgtataacttttggcaacttaacattatatgcc

SEQ ID NO: 266922 - DNA, 295 bp, Homo sapiens
gtgggtccatatgcacatggtcttattcctagcctcgtgctttctcctcatcgtggttatcgcccttgacactggggcaggaaagatcttgtgtgtggagagaatgatgtaccgaatcacaaaggtgacggagccaggccaacagctctgaatgcatgcactctagagggctgccacaggtccagcccgtgcagcttaaatccaaagggtgtcctcaagcatgcaaggtcatttccaaggctaggcccgccgaacagcaaatgggggatgaaaggtggatcgctggaaagtggaa

SEQ ID NO: 266923 - DNA, 385 bp, Homo sapiens
ttttgtattttttgtactttgtatttttgtaattttttgtattttgtatttttagtagagacggtgtttcaccgtgttagccagagtggtcttgatctcctgaccttgtgagccacccgcctcggccttccaaagggttgggattacagacatgagccaccacacccagccatatttggcacctttctaaggtatacccatacattttaatcctcacaactacccaccctaaatctgcatttaactggtgaaaattgaggtacagagtaccagagcaatcaaacagcatacccaagattatatatctagcagtctagttccagagtttgtgcttttagccacaaccctaaactatgattataaaaattagaggtgaacaaattgc

SEQ ID NO: 266924 - DNA, 385 bp, Homo sapiens
ataaataatactaatagctgctagctgtagtaatagtagtccatttgtcttagaactcttttatgcacttgtatttttccaagtgaatcaagctagaataaagtttgtagcgtctctattatacttgtggtctagagatgtgttagaaaaaaagtaagtaattttcttgtctattataatgtactataaggagttatcaagcattaatccagctatgatgctcttaaaattcccaaatctctatgttcaaacttgtttaatttagaggaatgactttggtgggcagggtggctcatgccagctacttgggaggttgaggtgggaagatcacttgaggccaggatttcgagaccagcctggggaatatagtgatatttcatctcta

SEQ ID NO: 266925 - DNA, 345 bp, Homo sapiens
acagtatttttgtaaagttactgtttggaaacttatcttgttatcttgtatgtgtattgcatagaccaagaatctgattgaaataacatggcaacaatattgccaccaagaacatgcattttaaccacagcacccttctattgcatagtgcacatgtccaggaattgagctggcttttactaaatgaatattttgttcacttgtatccagatcacttgggactgtgggcacattgggaatttcacctcagtctttgtctccttgtcctctgagatggtacaagtatcatctaaaaggatgtataaaacaggtatatgagagctgctttaccccctcccacccaaa

SEQ ID NO: 266926 - DNA, 291 bp, Homo sapiens
ctcaccctcagcaggaccccacatcccacattactggcaaagtgaagaggattcaaggctctcctgacaccagttcttgaactataaatgtgtttggattcccagaggtttttacactctactaacatttatgatttgtgagagatacccgttccctgaggggcatgcatcatgcacaggaaaaccacaggatctgcgaaatgcaagatgacccaacttccaacagtgttaatcaatggagtagtcatgaattactatgtactcaattaaactttgttgcaaaaatcatga

SEQ ID NO: 266927 - DNA, 501 bp, Homo sapiens
  misc_feature (498)..(498): n is a, c, g, or t
gtcttagaaatcccactggcacccgagcaccccactggctgcaattaacctgttcaataataggtcagcaactttgtagaggatgtttgcggatagcattctactgggtgcactagtactattgactttggtctatagaaagcctgatgtgtccccagtggcagaaaaaagctaggagcaaattctgctgcatcacagaatccttaggctagtgtgacatttagaggtcacctggcccttccatttgcctgcaggcaggcctggacataaaccagcctagacaggtaagaatcttctctttctctgccttcaaaaacttttgttcacagaaggacatttcatatatacccttagtgtctactattcctcaaccctgagacagttctcccttagagctcatctatattcctcttgttcccagaggttctctgatttgtacttccatgaagatggcaggaagaaccctcatgtgttgtactcaatggcgttctcgatccngac

SEQ ID NO: 266928 - DNA, 481 bp, Homo sapiens
aatagtttctccatgttgtgtgacacagcagcccctgtcttatcatagttgtcttccctccaccacctgtaccagagatgttggatatgttggaggtgaaggtgtgcaaggtttttaactaactgttctaattaaaggattctgcaggaaagaacatgggtttacaaaagagaagcttttgtattattagtaattttttttctttgatgaatttatgtgcttagtttggagaatcgagagttggctgggaaaagatttctgaggagttaagggactctggtgctgtttgggaaaacatttgctgtaactaggtttagggtattcagtctctgccagtgcttaggagctatatttgccaggtgatttccctgtcgcagggattagccagtgatgtgaaacatttgattaagggactaatagaaatctttcctggggtacatgagtggtggctgttactggggtgccccctcctcaactcttt

SEQ ID NO: 266929 - DNA, 453 bp, Homo sapiens
atcatctaggaggggtttgcttctagttaaatacatttagctcctatccgagacctaccaaaataattgatggggggccaggacactgagggtggcattatttgtcattgtttacactactcaggtgattttcagatgaaattactagatttgttagccaggcatgatggcgcatgcctatagtctcagctacttggggggctgaagcaggaggatcacttgagccccagagatggaggctgcagtgagtcaagatcacgccactgcactccagcctgggtgacaaagtgagaccttgtctcaaaaaaaagaaattactagatttgtggccaggagcggtggtcatgcctgtaatcccaacactttgggaggctgaggcaggcagaggtttacttgaggcagatcacgccaccgcactccagtctgggggacagagcaagactccatctcaaa

SEQ ID NO: 266930 - DNA, 351 bp, Homo sapiens
gttaactccattgtaccctcatggccacccttaattctcctcaaacagctgagttcaaggactgctggaaacaggaggagatggggctctagatctaggcacaagttaagagactcagttcctgaaaactaaagaggaaagttgtgttaggggatcactgttcctgtgccagagatgacaggaaggagccaatcgacacagttaatgatagacaatctacataattgttccctggtcactacatggaattgaaagataggggaaaaaagcaggtaagtgacgattccctcagctattccagcagcattctcagtttcttctgaaactcaatcagggccaagtagatgcgtc

SEQ ID NO: 266931 - DNA, 405 bp, Homo sapiens
caggcaccccctttaggctagctgggtttctctggcttagccccatcactgtttctggccctgtaggaatcttcttcactggcttacattgctgtttgtcaggaactgaccccatttcagcagagtggatcgtattattggagtcaaagctgtatgcaaagccatgacatctctgctctattatgaagttattcattactatttcacattcatctctgtcaaccgctctacagtcactttcagaagccatgcctctagcattttcaagcagcaagctggccaggactattaacctcattctgtagatatttaaataaaagcccaaatttggttaaattgatcttcatgtggtcttttttgggtcaagcagccgctctccaatttcattttttaagtcagagggag

SEQ ID NO: 266932 - DNA, 399 bp, Homo sapiens
tgccttgaaaatagaatgtatttcttatttattttggtacccccacagatctcagaacattacctgacatataacagatgctgaataaaggtttccagggttggattgcatctgattaaaattaagttgaactgaacaacatattaccttgaatttcagaattttgcatttctgatgatatctggggctcagatgccatttacctcatgccagatgacacatggcctcagttttcttcacaggtgtccatgtctagccctgtaccaatttcatcctaaacaactgcccatattcccattaatgtgacataatcattagcatatataagttcctagagaactgctttctatctcatgtctttattgtagtcaatggagtatactcagtcttttaggaata

SEQ ID NO: 266933 - DNA, 433 bp, Homo sapiens
tgttgctccttggctcctgaacactgtattactatgcagaatattgtagacagttgtaacacaatgataaatatttatgtatctagacgtataaatagtataataaaagtacaacataaaggattttaaaatggtgcacctgtggccaggcacagtggctcatggctgtcatcccagcactttgggaggctgaggtgggaggatcacaaggtcaggagttcaagaccagcctgaccaacatggtgaaaccccgtctcttctaaaaatacaaaaattagccgggaatggtggtgcgcatctgtaatctcagctactcaggaggctgcggcaggagaatcgcttgaacctgggaggcggagattgcagtgagccagaatcatgccactgcactccagcttgggtgacagagcaagactccatctcaaaaaaaaaa

SEQ ID NO: 266934 - DNA, 502 bp, Homo sapiens
tcttcctacctcttcttcccttagatttctttccttttttccattcttcgccttaaaaaaaaaatctacttcctaccttcatgtatctttcctaatcatgatattgaattaaagcacacttaaagtacattgctcatttatgtctttaattctcatagaatttatttttgaatacagtatggcattaggattctaactttttaaatagataattaaccagagcactatttcttaatatgccattgttttcttcttcatttgtagtgacaataatgattattattgagagcttgctatgggcaaagcagtgttttgagaggtttgcctgtatttaaattcctggttgtgtttcttgaataaaggtcttcctcattttggccaggcacagtagctcgtgcctgtaatcccagcactttgaaaatgccaaggcagaaggatcacttgaggccaggagcttgagaacagccttggcaaggtagcaagaccccggtctctaaaaaaa

SEQ ID NO: 266935 - DNA, 468 bp, Homo sapiens
agccccagtctcattttagaagatcagttgatcaaaaatattttctggtgtcattatctttagcattaagggattggggcagaggagggaaggggtgacaagtaaaagagaaaatagtttgaaaatataaattacttctacaaagtttagtgaaactgatttatggtgggtaagaaaagcaaaaatgggccgggcacagcggttcatgcctgtaatcccagcactttgggaggccaaggtgggcggatcacgaggtcagcaattcaagaccagcctggccaacatggtgaaaccccatctctactaaaaatacaaaaattagccaggcatgatggcgggcccctgtaatcccagctactccggaggctgaggcaggagaatcgcttgaacctggaaggcggaggttgcagtgagccgagaccgcaccattgcactccagcctgggcgacagagcgagactccgtctca

SEQ ID NO: 266936 - DNA, 399 bp, Homo sapiens
ctctcccttattttcttaatcatattttttctctagcttacgtaagagtacagtatctaatacatacacaaaatatgtgttaattgactatattattggtaaggctcctagtcaaacgtaggttattagtagttaagtttttgaggtcaaaagttatacaatgattctttattgtgtaaggggtcagttctcctaacccccgaattgttcaaaggtcaactgtactatcagttttcatttaaaatatttggtattgttacaataataaaagcatacaacgagacatagtccaaaagacactaacatgcatgatcatcggatttatcataaatgttcaactgcaaaacaagggagagagaggaagatggccttttcaataaatgatgttgaacaaattgc

SEQ ID NO: 266937 - DNA, 1413 bp, Homo sapiens
cctacatattctacttggtatattgaatttttgcagctagcagatttatcgtatctgaggccatagtgaatagaagagctgcaaaagagctttagagactgcaaaaccagctcactaataaatgaggaactttattctaatttactaccaggggctgaagtagcagccaaagaaggagacaaattctaacttcatgatctctagttaggtgtctattttcctgcatttgctaaaggtaaaaatcgctacttatggggcttttgtcatacttcttaaccaaacttccctaacttctgaggataaaaaccataagggcaatcttattcttccaaagcagttccctggtgccactttcagaaacagagtattgaactatgggtctgacccagtgtggcactgagtgtgtgtgtgtttgtgtgtttgtgtgtgtgtgtacactgaataagccaaaacgtgtgccatattctaggtttctgctttacttaactggcaaaatttggtgctgtaagggaggcagccacaaaaccagtgatagcatttgttagtatcatcttagttctcttccctcccctaggtagtttataaagggtgatttctgaaacccttcacaaaagaaaagctcaagggtttacattcaactgtgacagcactatgaattcattaagaagcatgtttcaggttgcactgtaatttccctatgtaatacaaacccatggaatctgacataagctgattgctcatgctggttgttttatttacatttctgaatggaaaggatttcaatactcataaaatatctaactggcttatttttcatctgttctcccagagaagctattataagataggcatagagacagaagtctcaacttgtataactggttaagcaaccagggaaatgttattgctcaaaatgcaattttaaaaaattcaatatggaacttgaggccaaaaaaacagaaggttactctcaatgccatccaaaagataaaagttaaaaaaaaaaaaaaaaaaaaaaggtaactatgctcattattttcaaccaagttctatggaggtggtaccttcacaggagctcagtggaactggggtttacttacatcttttttctgggaacctaatgttagcagacacagttgctagtttgaacaggaatgcagatgaatggatgaaagtgggctccctaccacccagaaatatgaatgtgcctccttaccaatatgctacaaatcagacctctgaattagaagatgccatcatgcaactaacttactatctggagatgtgtattttgttaacctaggcaaagaataacaatttctgcttattccagtaggtgtgacaagctcagagaagtgagcgacaagctagagaagtaataattaccaataaagtaaattccaaagccgaaaa

SEQ ID NO: 266938 - DNA, 410 bp, Homo sapiens
ttacagtcttaggtaatatcttatggaaattcatgcttttgttcaccagaatttgtgtacaagaatgttcatagcagcactataatgtctataaactggaaaaattcaaacatccattagaagtagaatggataattatatggcagtgtactcatatactgaaatattgtacagtaataaaaataacatgctaaacatgatagcatgaacaaatgtcacaaacatagacacaagggaacttataaagtgtttttccatttatctggacttcaagtaacaggcaaagctaaaatagagtgtttacagatgcgtaaaatggagtgtttatgaatgcatgcttgggtggttaaagtgtaaagaagagatagaatataattagcataaaaatatagtgtttatctttggacctg

SEQ ID NO: 266939 - DNA, 245 bp, Homo sapiens
aaaaattcacgtggaatctcatggggccttgaatagtcaaaacattattattgaaaaagaagaaatttggaagcttcagacttcctgcttgttacagtaatcaaaaccttgtggtactgtcataaagacagacatacggaccaattgaatagacagtccagaaataaacccttaagtatatggttaaatgatttttttttcttttttgagacagagtttcgctcttgttgcccaggctagagtgc

SEQ ID NO: 266940 - DNA, 359 bp, Homo sapiens
atagttttcttgccaaatatatttaaacttaacctaattatgacagagcaatcaaacaaatccagaatgttaggcattctacaagacaaatattctggacccttcaactcttaaaaaatgtcatgaaatacaaaaacaggctgggggaatgctgttctagattaaagaaattaaaaagataggcccacctactgtaatgtgtgaccttaattggttagccgggcatggtgacaggtgcctctaatcccagctacttgggaggctgagacaggagaactgcctgacccgggaggtggaggttgcagtgagccgagccgagatcatgccactgtactgcagtcttggcgatagagcgagac

SEQ ID NO: 266941 - DNA, 460 bp, Homo sapiens
aagatattaaaataattttaacaagtagaaattctgaagctgtaaaattcaactaaactgaaaaatgcatcattgtcttccaacagcaaagttaatcaaaagatgaaataattactgagctgtaagatgggctgtatgaaaatgcacagaaagaaaagaaaaatggaaatagaaagaataaagcatgcctacaagatctagaaaaagcccaaatgggaaaaattaagagctattggccttaaagaggatatggagaatggatgggggtagaaactttattcaaataaataataacagagaaattcccaaagctagagaaacgtatgaagacccagataccagaaagtcaagaaacaccaagaagattcaacacaaataagactaactcaagactatatcaaatgttcaatgtaataatcaagctctcaaagataaaataactaattctaaaagcagcaaa

SEQ ID NO: 266942 - DNA, 443 bp, Homo sapiens
tgggaatacaggcgtgcgccactgtgcccgttcaagtgcagttttttgtatataaattatttttcaataaagttaatttaaaaagaaaaagctaattcctgcacagcagaagcccagctcatgccaaagagatagagccagttcctctggcaccattttagaaaagaccacccaggccagagcggtggcccatgcctgcagtcccagcactttggaaggccgaggcaggcagattgcttgaggccaagaatttcagaccagcctggccaacatggctctactaaaaatacaaaaacttagctgggtgtggtggtgcatgcctgtaatcccagctactcaggagactgaggcacgagaatcactggaacctggaaggcaaaagttgcagtgagccaagatcacaccacagcactccagcctgggggacagagtgagactccatc

SEQ ID NO: 266943 - DNA, 519 bp, Homo sapiens
aatcaaaagcaaaaactacatgatcatctcaatagatacacaaaaagcctataatataatccaacatcccttaatgacaaaagccctcaacagattaagcattaaagtagcatacctaaaaatagtaaaagccatctacgacaaacccacagccaacgtaatactgaatgagcaaaaactggaacggttccccttgggaactggaacaagacaagtatgcccactttcaccactcctattcaatatagtactggatgtgctagccagcgcaatgaagaaagggaataaataaaaggcacccaaataaaaagagagaaaatcaaactctctctctttactgatatgattcaatacctagaaaaccctaaagactctgctaagtctcctggaactgataaatgaattcactaaaattttaatatactaaaccaatgtacaaaaatcctaacatttttatacaccaatattgttctaggtgagaatcaaatgaagaacagaattccatttacaatagccaca

SEQ ID NO: 266944 - DNA, 593 bp, Homo sapiens
ttattaggttttatttattgattcaagaaaaatttattgactacttaccaggttatgtttcttaattagggtaatgtagtcatggatgtttgcaacatttttctctatgcctttttgtgtgtctgaaatatctcataaaaaggaagagttttccagttgaaatggtttatccgtgtttcagtgaaagctgggagaagctagtcaacctcctgggtctttctcgttcttattgaaagatgccctcttacaggacggtctgatggtcaggaagcagtcaacgagttaagatgagtgaggccttcaacctgaagagttagtgattcttagtgtaccacagttttaacaaaaattgctcttgtcgatgccaaagagatatcttttcttcccagctaaaaaattttaggtcaggaccctcaaatattcctatttacagagggagagaagaaagaacttagttttactgagtaccaacaatgggcaattagaatcataattatgcttgttcttcattgagggtgcttgtttctcatcaaattcaatattcatagaacatttttatttcaagtcatctcactctgcaagagcttagttga

SEQ ID NO: 266945 - DNA, 412 bp, Homo sapiens
actgtttgttcctcgactacagttataatcctctatttgtgacatcataattagttgccactggagaagacgatcgtgtcacaaaaggattaggacctaagtcttggagtccagccactatgctgtggggaagcaaagaaagctgtggagaggccacgtggggaggaatgccatccttagcatgggctgagctcccaggcagcacccatctccagacatgcgagtgaacaggacttccggcaattccagccccagccactgagtcacttccagtttctcagtgtttccaggggaggcctcagacactatggagcaaagaaaatctgacccagctgtgccctgtccaaattcctgacccatagagaatacaagagagaataaaacgatgttgtttaaaccattaaattttgaa

SEQ ID NO: 266946 - DNA, 519 bp, Homo sapiens
gtcaacatggaaaggtttcttaaccaattgaatgacatgatacagatgtttcgctcactttctgtatatgcctctttcctttcttctattttccttttttctgagagctgctttgcagaagactttgtcatgaaataccacatgccataagaaaaattagcctacatcttttcaagattgtcttagtccattcagactgctataacaaaataactcagactgagtaatttataaacaatagaaatttattgctcaccattttggagaccagaagtgcaagatcaaggcagcagcagattcggtgtctgatgagggcttgctctcggcttcgtagataatgctgcttcactgcatcttcacactgcagaagggcaaacgggctccctcgggcctttttccaagtataatggatacatttatttatttactcatccatttatttattcattcatttatttactcatccatttacttattcattcatttgcaataatcctttgaacaactactgtttgcaaa

SEQ ID NO: 266947 - DNA, 511 bp, Homo sapiens
agtagaaaaacttggttcttccttagatgaatttatgtgtgactagaaatgctatgaaatgttctcaggtaggaaagtacttgcggcacagaagaaaatccctgttctctaggattttgggggagaaactttatcttaaattattctaggtatgaaatcatttacaaatgtaatttttattttaacatggtgggagtgagaaatacagaccactaaagatgctcacatccttatccctggaacaaaaagatacttttcagatgtgactaagttaaaggccttgagatagggaggttttatgctggatcattggctttgaagaaagaggaagggtccatgagcagtggaagcttctggaagctggaaaagtcaaggaaactgattcttccctggatcctgaagaaagaattacagccctgctaacactttgatttttgcctagcaaggactcacatcagatttctgacctctagaattataagataataaatttggattattctgagtcaca

SEQ ID NO: 266948 - DNA, 457 bp, Homo sapiens
gtcagtggagatgagaacattaatttatttgagtgtatgtatgtcaacgctgcttgaagaaaacgtgccagtgtggtctcaacatgtgaaacattttaggtcattctattctcacatttgccccctaaagcgctgttcaagttatgtattcaacatactgatgagaaacacattctgctatttaataatgaagaagaagagtgaaacagagaagcactgagctgaagaggaggacacaggtgtcccaatccaatttgaccattagctagctcttagatctctgaaaaatacatgcaacctctcagtctttcaatatctttagatgctaaaggcagactatgtcttcagttgtacctgaggtcatttctatttgcaaagtgttatgattacaacctgattttaaatgtaagtccagacctccttacaataacagcaataaacatatggtgcttacaat

SEQ ID NO: 266949 - DNA, 686 bp, Homo sapiens
tataaaataacaaaattgatccaaaaagaaatgggaaaactgaataggagctgcttccagagtatagtagcatagatatcttgaccaacactgaaactgcttgagaaaaacaaattctttaattatatttattagttcacaagaaaataaagaatacttaggtcaaaaactgagtaaaggcaagaacctaaagaaataaggtgaacactgaagccagctttttccttgaaggcatttaataaactgaataagtgtgaatttgataaaacaacctgaacaggacaatagaagaaaacaaaagttatagacaaatatctttcatactaagttgccacttttgtatgaaagacatacaaaacaaaacatatgcaagctgaatctggcaattcaggaatgagtcaatggctcagcatttaaaaagctttccacataactcacccattaacagattaagaaaaatatcatatcatttcaatagatacaaaaaaagcattcaataaaattagatacttatttagaaaggcaatatacgttttgattaggaacatacattctcagcagggcgcagtggctcacgcctgtaatcccagcactttgggaggttgcagcgggcagattgcttgatcccaggagttagagaccagcctgggcaacatttcaagactttgtctttacaaaaaaaaaaa

SEQ ID NO: 266950 - DNA, 141 bp, Homo sapiens
ttagtgcgactgagaagctgaatttaaaattttatggaatcttaattggtctacatttaaattaaaacaaccgcatggaccagcagctaccttattatacagcataagtctacaggctggcaggcctgttaggaaaagaaa

SEQ ID NO: 266951 - DNA, 268 bp, Homo sapiens
ttaactttccatttttattatcttacttgtaatctacacagatttgccagtgacctgaaaattatattaatttatgaaaagagcatgaatggccgtgtgtggtggctcacgcctgtaatcccagcactttgggaggctgagatgggcggatcacctgaggtcaggagttcgagaccaacctgaccaacatggagaaaccccgtctctactgaggctgaggcagcagaatcacttgaacccagggggcggaggttgctggtgagccgag

SEQ ID NO: 266952 - DNA, 296 bp, Homo sapiens
cgtggagacagtgtctccagaggggcgtggcgaaaagcgtccgcggcccgacagggaagaaactctggtgacgcaaatagatgagcctccctcgtacgaggaggcactaaagcaaggcctgcccaccacccgtcccatcgcgcccatggctaccggagtgctgggccagcacacacctgtaacgctggacctgcctccccccgctgacacccagcagaaacctgtgctgccagggccgtccgccgttgttgtaacccgccctagccgcgcgtcctgcgcgtgccgccagcggtccg

SEQ ID NO: 266953 - DNA, 881 bp, Homo sapiens
agcattgatgttcacaggcccaggctctgtaaaaaacatgtgttttatctaaggaaatgagacaattgcttaaaaatattttctttagcttgtagtgtcaagtgatgaattaaacagctctttgagtcatcagagatgccccaaagaaaatccgacagtctccccctcaaaaaatattttcctgtttttaatcagacctcagctctttgtcctctattttttcaggccattgtattgacctgccttgggagtgttaaaagctggtaaacgctcccttgccaatgctagctcaatgggcagtaatttattgagtaagacagattttcattttagaaatgaggctttccacgttatgacattaccaatattggttggttatgtattattatagaaagcagtgatattcatttcatggctggaaggctgcgtgctggtgtttaaccagcagtttgcaaagatttgctacatgatttactacacatgctgctttgtcctcaagtgattcctggtaaaatgtgtgcttctccttgcttctctttgtctggggaatgtgtttcctgtcattactaagacaataccatggccatatggtgcatgtggatggttcctgtagatatcttacaacaaagagtaagttgggagcatggtagaacccagtgccgtggggaggtgggagttcgccacccaggaactgcaaacatcgccccttcacccctagaagtggtgaggaaaactgttttcctctactcacacaattttccccacccagaaggaaaggcttggggtttctcttctgtatctgctaacaagatcttctcattgtgagtggagcacagtgtgaaagtaagttgtgggtagactttccaccaccagtgttagaa

SEQ ID NO: 266954 - DNA, 442 bp, Homo sapiens
gcccaggatttgcaaatgcagaggttatgcgggggcctaagaccagtttacaccagtgctccagagtcctgtctggttagtgcctatcacacccagagtgacttgtcttgtatatcttgttcaccaccacattgcatggagtacagtggaccttcagaaaataactccgcagcatgaacgtcgtggacagtgataatgggacaagaaaacacaaggtctccaccacagctatgccccatcacaattacagcacaagtttggaaataacttggcctgacattcaactcccgatgacaggctccaacttttctgcatcttgtcttaggcatcataaaggaaatgtgagctatcactcttcctgaaacatgagctgttctgcagcaacatcaatagatagctttgtcattttaaaaataaattggaaatctttgtattgctttaa

SEQ ID NO: 266955 - DNA, 482 bp, Homo sapiens
tcacagtgagccgagatcacaccactgcactccagcctgggcaatagagccaggccttgtctcataaatgaaatataaaatataaaataaaataaaataaaacgttgttggcaaagatgtattcaaaatagtatgtagaacttacctggaaggtaattttgcaatatttaccaaaatatactttttcatctagtaaggtctccttctcagaatcagtcttaaagccattcaaatacagatttatgattaaagatttaagtccaaaaatgctcattatagcaatatttataataggaaaaattggggaaaaacaattatacatccaacagtagtaagagtgtgactacattatagtattagtatgtaatggattgtcacagagcaacacacatgtttttgaagaatatttaaggcgtgataaatattaaatgtaaatgtaaattgaaaaaatgatatctgtagattttcattatgcatttctt

SEQ ID NO: 266956 - DNA, 255 bp, Homo sapiens
caccctcgttcttgtgagtgctgctcctcacaaggttggctactggaccagccagtcacaaaatatacatcaccttttatctttgtagtttttacattactgtttaccatttcaatgccacacactaatactgcagagatttatacttttcatttaatcattgatcattactgaaaactaagcaaaatttaaaaatagactctcagtaaatgagtaagcaagtgggtaaatcaagtatttccagagtttaagcta

SEQ ID NO: 266957 - DNA, 397 bp, Homo sapiens
tattattcagtcataaaaaggaatgaagtactgaggcatgttacaacatgaaggaactttgaggacagtttgttaatacgctatatactgtgtaattctatttatatgaaatatccagaataggtaaatcattagagactagagacagcagattagtggatgccaggagtttggggaaggaaggggtgggaagaatgggaagtgactgcttaatggatacagggtttctttttggggtgatgaaaaatttctggaactagattgtagtgatggttgcacaacaccgtaagtgtaataatgtcactgaattatacactttaaagtgatttaaatggtaaattgtattatttatgtattttaccacaataaagaagtcacctatcaccaaccctttaga

SEQ ID NO: 266958 - DNA, 483 bp, Homo sapiens
agaataaatacttgaggagatggatgccctattctctttgatgtgattacttgacattgcatgcctgtttcaaaacatctcatttatcccataaacatatatacctactatgtactcacaaaaattaaaaataaaaaaaaattcaaaaatgtgaaaccaaatcaccatggttttgtggtattttgtttttattcttaagatttagaggctgggtgtaatggctcacacctatattaccccagtttgtgtggccgaggctgaaggattacttgaggccaggggttgaagaccagcctgggcaacatggtaagaccccatctctacaaaaaataaaaaattagccaggcctggtttgaagcactggtaatcccagctactcggaagtataagatgggaggatctctagagcccaggtgttcaaagttacagtgagctatgattgtgccatttcacttcagtatgggctataccctgtctcgaaaa

SEQ ID NO: 266959 - DNA, 294 bp, Homo sapiens
tcagccactcatacacaggcccacctcactttactgcacttcactttactgcatgtttgacaaattgaaggttgtggtaaacctgtacccagcaagtctgttggcattatttttccaaaagtgtgtactcacttcatgtcttggggttagattttggtaatttttgcaggatttcaaactttttcattattatccgttattgttatcaaacttttttttttctttttttttgtattttttttttaattttttttttcagtcactctgttgcccaggctggagtgcagtggtgca

SEQ ID NO: 266960 - DNA, 202 bp, Homo sapiens
cagagtttcaccatgttggccaggctggtctcaaactcccgacctgaggcgatccacgcacctcggcctcccaaagtgctgggattccaggcgtgagccaccgcccctggcccatcttcactatttttaagtggacagcacagtagtattaactatatgcacatctctggaactttttcaccttgcaatactgaaaccctac

SEQ ID NO: 266961 - DNA, 1062 bp, Homo sapiens
cgtcggtattttgcgggcaactagctcttccagctgctgtaaattgctgctgcgggagaaactggagccgctgtagccggcgcgcccttcttcccttactgcgaggagccaccgcctctttcgcgctccttatacacctatcactgggagcggtggcagcaacattccctggaccaaccgccgcctcttcaggcggccgctttgccggtcattcccgaagcccggcaactgagggcggccccctttccttaacagtctcctcgctacagatcgtctgctccctcagcctcgcccgagacccacttccccagtctcgcccgggtggaggtcgacgaggaggagacaagagtcacccttcctccaggcggcgccggccccctcacccgcgggtgtgtcctataaatggcgtcggaaagcgacaccgaggaattctatgatgcccctgaagatgtgcacctagggggcggctaccccgtggggtctccaggaaaagttgggctttcaacattcaaggaaacagagaacactgcatacaaagttggaaatgagtcccctgtacaagaattgaaacaagatgtgtctaaaaagattattgaaagtattattgaggagagtcagaaagtactacagcttgaagatgactctttggattccaaaggaaaagaactctctgatcaagctactgccagtcctattgtggctagaacagatctgagcaatatacccggactgttagccatagatcaagtactaccggaagaatcccaaaaggcagagagtcagaatacatttgaagagactgaattagaattaaaaaaatgctttccttctgatgaaacctgtgagaaaccagtagatgaaaccacgaagttaactcaaacaagttcaactgagcagcttaatgtgcttgaaactgaaacagaagtattgaacaaggaagcagtggaagtcaaaggaggtggtgatgttttagagcctgtgtcctcagactccttatctactaaagattttgccgctgtggaagaagtggcccctgccaaacccccaagacaccttactcca

SEQ ID NO: 266962 - DNA, 295 bp, Homo sapiens
gcggtagctcatgcctataatcccagcactgtgagaggccaaggcgcatggatcacttaaggtcaacagttcgagactagcccaataaacatggtgaaaccccacctctactaaaaatacaaaaattagccaggcatggtggcgggcgcctgtaatcccagctactcgggaggctgaggcaggagaattgcttgaacctgggaggtggaggttgcagtgagccaagatcacagggaagagtcttccctgtccctgggcaacagggaagactccgtctcaaaaaagaaaaaaaaaa

SEQ ID NO: 266963 - DNA, 735 bp, Homo sapiens
cctaatcaacaatgcaaacaaataatactgtgaatacaggtttcccagaattaaaaagtgatgtttacagctatcttggtagtgaaaagtaaaagacttgactggaaggacccagccctcccatatctaacacaaaatttgccaagacttaaaaatgtgctacaacttacagagagcctctttcctgtctccatcactaccctcgtggcaacatcctcttcttttccttccctcccttctgccttcctcttttctgtacccccttccactgagcattcacacacaacatgatataggaattgtttttcttgttaaatgaaaccactatacagattcctattattttgcagaacatctggtttgcaaatgaaaagatctcaggggcacaacagcactagtgaacaattctgaagaagcttttaacaaaacttgaaattgcttatccaaaaaaaaaaatcatcccccgttgctgctgttctgtagcacacaatctcttcactcacaggggaggtgactttaacaaggaagagagctttatcctgtctctcctactttggccttttagttttcattctgttcctatccacttctcccatccctaagaacagggaatttgattaaaacataacatagatggaaagaaatttagccaggaaaccaggagaaataaattccagagtctcattttccagcagttatttttgttttcgatcgagttcaataaacctgaaagag

SEQ ID NO: 266964 - DNA, 341 bp, Homo sapiens
tctagggaaggagctttaacttacctttcagatgggtcaccattccacatcaaagaagaaaagcttttatctagagtgcactgaagttaaaggtcatgcttgatttctgaacatttaccatccatcccaccagaatattttccactgtcccataactccagggcctaggagagtggctaatgcatagtaagaccttacattagttgaatccaaagtcagggctgtggagacagacaaagcattgatcattttaatggggctatgaggtgtgtggtagtgccacaggaggaagcaatcagctggtgaggaggaacccataataaaaattactttgagaagca

SEQ ID NO: 266965 - DNA, 395 bp, Homo sapiens
ccatctcagttgtgtcctgtggctctcaagagagggtgcagcatgttctgatatgaaggctgcagaagtctcacaggatggaggtttggtgacaagtactttggaaaatgctcaactagaggatggttggtccttgaaagtcctttctgctttatgttcactagtttctctgtatgaagatgaaatcagcgattccaaagcacagctagctgccatcaccttgatcattggcacttttgaaaggatgaagtgcttcagtgaagagaatcatgaacctctgaggactcagtgtgcccttgctgcatccaaacttctaaagaaacctgatcagggccgagctgtgagcacctgtgcacatctcttctggtctggcagaaacacggacaaaaatgggg

SEQ ID NO: 266966 - DNA, 976 bp, Homo sapiens
actacgaggtccacaacaggcatgagttgtattgtgcttggtaatgttctgcattataacactgaagacttgtctatcaacgatcatgtggattccatagtgaatctggtatccatcttgttacacgctcagcccgttcatcctgctctagacccttgagctaaaaaatgggggtgttgatcacagccttgtgggccgcttcattcatctgctgcgctctgaggaccctgaccagcagtacttgattttgaacacagcacgaaaacattttggagctggtggaaatcagcggattcgcttcacactgccacctttggtatttgcagcttaccagctggcttttcgatataaagagaattctaaagtggatgacaaatgggaaaagaaatgccagaagattttttcatttgcccaccagactatcagtgctttgatcaaagcagagctggcagaattgcccttaagactttttcttcaaggagcactagctgctggggaaattggttttgaaaatcatgagacagtcgcatatgaattcatgtcccaggcattcattcctggggagtactaacccaaaagcgtctgtctcttgttttctagtccagtttgagattaatttagaagaaaggaatactgtatgtgaaattcatcttgggctttcccctaaattgcaagataaggccatgtgtaagattttccctaaaactagaatatattaatgcatgtttgagaattttaaagcaccatggtcaaaaccagaagctatattttgcatatttggactcagccatccattaagaacccatgttgtcctctggacatatttatcaatataattgggttttaaatagtataaaagaaaacttgtgatctatataatttatgtatcaccttcattgtaaatttagcaggaaatgcatcacaattatgattttttttttgcaccagtgaaacaataaagatgctattaacaatt

SEQ ID NO: 266967 - DNA, 782 bp, Homo sapiens
actacgaggtccacaacaggcatgagttgtattgtgcttggtaatgttctgcattataacactgaagacttgtctatcaacgatcatgtggattccatagtgaatctggtatccatcttgttacacgctcagcccgttcatcctgctctagacccttgagctaaaaaatgggggtgttgatcacagccttgtgggccgcttcattcatctgctgcgctctgaggaccctgaccagcagtacttgattttgaacacagcacgaaaacattttggagctggtggaaatcagcggattcgcttcacactgccacctttggtatttgcagcttaccagctggcttttcgatataaagagaattctaaagtggatgacaaatgggaaaagaaatgccagaagattttttcatttgcccaccagactatcagtgctttgatcaaagcagagctggcagaattgcccttaagactttttcttcaaggagcactagctgctggggaaattggttttgaaaatcatgagacagtcgcatatgaattcatgtcccaggcattttctctgtatgaagatgaaatcagcgattccaaagcacagctagctgccatcaccttgatcattggcacttttgaaaggatgaagtgcttcagtgaagagaatcatgaacctctgaggactcagtgtgcccttgctgcatccaaacttctaaagaaacctgatcagggccgagctgtgagcacctgtgcacatctcttctggtctggcagaaacacggacaaaaatgggg

SEQ ID NO: 266968 - DNA, 767 bp, Homo sapiens
gagtccaggcgtggtggctcttgcctgtaaccctagcactttgggaggctgaggcgggaggatatcttgaccccaggagttcgagaccagcctgggcaacatagtgagaccccgtttctttcaaacaaaagaaggaaaactaagttgaaagtgttatttttgcttcaatttttatttctttacataaaaggtttcttgtcataccttggtaaaaatttgatgagctggtttcattttgaaagcctttattttaaaaataagtatgtatctttgtatgatttataagtgtaccagtaggtagaaatacatgtgttcttggccagatgtggtggctcacgcctgtaatcccagcattttgggaggctaaggcgagtggatcacctgaggtcaggagttcaagaccagactggccaacgtggagaaaccctgtctctactaaaaatacaaaaatcagccgggcatggtggcgggcgcctgtaatcccagctacttgggaggctaaggcagggagaattgcttgaacccaggaggcacaggttgcagtgagccaagattgcgccattgcactccagcctgggtggctgtataaaagcctgtataaaaatttcttttatacagagtgagactgtataaaagaaaaaaaaaggctgtacaaaaatttcttttatacagagactgtataaaagaaaaaaaaaagaaatacatgtgttcttaaaaccatttgtatattttcatttctagaccacactgtagctaattattgttat

SEQ ID NO: 266969 - DNA, 466 bp, Homo sapiens
gctgctgcttttggacaacttgctgggctctgcctccacaagacaaagttgaagtttaaagtaacagtccagactcatttgaatctaaatatgaggctgatgttttacttagatactgatttcctcagactacgttattccagcagaataaaataacctgggtgctgaaatgaatctatgtacagtaaggccatagagagatttccaaatagaccaaaatccaaccctagaaccattttaccctggctacttgcctttcaaaacagcacttctcaatctgtttgaacgtcaaaatcatttgggaagcttttgaagacatcaaaaaatgtcccaatgcccaggcccatccctttggatggggctttaaattgatctgcagtgggaactgggcatcattcttgttttaaaagcagctcaggtgattctcataaactggtagataataaaatgagagtcaataaccaaa

SEQ ID NO: 266970 - DNA, 248 bp, Homo sapiens
cgcagctctaagcctcagtttccccagcagtaaatgggctggttcggggattccatgagttgacacctgttgtcagcaccgcactgggcaccaagggaagagcccagaaagggactctggactcagagggagccagggcccaagcctgcttctcctgctgcctgctggtctgtcttggggtctgccttctgctctgtcatgtcccccgctgagcctcagtttccccaaatataaatgtaattgaggtt

SEQ ID NO: 266971 - DNA, 290 bp, Homo sapiens
tgcggcactgccatccatcacccacaccaccttcagcatcacctccccactaggccctaccccaccaccccaaggcagtggggagccaggccagggctcagcacaagagagcctggcctcttgtcctttgattctattatcagcaaatgaccttgggaaagtcagttgacctctctaagctttcgttttctcatatgcaaagagagaacaacacttaggcagtgcaatcatatatacagaaagtactttggaacaagcaaaaaataaataaataaataaaaacactgatt

SEQ ID NO: 266972 - DNA, 396 bp, Homo sapiens
attcatgactaatatgtgacttctattcattttcttaagggcttgagaattatataaaactaatataaaaggctagattgagagcaaaagctgataattactaaatgctgcctaaaacttggcttcaatccatatcatagaaaagctgcagtgagacctggcaccaggctacctgcgttcatattttggctctacccacagtacataagtgatcctgaacatggtgctaaccccgcagtatgcctcatttttctatgtattaaatggatctcattgttacccatcctcatcaaattattgtgtggattaaatgagatgctaaaagtcaagtatttggaaagagttggcataatgcacattcactaaataaatgttagctattattataataaaaat

SEQ ID NO: 266973 - DNA, 385 bp, Homo sapiens
agccccactttagggaaacaaggaaactttgtgtatctttcagttccagaaaaggggagccttgttcctgagttaaagagcaagtttcatcttagccttcaagaatgatgccttttcatgtcttcatggggtactggaagccctgccaaaactcatgagtggaaaaccagacccaaattaccctgggcagtctgcactactagtctctgccaaatatgaggctccctcaggggtgttagtacacctttgtccttgggccttcatacctgtgttattcttcacgttacgtgcatgttatatagagccttttaggtgtatggaacatttcataatacatttcaaaatgcatacttaaaaatataaacaagaaagtaggaccaatatt

SEQ ID NO: 266974 - DNA, 401 bp, Homo sapiens
agatgatgaacttcactagtaaacacctccagctctttagatagagcctaaagtatttttcaaattagaagagatggatttataattcactgatgcatgtcctacttgactggctaaagagctccttctgtaacaaattacctcttctgtatttccagaaaatactacagacctaaaaatggatcaaaagaactatcccaattcatcccattgataaagatggatgagagtaaagaaaatgcactctttagccaggcatggtggctcacgcctgtaatcccagctactcaggaggctgaggcaggagaatcacttgaaccagggagttggaggttgcagtgagccgagatcacgccactgtactccagcctggcgacagagtgagactccatctcaaaaaa

SEQ ID NO: 266975 - DNA, 416 bp, Homo sapiens
tgtaaatgaaatacatttttccatttctttgttagatcaaacctattgacttctgtgtgtgtgtgtgtgtttatgcatgtgtgtgtgtgcatttatgcatgtatgtatatgctgtatatcctagccattttactaatttttgaatttattctagtggtttattgagtttccctagttttcaagcacataactagtattttcttgtctcacttaatttcctttaccttatcaagacaatgttaaattcaaaataataccaagggctgggcatggtggctcacgcctgtaatctcagcactttgggaggctgaggcaggcagatcacctgaggtcaggagttcgagaccagcctagccaacacagtgaaaccctgtctctacaaacataaaacaagagcgaaactccatctcaaaaaa

SEQ ID NO: 266976 - DNA, 499 bp, Homo sapiens
atttttgaagataatttatctggtgagatctataatatgtataaaacctctacaactcaataatacaaagacaaaccaatttatggaaaatgaagcaaggatcagaatagacatttctggaaagaaggtacacaaatggctagtagcacatgaaaacacactcaagatcattagccatcagggaaatgcaaatcaaatctgcaggaaataccacttcacaatcactagactggctataataaaaaaaaatagacaatatagagtgattcaaagccattatttagctttggcattattcaatcccaaagtggaaacccaaatgtccatccatcgacgacagtaaaagctacaatatagaaaaagttatgctaagtgaaagatgctagacacaaaaagaccctatattgtatgaccccatttatgtgtaatctatatagacacagtgtagactggggatggggaggaggcaccaaggtgaggtagaaatatgacgagtgtt

SEQ ID NO: 266977 - DNA, 442 bp, Homo sapiens
ttacccaaactcactaagctgtgaaggggtgtatttatccacagtcttgtttgtcacatcctcttagtagactgtgggttccattagggcgagccctgggtctgtcttcttcatggctgtatccccagcaccaagaagaatattcagtgactacttattgatgacaaattgaatgagctggcatcagaaaccacattttatgaccaatgctctaacacatttctgtacaccctgacctccccgtgccaatccctgttttggtctgatttgggcctctggctagtctactggattactagggggtcagagccagagcccccttacccttgtatcccagtagctggcctgagagccccactcctgccctgtgtctacatctaaagcagacttctcgtctgcctgcccttccttttttaaattttattttagtaggccggttgca

SEQ ID NO: 266978 - DNA, 230 bp, Homo sapiens
agtgccaatcctacccattcaccagtgttcattcacttgctttgtgaatgttcagggaccatggcaatggtggcagtgacacagaggcagtcctaatccttggatcatagctatgaccttgtgttttgtattcgacaattccagcttcagcctgagagttctgtagtgttctgttagtcattactggaaggccctgcagagcctattctttcagccattccagggatgcc

SEQ ID NO: 266979 - DNA, 336 bp, Homo sapiens
atcaactggtctatgcactgtcttttatatatgaagaaacaggcccagatatatgaatgacttgttcaaattgcactggagaaccaggtctcctcattctcagtctgattcttggctccctgtggacattggtgggcttcactggattctgaaagccattctccctgcccaacactgatcagttagtcggacttccatctatggaccctagagcttttcctgccagtggttgctcctgtaacctactgtggccattgtgggctgacagccatattgtgagggattaggtagctctctaggcattgacaagaacctttgaattttagaaaatatcca

SEQ ID NO: 266980 - DNA, 451 bp, Homo sapiens
gggccaaggtttttacttggaaaagaaaccgcacacttcgaatcacagaagtgtttacatagggcaggctggaggggacgagagagaccttggttgatggtgactcagttcataaacacagcatcaatattgatagactccaaaagatgcatatgcaggacatctctcgggatttgcagggaccgactgttcaggtgaacatcccgtactgttcgttcgagcaggacacggcagatgcttctttcttgttttatggagggtggtggtggattactcttcccatcttgtgcttttgaggatgctccaaaaactttaaaaatttatccatgttccctttcacacagtgggtgtttctttcctcaggcagaaggaaaacttaccaatggtttttgaatatgataggaaagaccacctgcagggagagagtgggacccctgctctctgcctctgg

SEQ ID NO: 266981 - DNA, 478 bp, Homo sapiens
gtgccgccacacccagttaatttgatctagtgattcacttctgagtacaaaccccaaagtattgaaaacagggactcaagcagatattcgtagtaacattattcacaatacccaaaaggtgggagtgacgcaaatgtccactgaggaatgaatgaacaaaatatggtatagacacgcaattaaacattattcaggccatgagtggtggctcatgactcaatcccagcactttgggaggccaaggcaggaggatcgtttgagactaggagtctgagatcagcctgggcaaaatagaaagacctcatctctacttaaaaaaaaaaaattagctgggtaaagtggcatgcacctgtagtcccagttactcaaggaggctgaggcaggaggatcacttgagctcaggagatcaaggctgcagtgagctgtggttgtgccactgcactccagcctgggtgacagagcaagaccctgtctcaaa

SEQ ID NO: 266982 - DNA, 288 bp, Homo sapiens
aaatgttaatccagagtctgacttttggctgagacatgactgtgcttgtctgtgtcgggcaacttgagttctagatccttcattcatttggacctggccatactctttaatctttcctggctgactagttatcttatgtgtttgagaatgatggtggcagtgtattgtcccctaatgctgcatgataaactctgttgttcctagcctatattttggtagatttattatatcaaacattcctggaaataaagccaaaaaaagcaagaatagaaaatgagcaaaggatac

SEQ ID NO: 266983 - DNA, 383 bp, Homo sapiens
aggccttgaccactatgctacatcctaaacctcccttgatggcgatgaggaggggctggtcaccaggagtcacgttcccatgacaaagtctcattggtgccccccagagcaatgggtctgagccctgctgcaaaccacctgtgtcagaatgggatgcaggcagcttcctagaaagcccattcagacctgctgtggctacatttttcacatgatgctactggattctgaagcgcacactggagtttaagaaccactggcttagaggcaattctgacctagacagaactagcgctttatttgtcaggacgatagacctcgagaagagctgcctatgtgggatctggaggtgacaataaaaacggctgttgattggtcactgagta

SEQ ID NO: 266984 - DNA, 332 bp, Homo sapiens
gggttttgacatgttgtccaggctggtctcgaattcctgacctcaagcaatgtgcctgcttcagtctcccaaaatgccgagattacaggcgtgagccaccacacctggccaaatgagtattgtcttcgttcgttttgtgttgctgtaatagaatacatgaggctgagtaatttagaaagaaagaggtttatttagctcacagttctgcagcctgggaagtaggagaagcatgttaccagcatcagccaggcttctggggagggccactacactaggtcaaaacaaggcagagaaggtcaaaggggaagcagacacatacaaagagaaaaaaa

SEQ ID NO: 266985 - DNA, 463 bp, Homo sapiens
agagttgcagaaccaggactacagcccttgcatcttgactgccagtacgatgcaggttaaactctgtgtttgatgcttgttgatgtggacgtctggaacttgaatagaagacatttcttatttcagatgcatccattagcaggtcttagccaggagccaggcccttgcaagtatatattgcaagtaattgatgacattggagccagaaatcgaatgaaccgggcccagttcaatccacttactggacaagctcctcaagcactctaagccccaatttcctcctctgtaaagtgggcataaattacatttaccttgagggttgctgtgaaggctagaaataatatatgtaatgtcccctgatacacagaaggtgctcaagaaatagtaagctcttctaatgattgttattgatggcaaagatgatgaaaaaacaaatgctctgacttctcaaaggagagagaat

SEQ ID NO: 266986 - DNA, 707 bp, Homo sapiens
cttcttccaagtgggaccaacttttcataattataggttcttaatgccttctttaaatataaacacatctgaagaaaagacagtgtagtagtgaaaagtaagagatttagagaagaacaagaaaaaaaaaaaacctgggcttgaattccagctctgcccagatttgtgtaaccttgaacattaaacctcagctttactcttctggaacttggagatatacatttaaagctttgaaatcttgcgccagaatattattactagtaggtcattcgtaataaacatttgaaaataagtatatatctatatttctttgggcacaataacaaatccttgttctttattgctaggcattgtactaggagtatttatatctattaagtcattcacacaagatactaaaataattataaatacacagatagttgactttattcaaaatttttttatttattggccttaaatatgcattttttttacaaaaagatgctcattttatttaatttttaaatcacctgagggttccaatatgatgctgatgatgatgatgatgatgacgactattattattattcttatcatcttatatctttctcatgtttaacaattctacattcagggcacacactgcatgtttgttactcgggcatcttgcctaatggtgctcatctgcttttcagtgtatccaccacccaaatctaaatatacac

SEQ ID NO: 266987 - DNA, 214 bp, Homo sapiens
ctaccacaataaagaggtaagtataaaatctctcaataacgaagctttcagaaattctagttttcctttttttaaaaaataacttccagccaggtgcggaggctcacgcctgtaatctcagcactttgggaagccgaggcaggcagatcacaaggtcaggagatcgagaccgtcttggctaacatggtgaaaccccatctctacttaaagcaca

SEQ ID NO: 266988 - DNA, 333 bp, Homo sapiens
ggttaaccttgagacagatcaaacctggagacccagctgcaaaatttcaaatatcaccttaaagccgttcgtccacaacctggtcattgttgtggttatgccagtccacgctccaggaggactgtgacccgagatagccactgaaaaaagagacacagatgtcacacccccatcactcgcttaccattacaatgtgaaatgcctcccatatcaagctttccttcttaaacccctgccctcagccaaccttcaaagcagtttctctaggtgtaaacctggccacttccccctgtggctatggaaataaagtggctttccattcactgcacttgc

SEQ ID NO: 266989 - DNA, 477 bp, Homo sapiens
tatctgattgaaaacttgaaaacttctgctacttgaaagacatcattaagaaagtgaaaaggcaagccacaaactgggaaaaacattcatgaaacatatatctgacaaagagtttatatccagagtatataaatcagtaataaaaaaagagaactaaaaatatatgaacagcaggcttaaaagaaaaaatttagaggctgggagcagtggctcacgcctgtaatcctagcactttgggaggccgaggtgggcggattgcctgagctcaggagttcaagaccagcctgggcaacacggtgaaaccctgtctctactaaaatacaaaaattagccaggcgtggtggtgtgcacctgtaatcccagctactcaggaggctgagacaggagaataatttgaatccgggaggtggaggttgcagtgagccaagatcgtgccactgctctccagcctgggtgacagagcaagactccatctca

SEQ ID NO: 266990 - DNA, 216 bp, Homo sapiens
acgagccccaaaggtaatgagcccagaatgctgctaactggagtgctccgcctgggatcactggagaaaggagctccggcagttctgtgctgagggaaactgaagcttccttaatgacttttttcctttatactgacacatcactcctcggcccaagagcagagcaaccagggctagcaggaagacagatgcctctccctgggtctgcttcctggc

SEQ ID NO: 266991 - DNA, 296 bp, Homo sapiens
gttcctgcaggtagggggccctatcactgcagggttctattccagcatcttgccccacttcctagctcctcctgtatactttaaatcatttctagattacttgtttacttaattcaaaggacatgctgtataaatacttgttatgctgtattgcttagggaataatggcaagaaaaattttatacgtgttcagtacagatgcaaccattttttttttttttggtccaaattgttttaatctgtagtcggttaaatccacagatacagaacccacagatactgaggatcaactatag

SEQ ID NO: 266992 - DNA, 362 bp, Homo sapiens
atttgatatatttttggagggatttcagggatctacattggttaagttgaatctgtaatttggttatacataaaattaaagttaatctaagtggacagaatcaatactcttgtgagtttaattagatggccagcttccaagcaagagattattctttttactatcctcctatcctctttccttaggcagcaaaaactcatagctatgctgttagcaatgtgagacagaagggagggatatgtgggtgaggaggccattgtattctagagatagtaataagcctgccttatctccagatcatagcccagccaaagggatagtgtcccatttgcagaggatctgcagtcactgtttctaaacca

SEQ ID NO: 266993 - DNA, 257 bp, Homo sapiens
ctcttccacacaggcaacccgtgctttccagacaaatctcacaacatcaaactagaagtattcatgccaccccctacccctgccaactagaactggctgtctgtgtcaggtcgtcatcttatcttagaacacatccattgatacatacactgtttcttcttccctatactccctctacatatttaccacaacacaatggggctcattcacccaccacacttaacaacataaaaccttcattcacacgagaaaacacc

SEQ ID NO: 266994 - DNA, 369 bp, Homo sapiens
tgagatggagtctctcgctatcccccaggctggagtgtagtggcatgatctccgctcactgcaacctccacctctgggcttcaagcaattctcctgcctcagcctcctgagtagcagggattacaggctcccacaaccacgcccggctaatttttgtatttttagtagagacggtgtttcaccatgttggccaggctggtcttaaacttctgacctcaagtgatccacctgcctcagcctcccaaggtgttaagattacaggcgtgagccactgcaactggccccttagagacatttcttagtccaggcaggatcttgcataggctgaatctagacattaaattcagagaccccttctgtcgtcttctc

SEQ ID NO: 266995 - DNA, 299 bp, Homo sapiens
tgaagtcctgagctcaagcaatccatttgcctgagcctcccaaagtgctggggttaccggagtgagccactgcgcctggctaggtttctcatttttttttaaaggtgaaattcacataacataaaattaacgattttaatgtgaacaattcagtggcatgtagtccattcacattgttgtgcatccaccacttctatctagtattaaagcattccatctccccaaaataaaactctgtacctgatgagtagttaatttcctattccctctttcccctagcccctagtaactaccaatca

SEQ ID NO: 266996 - DNA, 479 bp, Homo sapiens
tatatgagtttcaggtcctaggggaccacagacccaggtccaagttgcatcctcaagcttctgaataagactggggcaacaacgtcctcatctatacagttccagaacagtctcccagacctcactttacatgtcagctgacttaaaccaattagaagattaaggcatcatgtaatgtgctaactctgatgtgcgctgatggcctgggagggacgggggtggggacaggcaaaggcgaaaccttctcacgagcagatgacaactgccagctctagcatttgagagcggatgcgtccctggccattcccgcaggacctccctccagggacaaagctttggtttcctccccactgaggaccaggggcttggaatgggagttgtcacttggcaatcagcaggcagggtttaattcacacagtcctgggagggagacatttccttgcttttactgtttttctgataaaaatgtcccctatata

SEQ ID NO: 266997 - DNA, 98 bp, Homo sapiens
gggtgctcggtccctgcccacctgagagttcgactccatcagcctccctgggcacccttttatctgccgccttggtggcactgcctgtccgtttctga

SEQ ID NO: 266998 - DNA, 933 bp, Homo sapiens
ttgtaaatggaaacattgatagcatattgattctcccatacaataataaatatatgaattccaaaattgttgctcatagatgaaaactggtaataattcccatacttcctaatgtaaaaatatgtatttctgttaatgaaaaagtaagatcccacatcaagctgaataatatcaataggatacttttgtaaatatatttttgatagctcaaaatcatattataacattaatacaaacaaaattttgaagcaaccagctacttgatagcttttccattatcagtgttaactttttctgcagttgttcagaggctgtggaagttaatgcagatttgtagaaaccttaatatgtttgtaagtgaattttgcacaatgtacgattatattttgttgcaaaacaattttgatgccaaaatacgaaatatggagaacagacttcttgaaacattaaaaaaaaatttgtttctgaaatgtcaacacactcatcttcttttctaccttgatcttttttactgtgtatcactgtggccactcttcagtctttctggaatattaccctttctaaaaatactggcattccctgtttggttctaggctcttttttccaacctttcttaatttgcttatcctttggatgtctcacctttggatgtgtggctttagatatcatctataatacccaaatttcttgttgttagttcagctctcttgaggaattccacttgaatgtctctcaaaattttcaaatttgccacatctaaaatggaacagttcatcccctactctttagtctcccctttcttatcttatccctacagctgcttaaatcacccaggcaggagaatcacttgaacccaggaggtggaggttgcagtgagccgagatcacaccactgcactccagcctgggcgacagagggagactctgtctaaaa

SEQ ID NO: 266999 - DNA, 1040 bp, Homo sapiens
ttgtaaatggaaacattgatagcatattgattctcccatacaataataaatatatgaattccaaaattgttgctcatagatgaaaactggtaataattcccatacttcctaatgtaaaaatatgtatttctgttaatgaaaaagtaagatcccacatcaagctgaataatatcaataggatacttttgtaaatatatttttgatagctcaaaatcatattataacattaatacaaacaaaattttgaagcaaccagctacttgatagcttttccattatcagtgttaactttttctgcagttgttcagaggctgtggaagttaatgcagatttgtagaaaccttaatatgtttgtaagtgaattttgcacaatgtacgattatattttgttgcaaaacaattttgatgccaaaatacgaaatatggagaacagacttcttgaaacattaaaaaaaaatttgtttctgaaatgtcaacacactcatcttcttttctaccttgatcttttttactgtgtatcactgtggccactcttcagtctttctggaatattaccctttctaaaaatactggcattccctgtttggttctaggctcttttttccaacctttcttaatttgcttatcctttggatgtctcacctttggatgtgtggctttagatatcatctataatacccaaatttcttgttgttagttcagctctcttgaggaattccacttgaatgtctctcaaaattttcaaatttgccacatctaaaatggaacagttcatcccctactctttagtctcccctttcttatcttatccctacagctgcttaaatcacccaggctggagtgaggtggtatgatctcagctcactgcaacctctgcctcctgggttcaagcgattctcctgcctcagccccccaaatagctgggattacaggtgcctgccaccatgcctggctaatctttgtatttttagtagagacagggtttcaccatgttggccaggttggtcttgaactcctgacctcaggtgattggcctgcct

SEQ ID NO: 267000 - DNA, 682 bp, Homo sapiens
cagagtaatactcttctgcattattatgaaagaaaaatattcttaattttagttaaaattaggttagtaatgttattttattaattgcacttttatggaatactatacggcatatttttaagttataaattatttgtgaaattaacttttcaattccacatttttaacatgttaaatactatcatgaatccattgaaatgttattgtgccactaactttaacctattccatcttacacaagggtgtaggtaacaatacattatttggtaagataatggactgacatcgctagtaatcttttttgccagtaactttaaatggccaataagttaaaaaatattgttcctataggttatatttttattcttattttcacatttaaatgtatttttcttaatttctgtggatatatgtttatatgtttatgccatatatggcatattttaatacaggaatacaaaatatgataatcacattagaggaaatgagatgtccattacctctagcatttattctttgtattacaagcaattcaattctacagtttaagttatttttaatgtacaattaaattgttattgactacagggtcatttttatcatcataatacaaattatatacaaacatgtaaaatccatacatttctgagtccttaataaatatttttataaattttaatat

SEQ ID NO: 267001 - DNA, 141 bp, Homo sapiens
ttgaatgatcagccttcgtggcccccctcttttgtcccccagcttgagatgtatgaaggcttttggtctccctgggagtgggtacaggcagccagggcttacctgtacactgacttgagaccagttgaataaaagtgcaca

SEQ ID NO: 267002 - DNA, 365 bp, Homo sapiens
aaaaaaaaaaaaagaaaaaaaaatcagtcccaaaaggttgcatactttacaattccatctatataacattcttgaaatgacaaaattatagaaataggaaataaattaggggtggccgaaggttaaggaaggagtggggcagaaggaagtgggtatggctataaaaaagcaacacatggctataaaacagcacgagggtcattgtggtgatgaaaatgttctgtatcttaactaaaacagtataaaaattctggttgtactgtggttttgcaagatattattgggaggaaatgggtaagagatacatgggatttctttgttatattccttgcaataacatttgaatttacaattatctcaaaatt

SEQ ID NO: 267003 - DNA, 152 bp, Homo sapiens
ctgtaatttgtggtattctattgggatacctcccttacttgacccacaacacatatgttttctagtggcagaagccatctttatttctgctacttgggagtgcctccagcatatccagatttctctaaatacagaggagaaggtccagaggg

SEQ ID NO: 267004 - DNA, 155 bp, Homo sapiens
tgggtcggccgcccaaatctttcctggcgaaggggagggaaggggtgttctggtggagtgggaagggaggcttgggtaggattgtgggataagatcgccctggtgacgaggagcggatctcgaacggaacttaataaaggttgcctagataaaga

SEQ ID NO: 267005 - DNA, 304 bp, Homo sapiens
acccgggaggctgaggcacgagaattgcttgaacctgagaggtataggctgaagtaagccaggatcaaaccactgcactccagcctgggtgacagagtgagactctatctctgtctcaaaaaaaaaaaaaaaaagaaatttatgagaccatttttccaccttcaggaaagatgaggtcagagccttgctcagattatagagaacagttcataccagacccactgaatcatctcttccccttagaattatcaaattagtagttaagggaaacatagcagatagacatacactctatatttagact

SEQ ID NO: 267006 - DNA, 418 bp, Homo sapiens
ccacaagccagtgaatgccaaacgtcaccagcaaaccaccaggaactaaggcaaagggactactgcagtttccgtcaaccaagttgacacttcagggatacttttgtgaccaccaggcattacaaggatcctcaaagttccccaggagaatcctgttgaaaatgaagccactatcatggttaagaggatttgaaatctaagatcaggagtgactgctttcggtgaatacaagtttctaagactagaagatggacattctaaagttcagaaaaagtcacttctcaaatcactaagttatgttgcttccttcacaatgttgaccaagaatcccttcaccccttttcttgttaacattgcagtcaaacattgattatcatgcactttaataaaataatagccaaattgttatctcatttct

SEQ ID NO: 267007 - DNA, 474 bp, Homo sapiens
agtgaattcatcaactctatgactattgcctttcaccttacactacactgatatgttttgcatcaagagtaggacaatacacagtaatgaaaaagaatgaaattgtgtgctttgcagcaacatggatgcagctggaggccattatcctaagtgaattaatgcagaaacacagaatcaaataccgcatgttctcacttataagtgggagctaaacattgtgtactcatggacataaagatgagaacaatagacactgaggattccaaaaattgggaggaaaggagggggcaagggctaaaacattacctactgggtatatgttcactgtttgggcaatgagttccatagaagcccaaaactcagcatcacgcaatatatccatgtagcaaacctgcacatgtacctctgactctaaaataaaatgaaaatctctataatactttaaaaataaaataaaagggatactcattcttt

SEQ ID NO: 267008 - DNA, 332 bp, Homo sapiens
agctgcccattaagattttgcctaaggatggaaatagctgtgaacagcgtttgggaaaacgtttcctgcctgcagaagaggcctcttcagaactacagactcttggcttttttccctctctaggttcctattcactaagttacttagcatctcgtttaaaaagtactttggagaattaactcaggcttggaggttgggctgtaaaacgttcccaccaatggaaacccagaggatcttggtggcgtggtcacaggaacacacctacgtggcttgcttcccttctggcagcgttcactttcatctagcattaaaaaaaatctgcaccacagtgt

SEQ ID NO: 267009 - DNA, 266 bp, Homo sapiens
tagctttagctatggctggtgtaatcagacaccacgtaccaggcaaacctaacccttgaggccctgattacttaaaaacaataggagtgaaacctccctccaccaaatagaaaggaggtggctgcattcaagcattattcctcgttctctagaaaggtagcggcaagggctactactcaaagggaagattctggaaatggttcttgtgggaaaagaaggaaaatacattagtcttttcagctaacctagaaaaaaaattcttggca

SEQ ID NO: 267010 - DNA, 96 bp, Homo sapiens
ttataactgtaaattagtgtatagtgtttcactccagagacttcaataatatagtgttatcaaaggacctgtacagatttcagagaaagacacatt

SEQ ID NO: 267011 - DNA, 455 bp, Homo sapiens
gaagcggagaaggactacgtctttgacaaaaggctcagatacagtgtccgccagaatgaaagcaactgtcggtttcgagacatcgttgtgcggaaggaagaagggttcacgcacatcctgctgtccagtcagacctcggataacaatgccctgacacctgagggagctgaggatggtaactagcgtgcataaaaacttgactgcagcgcgcaatttgctcatcattttacatacattatcccatttgatctttatgaccgtgtaatgataccctctcatcttatggatgaagaccatggggagagggactcactgaactgatcgtggacacagacttagccaaggggcagacccagaatccaaacatcacatcttgggcttttccagctaaactttgttgtcatcagcatgtcatatttgttggccgcagatataattcactcagttaatgtatc

SEQ ID NO: 267012 - DNA, 482 bp, Homo sapiens
acaaagtaggaaacacaaatgactaataagctgaaaaaaccgtctaacttcacaggtaatgaaaatgcaaattgaaccaataatgcagttctatttttgtctatcaaatcatcacaaattaaaaaagataatactcagtgctcttcaggtgaggtgaagttgacactcttccagtcttttgctgtgaaacaaccattctggaaagcagtttgctggccactgaacagcccagtgcctccctgtcccgaggacatagaaggtgatgtgtgtgaaggctgagcacggggctccctgtggaggcaaatgtttgcatgagttgaggcttgaaccagcccagatgcccaccgatagaggaagtttaaagccattgggtacattgatttctgtgtcgccctaaacatgatttcataaaaacctttttcagtatgtgaaaatgatcagggtataaataaaaacaataggacataaaacttcatatttag

SEQ ID NO: 267013 - DNA, 323 bp, Homo sapiens
actctctggactctgtgatggaaagtgagggggtgtgtgactgaatgacctgttttggaaggtgattcaggggcacctgggaaaggtagcagattccctataaggcccccatgctggtccagagctggccttcacccttaactgcctaatgatatctccatgaaaaagttggaaagacataataggctgttaactggaatcatttacctgcctgtagttgaaatatttggctgaattgcattccttttgattgtctttttgaatagctatgcagtaagagaatgtctaaatatctgtaataataaaatagcagagaaaatcct

SEQ ID NO: 267014 - DNA, 291 bp, Homo sapiens
gctgttagttggcatcaagaatcttttaatctggaaagaaaatgttacctccttcatttgcaaaacagagtgtttctggcaccgtatcccaaagtgtcttctggttgttccgtttttcagaagttactgtgggcttctaattaccctcatttagacatccaggacagaaattgccacttcaacaagaaaattttgtaatgagccggaggaaatggtctcatcattactacgttatacgcagtctgagagtctgcgtggatttttatttcacaagaatgtgactgtttaatt

SEQ ID NO: 267015 - DNA, 425 bp, Homo sapiens
caccaggcagcactccaggctgtccatctatccgcccccagggggagaagggctcaggcagcttactgagaagggggctctggagacactcaccaggggcagaccatgaaaaccagactggccctgggaaagggagagtgccagaagcttccgaagaaagcacttcccatccccaggctcctttcctgtaacaaggttcctgggagtttccttactgcacagatgagaatggcttgtcattaacattcacatcaatagacgcttcttgaagacttgaaaatggctattgcctgtggggataagcatgtgacccctcctgccatccaccctcagccaccctagtgccaaggaaaggaagcatgaatacagattctaccagcagtagacacattctgaacaaatgaagttcaaattaaaatctcaaa

SEQ ID NO: 267016 - DNA, 185 bp, Homo sapiens
cagggattgattaatgtcccgctcctgaatacatgtaaaatttgtacaaaaatatcttctatgaaaatgatttgtaatctgtagacttattacctgggagatgtcttgatgtaaaatcccatcctttgggttgtgggttttttgttttctccaaataaatctgatctttaaagttcaaaaaaaaa

SEQ ID NO: 267017 - DNA, 395 bp, Homo sapiens
agaatttagctctgaaatccttataatgttagaatgcattgagttccaggacatgacattggtttctatgtggtaaatttgttacatcttactaagtagggggatttgggcataatcaagaacatagacataataaccatcacaatttgaagaaattagtgtgaggtcaaagctaagactgaacaaaaggaaatggagagcagtgtgccctgtgtgggtgcccacgtgtgcctggtcttgcccacttacagatggacttagccctggcttggggaagccttttcctctagaaccatatttgctcacgtgtgtctcctaattttactattcttctgccttgagattgcttattcctttaatattacaacttacagcagagtttccaaagtgtgact

SEQ ID NO: 267018 - DNA, 444 bp, Homo sapiens
ctttcaccccaaaagcagcgctgacctctgcaataataataatataataataataataatgatagcaaccacaagaagaacaataatgaccagtcttcccggtatccttcagtacttttactcctggcaaaaccaagcagcacgccgcctgattttccggatcttcactgatctaacaaacaactctgccaagatgataaatgctgcggtgaggttatcatcggttattatcgtcggcacaacgtttgcacagacaactgggccgtatagtttatgctggtctaaaaaacaatcaatatttaaatctacactctatagcctgatttttttttaaaacatggttaaaaaatactttgtcctttgacatgcattatacgtcttttctgataggctaataataataataataataataataataaagttagccagtgctgttcatta

SEQ ID NO: 267019 - DNA, 421 bp, Homo sapiens
cctgttaaataaggggaccctaatgtggcccgcgatcaaactcacttcctcattaagagcacaagcctaagaaaaatcaacttgcaaaaaaaaagaaatgtattagtccattctcatgctactgacaaagacatgcctgagactgggttcctttgtaaattcatcatttgaggggagtcctgacgcaaggagtgggaactgagaaaagagaaaacaggaaatacacgccaacaataaaaagcaggctttcaaatgaagaacagaacatccaaaatttcagcaatgagagatgtaaaattcatggaaacactgactcacgaggtcagttagccatagtttaatgtctttagttcactctttctttcccttcctcaaaaggaagaataaggagaaaataaaaacttttatccatagtatataa

SEQ ID NO: 267020 - DNA, 452 bp, Homo sapiens
cagctaattttttgtatttttagtagagacggggtttcaccatgttagccaggatggcctcaatctcctgacctcgtgatccgcccaccttggcctcccaaaatgctggtattacaggcgtgagccaccgcgcctggccaaggaaactttcttaatgaaataaaggctatctattatatactaacagtaaatgaaacagtgagacactaaaggcattcttcactttagagtcagaaacaaaataagggcaagcccatcatcactgcaattcaaaattgttctggaagttctagcacgacaagaaagtaaagaagtataaatattagaaagttattactatttgtagattatatgataacctgcctagaaaatccagacatcaatggaaaaactatcagaaccagaaagaaagtttggtaatgtggctagataaaaatgtgttgcaaaaaaaa

SEQ ID NO: 267021 - DNA, 485 bp, Homo sapiens
ctgcatcctgaggactatgggtctagtatggacaataaagatggaggaggagaagatgtgcagagttccaggctaatttttcttcacccatttgcaatgcagaggacagacagagggttattagctataatataaaaagtgcttttataaattgacaaaaaaaaggacaaaagataaacaataggaaaacggacaagagatgtggagaatccatggacagaaaagcaaatccaagtagccaatgaatatatgaaaaaaatagtttagaaacactagtactaggaactaggaaattataaattaaaactaataatgtaaacatcaggtaggcaagcatttaaaaagaaaactaagatatcattggtgaagttgtgggggaaaaggtactattatactttttggaggaactgtaaattgttacagtgtctttagaaagcaaacttgttgctttctaaagcagccattaaaatgaaaaatacatatat

SEQ ID NO: 267022 - DNA, 557 bp, Homo sapiens
aatcgcttgaacctgggaggcagaggttgcagtgagccgaggtcgtgccattgcactccagcttgggcaacaagagcaaaactccatctcaaaaaattttttaaaataaaataaagaaatagcctggactttagtcaggtcctggcggcaccttctgtaagctctgtgattttgcatgcctctcagagcctgtttctgcatctataaaatgagactaatacttcctacctcatatagttacaataaggcttaaatgacaaggcctgcaaacagccagcacagtgcctgacaagtgctacccactctaccaatgccagtgcccttcccgctctaacacagagggaaatgaaaatgaagctagtgtggttttgcctatggttgcaaatcacatgaaaccttaaagttgtgactgtgatgtgttgaaagggcactttatgaggatgttgaccccttatctgcaggaggtcaggatgctccccaccctcaagggtgggaaatgagcattttcatcatcacaaatgacataacagaaaaatgttaagaatatgtgggattct

SEQ ID NO: 267023 - DNA, 477 bp, Homo sapiens
aggcccacgcaggtgctgggtctggttggagtgctgctcccacgccgacttccccttggcgcactcttatggtctttcccttgcaaggaaatgcatcctcgggtggatctggaggtcacgtgaaccttttttcccttgtgggtttgcccattcactgcttctgtctcatttaggactgaaaaactttgattcgaggtctgcataggattgctttagggggtttcacttattcaggtgtttcttgctttaaggctatttcacttgttgttgttgttgttgttgttcttagtctccatatcttcaaccttagattctgatctgaaaatataaaagaaatttgtgaaccggtccccatcttgggggagaacaggatgaatcaagtgaaacaaaagtgtagtaagcttgagggttggtaaaggtgtgcaagggatcactgccaaaaactgaaggaaggggacagagcgagaatctgtctca

SEQ ID NO: 267024 - DNA, 256 bp, Homo sapiens
ctcaggtgatccacccttcttggcctcccatagagctgggattacaggcgtgagccatcccacccggctgaagttttttagcctgagtttctatcttcatattagcctagatttttcattaaattaaaacattgttctggatctttggttaactttagtcttcagaatattctatgatggtagtcacaaaggcaaaaattaagtagcttaagttacattctaataaaagaaataataaagaaatctgattgtacca

SEQ ID NO: 267025 - DNA, 609 bp, Homo sapiens
caccattcagtggattcctaagggacattttgcaaacatcttagttctgttctctcttcctctcccctccttcacttcttcacatctgggttcccaaaagcaaatggtcagcttactagacaatggtatggtttgagatggaaacactgctctaaaagagtggctcctagatgccagtgtatgaactccagttgtgtggtaacagagttttcactggtgcaagaatcataataatgaagttctttttcttaagtgctaaatgtattcagttgtttcattatgaaattacattgttctctctcatcttttggtgttaaagtgtccctttgtaaaatgatgtttattatagatgattgttctgtcattattgtattttaatatttttagtaggcaataaaaagaagccaaatctaatactctccaaaatatttttggaaatattaatggttgatcacagccagtggtctgggaattcgtgctttagaagatgtatgtttggctttgtgtttatatatatatgagtacctgtgaacgatatttgtatctagaaatacactagtcactgattgaatgtttattgactccctcctgaacaccaagacattgtac

SEQ ID NO: 267026 - DNA, 324 bp, Homo sapiens
taagagacacaggttttgttatgtttgttgcccaggctagtatccagctcctaggcttaagcatactcccacttcagcttcccaagtagctgggactactggcgcaaatcactgggtccagttctcagttcttaattcctacctttgtgtttgcaatttaggatatgctggctgtacagtgtttccatgttgtagcctcttgaataaggaaaaatctcagccaccaggtctgaccaaaaaggtcaattctaagttgtaatgttcatttcatgtccgcaactcccaagagttatttggagttcccactgggaaccacatgcattc

SEQ ID NO: 267027 - DNA, 643 bp, Homo sapiens
taaaagtagtatgactgagaagatattttcctcacttattaaaaagatgaacatatgtgatggaatctaaaatccattcatctggaggaaaaaatggtagagaatagtcagaaaatcctttaaaagaaagaatgataggggtaggagctaatctgccttatcatctatataattgagtcttcacaattattgtatttgacactgaggaaactgagacttagaaaatataactagctcagtgtggtagatattattatttgcttacagttcttcattttctctaagtccctgacatgccttccccgtggagacaatgcattttcctttcgcattcacttagggttgattgtgtgatcttcagaccaatgcagtgtacgtggaaaaaacaatgtgttggagttgaggtttaagagtgtggcaagtttcagccagccttcttgtactcttaccatccattataagaagaatttattccagggagctgttgttatcacagcctgaaaaaacagaaatgtgtagcactcaaatctgacctgtagcttggagcaaagtccatttgtgtccagaagaacactgcagtgtcacagctgacccagatacccacgaaagagaaataaatattttttgttgtacgccactgaga

SEQ ID NO: 267028 - DNA, 499 bp, Homo sapiens
ggacttcatgtctaaaacaccaaaagcaatggcaacaaaagccaaaattgacaaatggaatctaattaaactaaagagcttctgcacagcaaaagaaactaccatcagagtgaacaggcaacctacaaaatgggagaaaattttcgcaacctactcatctgacaaaggactaatatccagaatctttaatgtcttgatttctttacctgttaattcctaactgacactttagtgtgtattaaaaactcccgccgtgatggtggaactgtcattttcttattgtagttccatcaaagatatataaattatatatacatatatacaaaaattatatatatgtacacacatatacatgtatgactgtttaagctatttacatttattgtgatgtctatattgctgttatcttctaccatctcactttatgtttctagttgtccaactgttttaatgccccttttctgacttcctctgaataaaatgataagctttcgcttaa

SEQ ID NO: 267029 - DNA, 178 bp, Homo sapiens
tccagggataaagttttatcaaataaacataagcacccagtgtctcatgggagacaggtaacaaatgtagattaatttggtgttctgacattttaaaattttgtacatcttaaaatatattagggccacttcaggaaaataatgaattaaaatataccattaaaactattttaagagg

SEQ ID NO: 267030 - DNA, 427 bp, Homo sapiens
atttttcaccaccttagcggaagtaggagcccaacagaagagatgtaaaacatactgagaattaaagagctacaactggccttaaaaatcttataaattctatagtaccaatatgtatctggaaagagatggaagtactccttcagggacttaaaattctttctgcaactctctttccctgcttttctaataaatgcaagataccctgtggaccagagaggtattctgagtatggaccacttgtctggatggttcagaaagaagctttttattaactctggaaccattttgtagtaagactcaagctaggtaagtatataacaagcccagagttttatttcgtaaggaataaggttcaggacattagtaatagaaaaacacaaatttaatttaaaactaaaggtgctccttgggagaaatttatccc

SEQ ID NO: 267031 - DNA, 359 bp, Homo sapiens
tcatggctcactgcagacttgacctcccaggctcaagtaatcctcccaactcaacctcccaagtagctgggacaacagtgaggaccagatgctggttgaagagctccccagagtcttgttgggataactgcagtctctgctttctgtagaggatgtgacaagggtgaacaccagtgtggagccaggagaagccgttcacctgtgaatgataacagggccagcaccaactcctactgactgagcatttctgtgtcagaccaaggggtctgtgctttacacactcacttcatacctcaagatgactgtgtgagctttattgaggcataatgaacaaataaaaattatatctgcttaaggta

SEQ ID NO: 267032 - DNA, 658 bp, Homo sapiens
tgtcagcctcccaaagtgttggtattataggtgtgagccactgcacttagcctgtaatatcttttaaatagtttttttttttaatagactgtaggaactagagtgttatgctcctcttctgtgtttatgtggtttttccaaaaatgaatgttttttaggcaggttttcttaacagaggcaccattaaccttttgggactaataattatttgtcatgggaagctattctgtgcactgtaagaatgcctgatggcgtctctggcctctaccccctaaatgccagtaggaccttccctcaccctagttgagacaacaaaatttttccagactttattatatgtgcccttttgggggttggggtaaggtcaaaataatccccaaggctgggagcagcggttcacacctgtaatctcagcactttgggaggccgaggtgggcgaatcatttgaggccgggagttcgagaccagcctggccaacatggcgaaatcctgtctctactaaaaatagaaaaattagctgggcatggtcgcacacgcctgtagtcccagctacttgggaagttgaggcaggagaatcgcttgaacccgggaggtggaggttgctgtgagccgagatggcaacactacagcctgggcaatagagcaagactccatctca

SEQ ID NO: 267033 - DNA, 630 bp, Homo sapiens
tgtcagcctcccaaagtgttggtattataggtgtgagccactgcacttagcctgtaatatcttttaaatagtttttttttttaatagactgtaggaactagagtgttatgctcctcttctgtgtttatgtggtttttccaaaaatgaatgttttttaggcaggttttcttaacagaggcaccattaaccttttgggactaataattatttgtcatgggaagctattctgtgcactgtaagaatgcctgatggcgtctctggcctctaccccctaaatgccagtaggaccttccctcaccctagttgagacaacaaaatttttccagactttattatatgtgcccttttgggggttggggtaaggtcaaaataatccccaaggctgggagcagcggttcacacctgtaatctcagcactttgggaggccgaggtgggcgaatcatttgaggccgggagttcgagaccagcctggccaacatggcgaaatcctgtctctactaaaaatagaaaaattagctgggcatggtcgcacacgcctgtagtcccagctacttgggaagttgaggctgtagtgttgccatctcggctcacagcaacctcgacctcctgggttcaagcgattctcctgc

SEQ ID NO: 267034 - DNA, 354 bp, Homo sapiens
tttctcctcctctttctaaattaaaaagaaatattgtgataagaagctcctcctaccttttttccccatgtttgaagaaactgggttgctaagggaagaaaagacttgcctaataggagtttggggtcctgacccctggaagggagctggggatagactaggagaggaaggagaggtggaaaggcatccaagcccagaccagcctggctgcccaggtcatctaagtcagttccctgcctccgtaccagaaaaacccaaaccggaggctcttggatgtgaggctccaggttcatcctgccagtttctagtgaacttggtgatcacataggtttaaatgaataaatccacttttgt

SEQ ID NO: 267035 - DNA, 364 bp, Homo sapiens
tccagtcataggatacaagatcaatatgaaaaattcaattgctttcctatatgtcagaaatgagcaattggcattttatatttttaaaaaactaccacttacaatagtaccaaaagcaacaaaatggtataaatctgattaaatatgtacagaacaggtatatggaaaactataaaaagtagaagaaatgtaaaaagctaaaaattagtggagaatattgcatgttcatgaatttaagactcattattgttaatatgtgaacttttcccatcttcatctatagattgaaggcaattgcatttaaaatactatcaagaagctgggtgcagtggctctcacctaagtttacagcgagctatgacca

SEQ ID NO: 267036 - DNA, 472 bp, Homo sapiens
catcttgtaatagacatcctataaagcccctgtgatttccatatgctatctgtctcatgtacatctcagaatttcagtgctttgagatgattgactccagcctcttcattatcagcaagggtaacagacctggtgaggtaatgttgattgtccacattttacagtaaatttgtgccggagacctgtgcgaggtcttaaaagtgcctacaaaatcatacctcaggatagaactacttcttagaagggcaagaatattatttttgaaagaaagtttttcatcagtagatgttaagaattgggttatcttatcatttgttctaaaatgttccatatgtatagaaagtaaatctacctctgctttttgattctctgtgaacttaaaatatgaattacagtttaaataatattggataataaggaagtccagttattaaaacctattttactctaaaatgagtaactgaaacctatt

SEQ ID NO: 267037 - DNA, 249 bp, Homo sapiens
aagaacaaaaaacaaaaaaccttgagttacagtacaaatcacaggtatgaaacaacttgtttcaaagaagtttaaaagatgagtaatctttagaaattaggttaacaaagaaaatgacagacatggtaaaacccgtctctactaaaaatacaaaaattagccaggcatggtggcacgcctatactcccagctacttgggaggctgaggcagaatagcttgaacccgggaggtggaggttgcagtgagcc

SEQ ID NO: 267038 - DNA, 1456 bp, Homo sapiens
caggtgcggcgctgtggcaggaagccaccccctcggtcggccggtgcgcggggctgttgcgccatccgctccggctttcgtaaccgcaccctgggacggcccagagacgctccagcgcgagttcctcaaatgttttcctgcgttgccaggaccgtccgccgctctgagtcatgtgcgagtgggaagtcgcactgacactgagccgggccagagggagaggagccgagcgcggcgcggggccgagggactcgcagtgtgtgtagagagccgggctcctgcggatgggggctgcccccggggcctgagcccgcctgcccgcccaccgccccgccccgcccctgccacccctgccgcccggttcccattagcctgtccgcctctgcgggaccatggagtggtagccgaggaggaagcatgctggccgtcggctgcgcgctgctggctgccctgctggccgcgccgggagcggcgctggccccaaggcgctgccctgcgcaggaggtggcgagaggcgtgctgaccagtctgccaggagacagcgtgactctgacctgcccgggggtagagccggaagacaatgccactgttcactgggtgctcaggaagccggctgcaggctcccaccccagcagatgggctggcatgggaaggaggctgctgctgaggtcggtgcagctccacgactctggaaactattcatgctaccgggccggccgcccagctgggactgtgcacttgctggtggatgttccccccgaggagccccagctctcctgcttccggaagagccccctcagcaatgttgtttgtgagtggggtcctcggagcaccccatccctgacgacaaaggctgtgctcttggtgaggaagtttcagaacagtccggccgaagacttccaggagccgtgccagtattcccaggagtcccagaagttctcctgccagttagcagtcccggagggagacagctctttctacatagtgtccatgtgcgtcgccagtagtgtcgggagcaagttcagcaaaactcaaacctttcagggttgtggaatcttgcagcctgatccgcctgccaacatcacagtcactgccgtggccagaaacccccgctggctcagtgtcacctggcaagacccccactcctggaactcatctttctacagactacggtttgagctcagatatcgggctgaacggtcaaagacattcacaacatggatggtcaaggacctccagcatcactgtgtcatccacgacgcctggagcggcctgaggcacgtggtgcagcttcgtgcccaggaggagttcgggcaaggcgagtggagcgagtggagcccggaggccatgggcacgccttggacagacaggctttctcctcgttgcccaggatggagtacagcagtgcaatcacagctcacggcaacttctgcctcctgggttcaagcaatcctcccgc

SEQ ID NO: 267039 - DNA, 514 bp, Homo sapiens
taatagatttatgaatagtatctgttctaataatttccatatattaaaaattacttgaaatcaatgtgtttcagcaagaaatattagcatgaaattacatttttttaaagagaaccattcaaaaataagcagaatgcttatcagaatcaagattatgaaatattgcaattttgaaatataaatttgaaaattccaactatagaaaatttcccaatataatgactaccacttgtacttttaaatatatgcatttatttagattacttagcctgttcatgaggacatccatagattcaaaaaattactttctaccctttatttataatgcaatttgtcatattgttaaaattatgcaaaaattttatttgtaattagtagaattgagaaactatttttggttagtgtaaatttagctttatggtcatctagcttttacatatacatataaacatataatatgtgtatacttcagttgtaatatttaatgatctttaagagcctcacattttaaata

SEQ ID NO: 267040 - DNA, 352 bp, Homo sapiens
tcgcccaggctggagtctctaaaaacattttcttttcatttaaaaaaaaattttagaaagaaaatggaaggtagtgcttactatctctttcagcaaaagaaactactccaacagctgctgttttccttgcccatagtcatagcaaattactgaccaagttggaaacttagaaccagagcctgtatcttttcaaattctttccttaggcaagcaaatcagactccttcacattatttaaaacaaacaacaatggaatgttggattggcaagagataggcacagctcctgtttcattttgctagttttctttgctgattttttaaattaaaaacaaacaaaaatcctttcccta

SEQ ID NO: 267041 - DNA, 275 bp, Homo sapiens
gacaagttcacaggattttgtttttaattattttagtcaagatcatggagaaatgaaaaagtgttttaaaattacatgcaaaatagtagtggatatatattaggttaaattattaatacaatgaatcatgtttccttttaccactaaagaatataagattacatttatagcatacattatatttctattggacagtgctgctctgaatttaaaaagttatctacaaaatataaggtgtgactttggatcctgactcaaaccaaccagctgtttaa

SEQ ID NO: 267042 - DNA, 358 bp, Homo sapiens
tcattattttgtgatgtaagcatgttttaacccagaatcaattgactgttcaatacgattggagtccgactgcagtaattttagaaactttattacggtagtaaattgtggtttcaaatcacatgtcattcgtgaccatgcttataaaagagaagacgacagtacaactcccacactggtactagcaattttcttctctccagtggtcttggcttccggcaactgaagtttgtccacttacggctggggctccagggacagagaatgctttgattatttttccagcttggccagcctccctgttcttggggctcctgtctctctatgtatggtttatattaaaaagtagagcgccaaa

SEQ ID NO: 267043 - DNA, 1460 bp, Homo sapiens
cgacttcacgcagggtccgtggggtccccgcggcgcgcagcggctgaaggaggccccagggccttggcgaccgcagcggcggctttagcgtcagtgactaggcagcagggggtcaggatgcggcgaagctcccgcccgggctcggcctcgtcctcgcgcaagcacacgcccaactttttcagcgagaacagctcaatgagcatcacctcggaggacagcaaagggctccggtcagcggagcccgggcctggggagcccgagggcagaagagcccggggcccgagctgcggtgagcccgccttgagcgcgggagtgcccggaggaaccacatgggcaggaagctctcagcagaagccagcgcctcggagccacaactggcagacagcctgtggcgcggcaaccgtgaggggcggggcctcggaaccgactgggtctccagtagtctctgaggagccgctcgaccttctcccgaccctggatctgaggcaggagatgcctcccccgcgggtgttcaagagctttctgagcctgctcttccaggggctgagcgtgttgttatccctggcaggagacgtgctggtcagcatgtacagggaggtctgttccatccgcttcctgttcacggctgtgtcgctgctgagcctctttctgtcagcattctggctggggcttctgtacctggtctctcctttggagaatgaacctaaggagatgctgactctaagtgagtaccacgagcgcgtgcgctcccaggggcagcagctgcagcagctccaggccgagctggataaactccacaaggaggtgtccactgttcgggcagccaacagcgagagagtggccaagctcgtgttccagaggctgaatgaggattttgtgcggaagcccgactatgctttgagctctgtgggagcctccatcgacctgcagaagacatcccacgattacgcagacaggaacactgcctacttctggaatcgcttcagcttctggaactacgcacggccgcccacggttatcctggagccccacgtgttccctgggaattgctgggcttttgaaggcgaccaaggccaggtggtgatccaactgccgggccgagtgcagctgagcgacatcactctgcagcatccaccgcccagcgtggagcacaccggaggagccaacagcgccccccgcgatttcgcggtctttggcctccaggtttatgatgaaactgaagtttccttggggaaattcaccttcgatgttgagaaatcggagattcagactttccacctgcagaatgaccccccagctgcctttcccaaggtgaagatccagattctaagcaactggggccacccccgtttcacgtgcttgtatcgagtccgtgcccacggtgtgcgaacctcagagggggcagagggcagtgcacaggggccccattaaacatgctgatttttggagtagaaaagagt

SEQ ID NO: 267044 - DNA, 911 bp, Homo sapiens
tcggcctcccaaatcgctgggattacaggcgtgagccaccgcgcccggccaggagaccaactcttgacggagcctccctgaggggcggggcttcagagggcggagctggagccgggatagggctgcggtgggaccaaagcctgtgagagacttcccagctgtctggcttgtggactgagcaatctgcggcccggtctcgaggggaaaataggtctgtggtccgcaaggccccagtggagcccttgggttcccgcagaaccgactgggtctccagtagtctctgaggagccgctcgaccttctcccgaccctggatctgaggcaggagatgcctcccccgcgggtgttcaagagctttctgagagcctccatcgacctgcagaagacatcccacgattacgcagacaggaacactgcctacttctggaatcgcttcagcttctggaactacgcacggccgcccacggttatcctggagccccacgtgttccctgggaattgctgggcttttgaaggcgaccaaggccaggtggtgatccaactgccgggccgagtgcagctgagcgacatcactctgcagcatccaccgcccagcgtggagcacaccggaggagccaacagcgccccccgcgatttcgcggtctttggcctccaggtttatgatgaaactgaagtttccttggggaaattcaccttcgatgttgagaaatcggagattcagactttccacctgcagaatgaccccccagctgcctttcccaaggtgaagatccagattctaagcaactggggccacccccgtttcacgtgcttgtatcgagtccgtgcccacggtgtgcgaacctcagagggggcagagggcagtgcacaggggccccattaaacatgctgatttttggagtagaaaagagt

SEQ ID NO: 267045 - DNA, 508 bp, Homo sapiens
tcggcctcccaaatcgctgggattacaggcgtgagccaccgcgcccggccaggagaccaactcttgacggagcctccctgaggggcggggcttcagagggcggagctggagccgggatagggctgcggtgggaccaaagcctgtgagagacttcccagctgtctggcttgtggactgagcaatctgcggcccggtctcgaggggaaaataggtctgtggtccgcaaggccccagtggagcccttgggttcccgcagaaccgactgggtctccagtagtctctgaggagccgctcgaccttctcccgaccctggatctgaggcaggagatgcctcccccgcgggtgttcaagagctttctgagcctgctcttccaggggctgagcgtgttgttatccctggcaggagacgtgctggtcagcatgtacagctgagacttaagctccgcccagagccctgcgggatttctcccggtgcccacgaagtccatcccaaagcaaccagctccca

SEQ ID NO: 267046 - DNA, 1295 bp, Homo sapiens
tcggcctcccaaatcgctgggattacaggcgtgagccaccgcgcccggccaggagaccaactcttgacggagcctccctgaggggcggggcttcagagggcggagctggagccgggatagggctgcggtgggaccaaagcctgtgagagacttcccagctgtctggcttgtggactgagcaatctgcggcccggtctcgaggggaaaataggtctgtggtccgcaaggccccagtggagcccttgggttcccgcagaaccgactgggtctccagtagtctctgaggagccgctcgaccttctcccgaccctggatctgaggcaggagatgcctcccccgcgggtgttcaagagctttctgagcctgctcttccaggggctgagcgtgttgttatccctggcaggagacgtgctggtcagcatgtacagggaggtctgttccatccgcttcctgttcacggctgtgtcgctgctgagcctctttctgtcagcattctggctggggcttctgtacctggtctctcctttggagaatgaacctaaggagatgctgactctaagtgagtaccacgagcgcgtgcgctcccaggggcagcagctgcagcagctccaggccgagctggataaactccacaaggaggtgtccactgttcgggcagccaacagcgagagagtggccaagctcgtgttccagaggctgaatgaggattttgtgcggaagcccgactatgctttgagctctgtgggagcctccatcgacctgcagaagacatcccacgattacgcagacaggaacactgcctacttctggaatcgcttcagcttctggaactacgcacggccgcccacggttatcctggagccccacgtgttccctgggaattgctgggcttttgaaggcgaccaaggccaggtggtgatccaactgccgggccgagtgcagctgagcgacatcactctgcagcatccaccgcccagcgtggagcacaccggaggagccaacagcgccccccgcgatttcgcggtctttggcctccaggtttatgatgaaactgaagtttccttggggaaattcaccttcgatgttgagaaatcggagattcagactttccacctgcagaatgaccccccagctgcctttcccaaggtgaagatccagattctaagcaactggggccacccccgtttcacgtgcttgtatcgagtccgtgcccacggtgtgcgaacctcagagggggcagagggcagtgcacaggggccccattaaacatgctgatttttggagtagaaaagagt

SEQ ID NO: 267047 - DNA, 1499 bp, Homo sapiens
cgacttcacgcagggtccgtggggtccccgcggcgcgcagcggctgaaggaggccccagggccttggcgaccgcagcggcggctttagcgtcagtgactaggcagcagggggtcaggatgcggcgaagctcccgcccgggctcggcctcgtcctcgcgcaagcacacgcccaactttttcagcgagaacagctcaatgagcatcacctcggaggacagcaaagggctccggtcagcggagcccgggcctggggagcccgagggcagaagagcccggggcccgagctgcggtgagcccgccttgagcgcgggagtgcccggaggaaccacatgggcaggaagctctcagcagaagccagcgcctcggagccacaactggcagacagcctgtggcgcggcaaccgtgaggggcggggcctcggaaccgactgggtctccagtagtctctgaggagccgctcgaccttctcccgaccctggatctgaggcaggagatgcctcccccgcgggtgttcaagagctttctgagcctgctcttccaggggctgagcgtgttgttatccctggcaggagacgtgctggtcagcatgtacaggtcagaggaagggacgctggcgccccaggaacagctctttggagggggtggggagcagggccggaaccttgctggcgcttgagccgattcagatctgattgagtcatgttggcaagagctgggtctaggaccctggggtggggactggagggttgagcaggtcggggcctcagcctccctccggttccccagggaggtctgttccatccgcttcctgttcacggctgtgtcgctgctgagcctctttctgtcaggaacctaaggagatgctgactctaagagagtggccaagctcgtgttccagaggctgaatgaggattttgtgcggaagcccgactatgctttgagctctgtgggagcctccatcgacctgcagaagacatcccacgattacgcagacaggaacactgcctacttctggaatcgcttcagcttctggaactacgcacggccgcccacggttatcctggagccccacgtgttccctgggaattgctgggcttttgaaggcgaccaaggccaggtggtgatccaactgccgggccgagtgcagctgagcgacatcactctgcagcatccaccgcccagcgtggagcacaccggaggagccaacagcgccccccgcgatttcgcggtctttggcctccaggtttatgatgaaactgaagtttccttggggaaattcaccttcgatgttgagaaatcggagattcagactttccacctgcagaatgaccccccagctgcctttcccaaggtgaagatccagattctaagcaactggggccacccccgtttcacgtgcttgtatcgagtccgtgcccacggtgtgcgaacctcagagggggcagagggcagtgcacaggggccccattaaacatgctgatttttggagtagaaaagagt

SEQ ID NO: 267048 - DNA, 1623 bp, Homo sapiens
tcggcctcccaaatcgctgggattacaggcgtgagccaccgcgcccggccaggagaccaactcttgacggagcctccctgaggggcggggcttcagagggcggagctggagccgggatagggctgcggtgggaccaaagcctgtgagagacttcccagctgtctggcttgtggactgagcaatctgcggcccggtctcgaggggaaaataggtctgtggtccgcaaggccccagtggagcccttgggttcccgcagaaccgactgggtctccagtagtctctgaggagccgctcgaccttctcccgaccctggatctgaggcaggagatgcctcccccgcgggtgttcaagagctttctgagcctgctcttccaggggctgagcgtgttgttatccctggcaggagacgtgctggtcagcatgtacaggtcagaggaagggacgctggcgccccaggaacagctctttggagggggtggggagcagggccggaaccttgctggcgcttgagccgattcagatctgattgagtcatgttggcaagagctgggtctaggaccctggggtggggactggagggttgagcaggtcggggcctcagcctccctccggttccccagggaggtctgttccatccgcttcctgttcacggctgtgtcgctgctgagcctctttctgtcagcattctggctggggcttctgtacctggtctctcctttggagaatgaacctaaggagatgctgactctaaggtgaaagagggcacctagggtgggaaattggggggctcaaagttgcttctttgagaaccttgaaggcgtgggggcctttgggaggtgtccagggggacagggagccaaccccacggcgcccacctcccacctccagtgagtaccacgagcgcgtgcgctcccaggggcagcagctgcagcagctccaggccgagctggataaactccacaaggaggtgtccactgttcgggcagccaacagcgagagagtggccaagctcgtgttccagaggctgaatgaggattttgtgcggaagcccgactatgctttgagctctgtgggagcctccatcgacctgcagaagacatcccacgattacgcagacaggaacactgcctacttctggaatcgcttcagcttctggaactacgcacggccgcccacggttatcctggagccccacgtgttccctgggaattgctgggcttttgaaggcgaccaaggccaggtggtgatccaactgccgggccgagtgcagctgagcgacatcactctgcagcatccaccgcccagcgtggagcacaccggaggagccaacagcgccccccgcgatttcgcggtctttggcctccaggtttatgatgaaactgaagtttccttggggaaattcaccttcgatgttgagaaatcggagattcagactttccacctgcagaatgaccccccagctgcctttcccaaggtgaagatccagattctaagcaactggggccacccccgtttcacgtgcttgtatcgagtccgtgcccacggtgtgcgaacctcagagggggcagagggcagtgcacaggggccccattaaacatgctgatttttggagtagaaaagagt

SEQ ID NO: 267049 - DNA, 1322 bp, Homo sapiens
tcggcctcccaaatcgctgggattacaggcgtgagccaccgcgcccggccaggagaccaactcttgacggagcctccctgaggggcggggcttcagagggcggagctggagccgggatagggctgcggtgggaccaaagcctgtgagagacttcccagctgtctggcttgtggactgagcaatctgcggcccggtctcgaggggaaaataggtctgtggtccgcaaggccccagtggagcccttgggttcccgcagaaccgactgggtctccagtagtctctgaggagccgctcgaccttctcccgaccctggatctgaggcaggagatgcctcccccgcgggtgttcaagagctttctgagcctgctcttccaggggctgagcgtgttgttatccctggcaggagacgtgctggtcagcatgtacagggaggtctgttccatccgcttcctgttcacggctgtgtcgctgctgagcctctttctgtcagcattctggctggggcttctgtacctggtctctcctttggagaatgaacctaaggagatgctgactctaagtgagtaccacgagcgcgtgcgctcccaggggcagcagctgcagcagctccaggccgagctggataaactccacaaggaggtgtccactgttcgggcagccaacagcgagagagtggccaagctcgtgttccagaggctgaatgaggattttgtgcggaagcccgactatgctttgagctctgtgggagcctccatcgacctgcagaagacatcccacgattacgcagacaggaacactgcctacttctggaatcgcttcagcttctggaactacgcacggccgcccacggttatcctggagccccacgtgttccctgggaattgctgggcttttgaaggcgaccaaggccaggtggtgatccaactgccgggccgagtgcagctgagcgacatcactctgcagcatccaccgcccagcgtggagcacaccggaggagccaacagcgccccccgcgatttcgcggtctttttcctcctttcattcttcacccaccagggcctccaggtttatgatgaaactgaagtttccttggggaaattcaccttcgatgttgagaaatcggagattcagactttccacctgcagaatgaccccccagctgcctttcccaaggtgaagatccagattctaagcaactggggccacccccgtttcacgtgcttgtatcgagtccgtgcccacggtgtgcgaacctcagagggggcagagggcagtgcacaggggccccattaaacatgctgatttttggagtagaaaagagt

SEQ ID NO: 267050 - DNA, 937 bp, Homo sapiens
tcggcctcccaaatcgctgggattacaggcgtgagccaccgcgcccggccaggagaccaactcttgacggagcctccctgaggggcggggcttcagagggcggagctggagccgggatagggctgcggtgggaccaaagcctgtgagagacttcccagctgtctggcttgtggactgagcaatctgcggcccggtctcgaggggaaaataggtctgtggtccgcaaggccccagtggagcccttgggttcccgcagaaccgactgggtctccagtagtctctgaggagccgctcgaccttctcccgaccctggatctgaggcaggagatgcctcccccgcgggtgttcaagagctttctgagcctgctcttccaggggctgagcgtgttgttatccctggcaggagacgtgctggtcagcatgtacagggaggtctgttccatccgcttcctgttcacggctgtgtcgctgctgagcctctttctgtcagcattctggctggggcttctgtacctggtctctcctttggagaatgaacctaaggagatgctgactctaaggtgaaagagggcacctagggtgggaaattggggggctcaaagttgcttctttgagaaccttgaaggcgtgggggcctttgggaggtgtccagggggacagggagccaaccccacggcgcccacctcccacctccagtgagtaccacgagcgcgtgcgctcccaggggcagcagctgcagcagctccaggccgagctggataaactccacaaggaggtgtccactgttcgggcagccaacagcgaggtgagccccggcccaccttggaaacccctgatggatccctgctcccagggtcctgagacttaagctccgcccagagccctgcgggatttctcccggtgcccacgaagtccatcccaaagcaaccagctccca

SEQ ID NO: 267051 - DNA, 397 bp, Homo sapiens
ccgtttccaggctgaggtaggagcaaggacgacgggagctgagcggctctgtgttttgtcccttcatccaacaggaacctaaggagatgctgactctaaggtgaaagagggcacctagggtgggaaattggggggctcaaagttgcttctttgagaaccttgaaggcgtgggggcctttgggaggtgtccagggggacagggagccaaccccacggcgcccacctcccacctccagtgagtaccacgagcgcgtgcgctcccaggggcagcagctgcagcagctccaggccgagctggataaactccacaaggaggtgtccactgttcgggcagccaacagcgaggtgagccccggcccaccttggaaacccctgatggatccctgctcccagggtc

SEQ ID NO: 267052 - DNA, 259 bp, Homo sapiens
cacgaggcctaatgctgaatcctgcttagaggatctattttgtagagccgctttggtcccaatctttgttttcctctgggtcagcaggaaacagatgtcattctcaattttagaataagaatagtttaatattacgggactatttttaaaggtgtgggcaaagcttagggaaaccataagaaataggaaaatacccaaaagctagtaataagggttttttttttgtttgtttgctttttaatccttaggcctgaaaagc

SEQ ID NO: 267053 - DNA, 852 bp, Homo sapiens
aacccacacgccatcaacctccagaccctctcgccgtggcttagaggtgtctctgacaacgtggcacactgggaaggccttctttcctgctaccaatacaaatgcattctgaatttgatatgtcattaaatgtaaaaatacagccaatttgaaacaagcaaatggaaattcccaggaaccaaaaacagaaagaaaaatcagagctaccgcagtgctgtccctgcagacagaatttgggagaggtactcagagtcacctcctgtgagcctatgcaagccagctcctgcacaaccctggttttagtccagccttctgcagaattccacattaaacaggatgaagaataggttgttagcagactgaggtacttggggcaacatttcgtacacaacaggagggagaaacgactccagaaaaacaatcagattttggtgaaactgatgtttgcaagtgtgagtgagccccatgtgctgaagcttcaggaacccctgagatggcacaagttctgccgtactgggcaacggatggtcttgaagcacacaagacactggaagacatgagggcaattgctacacgccaagcccggtgccaagcacgttgtgcaggttgtttcgttgattccgggcctggcctttgagatctgtggaggataccatgaactggctggctctgcatcctgcttgcaggcgctggcaagctggaacctgcttttctacgccacactgcagagggccctgaatgtgatctatgattgcaacaagcagccctgatgcggatccggagggcagggatgacgtgggggctgcctttctggttgacctgctggtaagcatggcctcatggatctatcac

SEQ ID NO: 267054 - DNA, 530 bp, Homo sapiens
cagtccctgcagggtcagcagggccccagatgtcgaagcgtcagagtacagaaatcaaagatgtttggtgcagtgtgtgtgtctgctggtgtgacaggaagacagaccagcagcaagggagccttctgcagaattccacattaaacaggatgaagaataggttgttagcagactgaggtacttggggcaacatttcgtacacaacaggagggagaaacgactccaggttgtcttgtggtagaggagattttgccttgcaattttacatacttatgctacgtggaaggctgggtggcgtgacttcagaaaaatgtttcctcaggaaagagacacacagagagagagagaaagagagaaagagagaacccacctacctgttttgcaaaagtctcatgaatcatcccttcctgtggtcctgctccctgagatcctttcaccgctcacagtgggctacttctaagagcgtgcctggcacagggtcactgagagcatagtcttaataaaacaatgatggatgcttgtctctctca

SEQ ID NO: 267055 - DNA, 717 bp, Homo sapiens
aacccacacgccatcaacctccagaccctctcgccgtggcttagaggtgtctctgacaacgtggcacactgggaaggccttctttcctgctaccaatacaaatgcattctgaatttgatatgtcattaaatgtaaaaatacagccaatttgaaacaagcaaatggaaattcccaggaaccaaaaacagaaagaaaaatcagagctaccgcagtgctgtccctgcagacagaatttgggagaggtactcagagtcacctcctgtgagcctatgcaagccagctcctgcacaaccctggttttagtccagccttctgcagaattccacattaaacaggatgaagaataggttgttagcagactgaggtacttggggcaacatttcgtacacaacaggagggagaaacgactccaggttgtcttgtggtagaggagattttgccttgcaattttacatacttatgctacgtggaaggctgggtggcgtgacttcagaaaaatgtttcctcaggaaagagacacacagagagagagagaaagagagaaagagagaacccacctacctgttttgcaaaagtctcatgaatcatcccttcctgtggtcctgctccctgagatcctttcaccgctcacagtgggctacttctaagagcgtgcctggcacagggtcactgagagcatagtcttaataaaacaatgatggatgcttgtctctctca

SEQ ID NO: 267056 - DNA, 698 bp, Homo sapiens
aacccacacgccatcaacctccagaccctctcgccgtggcttagaggtgtctctgacaacgtggcacactgggaaggccttctttcctgctaccaatacaaatgcattctgaatttgatatgtcattaaatgtaaaaatacagccaatttgaaacaagcaaatggaaattcccaggaaccaaaaacagaaagaaaaatcagagctaccgcagtgctgtccctgcagacagaatttgggagaggtactcagagtcacctcctgtgagcctatgcaagccagctcctgcacaaccctggttttagtccaggtaaaggcccgcccaggtgtttgaatatggactcctcacatacttctgcagactccagctttgggttgacccatcggggagagggaacttagcatgaacccttgtataaaaatgaaaatctctttcattggaagggaagatcactgactgggctagtctcccaagacctaggaaagagcttggctgtcagagggtgagctagggaacgaactgtgcttgttgatatccacatccaagactgatggccggaggaggcagttaagagcaaaaggcaatggaccaaactacatcaaagatgggattataacaaaactttaaaagtttgtttacaatgcagaaaattcattcttctggaaacagacttgaaaaaaataaaatatttactctaaa

SEQ ID NO: 267057 - DNA, 647 bp, Homo sapiens
aacccacacgccatcaacctccagaccctctcgccgtggcttagaggtgtctctgacaacgtggcacactgggaaggccttctttcctgctaccaatacaaatgcattctgaatttgatatgtcattaaatgtaaaaatacagccaatttgaaacaagcaaatggaaattcccaggaaccaaaaacagaaagaaaaatcagagctaccgcagtgctgtccctgcagacagaatttgggagaggtactcagagtcacctcctgtgagcctatgcaagccagctcctgcacaaccctggttttagtccagccttctgcagaattccacattaaacaggatgaagaataggttgttagcagactgaggtacttggggcaacatttcgtacacaacaggagggagaaacgactccaggttgtcttgtggtagaggagattttgccttgcaattttacatacttatgctacgtggaaggctgggtggcgtgacttcaggttttgcaaaagtctcatgaatcatcccttcctgtggtcctgctccctgagatcctttcaccgctcacagtgggctacttctaagagcgtgcctggcacagggtcactgagagcatagtcttaataaaacaatgatggatgcttgtctctctca

SEQ ID NO: 267058 - DNA, 412 bp, Homo sapiens
gcactggaagggccaattgcccaccatccatcttgcaaggtagtggacacatagggttacctggcacacctctgccagacagggctgctacataatttgtagggcccagtgcaaactgaaattagggggtcccttgctcaaatggcaggaaaaacatttcttccttctttctgggtctctctcttgtcatggtgttttttacttgctatttaatgtcacatcccttggacacaggaatactcatggggagattgcagacactcacaggtacccagggccctgttcacaactgtgtaggcccaaccattcccatgcacaggctcaggtcccctcccagcagatggcagtggttgctgggggttgcttgggcaggtagctgagaacccatccctgggagggggaggcacctgga

SEQ ID NO: 267059 - DNA, 758 bp, Homo sapiens
tgcctggcccaaatctccagtactttttctgctcataaaaatctgattatttgctaatcctttagaatgtatggtttctattgacagttggaaaaggatcacttcattcacgctgcctagtcaagtgaccctagcctctttaggtaagtgattcaatatattattaataaaagttacctttggttcaagctttgaaaataaattatattgtttatgtaggtaaaacacaaagatcagaaatcaatgacatttgaaacagcaagacgaaagggagtttaacatccagcatatatgaataactacaaccctacagaaaaaaaatccagttcaaaactcggcaaaggatttgagtagacattttttccaagaagatatacaaatgtccaaggagtacgtgaaaagcttctcagcatcattaatcattaggaaaatgcaaatcagaatcacaatgagccattacctcatacccattaggatggctatttttttaaagcaaaaaaaaaaaaaaggtgtagctgctatggaaaataatatgctggttcctcaacaaaataaatatagaattaccatatgatccagtaattccacatttaggtgtatacacaaaaaagctaaaagcagaacctcaaagaggtcttgtataccaatgttcataaaatcattatttacagtagcaaaacggtagaaaaatctctaatgactatcagtggatgaatggataaacaaagtatggtctatctacacaatgaaacataccc

SEQ ID NO: 267060 - DNA, 403 bp, Homo sapiens
ctgtgtgtgtagagtagacagtgttgatttctgttttcaggagcctaacctgcagggagagctgtaagaccttctcagacaacaatgatgtggggagatgtggacaaaatcagtctgtgttcaaatctttctgaacactgcgcagttatgattttgggcagtaacatttactgagtcacacaaaccatacagaacctgttctaggcactaaatggggcagggtgggaaaaaaatacaaaagataagatataatccctgactttcttgttagagcctcacaacgtgagaaacagaatagagaagtgaattattctgggtcacacagtatgttaatatcacaggagcaaaataaagattccttgactcttaatctaagagtctaagggtgattttccaagccact

SEQ ID NO: 267061 - DNA, 441 bp, Homo sapiens
ctctctaaccatttgttttactattctgccttatgagagtagaatgaagtataaacatatatggtaattgattcagacactctcagaaatggagaatactgcatagtttccaatgaatatctcatttaaaaataatgacattaagacattcttgggcagattaagtgacttactaagacaacatatacaatagctaggtatcaaatatacatctttcggcatgagtttaagaaaccaaatttgaaacagttgcaaaaaagtaggccacatttcaccagtagagattcctttcaggcagtgtgtgctagtaaatgtttcacaactaactctctgggaaaacaaagtggatttatagcatttgctgattttcataatgtaaatactcccaccatgcccaatttcaaactaatgaggagatgacaagcagctcacaaaattcca

SEQ ID NO: 267062 - DNA, 266 bp, Homo sapiens
gccgggtgaggaacagccagctctgtacccccagggactgcagaccctgttcttggaaatgctgttcaagctgctgggccggggctttgtgccctccaagttggcacggggggtgatgaggtgggcacaaccataccagctcctgggcccacaatgggaggagcaaaccctgccccccgcagggacccctgatattcctgccctagagacgggagccctgaattctgagtctgtttcctgggccccaagtcgccccaggacaaaga

SEQ ID NO: 267063 - DNA, 447 bp, Homo sapiens
gacaaatgactcaaacacttctccagagaagacacacaaccaaccaaaaagtacatgggaaggtgctcaacatagtaactagagaaatgcaaatcaaaccacaatgagaaattaccttgtaccaggccaggcacagtggggaggtagagataagagaagttgatgaatgggtacaaatacatgatttgacagaataagacttactgtttcagagagcagtagggtgactgtactttacaataatcaattgtacatttccaaatagctataagagagtaattcaaatgtttctagcataaaggcaaatcgtgcagatgatgaagacaccccaagtatactggtttgatctctacaacttgtatgaatgtattaaattataacatgtaccccaaaaatatgcatcaactgaaaaaaaaaggatcacaggcttaaatggaaaatataaaa

SEQ ID NO: 267064 - DNA, 818 bp, Homo sapiens
gtactctctactttatgagtaatgcttaattatcagactttatactgttacacagatccagaaatgagttacatagattaaacatactggctttgttttacctgtctttaggttttaacacattttattttggatctgtatgagagatcctttctttgttttaagctgtggcagttatccatgttttttgagcttttttttttgagcacaagatgaggatataaaaggccagtggaaacatttaataaaaaaaggaacttcatggtagagtaactacagatgtttttggaagactttgtgtggattagaatagtttgaaaaactaacatttgttatgaaaactgagtgcctgtcttcagtaatgtttattatgctgaacgtgcagtccacaacttgattacctgtttttctgctggtttgttacgcaaccttgcgtgactcatttaagaactattttatctagtttctttcctaatgtagaggtaatgctagcttgagagcttcaataatttataaataaattaacttcagaatgtagctaattatttgaggattattgggtgttttaataatgtattgtatcttgtatataacttatttttgcctaagaagtaatttctgtattccattcatttccatggaacacagaagtcaaaattctattccaggaaagtccacacttctttgaagtgccacttgaatttcctgaaggaatgtttgcttcaaaaagccttgtctgctttatcactttgaggttgttcactaagtcaactgtgaaggcccataaacttggagattcgacaacttccaaaaaaatt

SEQ ID NO: 267065 - DNA, 502 bp, Homo sapiens
  misc_feature (483)..(483): n is a, c, g, or t
gtactctctactttatgagtaatgcttaattatcagactttatactgttacacagatccagaaatgagttacatagattaaacatactggctttgttttacctgtctttaggttttaacacattttattttggatctgtatgagagatcctttctttgttttaagctgtggcagttatccatgttttttgagcttttttttttgagcacaagatgaggatataaaaggccagtggaaacatttaataaaaaaaggaacttcatggtagagtaactacagatgtttttggaagacttggagggatggaggactcccatggagggagtaactgcagatgtggaggaaatggtaagagaatcagatctccaagggggagtctaaagatgggactgattggctgcaatctcatgttaaacctttatgggatgaggagtccttagggatgaccaaagaaagtggttcctggatggaatctcctacggntgtagaaatggacggggtc

SEQ ID NO: 267066 - DNA, 435 bp, Homo sapiens
tggtgaaaccccatctctactaaaaatacaaaaaaaaaattagctgggcatggtggcacgcatctgttgtcccaactactcgggaggctgaggcaggagaatcacttgaacccgggaggcggaggttgcagtgagccaagatcgtgctattgcactccagcctgggcaacagagcaagactctgtctcacaacaacaaaaaaaaaaaaaaaaagaaaagaaaagaaaaaatacttcacagggctcacagggattctaatctgcaggcctgggctatctgggaggcagtgatctctaggctcctccccagcctgcaccatcaagtcctaggtactaggtactaagttaaaataaccagcaggtgggctgggcacaggggctcatacctgtaattccagcactcagcactttgcgaggccaggacaggaggattgct

SEQ ID NO: 267067 - DNA, 409 bp, Homo sapiens
gttgggcaggagcatagatatccactggggtggacaggagcatagatatccactgggctggacaggagcaagaggaaacaagggcatgcatgatgcagtgctttgtgggtcttaacaatcgggagccattactatcttagacctgaagaggcaaagaaggaggtggtagccagggcccagggagtggagctgtagagagagcctctctctggctaccacaggccaagtctgacaggaagccaaaggccataggagcccttgggtgcaattggtaatggtgtggaggagggcagggaagagtagagacgagacctggagaggcagtgatgtccagcactgcttgcaccctgacatagactgagagcccccagtggctgcttacctcatgtggagtagacctcagtgtcag

SEQ ID NO: 267068 - DNA, 526 bp, Homo sapiens
ccgtctgtgaaatggtgttgattctcaatgcctctttgagttccttcttggtctgctattctctccgtctgtgggtaccccccatgtctactggtgggctggggtgttttaggctccatccctggctgcacaactgattcttggtatgaccttaggcaagcagctcttctttcctgaggctgtttcctcatctgtaaaatggggctaaaagaccctaatgctgtaacgatttaatgaagttgctttggtaaatccctttagtgcctgacacatatagtagaccctcatggaacagtagcatttgtaaaacccagatgccattttcactggtgcctcagagtcacatgtgtttgttgaaagggtggagtgaatggtctcctctctattctgccaagcagaagaggctcaggcaatgggctctattggactgggaaaaaacttatccctcctacccctctggctcaagtttgtgttttccctgggatgtttcccagaggaagagctgggtttcggggcatcttggaca

SEQ ID NO: 267069 - DNA, 328 bp, Homo sapiens
gacacagtcattaaaatgcagttctacctaacaatacggcaaaaaggtcctcactacgccgcgctaatagcggtcggagtcgcagcgccaggcgccacgagcctcaagcccatcacaataaccgctgggcaagagcctaggagcgcccgcccgcgtgcggtcgcctttgccacgcaacgtttcacagctccgtgccccgctctaggcccaggttcttatccgcctgccctgggaatataccccagagccggcggggctttctgaaagccggtcgctgctgcccgccactggcccgtccctctaggcaggcattgtctggcggccgcgc

SEQ ID NO: 267070 - DNA, 443 bp, Homo sapiens
atactagagagagcataggtgaggttaggctctgctctttgtcctttgagtgacacaagtacactgactctgagccatcgccagacagagacatttcttgcaagttatagtcaaatagctttgatcgttccccaaattcttgcagctctcatactgccccgcaatgtggatgtagcccactgcatggtactccacccggaaatcctccatgctccagtgcctcttcttacttttacgccagacttcctgttcctgagtagatcagtgtcagatgggtgttaggaagaaagtaatctagctgaagtaatttaggctcatcaaggtgtgaacaaacttcttaatattcatacagccgtctgcatttttaaaagagcatttgtttaccgggctactctctctctaattggagacaggttggttgggcacttcaactaatagattaa

SEQ ID NO: 267071 - DNA, 505 bp, Homo sapiens
tttaacgggtcttgtctttattcccacaatttacagcttaggtccctctcacttctcatctggatgactgcaactgcctccaaatgtgagctatctgcctccagatttgtcaccttcacgtacccactatgatcagaacgagctctcttggcaaacgtgctcatgtccctttcctatctaagatccttccatcactccccgctgtcttgttaagtgaaatacaaacttcaaacattctacattaggttgacgttcatcttgttattctcttcgccctcctctccaatcctttcagacacacacgcacacacgtgtgtacatgcaaagcacacaagagtcccgtgttctttagcttttgaatatgctgtttcttctgattctttatccttggttaggttaaactttaaatttttcaagacataagctcaagcttcatgtcttctgagatgttttctttgatcccatttcccctactctcagacatagttagaaatcacctaagtcc

SEQ ID NO: 267072 - DNA, 221 bp, Homo sapiens
cacctgttcatcataacagccaagaatggaagcaattaggggactgacttcttggatttaggcagtaattttttgttattttggtcttgattgtgcatttgatgaatttctcaaccttctacccacaactttattctacagctccttttacctcaagtgggaagcaagtgttcttgcttcttacttgatttcagctttagcatcctcatctgaaaggtgac

SEQ ID NO: 267073 - DNA, 411 bp, Homo sapiens
ggctgggcttcggttttctgctggtctccttcatggacttgcagtgggttggtaggacaactgagggatggctgatctagagtggcctcagctttgataaatcagatattttccatgtggtctctcatcttctaatgagctaacccatgcttgtattcacagcaatgtcaggaagctgaaaaagaggaagtgcacaaggcgttttgaggtccagactcctattctgtcacattctattggttgaagcaactcagaagttcggcccagattcagtaagtggagaaatagatgccacttgatgggaagagctgcaaaattaagagctagtttaaaggagggggaaaactggggccatttttattagcactccactacatagactttttgacttggcccagttcctatctgctt

SEQ ID NO: 267074 - DNA, 343 bp, Homo sapiens
taatggcgactgggccgcccctgacgaagtgactcccgggccggggagcggggccagacctgcgccagagagaactgcagggagccgcagctcggggggtggcttgccctgagggaggggaggcagcctttccgccttgtcttccttcccagcggaccggcggatccccggagccggtgcgaggagggcacccggtgcgtccccggagcggggaggccaggccgggcagccctggggccggtcggggcggcgtcactgcaccctccgccaggctccgcgggatgcaccgtggtagccgagggcggaggcgacactctcaggtgagctcctgtaggacctggct

SEQ ID NO: 267075 - DNA, 377 bp, Homo sapiens
tattcctcagtaattctttatgactagtttggtttctacttgttgcataagtataaattagggaaatcagtggataattaaagtgttctttggatttttctcttttagtatctatttagatacattgatccggtttctttaatgctgagtttctcagccttggtgctattgacattttgggccggtgaattctcttttattgtgaattgttttggatatttagcagcacagttggcctcttcccacaagatgccagtagttccatttatatgtttgtgtttgggattaaggagaccaggaccttgtaatagcaacacctttattaatggagacactgtagtccttaagtcatagcagaaaatacatctgacatatgc

SEQ ID NO: 267076 - DNA, 262 bp, Homo sapiens
ccgggtgtggtggcgagcacctgtagtcccagctactcgggaggctgaggctgaagaatggcgtgaacctgggaggtggagcttgcagtgagcggagatcacaccactgcactccagcctgggcgacagagcgagactctgtctcaaaaaaataaataataataataataataatcttcttttctgaatatgtgtatgtaaaatatatctggaaagatacaagagaatctaattacatagttcctccagggaaggaaactga

SEQ ID NO: 267077 - DNA, 693 bp, Homo sapiens
  misc_feature (587)..(587): n is a, c, g, or t
  misc_feature (594)..(594): n is a, c, g, or t
gatggtctccatctcctgacctcgtgatccacccgcctcagcctcccaaagtgctgggattacaggcgtgagccaccgcacccagcctgtgtttttcacttcttacaggaaatccatattcttagcaacatggagaggttttcattctcttattactgcagttaccagtgcaatttctttggggcaaatgaggaacttggtttccttctcaatctctggctctgggccagcactggcaccccaaaccacatgttgaaagaaaagattggatcatgaggatgaaagcactcgtcttcacccttctcactagtttgacctgacttcagcaccatgtgaggaagaacatttgctcttttgattcttaaacataaagcttaaagatgtcagctgctagaatggaaggccgagagaacaaaagttcccacctacaaccacctccagagccccagcatgaaggtagtctacaggagaactaggaggcggtggaaccacgccaagcttttgattcctgtgttttcttcggaaggtggtttaaaaaaaaaaaaaaaaaactctagggggggccccgtacccaattcaccctatantgaatcntattacaattcacttgccatccgtttacaacatccttacttgtactatcgtaatacctataagccctcaccgatcaccctttcccacagtttcgcaact

SEQ ID NO: 267078 - DNA, 685 bp, Homo sapiens
tggtgtcatatttacagaaaaactgcaaaggtactacagagaacgctcatgcactcgttcgctagctagttctaatgtcaatatcttgcatattactgtatatttgtcaaaactaagaaaatattatcagcactttactatgagcaaactccagactttattcaaatttcactcctttttctatgaatgtcctctttctgtttcaagatcccatccaggaccccacactgcatttagttattgtgtctcagactcctcccatcggtgacaggtcctcaggttttgtttttcatgatcttgaaaattttgaggcgtcgtggtcaggtattttgcagagtttccctcaatatgggtttgtccaatatttttgtcatgattagctgggattaagacactttgggaaggccaggcatggtggctcacgcttgtaatcccagcactttgggaggctaaggtgggtggatcacttgaggtcaggagtttgagaccagcctggccaacatggcaaaaccccatctgtactaaaaatacaaaagttagccaggtatggtggcgcatgcctgtaatcccagctacttgggaggctaaggcacaataattgcttgaacctgggatgtggaggttgcagcgagccaagattacaccactgcactccagcctgggtgacagagcgagactctatctc

SEQ ID NO: 267079 - DNA, 425 bp, Homo sapiens
tgctttttgtgaagcctcagaatctcctctgttctacttggcaccccaagctatgcctggtattgtatttctgacttggctcgatagttcggtggtctggcagtttttatctaccttcattattaaaaggccctctggagctgggcgtggtggctcacgcctgtaatcccagcactgtgggaggctgaggtgggcagatcacgaggtcaggagatcgagaccatcctggctaacacggtgaaaccccgtctttactaaaaatacaaaaaattagccgggcgtggtggcgggtgcctgtagtcccagctactcgggaggctgaggcaggagaatggcgtgaacctgggaggcagagcttgcagtgagccaagatcgtgccactacactccagcctgggcgacagagcgagactccatctcaaaaaa

SEQ ID NO: 267080 - DNA, 547 bp, Homo sapiens
tggatacattaaaattgaggggagaacagcaacattccgcatccgaggccacggaaactaccagctccaatggttcacagattctgcatttggtctctctacatttcctgggctgacacaatgtctctgtgaagctgaggtgtcagtgcttgctgtgaagaaaagcaatcccccagtgaaaatcagtgagaatgaggagtgagggtggcatggccccatctgattcgaaagttcgagaaattgcacggtgcccagcagacacacatatcccattattcaataattgtcattgttgaaaaatcgaaaaaatagattttaagagaaagaaggaaccaccacacattattaacatggctattatccataaaacagaatataacaagtgttggcaggctatggaaaaataagaagccttccgccctgttgttgggaatgtgatgtggtacaggggctttggaagtgagatggtttccgttaaattcttaataaagttaccagatgatccacctgtgtcctcatctgggtatatacccccaaaaattgaaaa

SEQ ID NO: 267081 - DNA, 605 bp, Homo sapiens
gaaaagctgagtaatgttagtgtcatttctgtatcaagaaaaagaagagcatacacttagacgcaaaataaaaataaagtcccaaaatagagccttgaaaataacgagaattccctttaaatatatatttgtggatctgtttatttagcatctttgttatttcttatgttttgagctccaaataattcttccatgcatgaacagtttgaatatgacttactttcagtttgggggcttggtttcttcatattttttttacatctgaatcattgtagtaattcagaaagttgcttaactttcactgccccaatttcttccccacttaaagggagagttatcctaaatcatctcgaaagccttcctacactaatgttttatgagtttatgattcacccatgctacacattgtataatgtgtctcagccaaaatatgtttaagtagagaaccccgattgaagtcaaaagtgaaatatgataaatatgtcatctttaaaaagtttaaatttttaaaggtggtctggccttggataaaatgggatctgccatatactaatgcttttttaagcctggagacatctaagaaggcgcctatgatggtataatgc

SEQ ID NO: 267082 - DNA, 362 bp, Homo sapiens
ctgcgggcctagaggccagagtgctggcggatgggcaggtcctgaccacgccgtcctccctgggagcttactggtgagacgctcgtctgcctcagggggcccaataatggtcacttgacataaagggacagaggtggtctgtccagggtgacggtgaccactgtcctggcatgtgacggagcccaggccctgggcaagcgccatgctgagaggggctggccgcccgctgccggtggcctgactcaggaaacctcgctcccctgagcggcagctggaggagaggcagcggcagtggaccttggagcctcccagctccggaggcctccttgtgagagcaataaaatgtctttgaaaggaggctg

SEQ ID NO: 267083 - DNA, 458 bp, Homo sapiens
gtcagcatcccagaacacggctccagctgacgattgcacttggcacccatatcctccgtgcgacaacctggtgtcagcagtctcggagcagaggtctcctctgcaccctctttaatccagcagcgttcctcagagctcaggagccactctggacttttctgggcaacatgagggcagctttctcaaagccccttcaccagggcccgcagcagcagcggagagcagacctacagtcttcatttgcaggaggtcatgacccagagaaaataacttcagaagactgagacatcctccgtgaaggaagaaggggttatgaaattattctcctgcttcctcgctctgaccctgatgatcaggatttgtctaaagttatggaagtcttcctgaacttttcttattaatttgaaaaaaaaaaaactttctgtcattaaacaaatacacagaaaacaccaggccca

SEQ ID NO: 267084 - DNA, 740 bp, Homo sapiens
ctcccgagtgttggagtgactgtttgcacacatctgttgtgttttgcctgtgtgcattcctcctcctggtcagagagcccgtctcttccgccctctcccttaccctaggagggctgagtcaggcctccctacccaggcccaagggcagatgcacctgagccattgtgtcccatggttgatacgggacggggctgatttcctgacctggacccctgagacccagtgctcttagctgtgagcctctgggaagaggttctggcaggtggaggggatggacgttacagtgctgtggccacctagaaaagccgtcccggaactgagaccaactgctgagggaggaagggccaccagatcgggggccgggccggggtgagcacctgaagccggctccacctgctcttctcagctgtgcgcctccaggaatttgcactcgcttcagctgatttgggttggatttctagcgtttcacatacaggatctagactcgcacacaactgcattaatatgttggtgtttgataaactagggttgaaggagttccatcagtgaagagagaagccacgtgacctgaggatgcagggcactgttcacgtggacatgagccgtttcttagcatcatgagattttagaaacatgttcttactctgccaggacccagggataggtgaggctctcctattgggataccatttcaccagcagagagattaattggagaatgtgtaattttttcccctttgg

SEQ ID NO: 267085 - DNA, 682 bp, Homo sapiens
cgtctcattgcagcctcaacctcccgggctcaagcgattctcccaactcagcctcctggacagctgggaccacaggtgcatggcaccacatccagctaatttttctgtattttgtagagatggtgttgcactattttgcccaggctggccattttttaaaagtcagcttcctaatcagggctctttgagtaaatacttccgctttcatagtaccgcccacttccctatttctgctggaaatcttacttggtcaaggcagggatttcatctgcgttattgatctccagatcctcatcaatctagaacagtgtctggcaaaccgttgatgtttaatacatatcacggattatgtaatgcttactatgtatctgtgtgagagagaagaggatatctacattggtatctgtggaattttctacttcagtgtctaatttctgatgtattcctgagtcacctgttgagacttattctgtctttcggagtgatgtgcatgaacccattattggaggagatcgcggtattggacatctgtctcaaagtctctatacactgagaactgcttgtcccaaccataggcctctataggtccaccagtctcttagcaatttctttatatatatctatatatgctggagtgcaatggcaccatcttgacttgctgcaacctccgcctccctggttc

SEQ ID NO: 267086 - DNA, 437 bp, Homo sapiens
caacttgaaaaaaattttgaggatctaatttagaaaaatttgcccaattttgttagacaggtcaacatgcagataaaagaaattcagagaactcctgtgatatactatataagaagaccatccccaagacacatagtcattatactatccagggtcaatgccaaaaaaaaaaattgaagtcaaactattgctctttgctgatggtataattctatccatagaaaaccctaacaactccacccaaagactgctggaactgaaaaacaaattcagtaaagtttcagaatataaaattgatatataacaattggtaacatttctatacatcagtagtgttctagctgagaacaaaatcaagaatacaatctcaagaaaataaaatatctaggaattcatacaacaaagagatgaaagatttctacatgaagaaccacaaa

SEQ ID NO: 267087 - DNA, 364 bp, Homo sapiens
tttttcctggccattattattactcagttcattaatcagttcagtataaatggggaaaatatttttaaaaaacaacccccctaggctgggcgcagtggctcacgcctgtaatcccagcactttgggaggccgaggcgggcggatcacgaggtcaggagatcgagaccatcctggctaacacggtgaaaccccgtctctactaaaaatacaaaaaattagccgggcgcggtggtgggcgcctgtagtgccagctactcgggaggctgaggcaggagaatggcgtgaacccgggaggcggagcttgcagtgagccgagatagcaccactgcactccagcctgggcgacagagcgagactccgtctc

SEQ ID NO: 267088 - DNA, 755 bp, Homo sapiens
gagcaaagtatggttgagaaattgtggcagaaagaattttaaatgttagtcgaagttgtctgtagtttctttattaagctctgaaaacacttccaatgccagtttgattctgagggcttgggaagtgggatctcccttgtggagcagctggagctggctgggagggagcctctccatgggtaatttattatgcctgccctgcttcccccagggagctgcttcagtgtgaaatgatgtgattgtcgggggtggggtgggaggagggccaccttcagtcggggagttgctcacatattacacaggtagcatcaggtggacttcagcgctgaactgtactagtagtgagtccctgtagtcaatgtgcaatttctctaattctgagaaactctgtagactctgcctgggttttactgggtcagcatagaatgctatcagtttacctctgtgaaatattcagtcagttgaaggaaacttggattcctagtcagaggtgactaaaagttaccctgaccaaaaggatctctgcggggggaagagaatggagcttcctgattttaatgtgttgcgtcagtggccctcttcgactcccgttttgggtagatgcgtagctcttcactttcttacctcaaggctctgtctagccatgttaaatctttagactcagtctgatgccgtttttctgttttgccattctcattattcacagctttcagaacaagtgtgctaaaactccggggcctttgacagttgttctg

SEQ ID NO: 267089 - DNA, 371 bp, Homo sapiens
cctgacaactctttgccttcattttcctatctgtgaaacagttttgctcattttgctacccttagaataaattctacaatgtctatgaatcgatttaagccccttcctagaatgacaactacaggaggctgcttcaagggtgttcgtgtagcccaaacctcccttttctgaaagaaatgcctccccctgcacaggactggacaccaggagccagatcactcaaatgatgctagcccctggccatagttagctgagtcaaaggtggatcaaggaagccaatctctaattaagctggacctactagtgtctgtctctcttgggacaggtcagttggttgggagcctgagactggggaacgatgcagagacaag

SEQ ID NO: 267090 - DNA, 327 bp, Homo sapiens
acaggaagtcccttgccatcctaaaagccaccccacttctctctaaggagaatggcccagtcctctcccaagtccacacaggggaggtgatagcattgctttcgtgtaaattatgtaatgcaaaatttttttaatcttcgccttaatacttttttattttgttttattttgaatgatgagccttcgtgcccccccttcccccttttttgtcccccaacttgagatgtatgaaggcttttggtctccctgggagtgggtggaggcagccagggcttacctgtacactgacttgagaccagttgaataaaagtgcacaccttaaaaatg

SEQ ID NO: 267091 - DNA, 286 bp, Homo sapiens
aaaatcagaaagaactcaaatgttcatcaacatttcttcaatggatggatcaattaagtcaactcagataatgaaatactgtacaacagtgaaaaggaatgaaacacagcatatacagtaacacatatgaatctcaaaaacatgctgaatgaaaaaggcaagttagccgggcatagtggcccatgcatgtaatcccagcactttgcaagtgcaaggcaggaggatcgtttcagcccagaagttggagaccagcctgggcaacataatgagaccctgtctttactaa

SEQ ID NO: 267092 - DNA, 499 bp, Homo sapiens
tgggtgtcacttagctctgaaaacataggcatcggagtgtagcagactgactcagagtcctcccaagatgcagattctactgaaatccaaacccaaggggtctacaaaatggatggagtcttactctgttgcccaggctggagttcagtggcacgatctcggctcagtgcaacctctgccacctgggttcaagcgattctcctgcttcagcctcctgagtagctgggattccagattgtactttcggtgtcatgactaagaactctttgctgacccctggatcctgaagattttcttttatttttttcctaagattttatagttttattttttcatttaagttacattcatttgaattaatttttatctgaaaaatactgtttttctttcactgtaggcttgtctctgtataaattcaatttgaaaatatggcaatatgtatctttgattttcaaatgaacaagctcataaatacaaaaattaaaggcataacaagaaa

SEQ ID NO: 267093 - DNA, 411 bp, Homo sapiens
gcccagggcgccgtggggtcccggggcagctggtggggccgccaaagggtggccgtgtgtgtggcggtggcagctggggctctggcagtgggggagggtgggcgggaggcagcagctggtggctggccccaggccagctggagcctgtgcagagggagggcgctgggtcggctcacgctgcctctgggtccccttctgagtccccctcagcctttctcggttggtctccatctctgtctttgtctctctgtctctgtctctttctgtctgtttctctctgtcttctttctctgtgctctctctgtgtcagcctccctgtctctgtctctttctcttccccatctctgtctgtctttttgtctctgtctctgtttctttctgtctctgcgtatctctttctgtccctctgtc

SEQ ID NO: 267094 - DNA, 331 bp, Homo sapiens
cttcaggcttggtatttccctgcctcctctgtgtatttccaattctttgacgtcacgaattttctgttttggacagctttgccttttccaggaggtgaatggtacggggatgactcacagaagtcttcagataagaggaggacaaaagagacccttgttcagtggcagaagtacctgtaaagccttagctttgcctgagatatgacctataactgctctgatttttggaccccagaaaacccttgaaagctcagcttccttattgctgcgtggtcaccttatcacagcactgcagagcctaggaaataaaggcacagactctctttagaaa

SEQ ID NO: 267095 - DNA, 362 bp, Homo sapiens
gtgacaatttttttttatcacagccctaactctgtgttaagtactatgctggcttctggggtacaagcatgagtggtaacagaccccaatgctgcctgtagtgcatccagcatagactgtcaggcagtgagatgcagcaggccccttgcaatagctgagatttggagctagggatgctgtgtcaatgtggatcaggcaatggtactttgaaaggtcatcattataattttattaagctgtgatgagagtgagaagataaatatagaaatgtgtttagtattggatacatattatctcacagaacaattatgaattgtgtttcttgtgtacattaaaatttggatatatgtgtaagagcaaaa

SEQ ID NO: 267096 - DNA, 438 bp, Homo sapiens
atcagttcagcccaggagttcaagaccagccagccccgaaaacatagtaagaccccatctctacaaaaaatttttttaaatagctggatattatgatgcatgcctgtagtctcagctactcaagaagctgaggtgggaggattgcttgagcctaggagctcaaggatacagtgagccgtggttggaccactgtactctatcctggatgacagagccagaccctgtctccaaaagcaaaacaaaaccaaaccattatttagcaaggcattgtacaacctaagtttaactctatcaggtaggtatgatgagccttgtttgacagatagaaagattgaggaatctatggaaggttgcacaaaggacacaattagtccaagtcagcctagtctcagaaccagtcaatttacccatgacacacacttcattctaattgggttt

SEQ ID NO: 267097 - DNA, 456 bp, Homo sapiens
ctctttagtttgactacattcattccaaatttaagagtgagtcctaagttaggcttgtttccttgaactatgtgaggagaaaaagctttaactagcaaaagaacgtattaaacaagatttggagaaaaattccttttccaccttaaaaaaacccaatgtacaactctggattactcttagcttccttatttcaaatactttccagtttatgtacttgaaataaatacaacaacttctagaacagcttgcagttcagatctggcttttactaattgtaatcaaacataattctggaggaggaaagaaagaaaggggcaatgaaggaatgggagagaagaaagagtaatgcaggaatacattctaacggttccccttcaaggggcagcatggcagagggggctggggtggaaagtgggttgcaaaatctacgaagagttgcgatagggaagaaaccag

SEQ ID NO: 267098 - DNA, 125 bp, Homo sapiens
aaactataaacattaaaggtagatctttaagggggaaaaagaaataaatttttaaaaatatcaaggttgaataaaaaataaactcaaaaataattataagaattagtctacctaaatgagaaaaa

SEQ ID NO: 267099 - DNA, 340 bp, Homo sapiens
cttccttgtcagctgagaggataaactgaagcagtataaaacttctctcacacagccacttcctgttactaaagaaattcttcagcagaagaatttgctggcactttccactttaaagtgtccaggcagctgtgactacaagaaggtgaggagatcatgctactagaaagaatgtttaatgcagggacaactctttcctgggaagaagtaacccatttaaattgggttaccaagatcagcacaactcatgtcgatgattttttgtagttgtttttgtttcgttttgtatttttgtaagaaaaagcaaggtttcattgattaaaggagttgtttgactttg

SEQ ID NO: 267100 - DNA, 457 bp, Homo sapiens
gttcaaacctctattgccataatcttcgataccaggtttaatggttgacagtagataaaagtatttaagaattctttaatgagtttagaaaattggattttagaagatggcaagcattattggtagttaggatatttgtgtcctgttcaccttttatgtcaggtgatattttctgcatctgtcacagactagctttagagttaaaaagaacaagtgccagaagcagtcggtgtcctcaggcattagtctctgctgtttcctcattgatgctttcataattgtgtaattttttagcttacaatgatataacaagtccttgttgttttcgccaagccataaaacatttcccagttccagctctgtaggatatcagtgtgctccttagatggatggtattaggctgtgtctgctgccctctgcactacatagacaccctgatatagtttggctgtgtccc

SEQ ID NO: 267101 - DNA, 416 bp, Homo sapiens
ggggtctcaagagatctttgtctactccaaggttgggaaaaccttcttctttgttttcttctagaggttttataattttagctgttatatataggtctgtgatctatttcaacttaattttgggtatggtgtgaggtgaagttggaggtgtcccccactccatattcatatccagttgtgtaccatttattgagagatctctccctatggaatcaccttgttcatttgtcctttaacaatgttctttaaacaacatttcttaaaaaaattagcggtgcttggtggctcgcacctgtaatcccagctactcaggaggctaagcaggagaatcgcttgaacctgggaggcagaggttgcagtgagtgaagattgtgccactgcactccagcctgggcgacagagtgagattccgtctc

SEQ ID NO: 267102 - DNA, 190 bp, Homo sapiens
atggagcaaagatggcatgagatttcatcgcgctactcagaactgtgtggaatttcaaacttatcaattgtttatttctggaattttcccttcagtgaaaccaaggaaagcaatatcacagataaaggggatttccgaatatataaacaaaaagcatttactgaatacaagaataaactatttctgctcc

SEQ ID NO: 267103 - DNA, 645 bp, Homo sapiens
attcaaattgtttgatgttgtatctgcttgataattcttcaaaataatagagctatgatctcagcactgtacttcagcctagacgacagagtgaaacccccatctctaaatattaaaaataataaaaaataaaatgcaaatattataatatcttgcaaaccagcattagtgaatttggattatataggatcttatcactcctaccactttgatattttttaagttagtattttcactagactatcacaatcattttacactgttagacctaggttttggggtttttttttctttttgtttgttttttaattcttaaaggatgttggactttttgaaatatttttttctatgtcttgttgagatgatcatgtgggttttgtctttatctaacctacatctataaacatttaaaataatggtgatttatttgtagagatagtagagagtaaaacaagcctaatttattatactaaaactagataaattaaactctcagacataatgaattgagactgtcttaaataaacatcaagcatcaacatcgcatctttagtatcagtgtagagccatgtcatgagttattgtttatttgtaacaccagccttgtctatccacaataggatatcacttttataacctccccct

SEQ ID NO: 267104 - DNA, 1047 bp, Homo sapiens
gtggaaggatcacttgaggccaggagtttgagactagcctgggcaacagagtgagactctgtctctacaaaaaataataataataaaaaaagctgcatatggtggcacacacctgtagtcccagctactcagaaggctgaggcaggagaattgcttaagcctaggagtaagccatgattgcatcactgcactccagcctgggcatggagtgagacactgactcttaaaaagagacgaaaaagagtatcagagacagaaatagatccacgcaaagatgcccaattgatttttgaaaaaggtgcaaaaccaattcaaaggaagaggcagagttttttcaacaagtggtgttgaagcaactggacatacatggcggagggggggaaagaaagaaaaagaaaaatgagccttgacttaaatctcaaactttaactcaaaatggaacatagtgtgaaatgtaaaaatgtaaaacttttcaaaaaaacacaagagaaaatcttcagacataagattaggtgaggagttcttacatttggcatcaaaagcatgacccataaaagtaaaaattgaaaattatacctcatcaaatttaaaaactttgctctgtgaaaaactctttcaaggagatgaaaaaagacaaattacaaactgagagaaaaatttgcaaattatatatcccacaaaggacttatatctggaatatataaagaactctcaaaactcaacattaaaaaaaaaatccaattagaaaagaggcaaaagacatttaactgaaaaggatacacagatgccaaataagcacatgaaaagatgttcaatatcattagccctcaggaaaatgcaaattaaaaccacaatgagatattgctagaaacctatcaaagtggctaaaataaaacactgtgacaacaccaaatgctaatgaagatgtggagcaaatggatcactgacatcgctggtcaaaatgtaaaactgcacaatcactctggaaaatagtttggcagtttctttttttaaaaaaaaaattagtattattatttattatacttt

SEQ ID NO: 267105 - DNA, 419 bp, Homo sapiens
caataccccttccgctctcattggcactcaaaattcggagcaggtcgagttggcagggggctggtgtatcagcaaccccctgagcatgtgcacatctggccaggttgtgacagtatccaggcttggccacaactttcctcacccctggagtgggcactgagagcagagagaggccagggagtgggatcaggcactttcaagcctgtgggggcaggagacttcctgggcccccaagagcgcagggatgccatggtctgaagctgcggctgggaggctgctgctacacctgggagcatgggcccctgacccaccaactcagtaagtggtggggctcttgcctgttctcagttcccccaggctctgcagagcgcacatccccacacctcaactgctgcagtcggcatcctcgcagcggccgc

SEQ ID NO: 267106 - DNA, 216 bp, Homo sapiens
tgtaaccacattattatgaagaacaaaattacagctgaattaaattttgaaggctgtccttgagaatatgcatagaaagttttgtgttacctaatagataatttgtgagcctgatgtcattcaaaagccagagaagaaatattcaggctaaaacaaaacttcctactttcttagaacaaagagaatgtacttcttgttgggaagctaaatcctagg

SEQ ID NO: 267107 - DNA, 206 bp, Homo sapiens
aaccagtctctactgcctgaagacgccccatagatgtgacaaacagaacaactgatgcagaagcaaagaaaaaggtctgggctcagaattaggaatcctgtgttctagtcctacttacttctggtgctgattcaccacgtgacattgattaagtcacctaatctctctctcagtctgaggtttgaccagttcatctttagttctga

SEQ ID NO: 267108 - DNA, 373 bp, Homo sapiens
gagcagtcagcatgttctctcagcatgatgtttgagctctgagaatggacagactgcctcctcaagtgggtccctgaccaccgtgtagtctaactgggagacacctcccagcaggggccaacagacacctcatatgggtggaggcccctctgggacaaagcttccggaggaaggatcaggcagcaatatttgctgtactgcaaaatttgctgttctgcagcctttgctggtgatacccaggaaaacagcatccagagtggacctccagcaaaccccaacagatctgcagctgagggacctgactgttagaaggaaaactaacaaacagaaaagaatagcatcaacatcaacaaaaaggccatctacaccagca

SEQ ID NO: 267109 - DNA, 407 bp, Homo sapiens
agccaaaacataaaagattgtttaatagttataaaatgaacatttaacacaaaatttctgggagcaaatatgagaaaattctgctaatatataaaagataactatagaaaagggccgggtgtggtggctcatgcctgttaatcccagtgctttgggaagctgaagtgggagagtcactagaggctaggagttccagatcagcctgggcaacatagcgaggcctggtctctacaataaataacacttttttaaaaaaagtagctgggtgtggtggcgtgtgtctgtagtcttagctactggagaggctgagatgggaggattgtttaagcccagaggtttgaggttgcagtgagccatgattgcaccactacactccaagcctgaatggcagagaaagaccctatctc

SEQ ID NO: 267110 - DNA, 238 bp, Homo sapiens
tttcaggcatctatagtagaatcttatactatctggaaaaatccaagtgttagaaagtggtttggtataagaagcctagaggaaatttaataaaataccaaaggaaatttacaaatggcctcccttatatttccaataacctttttctatttttgtgtgggttagctcctgtccaagaaacaaataggaggaagaaaagaaattcgtgtgttgttactaatcagctttcataatcatg

SEQ ID NO: 267111 - DNA, 387 bp, Homo sapiens
tcagcttttgagacaggagtcttgctgatgccccctgcagaataaaccccttccttccttaactcagtgtctgaagagttttgtatacggctcgtcctgctacagtaagagactgaaactgaaagttaattcttccaattctattactttctcatgccattgaggagactctaaaatattttttcacaacaagtagtattttatttaataataggtctttgtgaatttcccaattttaagtagaattatatatctgcaatattttctactgaaatatgactttgaaaaaatcaatataacacttgccgtcatgttatttggttagagcaggagaaataaattattattgtagaaatgaaatacagcatgtttctggcatttctttta

SEQ ID NO: 267112 - DNA, 273 bp, Homo sapiens
gtgaatgcccaaaataatggatcagtaaatagttgcatggattcaacaagaaataagcatcaaataaaaataaataatgacagaaatagattataacctgtttaataaaaggactctatgagcccaggttatacgttactgtgcaatgtcaattgatagaatgtagaagaaatggtggaattagaatattgctatttcataatgataactataataattcattcaagaaatattaatgcccggcactttgggaggctgaggtgggagaattgc

SEQ ID NO: 267113 - DNA, 459 bp, Homo sapiens
catttttcatcacccttctggtaaatacttcctaattttctctaggggatgtgctttccccatgtttgatctgtttttttctgagaggtgtttggttcatcctggttgtagggttgggtttgtgatataggcatagcctctcagaggcatttggccataagtcttatctgggtatgggctcatgaccccaggtcaatctagtcagatctgctgatgttaattctgaggctcttttctttccttacttttgtatttggaggtgtaaggatgtaatcccacgttcttggtcataatcttgtcatactatagaaagggactttttcaaaatgtagttaattcaaggaagaccagagttgagagaccttatatcatttgtgctcctggatgaagctgtacctgaagctaggttgtcccagaattctgttagtaaactattaaatttcttttttggttatacta

SEQ ID NO: 267114 - DNA, 295 bp, Homo sapiens
tttggagctatgacttactgatttacagccagtgaccccgttgattccacagtagccacccagaaaggaggggtctggaagacagcttttttcccctgaccagtgcctcctaagacaaaggagccagttcagcctacagataggttttctccattcctactggagagttctatttgtgcgtataggtttggtctgagctatgaaatcaagtgggttcctagggtttatcgggggagcacactatatatttacagttggaataggcggtagacacacgagcatatttcacctccgc

SEQ ID NO: 267115 - DNA, 330 bp, Homo sapiens
gcccatctgaaaacttgtacacaaatggtcacagcagcattattcaaaacagccgaagagtggctctttgttagttgatgaacattagtgatttctagggattgttggggcaggggtaagaagaaaaatggaggtgattcctgaagggtacaggctttccgagttgaaaaaatgttctaaatggattgtggtgatggttgcacggctctatgaatatactaaaaaccaacaaattatacatttaaaatgggtgaatcatatggtatgtaaattatatttcaatgaaacttttagaaaaaaaggcaacactccagcctgggtgacaggaaa

SEQ ID NO: 267116 - DNA, 423 bp, Homo sapiens
agaactcaactttttaaagacagagatcagctttaaatattgctaagaaagaacttggagagagaagttggtgataccggagacagcaggcaacagacagagtgagaggcccgaagaacaagaggaggagggagtctcttctgggagcagaaggagtgtcgacttaaatattagggagccaaagatgaacctcgcagagaacctgcaaaacccagttgcagaaatacctgcccacacctaaaaactcagtcactgaaagtctgaagtcaaatgattatgtgaaatcttagtagtgggtacatgtggtttcattagattattctttgtatctatatttgtactatcttataagcactataagttttaaaaccatacaagaggctctatggaaaataaattggacttcattaaaattcaaaacgt

SEQ ID NO: 267117 - DNA, 641 bp, Homo sapiens
ccggactccacggacaggacggggcttgggttgctcttaaaggcgacataaccagattttcttgaagtaaggtctaggatactcacagaaatgtgagggacctatgatatcggattgtgaagcacagcaagttctcaacggctacaccgccaaagggacacactataccacaaaggcactctgtctctactcatgcctctcagccatatgttgcttttcaaatacacatacagttaaactttgacttctatttattaagcttcaatatggttggtccaagagaacaaagaaagactacatggctgggaatttgcacaaaagaagacaggagataccgacgtagattgaaagggtgacgctgtgcctctggatccagaagaaaacatcattactgtctgtagagtcagtgattgtgttcctaccaagagtgcaatgcttttattctaataatacttattacttcatgtctgaaatattttacatttattttaaaagtctcaatcctgtctgaaaatgagagtgactgatacatgccatttcctgacaggacattttgtgccattccatagttggagtatatgtacacagggaacgtattatccccaataaaaactgtgaactttcatgatcttaaatccttc

SEQ ID NO: 267118 - DNA, 547 bp, Homo sapiens
aagtatttttgtgggtgtatgttttcatttcccttgggtatacatacttaggagtaaaattgctgggtcatatggtaagtctttaactttttgaggaaccccaaactatttcctgtagatgttgcaccattttacatttccaccagcaatgcgtgaagatacatattacctcttaatcctcacaatagccttaagagttattatcttaattttttaagtggggaaactgactcccagagagattcagtaccttttccaaaaatcacagagctaagaagtgacagaatcaggatttaaaatctggcagtgtggctctacaatctgctttgaactttaacataatatgtacaaagcctgaagcaacttctcagtactgtatttaagagggcatagcaatgtaagtcttcctaaatcaatactttataaatgaagcagcttaaaagacttccaagtttcaatcttacgatatttatttatcacacaaatcaatatacctaaactcatctgtataaataatgtcctgtagtaagaagaaaacgaggaaaga

SEQ ID NO: 267119 - DNA, 330 bp, Homo sapiens
accctttactaaaagattaatagatgcatccatcattactaaaagagtggcgactttgagactgtgtttaatcacgaactccttcattcatccaactgatacgtattgagctcctacttcaaagtatgaatcttctacagaattctagtaggtgaaaccaaggatcagcacacattttctgtaaaggaccagatagtaagtgttttgagcttcatgggacctacaggtctccttttcaactacttaactctgctattgtagttcagtcttacagtctttaaacaaatgggtgtggctgtttcaataaaactttgtgtacaaaaacatgaa

SEQ ID NO: 267120 - DNA, 439 bp, Homo sapiens
gggtgtgtgtgtgttggggggggagctgaagttaatggtttatctatggtttaggaagtgccatactgatatagtaaaccacccccattcacctaatcctccttttaattaaaaatggattttccaggaaaaaaaaaaaggcccttatatttgtcacacttaagtgcctgcttagggaaggtattgtgaaaaagtattagaaatcttgagatcagtatctattttatgatcagaaaaaaatactcttttgtacatttctgacagttactcagaagatcgttcaagcaagctaatcacagcattgtaactagaggacagttgtttgcagtgagtttttccttaagtaggtacgattttttaaaatattctgtgattctactctagcgtggttgttgagagagtttcaaattcagtgatacaggttctaagactgaaaggt

SEQ ID NO: 267121 - DNA, 831 bp, Homo sapiens
taaccattttagcaatataaatatatataaagaaaaatatcaagtcttatccctatcatggactgtgatctcactcttcctcaatatactataattatcactcagcaacttttcccccttactttaatcaaggaattcccactaggacaataatatagagctaacttattcttcaataactgcataatagtccacagtgtagtaataccaaaatttattcaatcaatgccctattgatggataattgtttctagttttttgccattacaactaatgatgcaataaacatccttatacatttatcctttcacactaacgcttttatttataagaaacagattccttctcgggattgtttgatcaaaggaaatcctccttttttactataataggtagcatcccatactaaaaatgttgtcacaatttacactcactggtagtgtatgagagtgcccattttccccaaacgttatctcagctcttgatgttattataggctgactgatactttttgataaagcttatttgcatttgtctctactgaaagtggaaacattcactgtttcaatttagttgattgctgactaataggaagtttgcaatcttaggtctggtggatttaccaacttatgacaaggtccatctgacctagtaatagagagagagcccaagggaaacacagcatatgaaaatctattgtttcagttcctgaatcagacacaggattcaaatgccacagataggttaaggaatttggttccaaatctattgctctcagattagtaagacagactctggaaaggaccagagcttaaaattacaacttaccat

SEQ ID NO: 267122 - DNA, 165 bp, Homo sapiens
gagattacaggcatgagccaccgcgcccagccagtggtgcatattcacaaaagaaaataagataactatggtttagaatataacaattattatttgtagaagcatgttactatcttccttctatcatccaagaatgacagagataattaaaagtctgttaaaatg

SEQ ID NO: 267123 - DNA, 438 bp, Homo sapiens
gtagagactgggtaggtaggtagggagctctgagggagccaggcaggagggtgacaagaggacagctgtgagtgccacatcaggttaaaagagattaggaaagaactctggagtgtaccggggggttcacaccaggactctttttactgtgggacactaagggacacttctcagtcttagatgtttacctttcaattagaaattaaccccgtgtatatgtgtgtattttatcagtaatgcatcattatgagtgatgactttcttttgtaatagaaaacctgcaaatagtcactacaccatgtacacccttacagatgtattaattactctgtaatttttttttagcaacctaattaaactggtagtcaatttaaagctgaagttaatgaagatttcctttgttgtgagatagcaccttcccccaactccattaaaaaa

SEQ ID NO: 267124 - DNA, 253 bp, Homo sapiens
taccagggactagtgtgggtgagaagttattgtttaatgggtacagagcttctatatgggatgattaaagagttctggaaatggacagtggtaaaggttgtgcaacttggtgaatgtaatgccctctgaactgttcatttaaaattcattaaagtgacaaattttacagtatgtgtattttaccataatttaaaaaagaaaaataaagaaaaaatatgtattcccaattgcactgtatttttggttattaagc

SEQ ID NO: 267125 - DNA, 399 bp, Homo sapiens
aaatatagcgggaagaggagcacatgacacttctatggagatgctataaccaaaattcagaccacaggaaactacagaacaaacaagccagtttcttcaacaaataaattgcaaaggaagaaaaagacaagggaagagaacctacaggttaggagagatacaaaagcaatcccaaccgatggcaacattcgaactttatttggatcctgattttaactagctaaagaaaccctttagctgggcgcggtggctcacacctgtaatcccagcactttgggaggccaagccgggtggatcacaaggtcaggagttcaagaccagcctggccaagatggtgaaaccccgtctctactaaaaatacaaaaattagccaggtgcagtggcgtgcacctgtaatct

SEQ ID NO: 267126 - DNA, 364 bp, Homo sapiens
agaggatgtcactcccccagacacaaaggatgctttatccagaaaccatggatagcgcctggcctgagagagagagactccaggtcctgccaccaatgcactatgaacaggcatcccacccagaaaacgttcctgctgacactggtagggcctatgtcatcatcatccattcattcactagataacatcaagcaccttctctgtgtcgagcaaggtactgaggttaaatggtgacgaatgctgtgttcccgtggtcaccaaggcaattttgatgaggaagctgataaaaaagcagacaatggcaacccggtgtgatttaaataataataataataataataataaaataaaaaccatgagagca

SEQ ID NO: 267127 - DNA, 399 bp, Homo sapiens
atagtactgaggctttatgaggtccttgggtccagtggccactggtcccacatggttcaggagtgaccttagggaagaatggaacttacacactttggaggaataattgtggggctggtctggaacccctaggctcaaatgatgtgcccaactcggcctcccaaagtgctgggattacaggcatgaaccgccatgcctggcccttgatttttctttttaagaaaaaaatatctaggagtttcttagaccctatgtagattattaatgaacaaaagattaaactccaaatattaaatagtaagcctgaaggaatctgaaacacttgtacttccaattttctttaaataatcccaaatagaccagaattggcccataccatagaagaaagaattagcagtc

SEQ ID NO: 267128 - DNA, 119 bp, Homo sapiens
aaacacctgacagttttagaatcttttcttggtttctctgagaactttgttgtgaatctccctcaagttacttaaatgattttaaatttttgggaaaggtgaaaaatacagaaaattac

SEQ ID NO: 267129 - DNA, 437 bp, Homo sapiens
tccaggaaacacctctggctttgtctgcctcttcctacctcaggtggcaagtaggggacaatccccagcgaaggaaggtacagtgggattgatggctcaacctgtggtcagctgtcgctgcaatcgcggcttcactccctgcccacaggggcacggtgggcaaactgactcctctgcatttcagtaacctcggctgtgaaataggaggcctctcaaaagtgactgcaaggactacgggaaatgatataaatgtgtgcatctatgtatatagttaatatttcctctttaatatattttatacatatacagcatgtattttataaatctataaagggaacgggatggagggaagtgggcttagcaagcctcgattggttatttttgctgggggggaggggatgtgacaattaaaattttggaaactgagtcggctgcaa

SEQ ID NO: 267130 - DNA, 494 bp, Homo sapiens
cttccttcctccctttcttttctttttcagaaatatgtactctatttctgaataacctattttggaaatcataggttaactcttctaggtcaatcaaggagcagacaatagattagtgctttaataaatcaagggcctccacagagaataaacatacatttataaaattatttttactctctgatttcgctttcatcctccatttttgactggccatcttttgtcttccaaatcttcctagtaatttctttagacttttataagttttgctgaagactagtctttcctgtcaatgtgtcagctcattttttattctgttcttatcctcagtccattgtttatatttcctaaaattgtgtgccctgtgtttctgaattattttgtcataatttcagagaaactttttagagaaaagttatgattttataatgcctattaagagaagtctatcagtttgggcacacagtaaataagagattaaatgaatacatgta

SEQ ID NO: 267131 - DNA, 604 bp, Homo sapiens
ctagctacttgattctcagttcagactctaatgtttttaacctttcctcataggtccattttttcatccctttaatcattcccgttgctctccttggaccatctctagtttctccatatcgttcttgaattgtggagccccaaactggatattgttctccaataagggcccgactaatgccaagtatagtgggaggattatttcccagttcttgcatgttttacatctataacatggagtccaagaaaatctgaaataatatggagttgttttataattgattgcaatttgctcactctgtaagtcgctttcaagtagaatactgacatattcttttaaattttattttgttcatttgtatttgagagttaactggtatttataatatctagtcaaatatttaaataaaacaagcttttaaaccaaaattgttaataattaatccaatatcaaattaaatttttaagcacctacgcatgacatggattactgttgatttcccttgtattattttgtatgttgagttattaatcagtaaatgaaaatttagttcttcattgttaccctggatactaattttttgaagtacgctttcatagcatta

SEQ ID NO: 267132 - DNA, 415 bp, Homo sapiens
gctatataaatgcaaagtggtactggtaccaaaatgacgttcagaactaaatgtggtggtggtgtttcattcaacactgaggaggaaattcttggcttggtcaggaatggtgggacctgtgagttgggatttgtaaatggcccttgaggccgggcgcagtggctcacgcttgtaatcccagcactttgggaggccgaggcaggtggattacgaggtcaggagatcgagaccatcctggctaacacggtgaaaccctgtctctactaaaaatacaaaaattagccgggtgtggtggcaggcgcctgtagtcccagctactcaggaggctgaagtaggagaatggcgtgaacccaggaggcagagcttgcagtgagctgagatcgcaccactgcactccagcctgggccacagagtg

SEQ ID NO: 267133 - DNA, 324 bp, Homo sapiens
catctcacgctttcctccctcctcatgcccccttgtcccctcatcctcccaactgccatggctttgtgaggcgccctgggttccatggctaccgtgtcgaccagggcagcccacccacttctcactttggtctggagttagcgagagcgacgctgcttttctcttgctcttcagcctggacctgtgatgtgataggcgtgagaaggaactgtgggttctggcggtaaggaaagtggggccttactttcccatgttcccaaaaggcagatgcaatccctgcactcctgaaggagtcaagcagtaaaggcaacacagcaagactgt

SEQ ID NO: 267134 - DNA, 423 bp, Homo sapiens
gttctaagggcatgatctgggtgaaattaagaggagaatttgagatattctttcagaggatttaaaatcaaggaatgaatttagggaaaattaaagaggttggcagctttaaacttttgaggaaaataagggtttgggtaaaattatcgagataatttgaaaaaaaaaaagaatttggttaaagcaaagagaaattggggtagattaagaggagaccttgaaagcaaaattgaagagtttgggggcttcttcccattggccacacccctcgactttcttactctcctcttcaaagctcatgctttttttacccttctcggttcaggggtgtccaatcttttggcttccctgggccacgctgttcgaagaagaagaattgtcttgggccacacataaaatacactaaccataactgatgagcca

SEQ ID NO: 267135 - DNA, 383 bp, Homo sapiens
aagattaatgtttagaataggcttagtgctagaagttcagcctggacagcataagcagacctcacctatacaaaacatgtaaaaaaaaaaaaaaaaaattagccaggtgtgatgttgcatgcctgtggtcctagctacttgggagactgaagggggaggatcactggagcccctcatggtcaaggctgcagtgagccctgatcatactccagcttggataacagagcaagagaccctgtctcaaaacaaaacaaaacacacacacatacacacacaaacaaacaaaaaaagaaacaaaataggaagctgaagaagataatgaaagcgatttgaaatagaggaacatagaattatgaaatgaatagtttatgggtgatacatgg

SEQ ID NO: 267136 - DNA, 423 bp, Homo sapiens
acaatgaataaaatacatgtcagtcgtcttaaatatatcagttaaaagagactgtcagagtgggtgccaaagaagccaagacccaactatttatgttgtctacaggagacccactttaaatgtgaagacacagattaaaagtaaaggggtggagaaagatataccatgctcacactaatcagagaaagctggaataactatattaatatcagatggagctaacatcagagcagggaaaattatcaggggtacaggggacattacatagcagaacctgcaaggccacagtgaggagttggcccaaatcatgaactagagcagggttgtccaatcttttgcatcccaagggccacattggaaaaagaattatcttgggccacacataaaatacactaacactaataatagctaatgaccttaaaa

SEQ ID NO: 267137 - DNA, 488 bp, Homo sapiens
atttcatgtagtagggatatagttagaatgcccattttatggttatgagaagcaagcctaaaacttagtttcccagttaagtgagaagaagtgttaaacataggctagttacctcaaattcctctggagtatcttggcttagctctgagatagacattggattaaaagattagttttcctcttacccagcttgaaactttattttacctaagaaaccaccaccacctctgtataaaaatgcttgtgcattatactttttttttttttttctctaacctttcattctcctgctttagccctcaggattagctacttcaaaaatgaaccttgtggcaggagaaagttatagagcaaaaaaaacgtgttaagttttaacaactcatatatgtattttctttcctttgaggaagtgattagtaagagatctattaagggtagcacagaacaacatttctttccttttttttttttttttttttttgagatga

SEQ ID NO: 267138 - DNA, 451 bp, Homo sapiens
tggtgcctatgacaccagggccctgggtttcaagcacaaaactgggaggccgtttgggcagacaccaaactagctgcaagagttttttctttttttttccccataccccagtatagtgcccagaaggccagtgagacagaaccattcactcccctggaaagaaggctgaagccagggagtcaagtggcctggctcagtgggtcccacaccatggagcccagcaaactaggacccactggcttgaaattctggctgcaagcacagcagtctaagcttgacctgggaagctcgagcttggtgggggaagggcgtctgccattgctgaggcttgagtaggcagctttaccctataaagccacccagaagattgaactgggtggagcccaccgcagctagcaagaccagactgtatctccaggttcctcctctttgggcagggcatctttgaaaa

SEQ ID NO: 267139 - DNA, 491 bp, Homo sapiens
ttcccaatatattttcactagagatgagatgctttgccccaaggtaagtctttcaaccatttacaatactgacaaaacacttggccttcagactttatgaaggattttgttcattcttcttaaaggcaatcatttgatttgtggctgatattctactacttttgttcctctgcttctgtgtagtccagtgaagtccctcaatgctgcacaactacctgtatgcagaaacatcttggcttcgagtgatacagatgcaattccttgatgaagttgataagacagtataaccttaaccttgctataacttagcccaactatttaatctcaacgtggagaaaatggatacccaagtagatgaagcgactatttggattacactaatagtcacagaatccaggacttttgactaataatttaataattttggctaataatgtgactaataatctacattttccaacgctccctgctgcttcccaaggggcagcatt

SEQ ID NO: 267140 - DNA, 309 bp, Homo sapiens
atttactttttaatctcatttattctaaattttctatttaagaaaatagctcatttagagctgcaattttataatcagaataaattagattgttttaaaaagcaaagactctaggaattcagcctcatgtttatgtctctgagatactctaccacatcaattagatttaaattgacatttttttttcctataataaaagacatctaggcttcagagggtcaattaaatagtccctccaaaaacaccctctgaaatggattttattgcctttttctgtctacaacttaataaagctactcaataatgcta

SEQ ID NO: 267141 - DNA, 154 bp, Homo sapiens
gttaatattttctttagccaactaatattcaatgtattttttatgggtcctttttcaaaggtagtatcagtaggcatagtcattttctgtatcttttcacctcacagttcacgaacatttcccatgtccttataacacttttgtgttataaaat

SEQ ID NO: 267142 - DNA, 405 bp, Homo sapiens
tggtaactgcagtctcattccacaaataatttctgaaagtgctaattaagatgcatcttaatttttgctatttttcttgctgttaatccaaaagtataaatcctccctccctaaactgtaaaattaagcttgttgaatggagggtgcaactactgtcactaactgtaagccacctaaaactcaacaaatttaacagaaatagaatcttcatataccagtgattatccaacagtattttattctactgaaaaaaaatctcttgggcctttctaaaagagtttcacattggccggacttggtggctcaggcctgcaatcccagcactttgggaggccaaggcgggtggaccacgaggtcaggagatcgagaccatcctggctaacatggtgaaaccccgtctctact

SEQ ID NO: 267143 - DNA, 592 bp, Homo sapiens
atatgttggaagatgatctgtttcaggttaaaaggcttcaagcattacaaattgagagaacaagttcttgtctcttcttcatcatatttatttttaaagattgatgtcatattgctcctcaacttttgtcttacaaacttgaaatgatgtgtattaaacaaatgtgacatacttgctatgtgaaaaatattatgaaaaaatattatataattcattctagtagggtaaatagctaaaattcagaaaatataaaattaagaagttaaatggtaaaggcttcagaggttatggctgtgtccaaagtcagaaaagagaccccacaaaatgaggcaccaaagttagtctagaatttgaatagatatgtttatccatataaatgtgttaaacaaaggggtcatccgtttttctaattcccactcgatagaaactatcgaaataaattggctttactctatgctgacaataatatgccttcgccaacattgtttactcaaaaaatggaaaccagcattccctatgcccagagtgttgcaggcatttttcaataaatagaaggccttttggccaagttttccaagtttttgggacaagt

SEQ ID NO: 267144 - DNA, 379 bp, Homo sapiens
ttgtttagcgtcttaggtcactccctcctctttttccttttggaaaagaaaaatcaagcagactgcccaaatagccaagatcatcaggttcagcaagagaatacccctctctgtgtaaccctttaagatgagaatcactgcaaatagagtccaagtcagacactgactcagattttgcgaaaacctctaatagtccatggcttggtggtgatgggtagttttgctttagggatcttccgcttggggtggtcttctccatgtttggaaagatattgtttgaacgtgactgatcttgcagttgaaggttccagtttctataccacagcaagcctgggaaaatgagaagggggttattaaaatgaatttgagaagcgttttc

SEQ ID NO: 267145 - DNA, 545 bp, Homo sapiens
catgagccaaggagagtgggtggcctctagaagatggaaaagacaaggaaatggattcttccccagagcctccagaaggaatagagtcttgacacctttatgttagcccagtgagacccacatctgactccctgatctaccgagctgtaaaataaggagtttgtattatttcaactgactaaacttttggtaaattattaaacaaccataagaaactactacaagggataattgatatcttcacaatattgaatctttcaatctgtgaaaatggtatggctctccatttatttagattttctttctctcaccaatgttttatagtcgtcagtctagcaaacatgtgtatctgtcattaaatttattcctaggtattttatgtttcttgattgctactatccatcatttaaaaaatgttatcttccagttgtttgttgctgacttcgcttgtgagacctagaagagttttgtagattcttttgcattttctaggtatataatcatatcatttgtgaataaagagttttacttattcgttcccaata

SEQ ID NO: 267146 - DNA, 359 bp, Homo sapiens
ggttcacttctttctgtattggtggattttatattttaggaacaattaacccccacccccaatgaaaaaccctggaaattttatgggtaggggaactgttatatcaacattttattctataataaatgaagtattttttatacttcctcatagagacagtttatattattttctgaaaaggaaaaaattagaaaatacagaaagttcataattaacaccttaattattaaattaaattaaattaaagtgcttattggagctgggcatggtggctcatgcctgtaatcccagtactttgggaggctgaggcaggaggattgcttgagcccaggagtttaagaccagtctgtggtacccca

SEQ ID NO: 267147 - DNA, 555 bp, Homo sapiens
taccaacctgtgattggttccatgcaaagaaccctctcatggtacagcagaccctccgcccagtggacagtgccacctgccctggggagaatgcaagccaccaggcaataaatttcagctcttgttaccacctctccattctcctccatcgctccctcttgatctcccctctctgctgacaacaagatatggctggcatttagttgaggatttaaaatcaggaaagcttctccctaccttcaggctggaagctcgctcccctggctctctgaggcctcttgaagccgggcgtttgctgagtgccaggagaccagctcctgaaaccggaaggggcctgcattgttggactaaaatagcaaatgtgcaacatgagtctcttcaggggccttcagcgggctggcagcttccggtgggtactctacacaggccacagggaagcaaactggagtggccctccctgccacttgagagagcccttctatgtacatgactgttctgtcccttagctagattagttcatccaactgaaaatggactttagctgtgcctagcaaa

SEQ ID NO: 267148 - DNA, 365 bp, Homo sapiens
gagaataggggactctcctggtcggtagctgcccttcttagaagacacttgctattgtaaatagaacttggttggtttgcccttaataatgcctcatgcttggtgatcttctgcacacagagctcttttgcatgcaacatctcttggaagcttttcagaagcctgcaaggagacgttaagcatcttattccaagtgcaacagctaagtgggaacaggaaacctattccctctggccaggtgcagtggctcatgcctgtaatcctggtactttgggaggctggggcggaggatcacttggggcccagagtttgaaaccagcctaggcaacattttttgtgtgtctacaacatttttttgtctctac

SEQ ID NO: 267149 - DNA, 551 bp, Homo sapiens
attctgagatactaaagattgggactttaacatacaaattttggaggaaaactggttagcccataacaatgaattcatcaatagactgatatgatcaaggaaagaatcagtgagcttaaagaattttaaatagcaacttccaaaacttaaaagcaaagaaaaaagaattaaaaagaacagaatatttaataagtgtaggccaattagaaaaggaaaaatatatgtgtaatgaagtatcaggaggaggagaaagaaaggaacagaagaaatatttgaagaaattctgactgagattttcccaaaattgaaaataaacaaaatctacatatctaggaagctgagagaataccaagcaagataaatacaaaaaatttaaacataggcatattatattgaaactgccaaaaatcaaagacgaaaagaaaatcttaaaagaagccaggaggggaaaaaatctttatctatggacaaccaaggataagaattacatcagacttctcttaaaccacataagcaaaaagagaggaaagtgaaatatttaaaatgttaaa

SEQ ID NO: 267150 - DNA, 451 bp, Homo sapiens
tgttgttctgcccactcctctttcttccctcctgcccagtgcccttcatctaggtgtcatctctccttctattgtctggaaagacgatttgcaagaccctagtttggaagtaataacacaagaagcagatatggtttcgttctctttgtgttactgctaaccctcatctggagacgtttggatgcctatgtctaaaagaagaaggccaggtagtgtgggagatggcaaaaaaggaaagctccaagattactatttcaaagttttatctcatcacatatgtgtcatttggatgtcaatctggaagtgacttattcagccatcaggagctaggatttagcaaaatgacccccatcatcagaatatgagcaggaccaagagaaaaccaggtggatactcagccctcaaatgggagggaaacaggatcactcagccctcagattggagggaacta

SEQ ID NO: 267151 - DNA, 453 bp, Homo sapiens
cagattggagttgtggtttggtaagggtgctaatgaatgaggatctactctctacctaacagcttagccaaaactcaccctttcttataaccagtaacaaaggagcctcaaataaaatacatttttcagaacaaagaaatgtgactagcataatagactgattgcaatgttatttttcttgttaacaatttacagtgtaacaaactgttattgctggtaagggtgcaaattggttacaaccactttggaaaactgatgtgcagtattcattatagctgaacttatcctaccctgtaattcagcagtttcattcctgagtgtatacgcaagagaaattaatgtatgtggctactaaaagtttcgtgtaacaatgttcatagcagtttgattcattatagccccaaactggaacaaagtgaagcatattcataaaatggaatattatctggtaat

SEQ ID NO: 267152 - DNA, 509 bp, Homo sapiens
aatgtcctgtggaacttagacattggacttagggtaaacgtttccagtataaattcatggaagcatttttcttatgttttttttcttagagtaaatcctcaatgtaagcaaaaggcataaggtttaaatataactcagtgagtgttttctcagagtagttttagtgaaagtagtgtcaaagtagtttaagaatctaggtttttggtatttttaaacataatccaactacatagagaacaaatgtctgttagactatattccttgactcctagttgcatcagctgggctttgtgaaagctaggtaagagttttcacggaaatagcaaaagatgaaatttgcctcaagatgctgatttcgagtaaatacccacacaccttttacatctttgatgaggcaacaaaatgtgtttaatatgttttatgattcttgttcttttcttaaatcaaaatagttattaattcaaagaaactactgtttattcagctgcagatgcctactggttcttgga

SEQ ID NO: 267153 - DNA, 496 bp, Homo sapiens
tggcttaaagaatcaagaattcttttatgaagttcattttccaaggggccacctctgacctgttttttttgtccttccatattcttcaaatttggaggttttccttaaaagagagagaacagtgaccttagccccagggataaagaccagcaggggtaaatgttcccagaaacctccaaaaaccatagaaaagaaaggccatgttcccttgggtttcctgcagagacactgggataaatctgttctcaggatttaagcagtcattctgccaggccagggcctcattttcggtgagtggagtgatatatttattcattagcaagtgttgacattaggtagcaaaatgtgtgtaaacagagaagccacaaagacaggaatgtgccatttccaagggggagaaaagttctccagatcagccaataggaagtgattaacctgccaatcggaaactaagacagctggttactcacccaaaacgttttgttgaaaatagaac

SEQ ID NO: 267154 - DNA, 257 bp, Homo sapiens
attttttgtatgtttagtagagacggggtttcaccatgttagccaggatggtctcgatctcctgacctcgtgatccacccgccttggactcccaaagtgctgagattataggcgggagccaccacgcccagccggaaatgagaatttcttaaggaagaggagtgggattgctttatcattgggcatactaatattgaatatgatgaggtataagcacattattttccagattggctgtgtcactctacggtccctgg

SEQ ID NO: 267155 - DNA, 318 bp, Homo sapiens
gcaccatcacatccaatttgtgaagatataaacacaaattggaagtaagctataaacaaatgtctagggataagagactcagcattgagtagttgtgattaacattatggtactcatagctatgtaaatctgcgaaacaattgccattaactaaagaagtcatgactgttgggtgccctagagtctagtcagcactaatacagtaacacagaaatcactaagtttagcaagttgggagaagtattgaaagggccaggagtggcctaagcttcctggttcatttgttgccaattatattagtccattttcacactgcta

SEQ ID NO: 267156 - DNA, 531 bp, Homo sapiens
gactgaagattggcaaaaactaaaataaattaaaactgcttacaccagaagccttttagagaagcatgagactgtttgactagtcctacctgggttccggaaatacatgcatcatctgtacttgaagaggccagtgggagaggagaggagggggaggtcatttatctgagtctctccagaagtttttaaggctacattttggaatcattaaacttggccttctcaaactcaatagcagatctctgagattctccttttattattttccataggcaatgggaggaaaggtggatctttttaaataatagaagttttaaacagtccttaacgtgcttttgttgaggcatcttccagaatgtaaggtacagcagctccggtttctattattgtgacttgaatgtcaggattcaagggctcagtgtcaaagataattggctttgactttttgtaatctaggagcagcagtttgtgagatgtttattcaaagtgttagcctgtttttctaccaacaataagctagaaaagacaaaa

SEQ ID NO: 267157 - DNA, 579 bp, Homo sapiens
ataaacaaggaaataagtgtatgtaacaatgtacagctagaaacgctgggaaagaaacgaacgtgagagacacttattggaatttaaatgcaagccactccactatatctactaggtgtgtgtgttacaaaatacaaaaaaagaaaagcctcctgggagggtagcaggagttaaattactcaaaattaagccacagtttaagacagcaaaacataacagaacccagagatgccccaaggcaatacaaagttaattatctaagtagtagtaacaagaataactgctggccaggcacagtggctcacgcctgtaatcccagcagtttgggaggctgaggcaggtggatcaccctgtcaaaactctcaggagttcgagaccagcctggcaaacatggtgaaaccccgtctctactaaaaatacaaaaattagccgggcatggtggcagaagcctgtaatcctagctactcgggaggctgaggcaggagaatcatttgaaccggggtggcagaggttgcagtgagctgagatggagccactgcactccagcctgggcgacagagtgagactctgtctcaaaaa

SEQ ID NO: 267158 - DNA, 451 bp, Homo sapiens
tgggggtttatcttccacccagtgctcctgccactgtcaactctttgccattgccaaaccttgcaccgtgaaatttcaggttttgctgaaaggaactgtacctccgacatggcaggagggcatgtttagcctcattcctgggatgaacacgatgcaccgtgtggccatagccaaggccaaggccgttcctcacctcctctccgtgcctccgtttccgcaaatgcaacacaggggcagtagccgcaccctctccatcccccatgatagactcagtgggttaatcacgggagccagccctggcatgtagtaagtgctcagtgaaaagaacaaagaggctgggctcggaggcttccgtctgtgatccctcctaaaggaggctgaggcaggaggatcgcttgaccccatgagttggagaccagcctgggcaacatagtgagaccccatctctaaa

SEQ ID NO: 267159 - DNA, 381 bp, Homo sapiens
cataaaaaagtgaacattagtgtaagcataatggacagggttgctttgaagactaattgatgtttaaagcaatttatagccctggatcaccatgcacatataaagatgtttctcataactactatgcagtaattgtctgtatgtgtaataaagatagcagaatagttccacaaatgggggcaaagtgtaaaaaaatagactgtaggttatgggtcacccccatgacctagtcacctctgaccaggcccaacctccaacattggggattacaattcaacatgagattcggccaggacatatattcaaactatatcaatatcatcaccagatgaatagctaaacaaattgttatatccatacaatggaatactgcttgattat

SEQ ID NO: 267160 - DNA, 531 bp, Homo sapiens
caataacagtctaatatacatgtgattccagcctcagaaggtgaagagagagagaatgaggcagaataaatctttgaagagatgatagttacatgaatgaggtgtggcggcaaggctagagagaagtggatatgggagcatttgcaaggagaaccactgaggcttggtcactgagtggagggaagtgtggcacctgagtgtctgtcttgggagctgcaggctctcagcaggtagtagtgggtggttagcaggtggtggtgccaggatggagagccaagcctagctctccagtgcctgtgctctctgctggtaccccacaccacctcctacaggccaaagtggaacagtagtgggcctttgctcctcgattccctagcctccagccccagcctttcctaagccctcaatgtactattcctattagtcaatgtgtggcagagagatgttcatctccccccattctctccacctcctctgtcccaagtgttgtgtcacacattgctctaaagtaaaggttttcttttcccaaac

SEQ ID NO: 267161 - DNA, 362 bp, Homo sapiens
catagaggacatttttgcaagtggacctgctgggtcaaatgtcttcaaattttaaaggctttacacatatatatctgatcaaacggccctataacttgtatgaatgcgtacacctggtagcagtataagagtactcattttccatcatcatcatcatcatcatcatcatcatcattgctaatatttaatgagcacttagtatgggtctggcaaatatccaagcattttattcagaacaattcatttaattgtcacaactctgcggtagataccatggttattcaacatgtacaatagggaaactgcagtacataattatatttagaaaacagaaatgtaaggccgggcacaatgactcacgc

SEQ ID NO: 267162 - DNA, 345 bp, Homo sapiens
tgccaagttacgcagaaggggctgctacttcatcagtcttcctgtcaaacattctgtgtctacatgaaatgaaactgcaggcagatgagttaagggaagatggataaagataataacgcatctgacataacgcagtaatgtgctcaccgcagtacctggatcttcaactacaaggtttgccacttgggaaaatgcagtggaagtattgttctcaggggcgcctgcaccgaagaagcagagggcgtcctgctctcagtcgcggtctataaaataggttctgattcctaaaactggaggcatcattgaacttttggagagtgttgccttaaagtaattgtgtttaac

SEQ ID NO: 267163 - DNA, 558 bp, Homo sapiens
gggtgctctacaaatgttgaaagactgcatgaaggagtggaagccagtgccgaatcctctgctatatctgtgccagcacatccttgtccctaacagcaaactcgttttctcctttgcatgaattgtattttcagtaagctgagataattggaatttaaggtaggactttccaaaattaagtttatcatttgtaacttaatttatttcttaatattttaaataatcccaaataatcatcagtacattgcatgacactcagggggtaagaaaatgaaacatatataccaaaggtaaaatttcatggtttttagaagtcgtcctcccatgtataccctcttctgctctacccttatagcacgcaaggatctgtatagtccaaattttaaacattcaatttgcaactcatttttaggaacacatttcgtaaaggagaggttgaggaacggatgtgttcatatctccctctcctctccacttctttctatgcacacaaagacacacacatgagatagatgtgctgtcggtgtatatatctttggataatttttcccctgaggg

SEQ ID NO: 267164 - DNA, 289 bp, Homo sapiens
caagctcaggtgatcctcccacctcagcctcccgagtagctgggaccacaggcacatgccaccacgcctgggtaatttttgtattttttcatagagatggagtcttgccatgttgcccaggctggtctcacactcctggtttcaagcaatcggcctactttggcctcccagtgctgagattacaggtgtgagccactgtgcctggccaccagctctatctttaccatcaacattggagtaaacatttacatcaggggtcaggggtatccaatcttttggcttccctggg

SEQ ID NO: 267165 - DNA, 399 bp, Homo sapiens
ttactaaaagtttaacattaattttgtaatagtatctatcagtttttaaaaagaagcctaaaaaggcttgaaaaagtggcaaaaatagaaaaagtgattcccccatgtagttagtagttggcaatacataagtgaaagatgtcactgatttttcttaccaagtagaatttaaaagtgtatgttgcatagtaataccctttagttttctttaatggtaattattaaagtgaatatgaaacaaaaaatatgataattgccggttaaacttttgccttatatagaaaaaaagcctgttctttgaaacaatttttaaaatgaaataaatttatgagctaatatttttccattgaaggttttttagtgaccatttgtaaatttgctttaaaattgcttttaaca

SEQ ID NO: 267166 - DNA, 443 bp, Homo sapiens
ctcaaggtgaggggtggcaagcgtggtaggaacaggcacacagtgtgcagccgaggctggtccccacttcggcagttggaggcaaggtccaaggcacaagtgagcctgtgtctgagaccctgggatgcaagtaacgcccctcctgcagcccgaggtcctgctgctggtaacctggagctctgcgtttctgcaggacatcgtcacaaataggatgtccaactgagcagctgtcatgagacagtgatttttgcaaacattgaagaagtgtgatgctcataacagagcggactcttctgctgttgattgattgagacagggtctcattccatcgcccaggcttgagtgcagtggtaccatcacagctcaccgcagcctggacctctggggctcaagtgatcctcccacctcagcctcctgagtagctgagacaacagacacacacc

SEQ ID NO: 267167 - DNA, 350 bp, Homo sapiens
ctcaaggtgaggggtggcaagcgtggtaggaacaggcacacagtgtgcagccgaggctggtccccacttcggcagttggaggcaaggtccaaggcacaagtgagcctgtgtctgagaccctgggatgcaagtaacgcccctcctgcagcccgaggtcctgctgctggtaacctggagctctgcgtttctgcaggacatcgtcacaaataggatgtccaactgagcagctgtcatgagacagtgatttttgcaaacattgaagaagtgtgatgctcataacagagcggactcttctgctgtgatcgtgccactgcactccagcctaggtgacagagccagagcctgtcgca

SEQ ID NO: 267168 - DNA, 307 bp, Homo sapiens
gaggaccagggctcccaccctgagaggcttggagcagaggacgatgtgcctcacccagtttctgagggacccctgtggctgcggactgttcccagcaagcccaggagagatggtgggggccaggtggtgggaggtgacatggggcacatgtccagggaccagctgtggcctgagaggctgggtgcctgtcctggcatggagggggcgtctggtggaggcatttaggatgggtttggattgcactgagcagcggggtgtgagggtctcacacgatccatagggggttggatgtccctgttgctggccc

SEQ ID NO: 267169 - DNA, 521 bp, Homo sapiens
aattttctttgtgaagggacctttctttctcagtcctgtggctcacacgggatgctaatgtcattttgttcatagcctttcagagctggatgcataagtcaagcagcatcaatgccaatgacctgtgaggaaacatttaagaaggagacactacctctcttttctgaagaatcaaatcagtgactcattctaattctcttgggtgtgtggaaggaggatgagagctttgaacctacagctactgtttagtaactacgaggcgatgtcctgagatttcctactaggtctctgtctgaggatgtagtcagtatttgaaaaaagaacagagggataaggagaaaaatcatctgtagcatgactcaagttgctggatctagcctcacctgaagagatacatcttggacttttctgttacatgacctgacatcttctctttaaatattttttgtagacacaattcttcatgtggacttatgtattaaattttagctgaatccatgaaataaatttttataaatggc

SEQ ID NO: 267170 - DNA, 375 bp, Homo sapiens
ccatttcttaattctgattggtcttcatttaacaagaggcatgcatgagaattgttagatgcttgccttctattaccaccacactgctggcatagcacctgtcatgctgcctacccccaggttcctacccacttctaggatgtgagtttgtgatgggcagggttcacatcctttctgttctatctctctaagagcaggctagacccagagtagcaattcagttaactatttgctgaatgaagtatgtgaattccaagatactctcagagtacttttttttttttttttaatacaggtactataatttgctggagtggccatgacttgttttacaaacacatatacccttcttctttgataacgactcccctcaaa

SEQ ID NO: 267171 - DNA, 314 bp, Homo sapiens
gatatcatctcactgacttctgagaaggaacatagacaagtacaagcatgttgtcttactcagcactcagccgcacacatcacgatgggcagaagtcactatcagtgagttctgttgcccttgtacaaagaggagttccacttcattataaagaaatggagcgagtatatttttaataggcccaactctttagctatgtttttctttttatcaggctttacttatttagtttttctagtgccttgaagtatattacttatatttctttttaatcttttcagcctcagtaataaaattaatataaatgagtcaaa

SEQ ID NO: 267172 - DNA, 415 bp, Homo sapiens
gtgtaaagtatagcctttctgtaaagcagttggcaatatagcgtgtatctagctttaagaatgtacttgtactttggcccttcattccacagccaggcatgcattttaaaatgttcatcatctgcatcattgtgacggtttgtttcttccatatttggagataaatttatgtgtagactttttttttgtaagacatagttgataatgaaaatttatttaaatggtcttgcaatgatttaagtattcaaatgcttaaagaaagcattgctggtacaaatatttctatttttagaaagggtttttatggatcaatgccccaagtgtcatcagagccattggtgttttcatttttaaaatgtcacctgtaaaatgggcattatttatgtgtatatggctttttttggcattcctgata

SEQ ID NO: 267173 - DNA, 404 bp, Homo sapiens
cggctcatctctagccccagttcattctgcccaccaccagctccaaatgagcagctctcccactgtggctttaaatcaggggcacctctaagactccacttccccctctctccctccacggtagggtcagcagggagccagtggcctggtattgatggctttgtcattaagcttggaggattggaggacgggggctgctgttgatttaactccaggcactgcctccacaatcttctttcaaattaggccattttgcccatcttatttggatgccttcacactagtaaaagcctcatatctcccaaagtagtcagcattttttttatgagggacagatttttattttcagccctgcagcttcttagttcagcattagagactctacttggtttattttattttgt

SEQ ID NO: 267174 - DNA, 408 bp, Homo sapiens
ggacaccctatgaaagatacaggctaaatagtattatattcaattcattttattcctgatttttaaatgtgcacacagagatgacttaaattatatcatgatgtccataatcacacatgatagccctagtcacatatctgaaagcagtgttgcagacaagaaagcttttgtggtacaaaggtgttgttgggtagttgctatagagactgcaagccccacaaagcctgtaatgttggttagctggtccttcacagaaaacatttgcccaccctacactagatgcctggcaaggtagtcttctgaaactttgcttgccctctcttctcctttttccttcctctcttctctctttactttctttatttctcctgcaactcttgagaaatacttaaaaatacttaaaaaaaa

SEQ ID NO: 267175 - DNA, 473 bp, Homo sapiens
cccgctcctggaggacggcgccatcttgtcttgtggctttgtgaacatgaatccctggcctgaactggggaagtcactttcaggattaaaggcagccaacagaacatcagcacccagagccctggagaacagcatctgtgtttgagtgggtatagggagagagaggctgcatttctaaaatatctctgagaacaagctgcttttcagaattcaaatcaacatgtgatcttcttcactttaggggtatatgcaggaagccattagacacaaccagagtaacaggaggagggaagagagagtcttcaggaaatgaagaagaaagaggagaagtgggctgagctggaagcctcattttccacaaggacactgaaacattgttaagccaaggagaactgttagctctgacaatagctcctcttcttatgagtcctttggtgttttaattatttttaaaataaagattgaagaacaac

SEQ ID NO: 267176 - DNA, 165 bp, Homo sapiens
gggtttaagtaacaccaacatgccacactctggagcagcaggatctttatttttggtgccaactcctcatcttgcaacaagtgagccacttcttccatgtactcagctgcaaagttcccagcaggtggtcctcctgtaaaacaagcatttgcatttccagaagta

SEQ ID NO: 267177 - DNA, 484 bp, Homo sapiens
agctgcctgtctgtgaaatgggtccatgtgtccccatgccttggcccgtctcctcttccctacaacaggctgctgtgcagcctggggccctttccaggccaccttctccatctgctcactgaggagggacccctgagtcagcgaggctccagcttggctgcacccagctgaaaggttatcctgctgataccccaccacttatggaatgatggaccttttccccactggattagaatgtcctttttgtgtatcatcgaccctgaacaacccaagtttgagccgtgtgggtgcacttctacgtggattttcttcctcctctgtcacccgagacagtaagagccacccctcctcctccccagctgactcaacgtgaagatgacgaggatgaagacctttacaatgatctgcttatgctgaatgaatatcttttctcttccttactttactttattgtaatacatgaagcatacaaaatgtgttaatt

SEQ ID NO: 267178 - DNA, 772 bp, Homo sapiens
gacatctcacccaccatagcagggaatgagtccctctaaactattccctcaggaatagtaagagccagcccctcttccccccctggctcttaggacccccatcgcaggggggtgaggcaccccccgcgatgcggggagtacgagtcagcccttctcctcccctggctcttagggcacctatcgcaggggggtgaggcaccccccgcaatgcggggagggctgagactggggtctgggctgttccggacttcaacactcaccccttgtccccccgcagggctatggcgtgtgcttggtggggctggagcggctggcttacctcctcatggcttacagcctaggcacctcagccgcctcactcctgggcctgctgggcctgtggctgccacgcccggtgcccctcgtggctggagcaggggtgcacctgctgctcaccttcatcctctttttctgggcccctgtgcctcgggtcctgcaacacagctggatcctctgtgtggcagctgccctttggggtgtgggcagcgccctgaacaatactggactcagcacactcctgggaatcttgtacaaagacaaggagagacaggacttcatcttcaccatctaccactggtggcaggctgtggccatcttcaccgtgtacctgggctcaagcctgcacatgaaggctaagctggcgatgctgctggtgacgctggtggcggccgcggtctcctacctgcggatggagcagaagctgcggcggggcgtggccccgcctcagccccgc

SEQ ID NO: 267179 - DNA, 668 bp, Homo sapiens
caagccttctataataactccttgcccaaggtgttgtcctataaacttccacaaacccattctccccactgcaaatatttcctctcgatacatctacctatgtatcctgcttagtgctgtatatgtttagaagccagagttaaaaaaagaaaactactatttttcccatcctcaactccaaattctggtttaactgctgtcaccttttttaaccaacatatttattaaatctgaaaaaggtatacagcaaaatgaatgtgtcatttaactgagtgtcaaaagtaacaaaaactatctgtaacacaattacttgtggaatgacctgctgatggctggttaaggtttaccaggattaaacaggattcttaactaggaattttattttattttctgatctgaagattaaataaaccagctccagctttgccctaggaatgcatgggactttaagaaattaattttgctttctgtaacatagcctgcttatctctaaaaagaattaataataactgcacactcaaaggcattgtgaccccaccagaaaggctcggtacaagcataagctattaaatctcaaatcggcagatctcacagtaaaagcagacatattaacaacacagtgttgaggcaaaattttgaaaaggcaggagttttaaacatacacacac

SEQ ID NO: 267180 - DNA, 478 bp, Homo sapiens
atttcaaaatagctggattagaagatttataatgttcccatagaaagaaaattataagaggtaaaacctacctcaattaccctgatttgatcctgacacatcttacacaggtatcaaaatatgacatgtattccaagaatacatacaactattgtatatcaaagaaagtttttaaaaataaaaataaatttaaaatactattgcctaataataaaaccaaatattgaattttgctgtgaaatcaaaagcatatcttgaatatggaaggaaaatacatgtcaaaattatttttaatgtatttttactttcaaagccaatgtactcttgcttatagccttccacatatgatgaggttcttatggtccacaaaaaataaacagtgacatcaaatgttttaagaaatatagcagagtctatttgtcatgatacagtatatcaattttatttaatagtgatacaaaatactttaaattgtgtt

SEQ ID NO: 267181 - DNA, 446 bp, Homo sapiens
tagaatgtaatggtgacctcattaaaagaaatccactgatataatatatcacaggagtaggtcaaaggaaacaagcagaaacaagagtctctcataaaaaaaaatttttttaagatgaaaatcaacatttattttttattttttaaactcccctagtaaggaaagaaagggccaggcacagtggcatacatctgtgatcccagcgctttgggaggctgaggtgggcggatcacttaagcccagggattcgagaccagcctgggcaacatagtgaaaccctgtctctacaaaaaactagccaggcattggtgcatgcctgtggtcctagctacccagtaagctgaggtgggaggatcacctgagcccagggaggtcaaggctatagtgagctgtgatagcgccactgcactccagcctggacgagggtgagagaggccttgactcaa

SEQ ID NO: 267182 - DNA, 332 bp, Homo sapiens
attggtggtggattcaaagcacagcatctggggtcctgtgtcaattacgctctcctcaacagaagatctgagtggtggtgcatcttcatggctgctggcaggccccgctgtgtaattacgtctggaattggtgggttcttggtctcaccgacttcaagaatgaagccgtggatcctcgtgctgacagaatcaagttttaaagatccagttaaatgcctggctatcaacttgccaagagctgatccagatggaagccatcatcctaagagtcagacaactcattaactctaaagggactgccatgtattaaaaattctctttatggattgtga

SEQ ID NO: 267183 - DNA, 468 bp, Homo sapiens
gaatgctggatcatatggtaattctatttgtaatgtttttaaggaactgccatattgtttttcacagcagctgcactgctttacgttatcaccagtcgtgcacaaggattccaatttctccacatctttgccaacacttactattttgctttttcgatagtagccatcctaatgggtatgcgtcccagcattgtcttttaaatgtgtttgtccaattcctgtttgccccaatggtaactattcctcaggcactttcacagtgatctctataccatagtgcagcaatcttcaagtatcacatatcctctaaaagaattttaagaacaagtgtaaaggagataatatatttttaaattggcatctaatttttatcataagaaatataaatagctgcagaggatctaatttcaagcatgttgtaaaattttcacttaaaagcaaacctaaaaatacagatggcttttcaaa

SEQ ID NO: 267184 - DNA, 718 bp, Homo sapiens
aagtgtaatgaatgtgggaaagcttttaatcaacaatcacatctttcacgtcatcgtagacttcatactggagagaaaccttacaaatgtgaagcatgtgacaaagtttttggtcagaaatcagctcttgagtcacataagagaattcatactggagagaaaccatacagatgtcaggtttgtgacacagctttcacgtggaattcacagctggcacgacatacaagaattcacactggagaaaaaacttacaagtgtaatgagtgtgggaagaccttcagttacaagtcatcacttgtatggcatcgtagacttcatggtggagagaaatcttacaaatgtaaggtttgtgacaaggctttcgtgtgtcgttcctatgtggcaaaacatactagaattcacagtggaatgaaaccttacaagtgtaatgagtgcagcaagaccttcagtaacaggtcatcccttgtatgccatcgtagaattcatagtggtgagaaaccttacaagtgtagtgagtgcagcaagacgttcagtcagaaggcaacccttctatgccatcgtagacttcatagtggtgagaaaccttacaagtgtaacgactgtggcaataccttccgtcactggtcatcccttgtataccatcgtagacttcatactggagagaaatcttacaaatgtacggtttgtgacaaggctttcgtgcgtaattcatacctgg

SEQ ID NO: 267185 - DNA, 488 bp, Homo sapiens
agaagctgttttcagagattcagaggcaggcagatgaccacagcaagaagaacagacagaaatccgtaaggataattcgtctaagctaattatagttaaagcattactgacttataaaaactcaggattatgctctcaaaggcaatcacatttatattatttttatttaaaatatatattacatgtaatataaactatacacacaatatattgaactatatggaaattgaaactgtgaaatcccgtactgggctgcacctcttttattgactactattttcttaccacatttggtgacacagcatacgtgctcccaatcacattcaatgattcttaatcagttctcctaccactctcctccacacactgacatatgcatcaattattcatggctattatcctttattggcaaaacctgattcagacaagaagcagcacatagtttcttctatgtggaaaaaataaactatttttttaatatcaataaa

SEQ ID NO: 267186 - DNA, 406 bp, Homo sapiens
cagagaagttaagtgacttgccaaaaggtaacaattgtaaatggtagagctaagatttgaacccagggtgtctgactcccaggtccatgctccagagtcagatatagaaggctggagcacagtgtaaaccattctggagtaacaagcctcaaatggtgaataattctttccctaactctggtccacctgcaacctaggagttaaaataagtatcttgctatgttaagagtaaagcaatagttacaggcatcatatattagctgtcttgctcccaaaatggtgacattacaaacttttccactattccctttgaaaacatgcttgcagccagttaccatttcttagcttatgatgtagagctattaagggagtattttcacttgtgccaaagagggtaagcgtttat

SEQ ID NO: 267187 - DNA, 441 bp, Homo sapiens
aatgaatgctctgtggagtttatcacaaaaagctttctggttccgtgggctgctcttcattgctaattaaattttcgaaggtgattctctacccctcccttccaatacacacaaggaagaaaaaagattgttcaggattctgtggggatttatgtgggccgtgaaaatgtatcacgcctgtaatcccagcaatttgggaggccgaggtcagtggatcacctgaggtcaggcgttcaagaccagcgcggccaacatggtgaaaccccgtctctactaaaaatacaaaagtaagccgggtgtggttgcaggcacctgtaatcccagctacttgggaggctgagacaggaagatcgcttgaaccagagggggggaggttgcagtgagccaagatagcaccactgccactccaatctgggtgacaaagcaagactctgtttcaaa

SEQ ID NO: 267188 - DNA, 203 bp, Homo sapiens
tgagctgggaataggcattggcagaaataacgactctcagatcacagccagaggagccagtgaaatacatataacaatgcctcactaacctcaagtaccattttttgatcaatgggataagttcaaagtatctaactcactagaacacagcagtatccacaaaactgaagcacaaaagctgccccaaaaccccagagtagtgc

SEQ ID NO: 267189 - DNA, 458 bp, Homo sapiens
acaaaccctgaggggacagccatgttccagtgtggctaggagggtctggagctgggcacgtcccccatgtctgcttgattcccctctggccgagttctactcaggtgagttgtgctcattcttgcttccccagggcctggatcacagttcctcaagctttgggatacaaacgaatcacctgggatttggataaaatgcagattcgtgttcagcagccctgacattctgcatttctcatgagctccagggagacgctggtgctgctggggcaggaccacactttgggtggcaagggcttggcaggcaattccaggtgtcaccctagagatggcctgctattgcactgtcagtaggtagctgccacagtgacggccgctccagatcaaggggaggaccttttgaaaagggtccttgaatcatttgggaaataaatcaagccatatgagtaaaaagtaatc

SEQ ID NO: 267190 - DNA, 479 bp, Homo sapiens
gaatggtgagaaattatctaagattaagacttgaatgagtaaaaagggggaaaacaaatctagttgatattaaaacagtcaaagtgaaacttaagggtcagtaaaatacacataaaggatttgagttttccagtgtatattttgcttacatatttgtggcttttataactcctttagtattaataaactactgaagtcacatgcaaaaaaaaaacagactcatttgcaaattccctgtgggctctatccattgaccaagtcatgtttacttctgtgcttaaagacagtaatgttcaagatgtgctttcatcatgtatgcctctcccatatcagactacgaaattatgtgactattcatagtctctttcgcatcttcagttaagcatataaaaggcacttttggtggaatagtcttttgaagagtattaatgaaattgaatttaagtattattattaaatttaatatttctattattaaa

SEQ ID NO: 267191 - DNA, 550 bp, Homo sapiens
cagggctgatcagttggtgttacatgtgactactatgcttaatgctatctggcttctaactttaagcactgaaaaaaagtccttcgtatttctcagtgtgtgattgaactgagatgaccatcctaagcctcctcattacataaatccttaccttctccagaagcaacgaatggtgttgagaatagcatatgttactactcagccatattccatagccttttctccaagatatttttccaaagttgccccttttctgaatcccttgcaagcaaacaaacaacaaaacaatgggtaataaaataattgtttaactttcatttatatgctctgagattgatgtgattttgataaataactatattaaaagacaaatgggagtggtgattttgtgaaaagcccatgcctctgcccatggaatatgtggcttggcctggagctcttattttacttatatatttctaagcagaattattcaagaatgtctcttattacaggtcttgaaacttggacagccaacagaaaggaagctaataaataaatttgtcagaaa

SEQ ID NO: 267192 - DNA, 470 bp, Homo sapiens
tcgcttgaacccagtaggtggaggttgcagtgagccgagatcatgccactgcactccagcctgggcagatgacacaggacttcatctcaaaataaataaaaaaatagattttaaaagagaaaagattttttaaaaattatagaaccagtccaggaagcctaatatctgaacaacaaaagttcagagcagaagcctaggagcagtgaccatccgtgtgacactgaggaccaataaagccagattgttgccttgaatttatttccctctaaaaggaacaagggctccttagaaaaatggctttttccaaatctagggcagaaaatctgcaaagtgacttggaacattttgttataccaagtagcaaggaagctaccaaagattagggttttatctaaaggactccaaagccaacttaaagacggtcccactcactggtgctctggtaaatgtttaacagctggttctcaaaa

SEQ ID NO: 267193 - DNA, 171 bp, Homo sapiens
ttcacagaagaggaaatgtacatagctcgaacatgtaaaaagatgctcacgatggccgggcgtggtggctcacgcctgtaatcccagcactttgggaggccgagatgggtggatcacgaggtcaggagatcaagaccatcctggctaacacagtgaaaccccgtctctact

SEQ ID NO: 267194 - DNA, 426 bp, Homo sapiens
tgtacagttaacgcaatcatcacagtggtccttaggtgatgtacatcctcagcttacgaagataacaggattaagagattaaaataaagacaggcataagaaattatgaaagtattattagggaagtgataaatgtccatgaaatcttcacaatttatgttcctctgctgaggctccagccggtccctccattcagggtccctgacttcccgcgacaccccaggtttttaaagagccacaggaagtccctatccagagatgaagtgacatgcagttagtgtgatcaatgcagtgcaaagccgctgttaataaccatccatgacatctccccttcctgatttgccacctgacaaaatgccctgtggagggctggaaatggaggatgaatccaatctcagcatttttctgagaaggaaaatgaaactc

SEQ ID NO: 267195 - DNA, 487 bp, Homo sapiens
agtgaccagtttcttaaaatccctttaaattgttttcaaaacattgtgtgttcgccccataccttcttctttggtatgtttgttgctattgccacactttccccatacctgccaacctaccctgttaccacctctttgtccatttctccccagcctcagacaggtaagacagaattgtttctgaaatggaataaagaacagtcttggccgggcgccgtggctcatgcctgtaatcccagcactttgggaggctgagatgggcggatcacatgaggtcaggagtttgagagtagtctggccaacatggtgaaaccccatctctactaaaagtacaaaaattagccgggcgtggtggtgcacacctgtagtcccagctacttggacggctgaggtgggagaattgcttcaacctgggaggcggagattgcagtgagctgagattgcaccattgcactccagcctaggtgacagagcaagactccgtctc

SEQ ID NO: 267196 - DNA, 718 bp, Homo sapiens
ctgaggaattcgtttgagcctcttataaatagtgggaacactgccaaaaatagtcaaatacaacttttttagaactctggaaatcaaccaaagagaagtatttatttacaacaacaacaacaacaaaaaaggtgatctcagtaagcacagtgaactttgtggaattttaatttgtcctattcctattcctccttagctcagcagaggctggagaacaaacagacccccagtcatggtgaaaaccagcagcctagcagccactggagggggcaaaatgggctgggaactcccaaaaacattcttctcagagagctgtcattttttgacaaatctggcagttccctggaaaattctgttctaaagccttgtctttatttgacctgactcagaacagccttttcccgagggccatttgtcaaaagcaatcaatagcaattgtttaacattacaactgcttgaagcagccataacagttgagacaaacaagaagtggaccaaaaaacacttaaaaggaaaagcttgggaatgaaatattcatagggggctttgcaaagcttccacatatttctagaaatctagaaggatgcaaatgataaggctctgcaagagcccagggaagacttaaataaatggaaagacatcgtgtgtttatggattggaaggtttaatatggacaagatggcaatactctcccaaatggatcaacagattcaatgca

SEQ ID NO: 267197 - DNA, 1264 bp, Homo sapiens
ggaagtctgtcaactgggagggggagaggggggtgatgggccaggaatggggtccccgggcatggtgctgggcctcctggtgcagatctgggccctgcaagaagcctcaagcctgagcgtgcagcaggggcccaacttgctgcaggtgaggcagggcagtcaggcgaccctggtctgccaggtggaccaggccacagcctgggaacggctccgtgttaagtggacaaaggatggggccatcctgtgtcaaccgtacatcaccaacggcagcctcagcctgggggtctgcgggccccagggacggctctcctggcaggcacccagccatctcaccctgcagctggaccctgtgagcctcaaccacagcggggcgtacgtgtgctgggcggccgtagagattcctgagttggaggaggctgagggcaacataacaaggctctttgtggacccagatgaccccacacagaacagaaaccggatcgcaagcttcccaggattcctcttcgtgctgctgggggtgggaagcatgggtgtggctgcgatcgtgtggggtgcctggttctggggccgccgcagctgccagcaaagggactcaggtaacagcccaggaaatgcattctacagcaacgtcctataccggccccggggggccccaaagaagagtgaggactgctctggagaggggaaggaccagaggggccagagcatttattcaacctccttcccgcaaccggccccccgccagccgcacctggcgtcaagaccctgccccagcccgagaccctgccccagccccaggcccggccaccccgtctctatggtcagggtctctcctagaccaagccccacccagcagccgaggccaaaagggttccccaaagtgggagaggagtgagagatcccaggagacctcaacaggaccccacccataggtacacacaaaaaaggggggatcgaggccagacacggtggctcacgcctgtaatcccagcagtttgggaagccgaggcgggtggaacacttgaggtcaggggtttgagaccagcctggcttgaacctgggaggcggaggttgcagtgagccgagattgcgccactgcactccagcctgggcgacagagtgagactccgtctcaaaaaaaacaaaaagcaggaggattgggagcctgtcagccccatcctgagaccccgtcctcatttctgtaatgatggatctcgctcccactttcccccaagaacctaataaaggcttgtgaagaaaaagc

SEQ ID NO: 267198 - DNA, 730 bp, Homo sapiens
aggggagtgagtcacacagcctcacatgcgcacagtcagaaaggtcgcctctacctcttctgtcctccagccctgcaagaagcctcaagcctgagcgtgcagcaggggcccaacttgctgcaggtgaggcagggcagtcaggcgaccctggtctgccaggtggaccaggccacagcctgggaacggctccgtgttaagtggacaaaggatggggccatcctgtgtcaaccgtacatcaccaacggcagcctcagcctgggggtctgcgggccccagggacggctctcctggcaggcacccagccatctcaccctgcagctggaccctgtgagcctcaaccacagcggggcgtacgtgtgctgggcggccgtagagattcctgagttggaggaggctgagggcaacataacaaggctctttgtggacccaggtacgggagccagcggggagagggaggggcagtggggaggatcctagaatcttaagacttttgagtcttaaactcctagaaacaaaaaactctaaattcttcatatcaaacttttttttttttttttaagagacagagtcttgctctgtcgtccaggccttggagtgcaggggcgcgatctcggctcactgcaacctccgcctcctaggttcaagcgattctcccgcctcagcctcccaagtagctgggattacaggcacgtgccagcacgcccagctaatttttgtatttttagtagag

SEQ ID NO: 267199 - DNA, 586 bp, Homo sapiens
caggagaatggtttgagaagtggtatagagtaatgaggtggaaaagggggaagagagtgagagcaccacacaaaggacaggaaaaacaccagcaatacatcagctttacacagcaggcaagtttcctgctctctacaagtacagatggaacttgtcttgtgaattaacatcctgactacttttgttgatcatcacattttttcctcatgagagaaataatagtgttttataggctcctgagaataggtttactaaagtcatcgagatctgggttcaaatgacactgcttagggaggcattcactgatcaagttacctaaaatagcaacaatctatcatccaaaatatcatttgccagctttgattttgcatataacacttactttatatatgtacatatatgtgtatatatatatttgtgtgtgtgtgtgtgtatacatgtatatatatatgcagtctgcaataaaatgtatgcttctcaggggagaaatttttttctaatacattcagtgctctatacccagaacctggaacaataccttgtacataataggtgatcaataaatacttactgaatattgaatgga

SEQ ID NO: 267200 - DNA, 440 bp, Homo sapiens
ttttttttaaaggcaagtagaccgaaggcagctttggtgactccacttctttttaaagtcaccctcctctgccctctgactttaagtgacaggcagttccctcccctctctttcaattctgtaaaatggggataatccggacctcatgcccccagagccttgtaaggaccggctaatgagggcaggcgagtgggaaacgaatcgtctgaacaatgatcagtcattctttcgggcttgcaaagagggtaaaaaaggttgggtctttagcggggtccgtagaaggctttgaagacgaaaagtgctgtagaggtgctaagcagcagccaacggaccgggcccgctgccagggggtcagggctgggccgaggcggccgcggtctcaggctctggccaattttgcagccgcgggtaaagttcacgctgcccgctcccctcggtac

SEQ ID NO: 267201 - DNA, 432 bp, Homo sapiens
gcggatctccccagttgctaatcccggctctgccactcaatcctatccctagttcccgagcgcgggtcccccgccttgcagtctccagccgtgcggggccgggagcaggcctccggcctcccagacttctagagcccgccgggcccatctttgtactcatccaccccagccggcttgggactcagacaccgaagtctttttttttttctctccgatccttggacacctcctctgtctgccatttattagccatgtgaacttggccacatcacttcacctccctgagcctcagtttcctcatctgtcaaatgggggtttataaacacctacctcgcagggttgttgtgaggatttaatgcgataatgtatgtaaagcgccttgcacactgcctggcacacagtaggcgctcaataaatctaagcttcccttta

SEQ ID NO: 267202 - DNA, 444 bp, Homo sapiens
aagtttctttaacatgctttgccttgactgtgagcttcttgagtacgaagaacatcctttattcacttttatatcccttattgtcttcaaagtacttagcacatggtgagtgttaaataatggctattgagtgaaggaaggaatatgaatgtgaatgagccacagtttaattatccttctattgtatggcctggacagagatgccttaatctcagcttcagacagtaactattctgtattcattttgtgtttttttaattcttcaaaagtcattaaaaaaaattatgatgacttggcaactagttgaataattagttatactttattaattatactatattatgcacactaaagattaatcttcaaaaggtgacatttctgccctccaggaacttaatgttctgtgaagacagtgtaacaatggtaaataaatacaaatattga

SEQ ID NO: 267203 - DNA, 494 bp, Homo sapiens
ttttcatttaaaaaaattatttctagtcagtctgtgcttatccaggggacttttaatgtttatttattccttgtaccccatccttacatgcttttcttggaggaaaatagtgtaattgttaccctggattctagtgtatgttcaggctggagtaagagaaaatgtgatggttcagtttttgtgaccagctttttaactttcaggccataaacgccacagaggggctcaatacttggaataagcagttctaaaatagtacattaagaaacagttggggagatatatacagtttgtttgtttgaatatgtaacatgaaataagaaagaaccatagcaaatttgagtttggtaaactcttgaaaggggtacgttgaaagaaatggggatagtgaaaaatgtttattctccacaaacaggttaccagcttagtaggaatgctgctcctaagttaaggtagtgtacttcctgctgtcagtgcaacattaaaaaaaaaaa

SEQ ID NO: 267204 - DNA, 518 bp, Homo sapiens
gttttcaaaattcacagtcccctgtgtactccagccttgtgtcctatcacagtgtcctgctcatggtaggtaggataatgattattgcatcttagaagagatggtgtagtcagctttcatatccatggaaatccagtattgacagttagacttgcctaactcatttaatctcactttttctgtagatagaagaaaatatttgatttagaaattaagagcggggaataaaagaatagttggaaaagaaatatttattagtcgaatctagtgattttctttctctggtttcttattcctccctagcctaccacaaaaatttaacagagaatttgatagtgtaattaagaatgtgcaggaattccaatatatcactggtctttcgtgattgcaaatgaaactgaaataaaaaaccctgaggctcatgctcttaaaaatatccttgagaattcttctgcctgggaagcacacagcagggagccattctctttcctgcatccttattttcttgtatttgtacc

SEQ ID NO: 267205 - DNA, 435 bp, Homo sapiens
caaagtgctagaattacaggcgtgagccactgcatccgtcctgtcctatcagcatttcttatacacacatatatttattttaaatcaacgcatatttattgagaatttattatggatacactgagaagactaagaaaggaaaatgaggtacaatctctactctccaggagcttaaaagtaatgggaaccaggcacagtggctcatgcctataatcccagcactttgggaggctgaggcaggagggttgcttgaagcccaggagtttgagaccagcctgggcaacagagggagaccccatctctacaaaagattaaaaaaattaggtaggcatggtggtgcatgcctgtagtcccagctactcaggaggcagaggcaggggaatcacttgagcctacatgctgccagtgagcagtgatcatgacactgcactccag

SEQ ID NO: 267206 - DNA, 453 bp, Homo sapiens
tctaaataaaaaaaaaaactcttgaaagtagccagaaaacacacacacacacacacacacacactttcacacacaaagtacatacagtaaaacattatggttagatagagtgaattccaaagtatgttcccaactagaagattaaaggtaatactttcttcattacaaatgaaaaattgacacttggagtaatccctcatgatgagaaacagcagtttacattaccaaacatttcccatgaagggaatgactttctttcctcaaaaaagcaacgcctgcaggcaaaattcagcctgccacctgtttatataaatgaagtattactggcacaccaccatgcccatttgtttacctattgtctatggctgctttcaaactacaatagcagaattgaatagttgcaacagagactgtatggcatgcatagccaaaaacacttactggccctttaga

SEQ ID NO: 267207 - DNA, 424 bp, Homo sapiens
gaaggtctgatctttaaaagccaaaacttgattttaacctaacctttttttattggtcttcgtgaatctgcgtaaattgctgcatctctcttggcctcagttttcttagccacacagacaggactgaactaaatgatctctaaagtacttctcaagtctataattctatgattctctttcatacttatttccctgcctccttatgttataagcaaccatttagcataagagtcaattcaggaaagcaaaatctgttagagagagtttctaaattcaaaatgaaaatgcctttgagtcattcccttgggaatgttttcttacagtttatatttcctactgtattgactagataaatattaataaggaaagtgggactactttaaaaccatcaaaaaatgagtgttgaggtatatttgagcaacat

SEQ ID NO: 267208 - DNA, 474 bp, Homo sapiens
ccttaggagagcgaatgtgaagcccagcagagcttggaatcttcaggggtgtcttgaacacaccagagagtggccccttcaaaatccaggcccctggggagcccaggccatgagtagggaggaaggtagtgctggaaccccttgcaggcctgactaaaagttgcagtggagaagtcgggtctgcaggaggcttggctggtgtgcgccgggtttcccagggtgggtcggggtgcccggggcgtagaccctgcggccctgcagcacgcagccacgctctccgcgttccaggggcggcgcgggagtggcgcgcggctgggagggcacccgggcgtccttcgcgcccagcgctgcatactcactgtgactcaccggctgctccgagatgcctcccggttttctcatcgcagtctggctgctctgagccccgagggcgtttttcattagggtgattaccctgccgtcattaaaagccgg

SEQ ID NO: 267209 - DNA, 138 bp, Homo sapiens
ccctgcccaacctggcccagaagactgttcatgccaagcccttgcctgcttcacaacctttgcatgggctgttcccttgtcctgcagagttctacctactctttgagccacctagcaaactcctattcaaccttcaaa

SEQ ID NO: 267210 - DNA, 432 bp, Homo sapiens
caaggccgacagtacacacgccctaaggtgttcttcactagtatttctttttaaattacaatctatatatatcttattcatattattgaagttgaaaacacattctaaatgaaaataacactaagaatgtctgtaaaataacggggaaacattttcaaactacatctcagatgttggattagtatccataatttatagggcaaactcagtaacaaaacagttggcaactaattttgacatagaattccaatagatatagacatgaacaaggaacttgttgattatgctaaaactataagaactaataagatgctaatataaatcctcagaagaatattaagtggaaaagacagcttgtgaacatggtcatgtgcacctcatccacagaaacatgtctggaaagtgtgcaccattctatggacaacagacctt

SEQ ID NO: 267211 - DNA, 435 bp, Homo sapiens
gttttgttttttctgaaattgcccagatttcatttaatgactgtatcatcctacctgtttcattggcatctctgtaaatattaaatcttagatgagaacagatgagttgagaatttccaggtatgatttttatatttgtgggtcttgagtttcctttttttttccagcctacatagatacaaattgttagaacacacttacctaggtagctggctaattcttaggagaactttttgtggagaaatgaagatcgagccagcttttgcccagcctttttatttatttattttttttcccgtcttctttttaaatgtcatctatgttattgtaattagaaatccccttttggaaaagatctccatttgcttctgccatgcaagggcaagggagatactggaaagccagagctccaaccttgaggagggcacaaatctc

SEQ ID NO: 267212 - DNA, 668 bp, Homo sapiens
gttagataaaatgactaaaaacgtgaaaaacaggaagaaggtttctagtaggaaacaggcctccctgtgctgtaggagaggttattcctcgtgggccatatttccatttcataaacttgactgtagacttccctccaaagaacctaaggaaaccatacaacctccccttataatctacatagtcataagtaacatgcaaccgtaaatttgattcccttcatttaccattttactaaatgtcactattcgcttataatgtcagtgactggtgaaatctgcagaaaagacaaagcttttctccttaggtgaaaaaccccaatcccaaatctttactattttttttgtattattatttttcttttctattcttgaagcagcaaatgttttggcctgttttgtgcctgtctttgcactttgcttatcaagtcatcagttgtgcagagcttgctttctaatttttcaattgttgctggtgtaggaactagagctgcaccaaaagatcagagcctgtttctgtagctgctgcttcctccagtaacaattctattagcattttagagacaaagccttgcaacacatcgatacagggaaaggaataaaagaacacagaataaaggtgaagcatgttaacatcactaccaagaaccaactcatttacgatactgatg

SEQ ID NO: 267213 - DNA, 504 bp, Homo sapiens
tgtgttggtgttcaaacatgaagatgtgcttacagtgggaatgcgatactatcttcaatagacaatcttttggcaatgtctagagactgtactttctctacataaatgttttcttttgcttttaggcaagaaagcatgcaaactctggaacacagtgtaaaacacttgaagagatacgagaggaaaactttgtgaatctgaattctgcgtgctattgaagcatggttctttccaaactcatggcaactatacctcagaattaaactctataattaaggaagaaaccctcattctccctgtaataactgaatacctaagcacattaaaatgcctaaataatctggtattttcccataagcattctgtaaagtttttcttaagctatgcggcagttataccctttgcttcctttaaaacaatatgaatgagcattttaaagagataaatggaatttataagctatcaacttctcgtcattaaaaaataattaaagctgatttaaaa

SEQ ID NO: 267214 - DNA, 506 bp, Homo sapiens
ttgagatgcagtcttgctctgtcgctcaggctggagtgcaatggtgcaatcttggctcactgcaacctctgcctccctggttcaagggattctcctgcctcagcctcccaagtagctgggactacaggcaagaaagcatgcaaactctggaacacagtgtaaaacacttgaagagatacgagaggaaaactttgtgaatctgaattctgcgtgctattgaagcatggttctttccaaactcatggcaactatacctcagaattaaactctataattaaggaagaaaccctcattctccctgtaataactgaatacctaagcacattaaaatgcctaaataatctggtattttcccataagcattctgtaaagtttttcttaagctatgcggcagttataccctttgcttcctttaaaacaatatgaatgagcattttaaagagataaatggaatttataagctatcaacttctcgtcattaaaaaataattaaagctgatttaaaa

SEQ ID NO: 267215 - DNA, 355 bp, Homo sapiens
tgtgttggtgttcaaacatgaagatgtgcttacagtgggaatgcgatactatcttcaatagacaatcttttggcaatgtctagagactgtactttctctacataaatgttttcttttgcttttaggcaagaaagcatgcaaactctggaacacagtgtaaaacacttgaagagatacgagaggaaaactttgtgaatctgaattctgcgtgctattgaagcatggttctttccaaactcatggcaactatacctcagaattaaactctataattaaggaagaaaccctcattctccctgtaataactgaatacctaagcacattaaaatgcctaaataatctggtattttcccat

SEQ ID NO: 267216 - DNA, 451 bp, Homo sapiens
aaaataagataaaaacagagtgggcaatacaaaccccccaacacacaacaaacaagcctaaaacagaaaccaggcgagacctgtctaactgtgcagacacagtgtaaaacacttgaagagatacgagaggaaaactttgtgaatctgaattctgcgtgctattgaagcatggttctttccaaactcatggcaactatacctcagaattaaactctataattaaggaagaaaccctcattctccctgtaataactgaatacctaagcacattaaaatgcctaaataatctggtattttcccataagcattctgtaaagtttttcttaagctatgcggcagttataccctttgcttcctttaaaacaatatgaatgagcattttaaagagataaatggaatttataagctatcaacttctcgtcattaaaaaataattaaagctgatttaaaa

SEQ ID NO: 267217 - DNA, 547 bp, Homo sapiens
ctcaatattcttaataggtggtagggctatttccctttttcacttttgagactgacagatttgcagatattctatgtacattttaggttttgtttcattttgaaattttgattaggattggttgtatagatcgatttgggaaacttatatattttctaattgtatgcctctgcattcacttgtaggaaatctggctatttttaatacacagggatttaatatagggaattggtgctttacaaagtttgaaggactggaggagtgggctttagcctgggctgtcagaagtgagtcctaagataatacagatttagtatccctaatccaaaaattttaaatcccaaatgctccaaaatcccaagctttttgaacacaagcatcatgctcaaaggaaatgctcattgagcatttcagatgacagattttcagattagggctgctcaaccagtatgtacataatgcaaatattccaaaaaaaaatcccaagtctgaactgggctgtcataggacctgctgcaactgttttcacccattaggaggatagaga

SEQ ID NO: 267218 - DNA, 233 bp, Homo sapiens
tcataacctccttccttcgatttgttaggggccgtacacaaaaatcaaatattaaaagctatcttcactatgccaaggatcattaaatttatcccattagacaatgattctcaagcttaatagatgtatttcaagtgactatattactattcacttgaaatgttttaagtttatttaaacttatataaggaaaaattttaaaatagctacaacagtactgtgaatgtaaacct

SEQ ID NO: 267219 - DNA, 394 bp, Homo sapiens
gttaacgacgtcacacagcaactgctggcagctggacctgaggccagcttttggaccaagcccctctcctctgctctgtgctgcctggtcaggccatctgtcttagtccctttgggctgctatgacagaatcccttagactgagtaatttatcaacagcagaagtttattttctcagtcaggaggctggaagtcctagatcaagatgcctgcagatttggtgttggtgagggctgctctctgcttcaaagatggagccttggctggagctggtggctcatacctgtaatcttagcactttgggaggctgaggtgggaggatcacttgagccaaggagctagagaccagcctgggtaacacagtgagatgccgtctatattttaaaagaaacaaa

SEQ ID NO: 267220 - DNA, 526 bp, Homo sapiens
catattacagaataggaaactgagtcacagagtgcttcccccccccacccccatacatgctggcttccaaggctggtaagggggctggaactggaacgcaggtcttgggactgacctggcttcattgcaagtctgccagagaaacgcaaaaggacaagcagcattcccaagcatctggcatggtcatcggtgcaaacaccccgttcatgtaacacgggcctgaggtcagcagtagaggaccagtattggttttggccccagcctctgcgtggatggattgaacgcctgcatccctgcttttctctcaactctgctgtctcaaaggagaggtgggggtgggcctgagggattctctccctgcatggaacctacgggcttgatcatcgaggatatggggctagatatgtcccgaacctcagctcgtcctttcttccccgggaatggtcacggggagtcctgcgtgcatgtctggctttgttaataataaagaataaataataagatggtgagactcatcagctcacga

SEQ ID NO: 267221 - DNA, 347 bp, Homo sapiens
attcatttagcttacaaattcattgtgactcataataaggaaaatgcagattaaaaccacaatgagatgctatgttacactcagcagactagcaacaattaaaaagtttgacaataatacacagcattagaaaagatatgacgcaatggaaacctcatacactgttggtgggagtataaattggcataagcattttgaactgctaggatcctgaaatctcactgaaaaatatatcctcaaaaaatcatggacatatgtgtaccaggagatatgttaacaaaatgttcatagcctcattgtttgtaatatcaaaactgtggaagcaatccagatgttcctcagcagga

SEQ ID NO: 267222 - DNA, 345 bp, Homo sapiens
ctcctgcctcagcctctcaaagtgctggtataagccacccagctggtctggaattcctagactcaagtgatcctcctgcctcacctctcaaagtgcaggtataagccaccatgcccagccttcacagcagttatatccataaattaacctagtttcaccaaataatccaccaaaataaaccgttctggaaaacctgtttaaagtcacacaaagtcacacaatctataaaaagctaaaaaaaaaaaaaggaacaaatacacaattgtacaaacatattatcaaactaaggaacttcacaaaaatcctatctcacataccaaatcttcatacatacttctaggggac

SEQ ID NO: 267223 - DNA, 1042 bp, Homo sapiens
tagatttctaaaatgagatttctgagtcaaacagtaaacgcacatgtagctttgtaaagtaatgtcaaatttcacttttaaaaggttgtaccagcttgacatcctaccagaaatgcatgtaacagaatgtgttgtaaaatttattaatttttgccagcctgacaggcaagaaatcgtatctcagtgttgttttaattgtattcctctaattatgagtgagtgtgaacaagtttcatgtttaagggccatttctatttcatttgctgtgaattgtctgctcacgaaagcaaagccagcaacagaaatggacaggaaactttcacatctggctcccaggataggccctgccccctggattgagctccatggagaccttagacttgcctgctttctcagccctattcatacacccagcacccagggcagacagaattctattcctcccagaggtggtccgtgacctcagtactgcagtttggttgctgtcttaaccaagctcaatggtctgagtattcagggttacggttatttttaggtttcctgtgacaataaaaaacattttctgcagatgcttaaaagtaagccctgtgtttggtgtagaaatcacaaagttaacaattaacatgggccctgggtatcttcacatttgagtgtcaggcattggtcctcatgtttcatactgggaaaagtcaatcaactcaccatttggcaaaggtcaaagcaggggactgaccttatgactgatgattctgtgttccagaccactgtgaattcctctacctgtttgcaaaagaaaaagggaattttcctgagtttcagttgaattaatcacatttaacagctcttcagaggaaaaaaaaaatcaatcttgtaaattacaagtactgccaggggagccttacattaggcatcacttccatgtatatagtcagaccagaatgaagctggatttgatcccttgaggttgaactgtcaccaaaggcagcatttccgctactctctatcttttcaataatgtaaataaagaactggatcaatttga

SEQ ID NO: 267224 - DNA, 431 bp, Homo sapiens
tttctggaaaatctatggaaggcaggttgggaacacttcttttttgtagaacctatgaagagacactttggagcccattgaggcctgtagtaaaaatacaaatgtcccatgatgaaaactagaaaaagttttatgtgaaaatgctttgcaatgagtggattcatctcacaagtttaaagctgtgttttgatttagcagattggaagcactatttatggagaatctacgaagggacattttggagcccattgaggcctcttttaagaaatcaaatgtcccacaatgaaaactagaaataagttgtctgtgaaaatgctttgtgatgtatggatgcatctcccagagttaaacctttgtttttattcagcaggttgcagacagtctaattctggaatgtattaaaagacatttcagggcccattgagaactat

SEQ ID NO: 267225 - DNA, 544 bp, Homo sapiens
tatgctaatatttgtttctaggtcccttattatatactaaatcatggctctacaaaaagcacaagatgaactcaaagtagatttaattatatactttgctacatttttggcactttaagaatacacttgataggatgccttcagctctaattcacctggtcatatgaatattagaaagttttcagaatactctacttttgaaaagatatacaaatacttgcaaattacacatccaacaaaggtctaatatctagaatctataaggaatgtaaacaattaaattagcaaaaaaacaaacaatctattaaaaaatggccaaaagctgatcatgaggtcaggagatcaagacaatcctggctaacatggtgaaacctcgtctctactaaaaatacaaaaaattagccaggcgtggtggcacatgcttgtagtcccagctactcaggaggctgaggcaggagaatcccttcaacccaggaggcagaggttgcagtgagccgagattgcactactgcacttgagcctgggcgacagagtgagacttgct

SEQ ID NO: 267226 - DNA, 168 bp, Homo sapiens
ccacataaatcatccgctctgttaacatcaggtcactgtctccactccccgcttcccagctattgaaatatctatttagggtttttgtttgtttgtttgttttttgagacagagtctctgttgcccatccagcctgggcaacaagaccgaaactcctccgtctcaaaa

SEQ ID NO: 267227 - DNA, 567 bp, Homo sapiens
aggcagtagctccctttgcaataactctttaaccttacttagaataaaatcgacagactatccccttttctcaccaagttttagtttagaacttttgaggtctttggaaatttactctgctcaacttctcctttcatattttacatctagtgttccccacatgaatgattctaattacaaagacagttgtaatctcttctggaggcagccacactgctgggatgcatgattaggtgaagcattttagctgacctgggcttggattggctatccaaagaagaaagtcaaaggctgacaactcagcctgggcaacatagcgagaccacatctctcaaaagctaattttttgtatttttagtagagatggggtttcaccgtgttggccaggatggtctcaatctcctgacctcgtgatccgcccgcctcagcctcccaaaatgctgggattacaggcgtgagccaccacgcccagctgaggcaagacttctgtaagtattcttcaagcagtagtacaagagttaaatatgtattcttcttttttaagctggtaaataaaaaaaaaaaatg

SEQ ID NO: 267228 - DNA, 460 bp, Homo sapiens
tatataatataatatgtaatataataaaagtatatgtaatacaacatttatccaggaagttgtgatataaatatatgtgtgtgggtataacattatacatgtactgttaatacattgattttaaatgaaaagataaaccatacatatttttaaaaattatctcatataaggggatgaagagatatgacagagagaaaaaggaacaggtcaaatacctcaaaatatgcttcggtttgtagatttgattttgaaaccacataaatatttttacataattatgaaacaaattgaaatattaaaaaaatcagttcctaaacatcaaaaccaaaatggaataaacataactattgatttgtggcatgtccacaaagaaagagacaatttcatgtgacttaaaaacattaatttcattgtacatccttagtgagacatgccctaaaaacaaaaagaacataaaaaa

SEQ ID NO: 267229 - DNA, 513 bp, Homo sapiens
atttacagaaataaatatgcttttttgaacctggccgttcatacaacctagaggaaacgtaacacaggaaaagcagcattgaaactcagaatccagatttaagtctcaattaactcactggttttggttttagccctgaaaaccaatcatcttggtgttagcactgaaagtcatgtgttccaggaaacccctaagttccaggacttgacctcttgcccaccagataactcttgttaaaacagatttcaagtcataatctctcctgaagactcttggttcattgtcatgcatcccctggtactattatacacatccattataagaagaaagctaacagaaaatatgcttccttgccagagtatactactaagttggaatcacagcagtattttcttctatgaactctatagcttagcttattaatatgctgatgaagtcattagcagtttcaacatttgcaatgaaatcaatttggttatactcataataaattaaaattaaaatatttcaaaa

SEQ ID NO: 267230 - DNA, 1698 bp, Homo sapiens
gtagacctggttctggtttcctcagtcagaatcttccagttgtccacaacctcacaaggccagagaagcgagagatttctattctggaaaggagtgagtggatggcacaactggtttggaaacacgacacacggcgcctgcatttacagaagcaacgcacacagggaacgtcctagcgccatctggtctcgcacacatacttaggactcacgttggggatcccgggcctctgccagccctagttgttggtgcccagcctgggaggcctgggcggaagttatgcaggcctggatcttccggtccagcgccaccaggaagcgcctccaggtggcgctgtcgggatttgctctcctcagggcctatctttagggaacgcactttatcttccaggttttgatcctctctctgccgcctccatcttctcagagacacagtcgcactctgactcacggcctcttcctctgctccgcactggccgtcgactcctgcagcgccgtgggcagccggaagtcggtctcccgccgggtctgcagctccatctcccacctcttcccgtgggcagctctgcgtcgaggccgccttcagcttgtggttcccagactgcaggtgcgtgtcggctgcagcggcctgagaggcctttcatcgtccgtcccgttgacactggatgccggagtagaagatggggctccacgccctgattctcaggatgattactcgagggctccatgttctcctgggtcttgtctttggctgtcttggccgcttcttccacctcctggaatttctctgcaaactttgtcagctgctgctcagaggaaaaccccaaaccaaacaccgtgttggctctgctgtcggcccactgcccagacgtctgtgacgtgttggtgaaggtcatattctgtgtaattgtgttgtttatggtcaccttggcgctgtccacactgatgatcccatagctgttccttgtgacatcatagaaacaggaaatggtgaccgcctgttgctcgcaggcatccagttcttcttggtgttggggtcaatctggaagacccgcgctcggggggtgaagatgggctgttctcccattctgacgctgctccagcggccgctccgacccggcctctggcgctggctctccgcccgctgggcatccgctccccgcgcggcacgtgcggcggcccctgcgcgcctggctcagccctggcgccgctccattccgccaggcgcgggcgggcaggagctctggaaaaaattattctaagagacaaattaaaagaataatctgtaataaggagacgtcaacattccatctcagaaaaaaactgaaaacatgtaatacatacaaagtcctgagaagaaacctcgaagcacaggaagggtctcatgtatagtagcatgttgagaaaactgaagagccctgtaatcctgaggagggggcctaatccaaggagagagaggctccgggtcctgtggacacacacgggttgcctgcttcaccccatctaggagctgcttcctgaagccttcaggaggcaggaagctgaatttgtttctcaggacaatctaatcacatccggacagggagaaaaacattcatgacctaggacagataaaatatgtataattaaaatttcattgaaaattgagaaattttggttgtatgtatttatagtgaataaagctatgttatgatttaaa

SEQ ID NO: 267231 - DNA, 1724 bp, Homo sapiens
gtagacctggttctggtttcctcagtcagaatcttccagttgtccacaacctcacaaggccagagaagcgagagatttctattctggaaaggagtgagtggatggcacaactggtttggaaacacgacacacggcgcctgcatttacagaagcaacgcacacagggaacgtcctagcgccatctggtctcgcacacatacttaggactcacgttggggatcccgggcctctgccagccctagttgttggtgcccagcctgggaggcctgggcggaagttatgcaggcctggatcttccggtccagcgccaccaggaagcgcctccaggtggcgctgtcgggatttgctctcctcagggcctatctttagggaacgcactttatcttccaggttttgatcctctctctgccgcctccatcttctcagagacacagtcgcactctgactcacggcctcttcctctgctccgcactggccgtcgactcctgcagcgccgtgggcagccggaagtcggtctcccgccgggtctgcagctccatctcccacctcttcccgtgggcagctctgcgtcgaggccgccttcagcttgtggttcccagactgcaggtgcgtgtcggctgcagcggcctgagaggcctttcatcgtccgtcccgttgacactggatgccggagtagaagatggggctccacgccctgattctcaggatgattactcgagggctccatgttctcctgggtcttgtctttggctgtcttggccgcttcttccacctcctggaatttctctgcaaactttgtcagctgctgctcagaggaaaaccccaaaccaaacaccgtgttggctctgctgtcggcccactgcccagacgtctgtgacgtgttggtgaaggtcatattctgtgtaattgtgttgtttatggtcaccttggcgctgtccacactgatgatcccatagctgttccttgtgacatcatagaaacaggaaatggtgaccgcctgttgctcgcaggcatccagttcttcttggtgttggggtcaatctggaagacccgcgctcggggggtgaagatgggctgttctcccattctgacgctgctccagcggccgctccgacccggcctctggcgctggctctccgcccgctgggcatccgctccccgcgcggcacgtgcggcggcccctgcgcgcctggctcagccctggcgccgctccattccgccaggcgcgggcgggcaggagctctggaaaaaattattctaagagacaaattaaaagaataatctgtaataaggagacgtcaacattccatctcagaaaaaaactgaaaacatgtaatacatacaaagtcctgagaagaaacctcgaagcacaggaagggtctcatgtatagtagtgttttgtgcttctctggtataacagcatgttgagaaaactgaagagccctgtaatcctgaggagggggcctaatccaaggagagagaggctccgggtcctgtggacacacacgggttgcctgcttcaccccatctaggagctgcttcctgaagccttcaggaggcaggaagctgaatttgtttctcaggacaatctaatcacatccggacagggagaaaaacattcatgacctaggacagataaaatatgtataattaaaatttcattgaaaattgagaaattttggttgtatgtatttatagtgaataaagctatgttatgatttaaa

SEQ ID NO: 267232 - DNA, 1803 bp, Homo sapiens
gtagacctggttctggtttcctcagtcagaatcttccagttgtccacaacctcacaaggccagagaagcgagagatttctattctggaaaggagtgagtggatggcacaactggtttggaaacacgacacacggcgcctgcatttacagaagcaacgcacacagggaacgtcctagcgccatctggtctcgcacacatacttaggactcacgttggggatcccgggcctctgccagccctagttgttggtgcccagcctgggaggcctgggcggaagttatgcaggcctggatcttccggtccagcgccaccaggaagcgcctccaggtggcgctgtcgggatttgctctcctcagggcctatctttagggaacgcactttatcttccaggttttgatcctctctctgccgcctccatcttctcagagacacagtcgcactctgactcacggcctcttcctctgctccgcactggccgtcgactcctgcagcgccgtgggcagccggaagtcggtctcccgccgggtctgcagctccatctcccacctcttcccgtgggcagctctgcgtcgaggccgccttcagcttgtggttcccagactgcaggtgcgtgtcggctgcagcggcctgagaggcctttcatcgtccgtcccgttgacactggatgccggagtagaagatggggctccacgccctgattctcaggatgattactcgagggctccatgttctcctgggtcttgtctttggctgtcttggccgcttcttccacctcctggaatttctctgcaaactttgtcagctgctgctcagaggaaaaccccaaaccaaacaccgtgttggctctgctgtcggcccactgcccagacgtctgtgacgtgttggtgaaggtcatattctgtgtaattgtgttgtttatggtcaccttggcgctgtccacactgatgatcccatagctgttccttgtgacatcatagaaacaggaaatggtgaccgcctgttgctcgcaggcatccagttcttcttggtgttggggtcaatctggaagacccgcgctcggggggtgaagatgggctgttctcccattctgacgctgctccagcggccgctccgacccggcctctggcgctggctctccgcccgctgggcatccgctccccgcgcggcacgtgcggcggcccctgcgcgcctggctcagccctggcgccgctccattccgccaggcgcgggcgggcaggagctctggaaaaaattattctaagagacaaattaaaagaataatctgtaataaggagacgtcaacattccatctcagaaaaaaactgaaaacatgtaatacatacaaagtcctgagaagaaacctcgaagcacaggaagggtctcatgtatagtagaggttgtaatatgtttattgttaaaattattacctttgtgttgttttgaaaaattgaagaaaaatataatgaaattaagtgttttgtgcttctctggtataacagcatgttgagaaaactgaagagccctgtaatcctgaggagggggcctaatccaaggagagagaggctccgggtcctgtggacacacacgggttgcctgcttcaccccatctaggagctgcttcctgaagccttcaggaggcaggaagctgaatttgtttctcaggacaatctaatcacatccggacagggagaaaaacattcatgacctaggacagataaaatatgtataattaaaatttcattgaaaattgagaaattttggttgtatgtatttatagtgaataaagctatgttatgatttaaa

SEQ ID NO: 267233 - DNA, 342 bp, Homo sapiens
gagctgccttggtgctgtaaaggtaagaaaatggaggctcccagagatttgacaacctgcccgcagcaatgaccaaatcagacttggtgctaagtctgcacctccccaaagtcagtgtgtttgtatgctctgctgccactgccccccgctggccctgcacatgatgtgaaccatcaggcagacctggagttctgtctcctgggtgggctgcttgccaacaccagggtggctggcccctgcctgtgtcaggtcctgcagtgttgactctcttcgtgtgatgttgggcaggtggagctggttgtgctgagcctgaggaaacatccaatgtgccaaactttaaag

SEQ ID NO: 267234 - DNA, 165 bp, Homo sapiens
gaaacttagcaggatcagctctacgtgacccagacgcttaagcacattgagagctgcaacaataaagtgcttaagaaagtcccaggtagaggagtttgtaaaggagggttctttagcactgtcattcgtcttggatgagagtggagcacttcttcttaggaacac

SEQ ID NO: 267235 - DNA, 449 bp, Homo sapiens
gcaggaggccctgtggcaagtggagccccaaccgcagagcaccatctccagccgtgtgctctcgggtgcagagctgacctcccaagtctcaggcttcttgtctctcaagttgggggtaacaatggctatgtacataagattaggagaacacacagaaggtggtgctggctaaagccattatcacaggctggtgcctatagtcccagcactttgggaggccaggcgttagagaccagcctgggcagtataacgagactctgtctctaccaaaaaaaaaaaaaaaaaaagagccatacaaggtggtgcgtgcctgtggtcccagctgtttgggggctgagatgggaggatcgcctgagcctgggaggtcaagagtgcagtgagccatgatgactgtgattgacgtgttgaccaggcactcaaaaacaaacaaacaaacaaaaaaaaaaaaa

SEQ ID NO: 267236 - DNA, 417 bp, Homo sapiens
cacgaggccgggccgcccgctgcttcccacccctgcagcctgcgctgcggagtacaaagagcggagggcgcgcttgacctggggctggggtccagccctgcccgccggtgccgtctgctcaactagttaggtggctgctgcgcaggattccgggaaacgtcagtctgccatgagccggcaggactgagcctgcgactcggagcagagcgagtgaggggcagagcggtgctcaggagtgcggcccggggccgccggagctgggggtcgggccgggcgatgatccggggcttcgaggcgcccatggcggagaacccgccgccgccgccgccgcccgtcatcttctgccacgactccccgaagcgggtgctggtgtcggtcatcaggacgaccccgatcaagccaacgtgcggcggtgga

SEQ ID NO: 267237 - DNA, 567 bp, Homo sapiens
aacagaacagtcccactccgccggggagggtctggcggtaaccgtagctcacacctccctgtggcccgtcgtcccctcctcttgcctgccctgagcctgcagtgtcattgcccccatttcatacgtgaggaaactgaggacacagaacaagcatccaggccttgtgcagtcaggtggtctgacctgagcccagtgagggaacactgggaccgggcctgggaggccaggtaagagatggtggcctcttgccgtcctgaattggcacagagccagtgctcagtggttggactgactcggagtcacgggcaggaagaacttcctcatggtcaggttcctggccaagaactaggacagacatgtgcctcctgcagggctgggcacagcagggtcactgcacccctggatggatgcccatcaggtgcgctggcatcacctggctgattgtctttgtaggcttagtgaccctctgcccctcctgacacccagagacgggatcccttctcaggaactggagtcattttgcttatttctattaacatctcttatttctttcaaaattcaaagtca

SEQ ID NO: 267238 - DNA, 240 bp, Homo sapiens
ctatttgttggagtgccagattatttaagggcctttgcatgtttcaagtcctcttcttaaagtaagaatactctccacatttataacagcaacaaaaacaccaatgtcagcacaaaatgcaaaaacggaggcacttctatgtcataatgatacatcagagttctgctcaactcttttttagaaaaagaagctcagacttacacacatccactttcttaaataaataattgttcaatgaaa

SEQ ID NO: 267239 - DNA, 380 bp, Homo sapiens
  misc_feature (327)..(327): n is a, c, g, or t
  misc_feature (335)..(335): n is a, c, g, or t
ggtctgggtttgtgtaaatgcactctggaatgtctgcacaatgatgaaattgccttatgatgcttctcagaatgtgtccccattgtgaagtggcacatgactgtataattgttgtcttttctcttcttttattgaataccacagcagatggtgttgtaatgtttactgcagacatcaaatacgattttgaaaactcaggaggaaaaggataatctcttcttctcatacctgtttttacccattctggtgttcttctttcccttctgatgttcccatctatcttctgtaatcctagtctttgggaggccaaggcgggaggattgcttnagtttagnagttcaagaccagcctgggcaacatagcaagacctcatctctacc

SEQ ID NO: 267240 - DNA, 460 bp, Homo sapiens
aatgataggatacatagaaatagatcatcaataaaaaggaatgcagtactgatacatgctacatggatgaacctcaaaaacattatgctaagtgaaagaaattactcacaaaagaccgcatatgatatgattctattaatgtgaaagttccagaatggataaatctatagagacagaaactagattagtggttgcatagggcttagaaagggcatagacagaatcttttgggggtgataaatatattctaaaattaggttacagcgatgattgcacaactctgtaaatacatgaaaaaccactaaatcgtgcattttaaatggatgaattttatggtacataaattatatctcaagctgctttttaaaaaagagatatagtttcattactttcagaaataatacaaagtttaaaatgacatgctaagcctgggcaacatggcaaaaccccttctctacag

SEQ ID NO: 267241 - DNA, 279 bp, Homo sapiens
atcaggcaaggtttggaaatacagcatattagaacaaatgtgagctttgggttagagagtaacatcaagtcataagtctgccatttacttgctgaatgattttggcaagtttcttagccactctgtctccaaattacttagcctgcttgtgacagtttcatcaaatgcctttcacaagattgttgtaagcatgaatcctctaaacaaacggcttagtataatgttggctccctctcctccccttaccctcccctcccctgaagttccagctccaattct

SEQ ID NO: 267242 - DNA, 470 bp, Homo sapiens
gttgtcagcaaagaaaaggtggtttcaaaagagcagcagaggactctgtgctagttgctactggccagctttgactccgattggaagcttgaaaaacatagattggaagctatgcagaatatccagtgacagaaataaatcagagattgccaggggctgagggtgagaggaaggagattgacttcaaaggggcacagataatttctcagggtgtcggaaatattctgtcttgattgaggtggtgattactcgactgtatatgcttgtaaaaatttgtagaactgtgtgcctgaaaagggtgaattctactgtatgtaaattataactcgataaacctgatttttaaaaacactgtagtttgggaggccatataaaaccaaataacattttgagtcattaatgcctctttaagaatattttggattgattttttttattagattaaaaaaattcttcatggtaaatattaa

SEQ ID NO: 267243 - DNA, 371 bp, Homo sapiens
tgctctttttagtcatccctggaatcttctgggatttatgtctcctttatgccatctacattcttgtaaactcccaatcttggctctcttgccaaacccattagagctcaccgttagtaatcctgcctcaacagtacctttccttggcattcaggataaattaaccctcctctatgctttcctggtgctgctatacacctccatcaggtataaattgcataatatcgcgttatatttatggcttcctcactgcaaagttttcatgtatatgttttcctcatctttacattttcagcggctagctggggaaaaatgcgaagaaagaaagagggagagagatagataaagaagagaaagaaaaaaaaagcaaa

SEQ ID NO: 267244 - DNA, 563 bp, Homo sapiens
ctggaggtaatggagagtgacgttgtagaaagacaactttatctctggagaggaggacatgtgggagagagaaaatgtaggcatgcatgggaggccgttaaaggtgtctaatgcatgtatatttacagcaattaactagtatgtctctacttgatacgaatatgtctctacttttttcaagggctacttaatttgataatactagaggattaagggtaacttagaaatttggcttcagaaacttcatatttctaggctaatatttacttatgtagtggatgtaagaatattgcctcagttaattttgtttaagatatttaaagagaggatgtggcttactatgttttagctaactaagtaaaaaggaagacagtgattaatgaggaaattctggaaatgactctgtttaggctgcgtttcacatgcaattttgcagaaaagttgcatctcaaggtctactattcgtgggccccatctgcctctcacttttagctttgagccatcaacaaagaagttagacttatttttattccatttgaatgcatttttttcctgattgtaaa

SEQ ID NO: 267245 - DNA, 386 bp, Homo sapiens
tcaaattaaaaataaatgaattgacttgatattttctttacttaacacttaaaaggaattaaagacattatgtttgattaatcgtttcagtaaacttatgcctctagccacattttcataagccatttgtggggtggggcttgaccaagtaatacaagtctttggaggttttaatagatatgatgtattacctttgccaaagaaactggagatgctaatataaacagatttccttactggaggattttttgtagaaacctttcatgtgtcaatgaactctccttctctcaagtctacagccacagtgtacagcacttcctgaattaattgcctcttttttctggagtattctgagtctactgctaagactcattcaatgtaaaaaa

SEQ ID NO: 267246 - DNA, 466 bp, Homo sapiens
aggctggctggctggcctcaaactcctgggctcagacaatcctcccactttgaccccctgagtatctagagttacaggtgtgcaccaccaccccaacctggcttgaaatgtcctttcttgcctccttgtctctgattcacggggaaaggatggttcctgctggtttatattcaagattggctaggcgcggtggctcatgcctgtaatcctagcactttgggaggcctaggtgggtggatcacgaggtcagcagattgagaccatcctggctgacacggtgaaaccccgtgtctactaaaactacaaaaaattagccgggcttggtggcgggcacccgtagtcccagctactcgggatgctgaggcaggagaatggcgtgaacccgggaggcggagctggcagtgagccgagatcgcgccactgcactctagcctgggtgacaaagcgagactccatctcaaaaaaa

SEQ ID NO: 267247 - DNA, 664 bp, Homo sapiens
cgagaccagtttaagctaaaatattatttccatctctttatagtgccttttccagagctcctatttatctcattgttttactccattcccatcctgaacttctcaaaggagaagttctccttcagttctgtcattttatcttgactctcacagtcactgtcacattgtaagtactttacaaagaactgagaaattagattgtcgagatcaaaaacagaacttatcttccatttaactgtcttctctctaacagggaaaaggaagtcacaaacttgggaggcaggagggcacagcactccaggacacgcgctttggagtctgagcacaggctgtgccacacaatgtgtgcgtgatgatggacaagcctcaaccttagcccctgtatctgtaaaatgggcataatgataaggccacctcaaaggacattatgaacaatacacaaaaagatgcctatgaaacccgtagcatggtcattggaatcagcaaagtgttcaataaatgttagctatatcagtgctatggttaaacatttaaaaagctgaggctgggtgcggtggctcacacctgtaaccccagcacttcgggaggccgaggcgggtggctcacctgaggtcaggagtttgagactagcctggcaaacatggtgaaaccccatctctactaa

SEQ ID NO: 267248 - DNA, 808 bp, Homo sapiens
ctaagagctccccttctccgaatattctttttttttaatagcatcctattttggctcatggttgcagtattttatctccttgaagatgtttgtgtgtttatgtatgtatatgcacacacgtatacatacacatacaggcatgcatctctgtattctttcggcataatctgtgtcctccagggtttgtttctttgtttcccctgtatgtttgttttggtcgttcacattataggctttcctcagagttaatggtcttggtagtctactcatatttaagtgtggaacaccaaaaagcttactataagctgagagtgtggtaaagggctctttgttttactatgacctacctgagctatcttgctggggaacaccctaatgtcagtctctttataaagggcctttcattttggcctggcaagaaatactctttcatcctcctgcatggagggcaaaaaaaaatttaaaaattggctgctagggtctgctcacttccctgttttgcagaccccacactcttctgcaattcatttcatagttgtcaagactatacaaattgtcctttttaatgttctctcttctgctatccctagttggcagtcttcctctttacaacctgctgaaagtggaagacctccagttttcctttaattcctcagcaaaccaccaactattatatgtcttttttccagaacaacttattttttaactataattatatgcatttatgttagattcactgaaaacctcatcttgtatggtgctctgtaccctatgggtgctaaataaaggcttgctactggcaactgga

SEQ ID NO: 267249 - DNA, 492 bp, Homo sapiens
ctccctttgttcagcaagagactccactccagactgctgcaactcagaacctctctcttcccacagctcccagtcagagaccagcatatcagcatttctcatcttgcccctagctacctgatgctgaaggtaaatcctgggggagtgtggtggagaggtgggagattccttcttccatccagaggctctaccttgggtggagtgctgagacaccagaggagacttcagctctttttctccatcactttcaccccatattcacccccaacctttttttttaatctctccatcttcccaagatagttatattctgtttgattaatcttcagtatatatgctattataatcatgtaaacggtagtcacagccaagttatgtaccaaactatgattacttttcctttcccacacaacttttagttttttctggagttaataattgtcttgttttgttggtttttccatgtaattctatcctaaactctgtcagtta

SEQ ID NO: 267250 - DNA, 394 bp, Homo sapiens
ccttcatccagtttctctctttccttttttctcaccctgttttatcgaggtgcagccctttttatctggtcacaaaagggaactcctaagtgttggtttgtgatcaagaagcagcaaagctgtcatctctctaaatatatttttatattttgcttggggttgtcactataaataagaagaagtattgctgatagggcttttcatgtgtgtactctctttctctctccgtcctcattcacttcatcatccttaggcccccagagctgtgtcaccaccctgaaacaaatgagggaaagcaaccaattacattaaaatgcaatataaatagagggaacaggcaatgtataatgtggatttcctgaacaactgttcacattctaggggctggtcaagc

SEQ ID NO: 267251 - DNA, 461 bp, Homo sapiens
tagggtgggtgatactgggaatgtgaaagcctgcctgtgtacacatttctggcggaaggacaagaggggtcgctcccaggccatagttcccagatatgggaaagaggccccctgcatggcaggcttcccagaggatgcacagcaggtggggctttgtgggatgtataggaggtctccaaatggagagtccaggcatgagccaccgtgcccggcctagacacaatttttataatgaatggaggtgcactttcacctgagcaaggtggaggaacaagaaagtgacctatgtgaggaaaaggatgtttgttttgcacgagctgtgtcccccaatgtacacagtaggtgctcaataaacttttttttttttttttttttttgagactgagtctgactctgtcgcccaagctggagtgacaaagcaagactcttgtctcaataaataaataaataaataaaatttt

SEQ ID NO: 267252 - DNA, 901 bp, Homo sapiens
ttttacagatgaggacgctgaggtacgaagaggctgcgtaacctaccagggtcacacagctttggtgtggagtagggactcaaatccagggcccctggtacggaggcatttgccctcaccaagattcaggcactgagagaagctgacgggcctagagaatggcaagacttgagatagcagaaggaaggagagagggtgagaaatggatccccgtgctgaggtctggtctggaaggagaagtctgcaaggagtctgcactatggaaacaacctgtcaatccagctcaaggcacacatagcccagacacccatgagaccctctccgtggggaccctagagcacctatcatgaacgaggagaccaaggctggctcctcatggaccccgttggcctccagctcggcaacaagaacctgtggagctgtcttgtgaggctgctcaccaaagacccagaatggctgaacgccaagatgaagttcttcctccccaacacggacctggattccaggaacgagaccttggaccctgaacagagagtcatcctgcaactcaacaagctgcatgtccagggttcggacacctggcagtctttcattcattgtgtgtgcatgcagctggaggtgcctctggacctggaggtgctgctgctgagtacttttggctatgatgatgggttcaccagccagctgggagctgaggggaaaagccaacctgaatctcagctccaccatggcctgaagcgcccacatcagagctgtgggtcctcaccccgccggaagcagtgcaagaagcagcagctagagttggccaagaagtacctgcagctcctgcggacctctgcccagcagcgctacaggagccaaatccctgggtcagatgtgccgggatctctagatgacccgc

SEQ ID NO: 267253 - DNA, 751 bp, Homo sapiens
gtgtgactttatcctggaggcagtgggatgctgatagcaagttcagacaggcatgaggccagaccagagctgagttttcaagataactccagccagaggagtctgcactatggaaacaacctgtcaatccagctcaaggcacacatagcccagacacccatgagaccctctccgtggggaccctagagcacctatcatgaacgaggagaccaaggctggctcctcatggaccccgttggcctccagctcggcaacaagaacctgtggagctgtcttgtgaggctgctcaccaaagacccagaatggctgaacgccaagatgaagttcttcctccccaacacggacctggattccaggaacgagaccttggaccctgaacagagagtcatcctgcaactcaacaagctgcatgtccagggttcggacacctggcagtctttcattcattgtgtgtgcatgcagctggaggtgcctctggacctggaggtgctgctgctgagtacttttggctatgatgatgggttcaccagccagctgggagctgaggggaaaagccaacctgaatctcagctccaccatggcctgaagcgcccacatcagagctgtgggtcctcaccccgccggaagcagtgcaagaagcagcagctagagttggccaagaagtacctgcagctcctgcggacctctgcccagcagcgctacaggagccaaatccctgggtcagatgtgccgggatctctagatgacccgc

SEQ ID NO: 267254 - DNA, 977 bp, Homo sapiens
ttttacagatgaggacgctgaggtacgaagaggctgcgtaacctaccagggtcacacagctttggtgtggagtagggactcaaatccagggcccctggtacggaggcatttgccctcaccaagattcaggcactgagagaagctgacgggcctagagaatggcaagacttgagatagcagaaggaaggagagagggtgagaaatggatccccgtgctgaggtctggtctggaaggagaagtctgcaaggagtctgcactatggaaacaacctgtcaatccagctcaaggcacacatagcccagacacccatgagaccctctccgtggggaccctagagcacctatcatgaacgaggagaccaaggctggctcctcatggaccccgttggcctccagctcggcaacaagaacctgtggagctgtcttgtgaggctgctcaccaaagacccagaatggctgaacgccaagatgaagttcttcctccccaacacggacctggattccaggaacgagaccttggaccctgaacagagagtcatcctgcaactcaacaagctgcatgtccagggttcggacacctggcagtctttcattcattgtgtgtgcatgcagctggaggtgcctctggacctggaggtgctgctgctgagtacttttggctatgatgatgggttcaccagccagctgggagctgaggggaaaagccaacctgaatctcagctccaccatggcctgaagcgcccacatcagagctgtgggtcctcaccccgccggaagcagtgcaagaagcagcagctagagttggccaagaagtacctgcagctcctgcggacctctgcccagcagcgctacaggagccaaatccctgggtcagggcagccccacgccttccaccaggtctatgtccctccaatcctgcgccgggccacagcatccttagacactccggagggggccattatgggggacgtcaaggt

SEQ ID NO: 267255 - DNA, 1074 bp, Homo sapiens
ttttacagatgaggacgctgaggtacgaagaggctgcgtaacctaccagggtcacacagctttggtgtggagtagggactcaaatccagggcccctggtacggaggcatttgccctcaccaagattcaggcactgagagaagctgacgggcctagagaatggcaagacttgagatagcagaaggaaggagagagggtgagaaatggatccccgtgctgaggtctggtctggaaggagaagtctgcaaggagtctgcactatggaaacaacctgtcaatccagctcaaggcacacatagcccagacacccatgagaccctctccgtggggaccctagagcacctatcatgaacgaggagaccaaggctggctcctcatggaccccgttggcctccagctcggcaacaagaacctgtggagctgtcttgtgaggctgctcaccaaagacccagaatggctgaacgccaagatgaagttcttcctccccaacacggacctggattccaggaacgagaccttggaccctgaacagagagtcatcctgcaactcaacaagctgcatgtccagggttcggacacctggcagtctttcattcattgtgtgtgcatgcagctggaggtgcctctggacctggaggtgctgctgctgagtacttttggctatgatgatgggttcaccagccagctgggagctgaggggaaaagccaacctgaatctcagctccaccatggcctgaagcgcccacatcagagctgtgggtcctcaccccgccggaagcagtgcaagaagcagcagctagagttggccaagaagtacctgcagctcctgcggacctctgcccagcagcgctacaggagccaaatccctgggtcagggcagccccacgccttccaccaggtctatgtccctccaatcctgcgccgggccacagcatcctatgacgaatacgtgcaatggctgcacttcgcggaagggtcggccatgctgccgctgatgctcaacctctacgttgggcgcctgggtgaagcaggtgcgcccttgcacccgcgtatcgaatccgaggtcgcgaactac

SEQ ID NO: 267256 - DNA, 672 bp, Homo sapiens
gtgggagtaagggttgggggagcctcaagtcagaattcaggtgacttcaaaaaaacaggtctgatccaggacttatggtggccttaggatgtgaagagcatagttatattacattcttggtgaccacaaaagcaagaacaaacaattctcagtctgaaacagtgaaagaaaaggtttatctgatttatacacagcatgtttgctccaacccataatggaaaaacaccagataaatctaatttgtttgtttttaatctggatatgctgttgttcaatgcactttttaatgtgtaatgcacacagatcattgagtttctgaaaaactgtatctggagcattggaaagctaaagccgctgttcaaaagaatgactaacaaccacaacagcagcggcagccccattaacacatctgagccaacaaacaccagcatgagacacactagaagcagagaaactagaatgaacaagtccgaatttttgcctggcacataggtcactcagtaagagtcaataggggaatgaaatgcatgggcaaactactgggaaattttgggcagctaaggaagactaagaacaaagaagtttcttttgaccccctctgctgagggtagagaaaagcaaaagggaagttaatgtaacaaaaagcctacgcagtaggagtaatagagggtg

SEQ ID NO: 267257 - DNA, 425 bp, Homo sapiens
ggtcttttagggatcatgactgcttcccagaccttagtctcaggatgccacaccggaagagctggaccccacatttgaagacagatgtccctggcggtgcccgcctgctctgtaaagagctagtcccaggctcccattgtgacctagcacctcaacctctcctgacccttttgcctaggccagatcctgagatcggagagtacatacatctccctggggcttgctttcctctcccataaaatttaggagttggggatgatcttatccctctacctagactgtagactcctgggagcgggaggcaaggcactcacaagcaagggcatcagagtgacatcaagacacaaacagccatggaatcttgggaacagatcaaggagtccacctcttaaaatattgtaaaaaataaaatctgagtacgaaaa

SEQ ID NO: 267258 - DNA, 463 bp, Homo sapiens
ctctgaatctgttaggaacatgttggttggctgggttcagtaataaatatgtgaggcttttcatttaaaaaaaaagtcaaatgatgtaattgcatagagtaccttagtttctgtattgctttttaggtttttttttttttttttttaactccactgggtcagtggatcacacctgtgatccttgcactttgggaggctgaggtgagaggattggctgagaccaggagtctcctgggaatcttctcgtctcctgtaacccagttcacgacagacccttggactttactatattggaaaaatctacataaaacaatgtcagtgtgtcaaagcattatgtctgtcacaagcttgtgaaaggaaaataaaaattactaagccaaagagaaaagtcaagctgggaactgcagcagacaaacctgccttccattttattcttaaacaagatagctagaaagacaaaaaa

SEQ ID NO: 267259 - DNA, 427 bp, Homo sapiens
cattgttctaagagcttttcagagcaaaactcttctaaccttcacaaccctatgagataggtactatttttatccctactttatggatttgaaagcagttaaacatttgcttaaagttacacagctaacaagtgatggagctgtgatatgaactcaagacattctgtccgaagagcctattctcttaactatgagaccacatttactgttttatgacaattagcttattctctatttttacttatataaaacaagctctccaatacagcagatattttatagaatattaacaggattaagaaagtcatatgattggccaggcgcggtggctcacgcctgtaatcccagcactatgggaggccgaggtgggcggatcacgagatcaggagatcgagaccatcctggccaacatggtgaaaccctgtct

SEQ ID NO: 267260 - DNA, 236 bp, Homo sapiens
tgtgtgtgtggttgtgtgactgtgtgggagtgtatgtgaatgtgcatgtgtggctgtgtctatgtgtctgtctgtgtgtgtgactttgtattactctgtgtgtctgtgtgtgtgtgagagattgtgtgtgtgactgtgtgagcatgtggctatgtggagtgcaagggcctgtgtgggaatgtgtctgtgtatgactgtgtggctatgtgtagtgtgtgtgactgtgtagctgtgtg

SEQ ID NO: 267261 - DNA, 179 bp, Homo sapiens
tgctcagaatgtagatgcttcttaggaccatgaagcgaaagccaagatctggggatagtgaaacagatagccagaggaccccaggctgtggatggatgagtgatcctgagcagcagccgtggacatgggttccctaattccttcatgtcccatgagaaaaataaacctctatgtgttta

SEQ ID NO: 267262 - DNA, 502 bp, Homo sapiens
ggggtttcaccgtgtaagctaggatggtctcgatctcctggccttgtgatccacaaggcctcctcggcctcccaaagtgctgggattacaggcatgagccactgcccacggcgttttttacaaagggaaataagaagccatttagaggaataagggagatactaaaagtggcaatatttgatgacgatgattttagtaaactctgattaagatactttgggtaccaggcaatgagtgaagggcttttgttaagtgttacatttggtcctcccctgtaaggtgagctactagtattatctttggttttctctactctaaagtttagagaaaaattaaattggccaaatttagagaactagaatgtggccgttcaaactcaggtctgtctgacttctaagttattaatcactgtgtgctataattgcctcagctgacattaaatttgtccttgggcctttttaaaaatttttttaaaagccttttgactcagtaattctgagtc

SEQ ID NO: 267263 - DNA, 447 bp, Homo sapiens
aggtggaactctagcttgtatattttgaagatgatccctaagtgatggtgatatatatcttcattgagactggcaccagggagccatctttctttattagatttaactcttacctatcactggttttttctaattaatgtttcctcatttaaacctaaaaggaaaaatcttaaataagaattgggttttaattttccatgattatcattggtaaattttaatctgttagcctacttcagctatgaaccagttacttaaaggtttactaagatatatttcagttgaaattgcacttgtaatttgagtgataatcagcccatacttactattttggtttacattatttatccaagaagtaactcagctccatttagaagtgacttcctttgttccacagctcagctataccaaatcccttctctctaagcaaaaaagaaaatatgaagt

SEQ ID NO: 267264 - DNA, 449 bp, Homo sapiens
atgcctgagcaagaatgcttcctactcattggtcattagctctgcccatacatatatgttatttaattgaaccctcacagtaaccctgaaagtttagtagaattatttcccattttgaagactagttgaagcatggagtggtcactgaactaagttgtcatgtagtacagagacagcttgaccctagcacatattgtagttcaccaggatgactttgaagtttttctgaaatagaacaatatgatgtgttttgttgtgtagacaagctgaagtcccagttttctagttgttttctttgttttaaagcagagattctaggagctgtagggcaggcagctcttaagaaaattgggatgaaaaggattagcagttcttttacctgctttgtagattgagagccctgtaagattttgcctgacaaggggctcttatgcttctaaactggaaaa

SEQ ID NO: 267265 - DNA, 345 bp, Homo sapiens
tgagacagggttcttgctctgtcacccaggctggagtgtagtggtgcaaacaccactcaccacagcctccatctcctgggctcaagcaattcccctgcctcaacctcccgacacacctgactatttaaaaagctttttctgtaaagacagccatgttgctcaggctggtctccaactcttggcctcaagcgatcctcctgcctaagcctcctaagtagctgagataacaggcatgaggcaggttgccaggcctgataagatgctctccataacacctgcccagtaatggcatcttcaacaatggccaactctggctttcagtctgcaaaaccaataaactctgtt

SEQ ID NO: 267266 - DNA, 263 bp, Homo sapiens
ctactcttaagtgtcatctccatctactggactacagcctgaactgcaccaccaaacaaaaaacctgctaccagaagggcttagtgctagtctgagataagtttcctaagacctatgcacctgcactctcaatcccacaggaaatagtgtgtccgctcatatgttcaatacatcgctacaacaatcagcatctaagaaagtcactacacagaggctatccacaaccaacgtacccatatacagccttggcccactgaaagtac

SEQ ID NO: 267267 - DNA, 449 bp, Homo sapiens
caaatggataaagaggaaaattactgacagatttaacttcccatatttctctcaaatttttagctttctaaggaaactactcattttgaattaatttagttaaaataatacatcccaactttttaaagatgttgtgaaatgaatactttaatacattactggtggtagtataaactgcctaaaaacagtctgaaaattcatttctaggaccataaaattatatactctgtaacacaataatcctactcttgggattatgtatgaatattttcattacagtatcatagaatggtaaaaaatgaaagtcattaaaaatacctaagcaagaaaggaatagctaagttacatatagtataccaacaaagtgaaagaagaaatgttatattgtgattgtaaatcatgtatgtacaaatgccatgaaaattaaagccagtaattactgcttaggg

SEQ ID NO: 267268 - DNA, 337 bp, Homo sapiens
tttttttttttgtagtagagatggggtttcaccgtgttacccaggatggtctcttatctcctgacctcgtgatctgcccgcctcggcctcccaaagtgctgggattacaggcgtgagccgctgtgcccagccagacttccattaatcttttaaaaaagtatttattaagctataatactcattaagaaaaagtgtacatatcataatttcacacctagatgagtttttcaaattttaaaacatctgtataactaagatcaagtacagcatcaagaataagaaacagtattatctgtagtccagatgttcccttcatgtccccttctgtcgtcttctc

SEQ ID NO: 267269 - DNA, 217 bp, Homo sapiens
ggggaatcatccagtcaaagggtcgaaggtctcccctgacccctgagcagctggtcccctcccctggagtcagcctgtgttctgatttgtgcctgtgttcccggcttttccgtgtgcgttcaggcagccacccgtgtgcctccctctgccttgtcaccctgcaggtagcgcacggctcctcttttctgcacctggcttttgccacttaaccacatct

SEQ ID NO: 267270 - DNA, 182 bp, Homo sapiens
tagtttgatcctagcaggtgccagtgactcaaacactgttacagagaactaaagattcgttgatcgtgcttattagtgttgatgtttcagctttccttaaaataaaacttgcagagattgaaggctcttaaaattatttgtctgaaaattaccacatattacttttcagtggcaggtctaaa

SEQ ID NO: 267271 - DNA, 156 bp, Homo sapiens
gtcccagtctcaaaaaaagagaagccaattcattaccttgaaaataggcaaaaaatgggaaagaatcaaacattcatcttgcctgccctatacaaactatatcttgcagcgtaagtcacaaaaacacactatgtccctcataaggaaggatcacaa

SEQ ID NO: 267272 - DNA, 310 bp, Homo sapiens
tgaccacagggtctcacttcgtcactcaggttgaagtgcagtgacacaatcatagctaaatgcagccttcaactcctgggcttaggcaatcctcctgctgtagcctccccaatagctaagactacagggatgtgtcactatgcctagctaattaaaaaaaattttttgtggagatgggattccactatgttctccaggctggtcatgaactcctggcttcaagctaagccaggagtgggattacagacatgagccgctgcaccaagcctctgatatctttcttatgaattaaaacttttatcattattcg

SEQ ID NO: 267273 - DNA, 332 bp, Homo sapiens
gtttttaataaagcatcgatggtcatccatgattgactgctacctgcttttcagctgcacctccacctaatctccaaaccaaccaacacaccattgttcttattcctgtcaaaaaacagtatatttcaatcacagttaggtgcttggattttttcacaacttatgctcttgtttgttttacaagtgttggtctttctgtctgcaacatattattgccctattctcctaaataacagttttccttcattatatttatctttaataccaaggtactctcctgtcttcagctgcattgggtttccattctcaaaaaatagtctgtgaatatctag

SEQ ID NO: 267274 - DNA, 586 bp, Homo sapiens
tggaacagatataataattgcagtacagttagttagggcctattgaaggagcacaaacgaagcgtaaacttgtctgggaactagtggaaggtgtcccccaggggatgttaaagagctaattctagaattaattcagtggggaaagaaaaggagagggagatgccaggcagagggagcagcatgcctgattgtctggaggtgatcagagggcctggctgattgaagatgaacaggaattgtgtagtctgtgttcattcattcatttattcattccacaactatggatttaaaaacggttagtcaaccaatgtggaaaaatagcatctcgataaaatgttcttcaaatgtcctcacttttcaaaaccaatcacgccttcccagcagccccccaaagtgttatttcagcattaactcagaagtccacagtccaaaatctcatctgagtcaaggcaagtcccttgcacctgtgagcctgtaaaattaaaagcaagttagttacttcctagatacaaggggggtacaggcattgggtaaatatagccattccaaataggagaaattggccaaaacaaagggactacaggct

SEQ ID NO: 267275 - DNA, 852 bp, Homo sapiens
tggaacagatataataattgcagtacagttagttagggcctattgaaggagcacaaacgaagcgtaaacttgtctgggaactagtggaaggtgtcccccaggggatgttaaagagctaattctagaattaattcagtggggaaagaaaaggagagggagatgccaggcagagggagcagcatgcctgattgtctggaggtgatcagagggcctggctgattgaagatgaacaggaattgtgtagtctgtgttcattcattcatttattcattccacaactatggatttaaaaacggttagtcaaccaatgtggaaaaatagcatctcgataaaatgttcttcaaatgtccacctagtattttgatactcagttttcatgactggacccaccatcaaaggcctctgactctgatatttctatcctttggaccctatgggagatctttgcctccatgtgataatctccttctcacgtttttactaaaagtttggagacttgaattctgctccaaacttttagtaaaaacgggagaagaaaaattaacactatattgagagctccaaaatatctggtactgggccagataaatagctttgtatattatcatctgttagtgcgttctattacttttatttcttacaggaatgctacctgtcttacagggttctctaaataaacactgtgtttaaacactttacaccaacatagctggcatgcagtaaaggacaatacaactcagtattatttccctcattttacaggtaggaggctcaggtgagagaagcgagtaaggctggatctaacctagctctgactaatttaccacgagccacatattactccctaagacc

SEQ ID NO: 267276 - DNA, 415 bp, Homo sapiens
aaatggtgcagatgaagagactttgacaaaggaagtttcctgagctgtgggcagggatgagagctcagacaaatgatgggaagcctcccagatgccaaggtttcccacccccaggtttcaagggaggagagaggaagtgatgtcatctgagcccagtgaggccctgtcaagggaccagggaaaactgcccccactttttgctcccatcctctcattgactgcaggtgcacaggcagctgcctgaaagagggcctgcgaagtgcaagccagaggagttggcctccatggcacagagcaggcagaaaacaaatttggagaatgaccagcactcttgggtttatttgactgaaagtgcttgttttattgcattcactcacatccatttatttaataaatatccatggagtgtctatca

SEQ ID NO: 267277 - DNA, 476 bp, Homo sapiens
aagggagtactgaagcaattttggttcacaaatatagatatacagataagaaaaaagtagataaatctctaggtttgagtgttcttaacctttttgtcttagcctagctcttagttgagaatcagtgcttcaatgttaaattcataaggaagagtagaaaccatttgggtatatgtgttgctaacctttccatagactgcatttggttgtcccatgggtcagggtgggtcagaggggctgaggttgtccccgtccatgtcctttattccccctgaaggatttggagtcttcttaggagctgctggtgggcacggcctccccaggaatgcccttcataagcccatggctaatatggctgtcttcaatctatataggctcccgtggaacagtcccaccctgggcttgttgagtacaaaagagagtaaaatgttttgccctttggaggaaaagccaaatcctcatttaaggtagaaacc

SEQ ID NO: 267278 - DNA, 1009 bp, Homo sapiens
acatggagaggaccccatgtgaacagaaccctgaatctgctcattttctgtgctcctgaatgtgtagctacagactctaatttcgaaaacaaacctgataagtgggacggtgccaaggcctaggaagctggagccctctctaatgctctggagcctgcccacctcctgagatctggaccagtctctgcctcttctggggcctcagtttcccaattgtaatgtaatgagaaattaaatgtaaaactgcataaacatatgctctgtgagaatttggtgtcagagttctcaatactggatgataatttggagtggggtgggtttgggacccatgggttctcaggcctcctttcacacccagtgcagtaggtgtagagctctggacagccaggtgttctttcctgagccagctgattacaacacaatggaccaagggctctgatcttaaatatggggggagcagatgacaaaccccattatagtgaagaagagcaagaaactagacttgtgggcctggggaaaagaaaaaaacacttctatttctcccaaactgtagaatctcttgtcaaatatttaattttgattatatctgagcttgataatacattcatgtgttaacagctgcttaaatttgttttttctgtgaagtgtgggataatgtctttgccgtattttaaatcaaattctaaaagctctctttagagtggataagtgagcatctttgtaatataaacttcacatatttgttgccagtttgttctttttgtttttgttaaaatgttttgttttattctgatttggatgtcttttggggttttgctttgtggctatttattatgacagtgtaacttctcctctaattgactgacaggtttgtacattctcaataaaatattttcataaaatctttgtaaaaattgtgtagtcaattttacattacataaacataaaacagtaaagactatcatgatgaaaaagaaagattgagggcttaaaaagtaaaatacgacac

SEQ ID NO: 267279 - DNA, 644 bp, Homo sapiens
acaatgaaaagtcagcagtctgcaacctggaagagggtcctcaccagaacctgaccaggctggcacacccatctcagacttccagcctccagagttttcaaatttaggctggtctgcgatttgctttggctgacagaatatgatgaagtgatgttatatgggttccttactcagcctttaagtggacttgcagctactgctctctactccacactgctaccaccatctgaagaaccctacagtaggagacacttggcccagataatcacaaagaaaaagagtatgcagtgagaaggacaagtctcataaccacatgttgttaatgaagaagctgaggcaccaagcgacttaaggatttgaccaaaatcagacagcagcagattcaaagataatgccagctcctcatcttcgtttctggtgctgtttacaccgtgatacttcaacactgaaagaaacacctatcaattctcgtacaactttaaagatgcattcttactgtctcgaggcatcctctaattttgtgttcctatttgcttcatctagtttaggttattaactcctaaaggctagggcatacattttgaaatttttttttctcaggacattaggaaccttaataaattacttttgatggttaaaaaaaa

SEQ ID NO: 267280 - DNA, 222 bp, Homo sapiens
cctcattactctccgatgtcccctcaccgccttctgatgtctcctcattactctctggtgtcccctcaccgccttctgatgtccccattactctctggtgtcccctcaccaccttctgatgtcccctcattactctctggtgtcccctcactgccttctgatgtctcctcaccgccttctgatgtcccctcattactctctgatgtcccctcattactctct

SEQ ID NO: 267281 - DNA, 343 bp, Homo sapiens
aacattgataggtgcagtccaataataacaaaaattttaaacgtagaagattgtgaccaggtgtggtggctcacacctgtaatcccagcactttgggaggccaagccaggaggatcacttgagcccaggagttggagacaggcctgggcaacataatgagaccttgtctctacaaaaaatttaaaaattagctggatatgggcatggtggcacgtgcctgtagtcccagctactcaggaggttgaggcaggaggatcgcttgagcccaggaggttgaggctgcagcgagccatgatcatgccactgcactgcagcctgggcaacagagcaagaacctagctca

SEQ ID NO: 267282 - DNA, 566 bp, Homo sapiens
tatataaccaatatttcatccttgcaattgctattattatgatcattctgcattaagtgtatgtaagatcctctgggcctttccatatttctacaagatcttcattctaatttaataaattactgctcccatttgaaaaattgtagctttcaaaacgtccattagtcctagtcagcaggagcatatattgcctacatcagaaaactgtgtggtgttgtgtgtggcacctgggaaagtggcttcagggaacctataaacctgcttcattaaagagcctggatttcaatgcctgtcacaacgggcagccagagttagccaagagagaattatcagaagcaccaattaagtaaaaaatgaatcttgcttatttttcttcagtcccaagagataggggaatgaaagtataaggagtggaagacccattaggaatagagaaagagaggttacctacttcctaattgcaatgttcaaaatgtagctatctttataaaagtacttgagaaggtacacagtcttccaaggagtcattgtgcagcaaggaggtggtgaaaagtaaagctatttcc

SEQ ID NO: 267283 - DNA, 353 bp, Homo sapiens
gcttcatggttctcctgatgctcattcctaggttctgtgctgtaggttaagaatgtgttttttcttaggctgggcattttggcttatgcctgtaatcctagccgtttgggaagccaaggtgagtgaattgcttgagcccaggagtttgagaccaggatgggcaacatggcaaaaccccatctctagcaaaaaatacaaaaattagctgagggtggtggcacacgcttgtaggcccagcttttggggaagctgaggcaggagaatcgcttgagcccaggaggtagaggttgcagtgagccaagattgtaccactgcaccccagcctgtgcaacagagccagaccttgtctcaaa

SEQ ID NO: 267284 - DNA, 391 bp, Homo sapiens
agctttgaggatgtgtaaagaataaaggcaaataggtggtgggaataaagatctagggtcataaaaacattaaaaaaaagatctagggtcatattagaaacagtttagaactaagagctacctttcactgcagggttagcaataatattcctcttatctagaaaagctactgctcacttttcatcatttaggggaaaataggcaaaagttattcatagggcaagactgctgtagcatccatatttttaccaaccacattaatatttacaccttcagatttgctgagtaagagacagcctggagctgtcttgagttgacaggtgaaatgattctgagaaaggacaaaagcacatggcttctaagataccaatctacttgcttctgtggaaaa

SEQ ID NO: 267285 - DNA, 352 bp, Homo sapiens
tttggacttagtgcgggcatactttattttattgtgctgccctttattgtgcttcacagatactgcattttttacaaatcaaaggtttatgacaaccctgtgtcaagcaagtctgttagtaccattcttccaacagcatgtgctcactttgtgtctctgtctcacattttggtaattctcaaaatattcgaaattttaaaaaattattttctttatctcttatgtgatctgtgatcagtgatctttgattattacaattacaataactattgtaattgttgtggagtgccatgaacaatatccatgtaagacaacaagcttaattgataaatgttgtttgtgtttcaacaac

SEQ ID NO: 267286 - DNA, 407 bp, Homo sapiens
gcaaccacaactcattgcagcctaggcctccccagctcaggagatcctcccacctcagcttcccgagtagctgggactataggtgcacgccaccatgccctggcaatttttggtatttttagtagagattgggattttgccatgttgcccaggctggtctcaaactcctagactcaagaccagcctgggcgacagtgagacccagtctcttcaaaaatacaaaaattagctgggtgtggtggcgcaggcttgtaatcccagctactcgggagggtgaggtgggaggattgctcgagactgggaggtcgaggcggcagtgcaccatgactgtgccactgcactccctctagcttgggcaacagagttagagctgtctctaaataaataaaaaaatttaaaaataaaca

SEQ ID NO: 267287 - DNA, 447 bp, Homo sapiens
gtctgtttcttcttgtgtgttgaaggaaatggccagcatgtaggagtgccattgtcctatgtggtcactcaaggcttcaggttttttctacagtttagcttcatttatccctttggtgtcttctatgtgaagcttgggtagtctcagtgggaagtgaggaaaggggaagcatagatttcattttaagtaaatggaacaagagttgctcagaacactttcactcatattctattcatgaggactcagctacaaggtgactcctgagtaaaagagaggctgggcaatgttgtcctaccagggcaactaaatgcctagtgaaactctcatatttcggaaaaaggttagcgggaatggattttggaggaaaaactagcagtctgtcacaattattttacatacccccctcccccagctatttttggctagccacttctctagatgttaacc

SEQ ID NO: 267288 - DNA, 623 bp, Homo sapiens
aatgtgatccatttttctctgactcatcttagtgttgtaaactagttaaaagtcatgccaagttaggtgtctatttcacggatttttaaaacatcattccacagcttcttatgaagcagctacttttctagggagaatggacagcaagagatcagtggatgggaatgataagaaatatcctctgacctcaaagagcttctaatctgctgggtcaagcgggagagcggttggtaactatagtgaaaggaagcatgaaacacaagctggatatggaggttaaaggaaacatttctacaagtcctgcgggaagagggtgacaggacataaaacagaggtagtgttattgtttaatttccatatttttaattgtatttttatgaaactcaattagtgtattacagaacttgtcactttagtgaggaaggaaaagggactttatgagtcaaggatgtcattagaacatgttaattcctcttagtttctttccctccttgttttagagctctgccaactcccagtgcttcaaatagccactttcagtgggtgaatatgttatggattttagtttccccaaataaaatattgtaacctaatcaaattatccaccagtatggaaataaatt

SEQ ID NO: 267289 - DNA, 434 bp, Homo sapiens
tataactaggaggaagagaaattaggaaggtcactggcaccctctcaacagctcacaacagactgcaaacaaaggcctctgagggccttcttggctcataagttgaccctgataatttagctcacgtttactgagaaccgcctgtttgccaggcactgcgtcaagaccttaatgtatatcagtccattgaggaacagtcgccattccattttcagatgaagaaacaggcttaaagaagttaagtcatttcatttggttagtgagttggtgggaacaggatatggctccaggcagtgtctccttgctttaaggatcagtctgtacaatggataggaaaggccttatgtactctaagactgcattagttgtggttaacctttcagggaagcagtcccctttgagaattgactgaaagttgtcaagtgaatttccag

SEQ ID NO: 267290 - DNA, 411 bp, Homo sapiens
tctacttctttccttcctgaggctccaaagagcccttgttacaatattagatactaatagcaatgtctgagggaagccacatgtatggcatgccacaatagagaaaataaattgagataataaacttaggccagacgtggtgactcacgcctgtaatcccagcactttgggaggccgaggcgggaggatcacgaggtcacgagatcgagaccatcctggctaacacagtgaaaccctgtctttactaaaaatacaaaaaattagccaggcgtggtggaggctgcctgtagtcccagctcctcgggaggctggggcgggaaaatggcgtgaatctgggagggggagcttgcagtgaacggagatcacgccactgcactccagcctgggcgacagagcaagactccatctcaa

SEQ ID NO: 267291 - DNA, 421 bp, Homo sapiens
ctgttctcatcttgttagtctgtttcctactgcttgactccagaactctgaactacagggaaatgcctagggaaggtgagctagaggactgggagggaaagaatagtaagcttttcaattgttgaaaaaaattttagtagtttcctatactaatcaatctaactaacaagcaccaccaatttaaaaacagaaagccaatgtactggaggagaaatgaatacagaaaacaactatttttaaaatgtatctttttatccactggtaagagttaaagaactctgcatctgtaataacaggaagccatcaaaaaattaaataagcacccaagaaagaacatttcttggaaatggacaagctgcagaacaaacatatcattaaaaatcctttatacattttatttttaaaaatttgtaaaaatgta

SEQ ID NO: 267292 - DNA, 407 bp, Homo sapiens
gtgctaaactcaaataccagcacctctcccaagctacccctgctctgacaggctcccacaagtttttgtactttgtgcacatttttatacctgtgcctcctctcacgtgggattacagtgatttgctcagctgtctgcttccctgctggacagcaagccccttgaggaggaggactgtgcttcattcctgtctgagtccccagacctagcacattattagattcttattaggtccttaaaaatcctccctctcgccctcccttatcttttccatccttcctttcttcctttcttccatcctttcttccctccttccttcctttcatgaggagaaattagtcattattctctgtattatctcacttcattagttttgttgaatgtatgaatttacacatttgaaaatg

SEQ ID NO: 267293 - DNA, 364 bp, Homo sapiens
gatgaagattcaaggctcagagggaagaaacttcccaggcatcatacagttggtcagtgttagagccagaatttaaagtccactctgttataccgttctgatattctaatcactttgactcagacagttctccaaggagccctggttccttttattggatatcggcattagaaaccaagatgtgagtggtagatgtgctcattaccactgaggtgtcattgcttccaggccctctccactgacagaggaaggaaatgatgctgtcttctattcctctgtacagtattgtaccttgcactcagcggtgaccccaaaagtgttgactgatttttccaccatgttataaaagattcttctaaagaaa

SEQ ID NO: 267294 - DNA, 1107 bp, Homo sapiens
gaccaatgtcccctataaataatcctcaacaaaattctagaaaacacaatccaacaatgctttaaaataattatacaccatgtccaggtaagatttatttttgaaattcagaatgattcaacatacaaaaatcaatcaatgtactacatcacagtaacagaatgaaggaaaaaagtgtgattaactcgactgatgcaaaaaagctgacaaaattcaatgcttttatgatacactcaacaaacaaggagtataaggaaactacctcagtataataaaggccatatttaaaaaaaaaaaaactacagtgagcatcataatggtaaaagactgaaagctttttctctaagagaaacaatatgcctgctttcaccacttcaacataatactggaagtcctaggcagatcagtttggcaaataaaaaataaaagacatccaaattggaaaggaggaagtaaaattatctctatttgcagatgacataatcttatatgcaaaaaacccttaagatcacacacacacacacacacacacacacacacacgaactaataagtgaattcagccaagttgcaggatacaaaatcaacacccaaaaatcagttacatttctatatactgacaatctacaatctaaaaaggaaatgaagaaaacaatttcatttacaataccatcaaaaagactaaaatacttagcaataaacttaaccaagtaagtgaatgacttgttccctgaaaactacaaaacattgctggaaaatgcgaaagaaggcacatataattgggaagataccctatgttcagtctacccaaagaaatctacagattcagtgcaatccctattaaaattccagtgacaagttttgcattaatagaaaaactaattctaaaactcgtatggaacgtaaagggatctcaattagccagaacaatcctgagaagcaataaagttggaggtctcacactgctgatttcaaaacttactatagccaggcatggtgatgcgtacctatagtccaagctactcaggaggctgaggtaggaggatcccttgagcctggaagtttgagaacagcctggtcaacagagtgagacccagtctttgaaaaa

SEQ ID NO: 267295 - DNA, 341 bp, Homo sapiens
gagcaaaagtccgattctgtaaaacatcccctaaagcactggtaagcactgaatgtttacatttctccaaattcatatgttgaaattctaacccccaaggtgactgtggtaggagctggggcctagggaggtgtttgaggagtgaaggtagaactcttataaataggatcagtgtttttataatagggactccagagagctctctcaccctctttctgccatgtgaggaaacagcaaggaattggcattctgcaactcaaaaaaggatcctccctggaccccaaccatggtggcattgtgatcttagacttcccagacttcagaaatgtgagaaataaatt

SEQ ID NO: 267296 - DNA, 188 bp, Homo sapiens
gtgtccaattacattttggagaggtggacactgctatcactgcatacccatgccctgtgagggaacataggacttttctgcagaattcctggactaattattattccttatatatatctaggaaagattacaaaattaactgaccctaagatgaatatacccacaatgcaaagggaaaaataatttat

SEQ ID NO: 267297 - DNA, 433 bp, Homo sapiens
acagacaggacttcctcacgatgagaaaataacaccttttactctgtggcatacatttccctccctttcattcagtatttgggatctacatgctgagttcaagcccatatactacattttcctcttttttttttttcttaaatgctcagctcatctcatgagtgaaaaaagaattttctcttctgcctcccacatcataatgcagcacaaaaagtactcccatcctccatctgatgtctatcttgttcaagaatctgcacccatctactccatagagagacataaaaatttcacttaggaatgagtcatgaattgttctttaaacgttggatcaaaggagcttgtaaagcccaggttattagtgcatgtgtacagtgtgtgtgtaagggaacaagtggatggttcagatgcaaaagtctaggaatgggacctg

SEQ ID NO: 267298 - DNA, 554 bp, Homo sapiens
aagcagaaagaaacccttcctcgtacagctgctcccatgagaaaaagttcaacagaaaacatattaaatgcccatttcccaagactctcaatcagagtggtaagaagcaaagggacgacgctacagaggtgtctgggaaactcaggctgattaaaggtagcctccttgacttgcaggctctgtgaaggaaagcacacctcataaatccttttggactgttttttggctaaactctcagatttatacgaagaactattttaaatgaatcagcgtgtctttgtttgcatcttctgagattctgaagactgcagccaaggagctagtaaggctgagaaatggattgagcatttaatcggttgaatacttccttatgttttcctcgtgtgttctcataacaagcgaccttagtccaactcctagtaacacatgattgtggaatgtgccctcctgagaaatactgccttattttttcatcctgagcacattgaaagtctctgaaaatgcagatgagcttgtttggacaatggtaataataatatatgctagcgatacct

SEQ ID NO: 267299 - DNA, 411 bp, Homo sapiens
ttagaaaccgttgtgttgattttgtggtaaaagtgcaactcaaatcattattatctatctatgatgtcatagacaaacaatgtctatcttagttgacatagaagttctctatttaaattattgcctgaacaatcttaattccattagtttatctaacatttttaaagtattgtctctgaagacaacatgcagagatattgttcagaaggagatgcatgaatatacattttaactaagagttttcatcaagtgagattccctgggttcctcatctacttgcttatgtggctgtctacaagtcacttaatttaccttagtctaactgccttctgtaaagtgggttgctatagtctttaagccaatatgtatattaccgtttttgtaataaacagtataaatatgagaaaatta

SEQ ID NO: 267300 - DNA, 802 bp, Homo sapiens
aggctatatagttataaaattgggttttatttatctaaaaatattagcattgtaggaattacttgagatacgttacttttttcaaaatgtgaaaatcagctggaattgtcaatttttaatttaaaataggtaatagtaactctatgtaacatactgtttatagacaaagatgagtattctttaagaggttttatattgtctttttagtaaatagtgctggagcaattggacacccataaggcaaaagaataaaccttaacccaaacctcacatctttctcaaaaattaattcaaaatgggttgtggatttaattataaaacacaggtcaggagcggtggctcacacctgtgaccccagcattctgggagactgaggtgggcagatgacctgaggtcaggagttaaaggccaacctggccaatataatgaagccccatctctactaaaaaataacaaaaattagctgggcatggtggtgctcacctctagacccagctaagtctggaggctgaggcaggagaattgcttgaacccaggaggtggaggctgcagtaagctgctatcacaccactgcactccatcctgggcaacagagcgagactccatctcaaaaaataaaataacctaaaaaataaagcataaaagtataaaacttttagaagaaaacaggagaaaatctttaagatctcaggctaagcaaagatctctagaacataataccaaaagcaccatacctaaaagaaaaaaattgataaattggatttcatcaaaattaaaaactttagctccgtgaaagatgcta

SEQ ID NO: 267301 - DNA, 465 bp, Homo sapiens
  misc_feature (106)..(106): n is a, c, g, or t
tttttttttgtgatggggtctggctctgcagattgcacatcacccaggctggagtgcagtgatggatctcagctcgctgcagcctcagactcacgggcccaagcgntcctccaatctcagtcttcctagtatatggtggtgctcacctctagacccagctaagtctggaggctgaggcaggagaattgcttgaacccaggaggtggaggctgcagtaagctgctatcacaccactgcactccatcctgggcaacagagcgagactccatctcaaaaaataaaataacctaaaaaataaagcataaaagtataaaacttttagaagaaaacaggagaaaatctttaagatctcaggctaagcaaagatctctagaacataataccaaaagcaccatacctaaaagaaaaaaattgataaattggatttcatcaaaattaaaaactttagctccgtgaaagatgcta

SEQ ID NO: 267302 - DNA, 397 bp, Homo sapiens
gtccccacagaacccttcccttcttattccatcctggactggttgttctttaggcctgctgcatgctcagccgtgatccttggattcccttctcactgggttgagttgcttgtttcctggatcccatgtctttttctctcttggttatccccacccactcaccatgggtgcacacacgtgcacacacacgcacgtccttcccactccctctgtagctctttctcaagtagctttccaggaagtcatgatgtatggtaacatttcaattccgctttagctccatttctcctgtcatctttctagtttattttctggaagcttttctagactttttcaaccctctcttgagttgtttattttgtcaatcatttaattcccaagaatttttttttgttct

SEQ ID NO: 267303 - DNA, 419 bp, Homo sapiens
gcccaccacgcagcccgcgattcgggatcccagaggagaggggtgcgggctgagccggggccacgagtcctctcccgcgctcccgcccttttacctcactgtcccgccgggcgcacgcagagctcaccttgcgtgccggccggtggaggcgagccataggtgacggtgcatcctccttctccgcctgctctcgcccggctggcaggggctggaggctgccagcgccaaccttcccggcgctccggggcggagcagctcctgcgccctgcgctaccgcagcggcccttcagtcagctccgcgccgtcccccgcagagcccccggcgcaccagcgcctgcttttccttccccgagcgcctcaagcagtctctgggccgcaggaacagccctctgaagaggcgcttgggtagaggccaccag

SEQ ID NO: 267304 - DNA, 478 bp, Homo sapiens
gtcaatgtcactgttccgaagctagacttgcagttcactgggaagcatgacaccacagcacctccagctgtggacgcatcatggacaagccaggctgagaggagaacttctcattacttgcagcacagcaacattgggttcaatgtatgcccatgaaaaacctcatttaagagaatgccttggaaaggtgccaaggtccccatactaattaactttcatctctcctggccctctgcaccctctctccatgaggaacattaaacatagaacatcagcttgagaacactctatttaaagcaaaagtccttctaaagatagccttgaatgtccatctaaatcatcctaagtccattttctggcccagaatccacaaggccagcgccccagatgggccctactatggtggcttatatccataaagaatgtctttcacggttcattggttggattaatctgatataaagtgtctaaactgaaa

SEQ ID NO: 267305 - DNA, 287 bp, Homo sapiens
tctgagaccctcacatgttttcatgcccgcattggctttttgtcttttatgtgataggtaggtagggagtgttttctacctatgtattattccaggttttatgcccctgagggtcttttagctggagacttataggcatagtccactccactgagtacagatgttaaagttgccaatgaagctctttatgagggatggagacaggccagtatctttggcctggattctagagacctggtttgaaaatcctgggaaagctgagagcttcgtttctccctctagagtac

SEQ ID NO: 267306 - DNA, 466 bp, Homo sapiens
gtgtcacctgttgctgtggctatttgacaggtttatagagtcctatagcaggtgcaaaagttagggtggaatgatagggaagcatagggtttgagatcagatggggaggagggtttcagggtagggtggcctgtcctgggtttgattcctgtagatgacaccttctagccattttctcactaataaaatgtacaatgaattaccttataggtctgttgtgagaattaaatgaaatagcatgttaggtgtccagaacaatggtacaatggttcaataaatgttactcctgttttcctcaaaaaagatgctggatgacacttatttttgcaaatttttcttttctttttcttttctttcttttttttgagatggaatcttgctctgttacccaggctgaagtgggctgagattgtgcgctgcatccaggcctgggtgacagaccaagactctgtctcaaaaagacaaa

SEQ ID NO: 267307 - DNA, 476 bp, Homo sapiens
ccctttttaaaattagctctgtgagttacagaagtaatccctgctttcttgttaacatgtttcaaacagcacagaagggttcaaggtggaagctgaaggtactccccagtctcccccacaacccccagcccacctctgctaggtcccacatggcctttgggaaacatatgcattgttccctcttcccatagaagccagaagggaagtctggaatcagtgagccaggtacagctctgggcccaggcccagagatcccacactcatgccagcccctacccacgccagccccctccctgtgccagccaccgcccctccatctatgcaggccccctaccaccaagcccatcgataggggctcattattccgtcctgtctccctaggatggggcagagtgacagctgttccgtgtttaattaccgatgggctgaggctatgccaacccatgaataaaattacagttgttctgcaatgcaaa

SEQ ID NO: 267308 - DNA, 406 bp, Homo sapiens
caaaggatacaacgaaggcaggttgtataggggttatagtggggaagtggataggggattcattttcttatgtgacattttgccttaagaatataaaagtgctttagcactgatggctggcatttttaatataggcagtgaaagtgactttagaagcatgggatgaaatagagggaagaagagtttttattttctggcctttaaaaagtgcctagtaggtcatttgagacccagagaaatgcacagagcttgagcaaaggcatgaagtccctgacattgttttcctttttgtctcagcatatagtattaagatgcctagaaataggactctattgttccctcttgtataggcactttacatttcttgtcactacagcaaccacatacagtacagacaacctccaaa

SEQ ID NO: 267309 - DNA, 510 bp, Homo sapiens
gtcccacaagactgtccccacttcagacatcagctgcaaagaaggtgcccaggctacccacatttctgcccaactgactataaatttgggggttcccaccagccctcttcatgtttgataatttgctagaacaactcaccaaactcaggaaagcactttacttactattattggtttattataaaggctaaaactcaggaacagccaaatggaagagttgcatagggcaaggtatggggatgggagtaggggtggctcagaactaccatgtcttcttgggatgcattaccctcccagcaccttgacatgctcagcaacctgtaagctccctgaaactttgcttgggaattttttttttttttttttagattccattaagtaggcatgattgatgaaatcactggccattagtgattgaactcacactccagactaggtgtggtggctcccatgtgtaatcccagaactttgggaggctaaggcaggaggattgcttgaggtcaggagttt

SEQ ID NO: 267310 - DNA, 316 bp, Homo sapiens
actgttgaaaaaataaaggaaaacagacttcacaaggatctccgtgctgaaagcagccttcaacaggaaggtccctggagaatcagctccttccaaaagatcaggggatgaagacttcaagaccgcaactgctgctgtctcacccctaggcaggaatggaccaccctccgccctccaccctccgccagcagcccacaggaagcaagtagaacctgataccacctcccgccagtctgtgaatatataatctgacttgtattttccctgttttcccattttgcatacttcagaataaagacatctgttcataacacta

SEQ ID NO: 267311 - DNA, 490 bp, Homo sapiens
gagggttgcagaatttgctctttttgggatgggttgccctgaataacattacggaccaggtaaataatttcatagaagttcagtatagtacgtaattcttgtaagagtattgtatgcaagctctctgtatgccacccactgttagttcaaattgagatttttgttttgttttgttcttaagaacataccaagaaaatatcagtgaattgttggatatgaattccctgttagttgatttaaatcctttctgaataaagatcagataaacagtaactgaaggagcatgtatagctctttccttcaaattcaactagagcctttttaaaaagacatttgcctgctagtcagatacatttacatttatgcaaattttttaaataggagaaaattaagaaattgtgttaaaggcctaaagttcaggagtgtattactttaggttctttccagtttgctggtttttttttttttttttttttttttttttgggcgg

SEQ ID NO: 267312 - DNA, 733 bp, Homo sapiens
gagggttgcagaatttgctctttttgggatgggttgccctgaataacattacggaccaggtaaataatttcatagaagttcagtatagtacgtaattcttgtaagagtattgtatgcaagctctctgtatgccacccactgttagttcaaattgagatttttgttttgttttgttcttaagaacataccaagaaaatatcagtgaattgttggatatgaattccctgttagttgatttaaatcctttctgaataaagatcagataaacagtaactgaaggagcatgtatagctctttccttcaaattcaactagagcctttttaaaaagacatttgcctgctagtcagatacatttacatttatgcaaattttttaaataggagaaaattaagaaattgtgttaaaggcctaaagttcaggagtgtattactttaggttctttccagtttgctggttttttttttttaagggggggggggggaggtaaaggaagttgggctcttggaaccaacagttaataagggccctctaaccggggagacgagacccgagagcaccgctgtgcagaagatgaactaaacctcagagggggccggctatcacaagagcttccggaggtcaacagccggaatggggggcacacgatcgggggcttggcagcactgcttagcccaggtatcagcctgggaacaaaaccactggggggaaatccgaaaagcccccccaacgtgg

SEQ ID NO: 267313 - DNA, 617 bp, Homo sapiens
aatatataacagcttctggacattattaagtgggctggcttgtgttttgttgaggaacaggacaaatggggcatttactagtgctgtgtgcctcgttgcttttctgggtagtgtttggtgatgggcatagtgtggagtggtggtagagtacacagtgtgattctgtctggtaaggaagctgtatgttgatgttcactgatgtgaataggttcatacagtcccttaggcatttggctggaggataaagaacagccattgaccagcagagtactttttttgaagtttatgcaagacagcgtgctaggtactactgccagcttgacaataaaggcagaaagacatttagagccattaaagaattatttataccagaatacaaaaacacacttttcaaatgttttgtaggcccttttcctgcacagcatgtgcctcatctactcaaatttaggaaaggtggttggtggttttgcagagaagcaaggaactgtaatatctgtctgcattggtcatgcttatcatgtaacacactggattcagtataaaggaaaaccgacaggtatggagtgtctgctgttttatttttaaaaaattgttcattttttaattaaaaaaaggaa

SEQ ID NO: 267314 - DNA, 387 bp, Homo sapiens
agatttaaatcattttgaaatattaatataatgatcaaaaattaacttttatacatgttattaggcagaacccacagaaaacaataaagcacgagagaaaagaggatggcagtttacccaggaaacataggttgtgcaaagctttgcaatgatactctcaattcagagcaatgaagaacagaatgctgtcttcccataatgatggcattcaattatcactagacttacaagactacagaaaatttctcaagaaccagtaaggatcagacagagccaatgacaatactgaagaagcttgccagtggagaatgaaagctcagttacacaaattacgttgttgaaccagtgccagaaataaaatgtgatggacaaactcattaaaaatga

SEQ ID NO: 267315 - DNA, 413 bp, Homo sapiens
atctttctgcatgcacagatccatgtggcactcatctcatcattctgagggaagaaagatgcatagggaatgttgcatgtggttatttctgcagaacccacagaaaacaataaagcacgagagaaaagaggatggcagtttacccaggaaacataggttgtgcaaagctttgcaatgatactctcaattcagagcaatgaagaacagaatgctgtcttcccataatgatggcattcaattatcactagacttacaagactacagaaaatttctcaagaaccagtaaggatcagacagagccaatgacaatactgaagaagcttgccagtggagaatgaaagctcagttacacaaattacgttgttgaaccagtgccagaaataaaatgtgatggacaaactcattaaaaatga

SEQ ID NO: 267316 - DNA, 393 bp, Homo sapiens
cgagtttgttttgccaaaactcttaaaatgagatctagaattagaaatgacttttttccttacatcttaggcagaacccacagaaaacaataaagcacgagagaaaagaggatggcagtttacccaggaaacataggttgtgcaaagctttgcaatgatactctcaattcagagcaatgaagaacagaatgctgtcttcccataatgatggcattcaattatcactagacttacaagactacagaaaatttctcaagaaccagtaaggatcagacagagccaatgacaatactgaagaagcttgccagtggagaatgaaagctcagttacacaaattacgttgttgaaccagtgccagaaataaaatgtgatggacaaactcattaaaaatga

SEQ ID NO: 267317 - DNA, 492 bp, Homo sapiens
atgggagccagttggcaagatggagtctgtagggttcagactcttgaagaatagagaaagggtacagagaaaggctgaaaatgtatctggggcatggtaggtggacaatatgtgaataaccagcaaactctagcaacaataagcttattaagatagcctgtgtgatggttatttctactacgaatttttctactttaggcaccagttcgagccttacttgtaaggcatggacatttaacaatacttggagaggttttttaaatcagaacttaccgtgatgtggctcggtggcttctggtgtgaagatttatagtgggggctagatgcctctagtaagtgggcttgggtggtgcctcaaactcaaatatccatttgcatctcctcatgtacatagaggtcaggaagcccaggaaaaaagtctttgatctctgttcaccaacagagttcaatataatggttaaagagacggctccaacaaatggtagtctgcaa

SEQ ID NO: 267318 - DNA, 496 bp, Homo sapiens
tccattactaaaagagtttgaagataactgattgtgctataataataagttataaagtgaaatatgtaataggaaaagttttaatttggagggtttttaacagtgttacagataatacacttttttttcaagtatacaagaatttattttaaaaatatgtgtgattaagaaaacataaacatttttaacatgtcatagttttggaatctaatccaggaaacaaataccagtatcactttgcttgttctgtttttctctttatcacttaccttctttctcatttctgcatattcagtttgtgctcatttcaagtccaccttcccttgaagcctactgcttttctttgtgcattttctaccacagttttacattgtgtatttattttctgcaatatttttgcttctattttataactaagcatattctattttgtattatgattatgtacttgtatcttttttcttatttataaaaataaagagaaaaaaatctttgt

SEQ ID NO: 267319 - DNA, 544 bp, Homo sapiens
catcactggcaggagtctggaacgtaggcggggagaagccagtgaatgctcctccattcctcgctttggccagtacttctgatattgcttgtgtctcctccgtggtcccagcttccctggggaagccttacccttggtggtcgcagcacccactgagcagccccagctcctaaactgtggtgaaaccacctcctctagaaaggtgatggtaacttcctacttttgcaaagacctgccttcaccatttgctgtttgcctttttagcacttcccacttcttaagttccccatgttaaattctctcagtgaaaccacttggtctgggttcttttttcctgactgtactctgactgattcatttcgcttgtagtctccaattcaaaccaccagaaatgggatgatgaacaggggaaccaaaggagcacattgaccatttctgccccttcaattaaattatataagatgtataaaactattgtgttgctagtggtagacatagacatagaaaatatagttcataaggatcatataatgtaaagccacat

SEQ ID NO: 267320 - DNA, 500 bp, Homo sapiens
agagcagagtctgcagcaggaagcccgagagtcaccagcccaaagtcacccagggatgactgcgtttctcacctctggaggactcagcattcaaggtgccatcttggaagcagagagcagccctcactagactacaaacctctggcgctttgatcttggacttcccacccaccagaactctctccactcccttcctagactttcttcatagagccagaagagggtacctgaattggcctggactgctcagcctgtacggttctgggagtggggtggggtggatggagtgaactcagcaggcacccccagctctgctctcctgtggtgtgactggatctccaggagggacttcgacttttccaggtcttagcactgaagatgctttggtgcttctgcacaggggagaaaattcaaaataaaaacaaaaccataaaccatgcaatacaacttttatatggatgctaaaaataaaatgttgttttgttttcttaaagttaaaa

SEQ ID NO: 267321 - DNA, 142 bp, Homo sapiens
aatatctactttcaagctcacttacataggtgttggaaaacttacttcctcgaagattattggactgagagcctcagttcccatttgactgttggctgacctcagttcattactatattgtcctcttcagcatggcagcttg

SEQ ID NO: 267322 - DNA, 216 bp, Homo sapiens
gaaaattcctgagaatatttattaaatgtcactgggaggaaatttccctaagcaagatacaaaacttagaatcaaaagggaggactgacttatttggttttagaaatgaaaaagaacagtttggaagaaatagtgcgatgtggatgacttacaaacaattattattcctaaaatataggtacaatgagtttattgaaaacaacataatgcaatagg

SEQ ID NO: 267323 - DNA, 515 bp, Homo sapiens
ccttgatttcctcatctgtttaatggggaccatatgtctctggcaaaatcgttgtgagcaatgtttgtatgtctgtgttcacagtaccattgtttgcagtggtaaaaaggtagaggcaacccacatgttcgttgatggatgaatggataaacaaacaaaatacacccaatggaatattattcagccctaaaaaggaagaaaattcagacacatgcaacaacatgggtgaaccttgaggacattacgccgagttaagtaagacagtcacaaaaagacaaatagtggattccacttataggaagtccctagagaagtaaaatccacagaaacaaaaaagtggaaagggggttgccagggcccagtgggagcgggcaaggggagttgatatttaatgggtacggaatatcagttttgcgagatgaaaagagttctggagccggatgattagtgatgattgcaaaacattgtgaatgtacttaatctgatggtaaattttatgttatgttcattttatc

SEQ ID NO: 267324 - DNA, 265 bp, Homo sapiens
catagtttttcatggataaatcaccattttctctacttaatttaagggaaatgacacatagaaccttagtggttggctgtagcttctggcttatttcctcatggcctgaccaaagagatgagccttagaaaatatccaacttgtaggccggatgaggtggctcatgcctataatcccagcactttaggaggccaagataggagcatcacttgagctcaggagtttgagaccagtctggccaacatagcaaaaccccatttctacc

SEQ ID NO: 267325 - DNA, 536 bp, Homo sapiens
atgcagagagccctgtgatggggctgctggagccgaggcctggggttcagtcccctgagaagcccccaccagcttagcctgggggacgagttatgggaaggacagatgagaaactgctaactaaacaaggccaaaaggaccagggcaagctgggggagaccatggaggctgtggaaggaacaggctgactaagctcaggagactccccacccacaggggctgcagtcctgcctcagggctcagcaagcaaacacgtaagagcactgcacagttgaaaaaatgagttttaaaacaatctgccaagaaaaaagatgtcaaagtagtcatcacgggaaaagtcagaattttggtggacttcactgcacttattctgtggctattaattttaaattatgtatgtgggggaggggagcacaccataatctttctagtgccctgaggctcttaaaccaggctctgttcacctggacctgtgttcatgggcaggaaactgttctaggccctttatatgcattgtttgatttaatcctgtaagt

SEQ ID NO: 267326 - DNA, 453 bp, Homo sapiens
aaatgtaatgtaatttgatttcttgattagtggtgaagctttttttgtgtatagtaaagaatcattctgtaagttatatgagtttttcctgtatcagatttgccttaaataatcctatgttgaactcattataaataggtttgactcagaagtatcattttagtgtttttttgcttgtgaacagaagaataaggaccacaatgtaatcatcgtatttttcttcacgggaattccaccatctgtgtgttttgggcagtgggagaagggggagggcaaacttcttctcggtccctcctgtgtttctctagttctagcagggacgtttctgtaattggttttcaacatttgctgagagtctgtttcctcttaacattcaacatgtttaacagaagtcttgtaatagttccaaaaataataaaaccagtcccaggaataaaaatgatacattcacag

SEQ ID NO: 267327 - DNA, 484 bp, Homo sapiens
cgcccttctccaccctcctgtctctgttgctgcagggaaagcagagtaaaaaactgcagctgcaatgatgagcctgcgtgccatgcgcaaaaggctggagagaaactccgtgcagcccttcttcgccactgttcttaccgttccacctgtgtatgtcttcatttccccagaagaactgtacacatatggaagggaacaatctttttttatagctcctataccccaaaacataagcacttaacgtaagtttgcatatatttggccacaataggccaaatataaaatttaggacatccatttatcgataaagctaattctaaagcaacaatatcaataattaacacatggcagagttcttcaacgcggcatgttaattttcaatatagactttgcgtgtaatttgctttttcaatgtttttttctttttgattcgaggaggacaatcataagttgaattcaaataaaaataatacagaaccacttt

SEQ ID NO: 267328 - DNA, 532 bp, Homo sapiens
ccctgtgatgtgacatggagaagtgaccaacacaactttgccaactatactccattcttagtaactgccgattaggaaggatttctttctaagtctgtcactaattcaactgttattcacaagagaagtagaggcaaatgatagcagcttgatcgttgatttttgatttagatgatcaatgatgttcagaatagtgtttgtatgtgtgagcatggatgtgtatgtcgtgtgtgtgtctgtgtatgtggtgtgtgtgtctgtgtatattgtgtgtgtgtgtgtgcatgcgtgtgtgcagggtaggtatcaccacattccctgtggtggtgtgtctcttctctgggattggttcttctagaatctcccaccttttagaaccactttaagatatttatttattctctccaaccatcctggcaatctttttatccttaaacaggaataaattcctacagctgaatctattcaggatttctgtgtgtatgtgtgaaaatttatatgatgctcaatcctttaaaaatcttttattcaa

SEQ ID NO: 267329 - DNA, 225 bp, Homo sapiens
ttatctatatgtgttccacaacatcatgttgcaaacctcaaatatacacaataacagtattttaaaattaaaaataaataagagagaggaagagagaagaaacttcagatttactcacatggaacagatcaccgaacataaaattgctgagcagatgattgagtaaaggaaataaagaggactgtaaacaaaatcttggagaattaaggacttggctttatatga

SEQ ID NO: 267330 - DNA, 454 bp, Homo sapiens
aatttcagtcatgaggagtctattccaagtgttgaagatcatggcacaataacagggcagctgggatggctggcattttcaagaacttggcataaaaggactggagctgagcagagtacctgtacccagaatacaaataaactacctgagatgataaaagaagcagaagcactaaaagtacttatgggggaaggagatagataaggagtaaaggtgatgtgtgcagaaaaataaacctcaataaagacagaatattcacatgaagatgaacaataaatccataattagaaggtggctcctgttgaagaaaaaagctgggaaatatcagccgtatcagggagtaaaccaagctcttattctgggaagaagccaacctggaatgagtagaaaaggatgaaagtgccctagcagaagttgcagcaggtagaatatcaggcagaggatgtcaggaagg

SEQ ID NO: 267331 - DNA, 482 bp, Homo sapiens
ccagacaacatagatattatttctggtagccttctttcctcaaggagaactccctgagaaaagattctaaattaaggtaatttctacacgtttgcttgtatttttactcacacttggtgtgcagatggctctagaaatgatttttctggaatactcttcttatgcaccctatatattggacaaattttctgactattacaacaaattgttccatttgtgtaaatatctgcagtgcatttaggcaaacacttgagaaaaatgtgtttttctcttagtgtctccatccaatctggatgttaaaatattacatatagacatacacttttgccttatatgaagcactaaactgccaactcgtgtattcctcatattctaatacacaagattaaaaatgcaaaaccatgacccaggcacattttcatttctcacaattgttcaagctattctactctctttgaaattgattctagagcttcaagata

SEQ ID NO: 267332 - DNA, 582 bp, Homo sapiens
ggagaccactgtgttttcactgttagaactgggctgtctctggacaagggccagccttgttacgagcagaagttctcggtactgtgtctgggatgtggctcttgctcctctaggtcgtgactacgttgtttatgaaagtcaagctcttacacctaaagccggtgctcatgggatttccttacagtgcattacattgttaaatttcaggcccagacgtggtctggcggcttgtctggaacacacagtggtgctccaagcatgcctctgcatggacgccttacccaccaacatccgtgggctccagaggcctcgcaccctcccctggccggccaccccgggatgcccccaggacctgcaccctcagctgacgctcctcttgggaaggtggttttgaacctctgtcatgtggttcctcccgtggttgggacacactcatctgcctctggtgtgacccatctctctttggtctttcctcgtccctccagtgccacccattttcgtacagaaactgaggatgcctctaattccgtttgagcatttgagtctcagtgtctgtgaccttgactccccctgtgcggccgc

SEQ ID NO: 267333 - DNA, 479 bp, Homo sapiens
tactgtaactgcccaatgagtacttcttgcccactgccaagatagagccagtttaccaagacaggggaattgcagtagagaaagagttgaatatacatagagccagctaaatgggagagtggagttttcttattacttaaatcagcctcccctaaaattcagaggtgagaatttttcaaggacagtttggtgggcagggcctagggaatggatgctgctgattggctagggatgcaatcataggggtgtagaaaaggtccttgtgcactgagtccacttttgggtgagagctaccaaggagctgctggtctgctggtcccggtagagccatctggtgtcaggaatgcaaaagtgtggccaggcacagtggcccacacttgtaatcctagcactttgggaggctgaggcaggaggaatgcttgagcccaggagctcgagaccagtctgggcaacatagtgagacctcttctctacaaaac

SEQ ID NO: 267334 - DNA, 405 bp, Homo sapiens
agttgacaaagggtggactcatgatggttaatattaagtgtcaacttgattggattgaaggatgtaaagtattgtttctgggtgtacctgagtgtttctgagtgttgccagaggagattaacatttgagacagtggacagggagaagaagactcaccctcagtgtgggtggtatcatccaataggctttcagcacggctagaaaaagcaggcagaaagcatattaatcttaaatttcatatatgcttttatggtgttgatactacttatgatgcctaaatgtacaatcgtgtacatttgtgcaaaaatgtacaaaaactggcaagctttcaagaaaatgacattcagtactatgtctggtgatgtcagaattttatatttgtaaatatattacaaatatatcaaa

SEQ ID NO: 267335 - DNA, 406 bp, Homo sapiens
agggtggggcctaatccaatatgactggtgtccttataagaagaggaaattaggacacagacaggcacagagcgatgaccatgtgaagacacagggaagagatggccacctaccaccacgccatggtcacctaccatccaagccatggtcacctatcaccaagccacagtcatctaccatccaagccaccgtcacctaccatccaagccatggccacctacctgccaagccatggccacctacccgccaagccatggtcacctacccaccaagtcatggtcgcctaccatccaaggagcgaggcctggaacagatccttccccagagccctcagtaggagccaaccctgctgacaccttgatctcagacttcaagcctccagaactgtgggacaatccttcactgt

SEQ ID NO: 267336 - DNA, 373 bp, Homo sapiens
gtcttagtctgttttgtgctgctgtaacaaaatacctgagactgggtaatttataaaaaatagaaaattattttctgatagttctgtaggcaaggaagtcaatgatcaagataccagcatgtaatgagggccttctgttgcactctcagatagcattagtttaaatggcaagagaaaggcagaactctatttgagagggctgttgcaaccttacagcatgatacatcttgtgaaatatggttttgaacatttttattaaaaatgtaggcatcaaaatctctaccatttgtgtcatgttataataataactataaaactgcattattcagaatatgtaacaataaaaattaatattaaaaagttttaaaatgta

SEQ ID NO: 267337 - DNA, 299 bp, Homo sapiens
tggttagttgtaaagattgaaatattctatgtgtggtgcctaatataatgcctggcacatagtaggcacttaataaattgtatctgtgatttttaattattaattttcctgcctcaagggtaatattatataaaggctgttagctgggttcaaatgtgttagatgatgggatgggtagatgaaggaacaataataaaaaaaggatatggaaaagaatgggtacttaaagtatagatttatttgtaataaatggaaaaatcagttgtataaattgtctttgtcaaataaaacatttacta

SEQ ID NO: 267338 - DNA, 293 bp, Homo sapiens
cattaggcagaaagaacacctccagcagtgtactctggcaccatttcctcctgagaggcccatcactttctttgtgctctaagaatgtgcttgccacatggtgccttaaggtagaggtaggtggacttttcacatagacatcacaagattgcctttggggcttcagtgagattcccgaggtgtttcagagtatattggagcaagagcataaaatactgagtatgaggcagaacttactgaagggattttatatctaaatctggttcatgtgtctagattttgtgtgtgtgtat

SEQ ID NO: 267339 - DNA, 590 bp, Homo sapiens
aaatatggtgttttaataattgtaattttttacataatatctggcagtagaagttctcagtataccatagtctttgcagttatcccgaatgaagttcgaaataatttaagttcccctgacgctctctcccctaacaaaacaaagcaagacaaacaaaaccaaaagaatagtaattctaggattttgccatcaccttatatggaaaactcagaaccttctatttcacatatgattcgttcactataattgttttatttacttcttcttacacttggctgtaaaatttaggcaagaatttaagtttctaatactatactaatgtcataagataatccatttaaaatgttaacaattattctatacatagttcattcaagcttagatcagttttgctgaatggttgttttatgttcatgtccttttagacctttttaggattgttctttgaaaagcctcaaattggccaggtgtggtggcttacacctgtaatcttagcactttggaggctgaggcaggcagatcgcttgagctcaggagttcgagaccagcttagcaacatagacaagacattacttgtctctactaaaagt

SEQ ID NO: 267340 - DNA, 744 bp, Homo sapiens
gcagtttctccctccactcaccggctccaggctggcaaagctgacaccagtgccacagaaaatgcaacccgctgccctctccccaaaatgtggggagagcacggttttgctatgaagatgtcggctttgacctgaggctgacttgagagcccagctgtcatgtctcttccaaataagctgctgaacttggaattatcttggctgaataattaatcaggactaaaaataacctcaaactgcctgggctttgcttaaatcctacacaggcacagcatcaccttacatcgaagacagattcaacgaatctgcctctcatcctaggtggccactaggcaactcctctgggaccatttcttcctgctctatgctcccatgaccttcattcatactccctcttcccctgctggaaacctacttcttttacctcctcaaaggtaaaaggaccagctggtgaacaaaagaatacatttgctctatctaaagagaagcattagagcaagggaggaaaaactgatgcaagacaaatgacttgggctcatcataaaatactgagcagtcagcagaacattaagaagagacttctactccccaccacacacataaccatctgcacacctgaatgccgagactaagcctcaccagacgccagcagcataaatgagaggagtcacttacccctctgaggctcaggcttctcgactggaaaaaaaaaaagataataaaaatatcagttcagttgggaat

SEQ ID NO: 267341 - DNA, 406 bp, Homo sapiens
aaaccaaaaccagaaaaacgatagaaaagtcaatgaaaccaatagctggttctttaaagtatgtatatttaaagaaccagaatacatacacatattttaaagaacaagaatgggccaggcatggtggctcatgcctgtaatcccaatactttgggaggccgaggcaggcggatcacctgaggtcagaggtttgagagcagcttgaccaacatggagaaaccccgtctctactaaaaatacaaaattagccaggcgtggtggcacatgcctatagtcccagctactcgggaggctgaggcaagagaaacacttgaacccaggaggtggaggttgtggtgagccgagattgtgccattgcactgtagcctgggcaacaagagtgaaactgtctcacagaaaaaaaaga

SEQ ID NO: 267342 - DNA, 641 bp, Homo sapiens
atggttcattacgttgccccattgcagagatccagagtgctcatggacagggccagaaagtctgagtggatgtgccctactgagagccagccttgactttaagagcaaagatgtgctttctcggagatctagggctcttgcttttatattcgacaagttgttttcaacacttcagtcttttcagctgttgggagaaggactgtaagattcctgccaactctacacaagaaatattacagaagtgctcatcaccaaaacaaatgactgatgtgactgttgacctatgagtgtcaaaattaacttaccacaagagagaaaaacgtctttaatatgtttaaaacatgttctgaaaggggacagaaaggatggagcccgagcacctaatattgtcatttcactgtcacacagcctgtgcccacagcatgaattttcctaggaaatgtcactctgatgccttctatgtagaagaaacttgaattgtcaaatactcaccaaactagcacagtcttccaaaaaccaggaagacctggaaccaaacagaaaatgaatattcagccaagcatgaaactttcaaagaaaataaactgcatctatccctattaaactctttgttcattctaaataaaaacaatttaattaat

SEQ ID NO: 267343 - DNA, 373 bp, Homo sapiens
tcttttctttggcgcttcagtgatcaaatctatcacaataaataagcctcgagcatcaagaactctgaagagaaagagaactgaattgatttctgaatgcgctaacacccagtggttctcaaagtgtggtgtggtcctggaaccctttgggagtttctgagaccctttcaggggatctgcaaggtcaaaaaaaaaaaaaaccttttatgacaatgctgagacttacttatttgacttgttcactgtggtgacgttttgcagacaatggtggttaaaagcgccggtggtttaacccaatcaaggcaggggcaccaaactgtattgctagtcaaagtacgcgtcactaatctgcactctcagttacaaaagaaaa

SEQ ID NO: 267344 - DNA, 343 bp, Homo sapiens
catggttcctactaacattctccctatacttttggcatttgatgtaaaaggggaaaatctcattttaaaaataataaaatgacttaaaagaaaaaatatagcaaggaagtatttcggtccatttcaactcgttaaaaaacagccttattaaatagttacttgctgtaatcacctgtattttgccaccctttttggcagcatttatggcagtgctgagtaacagtgtgacctctctggtttatctctctctgcctctgtgtgaaagcattactgtcactactgtaaatgggtggtttataggctgtaatgattcttcattaggtacattcctccaactcttggg

SEQ ID NO: 267345 - DNA, 462 bp, Homo sapiens
ttcgatggtgtgcctggtgaggttattattagtaacaatggtttccagtgaaagagtaattttcacagtggagaaggcttccccttccttcaggtcaaaagctgaacggagacgaaaatgacattaaccagtgcaggatcctgaaaagatgaaatgctcaacacctcccagctctaaattggactgggcgtttactagcgttttaagggccagagggaagttgaagcaactgccggggtaacacacacgtgaaaaatgtgaggccagacagtccgggcaaataaataaccctgtgctggcaataagagacgtgcctggagttttagcgcggggctgtaaaagttgacaggagccatttggactgaaaacggccgtgtggataacgctgccaggttttgccaagcgcccggctgttgaatactacaaaactgaatagatgaaaaagaaaacaacagccacaaa

SEQ ID NO: 267346 - DNA, 408 bp, Homo sapiens
attaatatgcatataattttaatgatacagtctttatggtctttcaattcccttacttaatacttactatttctgtgtttgttcatagtctgttggctcccgtggggccagcacaatgactcttgcaggtctctgtaattcatacggagccagacactgaactccaccttcagatatcccatgcccatgtgttgagggtgacaaggaatgatttctttcatctaaccagagttcaacaaatgcgtcttgatcttcaaagaaaacacctgagagtccacaacaagggccataggatgaatgggaacttttagtacatcggagagtttaaaaagcacataggggaatataagttgaaaagggatattcggcaacaaatcagactcttgtgcatagaaaggagagatccct

SEQ ID NO: 267347 - DNA, 391 bp, Homo sapiens
tttttttttttggagaaggagtctctctctgccgcccaggctggagtgcagtggtgcgatctctgcctcccaggttcaagtgattctcctgcctcagcttccggactagctgggattataggcacatgccaccacgcccagctcatttttacatttgtagtagagactgagttccaccatgttggtcaggctggtctcgaactcctgacctcatgatccacccacctcagcctcccaaagtgttgggattacaggcgtgagccaccacgcccagccaagtcatcatttctgatgcagcaccttctgaagattcagagccctggccacagtggggacactgcaggcttattcaatacaatgtggtgtcacaggcacaggggaccataggccg

SEQ ID NO: 267348 - DNA, 479 bp, Homo sapiens
aggaaggagagggctagttgtctgagagggaaactgcttaaggctgcagactaggaaatgggattccaggtttaagatagctcctttctggacctcagtccttcacctagtcacctagtcacagggtggatcgcctctaaggatacttagtggaaaaggaaccaaattcgggatggttctccttgctttaagccttgatgggagacggggaggccaacccttctctgcagaccgtgatcctcactagacagaggagctccaaacctgcccatctcatcccatgcaccgacggtgcctggcctggctccaaactcccgaaaggaactattttacaggtgccaaaaaggggacagtgttgataataataataaaatgaaacaatctgattggggcattgctggatcagaaaatgtgtgacctttttaaagttaaattgttaaaaaattttaactattaaacattttaaatattaaacctga

SEQ ID NO: 267349 - DNA, 524 bp, Homo sapiens
tgacagctctcaaacagattctttccacgaggaattagcccgcacacaacatgaatgggctcgttttatatcagaaggctgaattttaactgacaaattggacaggttccctaaggcaagggttgctaagctttgtcattctcgctaaaaatgtgatttataatatatttctatttgctagacactccttttcccaggaatgaagacccagcccagaaacaggaggtctgctcagtatcttgaccccatataaaaatatgctcctcaaaagttttcattagcatataaacagatatgcatcaatcaatctgcagcatggccacgtcagctttatttcattatgttttaatgatattttaagcagccaaactcttagaattcaggacagggcaagagtaacccacaatttactttagaattttatgttttaaaggaaagatctaagggtctgatgaaaggagttgtatttcctcggatcttttcttccactttataaaataaaaaccatttttgttgcttcttaa

SEQ ID NO: 267350 - DNA, 440 bp, Homo sapiens
cacttggcaaagttgaatatttttgtgcatatgtgtttgcgggttgcaatgtcatttctctccacctttgagccatgtgcttaaatatgcttgtaccaaattagagaattatcagtacatagtattgtaagagctcctcaagcatgcggtggatcacacagtgccctctgagccagcctgtgcgccattgtttggggaattaaaggtgcctaattagtgcgatcaagcccggaagcgagcactgcggaccttgtctgtagtctctggggcccactggtgatgtctgtgtcatcttctaccttcaactgtgctgtgaacccagttgaaatttgatcacattacagtatggctaaggggcctaatcagccgtaaacctcaggaaattcaaaaattagagagtccattaatcccaaggcccctccctttgtgagtgtctctaa

SEQ ID NO: 267351 - DNA, 701 bp, Homo sapiens
cttaagtatgcaaaatgacataatgttgaaagcctttctcagtagccttctccaaggggagcaatactgagacagtggactctggatcccgctgcctgggttcagactcagctctgatatatgccagagtggccttgggcaagatacttgatcctttctgtgcctcagtttcttcatctgaaaagggggctaatagcaatgcctaatttgtggcgtggctgtgaagattaagtttaaataatatatgtataatgcacccagaaccctgtcctggcacctaatacatctaaaaaataaaaagagcatttattttaaattgcacccctctgggagtttgggggtgggagtttttctgaggtcatttatttttaaagcacagaaactcttgcatgctgatatgtcttaaaaggaaaactttgacaattagagaggaaatgccagtctgtttactcatctgtttcaggataaggcacatttgtacgtttggttctataaccattgagtattaagaataaaaccatgcggacagtatttactgatctctgtttagatcccactgggtggatttttgaagacaaggatatgctgtcctgttggctaggtttcttgtaccctaggggttagctgctttcttgcctcttagtggtattgtttgagaattaatcatgattgtctgaataaagtttttgaaaattgttttc

SEQ ID NO: 267352 - DNA, 182 bp, Homo sapiens
cctgcccagtcctcttttctcagtatctttaggccatacagtgaggggttaagtgcataggcttttgcttaagatctacgtagatgagactcttccactttctgactattgacttggaacaagtgacttgatctttgtaaaaccgcctaaactggttgtgagaattaaatgaaataatctat

SEQ ID NO: 267353 - DNA, 582 bp, Homo sapiens
ccaacatggtcaaaccccatctctactaaaaacagaaaaaattagccgggcgtagtgacacatgcctgtaatctcagctactggggaggctgaggcaggagaatcacttgaacccgggaagcggaggttgcagtgagccaaaattgcgccattgcactatagcctgggtgacagggcaagactccatctcaaaaaaaatgaaaaaaatttgccaaacgctgttagttgctaaaaatgggtgttgagttatattgggattcaaaaattgtgctgctggttataatggggatctattcttaatttgtatatgtttaaatttttccacagtaaagtttaaggtgtgacttactacctttttctctaataaagcccagcggcaactgaaacaaagatgctctaaaataacactgtataaggtaagccaacaatattttgctactccatctgacaaacactgactgaatactaactacatgcaatgcagtactgaatgaatttaaaatgaatccctccaaagttcccatattacgatctagtcaatttcttgaactgcctttgtgcacaatggtacattttaaacag

SEQ ID NO: 267354 - DNA, 408 bp, Homo sapiens
acagatgtacaccatcacacccagataatttttgtatttttagtacagacggggttttgccatgttgtccaggctggtctgaactcctggcctcaagtgatctgcatacctcagcctcccaaagtgctgggattacaggcatgagccactgcctggccaagtgtagtatttttatgtgtcatgttaaaatggatctttgatttttttgttaattcagtgtttagaatcaagattataatacattaatgaaatgtcttggtcagtttctgagagtttactgtttttctagaacagcttgtgtaaaacaggaatgaacccttgaaatttggtagaactcattgtttatactaattggtctgttcagattctctatcagttcttgtgccagttttggcataatttaatggg

SEQ ID NO: 267355 - DNA, 779 bp, Homo sapiens
ccctgttgcataggcatttatttattcagcagctactacgtacgtgctggcccgcactgccgagggaccggacgcctgccccaggcgggacaatgccgggtgcagcgctggcggggcctggacgccaagcttcagggtccccagcccctcagtcagagggggcgcctcccaggccctggactcctctccagccgggtctacaccaccgtcccccgtcatcttcttctgggttactgagcagcttcttttaaaatagcaacaccgaggaaggccccgaagcccagtcttgcacctcgtggtgtgaagtcgtttaatcctgcccgctaatgcgtaaggactttccaccgtgtgcaggactccgcgctgggcaggggctctcgcagggtttgaaccgacctccgcctcccctgcgggttcacaggcctgcgaggaagtcgcgtgaaggagattcgctactgtgtgaggctggcctgcgcggcgtgggcagtagctgtccggggctggggacagctttcggctccccaggccatcccgtcggggcatctgcggccaatctcgaaggtggagaggctcagggttggaacagacttcacggaaggggtcctagaagaggaaaggggtcgtgtttgcccttagagcagtctgggcgtgaagcggaaactttaaaccaccagaaactctggagagcttggagcacctgggaaggagcaaccagagtgggccggaggtagggaaggaaggcacccacggcgaatttgcccgctttgaccgcatttagg

SEQ ID NO: 267356 - DNA, 690 bp, Homo sapiens
agtctatcagcaatttagaccttgttttgggtgggaaaacatttagaaggacaacaaccagttaggaggaggtagttttggtgatccagaagagaagagtgaagggcttgaacaagggactgatgggtgcacagggaggaacagatttgacaggtattaaggactaaggtggaagattgagtacataaaattacaagatgaccagttaaatttgaatctcagaacaactgaatatgtttctaatgtaaacgcatattggggacatacttaataatacagttaatttttgtttatttggagttggcgttatgtattttatctagcaactttattaaggaagtagaatagtcaggtcctggggactgactggacatagaatgggagagagcagatggaggaaggttttgaggatgatttcaaggctactggttggggatctgagtaaatgacagtaccacaagcagaatgagcttagcaagagaaggtgaactattcagtcttaggcatgttgttttaaagatgccaataggacagtccaggtagagatgtctaatgagcaattaaaagatacagagatcagaataggagacagggcttggaggaatacctgtagagggcactaatagtaccatccactggtgttctctttcaactaggttcctccatggccataaaggccaggccaccagg

SEQ ID NO: 267357 - DNA, 354 bp, Homo sapiens
tctagatgctggtttctgcagcagcctctctgcaacctgagggcagcaatgccgacaggcagcaagctgcaggcacacttgacagatgtgaagatctgggttctggggatgctgttgagctgctcgatgagcccactttggacctgccctaccgccagactttttgtgatccaagtgcaaggaaattacagggctatcaactctatctctttccaagaccagaaagtcggcagatggagaacggtttctagatggggagggaatctgcctttggaacttttagcgacctggtatggttcaacattccatcactatgcaaaaataaataaataaattgcagaccaacgtacaaag

SEQ ID NO: 267358 - DNA, 524 bp, Homo sapiens
gttgttgaaatatggttttggtttctataaaaatgcaaataatactgataagtataatgttttaagctcttatcattcatttggatcttaaagtgaatgtgtccttcttgttttttctttgaagcagattttaatgggggatgggaataagaaattcagggtactggaaacataaaaggaaaaaggaggccctaagaagaatcccgaagaagagaagctggaggctgagggttcattactttgttgagggtgtttcttatgacaccaaataagacccatggtgcctgagatactaatgagaggcaattgccgtcctagtgtgaggtggggcctctggcccacttttcttgacaatctaaacatccattcacaatgacccaactacacttcttcactctttcctttggtcttcaatgtgcctatgcctatcctccccagaacatatatagttttggctaaaattgctatgcagaaatttttggaaattcaccctggtagacagagcatgacagcaggcattaaaa

SEQ ID NO: 267359 - DNA, 460 bp, Homo sapiens
acatgtgatattttgaaaaaaagaaaattatgtgcatatctggataactgggacaaccttcaaccttcatctcaatcattgactacttctttgtggtaagaacattctaaatgttatcttctagctaatttgaaatacacaataaattattaactgtagttgtctatgtgccaattcagcattctcaggagcaatgggtgaaaattcctgtttttcaacttcctcgtcaacatttggtattgtctatattgtgtattttacccattctattaggttactaggattttttcaatattaaacatacatttacctaatgaaaatccagttggtcactttttatacttattgttagatgcactttctattcaggtctttgcccattttaaaattaaattgtgtggttttgttgttcaattgtaaggtaatttgtatatttgtaataaaagtccttttccaaata

SEQ ID NO: 267360 - DNA, 398 bp, Homo sapiens
atggtaaatattttatttgagaagaatcagtactgagaaagacagattatatggtagactaactaggaccagaaaaaccatccagggagtagtaagccaaacactggatgaacagagcctaagctgggctagtggtgatgcaatgaacatgcagctaccttgaggggaaactttgtctctaggcttattgttcagcagaaattgggttggggaaggtatgcctattaaatcgttcctggaaggacacttgaagaaaggaaaagtactaataaatggtaacctttactgaacgcctactatattcttaatgttttcatatttcattttatttattcctcaatataatcctgtggatattttatttatttatttatttatttatttgagacggagtctcc

SEQ ID NO: 267361 - DNA, 291 bp, Homo sapiens
ccccccctcaacatactggtgtgccccagggctttgtcctgccttccattctcttctttgtctctactccctccctgggttatctcagccagttctacggcctttaacactgcctataagtgttacaaacaactcccgaatttatttctcaaagtcagccctctctgtagaattctagactttatttccaattgcctgcagctccacatgggtatctaatgggcatctaaaacttagtatgaccaaaacagaactcttgatattccccccacatcctggcaaatggtactt

SEQ ID NO: 267362 - DNA, 533 bp, Homo sapiens
tgctcctctaatggcatccaacctccccgctgtgatcagcaatcataccatccgcccccattcttctctccccacaacccgcaccttctggcagcccatgaacatgtcacactcagactgtcctgccccaaatactatcttgtttgtcccacatctggaatgtgctttttcctctgactccccaaggagaaccctcccaggccccctcctctgcaacggcctctcctccaacctcagcaccgtcctgccccctcctctaccgcctgtccggtggagcaggcccggcccaagtctccatgcctggagggcagcccattctggacatagcgcatgcccagaactgcctccacagccggcttcctctgcggctctctcttcacaagacacggaagagttttggggcctgctggtgtggcattgcttctatgatggctaaaaacagctgggaagctagaagacacgcctgaaccaagcgcaggacagcgatttgttagccaaaagcttaaattcaggccccaaatccaagtgtggca

SEQ ID NO: 267363 - DNA, 747 bp, Homo sapiens
aactgctcagactcaagccaaattgaggtcaacatagtatgccaaatccatagtaaggcaaatccacccccctaccccaatacttaacacacagaatactatgtgatatagaatgcactgaagacctacggtcactggtagtttgagccacaggccttcctcatgtaaccagagacagaatgggctacttgcaaaaacgtaactccttgtgtgtatattaaatccataaaatctctggcagtaaagccagcctgaagggatggcctcaccatcttagaatactgagatctcaccagaacactgtaagccatataaacagtagggaaagagtcagcaacagtgaaaccatctgtttaaaatgggcaaaagcgattaagggaaaaaaaacaggtgaatttgaaaataaaccagggtaaggtaaattctagaaataatagcatttgaaatgaaaacctcacttaagttcactagaacagtaaacaggagattgctgaattttttgaagacagcaatgacctcacctagatgactcaagtttggggaacatcaagattttgacgggtactataatgcttaatatgtccaaattttcaaaatgaagtttctcagatattatttctgccataggagctacagtgtagagtatcacataagtatcttgggctagagaaatgcagtttatatataccgttggatttttataataaagtttcccaagacctgttaatttgccagaaatgcttctag

SEQ ID NO: 267364 - DNA, 693 bp, Homo sapiens
aactgctcagactcaagccaaattgaggtcaacatagtatgccaaatccatagtaaggcaaatccacccccctaccccaatacttaacacacagaatactatgtgatatagaatgcactgaagacctacggtcactggtagtttgagccacaggccttcctcatgtaaccagagacagaatgggctacttgcaaaaacgtaactccttgtgtgtatattaaatccataaaatctctggcagtaaagccagcctgaagggatggcctcaccatcttagaatactgagatctcaccagaacactgtaagccatataaacagtagggaaagagtcagcaacagtgaaaccatctgtttaaaatgggcaaaagcgattaagggaaaaaaaacaggtgaatttgaaaataaaccagggtaaggtaaattctagaaataatagcatttgaaatgaaaacagcaatgacctcacctagatgactcaagtttggggaacatcaagattttgacgggtactataatgcttaatatgtccaaattttcaaaatgaagtttctcagatattatttctgccataggagctacagtgtagagtatcacataagtatcttgggctagagaaatgcagtttatatataccgttggatttttataataaagtttcccaagacctgttaatttgccagaaatgcttctag

SEQ ID NO: 267365 - DNA, 176 bp, Homo sapiens
cggggggcgggggaggtggagacagagtctcactctgtcacccagtgatatctcattataatcattataaagcagcaagttaaagattactcagcagaactaatgcatagcttcagaaattagaggaaaattttcacacaaccaaataaaaccagggctggagaattttgatatga

SEQ ID NO: 267366 - DNA, 333 bp, Homo sapiens
ccccatcaacagtccttgagtcctccctcccctgccaccctaatggtcagtgagtccatgatacctcttgagtctactccctaacctgagtttgcatttgaaaataatttatttttagtacaattccccgcgtttccccattgacattttgtattagttggtgtatttgttattgttgatgcgccaatactgataagttattgtaaactacagcccatggtttacagtaggtttcctgtctgtgttgtacagtttctatggggttacacaaatgcataaagccatgtattccctcattaacaatttcatgcaaaatacaaaactgggcggctg

SEQ ID NO: 267367 - DNA, 329 bp, Homo sapiens
tttctgagccatccttccgtgatctgtaaaatgggggtaaccatgtaactaatgcctggggctgctgtggggattggtgggtgtgctccacgggaagcacacagcacagcacccggtccgcagtgggtacttggcctgtggtcactctcctgatgataccaggctccctctcccgtctgcgaggccctaggcagaaagaagcacagcacaggagacagttctcatacttgcctgcagggtttccatccctggagacgaaagcccttccctctgtaaatgacagctgtgttggaaataaatggatacctggaagatccaagaaatggaaa

SEQ ID NO: 267368 - DNA, 541 bp, Homo sapiens
ccattaggactcgaatgttgttgcctcctctaaagatgaaggtgtttatcttgctgtcctcagggggtcctctttttatctcttttctttttagttcatgagaccaacactgtttatttacaaatattttctgcacatgttgatgtaatgtaaatggaaaacacagtgctgcttcctttattttttggatggtgatatggtttggctttgtgttctcacccaaatctcatgtcaaattgtaatccccacatgtcaggggaggagcctggtgggaagcgatgtgatcatgggggaggatttcctccatggtggtctcgtgagctctcatgaattctgatggcttaaaagtgtggcacttcccacctcactctctctctttctcctgctgccatgtaagtaagacataccttgcttcctcttcaccttccaccatgattgtaagtttcctgaggtctccctagccatgcagaactatgagtcaattaaacctcttttctttataaattacccagtctcaggtagttttttatataaaagagtg

SEQ ID NO: 267369 - DNA, 646 bp, Homo sapiens
gtttagtctgaagtttgaaacttgataactagtatttgtaaactaatgaatcaactctcctatttaaagcagtcatcactctgttggagaatttttgttttttctcttggtacaattaaactctgtgatgacaaaagcatttggtactaataaagcattcataaatgcttaataagtaccttgccaagcactttccacactattttgtttagttcttaatggtcttttgaggaagaggcagagattgagtatctcacgcaggattataggggaatgaagactcggatctctattttgtgcccagactctgagctgctttatgaacacctcaattaaattacttcattggagtgatttgagtaatctatctatagtgtaatattttctatgaataattttctgtaaccttatttcataagttaatatctaaaaagtgtttatttccaaattgccaaataaaaggttttatattagtcattagaatgtaggcatctgtgtctctgtatgctaagaattataacccaaaattatttttgtgcttaaaaaataaatgatgtctccacgatggcacgcatatacttatgtaacaaacctgcacattctgcacatgtatcccggaacttaaaaaaattttttttccataact

SEQ ID NO: 267370 - DNA, 436 bp, Homo sapiens
cccaccgccatgggacctcactcactcatcccctctgggacccacccaccaccatgggacctcattcactcacaccctatgggacctgcccaccgccatgggaactcactcacaccctatgggacccgcttaccaccatgggacccgcttaccaccatgggacctcacgccctatgggacctgcttaccaccatgggacccgcttatcactcacgccctatgggacccgcccaccgccatgggacctcactcacgccctatgggacccgcccaccgccatgggacctcactcacgccctatgggacccgcccaccgccatgggacctcactcacgccctatgggacccgtccactgccatgggacctcactcactcatcccctgtgggacccactcactgccatgggacctcagtcactcacagctcttctttctg

SEQ ID NO: 267371 - DNA, 505 bp, Homo sapiens
ttggtcttgaaataagctcacaaatcaaggggaaaagcccagccaagtacagaacaataaccaaatacattacaatccagagctaccttgagaggaggaaataagaagcacatggcccttgcaggaaatgaggtcagagtcctgctttgggaggtgggcatcactgcggcatccgcagggtgcaggtcagtgggcaggcgcccctgctggaaggttcttgctgtctgtaaactgataagggtggaacccgctggaagggcagaacctgagtcacgttctttctgtttcttttactgttataaggcaacttggtgccttccaaccaaaaaagtccccctctctgatatctcaactgcctgtcttgaaagtgaaccttttggcaggagtttttatgggatttctcagttgttatttctctcctcccactgttttgggagaagtgtttttttttgttgttgttgttttaattaaaaataactggtgtttactgagcaaatcgtgtttg

SEQ ID NO: 267372 - DNA, 420 bp, Homo sapiens
ttcccgagctcctactcgccaaattatccttaaaaactccgatccctgttttgggggagacttgcttgttccccgactgtagcattgaccacagtgttgggaaatgcctccagcttccattgtgtcaactccttgagaagaaaaagaaatccctttcatctcagcaagctaagctcagcaccaaaaaagattacattgctaacacaacatcaagaaaaaagagctcaaaactctgcaaggcgtagagtctaaactgcaaaatatttgcaggcatcttttcagattattttaccttgtctaaggtctctcacctggtttcttcatcagtggttgatatttacttgcttagcattcagcttcacaagaaggtatttggaaacaactgcctttgtaaattatccccataggtaaaacaaagaa

SEQ ID NO: 267373 - DNA, 486 bp, Homo sapiens
tctttgtgcctaaggccccaaattaataatatccaagatttctagaagtatgttaaacgaagtttttgtttttacttatattgtctactataaaacttttaaaagtaaaatttaaaaacttgggtctgaaaaataacttcctactttaagatgagtggaaaaggcagttttctgcatgggcttaacttcttttgtgtcaaatgctcactttaagcctttcagtattcacaagtggtgcataaataatagtaaagttatcaaccacactctgaatgtgatttttccttttgaaggtgcttacctttatagggcacataaccatataatgttccaacagtagtttctggttcctctttctcagaatactgggttaaatatagtcacttcagtctgatgcttgtgatgtaaccgtttagacttgcctagggtaggtcattggactactaagtattaatcatcgcaagacagtgagctggaaagaaaaaa

SEQ ID NO: 267374 - DNA, 501 bp, Homo sapiens
ttggtaggttttttttaatcactgacttaatttcagaacccattattggtctgttcaggatttcaatttcttcctggcttaatgtcaggaggttaaataatcttgggtggagaaatagataaattccttgtttcgagggatttatatatttcttctaggttttctagtttgtctgcagagaggtggttttttgtacttctatgtagttggttgtatttcaactttgtcattcctgaatttattaagcatatgaaaataataaactataaaggaataaagaaaatagatttagaagaaaagaaagtgttcaaggaaattaaaaagcatattgaatcataattttatactttaaattgttttatctgtgaatataacattttacatatactatacatgaagataaacagatacttcgtgcagttggtaaccgaaagatagccagagtggctatgttaatgtgagacaaagtgagtttatgacaaaaatttttataagtaaaaa

SEQ ID NO: 267375 - DNA, 498 bp, Homo sapiens
tatttcctgaccttgttgtcatgtttagaaagccatactctaagaaaactaagtacttccactattttcttctagttctttagggccatttcctccttcattacatttattattcatttttaaaaattaaatattaaatatattttagtgataatttctgaataattgggatgttgatcttagtctaggatgttaaaagatagaaagtccatcttaagttatgatgtagaaaggtggagggagtattgctcccatccttactataacaaagagccagtcatctgcaaaatcatgttttcttgaaacaattacagagctaaggttgtagggcaaacagttaggctgatatttaaggaaaaacaggcccctccaatgaaaagcttgctgattcatggcaatcactggacactgtgaaatctggtaaaaataattcagctgaccaggggcagtggcttacgcctataatcccagcactttgggaggccgaggcaggtggat

SEQ ID NO: 267376 - DNA, 727 bp, Homo sapiens
gtaggttcccctcctttctccccctgagttcagttaacttatttttatcctgtagctctaactctggactcaatctttttttttcttttttaagagacaagctcttgctgtgtcccccaggttggacagtagtggtgcaatcatagctcaatagagcctcagactcttggcctgaagcaatcctcttgcctcagccttctgagtcactggaattataggcataagccagtgtgcccagctcgggaatcattctttatctcagtcatgtccaggctcctgtttgaacatagacctcatatactttagacttgacttctgatacctatccctgcagactctgtctcaagttcattattagtttcttgtgaagaacaccatatttggatgtttgtggctttgggtatgattctctcagtcttccaaactgtaaagctgggtttggtagtgttgtgaagtggccttagaatgtaacagatatgcagaatctggaaaacaaaatcacaaggcctgttaggaaagagcagtgattatatggagttgttagctcgatttgagttagtcaaatcaaatagtaattctacatacacatccttacatttattttgtgttaaaataatttttatatatacaatctcattttattcttatagcactgctgcagaataggcattattatcctcatgtatcagtcaaggtataacaagagaaacaagcagaaagatggatg

SEQ ID NO: 267377 - DNA, 282 bp, Homo sapiens
caagctgcacattgtcaggtcgaaacagcttgctattgattattccttcagtctgagaggaactgagttcatagaaaacttgaacgaaatgaaatgtataccctaaggggtaatgatttcagacaaacaaacgtaacaaacatctacttgttagaaccaatactttgcactttaaaatgtggttaagcctttaaggtaagaggtttcttttttctcttgcctctttagccttacagaaaggcacatcaagggtaggaatgatcttcaaagtgcctcacagaa

SEQ ID NO: 267378 - DNA, 499 bp, Homo sapiens
tgagtagcatctgctccagtaagcaaatgagcacatcctgattctccctgcaggtgcctgtctcgtctctctctctcctaatagtttgaaaaaaagatactaattttctgttttcccagctatgttcttgtaaggatgttagcgttgcttttatcagctctctacatctctaagctaagatctaaagctacgctgtatgattgtaattttttgtaatttagtgagatagactgtcctttttttttaatgtgcaaaggaaaccagagagttatgttatgcagaggttatcctatatatgtcagtcaggttggttaattatgtcttttcaatcttctatatcagtggtcagaaaactttctgtaaatgtcagatagtagcctttgtgagagatacagtctctgttgcatctaccaaactctgcagctgtagtgttaagcagccatagataatacataaacaaatgaatgtggctgtgttccaagaaaactttatttacaaa

SEQ ID NO: 267379 - DNA, 361 bp, Homo sapiens
tcctgagacagagtcttgctctgttgcccaggctggagtgcagtggtgagatctcggctcactgcaagctccgcctcccaggttcacgccattctcctgcctcagcctcccgagtagctgggactataggcacccgccaccacccccatggcccagcacagtctggcaccctctacagtaatccccaaagcatccccataggagatagagccaggctcctccttccacccagcctgtgagtggggctgtgcctgtttgcagggctcaggctgtgggctagccctggatgggactcctctcttgcagcaccagcctagagtggccttcatttgcagtctgaggctctgtggccctccctgct

SEQ ID NO: 267380 - DNA, 522 bp, Homo sapiens
aaaacccacgttttcttagactatcctacatttgcttcactggaagctgcatgaaagctgagattatgcttgtaatatctctagcacgtggcaggcatgaagtaaagacctggaacagagtctagtatagctctccagagctgcagctctgagtcagactggtcagtacatatctcagccctgccaagcttcctagcctccctgtgccttggcatcctctcatagaagagggagataaggatcctgcaggggctgccggccagaactgctcagagtgggctgccccattacttgttgaccctcacccggagcagacgagggcagggctgggaaggatggggagggacatagaggattcggttcctcccccaccttgtttcttgagtgtttcctaatcacttgatgggtggtaccacctagaattcttccagcagcctgtaatgggagggctacaggttagccctggaacctgcaatcaaaccacctttgaatctgtgtgtcattaaaagtagatataaatgg

SEQ ID NO: 267381 - DNA, 263 bp, Homo sapiens
atggtattaccctgccaccttctggccaggttaacagttgcagccccgggaagggattactagagattgtagttcttaggcctgcatttgtattcaaaaagacagaaacaggaaaaatatcatttttttgtttgtttgtttgttttcctttgcaaagcaggaactttgaatatgttagatatgattgtaaagagcacaagatgtttcccttgttggcagatgatcactgttggtctgaggaggatgatctgttccagagctag

SEQ ID NO: 267382 - DNA, 628 bp, Homo sapiens
taaagtagctgggcatgcctgtagtttcagcttctctggacgctgaggcaggaggattgcttcagcccggaaagtcaagcctacagtgagctctgatcatgccactgcactccagcctgggcaacagagtaagactttgtctcaaataaataattaggtaaataaataaatttaaacaggtggtcctccctgagtttgtttaacagctcagttgtgtcatcaagaactcaggcttcttaaaacatctccccttcccccaccattttgttggcttttcttatttgagcttgtcacctcgtggtcccaaaatggccgctgctttctcagtcatcacatcctcataatgtctcatccacaagcatacgagggagtctcataggagtacaggaagagcaatgttactagtgtttttagttcaaatagctttttatatgatttgttatgtgaactatagattacaccaaaaagcagtaaagctaattttgaaaacacataaaatacagaaaagaataaaaactcatttagaatctcaaagctgggtaggcagcaggcaaacggaggcaggaatgtgagagtttttttctacattccctattgtggcatatgtgcattctgatgcaaaacctga

SEQ ID NO: 267383 - DNA, 514 bp, Homo sapiens
ccactgcacccagccagccattattctgctctctgtctctcagtttagaattgtttttagctcctacgtataatatcatagactttcccctaatttatcagagattgtaatagtgaaaaattataagcaaccaaagtatccatcaataatggataaatgaattgcagtgtacttatatgatagcctgctatctagtagttaaccagagatgaactatatttacatatatctgatttaggatttttcaacctcagtgctactgacattttggatctgataatttattgtgagggactggcttgcacttcataggacatttaacagcatccctggcctctatccagtaaatatcaatagcacttctccctcatcccccaatcatgacaaccaaaaatgtctccagacattgccagaggtacctgggcggcaaaatcgtccctggttgggaaccactgatctaaatgggaaccactgatctaaatgaatagatttcaaaaacataatgcagtgaaaa

SEQ ID NO: 267384 - DNA, 693 bp, Homo sapiens
tgagatagtgtctcactctgtcacccaggctggagtacagtgggccaagattgcaccactgcactccagcctgggcgacagagcaagacttgggctcaaaaaaaaaaaaaaaaaattcaatggcctttgtgcaaggttgtgggttttgtggtcttttgtgatagtttttgttatcgggcatatggaccctctcttcatggccttccctagctctatttgttagggttttcttaacattagtcactctgttttgattctgacaactttcactttcaacatgaattttggaggggatgccatcttttaaatcatcgtacctggtaaaagggactttggagatgggattaagtgaagggccttcagatggggggttatcctgcgctatccaggtaggtcccatataatcacgatcatgagagggaggtaggagcttcacagttggacagaagatgtgaccacagaagcaggggtcagaggagggaagatgctggctttgaaggcagaggaaggggccacaagccaaggaatgtggagacccctagaagctggaaaaggcagggacagattctcccctaccctagagcctccagaaggagccagccctgccaacaccttgactttacctcagtgagataatttagacttctgacctcagaactgtaagagaataaatgcttgtgtttcgaccactga

SEQ ID NO: 267385 - DNA, 586 bp, Homo sapiens
ccaatctattttcttaactgctattccaaatgttaaattcatatttaaaagatagattgtttatacactaatagtgatagagaagtatggaaaaaaatgcagaaatttaaaagtctgtagttcataccatccctgcccctaacttcaatctgacttgttgaaacaacacattttatgggttgatgttttacttacactttcacattttttgactttttattaagtatagataaaaagacttataagaaccttataagaaattcttgtaattcttataaggttcttagaagtctttttatcatctttatcttttaagtcttcccccgcaacttagggggatatggatgtctatgaaagcatatataattcataaataggaatatgggctcctagaataagtaatatttaattattagtgaaaagcaccattttgagaggttttttgtgtttgtttgagactgagtctcgctcttctactgcccatgctggagtgcagtggcgtgatctccactcactgcagcctccacctcctaggtttaagcaattctcagcctcctgagtggctgaaattacaggcgtgtgccac

SEQ ID NO: 267386 - DNA, 613 bp, Homo sapiens
tctccttgttggaatagaaggtattgatgataagagacatgagttgggcaatttctgcctgaaaggcaaaagtctccacctccttctctccaaggtgcacttcctcaggcatcttgaaaagaaaaggcttacacgtattaaagagcaaggtaggctggctctccaacacacaggcagcacaaacgctgtgccggagtgactccagagccgttctgtgactttttcaacttccaggtcctccaaaagctggggagaatctgagagctggagggagctctctctagttctttcctcctcgtctcttctaaggattttgttagcatctatctccctttttatgtgaaatacctggagtgtatttttctttttttttattttttattttatttttattttttagttattattattattattatactttaagttttagggtacatgtgcacaatgtgcaggtttgttacatatgtatacatgtgccatgttggtgtgctgcacccattaactcgtcatttagcattaggtatatctcctaatgctatccctcccccctcccatttgtgcccatcctgttgtgaccaaccccgttttaaacatgtttcaatagatccag

SEQ ID NO: 267387 - DNA, 615 bp, Homo sapiens
gggcatatgctaagtgggcagcatggagggcaggcaggcttggtaccccagcagagctcacagccagtgctatcacagaagcccatgggcaccatgccaccttccatgtgcatgaagccgcagcaattggcaatgcagcagcagctggcaaacagcttcttcccagatacagaagaggaaacagaagtggaggttaagtaacttgtccaagattacacagcagctagcagagctagatctgaagtctggtcggtactcctcttaactgtttactgcctcaggattccaggagagggagtttgggttagtccttaagaaagtgggagctctggccaggtgctgtggctcacgcctttaatcccagcactttgggaggctgaggcgggtggatcacctgaggtcaggagttccagaccagcctggccaacatggtgaaacctcgtttctactaaaaatacaaaaattagctgggcttggtggtgggcacctgtaatcacagctactcggcaggctgaggcaggagaatcgcttgaacccaggaagcagaggttgcagtgagcctaaattgcaccattgcactccagcctgggtgacaagagcaagactctgtcttta

SEQ ID NO: 267388 - DNA, 462 bp, Homo sapiens
ttggttgaaagaaaatgtatttgtggaagaaaaaagaaccttctgggagattctgaagtctagtggttgggtgacgaggctgaggcaggagaatggcttgaacctgggaggcagagcttgcagtgagttattgttattgctgtcataacgatgagcacttcacaacagctgtcaccacccgatgcagcagcaattgcatggaatcataacttaaaaaattaacaaccagatttctgaagttagagttcttagtttcaaatcttgtctgcatcaaaattgctctgtgactttgggaaagtttaaccactgatttctaccttgaagaaaaaaatgagtataataatatctatctcgtaaaatggtggtgaagatcacatgggataatgcaaatgaagtttgtatcttattgcctgatacataaagtatattcaataaatatttgccattatgattaccattaaa

SEQ ID NO: 267389 - DNA, 433 bp, Homo sapiens
taatttacagtgatcactatctgatacttgtcttgcatatttatttttgtgtttgtcttttgtatgtcttctcctgctccactagaagtaagcaccattcagaacagaagccttgcctgtattttcattgatattacttgaaccttgaagtaaacaatgatgttctgcagatggagggagcatgggagaacattggaggaattgaaagaaagctggtgtggctgaaagtagataagagtgagtgacagagctcaactagggagatattacaatggtgagtgatggtaacagcatgacttagttgggtagcagtggagatggggaaagtggatggaccaaagaaatatttaggggtgccgggcaccctggctcatgcctgtaatcccagcactttgggaggccgaggcgggaggatcacgaggtcaggagatca

SEQ ID NO: 267390 - DNA, 307 bp, Homo sapiens
ctcatattaaatacattttaatttaatatgcaaatgttctcatccttctctgtgtaggtaaacctctctccttatggttagttgtgaaattttggtatagtaatatgaaagaaaacatgtccacaaatatattcattttattttcaattgcattgtccttttggcagttggctacagaagtatcttgtttaagaaacactagtcaaaacttttttactgactggggcaattttattaaaaaacactttagttatctgtgataatgtttcacaaacaccaagaaaagttatattgaaattagagctac

SEQ ID NO: 267391 - DNA, 593 bp, Homo sapiens
tactactacagtcaacttaaatagtggacaattagctacagagacaagattttaagtgataaattttgattttcacccttaagaaaataattcattcttcacatatatgcattagtgcacgtcaaaattttacaaaacatagaaagccaaattagtgtcgacaggattgttgataatcaataaagggcttaatagaatacaaaatataatttgaaaaattttttttgcatgttacatttttggagatctagagatagtcacatgttatattaataagtagactccgtggtgaaatgtggggggctgcagtgttggtgggggtggagggggcttgtggtggatgggggggggcggtggggtgtctcgcctcgcgactcttttccttctatgtccctttccctcacctcctttacccgtccgcgcttgatctgtatagttttgttttgtcacgttgtgttctgaatccccccttctcctaccactcgttatcgtcgtctctctgttgttcacccccctctttttttctctcgtcctcctctcgtcttactgttgtatcttcagtctatcttacctcgtacttctaccgtttcgcc

SEQ ID NO: 267392 - DNA, 473 bp, Homo sapiens
agtgggtttcaagaccaatggtgacagtgacatcaataactcaagtttcgatcaatctctcaaaactgataaaatgaccaaaaagggggaattgttaaagcgaactaaatatggcctgagaaggactccgtacttctgtattggagtccctgtgaacaaactgagcctaacttaataggtagacaagattgaaaacctaaattaggagtatgtacctgtcacaattgctgagtctcggccagtcccagcagccgtacttcaatcactcatacactgctgaatgttcaaactgtgtgtaaataaggcaaatgccaacctgtaactaatccaggtgtttctctacctcacttccctttttttgtctataaatcttccaccacgtggctgcactggagtctctctgaatctgctgtaattctgggggctgcccgatgtgcaaatcattcattgctcaattaaactcctttaaattt

SEQ ID NO: 267393 - DNA, 649 bp, Homo sapiens
ccctatattctcaccacctacgtgatattccaaaatactatataacatgcataccatgcccaattatatatactggatttcagtgatatgaggttaagaaatatccagaccatatataatatataatatgttgttttaaaaaatacagggcacatatttgtatagctaaagatatgattacataagtatagagaaggtttgggagaatacataccgacttactaaaatcaattcatgaagtaataagggaaaaaaggaaattaggcagcgcaggagtaagtgttcttagcactttcagaaataactgaaagtcatttaaataaaaaaaattcaggttgggcatactggctcacccctgtaatcccagcactttgggaggctgagatgggtgaatcacatgaggtcaggagttcaagattggcctggctaacatggaaactctgtctctacaaaaacacaaaaattaaccgggcatggtggcgggtgcttgtaatcccagctacttgggaggctgaggcaggggaattgcttgaacccaggagatagaggttgcagtgaaccaagatcctgcactgcactccagcctgggcaacaagagtgaaactccatctcaaaaaatacataagtaaataaaattaaaaacaaaatt

SEQ ID NO: 267394 - DNA, 492 bp, Homo sapiens
aatcagttgtgtttattctcaaacttatttatgctacttatttctaattttgtaatttaaaaaatttaattatcacataaataagttaaatgtaactgtttaaaagctatgatctacatgaaaatcaaatttaatgttttggaaagtactgaaaattactttaaaatcgctttcagataaactacaggtaaggaaacagaaaatattgggaaaaatcaggaaaacctaaatggattctgctttggattgctttatttatggcttttagttcttaattcacataaataaaataaaacaactggcgtttattgaggatacgttatggatttgtttgtgtcggccctacatttgaagtttggcaaatgaataggtatatagcttaagttaaactaatatgttatgatatgtgtgtatctttttattatttcagttttaacctacttctttgattaaacaagtaattgttggtaccaatcttataagaagtctttt

SEQ ID NO: 267395 - DNA, 470 bp, Homo sapiens
taattgcaacactattcacaatagtaaaaacagaattaaaccagttacccatgaatcttttattggttaagaaaaaatgatgtacttatacaacctccaatactatgcagcaacagaagagcatgaagtaacatcttttgcagcaacatgaatgcagcagaaggccattctaagcaaattaatgcatcagaaaaacaaatgccacatgttctcactcatacatggacgctaaaaattgggtgcacatggaaacaaagatgaaaacaagaaacactgggaattctaaagagaaggaggaaggaagggagacaagcattgaaaatctggttaggtatgatgtatactacttgggcaatggaataattaagtgtccaaacctcaacatcatatagtatacatgttttacaaatctgcacatgtaccccttagatataaaataaaaacaaaatgtttttggtataatgaaatgt

SEQ ID NO: 267396 - DNA, 825 bp, Homo sapiens
agaaaagctggaatgccgttaaaacaacaccctgtcatctttcaatcagtccttagctgaagttaaaatcccactcattctgcatgatccagcctctgtagcatagagtgagtagccccttaacaagaaccaaaatggagggtacggatgaggctcagatcgtcaccacctggagaatagagacagtgactgagtcaccaggaaatctgtcccctgctcatcccagaatccccgagctttgactttttaagagaacatgtgacagataatgccatctgagaaggattgcctcctttactgtatgttttccactgagatgaagattttggtcatttcctcattcatgttcctgcttttcaaaacccaagcaagaaaggaaacttctacagtgactttctcattatgaaatcttagcattcactagtcggccataatggaaaaccagccaaatggacacatatacactggtctgtacccgcagagaaagaaatgcaaatctctgtgatcagaaaactatcctatcttgtacattgttaaaagtctgcctccaaaaagtttacttctggaatactgtaattgaatagaatcagggatcctacctgtgtccttcaactttcacatcttgtctactcaagtaagggttgaatttgcatgactatatctaaggttcgagggcttacctgttggcagtagacccagtagtctatgaatggaaatgggcaaacctgtgacctcccaaaactttaatatgaaagttttgtttgtgtatactcatggcattattcttttaataaagagataatctatatagttttcttttttaaa

SEQ ID NO: 267397 - DNA, 497 bp, Homo sapiens
agaaaagctggaatgccgttaaaacaacaccctgtcatctttcaatcagtccttagctgaagttaaaatcccactcattctgcatgatccagcctctgtagcatagagtgagtagccccttaacaagaaccaaaatggagggtacggatgaggctcagatcgtcaccacctggagaatagagacagtgactgagtcaccaggaaatctgtcccctgctcatcccagaatccccgagctttgactttttaagagaacatgtgacagataatgccatctgagaagcttaggcaactcagtcatcaatgtgtcctcgagaagagcatatccccaaattggaaaataatccttcagggcatctgaacataaccacatttggcttactttgtgaagcagttgtctgaatagaataagactggcttggaacgagattcacagagcaaccaaataaagatgattgagtgaatggctaaagaaataaatatgttcgaatctgtac

SEQ ID NO: 267398 - DNA, 434 bp, Homo sapiens
ggatttctgggacagatgaaggatttttcttaccggtgaaaagaacaactaatttctggcattgttctgaaacactgcagctctcttcagcgtagtgtctgtattgagcagccagctgaagtccagtttctcatccctcaggccttctcctcttcagatggactgcagggggccacgagactccagtggcagccgctcaactctgaacacagccactgcatagagggttcagtgaagtgagtggggttgttactccccaccaagcagtgagtggctttctgctgttccactccagaggcctcacctcctgtgtttttaaactccagtttctgtctttccctgttggcaccaaacttatcttcataaaatataaatcaaatcacattatttccccatgaaatttgttgacgcctgtggctagtgggatcggtgcc

SEQ ID NO: 267399 - DNA, 533 bp, Homo sapiens
tttcaactcactacttttgttcttatgtctctttattctccagccctgttttctttagacgctgactcctgctgtctaccagatcctcgtggtacaatgactggtgtagactggcttgttgaagtcactctctggatctgagcaacgctggctgagccgtgatgaagtattcctatccatccactatgcttcacagtgggaatctctcactgttcatcaccgctgccctagcagccgcaggccttctcctcttcagatggactgcagggggccacgagactccagtggcagccgctcaactctgaacacagccactgcatagagggttcagtgaagtgagtggggttgttactccccaccaagcagtgagtggctttctgctgttccactccagaggcctcacctcctgtgtttttaaactccagtttctgtctttccctgttggcaccaaacttatcttcataaaatataaatcaaatcacattatttccccatgaaatttgttgacgcctgtggctagtgggatcggtgcc

SEQ ID NO: 267400 - DNA, 2161 bp, Homo sapiens
gcgagggaacggcgggcgggcgcggagcatgcggagcggcgccccgggcggcccccgggcttgggcgagggcttgggccaggcgcgcgggccgttggggttcggagcttcgtgggacccgcggccggcgcggggacgtacggcagtgactcggggctcaccgggggccagtgccgggccagggggccagccccgcccgcgtctcggcccggacggcccggcgaggaagctcccatgcgggaccgcgcggcccggtgagggcgcgcgcgggcgggcggggacgcagccggcaccatgtccatgctgcccaccttcggcttcacgcaggagcaagtggcgtgcgtgtgcgaggtgctgcagcagggcggcaacatcgagcggctgggccgcttcctgtggtcgctgcccgcctgcgagcaccttcacaagaatgaaagcgtgctcaaggccaaggccgtggtggccttccaccgcggcaacttccgcgagctctacaagatcctggagagccaccagttctcgccgcacaaccacgccaagctgcagcagctgtggctcaaggcacactacatcgaggcggagaagctgcgcggccgacccctgggcgccgtgggcaaataccgcgtgcgccgcaaattcccgctgccgcgctccatctgggacggcgaggagaccagctactgcttcaaggaaaagagtcgcagcgtgctgcgcgagtggtacgcgcacaacccctacccttcaccccgcgagaagcgtgagctggcggaggccacgggcctcaccaccacacaggtcagcaactggttcaagaaccggcggcagcgcgaccgggcggccgaggccaaggaaagggagaacaacgagaactccaattctaacagccacaacccgctgaatggcagcggcaagtcggtgttaggcagctcggaggatgagaagactccatcggggacgccagaccactcatcatccagccccgcactgctcctcagcccgccgccccctgggctgccgtccctgcacagcctgggccaccctccgggccccagcgcagtgccagtgccggtgccaggcggaggtggagcggacccactgcaacaccaccatggcctgcaggactccatcctcaaccccatgtcagccaacctcgtggacctgggctcctagaacccatttgccttgatgagcttgccttttgtgacttgacactggggacgtggagtggcggtgtccaggggcgccccgcccctgcggccccaccaggtactgaaagacccgcaggctgagcgggtagaacagccgggtagggcagatagctgtctatgttggttcttgtttgggatttattttcaacaagttacttttaggatccttttggggctggagactgagtcttgaaccacagaagggaataaattatacaccactgtcattctctctctccctctgtctcttccttttaccctctcttgtcttgccttttccccctttcctcttcctttcccttccttctcttttcttttttctgctttctgtctttctccctctccttgtattgctttccttctagatttctagcttgccaccgttcattctctccttctgtctctccctttctctctccttctctgtttctcctctcttctctcctgccagtctcttgtactctgtgtcctggtccctccgtatgtacccctgtctttctcctcctgactggtggtctatctgcccctacctctggccctcgctttaccggagtagggggtgggagagggaagaggagagaaaagacagggactttgaacctaggccatctcctgaggccttttccctcgcccatgtgggtcagtgggagctgcaggtgtcagcttttcgtctagtaacttaagtgagagagaaagggcagcgccacagaagcccctaaacgccgcctcgtcatacgcccctcctccttctctcttggcgaggccccgccacaccgcgctcttcctcccgggactgtgactacagcgctcccggctgagcgcgccccccgagccgccgacttgccgtctccccgtaatgccctcatgtgaatgttcttcgggaaatatttctgcttttattttataataaaattagaaatcataaatatataaatggttatatgccacaaggcc

SEQ ID NO: 267401 - DNA, 396 bp, Homo sapiens
caggtcatatctattatatttaaaattcaaggagagactacattagagatgctattagatcaacttctaatttcaaagatttctaagatatggaacagttactccttatacaaattaaaaaagcaaatgctgaagaaattcagctacatggatacaccatgaggtggaaagatgctccataactcttagttaaactgcactaattacacataaaaggaaaatgtttcatttcactgtaatttggaaaccaaagaaagaaaagactgaatttttacatactgttaaagagattgcgtatctgttctaagtttaagacagaggcaaaatgtattttattcatttgtcctgcaccgtttagaaataaaattcaacttccttttaattttttttaagaat

SEQ ID NO: 267402 - DNA, 276 bp, Homo sapiens
aacaatggaaaacttttcaaaagaatttgaagaaaacacacaacatttgttagatcatctctctattgtttacgtagctacagatgaatctgagacctcagatgattcagcagtaaatatgtatatattacattcaggaaacagccttatatggatacaggatatacgccatttctcacagagagatgctctgtctctgcagtttgaaccagtactactacctacttctacaacaaactttacaaaaattgcttcttttacctgcaaaggtacaga

SEQ ID NO: 267403 - DNA, 655 bp, Homo sapiens
gctgatcctatgtggattgcattgggctttcctgaaatattccattcctataacccatatcccaggctccatccttagcctatgatccagcctcaacagagtggcatgttcaagactgctctgtggtgtttctgctctcacagtaaaagcccacactctcttagccaaagcccctcatggcctgcccttccaccttttccctccctctgcactatgccccgcttcttcccctcccttccagcattctccccaaccccaaaacttagaatagaacctggcacaaaatatcaatatttgttgaacaaaggattcaaatgagttaaatgatttaaaaaaggaaattaaaaactactgctatatggaataaggagccattaaaatctcctaagattttttttttttttggaagcatgtgaggagtatatttttgggagtatgtcctttttgggaatatgtgaggtcagctctctaaatatacatttattctagagtgttacagacttttaaaaaaatttttatttatttattttttttaaagaatgcattcctttgttcatgagggccatcctcccttccggcccctattgctccttgccttacctcccttgctcgacctctttgactgcggcacaccgtccgcgcccccttcggcccg

SEQ ID NO: 267404 - DNA, 411 bp, Homo sapiens
gggccctccatagcaggtctaagaccaaggaagtgagttgggcttcctcaaggcaattcacaatccagagggttgcagccagcctgaggtcaaactaacccaattttcctcctatcctctgaagccgtagggaaagaaggccctgacccatgcagtcaagagaggtcaacatcctaagcagagaacaaaggtggaaaagggtggagggtgaatgtggagaggccagtgatggatatgtggcatgcagatgaaagttcgtctgtgttgaaattcttgtttctcatagatgacgggttgatgggtgcagcaaaccaccatggcacgtgtatacctatggaacaaacctgcatattctgcatgtgtaccccagaacttaaagtataataaaaatatttttaaaaaagaaattca

SEQ ID NO: 267405 - DNA, 391 bp, Homo sapiens
ctgattgtaagattttaaacttttatgtaataaacaaaggtataagcctaacctggcatgagggattttctgtgatctcacccacagtaaaagtcaaagtccttaatataacctaagacatcttacctgatattgtccatatctcctttttccttacccctttaactctctggcctcaaattttcctactgttttcctccctttttctactctagctgttgtttcttcagtaagctggacataggcatgtttccaattggggtttttgtatcctttgccaagaacgcgtttctccagatggctccatggctcccttccttccttcttttagcttattaattgaaacccatttttttcagacatcttccctcttcatcctccctaaaaatgg

SEQ ID NO: 267406 - DNA, 394 bp, Homo sapiens
tgttctttttctccatccagtcttttctgcttttttaactatattaataacaatgtttatattcaatgtatatattttcctcaaagagtacatatgtagtatattttctgaatctttgcatatctaaaattgtgcttttccctcacatatgggagcttttctggatgtgaaattaatcttgggttacctcagaactctatataaatgttactccattgtcttctcgtgtttagagttgtgaataaaatgtctgattaatattggtgtctgggccgggcgtggtggctcacggctgtaatctgagcactttgggaggctgagacgggcagatcacgaggtcaggagatcgagaccatcctggctaacacagtgaaaccccgtctctactaaaaat

SEQ ID NO: 267407 - DNA, 352 bp, Homo sapiens
aaatacttcctacaggagtctttagttttgaagttataaaaaaaaattatcagaggaaatatgactaatgtatatgcttggttgagctgcattttcttactgtttctatacttagtattttaacaggatgtgattgataggaatttaacattctaattctttaagacaatcatgaagttctgatagtttcttagaaatggaaattgtgtcattatattttgttgttttattgttgtgcattttaacaaaagaggtgacttcacatgtaccctaaaacttaaagtataataataacaaacaaaacaaaacacatgtaccctaaaacttaaagtataataatacaaaaaaaaga

SEQ ID NO: 267408 - DNA, 414 bp, Homo sapiens
gacaccttgggcatttctgtgtcattatgtgttggcgatgggaggcgtgtgggtgggggtgttaaggatatctgcctcaattccacaacccattttataagtgtaagaaaagaagggtagagggtgtttttttctggttttgtataaatgtgagaaacctgaaggcagagatgacagacccccgacaaggcagtaaattacatgctggatgtgtgtttgtaacacaagtcacattaatgaagatgaatgccacttcaggttcaccccagcagaattacctcatgtgacagggaaagtataatcctacctcataaaactctggacaccatgtactctatgactaagctgacttgtgaatttcacaggcactagggtcgtatttagattggatcaagctcaaaaaagggcacccag

SEQ ID NO: 267409 - DNA, 256 bp, Homo sapiens
ggtgaggggcactgggaaatggtgaggggcactgggaaatggtgaagggcactgggaaatggtgaggggcactggggaatggtgaggggcactgggaaatggtgagaggcactggggaatggtgagaggcactgggaaatggtgaggggcactgggaaatggtgaggggcactggggaatggtgaggggcactggggaatggtgaggggcactgggaaatggtgagaggcactgggaaatggtgagaggcactggg

SEQ ID NO: 267410 - DNA, 538 bp, Homo sapiens
atttttggtttctctttggggcctttcccataggcactcttcactgtccttgccttttctcctgagtctgtttttctttctccctcctaaccagcttctggctcctcaagctgctgttcctgttaggtctctgtgctattgccttctgcattcctgatgagcatctcttcccaggtactctccctcccacactcttggcaggagtaggctaagttttctaagataacaagtgggtaagaagaggagtaatggccgggtgcagtggctcacgcctgtaatcccagcactttgggaggctgaggcgggcggatcacgaggtcaagagatcaagacaatcctggctaacatggtgaaaccccatctctactaaaaatacaaaatattagccgggcatggtggcacgcacctgtaatcccagctgctcaggaggtggaggcagaagaatcacttgaacccgggaggcagaggttgcagtgagctgaaatcacaccactgcactctagcctgggtgacagagcaagactctgtctcaaaaaaa

SEQ ID NO: 267411 - DNA, 362 bp, Homo sapiens
tgagacagtctagctctgttgtccaggctagagtgcagtggcgcgatctcggctcactgcaacctccgcctcccaggttcaagcaattctcttgcttcagcttcctgagtaactgggactacgggtgcgcatcagcacgcctggctaatttttgtatttttagtagaaacggggtttcatcatgttggtcaggctggtctaaaactcctgacctcaggtgatccacccgccttggacctcccaaagtgctgggattacaggcatgagccactgcgccccgcctataatttttaacttatttaatactttctatatgccagggactgtttaaagaggatacagatattaacttacatcctcac

SEQ ID NO: 267412 - DNA, 479 bp, Homo sapiens
agcattttcatctgctttggtttcagccagagataaactgttcctgctgcaaagtaattaatatcagtcgcctggaaagcagaaattgggagacaacaggctcctctttcttgataaacagattgttgggtttcctttgggaggggaaggaataaccttgaagagagcccttgacctgatctatgtagagggttggaaaattcacagcaatacaaagctatggaaacagactgtcatccacatatatgttgggtgatgggggagacatgaagagtgagagactgtggagacaggaaagtagcaacatttgccatgagattttcctcgaaaccatctccttcttgaatttagacactcattgtttatgtgcagtggccctaggtacagaagggtcaccaccccaaggagaactataccctccggactcataaaccaaattctagccagattctcccggaataaaatactacagttcatcc

SEQ ID NO: 267413 - DNA, 265 bp, Homo sapiens
agcattttcatctgctttggtttcagccagagataaactgttcctgctgcaaagtaattaatatcagtcgcctggaaagcagaaattgggagacaacaggctcctctttcttgataaacagattgttgggtaaggtatgcacatggatgtgacaattcatttggccatagaaatagcagaaatgagacgtttttagacagatatttggaaggcatgagcaaatatccccaggcttcatccatttgagctcagatgagtcttttgc

SEQ ID NO: 267414 - DNA, 496 bp, Homo sapiens
tctgtctgggctatgataaagccttagaagagaagatttcaggtaatcaaggccctgcaggggctttggtacctgagaggctgccttcctgaagggcatccaaagtctgcaagccactgcccctttcacactgctcatgggcatcgaggagacccaacatactgagatgtgagtgggagacatttctatcccagctgctgcttctgtggactgtgagtcctctcttcccgacatggaaattaccaagctaagtcctgggtgataggactgagggccggaaaaccagaaaatagcagcaagccaccaagtgatccagatggtggagatgagcgttttaaagtaggcagagccgggcatggtggcagcacctgtggtcccagctacccgggaggctgaggcaggaggattatttgagctggggaggtggaggctgcagtgagccgtgattgtgccaccgcatccggcctgggtaactgagcaagtctcaaaaaaaaaa

SEQ ID NO: 267415 - DNA, 1398 bp, Homo sapiens
agaaaagaaacctgggcttctgctggcctatgtcagttgactagtgggtgactcctggggcaagcaggaaagagcagagcggagaagcagcgagggtgctcaactctgttcactctgatgccaaaaggcccttcggcaaaatttcacaaattgtaccaccaacggatgctgattggacaggccagctggggcttcggatgttaagtgattatggtgataatgaaatatataatatgactttatttcagaggataccctggagtcaccccaccatttcagccctttccttccccagcacgctgcatggccgtggagaacagcttttccagtgcagactctaaagaaatggaaactacactttggttcattcacagattcattcaataggttctctatttaccatgtgccaggcccagcgggtgacaaggcaaataaaatacgcttgatgccaaccctcattggtgtctacagtgttaagctctgcgtgtgagtagaatagaatgcggagaggcaactgggagatgggtaagggagacttttctctgaataacattttgtatcttttgaattttgaatcatgtgaatgtatcaaaaaataagtgtaagtaaaaatatttttacaactttaaaaataggttttactggactggagcactcagaggacaacagagcggaagtggaaagcaaactaaccttttattgagcatttactgtgagctagaccttcagccaggtgctttatgtacatgatatcttttaatccacacaaccctggacaaaggcagtatcatcctcatttttatccattttaaatggaagcttgccaggtatggtggctcacacctgtagtcccagcactttgggaggccaaggcaggaagatcacttgagcccaggagtttgaaaccagcccaggcaacatagtgagaccttatctctacaaaaaagaaaaaatagccaggtacagtggctcatgcctatgatcctagcactctgggaggccaaagtgcacagatcacttgagtccaacagtttgagaccagcctggacaacatgatgaaaccccgcctttacaaaaaataacaaaaaattagccggctgtggtgttgcacgcctgtagtcccagctactagggaggctgaggtgggtggatcacttgggctcaggaggtcaaggttgcagtgagccgtgatcacaccactgcactccagcctgggcaacagagcaagaccctgcctccaaaaaaaataaaaattaaaaaaaatagcaaggcatggtggcacctacctgtcgtcgtcgtcttagctattcaggagtcttagctattcagtgggaggatcacttgagtccaggagtttgagagcagcctggacaacataacaagacctcttttttgtta

SEQ ID NO: 267416 - DNA, 1337 bp, Homo sapiens
agaaaagaaacctgggcttctgctggcctatgtcagttgactagtgggtgactcctggggcaagcaggaaagagcagagcggagaagcagcgagggtgctcaactctgttcactctgatgccaaaaggcccttcggcaaaatttcacaaattgtaccaccaacggatgctgattggacaggccagctggggcttcggatgttaagtgattatggtgataatgaaatatataatatgactttatttcagaggataccctggagtcaccccaccatttcagccctttccttccccagcacgctgcatggccgtggagaacagcttttccagtgcagactctaaagaaatggaaactacactttggttcattcacagattcattcaataggttctctatttaccatgtgccaggcccagcgggtgacaaggcaaataaaatacgcttgatgccaaccctcattggtgtctacagtgttaagctctgcgtgtgagtagaatagaatgcggagaggcaactgggagatgggtaagggagacttttctctgaataacattttgtatcttttgaattttgaatcatgtgaatgtatcaaaaaataagtgtaagtaaaaatatttttacaactttaaaaataggttttactggactggagcactcagaggacaacagagcggaagtggaaagcaaactaaccttttattgagcatttactgtgagctagaccttcagccaggtgctttatgtacatgatatcttttaatccacacaaccctggacaaaggcagtatcatcctcatttttatccattttaaatggaagcttgccaggtatggtggctcacacctgtagtcccagcactttgggaggccaaggcaggaagatcacttgagcccaggagtttgaaaccagcccaggcaacatagtgagaccttatctctacaaaaaagaaaaaatagccaggtacagtggctcatgcctatgatcctagcactctgggaggccaaagtgcacagatcacttgagtccaacagtttgagaccagcctggacaacatgatgaaaccccgcctttacaaaaaataacaaaaaattagccggctgtggtgttgcacgcctgtagtcccagctactagggaggctgaggtgggtggatcacttgggctcaggaggtcaaggttgcagtgagccgtgatcacaccactgcactccagcctgggcaacagagcaagaccctgcctccaaaaaaaataaagagtcttagctattcagtgggaggatcacttgagtccaggagtttgagagcagcctggacaacataacaagacctcttttttgtta

SEQ ID NO: 267417 - DNA, 383 bp, Homo sapiens
ataaaaagaagtgggagtaagagaaattttcagtcaacaacatgttgtacttataaaaattcaaaagaccacagaaagaatcttagaattatagttattggaagtcctagccagagcaatcaggcaagagaaggaaataaagggcatccaaattggaaaagaggaagtcaaactatccctggtttccgatgatatgactgtgtacctagaaaaccctaaagactcctccaaaagacttctgtatttgataaatgaattcagtaaagtttcagattacaaaatcagtgtacacaaaacagtggcactgctataaaacaaccagggtgagaatcaaatcaagaactcaatcccttttacaatagctgcaaaagaaaaaaaataca

SEQ ID NO: 267418 - DNA, 410 bp, Homo sapiens
cacaacactggaaccccacccccatctccatcatgcttccattcagtttcttgctgcagcagctggttaactgacagcttatctgctgtacagagccaaaactccattatgagtacatcgtaattacccatctggattgcagtaatggcagtgaagatcttggtatagctcattaattctgattttttgctttgaggaaaagagatgaagacgtggcagcaacagctctaagttgactgcttttagaatttgaccttagtggcacagagttaagaaaaatctgctcaccagagatattgacaggcttactgtgtaagcattggcctgatcgggcctggaagttttgcccctttcatctgtagggataagagggcctaagagaatagcagcaatctgagctctagagcacc

SEQ ID NO: 267419 - DNA, 734 bp, Homo sapiens
cacaattacaaccccacaaaagtaactgctagactgatttaaatggtaatcactttgttgcatttgattactgctgccacacctaaatgcatatatctatattttaatattatcaatttaaagttgttattaaatgtatattttattttacatctcttttttaatctagaagttcctccttctttccagttccttaaaatttacctggtgaagaacctgatcctaggacctatagagtttcccatactttgtattttgctgattgcacactcatggcacggttcagcacattgccctgtcctctcgatattagcacacagtgcaggttcaggcacattgaatttgagaagacttaggttcagtcctttggcaagactgtaaatcacggtgtctttctttccttcctccttcttctctctctctctctctctctctctttccttttctttctctttttttcagagttgcactctgttgcccaggctggagtacagtggctggtctcgaactcctgacctcaggtgatccacaaacctcagcctcccaaagtgctgggattacaggcgtgagctaccgcgcccagcctgaaatactctatattgggaggttaattagattctctcctatcacttaccctcagcacacatacccagattcatagcagtgtgggcccagagttgacacacctctaccagtcggtaaaatactaaaacattcatctgtaaaatgggaat

SEQ ID NO: 267420 - DNA, 927 bp, Homo sapiens
gatgccgtggcgtgctcgctttggccatccatgtccctcgtgttggacactagagctgtccccgatgtacccatactgacctggtcacgaatcgccttgagaggctggaaactcacccgcctccttccccggactagggggaagtggggtgaaggaggcgtgcagggaggaacctgggggagggggtggcccgtctcccaggctgggcgtgggccgggcgaggtccccagcccaccgggccgtgccaacaatggcctgttgtagaaggaggcgggaaggaatgcggcctggggagctgggcggcggcggggcggggcccggccaagcggctgccttttacctggccaggtagctcgcatttcccggcaagcggcggcgcccgcagcacctgttgcccggtgcgcgggcggggaggacggcgggggacatggcctggtagagtcccctggggagaccgtgctgagttcagtccggggcagggcagggcgagggagggaaggtccttccctggcgcccgcgcgggctgcggcagcatgaaaaagaagcagacggtgcagggcaccttcagcaaactcttcgggaagaagcacaccacgacccccagcacctccctctacgccaccaatccgccctggatcttcacccaggaggccccggaggaggggaccgggggcttcgatggcatctattatggagacaatcggtttaacacagtgagcgagtcaggaacagccacgctgaaagctcggccaagagtccggcccctgctgaccttccttccgctgaatgcccaggaaaaccatgggctggctgtgcccaccccctcggttccagatgattttgcagacaaagaagtgacaggtaccagctcactagtcaatggcacctccgactgtacaggtccgtggcctctatgatgtcacgcag

SEQ ID NO: 267421 - DNA, 1252 bp, Homo sapiens
gatgccgtggcgtgctcgctttggccatccatgtccctcgtgttggacactagagctgtccccgatgtacccatactgacctggtcacgaatcgccttgagaggctggaaactcacccgcctccttccccggactagggggaagtggggtgaaggaggcgtgcagggaggaacctgggggagggggtggcccgtctcccaggctgggcgtgggccgggcgaggtccccagcccaccgggccgtgccaacaatggcctgttgtagaaggaggcgggaaggaatgcggcctggggagctgggcggcggcggggcggggcccggccaagcggctgccttttacctggccaggtagctcgcatttcccggcaagcggcggcgcccgcagcacctgttgcccggtgcgcgggcggggaggacggcgggggacatggcctggtagagtcccctggggagaccgtgctgagttcagtccggggcagggcagggcgagggagggaaggtccttccctggcgcccgcgcgggctgcggcagcatgaaaaagaagcagacggtgcagggcaccttcagcaaactcttcgggaagaagcacaccacgacccccagcacctccctctacgccaccaatccgccctggatcttcacccaggaggccccggaggaggggaccgggggcttcgatggcatctattatggagacaatcggtttaacacagtgagcgagtcaggaacagccacgctgaaagctcggccaagagtccggcccctgctgaccttccttccgctgactgagtttcattcttgttgcccaggctggagtggtacaatggcgtgatctcggctccctgcaacctccacctcctgggttcaagcgattctcctgcctcagcctcccaagtagctgggattacaggtgcccaccaccatgcccggcaaattttttgtatttttagtagagacagggtttcaccattttggccaggctggtctcgaactcctgacctcaggtgatccacaaacctcagcctcccaaagtgctgggattacaggcgtgagctaccgcgcccagcctgaaatactctatattgggaggttaattagattctctcctatcacttaccctcagcacacatacccagattcatagcagtgtgggcccagagttgacacacctctaccagtcggtaaaatactaaaacattcatctgtaaaatgggaataaaaaaaaaaaacaaataaaatactgaaatacag

SEQ ID NO: 267422 - DNA, 120 bp, Homo sapiens
agacaatcggtttaacacagtgagcgagtcaggaacagccacgctgaaagctcggccaagagtccggcccctgctgaccttccttccgctggtgagtacggttctgctctgaggttggag

SEQ ID NO: 267423 - DNA, 1218 bp, Homo sapiens
gatgccgtggcgtgctcgctttggccatccatgtccctcgtgttggacactagagctgtccccgatgtacccatactgacctggtcacgaatcgccttgagaggctggaaactcacccgcctccttccccggactagggggaagtggggtgaaggaggcgtgcagggaggaacctgggggagggggtggcccgtctcccaggctgggcgtgggccgggcgaggtccccagcccaccgggccgtgccaacaatggcctgttgtagaaggaggcgggaaggaatgcggcctggggagctgggcggcggcggggcggggcccggccaagcggctgccttttacctggccaggtagctcgcatttcccggcaagcggcggcgcccgcagcacctgttgcccggtgcgcgggcggggaggacggcgggggacatggcctggtagagtcccctggggagaccgtgctgagttcagtccggggcagggcagggcgagggagggaaggtccttccctggcgcccgcgcgggctgcggcagcatgaaaaagaagcagacggtgcagggcaccttcagcaaactcttcgggaagaagcacaccacgacccccagcacctccctctacgccaccaatccgccctggatcttcacccaggaggccccggaggaggggaccgggggcttcgatggcatctattatggagacaatcggtttaacacagtgagcgagtcaggaacagccacgctgaaagctcggccaagagtccggcccctgctgaccttccttccgctgactgagtttcattcttgttgcccaggctggagtggtacaatggcgtgatctcggctccctgcaacctccacctcctgggttcaagcgattctcctgcctcagcctcccaagtagctgggattacaggtgcccaccaccatgcccggcaaattttttgtatttttagtagagacagggtttcaccattttggccaggctggtctcgaactcctgacctcaggtgatccacaaacctcagcctcccaaagtgctgggattacaggcgtgagctaccgcgcccagcctgaaatactctatattgggaggttaattagattctctcctatcacttaccctcagcacacatacccagattcatagcagtgtgggcccagagttgacacacctctaccagtcggtaaaatactaaaacattcatctgtaaaatgggaat

SEQ ID NO: 267424 - DNA, 880 bp, Homo sapiens
gatgccgtggcgtgctcgctttggccatccatgtccctcgtgttggacactagagctgtccccgatgtacccatactgacctggtcacgaatcgccttgagaggctggaaactcacccgcctccttccccggactagggggaagtggggtgaaggaggcgtgcagggaggaacctgggggagggggtggcccgtctcccaggctgggcgtgggccgggcgaggtccccagcccaccgggccgtgccaacaatggcctgttgtagaaggaggcgggaaggaatgcggcctggggagctgggcggcggcggggcggggcccggccaagcggctgccttttacctggccaggtagctcgcatttcccggcaagcggcggcgcccgcagcacctgttgcccggtgcgcgggcggggaggacggcgggggacatggcctggtagagtcccctggggagaccgtgctgagttcagtccggggcagggcagggcgagggagggaaggtccttccctggcgcccgcgcgggctgcggcagcatgaaaaagaagcagacggtgcagggcaccttcagcaaactcttcgggaagaagcacaccacgacccccagcacctccctctacgccaccaatccgccctggatcttcacccaggaggccccggaggaggggaccgggggcttcgatggcatctattatggagacaatcggtttaacacagtgagcgagtcaggaacagccacgctgaaagctcggccaagagtccggcccctgctgaccttccttccgctgactgagtttcattcttgttgcccaggctggagttgcagtgagccaagattgcaccactgcactccagcctggacgacagagcgagactccatctc

SEQ ID NO: 267425 - DNA, 228 bp, Homo sapiens
tcaatgaaatactagcaaactgagtccagctgcacatcaaaagataatacaccatgatcaaatggattgtattccagggaagcaaggatggttcaacatactcatatcaggccaggcgtggtggctcacacctgtaatcctagcactttgggaggccacggcgggaggatcacttgagctcaggagttgaagaccagcctgggcaacatagtgagaccttgtctctta

SEQ ID NO: 267426 - DNA, 863 bp, Homo sapiens
tttgtttgtttgtttgagacgttgtctcgctcagtcgcccaggctggagtgcagatggtctcgatctcctgaactcgtgatccgccctcctcagcctctcaaagtgctgggattacaggcgtgagccaccacgtccggcctcaagcatctgtatttcttttaactctcaggtaattctaacgttcaatcaagaatgagaatcagtatcctccagagctagagagtctttttaaaagcaacctttactaacatgttaataagattattaacagttgttaaggatctggctgttaacaattcactaaaatcttagccacaaaaattatcccactgataaatggaaactttaacccaaacctcactcagcttccagaaacaaaaggatttagcccaagaaagacaatagttcattatggtttatttttaaataacgttcctactcggcaatggagtttgagtctgaaattgaatggtaggttcacctttatctgtgaaacttctgtaagtacaaaaatggatatattaatctggctttccaaaatctctcaagccaaaaggttacaatattccattttagacttaacctaaaatcaaaaggaaagatttaaaataacctcgtgactttcacaaatttaactacccacagacaaaccaggagaacaaggtacagaacatgaaacatttcgaatgaagtattcttttccaactgcatgtgaaaaggcaacattgacagcatcacaaaaaccttaatttaaaactaaatgtcacataagaacaccatatacacccaaacaaacccacataccacataattcaacacatccgggcagcagtggctaaataatggactagcatgaatactg

SEQ ID NO: 267427 - DNA, 466 bp, Homo sapiens
tggcgtgtgatagtcgattcctagaggatccccattacgctagtcggcaatggagtttgagtctgaaattgaatggtaggttcacctttatctgtgaaacttctgtaagtacaaaaatggatatattaatctggctttccaaaatctctcaagccaaaaggttacaatattccattttagacttaacctaaaatcaaaaggaaagatttaaaataacctcgtgactttcacaaatttaactacccacagacaaaccaggagaacaaggtacagaacatgaaacatttcgaatgaagtattcttttccaactgcatgtgaaaaggcaacattgacagcatcacaaaaaccttaatttaaaactaaatgtcacataagaacaccatatacacccaaacaaacccacataccacataattcaacacatccgggcagcagtggctaaataatggactagcatgaatactg

SEQ ID NO: 267428 - DNA, 404 bp, Homo sapiens
cacgaggcggcacgaggcggcacttggaagattaccttcttccaggtatattggttttccttaattgctttaatagcatgagttgtgaatcttctctgtgtctcagaagaaacctaacagtggagattgtttatggcaagggtcacaaatttacatgctcaggttaggaccctctttaaggtaaagacatgaagtgcccccctttttattaatacataactgcatttgctgataatattgatttgccttaaaaaaactagtcctattgagaattcaggctctttttgcgtttacagacagtgctgtcctgaatgtgctagagatgtacctttagtcacttaagctggtgtttctgtagggtagattcctaggactgggattggattgttgcattatagtgtgta

SEQ ID NO: 267429 - DNA, 412 bp, Homo sapiens
cttttccctattttataatgattttatataatttaaataaaagtaccaagtaacatggcccttgtctaaattacacaaaaattagagctaagtggtctataaacaatggcagaaatggggatataagcttctaattaaggctctgaaataagaaaaaatttaattcagacaaacattaataggactttgaaacatattttagaatgtttctagcaatactaaaaatgaatatgcagttactagtgaactaagcggaggtttgctacacatgtggatttgttatatgtatggaaataatctattattattatatattagaatactaaaaatgccttaggactctcataactatatataatcttagtttgtaaagaacaaaagatggtggtatagtacgtcataaggtttcaaa

SEQ ID NO: 267430 - DNA, 421 bp, Homo sapiens
agattggaccactctctccaaatggctcatgtcatctatcagggtcaatgttcaatcctttcaatgtcttaagagtaccctttttgcctggctaatccccaaactccagtgacaccctatttggaggctttcgtccctttatgtaccaactacagaagaaaactagagtgggaggaataaaagacactctcccagatgagtgtcataataaataccaaagctatttttaatgggtgttaacacaatgtttgagaattagtaaagtaagcaagggctgctttaaaaagttgatctggacatgcacaggtggccctccatatccatgggttctgcatccatggaatcaaccaaccaagtgcatcacttgaggtcaggagttcgagaccagtcaggacaacatggtgaaatcctgtctctacta

SEQ ID NO: 267431 - DNA, 408 bp, Homo sapiens
ctgaggtgggaggatcgcttgagcctggaaggtcaaggctgcagtgaaccactgcacttggcctgggagacagaacaagaccaaaaaagtaaaaataataataataataataataatacaagatcctgcattataggcactaatggaatgcaataaatgcacagagaaaacagccataaatctcatgttcgagaagacacccaagaaagcatcactgagaggtagatctgaactaagaacaatcagtaggattttacaggatagaaggtaggatagaaggtaggtgggaaggggtgacatgaaggcaaagatttcaggaagaagaaaaattcataattaaaaacataaaagggccgagtgcagtggctcacacctgtatctcagcactttgcggggttacggcaggag

SEQ ID NO: 267432 - DNA, 570 bp, Homo sapiens
agctcattggagcatttcagattttggatttttggatttgggatgtttaaccagggtaaaatatagaatgcaaatattccaaaatctgaataaaattgaaatctgaaatgcttatggttccaagcattttggataagggataattaagctgtataacttataaaactgaatataacaaaatttcccaacatgtggaaaatgatgtcttttttcaaaaatgtcaatagcagatacatggtacagtaagttaggggaaaaaatgaggtttcatatcttctagtttcctaattaaaaggagcccattctgggttggaagaaagtgtcagtaagatcatttctcctatttgaaaatcatacaaagcttgtcagagtgactcaggccaggagtgtagctgggcgtgtagctaaatgatatctccccacatctatataataagctgttacctgctttaaaaggaaaagctctcagcatgactctaatgttgcatttctggaatacagcttgaaaagctcttctcagggttgaacagagcatgaaggtaatggttattatctactcacattaaaaaa

SEQ ID NO: 267433 - DNA, 222 bp, Homo sapiens
ctagacaggttgagccactgtataattgtctctgtatcaatatggttggaagaaggcacaatgctgaaaagtgccctagccttacagtggtgaagatggcgctggagcggtcagaatgacctcaattgccatagcagcggacgactggactggggatcctaaagcagtgtgctgcaggctgttctttcatggaagcatcagaaactttttaagacatcctgt

SEQ ID NO: 267434 - DNA, 414 bp, Homo sapiens
tttttgagacagagtgttgctctgttgcccaggctggagtgcagtggcatggtctcagctcactgcaacctccgcctcctgagttcaagtgattctcctgcctcagcctcccggagtagccgagatgggaggatttcttgagcctaggaggtcaaggctgcagtgagctatgattgcaccactggactcgagcttgggtgacagagcaagaccttgtctctaaaaagagaaaagaaaagaaagaaaagttctgaccatgttgtcctgaaattatgccatccaggcattcctgctggtctatcaggttcccactgggcagaagcttgagggaggggctatagaggaataaaggctccagacagaaaggtaaggaaggtcaagttcacagcagtctgccccagactatgtctggag

SEQ ID NO: 267435 - DNA, 434 bp, Homo sapiens
ccgttgctctcatcctgttgagtttaataggctctcttttttcttactgatgttttcatgatgagatttctaataagttatttgggagctatcagaatagaaactaataaatattatctatctattagctgtcagaataaaagcttactgagggtcctgaactgtgaggccactgaaggcaggggtttgggtctgatttatctgtgtttgcctagagctttaacagagcctgacacttgtaactcttaaaaatatgctttaaaataaatctaaactcaggcatggtggctcatgccagtgatcccagcactttggaaggctgaggtgggaggaaggcctgagcctaggaactcaaggtgagagtgagctatgattgtgtcactgcactccagcctgggtaacagagtggagacgctgtctctttaaaaaaaaaa

SEQ ID NO: 267436 - DNA, 538 bp, Homo sapiens
cctgtgccttctgaccccgcaaaaggtataagcttcttaacacctgcctttcagctctcttgtgcattcatggtgctgagcaagtctttgtactaagtagatgtctttattagttaggaggctttgggctgcaaatcacagtagacccaacttcacaaggcttgggacaaagagcatttatatcttacaggagtccagaggtgggaggggctcaggatggcagagcagagagctggaaagaccctcggtccttgatgtcacctgagggatacaggctgaggtgcagtgacccaaaccatcacattcacctttacacactcatagccaaaagcccaaggacaaggtgtccctgttaaagatcaaggaaaacctccagaaccgctcccagtgcatgttcctgcaggttgcatggccaaaagcacttcacctgcttgtttctacgctactggtagagaccaaacaagggccactctttgcagctcaaaagatattcagcctccctgaagcatcagactgcctggcttttggggaaaaaaaa

SEQ ID NO: 267437 - DNA, 507 bp, Homo sapiens
aggtgtgcaggtcccaagactctcccacttctctcttagtttggagtgggcattcttttaagaagtggaggaccctgtggtcactggcttccttagtggtgaatcatagggcaatcagagagcaggaatctgcaaaggggcgctgtcatgtgctgaattgtatctcctcaacatttatagattgaagccctagcctccagtatctcaggatgtgacagtatttggaggtggggcttttaaagaggtggttaagttaaaatgaagccattagagtggtccttaatccaatatgactggtctccttataagaagaaacttgtacacagaagagatacacaagggacatggaggcacagagaaaagcccatgtgaagaggcagcaaaagagtggccatgtgcaatccaagaagagaggcctcagaggaagccagccctgccaacactttgatcttgaactttcgggttccagactgtgagaaaataaatttttattgtttaagccaccca

SEQ ID NO: 267438 - DNA, 417 bp, Homo sapiens
gctgaggtgggaggattgcttgagccaaggaggtccaggctgcagtgagctgagattgcaccaccacactccagcctgggtgacaaagtgagaccctgtctcaaaagctgcaccatactgaagttactttcaactgttttaatacataaaaatatttcggctgggcacggtggttcacgcctgtgatcccagcactttgggaggccgaggtaggcggatcacatgaggtcaggagttcgagaccagcctggccaacatggggaaaccctttctctaccaaaaatacaaaaattagccgggcacagtagcgggcgcctgtagtcccagctacctgggaggctgaggcaggggaatcgcttgaacctgggaggtggagggtgcagtgagcctagatcgtgctactgcattccagcctgg

SEQ ID NO: 267439 - DNA, 426 bp, Homo sapiens
tgatcatgacttactatagcctcgacttcctggtcccctggtccctggtgattcttccatctcagcctcccaggtagctgggactgcaggcacaagccaccatgcttggctaattttctgtattttgtgttaagacagggcactgtttcccaggcttatcttgaactcctggctcaagtgacccgcctgcattggtctcccatagtgctgggattacaagtgtgacctactgtgcctggctgatattatgatttttttaaatataacgttgtataattaaaacaaagtaattaacctgcccaacatctgaaatatctgacattttttgtaatgagagtaatttgagatttactctctgagtgactgtgaaatgtacagaactcagttattagttgtatttgccatgttgtgtaataaatctcaaaa

SEQ ID NO: 267440 - DNA, 401 bp, Homo sapiens
agcttaaaaataagtcatacctaaaaagttaccaataatcccttcatatcagtcagtgttcaaattttcagttatctcataacactttttttcagcttaagatccaaagtagtccacccaatggcattggttgataggtctttttaaactagaattctctcattttcttcccttgcaatttttttgttgaaaaattagttttatagagttaatcatggtctggattttgctgatattgcatccccttggtggtgtttagaatgtgtctctgtcctctgtgtgtttcctgtatattgatacctggaactagaggattgatccaattcaggtaaatttttgttacttgtttttggctctggtttctttttctgataatcacagctgcttgtacttagtcacta

SEQ ID NO: 267441 - DNA, 346 bp, Homo sapiens
tggtatctcgtgcctcagtttcccatctgtaaatggaacacacgcgatttcagccgccgttcaacctttctaaaagctttcacatccattatctgactggtgtctcaaactgctactgaggcttcagctctgatctggaccagtgctctccaggcctactgcacagctgtcatactgaactttcctatatcctacacctggttgggattccctgtgccctggaccttgtgtctcaaacttctagattgtggatttactctgtcatctctgtgcagcacatctttctgtagattcctgagaaaggttgcaaagaagcaaatatatttagtccttgtatgtctaaata

SEQ ID NO: 267442 - DNA, 293 bp, Homo sapiens
gttgcttttgcatgaaatgtctcactgccttttctgttgtcccgtgctgtggtctgtcccggcgagactccgagggaccgcacattctggatttggggagctgaaatatggcatcctatctgcaaacggggtccctctctgtgtcagtttctaatggagagcgagctgacagtgcatggagggactctgccaagatttgcacgcccactgtcatcctttgtcggcccagagccttgtgttcagggctggggtctaagtcggagacagattccccactcagggggcttaccgtc

SEQ ID NO: 267443 - DNA, 476 bp, Homo sapiens
ttaaaaattgtagagactagagtgccctgcatgttactgtgatcacagaaatgaaacagtggatgaagtgtcttggtgacaatgatgtcgtgttattaaaaccacccacacttaaagggtatgtaccaaggtgttaatagggcttaccctgagtggtggaattacactttattttcttttttgaattttttagtgtttcccagtgaatacatgttactttcgtttacaaaggtgtagtaagcaattcaaacagaaaaagatatttcatcaaacgaagcctaacactggttcagattactgcttgcaggtgaaaatcttagatgtactaaaaggcagttttccaagcagaatatactagaaacatttattcctttttctttttgtcaatagatcttttttatcgcctgtgttcatattacattgtcaacaacatattttaaactaaataaatattcagatttatgttgattataaac

SEQ ID NO: 267444 - DNA, 277 bp, Homo sapiens
ctcaaaggagaaagctcttccagggaggtgaggaaggttttgaggacagggtgacaacttctgccagagtgactgggcccagggcctagaatgactcgattgagctgggataataggtctgtattgcctggctagacacagccaaggccctcaagcagcagggtgagggacccttgtctcctgctggccttgcctaaggttctgaggcagctgtgaagaggttgggggggtaggggctctgaagcccctatcctaccttgtgtcaattcaagcccca

SEQ ID NO: 267445 - DNA, 844 bp, Homo sapiens
aggggacatttggcaatgtctggagacatctttggttgtttcacctcggggcatgctactgatatctagtggatagaggacagggatgctgctaaacctcccctaatgcacaggacagccccacaacaaagaattttccagctcaaaatgtcagtcttaccatggttgagaaactctgccctaggtgaacatttcaaagtaactgaaaagttaatattgctgaacaggcctttataaggtagaggcagcacttactcaggtattccagtactgcaatatcgtaccatcttatggttctagtgtttcctcattagtaggtttcagactttattaaaagttcctctggtatactgaatttatattctgcttttggtccatttcaatggagtgattaatgtagtaggggataatggctaaggttggaagttggaactctgcttttaaaagaaaaaatgccctaaatttagtgatatgattaatatattgttattattatctgttgtcagttttactgtaattgcatgaatatatctgacagataaatcaaaaaaacatgatcagtttggactgacatacaggaaggacttagaaagtaatcaagataggtatttctggatgaatctctataacagcgcttcactggctttaacatgcagatgaaacacctgggaatcttaattaaaatataagctactgattccatacgtctgaggggaggtctgagagtatgcctttttatgaagcttctgggtggcaagtccagatgaagcattagatcattgcaaaaataagtatgctttaagtatcactttaaccaaaaagaagacaataatttttaaaagac

SEQ ID NO: 267446 - DNA, 113 bp, Homo sapiens
ggggatcgagtaaggagaatgagaggggccagcccacactgaagaggtcagggatggttggggatgactggaagtcactgtgaaaaagggacaaaaccgaggatccagaaggc

SEQ ID NO: 267447 - DNA, 405 bp, Homo sapiens
aaagaccatcctttcctctaattaattatcttaaaaactttgtcaaaaataaattgactacatgtgtatctatctattctgggacttatatttgtttctatttttctatttgtctctctctatgccaatgtcatgctatttaataactacagctttacaaaagagtagagatcagccaggcacagtggctcacacctgtaatcccagcactttgcaaggctgaggcaggtggatcacgaggtaaagatatcgagaccatcctggctaacacagtgaaaccccgtctctactaaaaatacaaaaaattagccaggcatggtggtgggcacctgtagtcccagctactcaggaggctgaggcaggagaatggcgtgaactgggaagcagagcttgcagtgagctgag

SEQ ID NO: 267448 - DNA, 353 bp, Homo sapiens
actcagtacacaaacatatgtctgtgaactataatgtaatttataaaaagcaagtttaggagaggaagtgaagtgtaacttacccagttataggggaaacttggatcagagtgcctgaacagcagaaacatttctggggctcaaacaaaataatttatgttgacaagatgtattttgggatgtttttattctgtgtcttgtccatagagagtttccctcactctctttggggattaatactggaacaggacctttaaatacgctcaatacatttgacaaaatggggaaatgaaaagagttaagttgacccataaactactaagttctgagatatggtattttttatttttttt

SEQ ID NO: 267449 - DNA, 492 bp, Homo sapiens
gatttaactgaattgaaattctaaaatgtaactatgtttctttaagatgtaaaataattttcctggccggacatgtggcacacacctgtaatcccagcactttgggatgctgggattacaggcatgagccacaatgcccggctaatttttgtgtttttagtagagatggggtttcgccacgttggccaggctggtcttgaattcctggcctcaagtgatccacctgccttggcctcccgaagtgctgggattacaggtgtgagccaccacacctggctcttcacaactttttagtctgctccttgttggacacctctatggactatgtggcccttcagacctctgttcctgagagaaggctcatggttctggtgggtagttttgtatctgctgatgagcctgatcctcataaacagaaagccctttattttttctactattcttactttttttttttttttgaggtagagtcttgctctgtcaaaaaaaaaa

SEQ ID NO: 267450 - DNA, 674 bp, Homo sapiens
atacagtgggaagcaaaaacagggccctggccctactgagttgggattcagtgctgcacactttcacacgagtcagagacatttcatcctcacatcatctctgtagagtgggcagcattaactcgaaattagtaaagagattcagagcgttgggcaccttatccatagacacagcatggtgcaggccccgagggttctcaactaaaggccgttttgcccacaaagggacatttggcaatgtggaagacatttttggtgtcataagtggatggtgccactggcatctggtgggtagaggccaaggatgctgctaaacatcctacgattcccaggacaggctccgtagcaaagatttctccagctccaaaggtcaacagcactgagatgaggagacacagctgcagacctcactggagctcactcacctccagttctgctcacggaggcccaggatctccacaccccaagaccctcgcagggggattggcttgtggctgctctggataaaaggcatgagaggaagtgcgtgtgtcacttctgggcagaagtgtaaacatgcgggtgacagacctccatggacgttcccccaccatgaaggtgaaggtcgctttctctggagctggccaagcttggagacaggagcagcctgcagggctcgatttctgtacaaggga

SEQ ID NO: 267451 - DNA, 527 bp, Homo sapiens
catgctgttgtaagaaataatacagagacctctttcgtgtacctttcactttgtttcccacacagtgaacatctttcaaaactgtcatacaatatcatacccaggatactgacactggtatagctaagatagagaacgtttccacacagaactttttctagcacagggatccctcatcttgcttttgatgaccatacccacttcactcccatccctactcccttcttaacccttggcaaccataatctgttctccatttttatagttttttttttttcatttcaataaagctgtataactggaatcataataatatgtaaccttttgggattggctttttttcatttagcatgattttctggaggttaatccagcttattatgtgtatcaagtctattgacaggtactttttagtgtgaatagaatcccatagtatagatgtaccacagtttgtttaactgttcacctgctgagagacattgggccagtttttggctactataaataaagttgctataaacatttgt

SEQ ID NO: 267452 - DNA, 954 bp, Homo sapiens
gaaggttgtgatctcaagcatggcagctctgtagcggaagcagatcctgtgggagccaacagctggaggcagtccactgaccacattccacagctgggcaccatgtacatccttgcaggaggagccaggtggcatatcttggtgtgtaccacatctaatactgtccattttttcctttctggtttcctttttttttgtttttcttgcatatagtacactggacaaacaacacactaatgccaggtagtgttcgtttataaacaatagatttatgactgacacacccaagtgtctcttgagtatctctgccccactacaaataccagacttcttggccaagttgctatgacagcccccaggaactccattcagtctctgcctctctgggcactgccagaagagttgctatacctctggtgcgactgtttctactccccagcaggctccaggctcaagctttaggaaaactggatgggatttagctacatgatatgtttccatgttagcctcaagtatgtaaccatcagttacaagtgttcttccttaggaaaataaaaacatttacacttaacatttttcttttctctcccttgcacttgctctcaaatcaagtttgctacttttgtatttaaagtacccaagtgacttcagtgatcatatctaaattactcagatatcaatcagagctcacacaaggcatgtcctactactttgctctcagctcccctgctttcagtatttagtgactggatttgggacaagttctcatttagattaattgtcacttgaaggattataatgttactcttgaattatgggattataagtcttcaattaaaaaaaaggggggtaagataccgggggcagtaggacatttgtaaggcaaggggataagagggggggaaagggaaaagggtggaacttgggaggacaaaagagaattgggggttggaa

SEQ ID NO: 267453 - DNA, 874 bp, Homo sapiens
gaaggttgtgatctcaagcatggcagctctgtagcggaagcagatcctgtgggagccaacagctggaggcagtccactgaccacattccacagctgggcaccatgtacatccttgcaggaggagccaggtggcatatcttggtgtgtaccacatctaatactgtccattttttcctttctggtttcctttttttttgtttttcttgcatatagtacactggacaaacaacacactaatgccaggtagtgttcgtttataaacaatagatttatgactgacacacccaagtgtctcttgagtatctctgccccactacaaataccagacttcttggccaagttgctatgacagcccccaggaactccattcagtctctgcctctctgggcactgccagaagagttgctatacctctggtgcgactgtttctactccccagcaggctccaggctcaagctttaggaaaactggatgggatttagctacatgatatgtttccatgttagcctcaagtatgtaaccatcagttacaagtgttcttccttaggaaaataaaaacatttacacttaacatttttcttttctctcccttgcacttgctctcaaatcaagtttgctacttttgtatttaaagtacccaagtgacttcagtgatcatatctaaattactcagatatcaatcagagctcacacaaggcatgtcctactactttgctctcagctcccctgctttcagtatttagtgactggatttgggacaagttcatttaacttaagattcaatttgttcacctatgaaatggacattcaataatgtctacctcttagaattctaatgggaattaaataaagcattctctcaaaaattaaaaaa

SEQ ID NO: 267454 - DNA, 457 bp, Homo sapiens
aaagaatggaaaggatcttagagctatttgtacgtccatgtttaaagcagcattattcacaatagccaagaggtggaagcaacccaagtgtccattcatgaaggaatgaataaacaaaatgtgatatacatacaatggagtattcagctttaaaaaggaagaaaactgacataaactacaacatggatgaaccttgaggaccgtacactaaatgaaatagtcacaaaaggacctatactgtagtggtcaaaattcacagaaacagaatggtgtttcccagtagctgaggggagggggaaatggagactagttgttttatacagagtttcaattgtgcaagatgaaaaaattctgcagattgttcagcaatatgaagatacttaacactattgaacgatatacttagaaatggttaagacattaaattaggtgttctgtgttttttacctaagaaatg

SEQ ID NO: 267455 - DNA, 657 bp, Homo sapiens
ctactgtcggactctacaggccagcctctgcctcacagtggaccctgcagacccagatggtgtctcactgtggcatcctcaggcaaagctcctgcctttcggcagcctctacggggccagctcctgccttgcagtggcctcttcaggccaagctcatgccccatggcgacttttccaggcacagcttttgccttttgcagcctgctgaggcccagaatgtccttaactcggcatctccaggacgagcttatcctcccagtgcgtctacaggcccgtctcctgcctcacaacaacctcttttggcccaactcctgctgagctgctggcagcctctgtaggccacagacttcttaaagtaaagctttccagccaccttcggcctcccagcagcctcagcaatcaaactattccctcactgcggccaccgaaagccaagtttctccctgcctcacggcatcctccgaaaactgagcatttgcctcacggtggcctccccaggccacgaatctgcctgcctcccaggcaggtgctgcctcacaatggtctctttaggcccagctcatgctaaaaaatggactctccaggcacagctcttgcctcctggcagcctctgcaggcccaaattctccaaaagttggcctctcctaactcagctcc

SEQ ID NO: 267456 - DNA, 775 bp, Homo sapiens
ggtgatgtctccgacgttggctcccgaaccactgagtcagaggctgagggcccgttggatgcgccccgccccgggcctgctatggctgggccattgagcagctgccggctctcagcccgccccgagggaggcagtgggcggggtcggcgagcagagagggtcagcccctcacgctccaatgaggtcatcagcccagagatcctgaagatgcgagctgccctcttctgcatcttcacctacctggacacgcgcacactgctgcatgctgccgaggtctgccgggactggcgcttcgtggcccgccaccccgcagtctggacaagggtgctgcttgagaatgcccgtgtctgctccaagttcctggcaatgctggctcagtggtgcacccaggcccactctctgacgctgcagaacttgaagccccggcagcggggaaagaaggagagcaaggaggagtatgcccggagcacccggggctgcctggaagctgggctggagtccctgctgaaggcagctggggggaacctgctgatcctgcgcatctcccactgtccaaacatcctcaccgaccgctcgctctggctggccagctgctactgccgtgccctgcaggctgtcacgtacaggagtgccacagaccccgtgggccatgaggtcatttgggccctgggcgcaggctgcagagagatcgtctccctccaagtggcaccacttcacccctgccagcagcccacacgcttcagtaaccgctgcctgcagatgattggtcgctgtt

SEQ ID NO: 267457 - DNA, 349 bp, Homo sapiens
attcgtggtgctgcttttgctttttggtgaccagatcttggacaagcggaacttggacttcttcctctggagtccctgctgaaggcagctggggggaacctgctgatcctgcgcatctcccactgtccaaacatcctcaccgaccgctcgctctggctggccagctgctactgccgtgccctgcaggctgtcacgtacaggagtgccacagaccccgtgggccatgaggtcatttgggccctgggcgcaggctgcagagagatcgtctccctccaagtggcaccacttcacccctgccagcagcccacacgcttcagtaaccgctgcctgcagatgattggtcgctgtt

SEQ ID NO: 267458 - DNA, 434 bp, Homo sapiens
gagtcattgaggccctcaagtggcctcagatacactgagaggtcactatgaggggatatttccaggcacaatggaaagatagcgtctgccccttctacagaaaactgctggctctacctttttagtaatagttcacttttgtaggcatatgttttgtattcacctccaaaagatacctggcatagagggtaagtggatagaagccattttattttcctaggtcttttgctacagacacttatagtttacagtcctagatttgcatactagggatccgagactctgtataactcaagcagcaaatttgagctcattttaagcattccagcttcaaagaaaagcctgaatgtttagaaaaaggtaaggagtgataacattgtaaaatccagaccgttttacgttgtggtgtataaaaataaatgtaaccaaatagt

SEQ ID NO: 267459 - DNA, 292 bp, Homo sapiens
ctgagctgggaccttttgaagtggggctgaaacagtacctaccaaataaagatgctgtttaggaggaaaaaagcaggcatggggtgtgcttagcataatgtcaaaatgtggcactcaggcaggggctgagaaatggtaaggctgctccagggcctgctggctgcccaactcccatcaccggcagagacctggcagggtctgttctccctctggaagtatctacatgtggccaggagcggtggctcatgcctgtaatctcagcactttaggaagccaaggtgggtgatcacct

SEQ ID NO: 267460 - DNA, 395 bp, Homo sapiens
tcatgaaccacttccctcagctgacccagatgaagtaagctcttctttgctgctatgcccagagcccagaccagttaagaatctcagcctgacttggcctgttatccctcagcttccagtcctgactccaaggtaccttctttctacagggtcttgctctgtcacccaggctggagtatggtggtgcaattgcagctcactgcagcctcgacctcccaagcaagctcaagccatcctctcacctcaacctcccgtgtagctgggattacaggcatgtgccaccatgcctggctaatattttattatttgtagagacagggtctccctatgttgcccagtttggtctatgaatattaagttaggaaagaaaaataatgctttcctatcaagtgaat

SEQ ID NO: 267461 - DNA, 216 bp, Homo sapiens
accagtgtaccacagatgagccaatgctaggctgctgatgggacttgtgggaagtgagggaagttgttggcttttagcattaaaatgaaaggagtcaaaaacagcaactctaaaagacaggaagctgactgggctagtcagttgacttcatctataacaggtacacctaacttttaaggtatacctaagtcatacgtggactgaattaaaaaaaaa

SEQ ID NO: 267462 - DNA, 426 bp, Homo sapiens
gaatcagcataagttttcggagagccagttaatgtgaaatttctaaactgcgtatcttttcattttacaatgcatttttaggaatacatcccgaagaactcatcttgcacatgtataatggtgcaggaataagactgttgctttttaacagtgaaaaattgtaaatgacttcaaatgtttggcatcataaaaattggttaaacaaattacagcatatccaatgataggactgtgcaacatcattaaaattatcatatggaaaaacatttaaatgccatggaaagatgttcacaatatataattacatatgaagagcaatttaaaacagtacatatcatgtgaacccatttttaattaaaaaaactatgtcgagtatgcataggaaagggactggagaaatacattaaaatattagaagtgtttatc

SEQ ID NO: 267463 - DNA, 775 bp, Homo sapiens
aatcttaaatatctcaattggtattcctacaggatacttctatacatttgttgaatgagccagagtgtagatacacagcctttttttgcttatcctttgagccccaccaaatttaacaagaatacatataagtaaatacagaatttccttttaaaccacttatccagaatttagaaaatactagcacagttttccttataaagagaactcacaaagaatcccctttagttttgaaacagatgtgcagactactgaaaatatacttcatccattttcattaactattttaaatatacaacttaataaagtgtatacaaggcataatatcttttaagttgaaccaaaatgcgaagggtaggagactgtatttcccttttcagttcaaagtccatagcctcatgagaatggtttacaataaaagaatattttaactatttctctgactagcatttttgcagattcattagaactgctcactgtgtcaccaaaaaaattacacctggtaacatgcaatctagattccagaaggcacctgcttgggaatacaataggggtcaccaggggttaggggatagggaaataagaaattgctgttcaatgtgtatacagtttcagttgtgctaggtgagtaagttctcgaaatctgctgtacagcatggagcctatagttaaaactaatttaaaatttatttaggatagatctcatgttaagtgtgcgtaacacacatgctcacacacacacacacaccacaaagggacacaaggaaatgctggg

SEQ ID NO: 267464 - DNA, 383 bp, Homo sapiens
tttccatctcagtagcagggagggatgagcccacccttgcctgtcttgtggggatccaatgtccttgtccaagtgggtgcatttctcctttgtgatttagggtctcttcccaaccatctattattattccttctctggcaacatggtgaactgttgtataaataattacattcctagctaggcgcaatggcccaggcctgtaatcccagcactttgggagcccagggcaggacgatcacgtgaggtcaggagttcgagaccaccctggccaacatggcaaaaccctatctctactaaaaacacaaacatgagccgggtgttgtggtgggagcctgtaatcccagctactcgggagtctgagacaagagaatcgcttcaacccg

SEQ ID NO: 267465 - DNA, 424 bp, Homo sapiens
acagtggcctggaggaccaaaggctgaggtaataggatgtggtgagttgaattatgtctcccccaaaaacaatttgtccatctgaaacctcagaatatgaccttatttggaaggagaggctttgtacatgtgattaaggtcagaatctggagatgaggttatcctggatgagagtgggccctaaggccaatgagatagaaaaggagaagacatacagagacacgggaagaaacccatgcacatgaagatggaggcagagattggagtggggcagccacagccacggatcaccaggaaccaccagaagctggaggaggccaggaagggcgtgctagagggagcacagctctgctaacaacttgattttggacttgaggcctccaaaactgtgaggtaataaatgcctgttgtttaaagtcactca

SEQ ID NO: 267466 - DNA, 191 bp, Homo sapiens
agcgcgtcaggatggccgagcggtctaaggcgctgcgttcaggtcgcagtctcccctggaggcgtgggttcgaatcccactcctgacaagcgctcttttccggtatttcagaagagaaatcttcgacgaccgcacaccaagagaggccctcaaacacagaggaccgtacgttttacacacaatccaaagtc

SEQ ID NO: 267467 - DNA, 449 bp, Homo sapiens
ctgagtttagcattccctaggaactgaatgaaggccacaggttgaatcacagagcccaagagagagtcatgtggctgggacacaggcaaaggccaggtcctgtggagcctcaaagctacattaaggatttagaataggatccaagaagtgcaatgagaagccattaaagaatttttttcagtttctttatttttgacaacaatatttattttgggggtacaatgtgatatccatgtatagattgtagaatgattaattaggctaattaacatatccatcatctcacgtactaatggtttatttgtgataagaacatttaaaatctacacttttaggccaggcacagtggctcacacctataatcccagcactttgggagggcaagacaggagaatcacttgaggtcaggagttcacctaaagtaatatggtaaaccttgtctgtactaa

SEQ ID NO: 267468 - DNA, 422 bp, Homo sapiens
gtacagaatagaaggggagtggaagggcagcctcatagcaggagaggcggacaggtgccacctcagccaggtactcaagggcgacatcgacggccgtgagccacactgatagttctggcccttgaaacgatgtgacgagaagggccacttcacctctggggtctgtctcccagacccatacccccgtccaatcacgaggagaccatcagctaaatcacaatagtgggggacacttgactgaatccctgaccaggactcctcaaattgtcaagagcatcagaaacaaagagtctgagcaaccgcgagagccaggagcagcctggggacacctgatggctaaatgtctcgtgggacctggggtagaaaaggacattaggcaaacacgaaggaagagtgaataaaatgcaggtgacttactcata

SEQ ID NO: 267469 - DNA, 491 bp, Homo sapiens
gcaggctagtggaatgagaagattttcctcttgtcttatgtttatctgttttcaataaagctttaaaggcatttcaataaagggcaatataatgcttgttcacagaaacaaaagggaaagaaagtaattttaatgtctactaagggaaatgatatattttggtatcagaacctttcatgatatcatggcaggattgagggtggggagcagatatgggaaataaaacaatatgtttagaaatttgagtcaaacgttagaatacaaatatttttctcaaaatggagtgttagttttctgcctctagtaatgacggagcagcttgtatcagattaatcctgcagttaacaataataaactttaaacaaaatatgaaaaacaactatttgaagacatagaggagcaactaaatacaggcagaaacataggaaaatcatagctgaatattttttttttaacaattctcttccagtaactgatagactaactagaca

SEQ ID NO: 267470 - DNA, 337 bp, Homo sapiens
tacacacacttcttaagcggactattttatatcacaattaatcacgccatcaagaaggcgcgggtcccgcgtgcgagtgcggccagcggagcccctcacataaaattagacaataattgaagccataaaaaagcagccaaatcgcattgtcgctctactgtatttaaatctatatttatgatatttcataaggagttattgtttcagaagccacacaggctggcgggaagtcggaaacgaccaacagattcgtttgcctcgccgtggctcccagctgtaaaaatttacgaggacttggaaaggttagactgttgtgtttggttggcgagctccctgt

SEQ ID NO: 267471 - DNA, 639 bp, Homo sapiens
attactttgagttctggatctctttgtaatgcagttagcttactgagtaaatttgaacttatcgttttattttagtaaagccagcatgagaatcttaaaacagtagttatctgtataaattaagccttgaccttcttcatcccactgtttatagtaagttcaagtgaacgtaaaacttgtcctttatttgcttgaatttcagaacagctacttgataccgttttaagaaaacttaaaaaaacccaatacttaccagtgaagtcattcttttttttaatagttagaatatcataattcagtttaattatgagccagattggtataaagatgaataagataggttttctaccctgagaagtggggagacaaagacataaaacaggtaattttaatataattggtatgtataaagatatgctgtactagtcgcttagaagaaattcacctaaccttaccttcaggtgaggcttcctaaagtgagtcacaacagataagtaagagtgagctagatcattgttttccaactgggtagttacctcttagtgggccatgaagtcaatttagtggtcatgaccagtaattaaaaaaaagagagaatagaatagattgcatggtacgaagggtaggttttcttttatg

SEQ ID NO: 267472 - DNA, 603 bp, Homo sapiens
ttaaattttgacgctttgaatagataacacttttacatggttcaaaaataatataaagagctatacattgaaaaatgttgcttccactcctgtccccttctacccattcctcatcttgtcccgaataaccgaatttcttcatttcttatttatccttccagtatttttttgtaaatacatgtatttttatattattgcttttctctttttttaatcacccctttttataccaaataggttttttttcctgctttatagtttgttctgaggagaaattcatatgagtgcatggagattgtttctcctttttacagctgcataatattccatggggtagatatactattaatataatttattcagtctgtctcttattgctagacccttgggttgtttttaatcttttgctaaaatagcactaccacaatgaagagctatacataggtcattttctacacatgcaggtgtatttataggatacctttctaggagtgagattactgggtcaaagagtaaatgcatttgaaatgtgttaactattaccagatttccctccataggaattataccatttgtactcctatcaacattatataagattgc

SEQ ID NO: 267473 - DNA, 575 bp, Homo sapiens
atatagtgttgggattaaaagtaggactggtggagccagatggctcaattcagatcccagatcttccgcttaatggctatgtgactgcaggtaagagagctaattgcctccctgagcttgtttcctcacctataaaatggggatagtaatagggttatcttacagtgttgttaggatgattgaattagtatatacaaaacaaaacatgtaaaagagtacctggtatgtacatgttaaccatgattactatgaatggttagttggttaagaaaggtagataatgctggccgggtgcggtggctcacgcctgtaattgcagcactttgggaggctgaggcgggaggatcacgaggtcaggagatcgagatcatcctggctaacacggtgaaaccctgtctctactaaaaatacaaaaaattagccgggcttggtggtgggtgcctgtagtcccagctacttggaaggctgaggcaggagaatggcgtgaacccgggaggcggagcttgcagtgagtgagcagagattgcgccactgcactacagcctggcgacagagcgagactccatctcagaaaa

SEQ ID NO: 267474 - DNA, 480 bp, Homo sapiens
gtgattaatcccccatcccatgtcatttcctgctagaactgtaaaactaacatattcgacagcctgcaagctgaccactcagaggctggcagtggggaaaagattaagctcttcctgtttacttcccttgtcttcagccttccaccgactctgtgaattgggtaccttcatgatacccattttataaatgagaaaactgaggtttttactatatgctggtcatcatgctgaggactttacttggattttctctcctgccaatgctacgcggtggggaccttcatgttctcccctttgcagatgagattatcaaagcagaaaaagaccatctctcctactgagtaacagaggtacattcgtctctgtgaagtgtgtttatgtttaatgttggtgagactgaggagaacaagtttttgtccaaatgccaaaatctcctcctcagaattattataataaaacatagaatttgtatcctgcata

SEQ ID NO: 267475 - DNA, 555 bp, Homo sapiens
gaaagagcgagactctgtcacaaatagagaaacacacgcacacatacaggtacatatgtatgtatgtatgtatgtatgtatgtactatgtggtatggaaacttttttaaaacaattaaaggtgaatcaactggctgtggtggctgatgcctgtaaccccagcattttgggaggccaaggcaggaggatcgcttgagtccaggagtttgaatccagcctgggtaacatagtgagatgcctgtctctacaaaaagtaataaaaaaaatttacccgggcatgatggtgtgtgcctatagtctcagctacttgggaggctgaggtgggaggatcgcttgatcccaggaggttgaggcagcaataagttgtggtagtgccaccgcactccagcctgggcaacagagggagaccctttctctctctctcagtcaatcaaccaatcaatcagtcaatatcaatttctttgagaattataatatccttttctgtaatatgagaccattacagtgtctcaacaactagataataatctcagaggggttggtgcccttgtgttta

SEQ ID NO: 267476 - DNA, 429 bp, Homo sapiens
atgacatgatctgattttaaaagttaaagattattctggcttctgcatggaaaacagactgtgaagcaggactgaagcagggagaccagtaatccaggtaaactggaggtacctgcagtagcccaggaggggacagtgggaggagaaccgcaaagtggaagaggtcagtgtagggatgcaatttcaggacttgctaatacagcttagtttagagagaaagagcagagtcaagatgaattcatgctttttgcctgagcatctgggtgtgctgcgccctttactgaggtgtgaatagcatgctgagcaggtggaggtagagaaaccttgggttcagtattggatatctcaaatcagagaggactagtagaatccaaaggaagatgtcaaaggggcacttgtgccaatgagtctggaagcccagaggagagg

SEQ ID NO: 267477 - DNA, 774 bp, Homo sapiens
aggaaagtttaatctgtatctaatcatgaggaaacaatctaatgaatccaagtgaaaaacgttctgtggagctattatcctggactcttcaaaaataaaaaatatctaggtagttttctggattaaaataaagagacaacacaattcaagaaaaatgatcctgattgaattctgaattgtttttaagtcataaaggaccttttttttaggacaattggggaaatttgaatatggtctatattgtatcattgttaaacttccagagtgtgaaagttttttgtggcaatgtaggaaaatactctacatagacaggctgcagtatttaggggtgatgtgccatgagacatgtttgcaactaacttgcaaatggagaaagcaaatgtgataaaatgttaacaattgatgaatctcagtaaaagtatgtgagtattcattgtactatttttgcaacttttataaaggtttgaaatttttcagaataaacagtttgctgggaagtataaaagaaaaaagatcagctatctgatagcacacatctttcataaccgtaatagatgccagaagatgctggagtgatgtttcaaagtaccgagtaaaaataatttacaaccttgaaatcattaaaacattattcataggaaaagcgtttttaaacatatgaagagtaagagagtttaccactcaaaccttccttaaaagtgcagttaaagggctgggcgtggtggtttatgcctggattagcactttgggagaccaaagcaggcggatcagttg

SEQ ID NO: 267478 - DNA, 370 bp, Homo sapiens
tcgcttgtctcattgggatagtcagggcagtgatttttgtgggatggccctatattgaagatcttctttccctccctaaaggtagagaccattctttagagtttagtgagtgctgcaaatgaagatttgatcgttatttggatttttttgcatgtgtatgtgtggattttttttggtagttatccagatacattttgtggcaaaatttatggctgagggtattgataattgtttctgagacaaacagtgcacttagggaaacaggattgacatatagagtagagaaggacttctttttatttcagttggatattcatcttttggtggctagctttttttaaaaaaactattaatattatttttgattgac

SEQ ID NO: 267479 - DNA, 256 bp, Homo sapiens
atgttttttttaagcagggcatcgcatggcctcgacggggattacccataggagagatgagttttgctgagaacgcctgagtgagcatggagcagagctccgtgagcacctgcacccagctgggtaaggaacaagtcaggaaaaacatgcagaaaacgaagcacaatgatcttaaagcccccgagccaataatcggctgcttaggcccttgcttaagtaagggatgcgatttgtaaactaactgtgatcactggca

SEQ ID NO: 267480 - DNA, 428 bp, Homo sapiens
cacggtggctgacacctgtaatcccagcactttgggaggctgaggcgggaggatcacaaggtcaagagatagagaccatcctggccaacatggtgaaaccccatctttactaaaatacaaaaattagctgggtgtggtggcacacacctgtagtctcagctacttgggaggctgaggcagaagaatcgcttgaaaccaggaggcagaggttgcagtgagccaagatcatgccactgcattccagtctggtgacagagcaagactccatttcaaaaaaaaaaaaaaaaagaaaaggaaagaaatggcagtagtatgtgaatgtctaaactttcaggcatactactgcagagataattactaaatttggtggtaaagttaaactttaaagttaaactataattcctttaaatgtgattctggaaacttta

SEQ ID NO: 267481 - DNA, 399 bp, Homo sapiens
tctcatctatatgttagtagaaataaagattaaatggttactggcccccaccatgataagctgaaaagtagattgcaataaactctgagggtcctccctccactccacttcaatttatttaacaacagctactctttatggagcactattctgagaatgacaattctctgagggaagtctaattagcctcattttgtacataaggacactaaatcatagaaagctataaatctggcaacagtcatgccaggagtcacacataggtctttctgactccagacccttcccaccagacctcacactgcttattcttgattcattccatgaacattattgagaacttgccatatgtaagtctttgagtcttacagagaagattccatataaactcccacccaa

SEQ ID NO: 267482 - DNA, 864 bp, Homo sapiens
gcagaaactatttccttcagtttcctgacactgtccaagtgatgacatcaattggcattactgagagcccagggataattttagcccaaaactactactcctaggaaggagtagtatgatctactactcttaggaaggatttaggaatagtaaaggtgtatttcttccaaacagcatagaactattagtactattagtcatttaacatttaacatggcatgggattttagagctttggtgcctgtaaagttttacttctattagctgtttcatttctttgcacttataaagttttcttctgttgcctatgaaagcaaacatttattccggttactggcaaggcagtttaaatcacctgcttctttcatgaaaggccaagacaatacatttattccctaacttgttgggagttgcgattacaagtctatatcctgatttctattagcacattcagctatccatttgtgtacactcccaagtcctagcttttgctcttcatgtctctttcaaccatatgatcaatcagttggacgacttctggtttttcctgaataaatatctaatcttataggtgcttctattaaatataattctgtttctttttcttaccatttatcattataacccagccaacatgtagaagtgcaataaaaatattttaattttcaactgttcaactgctaaaattattagcttgtaattaaaaaagaaaaaatacatccactatatatttagatatattgtaaatgtaacctttggtgactgataatttgttaagtagaatttaaattatgtatccaatttattcaaagtgtatagttgtgtaattatttactatttgattaaaaatagttatcatgcatt

SEQ ID NO: 267483 - DNA, 609 bp, Homo sapiens
tttgcctgttcttgaacttcatataaatggatttattcagtatgtactcttttgtgtctgacttctttcactcaagattcatctatgttatttcatctatgagtattttattctcttttatactgggtactattccattttataaatataatactatttgtttatccattatcctattgttggacatttggattgcttccagtgtgaagctagtatgaatggataaatatgtaggagtggaatttctgggtcatagggtaggtatatgtttaagaaattgtagtcaaatttacaaagtttttgcactgttgcctctcccactagcagtataacagttctaattctagtcttaaacctcaccaacatttgttgttattaatctttctcattttagccattccactgaatatgaaatgatataatttccttattcctaatgatgttgatcatctttccacgtgtttattggacatttttgtgtcttctttcattgaggtatcttttcaagccttttgcccaatttctaaattgagttgcttgtctttttgttattcatttgtaggaactatttatatattgtggatacaaatcctaatattttcttgtggt

SEQ ID NO: 267484 - DNA, 469 bp, Homo sapiens
cacgaggggaagctcagcgaaggaagggctttggaagttctgtagtagtttatgtttattccattgttctgtcctctgtggggaactgtccagaataggccagtgtctgaatcctggccagaggtcttcatcccaagttgaagatgactgtatacagttagctttattaggttttctcatgccaacatttcaatccaatttcctttttccaagccacaaagacctctgccaagctacctctctctgtcacagcctgtatgtcagagaatttatacagatgtacatatgcacacgtggatacactgttttcaaagtgcattttaggatattccagtatgcaaaaatctaataaggttagagatgagactgcattttatcacagcactttgtgtgcagggccctgactaaacacttgggggaggtataaaaggagaaaactcaatccctgaatgtagggaaatccccacat

SEQ ID NO: 267485 - DNA, 461 bp, Homo sapiens
ggagataggtttgtattggtgttatatgactcaagctacagtgtatgtaataggttagtggggcaacacagaagacaggagaccattaggaggctacttcattaactcaagtgcagactggtgatggcttagacttcattggtggcagtgggggtgagataagttgacgcattagaggccaggcacagtggctcatgcctgtaatcccagcgctttgggaggccgaggtgggcagatcacttgaggtcaggagtttgagaacaccctgaccaacatggtgaaaccctgtctctactaaaaataaaaaaattagccagacctggtggtgggtgcctgtaatcccagttactcgggaggctgaggcaggagaatcgcttgaacctgggagacagaggttgcagtgagccgagatcatgccactgcactccagcctgggtgacaggtgacagagtgaaactccg

SEQ ID NO: 267486 - DNA, 410 bp, Homo sapiens
atctgacatgatctccaggtagatagtactggaattgaattggaggacacccttttgtgttcactgcagaagtgattggttggttggtggtggagagaaattcccacatattttggggtcacagaagtcttctgtgttgattgttattgtgttggcttaagagcagagaaaaaacatggtttcagaattttttctgaaacagtaccacactgggtattagggcaattactctgtgatttcctccccatgcatattaataagtttgcatacctagtctcctgttctacctgttgccaaattttcagtgaaccttcagagggcaaagtgaaagttttccctttggccctaaaatatgaaagcaaagcatccttttattagcattaaagcatgcgttaaaaacattccatatt

SEQ ID NO: 267487 - DNA, 395 bp, Homo sapiens
caccaccaccaccacaggtgttgagacaaagcggcttgcggtgtttcaaaaatcaaaaatttggtgattttgtctctgtacactaaaaagaacagcaaattattgaactttgaaatgttggttgtgcttttttaaaatgaaccgaaagtatgtaaacgattgaatccaaacaaccagaagggaaagataagatggatgtttggtgcccttgtcaatctctgtgcttcatagctggtctaatgtgggcccttagttctcaccatgtacactctttagagatgtgatttgtgtctgtgtgatgcaggctggtctgttctccagcttccttgccttcttctccctggtgaaggtaaaatacataataaagctgatcctaaggctgatatctgacttga

SEQ ID NO: 267488 - DNA, 340 bp, Homo sapiens
gcagcaaagtgttcaaaaggtgacttgggtgccattaaaagcatttagttttggatgcgcacggtggctcatgcctgtaatcccggcactttgggaggccaaggtgggcggattatgaggtcaggagttggagactagcctggccaacatagtgaaacccccgtctctactaaaaatacaaaaattagctgggcttgttgtcagatgcctgtaatctcagctacttgggaggctgaagcaagagaatcgcttgaaggtgggagacagaggttgcagtgagccaagatcatgccactgctctccagccagggtgagagagcgagactctgtctcaaaaaag

SEQ ID NO: 267489 - DNA, 396 bp, Homo sapiens
gaataagcaaatgaagtttgctatctcttcctcccctcttccaggaagaaataatcaccatcagaactttaagagtttcccataagactgggcaaattagaggaaggacctctatacggtggaacagatgcaattgtgcaaacagaatggggttattctctacatatggagatggaacagaccctcccagatgtgttagtgtggggaaaagcaggtggtggaggtgcgttcagagtagcagtgttcagctctcccaagcacattcaaatcacccaggagcttttaaaacgtactgatgcctgcccaccaccctctcctcacagccccattaaatcagaatctctgggagtgggacttgagcacttttcattttaaaagctccctggtgactcctgg

SEQ ID NO: 267490 - DNA, 520 bp, Homo sapiens
gcagaagaactctctcccaacctcagtctttgtatcagtcaaagtggggctacctccctggcttcagttaatttgaagataaagtgagatagtgaaaagaaaaaggacatgctagagctacatgtactgttatagaaagatgattttggcatattgtcaactggacaaaacaggtttcagaagaaataagcataagaagattgggatattgggtgagaaatagagcaaacttaagagtggccatctctggtgggtgtgactagcacagcttgtcactcagatgttacattctgccatgatggttaaaacattttttttcaaaaatgcatcatatttagaatcacaaaaaaatagtcaagactttccattttagaaagaaaaagatgaaatatccagaatattttatgtccaaaaatggagaccacctgtatcaattttggtgtgtctttccctgcaggacgtctgaatcttcaaggcatatcctgaaaggattttgtgccagcgtttatctgaaaaaaaa

SEQ ID NO: 267491 - DNA, 688 bp, Homo sapiens
tgtataagctctggaaagctttgtaattttgagttggtctggcaatatttcccagccttctccctgtacctagttatagaaataaactctcttctatcccagttcatctgcatcttgttattgggccatgagaataagcataaaacaaaccttcctttgatgctggtacctaagcaccaaacaatagataccagcatcaaaggaaggtttggatacaatcttctttcgttttgtctggatacaaggagctagtttgggtctgctcagttaatgtatctatgctcatattttccttcctcaattataaaataaatcagaggtgaacactgtggttagccatagattaaccaagaaagcagaaatcatctcaaatgttcacagtggaaggaatggaaagcagaggtgggtccatgaagagtggagaggttgagaattaaacagtgggctctaaaataatcctgggagattgaagatggcaggaagtctttatcattcttgggctggagagacaaaaggaaaacatgcaattactggcaccaagaggaccactctaggagactgaatctctggtggcctcgatacaatgggggctggagtcacagagaagataaagcccctggagtggccaccttaggctgaaaacaggagggagtgtcttgatctccctcccccaaaaaccactcctcac

SEQ ID NO: 267492 - DNA, 421 bp, Homo sapiens
ccttgacagagtgcagcagacattattgctttcacaatgtgaacttgctagggacttcaatagtaagtcattcttcagtgatcacctcccatgggaaatcccccctgactccccgaggctgagcaggaatccctctattctggcacttacccactggtcagtatgtaatgctttgtttgtgtatcctctactggactgggagcttccaggagtttcattgccccatcctggtgtctagcacagtgcctacaaacagtaggcactcagaagacatacagactaagcgaatgactgactgaataaatgaatgaacaaggactttggaagagtgaccagttcagctttcactgaaaataattttagacatgggtgatttctgcagaaagtaaaaaagaaaacatgttcacaagaaaatttaaaa

SEQ ID NO: 267493 - DNA, 668 bp, Homo sapiens
aattatgcaaattagccagaagaaggggaaccgtgctaatgggccttattgggtgaggggacgagatggggttcatgtgaaggaggaagcgatgccgaggtaggaaaggccagccccagacatcctatcgccacaatgccatgtcgcaataggaagcaggggccggccatcgctaccttcagcacactgaccaacctggaattaagaccacctagattgcgagagctgaatttagaaaccagacaacgtcatgcagcccagaaactcctgttgttacctttgcctaagaaattttctttaatggcgggggcggggggcgggggtccaaagagaaatctctaaaagaatatgatcttccatccaagtggagggaaactttaaaacaaaaacacccagtactgtggctcaggatatgatgcttgaggagagggagggaacagagatgaccttaacttttaaaaaagggactgctgtgggccaaagccaagcccatctgccaggacgaggtaatgtcagagctccatcagcccggacagtgggaactaactggtgcattccccacacttaccttccggtgggttgctgatgagagaacctgaaaaaacctacacctctacagcaggtcgaattcatgacctgaagctgaatacttccagcatatttattca

SEQ ID NO: 267494 - DNA, 243 bp, Homo sapiens
aagggagttcaagaactcatcccttaagtggactgggcaagctggccatttaccacttgtcacagttagaattaggaacttggctttcatattatccattggtgtcacagagtgggaggaaaacatcagtaatggatccataggaccaccagtggaggcaaattgaatttgggatatgttatatcaaatctgttaaagggaaaaaaaagaaagaaaaggaggggagagaaggaagaaaagaaa

SEQ ID NO: 267495 - DNA, 522 bp, Homo sapiens
agtcaaaggatttcaatgctctgaagtggtcatgggaagggtccttagagaggagaagactggcagcaaaacaaaggagagacaaactcacaagacccacctgttggaatagaaacatgccttgcacaaaggatcagaagtcctctactttaatgtctctttatagggtgagagttctcctgagggagcagaaacttggtttctaaccggagcctcttcagaccctcccccaggaaatttgggcaaagtacttctatagcacacccaggaatctcctgcctctaagttcacagcagcacctagaacagggaagatagcttgacaacttcaaaagaaacccaagtgtagaaaaaaatatgctccatactacaaagagtgatcagcccttggtactaggatgaggcaatgaagggtaggaacaggatggggactaagatatttaccatttgcttctaagaatctttgttgtttcagtttttataacaaaggaataaaaagaaatatattcaattctaaactagt

SEQ ID NO: 267496 - DNA, 325 bp, Homo sapiens
aaaaaaagttcagatcaccaatcattattagataaatgcaaattaaaccaatacttaacttacgtaacttttctcacctattatattggtgaaaattaacaagcagacaatatattctgttggcaagactgtagagaaacaagcattcttctgcactgctgatgaggatgcaaactggcacaaccatccttggtgataatttggcaatgcttgacaaaactacatacacacttacttttgacccaggaattccagttctaggaacctacactgaaaatatatgttcagtactatggaaatacatacatgaaaggttattcatttc

SEQ ID NO: 267497 - DNA, 1088 bp, Homo sapiens
gacgggatttcactgtgttaaccaggatggtctcaatctcctgatctcgtgatctgtccgcctcggcccagcactttggatggccaagacgggaggactgcttgggctcaggagttcaagacccagcctgggcagcatagaggagaccgcatctctactaaaaattaaaaaattggccacgcgtgatagagcatgcctgtagtcccagctacttgggaggctgagttgggaggatcacttgagctgggatgtcaaggctgcaatgacccatgatcatgctgttttattccagcctgggtaaatttcatgtaaagcaggtgatacttcataactttatgaagtaggcaatacacacccatggtaaaagaatccagatatatcaaagcaaaaagagtctttcactcctgtcgctcttctgtttctcctccccagaggcaacaactttgaccattttctgtgtatctttaaacttgagcatgcatcagaatcacctgaaaggttattaaaacagattgcttgaccctttcctcagacgttctgagtcagtagatctgaatgttgccctataacttgcatgcttaaaaggtcccgggttgtgctgcttctgctgatctgggagacacactcaaaaaccactcttttagtgtatatgggtatattcactccacctcatttttttccataaatacatatactattctgcacctttgatttttctaaaatggtaaacctcagaaatcattccgcatacatagatctagatctgcatccttcctcttcataggtgcagtggtactccatggtctgggcataccacagttacatcagtctctattctggtcggctttgctgttcctagttttttgctactgtgaaccatgctgcaatgagtttccttttatataggtaagatctttgtatacatagatggaggaattgcattctatagatttatgtgacatgtcttccaaagcgattttaccaattaatccttatactacagcaatatgactgctttaattttcctacaccctgaccgcctttctgatctttgacaatctgataagtaaaaactttgacctgtggtt

SEQ ID NO: 267498 - DNA, 915 bp, Homo sapiens
agagggacgccccctcctccagcgggcctcttgtgaggcgcgcggagccgcctcccctgggtcaggtctgatgggccggtgggcgcgctagtggtggccgccaccgccgaaaccgtcgacctcctgggccccagttccgcgtccagccccgcggcagcatggactacctgacgacgttcaccgagaagagtgggcgccttctgcggggcacggccaaccgcctgttggggttcgggggcggcggcgaagcccggcagacactggccaaaagaagaccctagacaagaaagatggaagacgaatgtcttttcagaaacctaaagggactattgagtatactgttgaatcaagggattctttgaatagcatagccctgaagtttgatacaacacctaacgaacttgttcaattaaataagttattctcccgagcagttgttactggacaggttctgtatgttcctgatcctgaatatgtctccagtgttgagagctctccatctctaagccccgtaagtcctctgtcaccaacatcatctgaggctgaatttgataagaccactaatcctgatgtccatccaacagaagcaactccctcatctactttcactggtattcgacctgcacgagttgtatcttcaacttctgaggaggaggaagcatttactgagaaatttcttaaaattaattgcaaatatattaccagtggcaagggcacagtcagtggtgtgctgctagttacaccaaataatataatgtttgatccacataaaaatgaccctttggttcaagagaatggctgtgaggaatatggcatcatgtgtccaatggaagaggtgatgtcagctgcaatgtacaaagaaattttggatagcaaaataaaggaatctttacccatgtaagagtgatatttata

SEQ ID NO: 267499 - DNA, 1027 bp, Homo sapiens
tttctttataggtcctctcaaactgtgagtaactaagtggtttgtgcatcattccagaagcaaagctaaaatttttagcggtgttgtcgacttgacctgctaatttcctgttctggaatcgagagaagactcctcaacaagttgctgcaatgtctgtgtctaatctatcatggctgaagaaaaagtcccagtcggtggatattaatgctccagggttcaaccctttggctggtgcaggaaagcaaacaccacaagccagtaagcccccggcacccaagacccccatcattgaagaagagcagaacaatgcagcaaatactcagaaacatccttccagaaggagcgaactgaagaggttctacacaattgacactggccaaaagaagaccctagacaagaaagatggaagacgaatgtcttttcagaaacctaaagggactattgagtatactgttgaatcaagggattctttgaatagcatagccctgaagtttgatacaacacctaacgaacttgttcaattaaataagttattctcccgagcagttgttactggacaggttctgtatgttcctgatcctgaatatgtctccagtgttgagagctctccatctctaagccccgtaagtcctctgtcaccaacatcatctgaggctgaatttgataagaccactaatcctgatgtccatccaacagaagcaactccctcatctactttcactggtattcgacctgcacgagttgtatcttcaacttctgaggaggaggaagcatttactgagaaatttcttaaaattaattgcaaatatattaccagtggcaagggcacagtcagtggtgtgctgctagttacaccaaataatataatgtttgatccacataaaaatgaccctttggttcaagagaatggctgtgaggaatatggcatcatgtgtccaatggaagaggtgatgtcagctgcaatgtacaaagaaattttggatagcaaaataaaggaatctttacccatgtaagagtgatatttata

SEQ ID NO: 267500 - DNA, 628 bp, Homo sapiens
ctcctgacctcgtgatccacctgcctcggcctctcaaagtgctgggattacaggttgaatcaagggattctttgaatagcatagccctgaagtttgatacaacacctaacgaacttgttcaattaaataagttattctcccgagcagttgttactggacaggttctgtatgttcctgatcctgaatatgtctccagtgttgagagctctccatctctaagccccgtaagtcctctgtcaccaacatcatctgaggctgaatttgataagaccactaatcctgatgtccatccaacagaagcaactccctcatctactttcactggtattcgacctgcacgagttgtatcttcaacttctgaggaggaggaagcatttactgagaaatttcttaaaattaattgcaaatatattaccagtggcaagggcacagtcagtggtgtgctgctagttacaccaaataatataatgtttgatccacataaaaatgaccctttggttcaagagaatggctgtgaggaatatggcatcatgtgtccaatggaagaggtgatgtcagctgcaatgtacaaagaaattttggatagcaaaataaaggaatctttacccatgtaagagtgatatttata

SEQ ID NO: 267501 - DNA, 1015 bp, Homo sapiens
agagggacgccccctcctccagcgggcctcttgtgaggcgcgcggagccgcctcccctgggtcaggtctgatgggccggtgggcgcgctagtggtggccgccaccgccgaaaccgtcgacctcctgggccccagttccgcgtccagccccgcggcagcatggactacctgacgacgttcaccgagaagagtgggcgccttctgcggggcacggccaaccgcctgttggggttcgggggcggcggcgaagcccggcaggtgcgcttcgaagattacctgagggagccagcccagggggacctcgggtgcgggtccccgccccaccggcccccggcgccgtccagcccggagggacctgacactggccaaaagaagaccctagacaagaaagatggaagacgaatgtcttttcagaaacctaaagggactattgagtatactgttgaatcaagggattctttgaatagcatagccctgaagtttgatacaacacctaacgaacttgttcaattaaataagttattctcccgagcagttgttactggacaggttctgtatgttcctgatcctgaatatgtctccagtgttgagagctctccatctctaagccccgtaagtcctctgtcaccaacatcatctgaggctgaatttgataagaccactaatcctgatgtccatccaacagaagcaactccctcatctactttcactggtattcgacctgcacgagttgtatcttcaacttctgaggaggaggaagcatttactgagaaatttcttaaaattaattgcaaatatattaccagtggcaagggcacagtcagtggtgtgctgctagttacaccaaataatataatgtttgatccacataaaaatgaccctttggttcaagagaatggctgtgaggaatatggcatcatgtgtccaatggaagaggtgatgtcagctgcaatgtacaaagaaattttggatagcaaaataaaggaatctttacccatgtaagagtgatatttata

SEQ ID NO: 267502 - DNA, 494 bp, Homo sapiens
ttttattttgttttctgcttttttttttctttcctttaaaaaaaaaaaaaagaatcctgatgtccatccaacagaagcaactccctcatctactttcactggtattcgacctgcacgagttgtatcttcaacttctgaggaggaggaagcatttactgagaaatttcttaaaattaattgcaaatatattaccagtggcaaggtaaagaatgacactttagagaagacctttaatcatgctttagttattactaatgtatgatagtttggcatttacattttaagtcatcaatgtcagaaaatgcttgaatattatagaaaggtactagtgatactattattttgggttagtatggatgttgcttataacttagagtctggtgatctgttgtaattgttaaaagtaatggaatataaataaattcactaaggcacagctaagttgctgttggtaggatatttcaaaagtgtgaataaaatgactgctgccaggt

SEQ ID NO: 267503 - DNA, 383 bp, Homo sapiens
cagaggcccagggagcaccaaccttttgggagaaagaagagcccttcaagctgaggctgagcttgagaaaggtgaagcagtgagcagaggatggggtcccatgtgctgaggagggcctggtggaggaggtcacaccctgctaagaggacagcaggacgccggctgggaaggaggccctggatttcacaatgtgggcaggtgaattcatcagaaattgtcagagccatgcggtggaggaggaaatgaggacagggaggggacacagctctccggtgggaagagtgaggagtagcggctgggaagagacgtggagtccaggtagggatcttacgcatctttcaattgtcccttaaaaatcccagtcgggtttagccccactaggg

SEQ ID NO: 267504 - DNA, 464 bp, Homo sapiens
aattcaactttttcttgtctggacttttctctgctttttgggagcactcccagatcactattagttctttgtatgggtccaatggtgttattcaaggtttatgatatcgtgctaaacatgatgaaaaacatatgagaactgcaagagatcactttttactgcaatgtgcaatttactggagaaactgcttacgtggagatgattagtgtcatgagaaatttaagcagatatttacaatacttgagcaacaggaggcggctacaaaattattacagtagtacacaataaactctagttaattttatgcagttatgatttaataccacatctttacatttgtttacatttctcttaactgtcaatggcaccatgtttggtctgtaagtgtgtgtctaagttttgaaaatgttaactttttatactttgtgtatatttatggtaataaataaaaaaggccaatatct

SEQ ID NO: 267505 - DNA, 377 bp, Homo sapiens
gataagcaccccgagtgagacagattggaagacaaactaacacaccaaagttgctgagtacacacgactctttaaagatggcctcattcactactcaggctttattaacttcaaaaaagaaaaagaacaacaacaaaaaagtcgagcttggaggtttcagaaactccctaagaaattactagaaacccctcagtggaaaatgccaatgcatgcacacatgtctgacccagacccacatttcttgcagtacaagggctgatggagaaacatcagcagggaagacctgttggggagctggagggacaggacctcttgacaagcctagagtttactcagacgtcccaagttctgagatataaaccaagttttatccccag

SEQ ID NO: 267506 - DNA, 224 bp, Homo sapiens
tcttaatttataaaaaggaaaaatctaacaaaagaataaacagttaaaaaaagaaaattatagacattgcctttttatgaatgctttaatcaagttacagaaagctcctgtggaataatgcatataagattttttaacctcatttttctataaagtagtaaaggattcctgtttattcttaaataatcagaaacataaaggatgtggcttgttttgaagcatga

SEQ ID NO: 267507 - DNA, 224 bp, Homo sapiens
cctgccttggcctcccaaagtgctgggattacaggcatgagccaccgctcccggccaggacttcttaacatacagctgtcacttggcccagagcctgccagggatccttgtgtccctggctcctgtgcccagcttttgcgggttcacagctggactcctctggccttcggagagggctgcccttgccaccctctgcacctgccacccaacttcctcctcatccc

SEQ ID NO: 267508 - DNA, 426 bp, Homo sapiens
gctgatgtttgatggttaccttttggtatatatgtcatggcatgagaaagaatcactgctttagtctgtagaagctttgtcgtcctttgccatgccctggggagggagcaggaccatcctttgcacccatcagagcattcctagttcttttgttgccagatacgtaagagtggttgagtttacaggtgtctgcatctctctttagcagaaagatggggtttcaaatgtgttgcctctttccaattttgctatgcctatcagtagtcagatattttggggagaagggaaaaatccaaggtaaatgtgaggttcttacagtgaattacttttcaaaagaaatttctgctaccaaggggcatttgggaagtggctgtgtggagaagttttcattgtaatgcgaacatattgccaaaaaatattgtacat

SEQ ID NO: 267509 - DNA, 424 bp, Homo sapiens
tcttacttgcttcccatttaaatcagtgcaagagagaatatgaatttataatgctttacttgggatgcctgtggaatatgttgcttttctttatcatgtttcctaaaagtaaatttgcaaagaaagtaacatgctgcagacagtataaggcttcagccaagagcttcttttagatatgataatgaattgtggtaaagaggaaatgaaaatgaactagtgtgtaggattttgaaatttggtattttccagggagaaaaccgttacattttcctgtagtggttatgatgttgtgtcctgaacccatttggtactgaaacattctgcagaatgttatactatgagaagaaattgtgaagcccaaatgggaacaagagacagtgtagttgtatatgacagtaaatacagtacaagttcactatcaaaa

SEQ ID NO: 267510 - DNA, 370 bp, Homo sapiens
atcaaaacaatattcacatgatccaaatactgggataataatgtattacacacacacacacacaaacacgtatgtatgcatgtgtaacatatatgcagatacacattacatagctatatacacatagatggtttgtcttattttgtagaaatatataactttgtataaaaacaatgttttaaattgttggggaaatttcttaatatgtagcaaaagcataaccagcgttcaagtcaagcctgaagttaggaaatctttaattttataaatattcagctcttttataccattgtatgtgtgccccttccctgtctaatattctaaaagagaaattcatttctgtatattttctccagtattcagtcattca

SEQ ID NO: 267511 - DNA, 524 bp, Homo sapiens
ttcatagtatgccagaaattttattttattttgtttgttttagagacagtgtctcactttgttgctcaggctggagtacagtggtatgatcatagctcgctgtagcctcggactcctgtgctcaatggtcctcccatttcaacctcctgagtagctagggttacaggcatgcaccaccacatgtggctacatatttagtttttgtagagatagagtcttgctgtgtttgaccagactcatctccagctcctgtccttaagcgttcctcctgccttggcctctcaaaaggcaggtattgcaggcatgagccactgtgaccagcccaaaattttaaaaagaagcaaggaaaattaacaagcccaccttaaatttatttattcttagaaaattttcttcaaaaacatatacttaaatgtgacatggctatggctattcagtgcctgcaaaatagttcccttggaaacagtattaagaattcccatatgaatgtcactatcttcaaaacagctggggttgagttacct

SEQ ID NO: 267512 - DNA, 580 bp, Homo sapiens
agactgcgtcttctgttctagctctgctggccccagggctggagtccattaaagaatataaatcaaagagtgagaagccatccctgtagttggtcctatgatcacacatgctaagcaagcagtgtgtaattatgggaggacattaaaatgccagtggaagagatggatgagattcaaaacatgctttcttttctgggtcagtaaagtctgtttccttttttgccagaatacatgttcccttttattctatgaagaatagaaagtgtatctgagccatcagtaattttaaaagaaaggaagggaagaagggagcaaagggggcagaaagggagagaaaaaggaaggaaggaaggaaggaaacttccttttgataatcatctttcttgatggaaaaaataatgtacaaaatttaaaaataagagcaatttttggaaagtgattgttgattctggaaaagaaattctgaacagtgaagagatctttaaagataaacaaaactgaaacttaaatatagaggatctctatgaagcttgagagaaaaaaaaaagaaaaatgaacattagagacacctaactttcag

SEQ ID NO: 267513 - DNA, 122 bp, Homo sapiens
gggtggatgggtggatgggtggatggatggatggatggatggatggatggatggatggttcgttggacagatagataaataaaagcctgagcttcacagtggctaacagtactgaaccagaa

SEQ ID NO: 267514 - DNA, 423 bp, Homo sapiens
ggtcatggcaacagttttttggggatgctcaaggcattttgcttgttgactttctggaggaccaaagaatgatagcatcagcttatttgaaagtgttttgagaaagttaaccaaagctttactacaaaaatgccaaggaaagcttcaccagaatcctgctccatcatggcaatgtccctgctcattcctctcatcaaacaagggcaactttgtgagaattttcatgagaagtcattcagtatcattaagtatgctgatttgtctcctttgccttttttgtttcccaatcttaaaaatctatgaaggaggcggagcatctaggctgaggcaggagaatcgcttgaacccaggagacggaggttgcagtgagccaagattgtgccactgcactatagctaggtgacagagtgaaactcttatctt

SEQ ID NO: 267515 - DNA, 239 bp, Homo sapiens
gacaggaggcactgatgtggtcccaactggagaccagctgcagtcgaatgccatctggaagtgaaagcatgcaatgcacttcacagctggtccctgagggagggcaaggggatggctatgtgtgtacctgcctccatcagtgacaacctcccagcaagggaggtctgggtgagcaccaagagccgtcactgctactgtctgcttcccgtcgaacacaactggaagcattgatggcgggg

SEQ ID NO: 267516 - DNA, 391 bp, Homo sapiens
gttgaatggtttttatttttgtgtattaaacatgacagcccaatgaagaaaacttgtaagagttttatagggtacagtttaggtcacagaatgaagttcaacataacttgtttattttacattgattgtttaaccagtaattatccatatgacatcccaatgcaaatgctgacatccatttccaaaagagttgtttttttgtgctttttctaaggttacaaaggtttttgtggtttaaatgttgttacatattttacagcattaggatctatggaatattttgacaactgcaacagttcaatgaagttggtaatttcttcttttaattatttttcattgaacagctttggagttacatttctacattttgatttctggtatattataagga

SEQ ID NO: 267517 - DNA, 223 bp, Homo sapiens
gagaatgtcagtggttggttattttggttttcttttggttatttgtttagaagggtgagagacagggagtggctgcagaaaatgcatctaacagtaatactgaggtcgtagaagtaacctagccacattctttgtattgggagataacatggcttctgtgtggtaactggttatataacgtgagttctcaagtgtctgccgtgcctgtattaagtgtgctttc

SEQ ID NO: 267518 - DNA, 497 bp, Homo sapiens
agatattttgatgtgtttctgtactgtccgttcttaaatgatttttatgtagttcatttatgtctcctatgtattgtacgttttcagatactatttttttgactcaaattataatttgcacatcacttgaagttgtatttttaaaagactattattgctggacatttattactattgggttgttagttgttagaactcggttataaaaattcatatagaatatgaccaagtaatttagatctgtatgaggcaaaaagcaaaagtagacctattcattctacaagtggtttttacaccttccagatgtaaagggagtaacaaggcaagaaaatgggattacaggtgtgagccactgcacccagccccagatttcttaatgttaaatctagttcatgtaaattagtgccattttattatctaacagcattattcgactattacatactagtaaatggtgatagagtaggatccctgggttagcttgcattaaaaaaaaa

SEQ ID NO: 267519 - DNA, 450 bp, Homo sapiens
tggtgaaagtacatatttttgggtatgactatttggggaaatactttaaatatccttaaaccttattgggcgaaaatgaagtgggctcgtccgggatttgaacccgggacctctcacacccgaagcgagaatcatacccctagaccaacgagccacttagaaatggcttttgcttatatttactgtaggatttattcccaaattatttatttttattcctcaaagaatttgttaccaaataatatttatcactccatcaatcatttacataaatgaaagggttggaaaggctatttctgtggatggtctgctggtagcttaaattaccatactatggtaaaacttgtcacctgtagaaacatttctcctttattctactttgctatactactctaagtaatttaactcattttttccatttttagctttcaattaaaatattttagaaaa

SEQ ID NO: 267520 - DNA, 283 bp, Homo sapiens
ggcgtggagccttccggcaagtcaggccatctgactgagccccacgggtgcaccccttcgtaacctggtcatcacagctcacaggggagagccagagtctatgttcccaaggaggttttgaggggtgatgcgtgaatatgggagacacagtagaaggtgtgtgcccggggatggggtgcgggacggtctcagtgtttcagtagaggaagagggtactggaaagactcctgagttccctcccacgctctgtggctgcactgcggttctggggagactcttatcc

SEQ ID NO: 267521 - DNA, 442 bp, Homo sapiens
ccaaggaggtttccaagctccatgcctaggcacatgtctgggtgcttggtggccacacactgaattctcccttacagctggtacttatgcctgccattgatgttctgtaggcaattctgcttgttctagtacctcccatcttgcctcctatcccctagagactgagaagggagctcaaactactgtgcactctgtgaatcagcatattgcctgtaacaaagattatatacgcagccacagtggctgcagccaatacatatctatgagcaccatctactggcttgtaggtcaaactgcacagtccagtgaaaaacctgccaacagaagtgcatagagttaaagaagcaaagccaaaggacactacccagcattctctagtcacattccctagaaaggaagagaaaggggaaataaaggaaaaaataaaagcaatattatagtg

SEQ ID NO: 267522 - DNA, 294 bp, Homo sapiens
ggctgaggcacaagagtcacttgaacccaggaagcagaggttgcagtgagctgagatcacgccattgcattcccgcttgggtgacagagtgagaccctgtctcaaaaaacaaacaaaaccaacaaggcagagatgtggccagggcttctgaaggaatgcatgaagtccacccagcacccactccagttgtgtccctccatcctcccagactaccccctgcccctgcactcccagccatgccccctgtgtggggctctggtcctctcaccctctacctttgctggagaacataca

SEQ ID NO: 267523 - DNA, 830 bp, Homo sapiens
gcaggtcgttggcatttccatattagccttattgctcagagcttcataactttgaattttaagtcaataactttttgaaatgtcagacagaatttgacaggtttaatacctgttttctgaggaagaaaaaaaaattatatccatgctgtcttcaggcagagggaaagtgcatgttgtgattgagaaaggtcttatttttccttaaattaggacactcatctttaaaagatagttcacacatttgtatttttttaaactaaggaaatttaattagggctttacttttgactaagttatttttggctgctaacttttaaaattatggtaaatcaataatataatgtagtatgaatcagtgaacagtatgtatcgattgtaatgtgcgctaccagttgaaaccattttaacactagtagcttaatatcattaaaatgtttttcacgtaaaacagaaaaacgaccaaagccccaagttaaaggtttggttttttttcttttgtggtgtggtgattcagagttccttgcctcatatttcctttaactttgtcataatccatgattatctttaaattgttccattgagtcgagttagtcaatgttgaattcttaattctagctatattttttcattttaatgttcacttaatgggacattttatgtacaccaatcttgaagaatggctctcatagtatatttcagactaagcctcatttttgatatcacaatacatttgctttatttattatgagagtttttttattctaaagagactgtaacaatgcatttctcaaattaaaatactgtatacttgtccttctcgataactattt

SEQ ID NO: 267524 - DNA, 674 bp, Homo sapiens
cagcttgagtatatttaagcccagatctacacagtactcacagggcaggattcacacgtttaagcctagatctacacagtactcacagggcaggattcacacgtttaagcctagatctacacagtactcacagggcaggattcacacgtttaagcctagatctacacagtactcacagggcaggattcacacgtttaagcctagatctacacagtactcacagggcaggattcacacgtttaagcctagatctacacagtactcacagggcaggattcacacgtttaagcctagatctacacagtactcacagggcaggattcacacgtttaagcctagatctacacagtactcacagggcaggattcacacgtttaagcctagatctacacagtactcacagggcaggattcacacgtttaagcctagatctacacagtactcacagggcaggattcacacgtttaagcccagatctacacagtactcacagggcaggattcacacgtttaagcccagatctacacagtactcacagggcaggattcacacgtttaagcctagatctacacagtactcacagggcaggattcacacgtttaagcctagatctacacagtacttacagggcaggattcacacgtttaagcctagatctacacagtactcacagg

SEQ ID NO: 267525 - DNA, 472 bp, Homo sapiens
tagactcagttacccagtatgccttaattttttaatgtgtgatgtgcgaaataattatttgaccactggatggcagtaaacaaagacaactttgagcatgatgtattattttccctctctctttgttgggaatgtaaattaaactaacgaagtctcatattttccacatacattttttgaaaaatctaagaacaatgggaacctatcattaatatacaacaattctattctgtattatatcaataaattttaaatatacttaaaatatgttgaaataattcagataactgttttactactttgtactatttacgcatccagcttgcatgcgtgtgtaaagttcatgaaaatccaatttagaaatattgattgattgaaaataattttttgaacaaaatatggatacaggaccagttagttggccactctgacttgcaggacattcctaaagataagaaagaaggaaaagaga

SEQ ID NO: 267526 - DNA, 407 bp, Homo sapiens
gaaaattggaagctcatgagtttggccttatctggtttctgcctgcctgggaagccccctatcagattactttcctcatctgtctgcttctttcagtaacttggccctccaatgttcttttccaccttagtgctttccataatgtatattccttctctacctagaaatttcattttatctgctcagattcctaattatattcacactctttcttaacttaaatgttactttgcttaaagacattttccttggcccttcagactgtataaggacctctctgaagtattttcatagcatctcatagtgctatttcagagcatttattttattgtaaaaaattgtgtaatggtttgtgttatacctgatctgttttcctgtatcaaaaataaaattaggatgaatctaaa

SEQ ID NO: 267527 - DNA, 405 bp, Homo sapiens
gagtgttttcgttgcattagtggtcttggaacttaaatatgaatattttttctgatttcccttgagattaaattttgacaatgaaagaggtatgctcaaataacagacgtctgtgttcacactattattggaaaggaagttccattaaaggatgctcaattacctgcagattctttgaataggagcaagtatccataatatgtgatgttataggtttttaaatattctagaactctgaaaagtaatgtgtgtgtaaaggtagaaggaaaactggctttcagtttttgaaaaaatcacaaaccaacaccctaatgattgttgttaatatataaaatacaaataataggacaatattactagtttttatacttgagttatattattctgaagaatgtttttcaaaaa

SEQ ID NO: 267528 - DNA, 512 bp, Homo sapiens
cgtctcaaaaaaaaaaaaaaaatcctaactctgccctacttttccagccttatttctcgttcttccacgtggcctctagcaatctgacttgtgttctcttgtctgcagtgcagctcttttctccagtcctccagtttaagacctgatgctacctattctttccaatccagctgaacttcctcctgttccataaaatagaaaaagtgaattcttcccaacagaaagtaatctctgctctcaacctctaccacaccttatgtttccaggcacatcactttatgtattacagtatagaggaggtgtgtgttaagttgaagcttagtcatcattgtcagccacatgtagtcaaaaattggcctaggaaatcctttaaattgctaaaatagtacaattccctttacattgaacttggccagtttttccttccaacattggaacacatctctgttctattgaatgctagttgaaaaagctgacttatatttataggtgttacatgaaataaaaaagaa

SEQ ID NO: 267529 - DNA, 535 bp, Homo sapiens
ccccaccccaccccttccagaaacagatgacattcttctaccagggagacatgaggagctaacttaggaaatgggttttaataatgtgtaaatatcacgatttcagagtctaaggagcttctgtgtaaaatgatgagcttctgtttggatttagttagggattcaggggaagggcatgaaaagtgacttatgctactaataaacactctttaattaaacagtgatttaagtttatcttataatgaaacacatcaactagcatagcaaataatcacgtattatttaagtactttcttagaaatgatcatttctttattgtgtgcctcttaagagtgtttctggtcagtcacctttcctttcaaggtcttccttattcaaactaaggtggcttttaggtcaaggtcacagtcattacctggggatgcaaggggatgataattgctatgtgaacagccacaatgaactgttttgccataaaaaagctggagttgttcatttatttttaaataaaataagagttactgtgctattattg

SEQ ID NO: 267530 - DNA, 180 bp, Homo sapiens
gttttttatgattggatgtaatagtttcagaagcaataaggagaagatgagaaaaatgacacccagtgatggccacagggtcagatctgagcttaggtgtctctggttcaaagtctcctgaccactttactgcctcttctctctgttgccttggctgggcaggtgcagtctggggtacac

SEQ ID NO: 267531 - DNA, 345 bp, Homo sapiens
ctcaaaactgtgttgacagtataatccctttcatcaattataatatattgtacataaggtggaacattttcctaaattaatcactgagcttttcattcttaaaatttcccttttacatgtattaaaactagaccatgacatcctctgctcaagtcaagaaggatccagccaaaatgcagataatcaaatgtaaattcttgtatttcaaaaaccctcaaatcagattttggaagctcatagcatagataacattttgagattaaaaaaaatatcagagtaacaaaaatcactgtcctgaagaagacatgttaccaattgacagagccagactattatctttaaaaa

SEQ ID NO: 267532 - DNA, 655 bp, Homo sapiens
tgctgggattccaggcatgagccaccactcctgactttaattttatttttaattgtacttgtttatttacttagtgtcatatctgaatgacttactttttctgcctattttaaggtaacttttacgtaggctgcctctccaggaagaaaatgtatcctggattacaaaagaagagtgggaaataggggaatctaataaagctgtgttaatgagtatgactttgtacttttttagaagcagacttcaattgttttaatacggtttcatggatacgataaaaaatcaaatctggcaaaacccagtcgtaaatgaggcctccccaaaatcattgcagaaaatcatattattatatggttaatgaaatgaccagagtgagcctgtaccgctagcctgcaagaaattctggggtctagcggcatgatttaagtctgtcttggccctggccaccagttgctgtcaccttgtttaaacatggatggggacaattttgagtccagctactgggattaggacttctactttattaatgcatatatttctgtaaaatatatttctagaagtaggattagtagattggtattaagcatttccagtgccaagtattattaatacttgcaattttgaaattcaaaaagctctgaaaaatcaagttgtt

SEQ ID NO: 267533 - DNA, 165 bp, Homo sapiens
ccttggctctcctgacttcaggtggctgccagcactccttggctgcagtggcctcactgcaatctctgtctctgtagtcatgcaggggccaaggcaacacttccccttcaccctctgaaggcttgctagtaaataaactgacaaaaggcagattaattggaggaa

SEQ ID NO: 267534 - DNA, 280 bp, Homo sapiens
cagttgcttatttatttatgtctttggtgatttttaatagtctttaatttttaataattaatttctaatagtaaatattttacatatttatttgatctgagagtaatagtccaccaaacgtcctattaacttcttatactctactgtggtttcttgggggttgtaagaggataaaaatcatgcatatgggattgcagttgacaaatattaaaataattattcattctcgtttgtacagcagtgagtaaaaaataaaataaaataaaaagggcaataatta

SEQ ID NO: 267535 - DNA, 480 bp, Homo sapiens
ggaagcatccagggtcagtttaccatggcatctggtcaccaggcttcacacttgcaatcagcacctgctctcctccccttaaagacagttggcctttaagtccacctctgcctaaataggcttcccatgctgctgatgtttgctacagggcaggtgctttagctgacccccaaaaagcctcttaattacaaagcctgcatcaagtcacatgtgcctgaatcatccatcaaagtggccaaacgggacaattaatcagacttgaagaatgtaaaacatctccgtacagaatagagggtaagctgcaaacaacctcgccatgtagcagaaccaacaggatatattgataaaatgctcatagaaaacattctaaaagctgccccaggagaaaatggatggggaaaatgctactttcctcagaacctaataattctgaaggaaatggagcataaaacaagcatgcatgaaacatcaaaaaaagaa

SEQ ID NO: 267536 - DNA, 1107 bp, Homo sapiens
  misc_feature (729)..(729): n is a, c, g, or t
atggaacctgggcagccccgggagccccaggagccccgcgagcccgggccaggagcggagaccgctgcggccccggtctgggaggaagccaagattttctacgacaacctcgcgcccaagaagaaacccaaatcgcccaagcctcagaatgcagtcaccatcgctgtgtcctcccgagccttgtttcgcatggacgaggagcagcagatctacacggagcagggcgtggaggagtacgtgcgctaccagctggaacatgagaacgaacccttcagtcccgggccagccttcccttttgtgaaggctctggaggccgtgaacaggcggctgcgggagctgtaccctgatagtgaggacgtcttcgacatcgtcctcatgactaacaaccatgctcaagtgggtgtccgcctcatcaacagtatcaaccactatgacctgttcatcgagaggttctgcatgacaggtgggaacagcccgatctgctacctcaaggcctatcacaccaacctctacttgtcagccgatgcggaaaaagtgcgagaagccattgatgaggggatcgcagctgccaccatcttcagccccagcagggatgtggttgtgtcccagagtcagctgcgcgtggccttcgatggggacgccgtgctcttctcggacgagtcggagcgcatcgtcaaggcccacgggctggaccgattcttcgagcatgagaaggcccacgagaacaancctctggctcagggccccttaaagggctttctggaggcactgggtaggttgcagaagaagttctactccaaaggcctgcggctggagtgcccaattcgtacctacttggtgacagcacgcagtgcagccagttccggggcccgggctctcaagaccctgcgcagctggggcctggagacagatgaagccttgttccttgctggagcgcccaagggccctctccttgagaagatccgcccacacatcttctttgatgaccagatgttccatgtggctggggctcaggagatgggcactgtggccgcccatgtgccttatggtgtggcacagacaccccggcggactgcacctgcaaagcaggccccatctgcacagtag

SEQ ID NO: 267537 - DNA, 521 bp, Homo sapiens
tactttttaccacaggggttgtaaattcagattcctcttggccatacgggaaatcaacaggaataaagtgggcttggtgggtagtgttgccaagtggagagtcccatgggtgggtctggaggggcagctctacttccctactgtcactgcttgggaatgtgggctgagagctgctgccacgtcttccactttttaagagaagataaaaatccatgcttttagtgtagtatctcaattttaaaaagatgttgggaactaattcaattaaggcttgaaatatacactcaacaccaaaagaaatggctcaggctggatgtggttcttcagccccatttgcaacctgtgctctatatgttatgtttcatcagcaagtcctttcgacactccttcctatgaatgaactgtgaagaaaacagcatggttgaaaaaagttcaatcataaggtgatcaaaaatggtcaactccttattaaaaagaaaaaagagaaaaacagaaatctctctcatgctgtttatgttttt

SEQ ID NO: 267538 - DNA, 408 bp, Homo sapiens
cagtcagccattctcgcctcccaatgtctagtaaaacttgagttattataaatttaagagattatctcgcccaacttccttatataaatgaggaaactgaagtaccgttgttttcaggctcccctgtccagggctgtgtcccttctgccccttactcactggtgctgccgttcagccagctcctggtaaatgcctcttaagtggcaggcatggtacctgacactggtgataacgaagatgaatcagtaacagtcactacccatgtaagcttggtgtcatgggagaaatagacatctaagggtctaaattcctgccataagactgtaagcatttattaaacatgtgtttaatgactagatcttgaggagaaaaatgcgttagcccaagggagagcgtctgattttgctt

SEQ ID NO: 267539 - DNA, 482 bp, Homo sapiens
catatattcagttacatctcttagaaacattaaaaaaccatttggtccagtagtggtccatttattatttgtaaatatgttaacttgttaaaaaaaaaaaaaaaaaactcgatggaagtttagcttctaaatgttttctctgatgccttttcattgccccaggctttgggagaacatgcgcaggtgtgtctaggctctttagtgctggtctgggctacagataatgatgcttaaatcatacgtgaggcttggagtgagttgaacatggattagcctatctcatctagaaattgatttaaaccaagtggggactcaatccagggctctccctacctttctcccctcttaatcatttcctgccttagttcatgctgtgtaaggaataaacgagcaatcacaaacattcctgaaatgaggatacccgtaagaattaggttttaaaagtgatttcctcctcaggatgcggtctgcatgcaaaaaaa

SEQ ID NO: 267540 - DNA, 369 bp, Homo sapiens
ttaaaacacaaacacattgtacagctgtacaaaaatattttcttcatatatccttattccataagcctatttctactttaatttttattttattattttctaattttacttctaaaactcttttgttaaaaattgagacacaggctggggacagtggctcatgcctgtaatctcaccactttgggaggctgaggcaagaagattgcttgagcccagaagtttgagaccagcttggtcaaaatagtgagaccctgtctctaccaaaaatacaaaaattagctggatgtggtggcctgagcctgggaggttgaggctgcagtgagccatgatggcgctactttgctgagtgatggaacaagaccctgcctc

SEQ ID NO: 267541 - DNA, 482 bp, Homo sapiens
gaagaactgttgagatgggaccaagcactggacctgcaaactggcctggcataagcagctcaaagggcctggactgactctgattggcacactaagttcagatgggtgcatcacacatcccccagctcccagaatccctcctcagagaaacatgggagcagcagagaactggggggcagacaggtcccagagccttctgaggcacaattcacatccacagggagcatttgcaatgttctttaataagaatatccactgccccctaaccgggtgcctaccttgtgcctagcactgagctttttgtgcatagtaatctcattgaaagctcacatcaactaaaagatgggggctgtcctcacatttttaggtacaaagaaaccaagactctggaagggcaaatgctgaggtctcctaactggtgtgtggtagctcatggcttccattgctacacagtgcaaatcagctgtgtgaggaaaaaaaaa

SEQ ID NO: 267542 - DNA, 386 bp, Homo sapiens
tccctcactttttccactctggccacactggcatcctggcacattcccaccccagggcctttgcacttactgttccaactccctggagtgccctcactcccacaccaagtcccttgcttccttcacagctttgctgaaatctcacttgctcagtgaggccttccctgaccaccctgcaaccaattccccctccctctgcaacattgctggcttttttctcacagcatttatcatttcctaacatactatgtaatttgcttgtttattatatcgtttctgtctttccctatatggtttcctttgttcactgatgtgcccaagtgccctgttcctgacacatagtaggcactcaataaatattcattaaaggaatgaatgaatgaaga

SEQ ID NO: 267543 - DNA, 834 bp, Homo sapiens
tgggctcctttcctaacatcctctctttcagtttcataaatggctgaatcacttctgtgggctgccttgagagccatgcagtccattctggtggtttcgatatgtgtttgtgcaggatacaagtgccagaccagtcactgttgagatttccccattgcactccgtcagttctgtctttaaaaagcgctagcaggccgggcacggtggctcacacctgtcatcccagtactttgggaggccaaggcaggtggatcacaaggtcaggagtttgagaccagcctggccaatgtggtgaaaccctgtctttactaaaaatacaaaaattagctggccatggtggcgggcgcctgtagtcccagctactcgggaggttgaggcaggagagtcgcttgaaccgggaggtggaggttgcagtgagccgagatcgcgccactgcactccagcctggtgacagagcaagataccgtctcaaaaaaaaaaaaaaaaaaaagcgctagcaaaatccacagcacatcaagtccagtatgtactgactggagtcaggcagcctctgcacagtgcttgccttcttactgagtgttggcgcctatggggaggcatgcgctctgacctagtgtgacagcagcagctccagagcctctgaattggtgacatagaagtggaaagttcacagcatgtgtgcatcctgaaacaggcgttctttcctaagtgacccagtgttgggaagaagctttacccgccagtagttgggaagagttacatatatcttataacttgacatgagtacaatctattaaatttaataaacacctgcccatgtttgatgaggtttca

SEQ ID NO: 267544 - DNA, 974 bp, Homo sapiens
ctgtaatcccagctacttgggaagctgaggcaggagaatcgcttgaacccgggaggcggaggttgcagtgagccaagatcatgccactacactccagcctgggtgacagatcgagactctgttattaaggaaaaaaaaagtttagtagaaactgaacatataatccatgttattgacaaggctactaaaaaaacacttgttttgtgtattttgggccccggaaatctacttgttgtgggtacaaggacagtgaatttagttgacagacttccatggtgacagtgatcctggttaaaggctaaggatctgggggcgattcaagattagaatcaggctctctgtgagtgagttgtatcagggctgaacaatgatcaaatcagagtcagtggctgccccacactgtagaggccaggcatcaaattcaagaagtcacttccagagaccagaaaaggctgggggaccaactgtgcatctgtctctaatggcaaagtgggcacttccaggccaagcccagctctggcttttctagcccaaatcaacgcagatgctgcacaaagactgaaggagctgctctgacaaggaagttcaggaggcttttctcaggaatatccatcatctacacagaaagcttttgcgcagggcagcccagggctgagtgcccagcaggcgggaaaatccaaatcatgagagtgtgatgctggcccttcttctccaactgctgtgtgcacatgtgtacgcatgtatgcatgtgcaggcatggtgtgtgcatgtgtgtgcgtgtgtacatgtgtacacgtgacatgagcataaacacatactccgtcactcgcctgcttctccctcgctgtgttcagattgccgggaaatgaccccgtggactttatattcctcaatgtaagcatttcagagcacaatggccaactatctgagtatcagactctgcaattttcttccctggttttttctttaaaaaa

SEQ ID NO: 267545 - DNA, 401 bp, Homo sapiens
ttgatgaagttgctatccatcatcctgaacttaaagttttgatttttccaagcaaggaacaattattacagttgtatgtaaaaattgaaagacttgaaaactctattatatataattgcacagaatccttgcattaaatttaggacaaggaagaaacagaatagtctattaatttattttcatagttccaggaagggataagagagtgaggaccataaacaaccagaatctgataaaatatccttaactttagcctcctgccatgagttagtatgttggaacagtgaatggcagagaaacacactaaggcaaggccaagtgagaacaagaaaatgtctgcaattcactttttcagtaagtactaccatgtgccaggttctagttatgtcaaaggacagaag

SEQ ID NO: 267546 - DNA, 409 bp, Homo sapiens
cgcgtctggagttcttccttctggtggttcgtgatctcgctggctcaggagtgaagctgcagaccttcacggagattgtaaaatcaggaagtatatctaagtcacctccagtagccgtaactctaccttgtccagtaaaagtgctgcttgttgctgacgtttctgcccaaacatcatgaaatgtggagaagaaagaacactcagatgtgccctggagactttccttttatttttaaacagtttttttttccattgggtttgaccaactctatattcgacttgaacaaatccgaaggaaagcttccaattatggggaacaagtcctctgaagtggctaaattcccacacacacaaaagaaaaggtagggtggtgggggggagaaaaacagccagcaaaaggaaaaaaaaa

SEQ ID NO: 267547 - DNA, 572 bp, Homo sapiens
cgcgtctggagttcttccttctggtggttcgtgatctcgctggctcaggagtgaagctgcagaccttcacggagattgtaaaatcaggaagtatatctaagtcacctccagtagccgtaactctaccttgtccagtaaaagtgctgcttgttgctgacgtttctgcccaaacatcatgaaatgtggagaagaaagaacactcagatgtgccctggagactttccttttatttttaaacagtttttttttccattgggtttgaccaactctatattcgacttgaacaaatccgaaggaaagcttccaattatggggaacaagtcctctgaagtggctaaattcccacacacacaaaagaaaagatgagtctatgcccaggaccaccagataattgagtcctgtacaaaagcttctgactaaacaatgtgctctggctcaggactatacagagaaaagacacagtttttaaattgatcgttcaaaaggaaacatatttatgatatttgctccatgatatgtatctctcatctgttagctcaggcagaattaaaatgctagacaataatgttcca

SEQ ID NO: 267548 - DNA, 415 bp, Homo sapiens
agaagactgcaaataacattgtttagatagcagggaaaccttcatagaggagacagaatttgggctggttgaaaagcaagtaagagaacactaggttaaaagaagaacaggaaggacattcttaaaagaggaaaggcatcatgtgtctggaaattcctagtgaagaaatgaacttggatgaatggaggtgctcgtgctgtagaaaatagctgtagagagggacagaggccagtgtgcaaagggctttattatatgctagggaatttggacattattctgtggatcataggtacacattggtagttttgaagggtacgagtaacataattagagtgatataatttaataggaccactgtaacataaaaactaacacatcactagacacaagcatcactagataattaattttctct

SEQ ID NO: 267549 - DNA, 287 bp, Homo sapiens
gctgtgtgctgcctggggcgtgaagtggtccaaaagccatcggtgggatttgcatggacagaaggaaaggtggggggtctgagcaaagcccaggaggtgcctccgaaccaggggaccctgagcgctggggcagtggctttctgtgagggaaggtggccaggaccctgagtgaagaggactgggtgcctgttggcagcagctggcttctgctcgcccagccagctctgcaaaccctccgcatctcagagcctatcaagaatctctctaataacacagcaaacattaat

SEQ ID NO: 267550 - DNA, 2047 bp, Homo sapiens
agtctggggaaataggcacatggacagattatatgaaggtatttcattagctttcttctctttatggcagcttcagattgatgaatttgaggtacaaatgagtgagtgacatatgtatattttcctctgattttatgactgatttacaaattaggagtgcaaatgggctgttccccgatagcatcttctgggaagaatccaaccaagatacaaagcagatgatggtggatcggcaaactcttttctatgaaaagaaaaaccagatataccagggactggaaagcacctgcttgaaaattgatatgagcatgtctgaatttttcccttataagagcctgagtattgtaacaggtctcttgcacagggggttgaaaaataaaaaaagaagttaacataattaaaatgcttggacaaaacatttgctttatatagattcttacaagtaatatttgattaggtatcaaaataggtttaggcaggtggaagttctgaatttcaaggcaaataaggcatgaagggtggaacattgcatctagggaaaataagagaaataagtgaaagtctgaccctacattgccaattctcagaccaagtacaaagtattaggaattttttatatcagctgacatcttgtgcttacagtaaagccatatagatgcacacatagtgactttattaaatcaaatgagttgtgcagagcagagcaaatctattaggctttctcttttagagttttctaattttactcttattagctccctcagttgtcatcaattacatattcctacatcagatattttacactatcagattctttgattaaaaaatcatcttcagctttacattattaatctctgaggacataaaatcaaataactttctagtccatgatcattaatccctactattttagatatttccataaaaggcttaaagggaaaaaaaaatggtaggtagttcagaaaaaaatggctgggcacggtggctcacgcctgtaatcccagcactttgggaggccggggtgggcggatcatttgaggtcaggagtttgagaccagcctggccaacatggtgaaaccctgtgtctactaaaaatacaaaaaaaattggctgagtgtggtggtgtgcgcctgtaatcccagctactaaggcaggagaatggcttgaacccaggaggtggaggtcgcagtgagctgagatcgcgccagtgcgctccagcctgggcaacagagtgagactctgtctaaaaaaaaaaaaaaaagaaaagaaaaaagaaaaattgaagaacataacttttctacttatgaaatagataattttttaaaattgtttaaactcctggaaattaagtgttattttttattactgcagttgagagataccttttcagaggaaaacaagaggctaaattccatgttaagagctaagtagtatttttttcttaacaattttgccaaaatttcttctactggaccaaaaggaaataaatctacaataaatctactttctaaatattatttaagatgggaaatgtcttttataggtatattctgtataatacccttaattagatgaattatcccttatcattccaaaaatgaaatgctgtgttaaatatctccagggcaaagtggtatgttgactgggacaaacgttagaaattgtattgttcattgcacttgttgccctgttccccaagcttgtcaatgtttagagatactattcgggttgctaaagccattattcatagaaaatttctgcccctacagaagtgtgtgcatgggccttggaaaatctacatgtgtatatctgagtagcgaagcacagattcactctaattgaaagcagcagtttggttttgtaaatgtaattgcaattgacactttcttttccctttcagttattattttttttaaaggacgttatgagaaggcactatgaaaagcctaattggaatagcattatgaaccatgtaatgcatgcccatgcacactgtgatttgcaaacatatgtccgctcttcaataaatgttacggctttcacagcg

SEQ ID NO: 267551 - DNA, 430 bp, Homo sapiens
agtaatagtctatcacgtctctgtatgtacatgtgtgcgtgtgtatatgtgtatgtgtatatatataacaatgtatccattcgtctaccaatggacacttaggttgtttccatgtcttggctattgtgaataatgctgccaatgaacatgggagtgcagatgcctctttgacatactgatttcatttctttcagatatatacccagaaatgggcttgctggattatatggcagttctattattaatttgtggaggaatctccgtaatgttttccataatggcttctaccaacagcgtacaaaggttcccttttgcccatatccttgccaacacgtattatctgctgtctttttgataatagccatcttaacaggcatgaagttatatctccttgttgttttaataaaatcacattgttgtacaaccaatt

SEQ ID NO: 267552 - DNA, 282 bp, Homo sapiens
caccattttactctttctgtgagttcatctttttaaaatttgacatatatatacccagaaatgggcttgctggattatatggcagttctattattaatttgtggaggaatctccgtaatgttttccataatggcttctaccaacagcgtacaaaggttcccttttgcccatatccttgccaacacgtattatctgctgtctttttgataatagccatcttaacaggcatgaagttatatctccttgttgttttaataaaatcacattgttgtacaaccaatt

SEQ ID NO: 267553 - DNA, 342 bp, Homo sapiens
tttttttttacataatttgtaatatttattaataaataaggagttatatataatcaattcaccgatggcacttttatcacagactaaattcttattaagttgttctgcctcgggcctttctgttttgttgcattaatgggtctaacgatccataaaacagtaccacactttgaattcttaaaatttaaaatatatctttaaatctgcccaagaaaatgcttcttcctttctgtgctccacacctgctctactgctggagtcattgctgccaccgttacctgattctcctctctttgagaaagaagtaagattcacaaccaaatccctttggttggggagtgc

SEQ ID NO: 267554 - DNA, 256 bp, Homo sapiens
ccagggcttgacggggtagacactgaacatgcagctgaccccagaagctcctctccggaacgcctgcagttaggcagcgccctcctaggccactctccaccctggacttcctctccgcggtggtgtttgtttcaatgctgccgtaatgaaactgcagtttggtgagggaaggccaagttacagctgtaatcaggatcatttcattccaagtaatacgttttctttctcagactaaatttgggttggttaaagctaa

SEQ ID NO: 267555 - DNA, 417 bp, Homo sapiens
ctgctctgatttatgaacacttgaactttgcctggtgtggtggttgggagtgggcgttttaaagatgatgttaactattggaaagttcatagaaatggtaccaagccaagtgccagtggctcacgcctgtaatcccagcactttggaaggcctagactggaggatcgcatgagcacaggagttcgagaccagcctgggctgttagtgagaccctgtctctacaaaatacatacatacatatatacatacatacatacaaaaaattagacaagtgtggtcgtgcgtgcctgtagtcccagctactcaggagcctgaggcaggaggatcacttgaccctaggagaggtcaaggcttcagtgagctgtgttctcactgctgtactccagcctggtcaacagagtgagaccctatctcaga

SEQ ID NO: 267556 - DNA, 430 bp, Homo sapiens
atggatgtaaaaggaagaaggtattttgtagggtagttgtaagttcctgaatgtgtggaatgatttatgtgcaaacattgtcttgcctaatggaaatagtcataattgcctagttttcattagtctgaaaaatgtcttaaagaagtattgggctcatcttaaatcaagagcaacagaagtctcttcatcagctgctgttagaacatgagtctgcgcagccatagagtagggatctgcagaccctgcaagaacagttcctgtcactggccactgtcagtggtcattaataattataacaatgtaagaaaacaagataatatagaagagtcaaactttgaactttaaacaaaacatgtttgctacattttaacagtcataaatagggcaatgggggggcggggcataagttttagaatatgttttatgtcat

SEQ ID NO: 267557 - DNA, 364 bp, Homo sapiens
tttttttttattttgagctggagtctcgctctgtcgcccaggctgcagtgcagtggtgcgatctcagctcactgcaagctctgcctcccaggttcatgccattctcttgcctcagcctccagagtagctgggactacaggcgcccgccaccacgcccggctaattttttgtatttttaatagagatggggtttcaccgtgttagccaggatgctctcgatctcctgacgttgtgatccgcctgcctcggtctcccaaagtgccaggattacaggcgtgagccaccgcacccggcctgactgatgcttttaacacttagtaataccaagaactgacgactgcttctatgacagaaaagaaaatcg

SEQ ID NO: 267558 - DNA, 437 bp, Homo sapiens
aactgactccccctccggttaccctagtaatttttgttgatcatttatatcaccctttatgacaaggacatctgaggtgaacatccatagtatcatacaaatttctcagctgcctcctccaaaactggcatcagcagaagagcaaatctgcatgagctcatgaatggctgctgtggaaaattactgacgtcaccagctgaataacaggctatctggagagtaagcagatgaaactgatgttaaattatcaaatgtacaagattttgggctcctgccaaaaccttcattgagaactaagaagagaaaaactgaaaacacacagagctttttttaagcttctgagccagcaggctgttcctacatccactccaggcatagaaagatggctgtaaaataaaagagatgattatctcctcccttcccttctcaatatttca

SEQ ID NO: 267559 - DNA, 118 bp, Homo sapiens
ggagaacaggcgctgaagagagacagatggagaaaggaagctaaagccagatgggctgaatgcctgtgtgtgaacgtatgtacacatgtgtaagcatgtgtacacatgtataaggcct

SEQ ID NO: 267560 - DNA, 492 bp, Homo sapiens
cagttctgctgccagaaggctttctccaaggtgactgaatttctggaactgacagatggagcctgagggaccttggtaatactgtgtcagctcccgtggccagtcagggagagcagagtcttcagggctgtatctccgcaccctgcccaccatcttccctctgacgcagaccaagcctgcagaccagtgagaggagaagaaatgaagtcagctgacccacagttggcactgccaggactggatgctgctggctgttggccaggatctgatccactcctttgagagtgtcaggagctgtggaaggtatggggtggggggcggggttcctcccaaggcaaagttcctgtggaggtcagatgagactgagcttgagaactgagttatgaaaaaaacctcaaggaacatccttcacctgccctctatggctccttagcttcttgaggttctgctgctcagagcctagtgtgataaataacctctttctctttaaaa

SEQ ID NO: 267561 - DNA, 392 bp, Homo sapiens
agataaggcatttgcaattggcagtgtttcaaaggactccagatttctccaaagaacctagatttcccaggtactgaacatgtgcaaaatagaaacaaacattcaagatgagtgagtgatgagttctgcctgtggtcagaagaaaacaacactcccaactctgcaacctgatcacttccctacttagtcctgtttgtggagccgccttattaacgacattagaacaaagatatgaaggtgatgtacaatcattactagtttttaaccaaagattttggtcacaataaggaccaatagctgtttctttggacctctgagcccatctctgctggaaaggtatttgatacattttagcatgcaggaaacaataaacatttacatttattttaaaa

SEQ ID NO: 267562 - DNA, 1234 bp, Homo sapiens
aatatttacaatcctatcccagtgtctaagacctgcaaaaggataaataaaattgcttgtaccatctatgtttattttgttcccaatcacaaaggaaatatttgaacattccattgttaagtgttataatttcaatagaacttttgaaaacaaatgttatcagttaaactagattctcttttaatttcgggttgttaaaatgtatgactttttaagaaaataaaattaaatatgcttataatattgttaagttatttgttgtggtgtatcatattaattgatacctttacatgaggccattattgcttcccagggtttcttagaataaacattggctgtgatgtcttacattttaatgcattgcttatttctgcatggaacttttttaagttttccttcaatattttcataaattacattggtgtttaatttactttccctttactatccttgtcaggttataatatcagagtcataatagcataataaaataaaatagagtatgttctttcctgtttcatgctcagaaagaattgtatgtaagattggaattattgttttgtttcatgtttgaaacaacttgccagtaaagtcatcatggcttgaaattatctttatgatatgatttctgactactgattacatgcatttgttgtagcacaattcagatttttcttttcactttaggttacttttggaaaaatgcatgtttcaagtaattgtacacattttacatatatttccaaatttattgaattaaacgttttcatactacactaatttaccttcttgatatttgtattatttataacaaaactcaataaactgtggcaaataagccagacagtatttataaataaagtattactggaacactgtcatgctcattcattgacatactgtcaatttatgccacaacaatagaattgattagttgcaacaaaccatatagcccaaaaacctaaaataattaccaacagatcctttccaaaaaacaaaaaaaattcttgacacctgatgtataattatttcctattttgattcctgagatggcatacttgtttcttctcttaattttatcaagccatttctccagagttttgttattgtatggctcctacaacaactaacaaacttttggccatatttcttgacttttctttccctgtattcttaatcactatgcatgtatttattatttccttttatttctgttgatatttctaacttctac

SEQ ID NO: 267563 - DNA, 523 bp, Homo sapiens
cagttgagacatttatctcctcactctggaccactatatgtattgcttctggctagttccctgtctccaggttcttctgcctcgttttccggctcccatttgcaaaggaggtttatgtacaatgctgctttaggggaaagggcactgacttcgttatcatgcacacttgggtataaatcccactctgccatttaccgggggtatctgggtgagtggcatcacttttcagggccttgtttatttgtgaaatgggaatgacaatacctaaactgcagagttgtaactattagaaaaaaatgtatgcaaagggtttagtgtggggcctggcccttagttggtgctcaataaatattcttagttgtggtagaagtagtatttcactaaacacacacacacccccagaacaaaacaatgattcatcattgctcacaggcagaagtccagattcctaagctttctgttctctctcctaacctaccatcctatccttattttccttttttaaaaaatcataaattctttg

SEQ ID NO: 267564 - DNA, 304 bp, Homo sapiens
caggagcccaagatcacggtgtcggcagagcccgttccttctgagctctgggtgggggaatctgtgttgctggtggctgctgacagtctttggtgttccttggcttgtaggcacagaactccagtccctgtcttcgttgtcacgtggccttccccttgtgtgctgtctgtctctgtgtccaaatttccctcctttataagggtacctgtcatattgcattagggcccatctcaatgacctcatttcaacttgattatctctgtaaagacaatttccaaataaagtcacaatctgagctactttg

SEQ ID NO: 267565 - DNA, 1022 bp, Homo sapiens
  misc_feature (974)..(975): n is a, c, g, or t
  misc_feature (985)..(985): n is a, c, g, or t
  misc_feature (1005)..(1007): n is a, c, g, or t
tcagctttgatgacaaaactcagcagaagctttcttacagactaagagcactttataaaacactgcttaaagctgaaggaaaccctctgaatgaccacccttgaatacctcctttactaagacccatgattatctgggagttagaatccataataatagctgccactgtgcacagtgattgtgtgctgggtgctttacatctattttctcatttaattctcctaacaactctatgatagcagtcacgctatgatacaggtcacactggtattgtttcacaaatgaataaacgggcctagaaaattcaactagatttccctaggttagcagtggagttggacttcaaacctaggtctgtgtagctcacaaatgaacacttattatgcttataccattttgcctcattagaataataggaagtccttccttttttggtgaggaagaaatttagagattggttaccctgactggtgatacagagcaaagctatgtacaaattgcatcaaagggtggcagatccctacattcccatctaacatcacatcattcctaacctttttccatgtggataagcatgaccttagtcaagtcatttcttagtaagatagattgttggttgctcgtgactctcagtgaagacccagtaatgccaagaatcatggcagacagttagggggaatatgtatcttcaactatggggcagtatggcaaagatattgagggccaggaatttgactacttttgaggagcgatgacaactgagtacaggaagtgagaggaagggagcatgtaccgtgtatcatttaatcaaccttgagcttgagaccaaagggaacataccctaagtttaactaggatgggtttatccagatataatggcatcacatcgtaaattgaaaagtgtctgtgtgtaattctctctgtcttatttcttcgagaaggagtttcgctcttgttgcccaggctgagatcannccactgcacnccagcctgggtgacagagcnnnactccgtgtcaaaat

SEQ ID NO: 267566 - DNA, 1158 bp, Homo sapiens
  misc_feature (1110)..(1111): n is a, c, g, or t
  misc_feature (1121)..(1121): n is a, c, g, or t
  misc_feature (1141)..(1143): n is a, c, g, or t
tcagctttgatgacaaaactcagcagaagctttcttacagactaagagcactttataaaacactgcttaaagctgaaggaaaccctctgaatgaccacccttgaatacctcctttactaagacccatgattatctgggagttagaatccataataatagctgccactgtgcacagtgattgtgtgctgggtgctttacatctattttctcatttaattctcctaacaactctatgatagcagtcacgctatgatacaggtcacactggtattgtttcacaaatgaataaacgggcctagaaaattcaactagatttccctaggttagcagtggagttggacttcaaacctaggtctgtgtagctcacaaatgaacacttattatgcttataccattttgcctcattagaataataggaagtccttccttttttggtgaggaagaaatttagagattggttaccctgactggtgatacagagcaaagctatgtacaaattgcatcaaagggtggcagatccctacattcccatctaacatcacatcattcctaacctttttccatgtggataagcatgaccttagtcaagtcatttcttagtaagatagattgttggttgctcgtgactctcagtgaagacccagtaatgccaagaatcatggcagacagttagggggaatatgtatcttcaactatggggcagtatggcaaagatattgagggccaggaatttgactacttttgaggagcgatgacaactgagtacaggaagtgagaggaagggagcatgtaccgtgtatcatttaatcaaccttgagcttgagaccaaagggaacataccctaagtttaactaggatgggtttatccagatataatggcatcacatcgtaaattgaaaagtgtctgtgtgtaattctctctgtcttatttcttcgagaaggagtttcgctcttgttgcccaggctgcagtgcaatggtgtgatctcggctcactgcaatctccgctacccgggttcaagtgtttctcctgcttcagcctcccagctattagggaggctgaggcaggaaaatcacttgaacctgggaggtggaggttgcagtgagatcannccactgcacnccagcctgggtgacagagcnnnactccgtgtcaaaat

SEQ ID NO: 267567 - DNA, 263 bp, Homo sapiens
gttttattaaaactaagataagaccaagattgtttgctaaaattgccaaattattttgaatttcagtggaattgattagaagtacagattgttggtattataattttcatgttaggattgtgtgtttttaatgaatattctaggtaactttctcatcagacagttttaggaaacagtggtttaaagaatatacatgcaaacaattagagtgaagttataaccaaatgaaattgtcattagccaataaaaagcgctttaaccca

SEQ ID NO: 267568 - DNA, 401 bp, Homo sapiens
gatgtgttcctctcgacctccagctgcttgtgaatctctgcccgcaagggtctcagggtttttacaggtacaggatggggtgtggcaagccaggttggtcttaggaaatgcaacatttaggaacaaaaacagaaatgcctgtcctcacctaggtccatgggcacaggcccatgggagccctcacgagggacctgcctttctctacccatgctcccctcctgtgtcatctcccccctctgaagaggtacatctaactgctgttaaaatatggatgatgactagtcttaagctacttcctggtgacagggggtgttgttttggggagaacagcagtgagattcctcccaggggtctatctaagggtttctagcaaacaggagctatcatccaaggctccaatt

SEQ ID NO: 267569 - DNA, 433 bp, Homo sapiens
cagaacccacacaaaatctgtcttaactcaactcttagctggttcccaaaaacgtccatggcccctgtattaccacctgcatacggagaaataggaataatatttaaataaggggaataaccaattgcattaataaaccttacttctgaaaactttgtgtggccatggtgggggcattgcagggcccctgctcaggtcgtgtagggtcccatgaagagggaagccctaaggctactctcctcagggctctctccagcaacctcgtgactgctctttctcctctacctactgtggacgtctaagcagtgaccaactctctgccgaacatgggtgctcacacaagctgaatgaatgaatgaatgagtagtacagagcctagcagaagaattaagagtgcactcaattgaagtaaaattatttgccacttcccaaa

SEQ ID NO: 267570 - DNA, 343 bp, Homo sapiens
cactgcgcagtgacacacacagacagccaggattattctttatttgatttttattacctggaaccttagcgagttcagttcttagactctaggggataaagaaatgatttcccttgaagggagaatgagagaccccagtgctcaggaagagttgttgcagagcctgaaaactgtttgccagagccttggctcttctgggtctgagtgcctgaaagaatctggggcggcccaggccaggggagaaggctacgctaggctatgagcctacagaatggttttttgggggtcctccttcgactctcatgcctcaagagaccaagaggaaagctgggagggcactgac

SEQ ID NO: 267571 - DNA, 315 bp, Homo sapiens
tatccaattagatgaagtatatgaaaataacttctaagttctagatgtgtgtattattaagctgagatcattcattcagcaaacttttatatttaacatatcgaattaaaactagttgtacatatttattttttaccactatgagaaaatcatatccagtactggaatctgattttattcatattgttatctttagtgcttcacacaacacaatgtccatagttggtactcaaaaatatttgtagaagataaaaaggagaaaccaggagggtaagatgatgattggggctattggaagttaattgaggatgatga

SEQ ID NO: 267572 - DNA, 487 bp, Homo sapiens
cacgcatttccctccaccttcactgctccatctcggccaagtcaccacgcctttcagggaactcaggagcaacaagcccccagtgcgggacgagccaccccaaagcccctcgagaagttttctctaaccacagccccgaaaagccccgccactacgaccactggcacccctgcttatttcctccagaccctcctcggccgtcccaccccatcaagccctcctttcgctcgcatctccaccctccctgcacactgcctaacccagaaaatggccaagcaggtaagccctgtcaactcacttctcctcgggactcgggtgtccctgacttccacgtgttcacgagaagctcgtcagagaccctgacctctcccgggagcacaacacagactcgaactggctaactcgggctgacgccggttcagctgactcccatcctggcaagaggcttccggagtgttccagcgcctcccaggcctgctgcggccgc

SEQ ID NO: 267573 - DNA, 436 bp, Homo sapiens
ccaatttatctgaatccttgacaccatttattactgtccattttctttattatagccatcttagtggaaatgaagtgggatctcattgtggtttggtttgcatttccctaatggtctataatattgatatggtttggctctgtgtccccacccaaatctcatctcaaattgtaatccccacatgtcaagtgagggacttggtgggaggtgtttggatcatgggggtggtttccccaatgctgttctcttgatagtgagtgagttctcacaagagctgatggttttaaagtgtggcacttcctcgctctctctctcctgctgccatatgaagaaggtacttgcttctccattcaccttctaccatgattgtaagtttcctgaggcctccccagccatgcaaaactgtgagtcaattaaacctttttctttataaact

SEQ ID NO: 267574 - DNA, 434 bp, Homo sapiens
tatcccactgcacactctgtcacccaggctggtgtgcagtggcgtgatctcagctcactgcagcctcaacctccagggctcaagggatccttctacctcagcctcctgaatagctggactgcagatatgcatcactacacccaggtttcaccatgttggccaggctggtctcgaactcctgacctcgggtgatccacccgaggcctgacaaagtgctggaattacaggagtgagccactgcatccagcctagcacactgaacttttaagagtacttgggaaacttagtatgtttaacacctcccaaaagaatgttaaaatgaccacagtttgcaaaattgaagagaaaacaatggcaacataaggcacaatattggtaatcaagaagaaactatagccatggatatggaagacattaaaataattataatgaat

SEQ ID NO: 267575 - DNA, 224 bp, Homo sapiens
ctaacacccatgtatcataaagactgcctcatacactaacattcaactattcaactgagagggggctcaaggggctttctgagtacctataatgttctatttcttgatctgggtgatggctatacagggttgcttgtgtgtgtaaattaaactgtaagcttataatttgagccttcttctgtatgtatgtcacctctattaaaagctgtatttataaaaactcc

SEQ ID NO: 267576 - DNA, 711 bp, Homo sapiens
gattaggattgatgttagctgtggggcacttaaagtgattgtattgtaaatcttagtttattctagcagtggcatcttgcagaatgtgtctggggttaggataaagttttagtctgtcttgggcaaagtgtagaagaacaagaagaaaggaagtaatttctgaatattaaattaagtgtatctattcccaaaatgcacttgctgagatgggtggtgtggaggcttgcttctggtcacaggaaaggggaagtcgggtcttctttatttttcaggagtttacccactgcagttgaattctgaccctttgtacatctttgcctttctcctccctccatttcactttccctcatcacaaaacaagggcaatgatgaatatttgcaagaatagaagctagtgggaaaacagaaatatatcaaattatattgaaacaaagtattttctgttggctgaggtaaggcagaaccaggaaaaaaaaaaaggttctctttttctaaaaaggcttaaaaaaaaacgttgaacctgtaaagcttttgagttttatttaagcgctgtatgcctttatttttaaaagtttgaattaatttcaatatgaaactcattttgccttgcaacggatcaaagtttagatgagaattttcggagttcagtaaagcccctctggttcctaatattctgaaagtacagtttctacaaagaaatgtaactacttt

SEQ ID NO: 267577 - DNA, 630 bp, Homo sapiens
gcctactactactactaaattcgcggccgcgtctgtcttgggcaaagtgtagaagaacaagaagaaaggaagtaatttctgaatattaaattaagtgtatctattcccaaaatgcacttgctgagatgggtggtgtggaggcttgcttctggtcacaggaaaggggaagtcgggtcttctttatttttcaggagtttacccactgcagttgaattctgaccctttgtacatctttgcctttctcctccctccatttcactttccctcatcacaaaacaagggcaatgatgaatatttgcaagaatagaagctagtgggaaaacagaaatatatcaaattatattgaaacaaagtattttctgttggctgaggtaaggcagaaccaggaaaaaaaaaaaggttctctttttctaaaaaggcttaaaaaaaaacgttgaacctgtaaagcttttgagttttatttaagcgctgtatgcctttatttttaaaagtttgaattaatttcaatatgaaactcattttgccttgcaacggatcaaagtttagatgagaattttcggagttcagtaaagcccctctggttcctaatattctgaaagtacagtttctacaaagaaatgtaactacttt

SEQ ID NO: 267578 - DNA, 328 bp, Homo sapiens
gtttgcaattttgaagcaattgtctatactgttataagcaaataagtaaatatattgtggaaaatgggagccagtttctcactgttggagaagggagttacaaaggtgaaaaatgtgaaggttaaaatgaactctgatgtttgattggaattgcagatagtggcataaattcatagttttagaagtatgtagatataggccgggtgtggtggctgacacctgtaatcccagcactttgggaggctgaggcgggtgtatcacgaggtcagcagatcgagaccatcctggctaacacagtgaaacccccctctctactaaaaatacaaaa

SEQ ID NO: 267579 - DNA, 338 bp, Homo sapiens
gctaggattttacccctactgggccatccacgcttttagaaccacagattctcagggaatgcagcattaacctacatacagctagaaaattgacagtagcatatctcaacccaattaccttgaatcacaactctggtaaaagttttagcaatggaagagttaaaatgattcactagatggaagtttttgataatttgttgactttagccatggataattaagagtgatggaatcctcgtttcactatcaaggaagctgcagtcaaggtcaaacagatgagcgccctggaattccatggaagacagcacaaaaccaataaaaccactggtgttcagtta

SEQ ID NO: 267580 - DNA, 329 bp, Homo sapiens
gccagaagagcagttctccaggcccagaagtaagctacacccacaattctgtatgcagctgtgagaaaggagagtggaaatccaagtcaatgcagtatcaccgtgttcccaatcacgagtattccactgggcccactggctgccaagacatggatgggatccagtggtgagcctgccccagcacatgaaacacatgcttgggaaacagtgcctgactggatggagccctctggtaccctcaaagagaagcaactcgcctcatgacgatgagcgccctggaattccatggaagacagcacaaaaccaataaaaccactggtgttcagtta

SEQ ID NO: 267581 - DNA, 339 bp, Homo sapiens
tactggatctcactccaagctgggaatagctcatactttcaataggcagagtgaagaaacctcatactaaacaggtttttgaggagagtactcaaagggtacttcctcaatggtgggacaagattagtccagactaaggctacttttgtctggacaaaatttaaaaggtaagacctgaagggatcaagctgtttccaagcaactttactgcatctcagaataaaactttaaaatacctaaaggaatgcaaaaatatccagtaatcaacaatgtaaaatttatagccaggcacagtggctcacacctgtaatcccaacaactcgggtgggtgaggtggga

SEQ ID NO: 267582 - DNA, 491 bp, Homo sapiens
tcttgtaatttttttctcttggatgaaagagagacatgtgctaagtgaggcttctcctttccctaccatttagattctgagatacggcatctattgtgaatagcacagcaaagtcatggtatgaaagccagggttttgaagaccaggagaagaagggtgagatccttgagagcctaaccaaccctgggactacctacctgcaaacatctattttgagagacaataaaacttcctattgatcaaggcactgttactttggcattatttcatttgcagctaatatcatcttaatttgcatgttcccaagaagcaactattttagagatctcttgttttagcctttgtagggaactcagatgcagactgttgacttaatcatactccttgattcatgacatataaccttctcttgttataaatatgtctttatttctttttatctatatttcccaccaggaataaatctgaaggttttgatgtgtaccttttta

SEQ ID NO: 267583 - DNA, 448 bp, Homo sapiens
tgaaaaataactatgaatcgacgttagttacaaattgtgactgtcgcgatggagaagtactaaaatctatgaaagagttctaatgtagatttaaggtcatgagaagtctccggcaaagtggcattttaaagtaatccctcagtcgtggagctactccaatgagaagcctgccactccagggcgcaccacggaggaggatccccagacaagaagacctggctccccagaggagtgcggaaagccagcatggctagaggacacagaatgagggagaagacggatccgatcgcaggcatcgggagtgctgatttttctcctttgaaaaacaggttgccatctacctttttaaatgtcccactgtgtaggaaaactctggggaaagctacgtcagcaatatggagtctggggttgcctttctcatgtcataccatggtcctggctggggagc

SEQ ID NO: 267584 - DNA, 379 bp, Homo sapiens
cgtctgtgaggactctggtagtcatattcattacctcctttttctagttcagtgcttaagaaacaggctgttagaaatgtttctaaaaatgggctgggcatggtggctcacactggtaatcccaacactttgggaggctaaggtgggggaattgcttgagcccagaagtttgatatcaacctgggcaacatagtgagatctcatctctacaaacagtaaaaaattagctgggtgtggtggcatgtgcctgtagtcccagctgctcgggaggctgaggcgggaggatcgcttgagtccaggaggtcgaggctgtggtgagccatgattacggcactgcactccagcctgggaaacagagtgagaccctgcctcaaaaaga

SEQ ID NO: 267585 - DNA, 604 bp, Homo sapiens
aagcatcattcaaccatacatccatccatcctcctatcattctgttctcccctttcctttcctctctttatccttttttccttcctcccttcctctgtccttcagttttccatccatctattcatccccccatttatctatccacccatctttccatttattcagtcaataaacattgattgtatgccacatggtataccagtatttatgtgaaggattgcaaactgatagctcaagggtaaaatctagtatctagaaatatttttgtttaagagtgtttaaatgaaaactaaatgtaaatcctttagataggacacatactgtacccttcagttccaaacgctacaattccctattgccttaggccaggttgtttcagatattttgttcaaaagagctacgttttattgaatggttgctcttgttccctgctgcactgagtgctttgcctacattatctcattttttttcacaacgcccagaaggttggcattaatattttcattttacgaatgagtaatttggagcctagtaaggtacagtgatttgtcccaagttaaatggcttttgtaaggtttagatttaagtacaacttgaactcaag

SEQ ID NO: 267586 - DNA, 575 bp, Homo sapiens
tagagcatcaagacaaaaatctcagtcttcgaggaactcacagtgtagcagaaaagacaaaggaggtaaacaggaggagcatgaataattcatcttgatgtaatcatgcaagactcctaagaagatgttaggagaccctgtcatcattcttttggcctctagtgtcctttatcttcatgtttgctggcttccttttactactatggaaatacaacatatgcaaaagtagtgttttcgctgtttaaaaacatcgtcagcagcatcatcatcattaactgcaccaggaagccatgactcctttctggacaaggtgcacttgcctgtcatccttccatctctttcttcctccttgaagttcacaatacccagtccaggagcattgcagagaatgctaggtgtgtctgcagacttgactttaaaagaaaacaagttccttcaagtgagttcatcatgatgggaatgataatttgtttgagagaatgtgtgttctttggcaaaggaactcctgttataccatgacagtaataatagcagtaataaaatcaccaataataaatttacttttgaatttaaaa

SEQ ID NO: 267587 - DNA, 696 bp, Homo sapiens
gtttgatcaaaacagtgacagaaaagagcagaggtgaagacgaagaaactttccactgaaagaggggactgcagacccaaccaggcccttcacattgggggtggacaccagcagcctagggggcccccagcacattccaccagggaacacattcctgcctgcacccctggcccagaattaacgtgagaacaaatggaatgggaagaccaaggcgggatggggctcaggcttcacccgcatggctttatgctacacagagagctcctgcacgcagggcggtccccagaacctgctcggccagtgggccttgtgctcctacctggactcaaggtttaatggcaaggaaaggcagctgagtctccactactcctctcccccaaggctttctaatgaggggtgcccagtttttagacatacatttcagaaagtgcagatgctgttgagtagaacacagcttccccacatgggaagccaccagaggtggggacggtgggcctagaaagtccctgacacaggccccaaagccaacttgttttctaggtaactaatggcgacccctccccatgatgctttcccaggagcagtctccccctgcccccccccccttttttttttttttttttttttgagacggagtcttgctctgtcgcccaggctgtggcatgatcttggctcactgcaagcttcacctcccgg

SEQ ID NO: 267588 - DNA, 496 bp, Homo sapiens
  misc_feature (50)..(50): n is a, c, g, or t
tcagatgcaatatggagaatggggagaatgcattcgagtaaaagcaggangaacagttagtgccttgtgtagaaagaatttttagtaatctgtttcagatatagaaggacaaactaagggcctggcaatagaaatgtgggattcttttagagttacctctgagtcctggctattgtggggagaaataaaagagaaggaagagagttatgtgtgcacctgtgcagcacttgatctcacccagcacacaggttttaaaatcgccttctgtactggccactcggtggtttctgtactcagcctggcccttcctccttaaggccagatgtctcagactgactccacatgagtttccacttaggtgtctgtggaacatctaagtggagatgactagtaggcaaattggataaaccggtatcgagctcacgggatgtaaagagtgttattaaaatgatggttcatggaatgtaagggtaagaaatcatggataagaaggaaa

SEQ ID NO: 267589 - DNA, 428 bp, Homo sapiens
tctgggtgatctctccccattgaataaattcctttatagcctaagtcaactagttgctttctctagcttgcaactcagaactcttgttaaacctaacctcttccactgggtctatgtcctgtgttctactctgagatcttatgaaattcatttccagaggtgaactgctaagagccaatgcatatctaaactaaccctcagccacatgggctgccttttgagtcaactgaatctgctgggaagattctgaagagaaattaaacctcttggtaatgcagatgtcagttttcctgttaagaatgtgctttaggatgggcacgttggcgcatgcctataatcccagcactttgggaggccaaggccggtagattgcttaagtccaggagttcaagaccagcctgagcgatgtagcaagactctgtatgtac

SEQ ID NO: 267590 - DNA, 578 bp, Homo sapiens
atatggagagtgtctactttgacacattcagggctagccctctcctgctggtgcagttcaatgtgaatttagtcatttgtggtcacttaacagcaaagagatctttctacagagtctagctgtgctgattatcaaactggggaaaattgatggccatttgttatggctaataacacaggtgccggtcaactttataaaaatgtagaaaagtatttgcggtgaaaattatcctaaccattgtggaaaaatgcccatcccacttcaattcatagctgaatacatataggaactacagttctcagacctgcagtgagttctgaccaatggaattcagtgggatgatagatgctgcctttgaagccaccccatcaactggctcatctcctcctgtctcagctctttctcctgctgcatcctgatgcaggaccactgcacaacctcacaaaccttatgtggaaagtagtggagccaccagatgttatgggtatcctttaatggagaactttacactactttgaaatgacagttttatacttttcataagaaagaaataaacttccattgtactaagccactgt

SEQ ID NO: 267591 - DNA, 408 bp, Homo sapiens
gcaacctcctgggttcaagcaattctgcctcagcctcctgagtagctgggactacagggatgcaccactacacccagctaatttttctatttttagtagagatggggttttaccatattggccaggctggtctcgaactcctgacctcaaatgatcctcccactcggcctctcagagtgctgggattacgggtgtgagccaccatgcctggccattcttaagatcaaatggctacaaagttggtggctcaaggaactgaaccagacattggaaccatctagggctttgtttataatcgttatgctatacggctgttgggagagtcaaatgaggacatgtgacacgtgtatgtagtcacttctcatgaaatgttagccatctcatataaatgagttagaacattctggg

SEQ ID NO: 267592 - DNA, 241 bp, Homo sapiens
ccaggctcccttgctctttaagtgacacctctagatccccagagcccaacagcgcatctgctcacagcctcgagggtggcaagggtggaagacatggcctgctagtgtctgcgtaggttggtgctttcagaaacaagtggttctggaggtgctggatgctttattagaacaacctgtgtggagcccgttgacaatgcagatgactcatgttggctttttttttttcccctttacaaataaa

SEQ ID NO: 267593 - DNA, 479 bp, Homo sapiens
gatttaccaacaacataccttctcaatggaaattccaattcattttagatggaagggaaattatctcaagaaaagactgaaatgtgaaacataaaagctgactgtatgctgggaataaagttagcctcaacaaatttccaggtacagtattgattttaattaggctccctgatcacaatgcaatcaagttagaaatcaccaacaagaaagagaaaaacccaatacatttggaaattaaagacaattctgacaacttgtaggttaaagacaactctttaaagtctcagaaatatgaagcttgttccaactaccttaaaacatcaggcaatttctcatgtaatcattagtaaaattgattatgttttaaaaaatataattgccaatacctaagctgcagatgtaaattttgtgttgtacctgtatacacttttaacaaatacactaaaacacatgattaaaagaacaaaagcttacagctg

SEQ ID NO: 267594 - DNA, 497 bp, Homo sapiens
cttcccagcagcaaatgtcaaagccagtagaaaacaaaggaagaataccttcattgtactaggagaaaatgctgtcaacctagaactctttcaagaccagggtgaaacataaaagctgactgtatgctgggaataaagttagcctcaacaaatttccaggtacagtattgattttaattaggctccctgatcacaatgcaatcaagttagaaatcaccaacaagaaagagaaaaacccaatacatttggaaattaaagacaattctgacaacttgtaggttaaagacaactctttaaagtctcagaaatatgaagcttgttccaactaccttaaaacatcaggcaatttctcatgtaatcattagtaaaattgattatgttttaaaaaatataattgccaatacctaagctgcagatgtaaattttgtgttgtacctgtatacacttttaacaaatacactaaaacacatgattaaaagaacaaaagcttacagctg

SEQ ID NO: 267595 - DNA, 553 bp, Homo sapiens
ctctaaggtgagaatgttaatcatttcatattcattaggatagtcagatcaacatagtaagagttttccaaagactgtttttctgaactgtaaacccttggattgtcaaggcctcaccaaactgagccagccaccagcctgtaatgaaaagttctcatgcaaatgaccagttagcatgtggcaggcctgtcttaagaagcttttgagacataagaaggcctgtcttaagacaggcctgtcttaagaagctggaaacttcacctgcagtatgtgagaaaagtggaagcaggaaaatgtccctcagcccttgggaagccaggcatctgtgaggaagcatgttcatgtatttcctgggtatttgaatgaatcaaatcactgtgataaaaataaacacaggtaatgaagggtatttttacttatttccaaccgtgatttttcacaataaaataatactccccaaaagtctcctaattagtatatttaatcttcacaatgaatgaaatccctgttgatatcggaggtgatacaggatttattagtgagactgtggggg

SEQ ID NO: 267596 - DNA, 400 bp, Homo sapiens
tgatcatatttagatatcagataaaatcagtgtgcatggaaatgttacgtgtgccttaaaaatgtagttatcaactttgaatcaacagaaaaataagtgttttaagtgtaatttacattaggatgtttacatttctaatattcttaagaaagtaaatgtggtatttagtataaaaatgaaatgaggccggacatggtgactcacacctgtaatctcagcactttgggaggccgaggtgatcggatcgcttgaggccaggagttccagaccagcttgggcaacatggtgaaaccctgtctctagtaaaaatgcaacaaccagctgagcgcaggtggcacacgacagtagtcccaactgctttggaggctgaggcacaagaatcccttgaacctgagaggca

SEQ ID NO: 267597 - DNA, 516 bp, Homo sapiens
gaaaaaaaagaaaggggaaggaaatagatgtcacccactgtggcagggaggccaaaaaaagtgacaaatcaatccaccacaacctctttgatcagcacactttataaagcagaatgacatcatacagtaaaggacagaagagtgattgagagtgaacacatgaagatactggagcctgacaactaacaagagaataatatttaaagctgtggagtgttgtggtcaagactgcagagtttagaatgaatctgcctaggtgtgattcttggtttcttcatttaatagttgtatagcttgttgggtcgctgtgaggattaaatgagctaatgtataatatatgaagtgcttggtctagctcttgagggattgtaagtgctaactaaatgttataaatcatttttgagcataacttatattgcaaattgcttatcacagaagtatttacaacttaaagctaggaatttaaactttatcatttttgtctaataaattattgattttatatgctcaaattag

SEQ ID NO: 267598 - DNA, 362 bp, Homo sapiens
ttctcaccaccatggaaggtattttcctaatttaatggaataattattttgttgttactggctttaagtgtgtgtctcgttttaggtgctcagtttgtgttgactgaaagaagaaaaacagaacacttagctacttaaagtttcaaaattcaactgttttagggcagacaattagtctgttagacaaactggagcactgattgcctttggaggaggggaatgactgggatggagtataagggatctttctggggtgatggttatagtctatagattgataagatttggtttacatgggtatatgtatttgtcaaaactcaatgaatacacacttaagatttgtacatttcattgtatgtaaa

SEQ ID NO: 267599 - DNA, 334 bp, Homo sapiens
actaatcctcaatacaatcaatagtccatgacagcagtttttggacatcagtgtacatcagtattaactgcagggcttgttaagctatggattactggaacccaccaagagtttctaatttagtaggtaggagacaaaggctgggaacaatttccaggtgatgctgatgtgctgatgcttctgatcaagggaccagtctactatctggtccagtgtatttttgatcattgaatggctccattacacattaaaatggaaaatacctactatgataatatgcctggtccctagggaccttgagtgtaatgtggccagcatggattatatgatgatt

SEQ ID NO: 267600 - DNA, 427 bp, Homo sapiens
tggtttaatatatgccacactttatgctgcagtagcaccatttggtcatatttagtgaactctgtggttgttgagaatgccaaagcagcaggctcagcgattgcagcataggcctgtacttagttagcaagcttagcttaaaagctgtcagtgcagctaatgttacagtggcttactgagaccttggcctggttgtgatagttctccaaacctgggtgttttcacctttgaaatatgaatctggatttagctttttcttagcagcaacaacaacaatacatattcacttattattaaatgctgttgtaaataacatttttagatttaataatgatttcccaagacatttcgtgctattctttactttgctgatggggtgagaagagagttgaatcttaattattattttttagttaattcatgtgat

SEQ ID NO: 267601 - DNA, 434 bp, Homo sapiens
caaatacaatttgatcttacccctcacaaatcatgtttttaatgagacagtggtagattcctttatctagaatttaattttttttctccgaagacctccatattcataactggatttgaatgtttttgaaaataactttcacagtagagcaaaactgtaaagaacaattgcattaaaagcaatttacctctaatttcttcatgctgtttgctatttattcctggctgttgttgctgtacgtgaacaagaatgtactctctgaaatagaggctttctttgaattagcactgaggtcctacagaagtttttgtcaacttcatggatctaaaatgtgtgcttttatgtacaccattgaaaagattcacttttgattaaaacacatcttgtgttccttttctataaagacctctatatgttgacaaccacatttgagt

SEQ ID NO: 267602 - DNA, 196 bp, Homo sapiens
atttccttttccaaatgtaatgaaccttttcctctccggggaaaaaaggaatacacagatttggatataatttccaggagtttaggaagtctctagataaatcctacgcaaaggccctgtgtgatttaaagtcacataacaattgaagtttattttgtttactgtgggccatatggtgagtgcctgataatatttc

SEQ ID NO: 267603 - DNA, 511 bp, Homo sapiens
aacttggcaagggtacagagaaacggatgtactgttttacagtatttggggagggtggtttgagcagcatttattgacaatttcattagtggggatgtttctattgaaaacacagagttaggaagtcataaaatgttcttgcaatataaggtaataataccaccggcgtttatcttatgttttcatgttctaagtgcatgcatctgagtaaaaggatctgggctgcagtccagtctgagagatgccagcaaaggcttcctaggccaattcagtccagtaaatccctcttcaatcttctctcccacacagacagcagtgatgagcatgcccgtgaactcacatgattattttggggaaaatgaaagagttgtattctttttgaggtagtaattccactttcaggggcaaatacattttgattattttatcacccttcagtgagttgtttttgttctttaatcaaggatgtatgtttgaagtaagaagtaaagcataaagtatacgattttgt

SEQ ID NO: 267604 - DNA, 419 bp, Homo sapiens
atcaacgtgaatcttaatttctaatagaaaaaaaccatcaataaaggcttaatttattttatttttaaaatatttaatttattttttattatttatggagaccggggtcttactatgttgcccaggctagtctcaaactcctaggctcaagggattattccacctcggccttccaaagtgctaggattatagcgtgagccactatgcctggccaataaaggcttaatttagaataagcaataggaatgattgctaatagtaaaggagcagaaaaaggttttcattacccatgtgaaaatgaactctttgagaattagtgcttgcttcggcagcaagtatactaaaactggaatgatacagagattacatggcccctgtacaagaatgacacgcaaatttgtgaagcgtttcattaaaaa

SEQ ID NO: 267605 - DNA, 304 bp, Homo sapiens
gcacgagggctttttgtttttttgagatggagtttcactccagtctgggtgacagatcgagactccatctcaaaaaaaaaaaagtattaaaatctctacccagtggtttaaattctggtcccagcaggaaaatttctcagaaaggattcgctcattaattaaataatgaagaactctttctctgcatgtgtaacctcctttctagggttccccaaagtggaacggctgcttaggtaatgtttgtttatttgacaagagtttaggtttattttttcttatgataaaagtatattataaaaaatga

SEQ ID NO: 267606 - DNA, 446 bp, Homo sapiens
actggtgaagtctatttatttaaccagttattcattgtattctttagttaagtcacacttttcttcatgtctcattttaattccatattgcttttgaagtttttgtgtctttaaatcacaaacgaggccgggcgcagtggctcacacctgtaatcccagcactttgggaggccgaggcaggcggatcacgaggtcaggagatcgagaccatcctggctaacacagtgaaactccatctctactaaaaaaatacaaaaaattcactgggcgtggtggcgggcgcctacagtcagtcccagctactcgggaggctgaggcagcagaatggcgtgaacccgggaggcggagcttgcagtgagctgagatcacgccattgcactccagcctggcgacagagcaagactctgtctcaaaaaaaaaaaaaaaaaaaaaaaaaaaaaaaaaaa

SEQ ID NO: 267607 - DNA, 686 bp, Homo sapiens
ggagtttgaggttaaagtgagctatgatggtgccactgcactccagcctgagggacagagtgaggttctgtctttaaaaaaagtggaggattgggactccagaggaactctgagaagttccttgtccccagctctcagctcccctcctcccattccttttaagccaccatgttgatcagagccaccctgggctgtcactgtggcccagaggctgccagaggaaacttctggctctgtgtcattcacatcgttgtaatggccttgagcaagtcacttaaccaggatccacattcatctatagactggaattttcgatgtgtacctcacagggtcattttagtattagatgaggtaatgtatgtaaagtacctagcaacgtgcccagaatataagaggtgttaatacgtaggggctatttttgttgtcaacattgagttgctgtcctggccacttgccttgcttcagttttatatttagaaccagctaacagttactaagcatctgcccagaactgggcactttcacaaacacaacctcatttgagcatctgtttgcccagcccgtttgcctgagttctgagctcatatctggcttgcctcttgctgttctttgttcctatgagtttcctagtttcctggtttttctatcagtgcctatgccttccagtgcctgttgcctgatctcag

SEQ ID NO: 267608 - DNA, 557 bp, Homo sapiens
ctctcagcccactctccatgccagcccaccctgggaggatggatgaggatgttatgttaatggcatctgtcatgtccctgacttatcatgagacatccacgatgagccagatgccagctgatgggcaaacgtgagtgatggaaaacaagtgtgtgagtgatgaagttggctcttgccagatgaggatgaaaaatctcttgaccaaaccccatgtctgaagctgccagttcccaatatcagagagatagtcgccatcctgctgtaggaggttggagaccgggacaaccccaggccccctgagaaaaacccttgccagaggctgaaggtgaagggaggactcagcttccacctgcggccagctccaccctgggagctggactccttgacagactcctggctacggggctgtctctgagcttttgaggtgtcactgttactgctccccagctgcccagcttgggctggacccagacttaagacatttgtggccgggcgtggtggctcacgcctgtaatcccagcactttgggaggctgagggaggcggatcacttgaggt

SEQ ID NO: 267609 - DNA, 909 bp, Homo sapiens
ctaagggagcttgcccgagcccagctgctgattgttaccagggcttataacaggttgcggggtctgtgatttagtgctttcatacaggcacaggactcgggcacggagaggggccgtgctgtgcaagacggctgaggctgtctttatttgagagctgctcagtttgtcctttttcagctgcagggttttatggtggaagctgtactttgctttccagtgaatcaatgctgtcgtccatgtgttctctccttggcttgtttgtatgaatcactgaagggctccaaaacaaacaaacaaacaaacaaacaaacaaaaaacagcttcctggaccgcaccttagaatgatgaaatattattttctggtatattttatcaaacatccccaaaggcttcttatgataatgaggaagcatgattataactgtctaactcttctgtgttcatattgatgttaatgggactaaattaccttgctagcttaatgagataagattttaaatgggtgttttatgtactctgtgtgtgtgtatttaatgaagacttggtggtcgcttctgatttacacttgggaatcaattcccctcttgtggctttttgctttgtttcctttcattcaccctcgaattaaggcatcctcagtatagaaaattttgaaaatacagaattatgtttaaaaaggtagaaaaatggaggtaaaatatgcacttgaaatctgtcataggcagtgttccaacaccaggtcttgtcctcagaggaggaagacggaggagattttattaccgaggacaagtgactatgtttaacaattaaccaacctttatgggttggaagtatctattaacacttatttacatgtttcctgtttccaagagaccaaaactgatatattgtgtcaactgttgactctac

SEQ ID NO: 267610 - DNA, 380 bp, Homo sapiens
taaatttaatttgtgcatgtgtgagagaccagagtgagaccagagatggcagcggtgaggggcggtggtctcaccatgttgcccaggctggtcttgaactccccttcaagtgcccccctcctcacctggcccccctcaccttgcctcctccccctcactcctatgccagcccctgccattccctacgccctctgttgaccgcaagactcaacaagtgacttgctgagcaaaccctgctgagaagagatctgtttagggacacaggaggccaagtacacaaaaaagcaaaagaactagcatgcctttttcaatggatgtctattttacagggctggcttcagattattgttatagctttaaataaaaggaccgttttgtca

SEQ ID NO: 267611 - DNA, 440 bp, Homo sapiens
tacatatgatcagtttattttttttcctaacactatttattgaaaatctttcaatgtcagctctctctccccacctcccccgctttctttttttctgagacagggtcttgctctgttgcccaggctggagtgcagtagtgctatctcaacttactgcagcctccgcctccagggcttaagtgatcttcctgcctcagcctcctgagtggctggaatcacaggtgcaccatcatgcctggcttggtcaccaaacttttactgtaaggggcagactgtcaatatttttggctttgtcgggtgcggtggctcacgcctgtaatcccaacactttgggagtccaaggtgggtggatcacgaggtcaggagttagagaccagcttggccaacatggtgaaaccccatctctactaaaaatacaaaaattagctgggggtggtggc

SEQ ID NO: 267612 - DNA, 118 bp, Homo sapiens
attgagaagaaacttaatcagaatagcaggtcagaggctcctaactgggcaactcaagattctggcttctactgaagaaccataaagaaaagatgaaaaaaaaactattaaagaaaga

SEQ ID NO: 267613 - DNA, 415 bp, Homo sapiens
ttaatttcacatttcataggtaacacatagacttagccacatttttcatattggtgcctccatggtagataagacattgaaactataatgcaactaagatcaaattttttaaatgtcagaataactttaataaataaatttgctcatccttttttgatggaccctaacaatgatcagtttttagccatgatgttatctgccactagactgtattattttctcatttaacatagcttcatggtactaggaatggaaggaggaaagggggcatgaacttctcaagactgctttgtaagtctatttctttctttgattcccatacctcaaggaactgagagcaaactttgagcctgagtgtaaagtttgttttcctggaaatgtcaccaggctgtaaactcagaaacagattgccccc

SEQ ID NO: 267614 - DNA, 371 bp, Homo sapiens
gaaacagagtctcactctgtcacccaggcttgaatgcagtgatgcaatcttggctcactgcaacctttgcctcccaggctcaaaagctcaaacaatcctcccacctctgtctaccctggaacaagaagggagcctgctatctaaagggaaggacccagtcctggctggattcaccacttgctggttaaagagcccttgggccttgaacaaacatcagttgtagccaggcagtagttgcccggggcctgggatggtgatggccacaggagagggtctagaaatgttgtccaggaattagggcctagaatcaggaatgttagaaatctacttggtgcttcattttactgtagctgaggtagtacccaggttgc

SEQ ID NO: 267615 - DNA, 317 bp, Homo sapiens
gactctactccctcaccacatctatcagggtgtctgcagatctttacatactgttccctttacctgctacactttcatccagatcgttcatggaggacttctttccaacaatgaggtctctacatgaatgtcgtctgctcagagaagcttgccgcaaccaaaatttcatcctttcttctatctcgagcctaaaatggtgctaaagaaatatttgcccttcaaaatactgtgctacactgcaaaatgtcatgaaacattaaaatatagcctgccaaacatttttattgtatgctaagtgactgccatcttcagatatt

SEQ ID NO: 267616 - DNA, 429 bp, Homo sapiens
gtaaatttgtaaccagaactttatcacatcctggctttcaatctgtagatgtacaaatctagttcagtatttgtacaatgcctagaaagtcacaggtcctgtagtccaaatccagtgtcaaatcatggctagacttgtctgtatgagagacatatagcactggataaagttgggtattgtagtcatttaggtgaaaagggagaatcaaagataaaggtgatcatttttcatgcattctttaatgtgtactaaataccaattgttgagtctttgttccgggttgaatggcagtcctaatagcctgaccaagtcaactagatttccaaaatgctccacttgtgctttcacacctggaaatacctacccaggtatgtgtatgtatttatatctaagggtggataatctgacatcctgtaggtatagatgttg

SEQ ID NO: 267617 - DNA, 343 bp, Homo sapiens
caaaagaattgagtagatttgcaagggctgctgactttttgacccctaataatgtataatacttaatatgaacagcaagtaacagatctcagtgattgtagatgtttactaaggtattttattttccacggggctttgaatgctaacatatatttcctgtcatcagctgtcttaccaaataataattaaatttatcatccacattttgaataaaatattagtactttctattggcgtatggcaatttaaaaaactttaatttccataattaaatccatcaacttgtaggtgatatagatgataagtgcaaaatactttcagttttaaatggaaaaattgaggc

SEQ ID NO: 267618 - DNA, 686 bp, Homo sapiens
agatagaggagctcttattaagtaaggaaaagtgtgaagaagttcgtcaagcattgagcaaaccttttagtctaaagggaagaggagtgagggaagtgataacatgagtgtgttgaaattagtggtttgaactgactgaatctcttaaggtcgcctcgaggtctaacatgcttgttaaaaaaggttttcagtatgtattttttatctaatgccagtggggtcatacaaacttgtgtaactctgagttatgaccttttgaaatccttagaattgtgttgtaacaagacttaaaagatcttagaacagtccaagggagattcatatgattaagtcccaaccaacttacattaacaattaaattacctttgcttttgttgttgttgtttttaacagaaacaaggtctcactatgttgcccaggctggtctcaaactcctcagctcaagtaataatcctcctgccttggcctcccaaagtgctgggattacaggagggatccaccatccctggcctagctttgctttaacattatgttaagctatttcttttggttgcaaataacagaagcctactttggtttatttaggcatgaacattcaagctctgtaaagagtaaggattttagtaggaagagtttagatactttagatatttcaatataataaagttcccactcactttctttca

SEQ ID NO: 267619 - DNA, 453 bp, Homo sapiens
gaggagtgctcaggaataggattagtgtcttataaaaacgatcccagagagctctcagctccctttcaccatgtgtggccatggcacgagggtggtcgcctgcaaccttgaagaaggcctcaccggaagctgcttgcactggcaccctggtctcagcttccagcccccagaactgtaagaaataaatgcttgctgtggccggacacggtgggtgatgcctgtaaccccagcactttgggaggtggaaatgggaggattgcttgagctcaggagtttgataccagcctgggcaacatggcaagaccctgtctctataaaatattaaaaaattggctgggtgtggcgcctcacgcctgtaatcccagcactttgggaggccgaggcaggcagcagattgcttgagctcaggagttcacgaccagcctgggcaacatggtgaaacattgtatctac

SEQ ID NO: 267620 - DNA, 378 bp, Homo sapiens
ctcaaagcgggcgctgacactgcccccaggccagcgagccgtggccgtggcgctggcaccagagtccacctggagcaccgaggctgagccgttggtgggcacgtagaggcggccgtcgcggggggcagggtagatgacccgcagcccagccactggggagaccacgtcaaagctgcaggacaggttgtgcctggacacgccattgcccacctctgcccggacctcatagcgcccaggcagccgcagcccagggttgggcctcaggcccagcagcacggtgagctgttccgtggctgcaagcagccgcagggcacaggcagggcaggcccaagtgccctccagctgggctggcaagtggggcagccatgacgaggcgtt

SEQ ID NO: 267621 - DNA, 342 bp, Homo sapiens
caactcagtatggaacgtgggtttaattttaattataaacaaaccataactgagaaggtaactctgttacaagcagataattcttcatgaagacaagtataaattcaggctaaggagtgatttaattgctatcatcttattcaattctacaaattttgtttagcgagaaaatattgactaaatagttctttcagttaatttggtcttcaaatccgtgccttcaataccagatattatcctatatcttcactccccaaaagatttattttaatgtaaaactcaccatgaaaaagtaatcagtctcttcaataactagatcaaaaccatcctgcaaagccttcc

SEQ ID NO: 267622 - DNA, 1018 bp, Homo sapiens
aattttttcagcgtttttcctctgtatctaaacaccaataatatacttaatttttgaatataaaagaagtagcaattgactaagaataaatatgttataaaaactaggggattatcttgatttacatttcctagagtattaaaagagattaattacagactttcacttgataatattgaggagtctggagggtcatagcaaaattttctttagttcatcttaaaatttagggaggtaaaaaaagattttattcacataaaagatttcttggcatagggaaggcgtaatgttaagggcttcttccttacccaagtgggagctgaaccagtaattgtggggaaaactgaatttatagcaacaaaggatagtagtttctcaactgggagcatacgagcaatttctcagttcagagatatttatagcatcttggtgttatgcaataaacaatgacaacaacaagcattgagctttcactttggagttactcagatctgagtttaaattctaaaattattctagtagtattttcctgcggtgaatctgttaaggatgtaagctatagtgtagcttggggaatcatcttgaacagttatgaaactcattaaagcttcttttcccttgtctgtaaaatgggaaaaataaatacctctatagctcttaagaggcttaagagttctatggcttacacccacatacagtccttggctcagtgctaggcatgtagcaggtgctgactgcctctctcccttcccttctttactctcagttgtcttatttcttcttatgcagaagagattaccttaaagctgactagaaaactcagacataaattgacatttccttatcattgcctgaaacccactgaataagtcccctttgatttctctcaggaaggataaaaaaggctacagtacctgctcataggagttcagtaaatgtttattgattgaatgaaaagaatttgatttaaggaaacaataacactccatcctgggcaacagagcaagatcccgtctca

SEQ ID NO: 267623 - DNA, 458 bp, Homo sapiens
  misc_feature (15)..(16): n is a, c, g, or t
  misc_feature (162)..(162): n is a, c, g, or t
actgtagaagaaagnntagtagaacgtgctgagatgaaactcagactggattcaatagtcattcaacaagggaggcttgtggatcagaatctgaacaaaattgggaaagatgaaatgcttcaaatgattagacatggagcaacacatgtgtttgcttcaaangaaagtgagatcactgatgaagatatcgatggtattttggaaagaggtgcaaagaagactgcagagatgaatgaaaagctctccaagatgggcgaaagttcacttagaaactttacaatgcatacagagcctgtttttgagttttagatactttatttgtaaataacttaaaatagctttctgaaaccgtgcattctgtagtttcttcctttcagtgaaattgctaaatgtcaatgtatttttggcactgcgattttaaccatttattaaataaaaattttgttaaagaaaaaaaa

SEQ ID NO: 267624 - DNA, 424 bp, Homo sapiens
  misc_feature (15)..(16): n is a, c, g, or t
  misc_feature (162)..(162): n is a, c, g, or t
actgtagaagaaagnntagtagaacgtgctgagatgaaactcagactggattcaatagtcattcaacaagggaggcttgtggatcagaatctgaacaaaattgggaaagatgaaatgcttcaaatgattagacatggagcaacacatgtgtttgcttcaaangaaagtgagatcactgatgaagatatcgatggtattttggaaagaggtgcaaagaagactgcagagatgaatgaaaagctctccaagatgggcgaaagttcacttagaaactttacaatgcatacagagcctgtttttgagttttagatactttatttgtaaataacttaaaatagctttctgaaaccgtgcattctgttggaatcagtggctcagatgtccactactgggagtatggtcgaattggggatttgattgtggt

SEQ ID NO: 267625 - DNA, 1089 bp, Homo sapiens
cctcatttctgatataccacctctctatttggcattttcacctagctcaaaaagtcagttcctgatagcattgttaacatagctagcctgtgctgacagcttgcagaaactggcagggtctattgcccaggctggagtgcagtggcacgatcttggctcactgcaacctccgcctcctgggttcaagtggcccggctaatttttgtatttttagtagagatggggtttcgccatgttggccaggctggtcttgaactcctgacctcaagtgatccgcctgccttggcctcccaaagtgttgggattatatgtgtgagccactgcgccagccctaaaatctcatccttatgtaacctaagcccaggacttaggacttagtggttaacaggttcctgtgtttagttgattttaccgaagatgtttgggactctcagatctgatgggcacttggcattgctgttgcttttttttttttttttttgagacagagtcttgctctgtcacccaggctggagtgcagtggtgcgatctcagctcactgcaacttcagcctccctggttcaagtgattctcctgcctcagtctgctgagtagctgggactacaggtgcgtgccactgtgcccagctcatttttaaatttttggtagagacggagtttcaccatgttggccaggatggtctcaatctcctgaccttgtgatccacacctgcctcggcctcccaaagtgctgggattacaggtgtgagccgccgcgactggcctattgaattcttaaatatgaagaagccagccctgttggcagtttatcagctttaatcaccattactgaaactggtgctatgattgatcatgcctggtcctccagtcttccctggccactgtaccgcagctgcatgaacagctgcgtttgctcaatgggaaggagacttcctgctgggggaggtatgggagggaggccccggggagaggcatgaggaaatccaagtggccttctacatttttctctttcatcattatccatatcttgattctagaactttattttctggtgtctcagaaagttaagaaaccagtgtcttcaaaagtg

SEQ ID NO: 267626 - DNA, 866 bp, Homo sapiens
gatattgattcttttatatgttgcaaatatttttctagagtcttacttctcttttagcttgttcaaaatattttttcccatgcagaagtcattttttttaaagctttttacttatatcatgaacatgttttcatttattccttttttttttttctttatttgagacagggactcgccctcttccccaggatggagtgcagtagcacaattatggctcactgcagcctcaaccaccatctgcctgccttagcctcctgaatagctgagaccacaggcatccactaccacacccagctaattttttgttctttgtagagaatagagacagagtctcactatgttgctcaggttggtctcaaactcctgggctcaaactctcctctggaagtactgtaattacagatgtgtgccccactcctggcctcataagttcttcttaagtttacatcttatattcattgtctattaatacctaagaaattactccaaaaggtagtgacttgaaacaacacttaaaaaaaaaaatctcacactttctgtggctcaggaataagggcatggcttacctggctactttgattcacagtctctcatgggggttgtcgtcaaggtgttagctgggttggaatctgatctgaaggctgaaatggggaaagatgcagttctaagctcacttatgtggttgttgggaggattcatttccagaatgagaaatgaggtagtttagttgaggtcctcagtttctacctgtctgtttgtcaaagcccacttttagttttttgtcacatgcacctcccctatgtgccaaattgtttaatcaaagctagaaaatgacagattctgctagcaagatggaagtcatatag

SEQ ID NO: 267627 - DNA, 347 bp, Homo sapiens
agagatactgatttctttggaatgtaagaataaatgttagcattattcatctgctacataaaaaacagcaagatacagtggaaggagagagggccttagactgggaaagatctaggcacctattttggcccctttactatgtctgctgcctgaccctgggcagttactaaagtcttgattaaagctctcaattctctcaactgtaaaataagaatccatacctcttgggatctgtgaaaggaataagtgaagtgatttttttaaagtgccaagcacagtgacacataggaagtgcttaatggtagctgtttattatgtttttgaaatagagcaagaccctgtctaaa

SEQ ID NO: 267628 - DNA, 529 bp, Homo sapiens
ttttcttctttcagtctgataatacggcaaattacattgatttttcaatgttaaaccgactttacattcttaggataaaccccacttcatcattatatcttttctttgtaaagtattggattcaatttgctaaaattttgtttgtgatacagtctgcgctccatatccacaagttctgcatttgcagaaccacagatggaaaatacattttaaaataagaaataacatacaacaataaaaataatacaaataaaaaatacatataactattatataatgtttacattgtattaggtactaaaagtcatccagagctgatttaaaatataaggaggatgtgcataggtcatatgcaaatactataccatttgatctaaggacgtcaccacccacacattttggtatctttggtatctttggtatcagggaaccaatccctgaaggatatggagagttgaatgtatttgcatctgtgttcatgagggaaatggatatgaagttgtcttcaaaagtccttgacctttatcgg

SEQ ID NO: 267629 - DNA, 475 bp, Homo sapiens
tgacatggagtctcactcttgttgcccaggctggagtgcaatggcgtgatctcagctcacagcaacctctacctcccaagttcaagtgattctcctgcctcagcctcccgagtagctgggattacaggtgtctgccaccacgcctggctaatttttttgtatttttagtagagatggagtttcaccatgttggccagactgttctcgaactcctgacctcaagtgatctgcccaccatggcctcccaaagtgctgggattacatgtgtgaaccaccgcacccagcccataaggtttttgaagaaatggcagctataagtatctactgagtgcctgctctatgccaggcattgtgcgaagggcctaacaggcactgtcgtctttgatctaacaatagtcttgtatggtgggtactaggatggactccattttacagatgaggaaaccaagacccttagacttgactgacttgtcca

SEQ ID NO: 267630 - DNA, 84 bp, Homo sapiens
tctacccattacaactattcacaaatatgtagtattatcattcataagggagaaacattcctcctactttaactaaactatccc

SEQ ID NO: 267631 - DNA, 397 bp, Homo sapiens
ggaaaacaccagtcactaaaaaaatatgaaacaagttctgaaaactcttgtttcgtagtaatagaatagagagattcgacatccttgaaatagggatggagaagagatacagaagaaaggcattcattccctccacaaattggatctcaaattctagtgctggtaagggcaaaaggtggtttccagagtagctgtaatcatctgttattctgaaatacaggttgagtctgagggagtcttaacagtgctgaagggcaaatagtcaaagggattttcagatgtcagctaaacagtggacgctgcagcaacatgttacatttgtgtaaggatccagaagtgggtgaacttaaatgatttttaggcccagattttacagtaaagatgataacttcacaaa

SEQ ID NO: 267632 - DNA, 440 bp, Homo sapiens
gacacacatgcaccagccttgtgcctgttctaggataggttgtgtgctttgtcttgggtaccctgatatcactgttgagaaatttctcagtccactgggagaagaaaattgttcatttccatgctcacacttcctctgctctctctgtcctgattggctaaccatggtactggggtgagaaagctgagactagtggtgttgctagagcgaggttgtcttgacttagaagagctgattgtgaaattttcagaaattttgcttgctgattattagtcacagccattattaaaaattaatgtacatggcatgaagcatatatggcaaaatgttaatgaatctaactggtgtgtatatgggtgttcaatgtgctattttttcctattttctgtatgtttaaaagtatatatatatttttaaattaaaaaggcaacactgaaaca

SEQ ID NO: 267633 - DNA, 1293 bp, Homo sapiens
ctcctcagtcctggctggtaagcctatactcgactggaagaatagaacataattatggaaactgtggctttttgaagtggcatttaattttgctgttattaagtctatgtgaaaatagctaaaacttttatttggaaaatataattgaaagcttcatccattctttgatatgactaaaatgaaagtttttatgttttcctgttcctggttatactgtattcagagctatggtgctttgtaaaatcttgaaaggcatttctttgttgttgttgatatgcattttaatggcatttaaatgagacgatttgtaattcttaagtgcattttacttaattgtatttattcttgggagaacattcattctttttatagatcaaaggttaaaaaataaccaaagctaaggcatgataattatcgaattaaaatatttcatgatctaaacatgaaataaacctaacaactgaaattttctttcaactctgaatttattttggattatgtaaaatctttttaccttagtctttaatcattgtatcaaaggtccatatttttagtaagttgctttatgtgctgtcacaaattgtgcatgtcactctgctagtccccatggaaatgtgttttatctgttaccatcatggaattgctgcctctttgtccgtggactgtcattcattacctgcccatctaatcttgctatttgatatcttgtacatgtgacaatgtgtttggcattggaggaatatagataagtgtaagaagagccagtatctcctgtcctcaaggattctaagtgaaaaaagtgaaaaagacaaaagtgattaagtgaaaaagacaaaatagtatatacatagtgctttgccacacgtgagtgagataaaggaagagctgtaggatttgaagtaatagaaatagaggaagcagaaatattatagaagaaagtgaaaaggatatgtattagttatcaggtgctttattagaacttcaggtggaaatggagatattaggagatacggtcccagagtgtgtagagtggtgaggaggaaatgtaaagattgggaatcgtttatataggagtgaaggttgaaatagaatagaggaagttaacaagaaagataatttacagggagagaaggagaggggaaaagtgtgaaattacccagatttatggaatgaaggagggatgggatggaggaggaaaatgatttcagcaaattagacacacagacctagaagaggaatcagaatgatgaaattctgtgaaaaccaaactagaggttttgaggagggaagatt

SEQ ID NO: 267634 - DNA, 482 bp, Homo sapiens
aagaaaggacgtctgctctaaccatcggatccggcatggtgctggaagcgctgggcactgcagtacgcaggacaaggaaagaaaaggcgtgtcgatcacaaaggaagaaacgaaactgcctgtttacagatgacgccgttgtctttgtaggaaatcccaaggtatccaccaaaaacactcctagaattatgaagcgaggccgggcgcagcggctcacacctgcaatcccagcactgtgggaggccaaggcaggccagtcacctgaggtcgggagttcaagaccagcctaacatagagaaaccctgtctctactaaaaaaaaattcaaattagccaggtgtggtgacgcatgcctgtaatcccagctactcaggaggctgaggtaggagaattgcttgtaccggggaggcagaggttacagtgagctgagattgcgtcactgcactccagcctgggcgacagagtgaaactccatctcaaaaa

SEQ ID NO: 267635 - DNA, 382 bp, Homo sapiens
acagagcgagactccatctcaaaaaataaataaataaaaatgaaaaataatttcagcagataattaactttgttagactcaaactacaaactttttcatggctgtggtgggttgtggctcagaacttagcttagattgctcccagtttgccacatgcatggtttagggtcaaccagagacttgggctgggtctatataccaatatgagtttcttcttcttctctaacttcctgttttccagaattccttcctcactctctattgcccctgtttgcccctaagcttcttccataaggacttccttacctttgattttttaaaaagttatttagtttcatgacataccctgcatgtagcattcaaaacctgtgctttaaaaaaa

SEQ ID NO: 267636 - DNA, 414 bp, Homo sapiens
ccaaattcaccagactgtggaagccagaaagaagatctgaccatctcttgcagaagaaataaagaatggtaactgtgcaacaagttattaccttaagtggtatttaaaggcagacatagtgaagaaatgaagagaaggaaagaggaagaaattcaagccaagtcgcataaatgttgcccctggggaaataagatcagagattctaagtccaatgtaaaaatcaggaatggagttgctcattttaagtacagactttccagtctttaagggaaaaaggccctagaaataactatcctttgacttgcagatgaaaagggaactcatggtcaaatggtatgataatcacaatcctgatatcacatatattctcactcatatgaagttacccaaaattactcaggctggttcttagag

SEQ ID NO: 267637 - DNA, 860 bp, Homo sapiens
tatgtgccaatcactgttcgcagcgttagctcatttaatgcattaactcatttagttctggtagagagagttctagtgtactcatttgcactgccacccaagtccgcatccacaccaagaagtaaatggatgtagcatgccactgcgtacactgcgaacgcagacaagcactccttttgggattcttttccttttgggattctattctgttccataacgtcatttctctcctgtaagccccttctctgccacatcaatgctgtcctctaactatgccataaatattttccatcatctttctgttcctaaatcactgtgtgctgttgatattccaccaatacagtacacttaacatgtacaaaattttagatttcactatcacctctcaaaagctggcttgctttctaagattttcccattcgtgtcagtgccgtcaccgttccctaggcccccaaacttgaaacgcgcgagtgtttcatccctctaatatccctcgcctcttcccaggtcttccccagccctttcccttgcaatttaatctttttgttgttttctgtgaaatatctctcaatcgacttattcattctacaaatattcgaggcctacttcatcccaggcactgtattagttctagagactcggggataagacactattcctgccttcaacgagcttacaacctggtagggaagacagtgaggtttataggcatagtgcagtgttataggcactgcaacagggacaacacaggtgctttgagagcacagcagagagatgtctcctgccactaaggaagaaagggaaggtttctcaaagaaactggtggccaggcacagtggctcatgcctctaatcccagca

SEQ ID NO: 267638 - DNA, 254 bp, Homo sapiens
ctgggcaaacttaagctttttaactatgtgccagtgacttaaacacaatgccacttttattttttttttagagatagggtcttgttctgtcacccaggctggagtacagtggtgcaatcataactcactgaagcctgcaactcctgggctcaggcagtcctcctgaatagctgggactacaggtgcacaccaccatgcttggctaattttatgtttttatttttagagacagggtcttgctgtgctgcccaggc

SEQ ID NO: 267639 - DNA, 556 bp, Homo sapiens
tctaaggaggtgacgttgtgccggggcctgcctgatgagaagacccagggaagagctttccaggcagaaggcacagcaggtacagaggccctgaggtgggaaggagcttggtgtgtcagggcagagaggaggccagtgtggctggagcttcctggccggaaggtgaggccggacccagtgaggagtttggattgtgctctaagtatattgggaagctgttggagagttggaagccaaggagggacaggatttaattgatgttttaaaaagagctccttggtgggtccgggcacggtaatcccagcactttgggagggcaaggcgggcggatcacaaggtcaggagttcgagaccagcctgaccaggccagcatggtggaaccccgtctctactaaaaatacaaaatattagcctggcatggtggcatgtgcctgtagtcccagctactcgggaggctgaggcaggagaattgcttaaacctggcaggcagaggttgcagtgagccaagatcgagtcactgcactccagtctggccgacacagcgagactctgtctc

SEQ ID NO: 267640 - DNA, 597 bp, Homo sapiens
cagaaagcaaaaggcccttcaagaaacagaaaaggaaaagtcctgttgtcaagacctccaaggacaagaaccagtgaagcctggtaacaaacacattatgctttgaagatctgccagttaacagctgtgtggtctctctccgattaacatctctcagcccttttttcacctttatgagatggggattataataccacatcccttgtagggccattgtgaggattgaatgagctaatgcatgcccacgtgcccacctcatggtgggagcaagccattgcctccccctcagaggacccagtggagagaaggttgacagcttggcattctctttggaatggctgttgacttcgcactgccatccacagaagagctccataaccccacccgagggcacggaatggcctttccttaaaggtgaagcacaacatcattctcaagtgcctttgcaaataacgaagaccagaactggtcatttacccaggccgagccagacctatatgatacatcaaaagcagaacagaaagaaagggaatgagagaatccaaatgagtttatttgtccattaaataaatatgcaaaattatgcagatgtggaaa

SEQ ID NO: 267641 - DNA, 435 bp, Homo sapiens
cagaaagcaaaaggcccttcaagaaacagaaaaggaaaagtcctgttgtcaagacctccaaggacaagaaccagtgaagcctgggccattgtgaggattgaatgagctaatgcatgcccacgtgcccacctcatggtgggagcaagccattgcctccccctcagaggacccagtggagagaaggttgacagcttggcattctctttggaatggctgttgacttcgcactgccatccacagaagagctccataaccccacccgagggcacggaatggcctttccttaaagaacgaagaccagaactggtcatttacccaggccgagccagacctatatgatacatcaaaagcagaacagaaagaaagggaatgagagaatccaaatgagtttatttgtccattaaataaatatgcaaaattatgcagatgtggaaa

SEQ ID NO: 267642 - DNA, 494 bp, Homo sapiens
ggacaaccagccagagtgggcagctgaggtcacctggagtaattaatcctaaagtttactggtgcctgttctgctggggagcaggaatccaattacccacagtgacagcagcttagtccctggggagatactcatctgcagggcggccaacaacctgtccacctgaaatcttcccgagaagcaacaccaacctccacccccttcactttctccgcacaccctagccaggcacagacctcagctaaccaggacattgcccaggccacactgcctgggttgtggtgcaaaggagtgaattctgggagattggaccaggacagcttctagaggtctcctaacaagaacccatttctcctgtagaacgaagaccagaactggtcatttacccaggccgagccagacctatatgatacatcaaaagcagaacagaaagaaagggaatgagagaatccaaatgagtttatttgtccattaaataaatatgcaaaattatg

SEQ ID NO: 267643 - DNA, 369 bp, Homo sapiens
accccagggcttcctctagatcagaccactctctcgcgttccaggggtcttggttcatgcacctccccaaagttcaacacctttgcccctccctgccctccccgttcacatctggcctggtctccaaggcagagggaagtttattagcccctcctgtttcccagcctcatgagaagatggagagtgtgtttttaagatgatgaattccagaaatcataataatttagttcatggcagttaggggtgtatagaagttttacatttttagataggaaaatttatcagtcttttatagttttccctttggtatcatccctagaaagactcccccaacttgtatcccaaggttataaaacattcatttatatt

SEQ ID NO: 267644 - DNA, 1153 bp, Homo sapiens
caaacaagaaaaaactgataggagtgtgaggaattaccaaaccgagaagggaggaggaaatccagagttcccaagcacgttggctgaaccagaagagattgctgaaagaccaagcagtgcttttgacacactcatgagtctagaaggacaatagaggctaggacctaccaatatagggagcctagtacattactccacatatttcagtgtgtactgaagggttccctctgggaataaggatgagctagaagtaagccagcctttctgtgaattttattaatctgtatggcccagttattgcaagcactgaaatttaattaagttgattataagtggctagtatcctagatgattgacataataaatgtactaaatgaaaattctctctgggggaagacattttcctactacacctcaacatatttctataattcttagatgtacattttttcacattagtatttacaatggaagtatatcagatattgtgacatcttaaattgctgccaggaggcagttgtaacatagttggcattacctgcacattagcagacttggttgtcatttgtggtattactgaaaaactatattttttagtcagaccacttaaaatgaccacttaagaaagggcagcaaattctagttgtgatctgaaaatctgtgggcttcttttggtaagattaagataacctcagtattagaccttgccaaatgaatgtcattggcttagaaggaaactcccggagacatagtgtggcactatttactatctagaaatgcagcatcatcacactgtgggcttaattggagaaaaaagaaaagaaagaaagaagaaatacaacatcacctttgtttttagtagcacaggtagcagcactttttggaaaaactgaaaaatctatgaccctgggtgggaaaaatgattcagaagattcagattctgaatgtgagttattagaaatatcttaaccggttttatattttcctttttgtataagagcaacatgataaaaatgtgtatctagttacataaaaagcttccagtaagaagtaaaaattctaagccatagaagtcattatatactttggttgacattgttttttctttcttagtactacctgaaataaatgttatgtcttataattggttgta

SEQ ID NO: 267645 - DNA, 474 bp, Homo sapiens
gagacagagtctcactcagttgccaagctagagtgcagtggcgcgatcccgcctcactgcaaactctgcctcccatgttcaagcgccccaccttctattgtagacagtagaatgccaagcaaaggagtgaaattgttgttgcatttcagagaaatcattctactctgattggcatattgaaaagtaggttgtggctggctgcggtggctcacgcctgtaatcccagcactttgggaggccgaggcgggcggttcacaaggtcaggagattgagaccatcctggctaacatggtgaaaccccgtctctagtaaaaatacaaaaaaatcagccaggcgtagtggcaggtgcctgtagtcccagctacttgggaggctgaggcaggagaatggcatgaactcaaggggcggagcttgcagtaagcggtgatggcaccactgcacttcagcctgggcaacagagcaagactctgtctc

SEQ ID NO: 267646 - DNA, 490 bp, Homo sapiens
aattcgcggccgcgtcgacctgaacctaccaacaaggtggttatctgagttgagaagtaagtattccctcagccttctaagacacaacacagacctgtgcagcagcaaaaaatgccaggtgggaatcaggaaccacctgtcaaatttaaacagctctcagtgtccagcgagaggagaccagcaaccttccaggtgtgagtggatgcaacagctctctcacctggaggacaaaggagaggattctctctcaaggttccctcagtccaagcactgactacttccctttggagacatagctggcctgctgcagagacacaacctctcagaggaaaggagagtggaaagtgtggatgggaaaggaaggacaaaagaaaaactacacaggaaaagcattgcagcgggaggggcaagaaccacccatcacagaccagatattctttctggcattttctggaagatggttttacctgcttctttctttatttaaaaa

SEQ ID NO: 267647 - DNA, 1867 bp, Homo sapiens
gtagagacggggtctcaccttgttgcctagactagtctgaaactgctaggctcaagcgatctgcctgcctcatcaaattgtatggtttaacaggattaattttatagtatgtaaattcaagctcaataaagctgttattgaaaaagaatcctctggctgggagagtggctcatgcctgtagttccaacactttgggagtctgaagagggtgcatcacttgagcccagaagtttgagaccagcctggcgacagagcaagactccgtctcaatagaaaagaaaacaaaagaaaagaacctatgtaaccacttagaggccttatcccttataaaaagctagatactaaaaaagaggcacctaattaatctcatcagtcatgaatacttagagtaattttgttaaacactttgagaagactttcagctgcagcagtttaggaacaagatggggcttgggaagaagaaacagcttggaacacgaagacctagattgagtatcctggaagcccaggcatctaagggacagcagtagggacagggaaggtggcaaacatttactgaacaccttaaacagacattgagcaagaagcattacagatgctttctcatctactctactcaaagtgcatttttgttaacatcacttcacaaataaggtacttgtggctcagaggaattatataatttactgaaggttactaaaaaaatactgagccaggatttaaacccaaatgtgcctgactccaaagccctgattttttccaacatagcaccttggtgggagaatatctcgaagtgggagaatatctcgaagtgagagaagggagaagggtagatagagaagagatggattgttcccaaagtcttgccaactttacagttccacccttcattgcctctttagtaagatagagggatagagaaagcggggagagagagcagttccctccctattagttatcactccccgacccaactcctgtgctagtgtgggtgctgggtcatgaacatgaaaacctgggtcatccagggcctcttgtccatacccacaactgtttccagcccccagcaatcttccaccttcctggcccatgtccccgtgtgcccctaccacaggggcccagctctattaccaaagtaaatctcctgttcaaaggtgttgtctgtggagtaggcaaactttccagctcggggagtcacctggcgaaagtagctctgggtttggggctgggagaggctcgtcttttcatggatatcctcagtgctcttgttgccaggcatgatctcaactgtctctgcttgttggaagtaactgggcaatcttggcaggggtgagaaaggagggaaaagggggaaagagtaggaggtggatccccctttccattaaatccacagctcgttccctttcctctttaagctcagctcctatacacgtgagcattgcagaacaccaatgtttaacttttagccttgtccccatggtgccagttgaatgtggagctgccagaagggcctgtctacagctgtcctgcctggctactaaaggatccatgccttctgcagccaccaagcagcagggcagagtggcggtgctccagcataacccttttttaacattcgtactcttagaggcggcatggccttggggaagggatcccacctccttcgtcatctcactctgtctattctgtgtgtggttatttaatgtccatccacctggtggtggacaggctgtaagctccttaaaggtacatatctgtgtctgttgcttttacattgtattcccagcactttgcagagtgcctggaaagtagcaagaacataatttatatttgtccaataaatgaataaataaatggatttccactg

SEQ ID NO: 267648 - DNA, 612 bp, Homo sapiens
aaaatatgcaatggtagtcctgccaaaaatttagaaaaattaaaaggtttatggtatctgtgtttgtgagttgtcctttaagggaaattacagcttatatctttcctgaggataacttaatgtcttagaaacagctttccaggctagcagcctaaagctatactcattttggaagggaatgttttgtagtgttgtgattcaaggcagaactgaaagctgaactctaatcagagtcccaggatatgggaaaagctggtgtgtgtaaggatttggcatacacacatcataacaacaaagaaaggtatcataatgtacgattcgagaatagcaaggaaagaatgatataagcttaagtacccaagtggcaaaagtaatcttatctgtaactgacttcagacaagggaacactaacttcctctgctcaattctgctttaaacaacttcagagaaacatttatttttcctgtttacaaacctactaagaacctccttatagcaaagttttcatgtttaagctaattttttattaggtgacactcagaggatatgaaaaatagcctgtcactattcccttcatttattcattcaatgaacatttaccaaatactacta

SEQ ID NO: 267649 - DNA, 434 bp, Homo sapiens
gtaaccttcaaaattgaagatgatttcccagaaacagaatctgcataattccacataagtagtggctcactcattccatagttctatcctaagacttctcatatgcaattaaaatgaccacttttcctgttggtctctttcttcagaaggtagattccttgaagacagagcagttgtatcttatcacttgtatgcctgccagctcttattgaatgactggtacctagctatctactgggcactaagaagtccgagattcttttttttttccttttttaaaaattttatttatttatttatttatttatttatttatttatttatttatttaattatacttgaagttctagggtacatgtgcacaacatgcaggttagttactacatatgtatacatgtgccatgttggtgtgctgcacccagtcactcgtcatt

SEQ ID NO: 267650 - DNA, 498 bp, Homo sapiens
tgaactacaaaatatgattgttttagttctcatattggttatcattgaatgtttatcgaatatttttgaggaatcattataaggtgtctttacctcattttcttttcccagcagattgaaacctactctcccctttcagaagcccatagtcattttttcaggcctccatatgtcagacatacaagagatatgaattaaaaagctgtattgcccttgctttaatggacctgcaggaaccagtcatcttggaaatatacctgtatgtcctgtgctaataggttgcaggcatttgcttgcccttgatttcaatgcagaggtactatttctggttcaccagaaaacagttaaatgaggccaccagagttgctgtcagccaacagggaacttgtatctcccacatcattagcttagctctgtgagtagctacttataccatattcccaaaggcgaatgttagcccccaggaaaacaatgcaattaatctaatctcaacatttc

SEQ ID NO: 267651 - DNA, 494 bp, Homo sapiens
atagaaatcagctcgggttccaactagctgtaaggtagtttgaattttagtttcctaaactttttgaacttccttttcttccgctttggaaggaaaacaaaacaagaactttcctatttcaattcatgagcaataaataaggaagtgatgaaaaatagttttaagttggaaacaagctagagaacctctttacagttcatgtcactggctcttcctacaggggtaaaccttcatgaagatgtctttctttgatactgtaaaaaataacccccagaaatgatctgtaaagacctctgtgagtcacaatacctgtgtctaattctagccccaaggtttgctaatcccatgtctcacatcttccttgagtctcagcttctttacctgtaaaatggcgaaagtaatacttaccctttggaacttttgtaaggacccaataacatatgatatggaaaaaagtttagaaagcttattaaaagccctagtaaaatatgaaa

SEQ ID NO: 267652 - DNA, 671 bp, Homo sapiens
  misc_feature (662)..(662): n is a, c, g, or t
ccttgcagacgaaagctgctgacgggaaaaccacgcgggaggggaacgtctaggccctggccctttcccctcaaaggccgcgggaacatagggctggggaatcctggcagaggctctgggcattattacagatggtcgttgagggtcgcaagcaccaggcctggaggccctcctcggcctgctaccagctgtgacctttggaaagtgacttggctcgcgcctcagttttccgttttctggaggacttgcggcctgagagtggccaccagtcatgcctttgctctcggagccagtgcctggtgcaagcactgcggtgggttcgtgccccagcttgggggccacagggctgactcggccgcactgcctatgcgagcttggccccagtttcctcgtcagggcacagaacttccttcaaagtgcaatacttccattgtgttcagtgcaataccttgcgtcacaccatgggacccatgcaatgctggaagtgctcccaagaagcagagaaaagtcatgacattagaagaaaaagttgaattgcttgatatgtatgggggagtgaccataccgataaaggaatggccctaggattttctaatccatgtttatcctaatttattggagaaatccgtggggaacccttcatcccttgtgtataccccggnatgtgttgc

SEQ ID NO: 267653 - DNA, 662 bp, Homo sapiens
agcatttcactggtgtcatggggaaaagttcagtaaaacttgtaaattagctggttttcccttcccagaatgtgcctttcttttgcagaggaggtgaaccctgtctgcgtgtggcattcagcctctgggatatggggctggccccagctcagtacccggggtggtgtctgctccaggggcctcggtgcttggcttccagaagaagcaagcgctggttttgctgcctgttgtctgagtccagcctgccagtgggttctctctggcctgggttgcatttttgaaagaaacttttcatttcccaataatattaggtttacagagaagtcgtgaagatagtacaaaggattcctgtatatcttccatccagtttcggttctcctagcgatcacatgtattactgtatgcttgtcaaaactaaaatgggctgggtgcagtggcgcatgcctctgtagtctcagcactttgggaggcttgaggctgaaagattgcttgagcccagcagttcgagaccggactgggcaacataatgagaccccgtctctacgaaaaataataaaaaaaaaattagccaggcatggtggttcatgcctgtaatcccagctacttaggaggccaaggtgggaggattgcttgagcctaagagtttgaggctgcagtgaggt

SEQ ID NO: 267654 - DNA, 714 bp, Homo sapiens
aaatgacttggcaatatttaattttggcttgcctttcaatctgcatgtttgtcttaaatttagaaaaattaagctctttacttacttttatataaagtattaattggccaggcatggtggcttacacctgtaatcccaacactttgggaggccaaggcaggagagttgtttgaagccaggagtttgagaccagcctgggcaacatgatgagaccgcgtctctacaaaaagtaaaattagctgggtgtggtgcttccagctactaggcagctgaggctaaaggatcacttgagcccaggagttcgaggctgcagtgagtgatgatcttgccactgcactccagcctgggaggcagagcaagaaacaccctgtgtgaaaaaagtattgaatttgtttgattccactttcaaaatatgctctagatacaggtagtcattctgccaaattgtgttcttctctaaaacattttgtccgtcattctttgaaactcattcttaattatttccactttaccttctagtttggtttgatgccttatattcttgctagttaaaagcattttttccctagtattttctgtctttctagcctttaaggcatattgttgttaacaaatctcttatttaagttaattaaagttttttctgtgcagctgggttttttcttttactacatgacaagcttcatttttacatttggaagtacatgtatatat

SEQ ID NO: 267655 - DNA, 324 bp, Homo sapiens
ccatgttaatgtaaatgcactgccaaatccgcctttcagaaagccagcacgcttttctatttgtctgaaaacatactatattttgtgttctctctccataactactcatattgattcatctttgtaacaatccatgaaagcaagtaaatacctgaagaccacatatctgatgaatggtaaaaaaaaaaaaaaaaaacaaaaacccaattagaaaatggccaaaaaacctgaagtgctatactactaaagaggctatacagatggcaaataagcaaacgaatcacgtccaacaataagatatcaacacacacctatcagaatggc

SEQ ID NO: 267656 - DNA, 380 bp, Homo sapiens
gatcaaataaactaagcattaatcttccatctgaaattgtcaggaaaccttgagatcaaaagaacatccctgggaaggtgttaggctcagcttattattatgtgggggctcagcgtctatacccacctgaagctgggctgtccatgaggcttcagttcactaaccagatgtgcatgaaacagatacaaaaaggggaagcctttagggccaaaaaatagacctaggtttgtattactatttcagcttaatcgtgtataccttgtgtttcctcggccaacaatggctaattatggtaaatactatttagaattatgtgctatgtactaagtgtttgacatatggtatctcatttaaaccttctgtgatcctctgaagagtgt

SEQ ID NO: 267657 - DNA, 435 bp, Homo sapiens
ccaacaattgctatgatctgtgtttttaatgtttataatgctactagggatggagtaatagtatcttattgtagttttaacttgcatttctctaaggcttcatgattttgagcatattttaaatcatgtttttatttgccacccatataacttctatggtaaaatgtctactgatatctcttgcctattttaaaagtaaatattagttgatattgaaatagtaaagaaattttttggaactgcagtcatttattaataatgccagtgacttatttgttttgtagggtaattttgaatattggaagaatatttcctcaaaattttgtgctgttcacaatgggaaactagagacatgaaacacttttaagtttaatctgaattattaacatattctctgctttcttaagtctacctggtcaataaaacaacagatca

SEQ ID NO: 267658 - DNA, 511 bp, Homo sapiens
agtcatcacttgcttgttgcaaactctgtaataatcctttgttactcaagcgaagacttcattatatcgaaggggtaactcgcgatagttacattttctgaataaaaaaatgagacaagttattgaacaaaagatttggggaggtgaagttcagatagaaaaatacgggtacttccaggccatttttgttgtttctgtggagaatactgaagaatatttcgtgtcattgccacctgggaaccttggaagtgtggtcctggagctcgtggccaggcagcgtgtcaccaagagggcagcgcgtcaccaagagggcagcgcgtcaccaagagggcagcacacgccctgagagtgcggacaggctgaggctcccgcacatccgcagagggctgggcttcaccacacgctgtccagcctgtgtttttgggtgaaaaaagaacctgtataaatatattgccttaatattcttggatatcaggaagttcactttaaatattaaacttaaaaaaaaaaa

SEQ ID NO: 267659 - DNA, 342 bp, Homo sapiens
ccctgtgtctttgtctccttctgcctttctcctaggacacttgtcattggatttaggccccaccctaaatccaggatccttaattacatctgcaaagatcctttttccaaataaagtcacattcatggttctagggtcaggacttggacatatcttttggggggccattatctattcaatttactacagtaaaccgccagagagtatgtagctgatgaaatggaggttattctcttggatgcaaggggataatgtacggcgaaccaacagcatgaaaacaattccgaaatcgttctatttagaaagagagtgatagctgggcacagtggctcatgcctgtaa

SEQ ID NO: 267660 - DNA, 330 bp, Homo sapiens
ttcaggaaattaaaagcaggaacagaagcataaattctagaggaaaaagattcagataataagatagaagagtgcagtcatgaagattcctctcaactgaagtggttttagaaactgaaggattggaatgtagaaagatatttgatgtggggagttagggagggcgaggtgataaacattactccgagatttggactttgggtggaagatcataatggcaaaaaaccacataggaatacagaacaaaagggtactgcttacgtagtttatccattagagttgtaagactgcaatcaatagaagacaatgttggctatcttaggtagaaag

SEQ ID NO: 267661 - DNA, 408 bp, Homo sapiens
ggagtcaaaaaaagcacaagggaggaaatgagccacatagttgatgtgaggcatcagcttttccctgcacattcttgctgttcggcaacactatgcgtttttcttcttgtcacccactgcccttcagaagggggttgataaattaagttgtggcacatccatctatacagtgagtgtgcttattaaaaagaatggtgaggatccatatgctatggcatggaaaagtgtaaaatttaaacccaagttgaaaacagtatatttccaaatatttccatggctcagttttcttccaaattaatgtcagggttagagtcccttagcctctgccttcagacatttaaagtgtctttttatttttaaagtaggtagcatgcaatacaaaataaaaagaattaattatcgactaat

SEQ ID NO: 267662 - DNA, 616 bp, Homo sapiens
gccaagaagctagaaagaattagaagacagatgagtcagaatggaagagacggggttttgccatgtttcccaggctggtcttgaactcctgggctcaagtgatccaccagcctcagcctcccaaagtgctgaaattacaggcatgagccaccctcacctggcctgagtgctgaaaaacagaaaagcctcagaggccaaagatgaagcactggatggaagttgacctccaagcagggagcaggcaactcagcaccagcctaggctccacgtggggctgagagagggggaaggccaccgacagtccctgctccatggggaaggcagcctctgactctggctgacgggccggcagtcggataaggattggctggcaggaatgggcatccagctgcctctgctgctgctgtgagctgggaatgatggtgccagtcaagtctgcatggccaggtggccgggccggggtctctcagctccagtggctgaaacacactacagaatcatcaaacctagtctgagatagtcatgaaagagatttagaaaaatacatagtgattttgttccccatttgctttttctaaaaacactcctctctaataaaatgtatgacagcaaaaaa

SEQ ID NO: 267663 - DNA, 650 bp, Homo sapiens
catggtgactggctcatacctgtaatctcagcacttgaggaggctgaggcaggcagatcgcctgagctgaggagttcgagaccagcctgcgcaacatggcgaaaccctatatctacaaaaaagaatacaaaaattggcacacacctgtggtcccagctacttgagaggctgcggtggggagaatcacttgagcctaggaggcagaggctacaatcagccaaaatcgcctcgctgcattgcagtctgggtgacagagtgagaccctgtctcaaaaaccaaaacaaaattataaaattgttaccaaaatgcttcacactatagattaccaactatagttctcaaaaagcaattaatgttcaaccaaaattgacaatataggagaaatggaaaggggaaaaaaaaaaaaaaaggaaatgctgaactgtttatgaaaagctgggttttaacagcacatgaagcagaaactgaaaagtcttggatttgaatttctgaccaacaagtcttccttacaaagattttaatttcagaaataattttggaaacctactgatacaggagttaagtacagctggctctctgtatccatgggttccatatctgcagattcaaccaactgcaaatcaaaattatttgaagaaaaaattaaaaat

SEQ ID NO: 267664 - DNA, 145 bp, Homo sapiens
caggctgctcaacccatgggctctgctgccccactaaggttgttcccaggcatagcaccttcctcttcttgattggaagcagatagtgggggcctaagggagggttcggactcttggacttagaggcagaaggggagagagagtc

SEQ ID NO: 267665 - DNA, 391 bp, Homo sapiens
tgcatttcaataaagagaaacttctagtgtgtgtatgagcttgggaaaattactttgtttctctgtacttcagtttccttttctgtaaaacacatgtggtaataatgtctactttttaggactcttgagtttatgtatgtagatgagttaatatatttcgaccactgaaaacactgctagacaccttgtaagttctctacatgtttattgttgttataactaactctactcgatctcttaattttgtgtttttagtcaggttagtcaggagtatgaaatctgtctctctttgttctatttttttatctttctttctttacaaagataatcaaatctctttgttcttaccttcctttatttccccatgaggattttacttttttcttttttt

SEQ ID NO: 267666 - DNA, 343 bp, Homo sapiens
tgattttccacctgcagtacataaacccagatcttctcgtggatgtcctgcccctggtgctgagcaggggcaccttggagagtctgaggaaggtctcacatcccttcctcactctagcagtggaagaagcactaccacactagtctggggtgacctgggggcatcaccccacacctgagtggaggtgaccgtggctgtggccccatgttggggatggccaggaaggatgtggaagcctttgactcagagccgctacttgacatctgagtttttcatttcattctttccctgctttccctctggaatgtctctctttcaaataaagaatatgtttgacgagagt

SEQ ID NO: 267667 - DNA, 121 bp, Homo sapiens
atatatgtatatatatatattatatttatactcgagaaacttacacagagtctttcctatgcacaaacccaaaagtaaagccaaatggctctatgcaataaacatcatggtaataacgtaa

SEQ ID NO: 267668 - DNA, 315 bp, Homo sapiens
tatgcaaacagtgttcatttggtcttattgtcaatgttggcatttcatatttcttgtcttactgcattggctaaatatcaggaaaaaaattcagctatattggggatgatgaacatacttaacctgcccttgatatactttgatctttttatctattctaatataagattggctgaagttttgtaagactttattgtgctttgtctgatttttgtattgacattgtattgcctattgtctctgtcagatttttgtattggcattatgctaacttggcaaattaaacgagagcctttaaagaaattatatggtctg

SEQ ID NO: 267669 - DNA, 651 bp, Homo sapiens
agaaaaagtcgaaacacaaacgtctgccaactcctgacaaagacccgcctttcacagcgacggaggggtcttccagggagccagcagatggagcaccggcctggctctgcatgtgcaagctaactatcagtaactccagaaccatcctgcgtgagcctcttattcaggcgcgctaatacagcctcacatggggccacacaaccttctagttcctttgctgtgttaatgcgcaaacttaaacacctttttgcatatcaggatgcttactaaccaaaggctccggtaaggtaaccttataaatcattagacactactaaaagtaaacattctttacatatattgtatttaaaattacactatgagcttctaaatgtaaaaggagaaaacagcatttgggaaaatgccattttttttccttaataatcaaaatgcttctgaaggcattttgataaactcctttattgcatataggtgcatactatgaaaataaaaagaaattattcactggccaggtgtggtggctcattcctgtaatcccagcacttcaggaggtcaaggagggaggactgtttgggcccaggagttcgagaccagcctgggcaacacagtgagactccctctctactaaaaattaaaaaaaataaaaaaatt

SEQ ID NO: 267670 - DNA, 357 bp, Homo sapiens
  misc_feature (8)..(8): n is a, c, g, or t
  misc_feature (11)..(11): n is a, c, g, or t
  misc_feature (16)..(16): n is a, c, g, or t
  misc_feature (97)..(97): n is a, c, g, or t
  misc_feature (99)..(99): n is a, c, g, or t
cggcgcanctnaattngatatttcctgattacggcactcggctctggacagggggcctggacaacacggtgcgctgctgggacctgcgggagggccncnagctgcagcagcatgacttcagccccagattttctccctgggccactgccctaaccaggactggctggcggtcggaatggagagtagcaacgtggagatcctgcacgtccgcaagccggagaaataccagctgcacctccacgagagctgcgtgctgtccctgaagtttgcctcctgcggacggtggtttgtgagcaccgggaaggacaacctgctcaacgcctggaggacgccgtacggggccagcattttccaggt

SEQ ID NO: 267671 - DNA, 306 bp, Homo sapiens
gatttggggagggggggacttccatatgcggtttgtgcgtgaagagcctaggctctggagtggtctctagttggcggcaaacagctctctgctctcagaatggggagctgtcacctagaaaaaaagaaggaaataaatcccccacaaagacgtagttgtcaccaattttaggaagacaggggagcactaggaccccatctgagggatatggaggggattttgattgttatgaattgtataagattaactctctgtgtgtcgagcgacggcaataggaaatctcactgtggactaaatttgaatttg

SEQ ID NO: 267672 - DNA, 501 bp, Homo sapiens
aattcagcaaaacatacaaaaccatctatcctgtgtgggagaccagaatataccttctcaaatatgaaggattgctgccctgaagacaagaaccagcagatgcaggagagctgtccacctgccctctttttacccagaagcaagacatagattagaaagagaaaaggtatcctgccccactcctttaccagggagaacaaaggttaaccactgaagacagcgtcagaccctcattagccttgaaatgatatcagaggaattaatattagctttttttaaaccatcttttgtctgctatttgtttgcttagcccaagttactgcctgtagagactcagagtccttttcctttgtcacatctctaaaaatttcctagtctttgttgaagatgctatacaagctggaattcaaagacgcttctttgagaactactcattctctgggtgttcctcatatataaatgaaatatattaataaacatctgtttttctcttgttaatct

SEQ ID NO: 267673 - DNA, 337 bp, Homo sapiens
aatattagctcgcattgtgaatctgacacaagtgctttaatggttaggaacaaaaagtatttcctcttactcttcctctggctcagatagtggctatctgtattaagcctgcatacttaaacaagtaaaccactgcatcgaagtcaaatgagaatcatgaaaacacagtaatctgattaaataaactttgaaactttcttattatgtgaaaagttaactgaactttagcaatatcatatgaataccagaaaattattctttataataaagaataaagaatgtcatagaaacccatgtttctaaattattgaactaactttcatattgtaaaaaaaat

SEQ ID NO: 267674 - DNA, 582 bp, Homo sapiens
cgccacccggaaatacttgggttgcgctagaatacgcaatgggtctgtgttcgggtaacctggtgctcatggtgggttattactattgttgttttactttactgcttttcttgctttcattagaaatgttactgagagaagcctcaaagagcgcagacctggggtcgtttggatgggttcatttcaactcaaatccactaattcaattcagttccacgactagtttccagcgcacaggtacacatggtagacgtcaagtgtatgccgtatgcatatgcacagagacgctatttgaaggcaactcttggagaattttgagataaaattcactctcctggagttacattcgcaatatatgaatatggaaaacaggcaatcagttgtatttaaaatttgccaacacgtcccagcaatccactctcacctaagaatccaaaatggggcattgaaaagatttactggcattctggttgtttaatattgaaaacaagcgtaaatcagttcatttctctttatatttcttttcaaatttaacaataccataataagtgtaagtaataaaaccatattttgctaaagaaa

SEQ ID NO: 267675 - DNA, 498 bp, Homo sapiens
tctatggaggctgcatagaaatgtccatcagaggcctcaacatagtggtcttgtttatagcaaaggcagatgctcccatttcacagacgagagaatctgtgacttgcccagggacgtagtcaggctagactagaaatggtttcttgaagcacacctgcattcaactcgggggaacagagatgttctgggcccccacagtgggtctttagggagggttgagattgctgttgtccaggtgttcgtccaagacagcgacccccagaggcggcctggagaatgggcacaagagccttaaaaaattgtgctaaaacggtgaaaccccgtctctattaaaaatacaaaaaaaattaaccggacgcggtggcgggcgcctgtagtcccagctactcgggaggctgaggcaggagaatggcgggaacccgggaggcggagcttgcagtgagccaagatagtgtcattgcattccagcctgggcgacagagtgagactccgcctcaa

SEQ ID NO: 267676 - DNA, 419 bp, Homo sapiens
agaattgtagttgggatcttagcatcttcactcaatgtcaaagtattttttgtctttatttatgattagaaatggaaaacaaaagatgagacattcatttctattaagcagtcagggtacacctgaactgtaatcaaaaatacatactgctgggcgtgatggttcatgcctgtaatcccagcgctttgggaggctgaggcaggaggatcacttgaggccagaaggatcacttgggtccaggagctcaagacccatctctaccaaaaaaaaattagctgggcatgatggcatgcctgtagtcccagctacacgggagcctgaggtaagaggatcatttgaacccaggagtttgaggttgcactgagctataatcatgccactgtactccatcctaagcaagagcaagaccccgtctctac

SEQ ID NO: 267677 - DNA, 474 bp, Homo sapiens
tttttaatattcacttgcagcaaccaatgagttaagtcattcccctcatttcttcagggttccctgtgttagtacaccctaaaaattgtctcatttttcaggagagagaaatgtttgtaaatagccttgactaaaatgcaggaaagaatagcaatagtaatagcatttgtcattcacctgctgtgtgctaagtatccacattgtctcatttaataatttctttctttctttttcttttcttttttgtttggaatcggattctcacttttgttgttcaggctggaagtaattgtctcaaacaaataaataaaataaaatgtctaatttcacaagtttattcaaatagtccttatttttagcacagctaaatatgagtgacaagcatcttcgtagtctggtttccccccactccatggcaaccccccagaggtgaaaattatctgaagtaacaaatatactctaccgatgatgaaa

SEQ ID NO: 267678 - DNA, 346 bp, Homo sapiens
ttggcccctccaaaactcatgttaaaatttaatccccaatgtggcagtattgagaggtgactggatcatgagggctctggtcttgcaaatggattaatccattgatggattaacagattaatgggttagtggattgatgggttatcatgaaagtggggctttataagaagaagaaaaaaaagaccctacctagcacacttagccctgtgtcgtatgacaccctgcaccccctcaagactgcggagagtccccacagcaaggagcccttaccaaaggcagcccctcaaccatggaactcccggcctccagaacagtaagaaataaatttattttcttataaattacc

SEQ ID NO: 267679 - DNA, 503 bp, Homo sapiens
ctctgtctaaaaaacaaaaaagaaaaggaaagaaataaaatgaagaatcccagggaattcaccagaaatgtggtttagcgggaagttgtactacctttgtgggcaggtgggcctagttcaaatccctgctccaccactaatgccggtggccttggaaagtcattcctcatctctcagctgacattgcctccagattccaccctcccagcatgaaggccagcagataaaatggccatttttttcctgactcttcccatgaagattgcctctgactggacagacttgagccacatgatcatctctgagccaatccctgtggccagaagggatcatgagtgagggaaccagtttgggtcagagaccaccattaggtccaggggaaatacctgaaataggatttgcttaatagtcttctttagattaagtcattaattttactaaatcgagttgttttaacaggaaatttgatattatgaagaactggtgccatttgccataaatca

SEQ ID NO: 267680 - DNA, 451 bp, Homo sapiens
tgaggcagtgtctcccttggtcacctgggagtacaggggcatgatcacggctcactgcagcttcaacctcccaggctcaatcaatcctccctcctcagcctcctaggtagttgggactttaggctcatgccaccacacccattattgacagtgaatcttctgaataattagataagcttaaggtttccttttgtttctttaggaagaagtatggctccaaagcctgagcttttaatctcagctataaatacttgtttaaattaagaagaaaaaaaatcatattatctagaaagaaatatttgcatgtagctttccttgttattctctgttgaaaaacaaaacaatattttgtgcacagctttaaatttttccatgagaaaacaaagcaggtgtgaaataacttagttcgattttcatcactctgttagctagtcttcttaaaagccgatgg

SEQ ID NO: 267681 - DNA, 159 bp, Homo sapiens
tcaccccacccccacctccccgcttgctctttcctatttaaatattgaagttcccaaaaccatacttggaaaatgcatggatcacagatcctacagtaacttgcatctgtttcctaagtgtgtcctcaaccttggcaaaataaacctctagtcaattga

SEQ ID NO: 267682 - DNA, 528 bp, Homo sapiens
tatttcaaagatctaaagctttcacttgaaaattagtcttttggaaaaaaagacattgaaactagtgttaaattatatttcattgaggtaatgaatataaagattcatttgctgtaatctccttgtgatcttttaaagtagtttcttgtacttttaaaaataacactataatggtctatatgtgtatcagtttttacaataatttgtctaaactttagcttataccggtgtgcatgaaaaaccaagtgcagtctgaattagcacaatgcaaatagaaaaccgaccttttattttcctcacaaaattatatctaatataaaccttatgtaaataaagaatttttaagtgcttgtaaattagtaagaaaatcatacaaaatgtcagtggagtagaatagttaaggattttatatcacagtaaaatgcatttctaaattgacagtattgttataaaacatattcttgaatattgtatgaatttatcaccactattgaagtcaaaataaagatggatctctaaagtatacaa

SEQ ID NO: 267683 - DNA, 414 bp, Homo sapiens
aggctcccgagtaactgggattacaggtgtgcaccaccacgcctggctaattttttttttgtggttttagtagagatggggttttgccgtgttggccaggctggtctcgaactcctgacctcaggtggtctacccaactcggccttccaaagtgctgggattacaggtgtgagccaccatgcccggcccacaattcctttagcagttctgatgtgatcctgtcctttgaaggtggatctaatcaaattgtcaacagagaggtccttgaaagtaattttccatgatggagggattttggatctgtaacttgaaaatagtacaaagaacagaatgccagtattataacacaacatctctttttttcccccatcctctcatttatatgaacacattttctctttccttatgttatga

SEQ ID NO: 267684 - DNA, 403 bp, Homo sapiens
attgagtcctattcctctgataccgtgccacgtttgtacatgcctcttcaatgttggtggcctgaagtaaatagacattttaggtccagaatagaattgaactttcacctatcttattttagcatctataattctactaatacagcttgtgtctatgcgtgtcagccatattcactgttgactcattttgaatttatagtcaaactaaaactcctgagttatgttcttattaactgttataaagctaagtttctgtaacttatgctatttcagtatgtttttgaccttaaatataagccttgtctgcattaaatgttttatcttttgtttcttgtttatctaaattatcaagaaaacaatgattttatgttttattccttcaatataaaaagtaatcttcacg

SEQ ID NO: 267685 - DNA, 404 bp, Homo sapiens
gtattatggcttacacgtaacccatgattaaaatataagtacatataggaacagcagccagcaacaacagtgatgattaaatcaagagcctcaattttagacaagtataatttctttgcgccattgaattaggtggtccaaatagctttgtggctcttttaaagtaagtaatttatacttactccatctgacatgcattcatatcttttcttttttttttaaagagagacagcgactcattctgtcacccaagctggagtgcagtggtgggatcatagctcactgtaccttccaattcctgggaggattgttgaggtcaggagtttgaggttacagtgaactatgattgtgccacggtactgcagcctgggcgatagaacaagaccctgtctcaaaaaaaaaaa

SEQ ID NO: 267686 - DNA, 494 bp, Homo sapiens
tggtgctcaagaggatccccgcacaaggaacacttcaactccttctttctctccaagtgtacacaatgtgacagggactgtttctcagaagacatctccttcaggtgaaacagctacctcatccctctgtagtgtcacaaacacatccatgatgacatcagagaagataacagtgacaacctccacaggctccactcttggaaacccaggggagacatcatcagtacctgttactggaagtcttatgccagtcacctcagcagccttagtaacagttgatccagaaggacaatcaccagcaactttctcaaggacttctactcaggacacaacagctttttctaagaaccaccagactcagagcgtggagaccaccagagtatctcaaatcaacaccctcaacaccctcacaccggttacaacatcaactgttttatcctcaccaagtggttccttgtcggggatcctctatgagcgccaacacccaggcacga

SEQ ID NO: 267687 - DNA, 438 bp, Homo sapiens
ctgctccgcccctctctgctgctccgcccctctctgatgtcatcatggatgagtacctgttactggaagtcttatgccagtcacctcagcagccttagtaacagttgatccagaaggacaatcaccagcaactttctcaaggacttctactcaggacacaacagctttttctaagaaccaccagactcagagcgtggagaccaccagagtatctcaaatcaacaccctcaacaccctcacaccggttacaacatcaactgttttatcctcaccaagtggattcaacccaagtggaacagtttctcaggagacattcccttctggtgaaacaaccatctcatccccttccagtgtcagcaatacattcctggtaacatcaaaggtgttcagaatgccaatctccagagaggggcggagcagcagagaggggcggagcag

SEQ ID NO: 267688 - DNA, 898 bp, Homo sapiens
  misc_feature (887)..(887): n is a, c, g, or t
gtgacctcagcagtctcaataacagctggacaggaaggacaatcacgaacaacttcctggaggacctctatccaagacacatcagcttcttctcagaaccactggactcggagcacgcagaccaccagggaatctcaagaggatccccgacaaggaaccacttcaactccttctttctctccaagtgtacacaatgtgacagggactgtttctcagaagacatctccttcaggtgaaacagctacctcatccctctgtagtgtcacaaacacatccatgatgacatcagagaagataacagtgacaacctccacaggctccactcttggaaacccaggggagacatcatcagtacctgttactggaagtcttatgccagtcacctcagcagccttagtaacagttgatccagaaggacaatcaccagcaactttctcaaggacttctactcaggacacaacagctttttctaagaaccaccagactcagagcgtggagaccaccagagtatctcaaatcaacaccctcaacaccctcacaccggttacaacatcaactgttttatcctcaccaagtggattcaacccaagtggaacagtttctcaggagacattcccttctggtgaaacaaccatctcatccccttccagtgtcagcaatacattcctggtaacatcaaaggtgttcagaatgccaatctccagagactctactcttggaaacacagaggagacatcactatctgtaagtgttccttgtcgacaaggaaccacttccggttgatgtgggagcgaaaactgaactcctgctgtcacgcggggtcaggttgaattgattatggctgatatcaccgcgcacggtggctgttgaatcccccgtgtcgcagncctgtgcctgt

SEQ ID NO: 267689 - DNA, 870 bp, Homo sapiens
gtgacctcagcagtctcaataacagctggacaggaaggacaatcacgaacaacttcctggaggacctctatccaagacacatcagcttcttctcagaaccactggactcggagcacgcagaccaccagggaatctcaagaggatccccgacaaggaaccacttcaactccttctttctctccaagtgtacacaatgtgacagggactgtttctcagaagacatctccttcaggtgaaacagctacctcatccctctgtagtgtcacaaacacatccatgatgacatcagagaagataacagtgacaacctccacaggctccactcttggaaacccaggggagacatcatcagtacctgttactggaagtcttatgccagtcacctcagcagccttagtaacagttgatccagaaggacaatcaccagcaactttctcaaggacttctactcaggacacaacagctttttctaagaaccaccagactcagagcgtggagaccaccagagtatctcaaatcaacaccctcaacaccctcacaccggttacaacatcaactgttttatcctcaccaagtggattcaacccaagtggaacagtttctcaggagacattcccttctggtgaaacaaccatctcatccccttccagtgtcagcaatacattcctggtaacatcaaaggtgttcagaatgccaatctccagagactctactcttggaaacacagaggagacatcactatctgtaagtggaaccatttctgcaatcacttccaaagtttcaaccatatggtggtcagacactctgtcaacagcactctcccccagttctctacctccaaaaatatccacagctttccacacccagcag

SEQ ID NO: 267690 - DNA, 796 bp, Homo sapiens
gtgacctcagcagtctcaataacagctggacaggaaggacaatcacgaacaacttcctggaggacctctatccaagacacatcagcttcttctcagaaccactggactcggagcacgcagaccaccagggaatctcaagaggatccccgacaaggaaccacttcaactccttctttctctccaagtgtacacaatgtgacagggactgtttctcagaagacatctccttcaggtgaaacagctacctcatccctctgtagtgtcacaaacacatccatgatgacatcagagaagataacagtgacaacctccacaggctccactcttggaaacccaggggagacatcatcagtacctgttactggaagtcttatgccagtcacctcagcagccttagtaacagttgatccagaaggacaatcaccagcaactttctcaaggacttctactcaggacacaacagctttttctaagaaccaccagactcagagcgtggagaccaccagagtatctcaaatcaacaccctcaacaccctcacaccggttacaacatcaactgttttatcctcaccaagtggattcaacccaagtggaacagtttctcaggagacattcccttctggtgaaacaaccatctcatccccttccagtgtcagcaatacattcctggtaacatcaaaggtgttcagaatgccaatctccagagactctactcttggaaacacagaggagacatcactatctgtaagtgatccttatgccggggatcctcttgaatcagctaaacccaggcacc

SEQ ID NO: 267691 - DNA, 572 bp, Homo sapiens
gtgacctcagcagtctcaataacagctggacaggaaggacaatcacgaacaacttcctggaggacctctatccaagacacatcagcttcttctcagaaccactggactcggagcacgcagaccaccagggaatctcaagaggatccccgacaaggaaccacttcaactccttctttctctccaagtgtacacaatgtgacagggactgtttctcagaagacatctccttcaggtgaaacagctacctcatccctctgtagtgtcacaaacacatccatgatgacatcagagaagataacagtgacaacctccacaggctccactcttggaaacccaggggagacatcatcagtacctgttactggaagtcttatgccagtcacctcagcagccttagtaacagttgatccagaaggacaatcaccagcaactttctcaaggacttctactcaggacacaacagctttttctaagaaccaccagactcagagcgtggagaccaccagagtatctcaaatcaacaccctcaacaccctagaagtaccccaagtggttccttgtcgggtaccgag

SEQ ID NO: 267692 - DNA, 1150 bp, Homo sapiens
gagaattgagccccttctttttaatggaaatcactaattttggtattcaaacttacattttagaatgcaagtagtgtgtatttcactgtttagaagtcatatcttagggaattaaatttgtgataatctttttaattactgagaaggcaatttaaactgcttgaagtttgaatatgccttattacacatgcaaatttgattgttttaacaaggcaaataaaccataatcttatttatttccaagaatgcatattttaatacaattaaaaatgaattttcctgaatttaaatgtaagctttaacttaactttaagtggtttgagtgaagtcttctaaattacacataatcactggttctaaacttccagaaccattctgtttaattaaacattatattatatatatattattattgacatggttcagggttaccactgccagagcattgattcatgttaacttcatcctattaatactgtatcaccctgtattagcagaagccaatatttattatagtattcaactggtaaaaataatacatgatatccatgttgcagtttctcatataaagatatgttttctttagcctctgtaataaagataatcattttcccatcaacattttttaaggaatatatttcttctttcataagatagccattaaactatattaagtggtggtatattttaatatagtgcaaatcaaaccacatacaaaaaaaaactggttctagacacggacagtcacaggctgatataagaaggtatgtgtttctaagtctggtaaaggaagtgggtttagacaaagcaaaaatctagaaaggtttctttctcaaagcaaatgtgcataaagactcaaagggcaggtcaacgcagaatagcagccttgaatcactgccgaatcagcaagaacattgctgtccatggtcaccatctgtaatcactgtgcccaaatgtcagcatcttggctggctggtgtagctttatttttaaaaatattttttgtaatagtacacttgtgtttaacatagaatgttgacttagataaatgatgaggaagttataaataattggagtagcataactttattatttggaaataaaagtattatgtacatatattagtaaaatgaaatgcacctgattcaag

SEQ ID NO: 267693 - DNA, 473 bp, Homo sapiens
cacgaggcgttcagctacctggaggtccaggccatggcgctgcaggagacaccccctcaggtcacctttgagctggagtccctgcgtgagctggtcctggagtttcctggtgtggccgccctggaacagctggcccagcacgtggctgcagccatcaagaaggtcttccctcgctcgacccttgggaagctattccggaggcccacaccagcctccatgctggctcggctggagagaagcagcccctcggagtccactgacccctgcagcccctgtggtggcttcttggagacatacgaggctctgtgtgactacaatggcttccctttccgagaggagattcagtgggacgtggacaccatttaccatcgccagggctgccgccatttcagcctgggagacttcagccacctcggcagtcgggacctggccttgagtgtggctgccctgtcctacaacctgtggttccggtg

SEQ ID NO: 267694 - DNA, 477 bp, Homo sapiens
tggtttttgcattttctatgaatactatctgtgtctcttgtgatgtggtgtcacgatctagaatgggaggagtgagacctgggttctgatcttgattctgctgccctggcaccctggagcaagtcacttaacttctataggcctcagttcttcagctgccaaccaaagacaatcatgtctatcctctctccatgaaagccctttggaaaatgcagggtgatccaaatagaaagtgggtcactggctgggcactgtggctcatgcctgtaagcccagcactttgggaagccaaggtatgagaattactcaaggccaggagttcaagtccagcctggacaaaatagagtgtctctactaaaaaactgaaattaaaaaatgggccagatgcggtggctcatacctgtaatcccagcactttgggaagctgtggtgggcagaccacttgaggtcaggaggttgagaccagcctgaccaaca

SEQ ID NO: 267695 - DNA, 485 bp, Homo sapiens
atttgtcatttttcttatattacttgtactattggtcaccagccaagaaaccactaccaattctaatgtccataagattttcctcagtattttcttgagggttttacaggttcaattcttaagattagttctttgagtcattctgacttaatttttgaaaagggtgtaatggaaggacatgaattttttccagcatcattcttttgcatgttgatatccaggtttccagcaccatttgttgatgcaccatctgttgcagtggggctgacacatttgtaagatgcagtgagcattaatacatgggagcaccatgcatttatttacctgtctttacttcacagttgttttgagaaggctttcactgacagactcaacagaaatgaatatatatgacttcttataaaatcatattcaagtaaaattataaattttaaaatgttaagactggagcaagactggaacatcactagacaagctgaaacata

SEQ ID NO: 267696 - DNA, 444 bp, Homo sapiens
gggttcctgtgtgcagtgacatcaagcaagagatttaccaagagaagtggatgccatgacaatgcatgtaaccatggtgtgaccggcctccctgacatggctctcaaaagctttccctctgtgaaaacagaagcctgtttgcaaattaattagtttctggcggcagcttgattgttgacccagagtttgtagagtggaaaaacaatcagattagtgtgctcagggtaaaagaccagtgtgcacttgcgtgtggcttgctcaactattgaagctatgaatggggtgaaacaaattctattctgagaagcccaggcagaggttaagtgtgatgagcctagagctccccaacagcaggggctggggaattaaaggattttacccagatcaagctgaatgatgggaagcaatgccattgaattttaatggaatggagagttttgacca

SEQ ID NO: 267697 - DNA, 618 bp, Homo sapiens
agagggcttccgaagttgtgtagtcttcaagtcccatgaaacccaaatctgtccctgtacttactgcctttctaagtactctatgaattcctttccatggtttcctcatgcaattctcacaacaaccctatgaggtagaagctattatattcacttctgagatgaggaaattgggcagctccaccatggttaccccatgagggagtgataggcaaggactttcactctggcatttgagactaactctacaactccactgaacactagggatggccaaacctaactctagctcatgttaaattaggcatgtagccaggtgtggtggtgcgtgcctgtaatcccaacactttggaaggccaagatgggaggatctcttgacccccagagttcgagaccagcctgggcaacacagcaagacctcattcctacgaaagagttaaaaattagccaggtgtggtggtgcatccctgtagtcccagccagttgcgaggctgaggtgggaggatctgttgagtgcaggaatttgaggccgcagtgaactataattgcaccactgtattccagcctgggtgatggaccaagatcctgtcttagagccattgcatgttggttgtcttt

SEQ ID NO: 267698 - DNA, 146 bp, Homo sapiens
cactccctatctgggggaggggtgatgctgtgacttaaatgcatggcctaagcaacagtctgtagtatgatacgtggaagttagtgaaaaagagaaaactggtagctcagaaaaacatgtgggaagggtctagatatttaaattct

SEQ ID NO: 267699 - DNA, 3364 bp, Homo sapiens
  misc_feature (497)..(497): n is a, c, g, or t
  misc_feature (1260)..(1260): n is a, c, g, or t
taaacacaagcttgtaataatagatattcaacttggaaatatttttgacacccacagatttttctggtaatggcaactgttgtaatgttctttgacgaatttttatttttcttcccacaacatctctatgctttaaaacagatacggcagaagttcttatctctgggagacatttgctctgataagaaagtattaagattctccctagaaaggctgactgggatggcacagggatggagggctaatgttagatactacagtttgggcagagtaccctgatgaaacctgccttctgactgctgtgtccctattttcctgtatgccaggtttatgactaagacgcactgcccaccctacctctactgctgaaatcagacaccaatacttaacgtgtcctcataccatacaacttctagccttagagaaaatggcatctctccaagccaaggagacatggtcaaaaacccaggtgccccatcagttccagctcccattancatgcagaatggaataggggagaaggtaggaaggacacacacttaaccatatcacaagaaggaaacagaattggcttggtcttcaaaggactttcctaaataaaagaatcccaattaaaatgcagaatttgttaatggaacagtccccactgcagctgagagactggggagactaagaagaacaacatggtgcacagtgactccggggaagaatctgcaggctgggccctctcctggagctctcattctcaccttctcaccagagaggctcacctggttggtgtcttaaggccctctttagctgagatgttactgacctgaccagggtcagtcagatctctccttctggtttataaaggggataacggaatcctcgcttctgggtgtttcattctttccacaattggatcatgtaaagacccgctaaaataatcttttaaagattatgactaatcctgtgcatgtggctatttatgtttctctataactactggcatcaagctaaagcaaggaactttagaaaacaatttcattaaacaggataaattgatagtctttagccataaaaaagagtgagatcctgccatttgcaaccacatggctagaactggagatccttatgttaagtgaaataagccaggcacagaaagacaaacattgtatgttcccacttatttgtgggatccagaaatcaaaacaattgaactcatggacatagagagtagaaggatggctcccagaggctgggaagggtagtgagggnctgggaggtagggatggttcatgggtacaaaaaaatagaataagacctactacatgtgacagcacaacagggtgactatggtcaataacttaattgtacattttaaaataattagaacagtgtaattggattgtttgtaacacaaaggataaatgcttgagaggatggataccccattctccatgatgtgcttatttcacattgcatgcctgatattgtttggctgtgtccccacccaaatctcatcttgaattgtagctcccataatccccacatgtcatgggagggacctggtgggaggtaactgaatcatgggggcaggtctttcctgtgctgttctcgtgatagtgagtaagtttcatgagatctgttggttttataaaggggagttcccctacacaagcccgcttgcctgccgccatataagatgtatcttgcttccccttcgctttccgccatgattgtgaggcctccccagccatgtggaactgtgagtcaattaaaccttttctttatgtatcacccagtcctgggtatgtctatattagttgtgtgagaacaagctaatacaatgcctgtaacaacacatctcatgtattatatatatataatatatattatatatatatacctactatgtaccctcaaaaaccaaacagaaaaaaattttaaagaaaaataaataaataaataaataaatggatagccctcactgcagaatcacctgaggatctggttaaagatgcagatgctgttttggtaggtctggggtgggagtcaggaatctgtatttcttacagaggtggttacacactactctgtaggaaatgctggcctggactcaggaaaacaaacaccatttaacttaaacctaccagcctgtgatcccctccagggtgagactgtgttttattcaacctatgtttctctagcacaaaatcaggcagaggagcccatgtgatgatcaacatttgctgaatgaatatatccattcaaaatgcatttcccaagttccagagttcagccagagcacaacgcacaaggtaggagaaggagaaatacacagagtaagcatccacatcattagcatccactcctgagccctggtggacagatgcatacacagctatgagcaagttcctgccctgtttgaggccttgagttgttaattgtacactctacttgcagccttcaactggaattcacagtttgtgacatttagtcatgcatggacatacaaatgtaaacacagtggcattttaccaagaggcactcttatgtaacaagacagcactgggaaaaagagtgaacagatgtacaaactaagcttctactctgcctaatgaaggtgtttgttgctgcctctgcatgctgaattaacttctcctttgatatactgttcttttcccccttccccttcatttgaaaaggctatttggccaggtgcccatcagctctaagcaatcgtctttcctgggctgtctggccaactcttgctgaggacagatttatccctacctgggctttttggtagcttctagaaaggtctgagtaccctgtagttgacctcttccctgcatgctgaccttccttgctcaccctttaaaaagtcagtggtctggtgagatccctcttgggaaaggctatatattgggttggctcccttcccctgtttcccagttgggagagtatttgggacccctttatgttgctctgatgggtttaaagtttcagtagctatatgtcccctggaagaggaaatggtggtggtaggggaagtggtgtggaaagtggagaaggtaaaagggacagcctttcctcgtgtttcttttgacatttggcctttcatggattctgagaacatggtcttcacactaattcattcatcttctaagcctacttcccctcctaacctatctgatggagtcattacaagcacgtgattagtatatgtaaagcatggctgactcacaggagatgctcaaaaactattagcaatttcattatcaaaaattgtttttttcaggtttggggctaaattaatctgtttctctgtctaaaccctgttatgtatccataattccaataaaaattcttcttgcta

SEQ ID NO: 267700 - DNA, 241 bp, Homo sapiens
tttaggctcctttacatttcttaatctttttatcagaaaataaaacaaagttagctttagtcattgctgaagcttccagtaagaatctctataagtggttttgtagtcgtgtgtaatcatatgttggtatatggcatacatttagctgtctggtatagatacataaaattaggtatggttttcacattccattcaattttctcacttgctctagtgtaagtaataaactttcatcctgata

SEQ ID NO: 267701 - DNA, 1229 bp, Homo sapiens
ttttgacatttttgtgcttcaagtgtttccagtgtcttgaacaaataaagaaatttttataactatttaaaatgaaaatgatagttttgaaaatgatagaagcataggaagtactctaattgtcctacaataaaggatacatctaactaacaagtaatcagtttcagattaaatatatatttatcatttcataatgatataaacaactgattgttacaccaggttaagaaaattactaaatgaaaaaaacagtagcataactaaagataacattaataaagtactcacagagatccttttactgtgaatatacctaagtatcataaaactgctaaaaagttagaaggtataaaattaccagtatggatcagattagtatttttgcttttacaggggtaatatcgttagcagcaataaagattacctttagtgctccgtaacttgaaatctgcagagcctttaaacactaaacaacaaaaagctacaaatccctagttttaagtatcagttcattttatgattaaggtttcttttttcattaaccctcattcttcagttagcttcatcttcagagcaagctgatgatggcttgtgtgtgctagcaggatgaacgctatcttttcaaaacataatgccacagttcatgtacagctggcacatctatctgctttaccagcagtgtttttaaggatcatgcggattgaacagcaactacagcttaaggccctgacaaggtttactgctgacattctcttcatggagatggtcacccttatcgtacgctttattcgttacttattatcttgaaagtagaggcgacgtctcattgcatcctgatatcaccacatcatttttatcttctaatttaacaatttctcagaaacagctaacaagagtaatttttctagtttgtattgtactgtgactttatttacattttaattgatgttatataatatacactgtatattatataatttaaatatatatttcatgttttatactaaaatgttacattttaaaatacatatttattcttgcacatagtatcaccagaatcctaaaatattagcacgaaaagaacttcgggaatcatccaaaacaaacgttcttttcactaatgaggaaaccgaggttcagaaagacgaaacaatttatgcctaggatgatatgatttaaacatccaaatataaaacttacctactttggacatttttccagctacatgt

SEQ ID NO: 267702 - DNA, 404 bp, Homo sapiens
tactaaaatatctctaggaaatagagatacatgcaatttgtttttctcagcactgcttaaaatagcagtgtatttggaaaaccccttatagtggattttataaattttataaatttatcaataaatttcagtgcatccataggatgggacaatatgggacctttgcagatgtcagtagatacagatgtatgttgaggtgtgaagatgtactctgaaaaaaagttggtttgattatacatacacacaaacaatctatggtgttagtaagccaaatatgtgtacaaaatataacatttcttcttttctggcaggtgtattgtgatattttttcttatctgtgatgtataaatgatcagcatgtttaaaacttctagtaaatgttttttattaatgaaattatcctt

SEQ ID NO: 267703 - DNA, 362 bp, Homo sapiens
gggcttaatcaaaataaaaaatgtttgtgtttcaaaggccatatttaaaaagtcaaaagaaaatctgtagactgggccgggcgtggtggctcacgcctgtaatcccagcactttgggaggccgaggcgggcggatcacgaggtcaggagatcgagaccatcatggctaagatggtgaaaccccgtctctactaaaaatacaaaaaaagttagccgggcaaggtggtgggcgcctgtagtcccagctactcggaaggctgaggcaggagaatggcgtgaacctgggaggcggagcttgcagtgagccgagatagtgccactgcactccagcctgggcgatagagcgagactcctcaaaaaaaa

SEQ ID NO: 267704 - DNA, 681 bp, Homo sapiens
aagaaagttaacattaattcagtaatactatatccaaatttttctagttgtccctcagaattccttcatagctgttctttttttgcaatccaggatccgatcagtgttcacatactacattttgttctcatgtctttttagtctcctttaatttagaaccgtcccccttgccttttgttgttcttggtgttttggatgacgctgacattttaagagtcctgaccagctgtcctgtataatgtttcacaatctggatttattgtttccctatgattagattcagattaaacattttttggcaagaatactatgtaggtgatattatttcccattacatcatattagaaggtacagaaagtaactttatcccatcacggatgttatgaagttggatcacttggcttaggtgttttcatcacgtcctgctccattatagaggtacattttcccctttttaattaatatgctatctggtgggtgatcctttgagaccatctgaatatcctattccccaacaaccattctgcattttgttttagtttctgaattttgctagataatggtttttcatgtatacctggcactcacgtattgaatattctctccctaagtgattccaacaaaaataaaacaaatttaatactgtgttagccaaaaagagactccattaagtcgattttt

SEQ ID NO: 267705 - DNA, 178 bp, Homo sapiens
aaatggagagttattgctagagtttgtatttgcagtgatgaaaatttttggaaataggtagtggtgatggttttacagcactgtgaatataattaatgctgctgaatggtacactttcaaaatagttaaaatggcaacttttgtgttatatacatttcatcacaataaaatttacaac

SEQ ID NO: 267706 - DNA, 778 bp, Homo sapiens
aacaccatcctttaaaggaaggcagaagaagcagagcccttataaatttcacagagtccccctaaggacattcagaattgagcgtgaaacctgggaaagcagaactagtttattgatcaacatttacaaatgtgaaacttaattttgaggaaaacagggtatactgcaattgaagctgttgagtagacccaaaaatgcctttgaaggtggaattgctcacctttgttactgagaaaactcccgggcaaaagtttagttttgatcatgttaaaggtaaattaaaagctgaccttggcttttatattcctggctttcctcaacctgaagtcttctgacttctctgaacctaaaggaatgagaaagttgcaaggatttgtaaccggctattggaattaattgtgctcactagcctatattttgttttgcttttttctccatgtgtttgctttttggatgtaattcttaaattgtctaaatggtcaccttttgttgttgttattctttaaatggtacctggacagctatgatgggtcaagagagagaattgctttatactacaaggctatcagaagatcactgaggttgtagtgagccgatatcgctccactgcactccagcctgggcgacagtgagactgtcgtgaggaagggaatgtgataatccaagagagagatgacaatggattggaacacagtggcagcagtggaggtagtgagaagtggttggatgcaggatatattttgaagaggaagccaataagattcggatgtgagaaaag

SEQ ID NO: 267707 - DNA, 891 bp, Homo sapiens
gcacattttactggctggaatcccagctgctttgggtgtggggttggtggccggggagcctccgggttcagtcggcctgaggtctggagggtggaaggggtatcttagggtcccctggggtgcagcagggcctgggcggcacccctggctcccattccagggctgtgtcccgtaaaactcgttccatccacttctgcctgccccgtctcctgctgagcttgacgtgcagtgcgtggggtgagcttttcaccccctaccacgggtggagcccgaggaatcgtggagggagcttggtctccccgaggtgctcagtgagctgtggggactgagggcgtgagctgtggggaccggagcccttcagggcccgggtgtgactgaaggcgtcagtgtcgggggtttccccaggatacctgccatcggcctggcttggttgcggttgtggctggggggtctgtggtgagctgtgcaggtcaggggtggatgggctgccgcttccgctgccttccccagacccctgctgtctccagagcttggatgctcccctcagtggcagctggagcccagggctttggaccgactcttcataccgcagatgcctctgagcaccgtgtgttcgggccgtgtgcactgtgcctggcctgcgcccccaccgagggctgctactggtgtaagccggggaggccgaggcagcgtctgggtggggttcgcccgtgggggctgcttcgtgtccccaggtgctgtggtgactctgggagcagggcatccctctgccgtgatggggcccctgttccactccagggctgcccgccgtttgctgtgcactcactgccctgttgggctctctctgtggctgtgctgcccgcacagagccttgtgtgagggccgaagagg

SEQ ID NO: 267708 - DNA, 257 bp, Homo sapiens
atgtgattttggagtttggtctcccgcaggtaagctggcactgatgacctcatcacaagttgtgggtgcaatacagatggtagcagtggagttaaaattttggctcaaggtgggtttgtctggcttactagtgggagcagctgcaccagctgggacaatactgcacatctgagaagtacaaggcagttgaagacaatggaattggatggctgtggctgggaataatagatcctgtggaaaaataaaaaaaaaaaaaa

SEQ ID NO: 267709 - DNA, 340 bp, Homo sapiens
atgctgaatctgcaaagtgctttcaggacctccaaaaggagatgcaggggtggggcttcaccagcagctttcacctccccgcctggaagcttctctctactgcgtggggagctgtgactacaggctcccacctctctggtcctggaaggtcatctgagagtgttgccttgaggcctagagctctgctttatctaaatttaaaaggagatggaaacttagagaagagtagagggttctgtagtcttgggcagcaagctcctctctagaaggtaagctagcggaaatgcaaatccagatgaacacagcctcatacgagtgacctccagactttggggattgc

SEQ ID NO: 267710 - DNA, 344 bp, Homo sapiens
ctattaatatttttagttcaaaaatacttttttccctcaaactccaaatatttcatgtttagaactgcagaaccacatcatgttgtcctaggaatcaccgtgtttccaaggccatcgaagtgtctcatgtgggtgctgattgatgggcccgggaggagcatgggtgcccctggacaacaggtgcccactgttgagagcagccttgagattgtctgtcccaccgattgcaggtgcacatagcacctcgattctctaatgcctgatgtccctctccatcagattccgaaaaatggggcagttccttctttcccagatacaaaaatggtagtttgtggcaagatgag

SEQ ID NO: 267711 - DNA, 497 bp, Homo sapiens
ggaagggaggaagcgtagaaggtgccgatgcacttttcctctctccagccctcctgactgctccaagaatttcatcgaacaagactcaaagaggcccagctgctctgcgttttgattcttctccctctctcagtccacactgacctgggaggggcttctcaaacaccacatttcctagcgtgctgtgagaagaggactgtgagctaagaagggagaaaaggcactccctcctcatcaacaaacacctgacctgggtagaccctctgcttaccaagatccagtccaccttttgacatcagcattcatgctgcctctttttacgaaccaagccaaagtggtcccttcctctggaaattataggatacttaatgtacatcatatccagcttcccgactccagactgtgggagatgacacagagccagcctgcctggatgtgactcagctctgcaacttattaaagacctttggcaaatcacctaacttccctgcggccga

SEQ ID NO: 267712 - DNA, 367 bp, Homo sapiens
tcattcctgctaccctccttgtggcacccaggtacattttttttttaaaggaggaaaaaaagacatttatgtgtaagtcccggttccatgggatactagctgtgtaaaagtgaactggttattacaaatgtaaggtttcaaaactgttttattagatcgctgattattcctcttatgtgggaacaaatccccttgtttgcagagagcatggtcctcttagggtatgaatttctgaccagtgtcctccatctccagcttcccgactccagactgtgggagatgacacagagccagcctgcctggatgtgactcagctctgcaacttattaaagacctttggcaaatcacctaacttccctgcggccga

SEQ ID NO: 267713 - DNA, 378 bp, Homo sapiens
aaatacagacaaaccaaccaaccaagcactgacgagccagtaaagagggaactgtcggggaatcagggctgagagaatctctgatacagcagcggaaataggcactccctcctcatcaacaaacacctgacctgggtagaccctctgcttaccaagatccagtccaccttttgacatcagcattcatgctgcctctttttacgaaccaagccaaagtggtcccttcctctggaaattataggatacttaatgtacatcatatccagcttcccgactccagactgtgggagatgacacagagccagcctgcctggatgtgactcagctctgcaacttattaaagacctttggcaaatcacctaacttccctgcggccga

SEQ ID NO: 267714 - DNA, 450 bp, Homo sapiens
ttaggattcactgtttgtattgtatatgctatggggtttgacaagtatgtaaggacatgtgtctagcattacagtatcatacataaaacaagttttactgctctaaaaatcttctgtgctctgcttattcacccttttgtcccactaatctctggcaaccactaatctgctttctgtctccatagttttggcttttccagaatgtcatattgttggaatcatacagtgtatagtcttttcagattggcttctttcactgagcaataagcatttaaggttcctctgtgttttttggtggcttgatggcccatttctttttatttgaaaagttagacttttaataagttgtgttggaacacctagataatcatttggtaaatatgaagtaggagacatactgtacaccgtacaccatcataaaatccagatgggtcagacatctaattgtag

SEQ ID NO: 267715 - DNA, 408 bp, Homo sapiens
gttgtccagttgtatattatataagacccagtagcatgacaaaattgccagaattttgcttttccagattacatagtctttcctgtgggctctgcaatctccactctccctccaaaacaagtacatttttgtgaaattttaaatagaaaaatctctatatagatctaatgtcggtttcttaacatttacatttcagtgtcttgggatttgtgattacatcaacttgttttggaaaagaaataaattctcttaactttcttttaaaaaaatctattttaagttatagagatgacataacaatattatagacagtttaccaaaaatgtgataatcctgccacccagtcagaatagacattgccatttttctgtttcctttcagactttaggtgacaggacagtgtgattt

SEQ ID NO: 267716 - DNA, 493 bp, Homo sapiens
catgctgaactgtgagtcaattaaacctccttcctttataaattacccagtatcgggcagttctttatagcagtgtgagaacagactaataagcacctggagtctgggagcgtgccctgcggctgccatcatggcgagcgtcatcagggagaggggccaggaaggcaggtgacttcacccacacagaaaaaaaaaaaaatgctgcttctgcagcccttcttccctgttacctagagtgggtttcagcgagaagactctgacaagacaacacctgaaatcgaacgtgtagtcttctaaattgtgtgggaccctcaaaggagggttggtcacgaaccagagggcataagagacaagtaaacagtagacccttcattttttatttcccgtccctggcgtccagcgacacacttttcattcccaaggacttccagggacccaaagtcctcccctggcttgcttttgtgaagcccatgatcttgcatggaaacctaaa

SEQ ID NO: 267717 - DNA, 369 bp, Homo sapiens
gttttacagatcagcaaatgaggcagagaaaggaaggttacttctgaagttcacactgctggtatgtggtggagccaggatgtcaagctcaagaatctctgcctctaaagcctcttgaagaaacagctaataatatctggagagccacgagaaaaaggaaaatacttgagtctgaaaagttttaatcctacttgacagagtgcaaggggacgtcactgtcggaagggaaatagtgcatacagtgggtaacaagggaagtcatttagccagttgggaacaaaccatcttgtaaaagtgaccatgaggaataaccgatggaaatttttgtatagtgctttttcagtataaagttcgaagtaactttcaata

SEQ ID NO: 267718 - DNA, 231 bp, Homo sapiens
aaaaaaaaaaaagattgataagctggctcatgtgatcttgtggctcaccctggaactgactgactcagtgcaagaggacagcttcagttccctatggtttcatctcctgccaaccaatcagcactcttgactcactggctttcctccacccgccaaattatccttaaaatctctgatcctggaatgcttgggcaaaactgatttgaataataaaactcctgtctccgaaaa

SEQ ID NO: 267719 - DNA, 526 bp, Homo sapiens
gtaatgaatggaaagacttttcttttccaaaaatgacagcttagaaaacaccagagggtttataccaaaatatatttttgcagatgcagtaaatatcaaaaaatatttaattcaaaattgattctatgtaaatatcagagaattttccatagaataattaaggcactgacacttcagacattacactaaatcagaatgttcagtataaaaactaatccacagctacagctgttagataaattatttctatataattttttaaaaagtggatttttgaagcactgtaattacattgaaagtatacttgttttcttgaaaaaatttttttgaaaagtgaataatgatataatacagctttcacattgctttatgctattttattcctattatattcacatgtgaaagcatgtgatcaattgttgctgcattagagatattagagattgttttttattagttgggcattatgtatgaccttttctataaaagagtaaggacattaaaatgtaagatgcatgatgaaaat

SEQ ID NO: 267720 - DNA, 746 bp, Homo sapiens
tccagcaggtagaggccaaacagaagctccgcttgggcagccctggtcggcctctcttatgagacccacacggctgcacgctctcctgactgcagctttgggctggatcagtagccccagggcccccaggccacttctgaagagggcgagaagctccccgccaggagtcttgttttgtcccctaggctggaatgcagtggcatgacctcagctcactgcaaactctgcctcctggattcaagtgattctcctgcctcagcctcccaagtagctgggattacagagacctgaggctgcaggacaaccaactggaagctggggagagacagggcctgcaggggaatggcattgagccctcccgtccctggggcagtcacggggcatcgttggcaccctgaggcacggacttgaaaaaatgcattgattcaagatggaataaaccgagtaggtttcagaacagccacccttggcctggacagtgcaagagctgcagagtgtcacctcacagggccagcggcgacccaagacacgggtgcctggaaagggggctctctgcggggacagggctcagaaaggctggacctgtcctgaaccacagaaacagggttccctgaacctcggccatcgtctaccattacggcgccctgtccagatataaagtcagaaaatctcagatgcacaaacattttgaagtaaaagatagtttctaaaccattactcaaaccaataaaacgtgaagtgaaatg

SEQ ID NO: 267721 - DNA, 419 bp, Homo sapiens
tcctaaaactccttcttcgcccccctccccccccttaagagtaaagaaaaaaaaattttatagcaccctgaggcacggacttgaaaaaatgcattgattcaagatggaataaaccgagtaggtttcagaacagccacccttggcctggacagtgcaagagctgcagagtgtcacctcacagggccagcggcgacccaagacacgggtgcctggaaagggggctctctgcggggacagggctcagaaaggctggacctgtcctgaaccacagaaacagggttccctgaacctcggccatcgtctaccattacggcgccctgtccagatataaagtcagaaaatctcagatgcacaaacattttgaagtaaaagatagtttctaaaccattactcaaaccaataaaacgtgaagtgaaatg

SEQ ID NO: 267722 - DNA, 407 bp, Homo sapiens
accacactccaaaacacacacacgcccatgtacacacacacacatacatgcatgcacacataaaacagtcacagctaagttgacctagacataattttcttacaacgaactacgcgttataataactacttttactctatagaaacagatggatatttgctgcatacttattcattaaactggtcatcaatgtctcatgcacttttttttttttttttaagaaggagtcttgttttgtcccctaggctggaatgcagtggcatgacctcagctcactgcaaactctgcctcctggattcaagtgattctcctgcctcagcctcccaagtagctgggattacaggtgcgggctaccacgcctggctgatttttgtatttttagtagagaagggattttgccatgttgg

SEQ ID NO: 267723 - DNA, 275 bp, Homo sapiens
ctggggcagacctgggcagggcagagcacagcttgcaggacctagtacacagtgttgggaattgaatttgggttttgacctttgaagctgtgcataaagtctaaaacaagaagaggagtggaggctgaggttgtatttgtattttaaaatgagcatttgccacacaaagccaggagcttcagaccagcgtggttaacacagcgagaccctcctctctgtgagaaattaaaaaaaaaacaataataaaagccaggcatgttggcatgtacctgtag

SEQ ID NO: 267724 - DNA, 717 bp, Homo sapiens
ggagcgtccgcgaggcgctggggcgacggggcaggtttatccgggctaactttgccgagtctgtttttgagggaagaggttgtgaggatcgtatcttccgggacgcgtttcacgtgggaaggcgctccacgcctggaactgtcagcagccggcgcctgaagagctcctgccgcgggcgggcgcggggcctctggcctggcagccgcaggacccaatggatcaggcgctcacgctgttctcactgcatggcttcagtgccttgcctggcacctcctatcctgtaactggccgactcggggtcccacccaggcttctccagcggccgggaaggggctctgcttccggaagtgtttaggaagggagccagcgtaaaccagagtcccttcctccaagcatcgctgaagccttttctcccctggcagccgacttccttttctttggaaaggacgtcagtttattttagcttgttgaaactgttcagagatgcggtcttgtgggcaaataaatgcctgtttagctgagctgttattttcagctaagaagttcttcaagttttcaagatctaggagggggtgtaggctcgaattataatggacccagtgtagcaaaacatttattcatttaaacaattgtgcatgctcattcagacgcactacctgagtgagatgatgccgttctgggctgcttcatcttaaagagagtcactgtttcttctgg

SEQ ID NO: 267725 - DNA, 347 bp, Homo sapiens
atacttaatcttacaaatcaggaaaaagtaagccagtgaggtaccactttatgttcatcaatttggcaaaataatatgacaatatggataattgttgcagagaaacaggaactcttataccacttggtgggaatgtaaaaatatgtaactattttgtagatcaacttagttgatgaagttggaggtatatattaaatatatcctttgacctagcagttttctttctaggaatatattctagaaataagtattgttctcaagaattgtttattgcagcttcataataacaaaattgaaaacaagtgagaccctgcctgtgcaacatagtgaaaccttttctttacaaa

SEQ ID NO: 267726 - DNA, 735 bp, Homo sapiens
attgaaattagaaacattgtgtgcatttctaatactcgtgctaggaaaaagactatagctgtgttaaagtttaatgcgtggaccgtaatagagagctgaacagctctccacggccccgtttttccattcgttttcggaataaagaagctggttctattttaggcttgtatttgggaagtggactttaccagaatgggagtctgaggccagagttgccttttccctcccatgtgaacagatacagttgagaggtgaagaatggtgtgctctgccctccactgcccgccccctttgtatgtgtgttatgtgaaattttaagggggtatatggagtttggtgatttaaaattctttatcagttttctctctagattttcatagaatcacctatagactttctttagggtacctctgttagggacagaaaaagggaatgaaatatacaccggtttcttgttgttttcatttttagcattcatttgagcagggatgcaactgaggctttagtttgcccttggattagttatcctctgtctcagtaggcaggtttatttggacagtggcatatggagagggtcaatgggggcaggaaggatgttggtattttatcactaacattgtttaaaattacagtgcatgtggacaataaaaaccataatgactttattatttgttttaaaactatctagaccagcactgtccaatagaattttttgcagtgttgcaaatattttac

SEQ ID NO: 267727 - DNA, 2055 bp, Homo sapiens
aggatgtacttataaggcatgggacataagccacccatctgtccataatcaagtggcacagtgagtgggaccaattcaacgtaggagagtatgcaaaaagtaatccagtgatctccactaccccaggtttctgcgttgcttattcactgcaacaaataatctgggtgttattaggcaactagatcttgcaaaacggtgattaaatgcagtcaattcttggtttgagtgaaccaagctgtcgataaaatgtagctgcattctcagttcaactgcaaagcatttaaaagaacgttgcttccagagcatatccatccagaagacagctttaaaaaaccaaaataggtcagggccatttttgtttaaatggatgtaggcttaactgattattcctataataaaagaagtttccagggaaatatcccagagcattcaattgagtcttccacccagcataggtatcccacaaccagctctgttttactcctgggttactttgggaaagggtaatagaacttctatcactcttagcctttaacttctatattccctctccccacacacaaaaattcatgttctgctatttcagtgttaagacagtcttcaaagaactttccaaagaggtctaaggagatagcttaaccctgcttattccttgaataccaatagagaagaagctctagaggacaaaatcccagtccttggcacaaactcaggaaatggaagccggagtctgttttttgtggggctgctaattgtgctgattgtcagcctggcactggtttttttcgtgatatttctaatagttcaaactggaaacaagatggatgatgtgtcaagaagactaacagctgaaggaaaagacatagatgatcttaagagaatcaataacatgatcgtaaagcgactcaaccaactcaaccaactggactctgaacaaaactaaaggactgattttctgaaagcacctgctaacaccttgagctttttactttcctgggagtgtacagggttaggaactgagaaagtgcacttcctcaggcaacagatgatctggtcaggcaacccacccctggggcccactttctgcagcaagatgggagcaattccaaggcaagtgggtatgggaatagcaactaaaaaggggtgaacttgtctcagcccccttttatggtagggcacttcaactttaatggggtgggcggctacagggaggagaatcaacaaagcaagagaacttgactatgtacgtccaacttcttacagaaggagctttgctaccagaacaagttcactgtgtcaatgaagttcatgacacctcatgcacctttacagatatctgggaaagcctgagaaattcattgagttttatgtattgaagggaaccaggtgattactcttttcaataagagggattctgctcaggtgattagactttgactctatttccccagggacagtgatgggtgggccccagagctagttgctgtctggtgtttgctggtgaaaacatgagcagtagttatgtggggctgagagtcaaaagggaaagcctaattaattcaactaatgtttattaagctcctactctgtgcaaatcactctactcaagaggagctcacataagagtgcaggataaagaaaggagatggacagttatatgtaattatataaactttgtgtattttgtttctcatgaaaaaacccctttggcaccctgctgattgatttggaagaaatctgatagatttgtggcctttcctaaattgcactaggaaattatgtagttagaatatttggaacctgcattagttccagcaatgaaagtaagacacacagcatatgacataagacacagtgtgaaataaatgagtttaaaaagcatatgagtcttagaaaatcttttatttaatataaaaatattctaccggtcaattgaagaatgtattatgattctatcattttggattgatcaaaaacatttgggtttactacgatattaagcattcactttacaatactaaatagttaatgaaataaacacattttgcttaccca

SEQ ID NO: 267728 - DNA, 1914 bp, Homo sapiens
agtcagtcatcatagtggcagcttccgcctgctacaggatatttatatatggaagcataccatggcaggagtgctggaaaggtggtgtcagctaacagttgcttcagccagataaggacggtgttccatcttaacataagtcaccaacttctaaacctggcactgggcatttgaagaataggattcgtccctactctaaggagttttcagtctatcgggaaatcaaagatgtaagcaaatagatgcaataaaatactacagatgttctgatagaagaatgtaaagaatccagcaaaggcaaaaggaaagacagggacaatgactcattcttcccaggacactggttcttgtggcattcaggaagatggaaagctttatgtggtggattccataaatgacttaaacaaactaaacctctgtccagccggatcgcagcatctgttcctgttaagacagtcttcaaagaactttccaaagaggtctaaggagatagcttaaccctgcttattccttgaataccaatagagaagaagctctagaggacaaaatcccagtccttggcacaaactcaggaaatggaagccggagtctgttttttgtggggctgctaattgtgctgattgtcagcctggcactggtttttttcgtgatatttctaatagttcaaactggaaacaagatggatgatgtgtcaagaagactaacagctgaaggaaaagacatagatgatcttaagagaatcaataacatgatcgtaaagcgactcaaccaactcaaccaactggactctgaacaaaactaaaggactgattttctgaaagcacctgctaacaccttgagctttttactttcctgggagtgtacagggttaggaactgagaaagtgcacttcctcaggcaacagatgatctggtcaggcaacccacccctggggcccactttctgcagcaagatgggagcaattccaaggcaagtgggtatgggaatagcaactaaaaaggggtgaacttgtctcagcccccttttatggtagggcacttcaactttaatggggtgggcggctacagggaggagaatcaacaaagcaagagaacttgactatgtacgtccaacttcttacagaaggagctttgctaccagaacaagttcactgtgtcaatgaagttcatgacacctcatgcacctttacagatatctgggaaagcctgagaaattcattgagttttatgtattgaagggaaccaggtgattactcttttcaataagagggattctgctcaggtgattagactttgactctatttccccagggacagtgatgggtgggccccagagctagttgctgtctggtgtttgctggtgaaaacatgagcagtagttatgtggggctgagagtcaaaagggaaagcctaattaattcaactaatgtttattaagctcctactctgtgcaaatcactctactcaagaggagctcacataagagtgcaggataaagaaaggagatggacagttatatgtaattatataaactttgtgtattttgtttctcatgaaaaaacccctttggcaccctgctgattgatttggaagaaatctgatagatttgtggcctttcctaaattgcactaggaaattatgtagttagaatatttggaacctgcattagttccagcaatgaaagtaagacacacagcatatgacataagacacagtgtgaaataaatgagtttaaaaagcatatgagtcttagaaaatcttttatttaatataaaaatattctaccggtcaattgaagaatgtattatgattctatcattttggattgatcaaaaacatttgggtttactacgatattaagcattcactttacaatactaaatagttaatgaaataaacacattttgcttaccca

SEQ ID NO: 267729 - DNA, 1586 bp, Homo sapiens
gatactctggtttctcttcagatcgtataaatctttcgccttttactaaagatttccgtggagagaaacgagtggacaatgactcattcttcccaggacactggttcttgtggcattcaggaagatggaaagctttatgtggtggattccataaatgacttaaacaaactaaacctctgtccagccggatcgcagcatctgttccctctagaggacaaaatcccagtccttggcacaaactcaggaaatggaagccggagtctgttttttgtggggctgctaattgtgctgattgtcagcctggcactggtttttttcgtgatatttctaatagttcaaactggaaacaagatggatgatgtgtcaagaagactaacagctgaaggaaaagacatagatgatcttaagagaatcaataacatgatcgtaaagcgactcaaccaactcaaccaactggactctgaacaaaactaaaggactgattttctgaaagcacctgctaacaccttgagctttttactttcctgggagtgtacagggttaggaactgagaaagtgcacttcctcaggcaacagatgatctggtcaggcaacccacccctggggcccactttctgcagcaagatgggagcaattccaaggcaagtgggtatgggaatagcaactaaaaaggggtgaacttgtctcagcccccttttatggtagggcacttcaactttaatggggtgggcggctacagggaggagaatcaacaaagcaagagaacttgactatgtacgtccaacttcttacagaaggagctttgctaccagaacaagttcactgtgtcaatgaagttcatgacacctcatgcacctttacagatatctgggaaagcctgagaaattcattgagttttatgtattgaagggaaccaggtgattactcttttcaataagagggattctgctcaggtgattagactttgactctatttccccagggacagtgatgggtgggccccagagctagttgctgtctggtgtttgctggtgaaaacatgagcagtagttatgtggggctgagagtcaaaagggaaagcctaattaattcaactaatgtttattaagctcctactctgtgcaaatcactctactcaagaggagctcacataagagtgcaggataaagaaaggagatggacagttatatgtaattatataaactttgtgtattttgtttctcatgaaaaaacccctttggcaccctgctgattgatttggaagaaatctgatagatttgtggcctttcctaaattgcactaggaaattatgtagttagaatatttggaacctgcattagttccagcaatgaaagtaagacacacagcatatgacataagacacagtgtgaaataaatgagtttaaaaagcatatgagtcttagaaaatcttttatttaatataaaaatattctaccggtcaattgaagaatgtattatgattctatcattttggattgatcaaaaacatttgggtttactacgatattaagcattcactttacaatactaaatagttaatgaaataaacacattttgcttaccca

SEQ ID NO: 267730 - DNA, 406 bp, Homo sapiens
aaagcacacccatactgtgtcttacaccaatcagatgctcatagatgcttcttctttctcttctggtgaccaaagttacggtggagtatagtggcttcacgaaataaacaccttaattgtcctccctgtcagagagcattttataagagtcttcattctcttccatttctttgaaagagttctatagaatcacagtgggttagataatgaaatggcactgatacacctttcaacctgaaaataatccatacatgattaagagaactaacattaaaaattcattgagggccaggcacagtggctcatacctgtaatctcagcactgtgggaggccgaggtgggcagatcgcttgagcccaggagtttgagaccagcctgggcaacatggtaaaaccccatctcaaca

SEQ ID NO: 267731 - DNA, 885 bp, Homo sapiens
tagaattgtattcaaataaaatataaaaaagaaagatcacttagagtaactttttcctgcctcacttgaataatgcagagacacttcaaattcgtaacatgtttagggggtctcaaggaggatgggctatgcgttttgaatatatgcatataaaacaacaaatgacataggcctaataatttctttgcatgtgtataatcctctcttcaatgtaattcaaaggtctcttttttaatatcagtctttacattgtccctgtaatatagagctatacacctttcctcaatcttttgtgatagtaggaaaagtagcattataagaagtatttataaatttaattcactccaccagaaatgttttattttaaagttagcatgggacttgcggtatccgcaaggtcagtgtccccactgaagaagtggccttctagagtaagaagtttcagcatcaacatgggtaatggaagccatataacagaacttaagaaggaactttgtggtaagaaaatgtagacagtggttataggcatatatgtaagaaggctgtaagttaaaggcaagagagatgtagcaattaataggagatattttttctgccatcattaacaaatgtatttgtttactactccttactttttaactcatccaccttgtatccactgctacctctgccaaccctgtatctgttactgaattctgtctactcttgtagggcctcttgaaaatgaaaatatccatttgtttccatctcttttgtcaagcccttatcagttgtctaaactcttgactttccaactgatttgtcagttttccctgctctaaaccatcttatgcattttttacagattagctataaacagcattcccataatagcactctcatgtc

SEQ ID NO: 267732 - DNA, 485 bp, Homo sapiens
acacattgccgttgaacttctaagatcttaggtttccacttactcatgaaaattataccacagggtcagagggtagtgttcattggagccaggtgccagaacaagttattacaaactactattttagagaaaaatgtcattaaagtttaagataccttaagctataggtttgcatcaaagttaatgaaaggtaaaaagatgccaagcgtggtggctcaggcctgtaatcccagcgctttggggggccaaggcgggcagatcacgaggtcaggagatcgagaccatcctggctaacacggtgaaaccccatctctagtaaaaatacaaaaaattagccgggcatggtggcgggcatctgtagtcccagctactcaggaggctgaggcaggagaatggcatgaacccaggaggcagagcttgccgtgagctgagatccagccactgcactccagcctggctgacagagcaagactgcatctcaaaaa

SEQ ID NO: 267733 - DNA, 457 bp, Homo sapiens
ttaaatttaagtgccttctatgccatgcacagtggtagatgcttttacttacaatgtttcacttagttctcacatttctccttaaagcagaggttattccatgttacaggtcaagaaatgtttactcagactgaagaactcttcctaaaatcatgcagctagtagtaatgtagctaggatcccaacctagttctgagtcccagactccattgctggttactaccttcatggatgaatgtataccagagaatttaggccaggtgtggtggctcacgcctgtcatcccagcagtttgggaggctgaggagggtggatcacctgaggtcatttaaatgtgtatgtgcgcacacacacacacacacacacacacacagaactgcttcattttctcaaagtgtttacgtttgaatacataaagactgagttatctgaacactgcttcattatagaaatctca

SEQ ID NO: 267734 - DNA, 372 bp, Homo sapiens
aagcgtggcaggtcatttgcactccctggttgaaatttccaggatgtgccagggccctgggacatcccaacaaacccctagagaatgtgagtctttaggtctgtcccctcctctacctactcctataggaaatggcagatgagaccaccggcccaaagctggatgccttctataaatgataccatcccgtctgttgcctgggggcacttaggagcagcaggattgcctaaccccgtgggaagcccaagtgtccaagaattgctccacaagttgccacatgaccttgcttcactccaacaggcgaagcacccattgcataattatataaatctaaatgcacccaaagctgtaccatgagattgtgaaatcaag

SEQ ID NO: 267735 - DNA, 666 bp, Homo sapiens
tacaaatgcatttttcaacatcttaaattacacaaggaagaaactccaatttgaggctatcagtaaaggcagcaatgggaaagggagaggtacaagggaccctcctggtctcctaaaatcataccacatgggtggtactaactctgaatgttagatcaatgtacattattacacctgcttatgagggaacagttagcttccctgtgggtaactgctatttgtgtcccaagtttcagaggcagcacagggaatatgtaaatccaggagctctagagtcaaattccctggctttgtattcctcttcctggtttagcagccaggggagcctctcctcctgtttccctatcttttcagtgatgatgctcacagcacccaccccaatgaggttgcagtgatgattaaatgagtgaacacacataaagtacttagatgggtgtatggcacctggcaaggacccagtgcaagttagctgctaatatggtacttcctaaataaataaaatcatgacaaagtatactggggtaaacatatgtaatttggagagaaggaagtgtcagtatttttattaccatcattcatcacagtctctggagatgaaaaggttacaacaatttctggaagttatagatagaagacttgttcatgtcctctcacttttcagctgct

SEQ ID NO: 267736 - DNA, 580 bp, Homo sapiens
tctccaagaaagttttaactatttgcgttctgatgagtcgacctcagggaagtcaagtgtcattaagagctagatctggtcataaaacaacttgaagttgtttactggaaagtttaaatacttgaatgtaattattcacagttatttctatttggtttattctgatactgctgtataatgacaacgtgatactaataggtcattaatgtaactaatataatagtatatgtatttttcatccacttaagtcctgtataacaaattacattttaactaatttgaaatttaattcaactcattttaagcgttagacggttttgtgaatctgtcaattgtgtaaaaaatgtattgaggtaatatttatattgaacaaaatagataaaactttaaattataattaggaatatttattgagaattttttctgcagtttgtgtccgagatttatttcaacattgactgacttttgagtgcagtggatcccacctgtaatcctagctactctggaggctgaggcaggaggatctgttgagcccacgagtttgagaccagcctgggcaacatatcaagaccccttttca

SEQ ID NO: 267737 - DNA, 523 bp, Homo sapiens
  misc_feature (5)..(5): n is a, c, g, or t
  misc_feature (14)..(14): n is a, c, g, or t
ccccncccgccganacggctgcgagagacgacaggaggggactcacagaacgactaagaaccttcctgctcggggatctgagacccccaccgaccctcatcacctttcacggcgaacaagatacaacactcacatgggacagactgggcgagggggagcagagggagggataggcgttgagatatacatccatacagatttggggatgcttaagaaccacccccagggccgggagcggtggctcacgcctgtaatcccaacactgggagaccaaggcgggcggaccacttaaggccaggagttcgagaccagcctgagaaacatggcgaaccctgtctctaccaaaaacataaaaaaattagccgggcttggtggcgcgctccagtggccccagctactagggaggctgaggtagaaggatcgcttgagcccggagattgaagctgcagtgagccgtgatcacgcaactacactccagcctgggctatagagcgatacctccatctcaaaacaaaacaaaacg

SEQ ID NO: 267738 - DNA, 423 bp, Homo sapiens
ggttaatggaaatttccttaaagtacagtcctgctgtttgagaaactgattttacccttattctgtctcacataattcttctgtgaattttaaatttaaccagttaaaaatctccatattttgggtatgtttagatgatacaatctttggttgaaattagttggattgaattccataatattctccttgcctttgtattttctttattgctttttaataagattctagtaactactatgtaatgatattctttatactcattttaaatactttataccatgattaccttactgtcagatttttattaaaggcatacctacattggctattttgttacaagactgactctgttttagtaaaattacagttcgctgtatgctcctttttcctaaaggactagcaatgtgcttaatgttcaagtac

SEQ ID NO: 267739 - DNA, 487 bp, Homo sapiens
aggaagactctgtacatgctcagtgtagggcttggtccgtcaagactggctaggagttttctagatagagccttgaatcttgcattacagtcactacagagcatgagctctgtggacatttcatgaaaagcttcctttctacttggatatatttttttacttcttgtgtgcatacttgatttatttactgttccttatagagctgcaaggccttgtttcttttctatagaagttatatttctctgagttcagatgtcacatcttcgttaccttctctcaagttttgctatacaagcttaggaacgtcatctctttctcttccagagttatcttccatcatgtaggctttggagccactttcctcagagcctccatttgcctcacctcttcttgcctgggaccttgtaaaaacagtgattgtggtaattaaattgagatatgaggaatatatataactattatgtagtcataataattaaaaatttaa

SEQ ID NO: 267740 - DNA, 293 bp, Homo sapiens
aaaatatacatatagaccaatataacagaagaaagagccctgaaataaagctacacttttacacccaacttatttttgacaaagtcaacagaaataaaggggaaataactccctgtttaattaattgtactgggaagactggttagtaatatgcagaagaaaactggacgcctacctcttcccatataaaaaatgtaactaaagacatattaaagacttatctgtgagtcttcaagctacaaaaattcaagaacacctagaaagtactcttctagacactggcgtctgaaaaa

SEQ ID NO: 267741 - DNA, 451 bp, Homo sapiens
cgtgagattctgcccttctgttctctttaccctcagacagtccctggtctgagggaaaggcagccgtggaggaagtgccagtctggacaggctcttctgctggaaacccacatcccaagtttctctctaccttcagtgatatctttattgtgaaattccaaactgtggtccctgaattgaggctgttgcaccaatattgttgtgtgttgccatacaacaaattgcaaaggttaggagactggatgtcagcccttaattaaagacctgcaaatatttctgccccttgcaccttgaccttcaagcaatggaaaacttgtctttccttcagacctttgattagaactctaggctgagttctatacttggaatgactctgaatgttaccatgtcacctacctgtgtcccctggcctcatccttgtgagtacataagtgtcattgatatcacctct

SEQ ID NO: 267742 - DNA, 163 bp, Homo sapiens
ttgtaaaactaatacgtgctgcttaccggtgttcagagcctcttctttcaaacatgacttatttacaaatttctccaactgaagtcatgcaatttttatttgttgtgcacttattttgtaccaatcactcttccaaccactaataaatatgtatttatacaca

SEQ ID NO: 267743 - DNA, 836 bp, Homo sapiens
tagtgtgtgtctctcaaatcttcattcaattcgtgtgtcgttccctctggagggactatggagcttaataaatcggttctcctggctttcatgttaaatgacctgtccgagatgtcctgccttgagaaacgatgtggggaaaaggccaatccccctgttcaaggctctcattctctctctgtggttagggtgagatttcgagtcttcatttgactgtaactttaatgagtgaagactgcaagcatggctcaggaagtgacctggggatggtgtagccgctgagaagttaatgctgtaggcgctcagaaaggacgtcctttggaagaggcatgttgttgacctgtcagacagaaggcctgtagcttcactcttctaaaaccgaagcaccacgttcaagaggattctgttcttaggaatcaactctgaatatctcctctgtattctcccattttttgttattttggctactgagcctacaaagtgaggaaagtccagcgtgttttctttgtgtccagggaggaaaaataaaaacattagtaactctattgacaaagctttgccccttaaaaaggggagctcttttcttcaggtttccctgcaataaaaaaaatcaaaagctgtcaactctgtttaatagatgattccctttatctccatagaaattacaacggacagtagcagtgagggcagtcggtctgggccaggtagtgagggaaacctctctcctgtagaagacggtgcttattcttatggcaccagtggatttgggagcccacccaggcgtccaggcatgagccctgatctcccacacgatatgcacacccttcctcctaaca

SEQ ID NO: 267744 - DNA, 567 bp, Homo sapiens
aatatatacttaattaggtttgatttttatcctttataacttttggtctttgcatttatctagttgttgacctgtcagacagaaggcctgtagcttcactcttctaaaaccgaagcaccacgttcaagaggattctgttcttaggaatcaactctgaatatctcctctgtattctcccattttttgttattttggctactgagcctacaaagtgaggaaagtccagcgtgttttctttgtgtccagggaggaaaaataaaaacattagtaactctattgacaaagctttgccccttaaaaaggggagctcttttcttcaggtttccctgcaataaaaaaaatcaaaagctgtcaactctgtttaatagatgattccctttatctccatagaaattacaacggacagtagcagtgagggcagtcggtctgggccaggtagtgagggaaacctctctcctgtagaagacggtgcttattcttatggcaccagtggatttgggagcccacccaggcgtccaggcatgagccctgatctcccacacgatatgcacacccttcctcctaaca

SEQ ID NO: 267745 - DNA, 294 bp, Homo sapiens
ctcctcataccttcatcctgtcatcctccttccttaacttgcaaaacttgttgaaaaaggagtctaccagccagtctccacttcctccattcacattcacacctccaaccccacacgctctaatttccataacaatttccattaatagcatcacctcccatccagtctacatcataaatcctgcagtcattgcaaatgctgcctcctcctcaagggcgccctgccttcctgacatccagctggtcaccaaattctgcaggtctgcttcagaaatgtccctggagtccagcacct

SEQ ID NO: 267746 - DNA, 506 bp, Homo sapiens
caggcaccatactgaatggcttataacagtgtttttccaagtgtggtccccagaccggcaacatgagcatcacctgggaactcattaggaatgcaaattatctgactccctcagacctgttgagtaaaaaacctagaggatgaacccagcaattggtgtcttcgccttccaggtgatactgatggcatgctgaactttgagaaccattgctttatttgcattctctaatttaatttacaagccaataaagtagatactgttatcaacctcagattgcaaaagttgaaactgaggcatgggaggctgagttacttgcttaatgtagttcagcttctaaagggaagattctggtttcaaatccaggtcacctaatccagagccccactaggccacagtgacctgtataaggtcttttggtacgtatggggggcaacactgtccaatatggtatgtgtccatttaaattgaaataattaaattttaaaaattgctttcttagcagcaca

SEQ ID NO: 267747 - DNA, 198 bp, Homo sapiens
tttcaaatggtttaagttgtaaggaagtacagtagagaaaatacatatatatgtgttttgtatattttatatacgtgtgtatgtgtgtatttctttgactaatatatgtcttactggaagaatgcttatatcagaaatctggcccactggcttggtgcagtggctcacacctgtaatcccagcactttgggaggccga

SEQ ID NO: 267748 - DNA, 447 bp, Homo sapiens
agacttcataccaaatgagaaaagcagaattcacactttgtttaagccacaaccagattgcaatcaacactgttgcacaatgaacttctctgcacacatcctggaagaaccagaatcctaggagcatggaagacttaattcattcaacagtaaccacctctttttagcctaagactttggcagccgaacaacagaacaggaattatgtcagcttttctgcttagcatgagctctgccccagaaccaatgacataaaatacgtatgtttgctttccctgccacaaagttgcgacacattatcaaagctttacaaagtcactctatcttaggacacccctagacaacttgtttccatcttacttctgggacaaaaatatttactgtatcctgctttcattgtctttgtgaatattacattaaatgttgacatgtgcttggcaattcaaa

SEQ ID NO: 267749 - DNA, 429 bp, Homo sapiens
acacatcccctcccagataaaaacaagcaatttactatatttagctgctaggagcttagggtcaaatttgtttttgttccctggcctttatattaactattttgtctgtctaaaagtttctttcccatagaggcagggtgtggtggctcatgcctgtaatcccagcactttgggtggccaaggtgggtctatcgcttgagcccaggagtttgagaccagtctgtgcaacatggtgagaccctgtctctactaagaaaacaaaacaaaacaaaacaaaaaattagctggttggtggtgcatgcctgtaatcccagctacttgggaggctgaggcacaagaatcactcaaacctgggaggcagaagttacagtaagctgagatcatgccactgcactccagcctggagtctcaaaaatagagtagaataat

SEQ ID NO: 267750 - DNA, 296 bp, Homo sapiens
ccccattactgtttcagctcctctacccaagcccgccagccctccagctactctataaacagtcttcttccaccttaaccttgccctgcaagtctgcctttttatgactccttgtacatttgaaggccagctttcccctaaagccatccctccccttcaactcccagaacagagggtggggtcaccttctcagtcacattctccatgttgcccccaagccccagctcctccgccatccctccctgcttccctctctcaaagacatctccttccaccactctctcaccattcatgtc

SEQ ID NO: 267751 - DNA, 425 bp, Homo sapiens
caaacgcatttgtagtcttggcaccgatgtgatctatgtcatctacattcacgttctataagccacagcaagccaaattgctaagttcaatacccatgtagttgggagctatacttctctcatgaagtctggggaaagggaagcattcaatggaaaaagagattctttgttaaataataatatgatctacaacatcatgtaaaaaaagagacacacgagtcatgacgtgcccatgatgtgaacaagtaagaagtgtgcaagccaacctatgaagtattctaaactattttttgtcaaactatcaatttatagaaaataaaagaagtaggggaagacgtcaagaaacgttacaaggaagcaactggcaacatctagaatgcgaagaataccacagagcaataaataattttcttctacaaattgtt

SEQ ID NO: 267752 - DNA, 312 bp, Homo sapiens
ccatgggttcatgtgtgattgatcacaagcacaaagggaaagaaatgcagaagcatcagggctgaccgatttccatgacaggaaaagaccctctatttgctatattgtgtctgcattttccatccctggttttgcaaatattaaacctgcatagaccttaccctgtgggttgtgtgaaggggaggctgaggttgaagggctccaggcagaagatcccacaggtgtgccagcgtgccaccctccctcctctgatttcacgttcaaccacagacagacggcattctgtcgttagtctttccagcctgggaattc

SEQ ID NO: 267753 - DNA, 572 bp, Homo sapiens
ccatattaatcctccagctgtattctcttcataacccttaacagtactcagaaaaggtctttcttttctactggtctctcctctccagaatgtacacttcattctctctcgtattctgctatatcctcagcacctagaaaggagcagccatatagaagatgctccataaacatttatgcacttaattatcacacactctgaaacaagtgtgtgttacgaacaagccagcacctcagggaagatcggcattcccccatctcctcatgcaggaccaagggctgtcgctcatggctctccatcactgtctttgcccaagtcacacagggctttgccttctgcccaccccacacctgccccagctccagattcttcatccatgtgggacttcaggcaagtcactcctttcatttcctgggcctcagttccttaataacaacaacagttaaagaatacttgtacggtccttagcaggcaccagcaattgttttaaacactttagtgagaccaagcgcagtggctcgcctgtattcccaacactttgggaggccgaggctggagaatcacttgagccc

SEQ ID NO: 267754 - DNA, 652 bp, Homo sapiens
ttagagatggggtctcgctctgtcgtccaggctggagtgcaatggagcgatcatagcccgcgctgcagtgcccagctggttttgccatttattcgcttagtgactttaggcaaatcacataacctatctttgtctcttaaattctatattaaacgttaagctgtcatccctaaaggtagctgtggtttggggagcacaaatctgacttttatttatctgcttaaaatctttcattaatttctcattgtcctctctgtaaaatctacttatttaccatagtattctaggcaatgtgctttctggagctggcatacctcctagcatatccccttctctcacttaaaaacaattttaaaatattataggccgtttgcggtggctcacacttataatcccagcactttgcgagactgacgtgggtggatcacctgaggtcaggagttccagaccagcctggccaacatggtgaaaccccgtctctactaaaaatacaaaaattagctgcgcatgatggtgggcgcctgtaatcccagctactcgggaggctgaggcaggagaattgcttgaacccaggagggtggaggctgcagtgagccgagatcacaccactgcactccagcctgggcaacagagtgagactgtctcaaaaaaa

SEQ ID NO: 267755 - DNA, 415 bp, Homo sapiens
aagagattctgatacatcataaatagagggacatacatctttacatgaaaacgacatggaagattttctgagggacatgtgaatgggagacctgaggagaggcagagagtcagagactgactgctggtcagtgaagtcggaacaccacacacaacatttacagattaagttcgccgtcttatatgggtgtggttcgtggtgctccaaaacaattacactagtaacatcaaagatcactgattacagattaccctaacagatataataataatgaaaaaaaattgaactattgcaagaattacaaaaatttgatagagacataaagtgagcacatgctgctggaaaaatgacactgacacacttgctcaaagccgagttgccacaaaacatcaatttgtaagaggaaaaatatcta

SEQ ID NO: 267756 - DNA, 831 bp, Homo sapiens
ataactcagaaagagaccaacatatacaagataaatagaaagaaaaaaagaaatgttgggcttcttcatcagccctaaccctgccaaccactcctgcctcactgaatgtgccaacggattgctcagctccaaccaaggaaaagaagaaggaagttggatactttataccctctacattgtccattagcaacacaacctagagctaggatggagaaagaaaatgccaaaatgctaatgaaaaatgttcagatgtatcacatattaagcatacatgatctcaaatattttgcctgatttatgctatgcatgctattttccatgttgtgtaggctctgatgctagtctacatttacagaaatctccatcagctgtacaaatggcaatttaaatacatttaactatgtgctaataatctcataatacaatttatcatgtatgattggcagaagaaattatttggggcaaaagctatgattgtattgttgtaagttattatgaatgctgggcagtgtagggcatggcacttgctaccacctcccagaaatgtgtaagggctgttgaaggtgccttgttcttctttcttcttcaatataagcaaagctatttatatcataaagctgaaacttgaaattccaaaaatgataacaaaatggcctagttgggttcaagcaatgatgttctcgccccgtcttcattatacgaagggctaatccatgatcctctatcgctgactaactgggctaagtatacgggttgtaagcgaggagtttggctactcgaaggtcggaatggggggatccacgagtcaggcgtgccggagaaatactcggt

SEQ ID NO: 267757 - DNA, 408 bp, Homo sapiens
tccagcaaagtctggatctcagccagccctaagagtgtgtctgtgtcttggaggagctctttttgagatgctgtatctcagccctagggtgcaagcccagaggcagtctataccccaactcaactggctggtcctcaatgctgcctgcttccgtgcccaacttagaactacacatctgctgcctcttggtaacatgtcattataagtctgaagattgccatttgaaatgctctttgagggatgcgaagtcaaccctggatccaaagtagctttgatgtttgtcaggaaaatgctggaattctatacactacagtttctacagagcatgaagaactccaacttcagacaacctgcaaaaaaagtcagagagcaattaaatataaaaataaattcctttgataaaacaaa

SEQ ID NO: 267758 - DNA, 979 bp, Homo sapiens
tccagcaaagtctggatctcagccagccctaagagtgtgtctgtgtcttggaggagctctttttgagatgctgtatctcagccctagggtgcaagcccagaggcagtctataccccaactcaactggctggtcctcaatgctgcctgcttccgtgcccaacttagaactacacatctgctgcctcttggtaacatgtcattataagggcttcttcatcagccctaaccctgccaaccactcctgcctcactgaatgtgccaacggattgctcagctccaaccaaggaaaagaagaaggaagttggatactttataccctctacattgtccattagcaacacaacctagagctaggatggagaaagaaaatgccaaaatgctaatgaaaaatgttcagatgtatcacatattaagcatacatgatctcaaatattttgcctgatttatgctatgcatgctattttccatgttgtgtaggctctgatgctagtctacatttacagaaatctccatcagctgtacaaatggcaatttaaatacatttaactatgtgctaataatctcataatacaatttatcatgtatgattggcagaagaaattatttggggcaaaagctatgattgtattgttgtaagttattatgaatgctgggcagtgtagggcatggcacttgctaccacctcccagaaatgtgtaagggctgttgaaggtgccttgttcttctttcttcttcaatataagcaaagctatttatatcataaagctgaaacttgaaattccaaaaatgataacaaaatggcctagttgggttcaagcaatgatgttctcgccccgtcttcattatacgaagggctaatccatgatcctctatcgctgactaactgggctaagtatacgggttgtaagcgaggagtttggctactcgaaggtcggaatggggggatccacgagtcaggcgtgccggagaaatactcggt

SEQ ID NO: 267759 - DNA, 364 bp, Homo sapiens
gcacatgcccacagttcccgggcaggccctgccagtgcacacaccctttttatgacttaagctgcctcttctgcctgggatcccttcctgccactctcccctctttctagactgagctcaggagtcacctcctccaggaggccttcccggacatccccctgggtcaggtgtcctttgtctatggttccacagcctcaagcaccctgttctttcagggccctcagtatctactcctggatctgcttcccccagtaggtcccgggctctttgagggcagaaatatgtcttgttcccttggtatttcagtccctagccccttgcttagcatacagtaggtgataaataaatagttcattaaactgtg

SEQ ID NO: 267760 - DNA, 696 bp, Homo sapiens
aattcgcggccgcgtcgacagaagacgacagaagggtgggcaggggggacagagtctcgctctgtcacccaggctggagagcagtagcgcgatctcggctgactgcaacctccgactccccggttcaagcaattcttctgccccaccctcctgagtagctgggactacaggcgcccgctgccacgcccggctatttttttgtacttttttagcagagacggggtttcaccgtgttgcccaggctggcaacccgcccaccttggcctcccaggtaggattacaggcatgagccaccgcgcctggccaatttttgtatttttagtagagatggggtttcactatgttggccaggctggtctggcactcctgacatcgtgatccacccgcctcgccctcccaaagtgttgggattacaagcatgagccatcgcgcccggccatcttgtttccacatttcaagctgcaaaggcaggggcttgggccagctgttcagaatttaattagtttacctaagagacgtcagatccccctgctctcatgatcactagtgaggtcttatacacacacatacttgttcagcgtgctgacctaaacaaggtggaacatagtttgaaaatagagcaatctgagttatatgatccagtggttgcaggaacttgggacaggattttatcttcagcctatttcctcatttaga

SEQ ID NO: 267761 - DNA, 478 bp, Homo sapiens
tccccagcaaccaccaatctgcatcctacctctatggagttgcttattctagatatttcatattaatggaattatacaatatgtgaccttttgctactggccttttccacttaatgtgttttcagggttgatgtatgttgtagcatgtattggtacttcattcctttttatggctgaatcatattccattgtgtgcatataccataagagtttatctgtttattcgttgaccgacatctgtgttgtttccaccttgtggctattgtgaatagtgtgctgtgaacaaggatttgtttgaatacctgttttcagttcttttgggcataaacctaggaatggaattgctggatcatatggtaattctacctttaccttttttgaggagttgccaaactgctttcctttcccctcatttttatcaacatacttataaagtcattttcctttcttgaagataatacacatattaagtggcata

SEQ ID NO: 267762 - DNA, 399 bp, Homo sapiens
attgtgcactttcatcacttgggatcaggagctgcaaggatggagtaagctctgtgagtcaggatttgctactggccaactcctccattcaggaaaaagagccaggactgagttattcattaggaacagtaggaaagtgcctagggcccactatactttcaggagcccatgaaaatgttttaactcttttaaaatcagaagaaaaggaatacagtctagcctggattgtattcaactttatacccatgcaattataaaaatataatttttaatattgttgtatggagggaggaacccaaaaagcaaaagtaccaagggcccatgaaagttataatgtgactctggaaaggacttatctgagaatgaaaccaatatggggaaaatatctttgagagatgg

SEQ ID NO: 267763 - DNA, 474 bp, Homo sapiens
tggaggcagtctcactctgttgcccaggctggagtgtagtggcacgatcttggttcactgcagcctctgcctcccaggttcaagtgattcttgtgcctcagcctcttgaatagctgggactacaggcatgcaccaccacgcctggctaacttttgtatttttagtagagacggggttttgccatgttggccaggctggtctcgaactcccaacctcatgatctgcccacctcagcctcccaaagtgctgggattacaggtgtgagccactgcacccggccttcattctctttagataaaattatttgtctgtatgaaacagttgcctaactccatgtttacttgatgtcttaaaactgttactaattatttaatcattctgccaataaaatcagcgttgggatcacaaatccaaggaatagactcactcggtcagtttgaagaatgtttcaaatagaaatcaaatccatgattt

SEQ ID NO: 267764 - DNA, 399 bp, Homo sapiens
cagtatgacatatataactagtgaatgttagcatgtatctgaaattcttccctcatttttatagggggagagaattcaagactagtttgaggaaattttgttaaatttggagctaatctcaaaaatcttggaattaaggagcccaggatgttataggttaatcactgggactttttgttaaattaatattaacttttttcggttgactttccaccccctaaaatatgttgattcagttttctctcaaactgatttaacttaattgttttaacttttcataattgaggctcctgtagagctttgaaatgactttgctgagcaatgtaggtacaattcaaatgggagactaacttgatacttgtatagaccacacataactaaaataaatctaaatacatg

SEQ ID NO: 267765 - DNA, 432 bp, Homo sapiens
gttcttttgcctatctatttttttcttccctgcctactttgaatctgctgatttgtctactggtgttgagataagacttactgtctgtggtgttactaattcaaggtcacttggctgaagaaaaacaaaagaatgaaacaattctttatttttttctctttttgagacaaggtctcactctaaggtctcactctgttccccagactggagtgcagtagtgggatcatagctcactgttatctcaacctcccaggctcaagcaatcctcctgcctcatcctctctagtagctgggataataggcatgcaccaccatgcctggcaattttttatcttattcttagtagagattgggtctcactatgttgcccaggctggtctcaaactcctgagctcaagtgatcctcttgcctcagcctctcaaagtgctggg

SEQ ID NO: 267766 - DNA, 367 bp, Homo sapiens
tctagttttataggttcatggactgtaaccaagctttggaagaaactattgtcagtttcacttagaaattaactactctaggaatactcaagtattaattttaaagacttattcaaaatgcctcttgattattgaatgcccatttctgtattttttatttttttcattttactttaagttctgggatacatgtgcagagcatgcaggtttgttacataggtatacatgtgccatggtggtttcctgcacctgtcaacccatcatctaggttttaattgaatgcccatttttaaaaaacagaattagagggggaaaaaacctactatgcttttgtagttttgaagctaaaggaaataactttatagag

SEQ ID NO: 267767 - DNA, 307 bp, Homo sapiens
tgtttatttcacaccagggagaatcagggagaagattcaaaagcattgtgtaaaccttgaattcatgaaacaattttaacaaagggtacaacttcagaagcattaaatttgattgtcttgtatttttgttactaaataatactaaaaccctctcaatcttcgtgaaaagtcttagtaaggaaaggattcttgggccaggcgaagtggctcatgcctgtaatcccagcactttgggaggccaaggtggaaagatcgcttgagccaggagtttgagaccagcctgtacaacatagcgagaccctggctc

SEQ ID NO: 267768 - DNA, 369 bp, Homo sapiens
tatactgctaaaatggagttttagtccaaactgagtaaactattacaaatttatccaaactcagctaaaaaagcaacaatatcttgcatgccttagtctgtgaaaccatataattctcaatatgtgtatgggtttatccaacatggtttagaaaaggcaattctgaaaaataatatcaatttattgatgctgggattacaatacctacttgtgttggagcagatagatcataaaggatccttccttaaatgatcagtacatgtatactgttccaggaatgtgaaagaccaaaaacagagtaaaattttctagataatcggattcaacatatctgtccccaaggatccagaatccaaaatttttgcaagt

SEQ ID NO: 267769 - DNA, 963 bp, Homo sapiens
ttatcttgccacgtccaggaaaagcacaaatctggacatttcaaaggctgagaccatcatctgaaaaagcctgggttagccccctggaggacaagaaacaacttggagcagagatgaacagtccttgctgaggcacctagatccctaacctgcaaaccttaaaatatgtgagtgaagtcatcctacactatctagaccataggagttgccagctgaccacagatacagcaaagcaagcacaagccagaaaaaaactgccagcatatccccagaattgtgagcaaatgaaattgttgcattaagccactatgctttgaagtggtttgtaacagagcaaaagctaactgatacactggttaatccatttttaataaatcaatagattcagatccctgcattgtaaagttccccaccaatctttcaattaatgctcatccactgattgttgcctatatcaatgtttaatttcatgcaaatcaataacttttttcctttttttttttgagacagggtttggctctgtcactcaggctggagtgcagtggcacaatcatgactcactgaagccacgatcttctgggctcaagcaaacctaccacctcagcctcccaagcagccgagactgactacaggcacgtaccactctgcctggtttggttatttttaacttttttggtagatatggggtctagctatgttgctcaggctggtctcgaacttctgagcttaagccatcctcccaccttggcctcccaaagtgctgggattataggtgtgggccaccatgcctggactaatgatgattctctaattctatcatatcttccacatcaatgagcaggaattcttctgcaaagcactttctctcatctaccagggttatgtctgtacatgatagatgcccaattctttccttttaaatacaaatattcaaatgagtaattctgccctagttacatccca

SEQ ID NO: 267770 - DNA, 345 bp, Homo sapiens
caagataaagtgacagaacgcctgaaatctaatcatctcttattttaaggaatgagatttcatatgtaaaaagttttctgaaagaaatgcaaaaacaaacacagtgaagggttattaggaatgaaaactccattttaaattgacctttaaatactctatgatgttgaggccaactgagaatgctcatttaaaatcctctctgcataaaggttataggtcatctcagtataatccaaaggtaagccagttaaccagttagttttgctaacaagcattattcttcactggttgaactccatgtctgatcgagatataatgtctactttagattagctattaatccat

SEQ ID NO: 267771 - DNA, 397 bp, Homo sapiens
ctggagtacagtggcatgatcactgcatgctgcttactgcagccttgacctctggggctcaagccatcctcccacctcagtttatcaatcagatgtcattttcctcattaacaatgccattccacctttatcggggaatagcttccagggaatagtgctataaggttactccatagtcattttcctaaagagaaagcaaaggcattttattaaaacttgacgtatacctatgtctttatagcaagaaaataaaatataataatagtaacaaaacaaaacaaaaactttacatataccagctcagtgccctaagtagctaggattgcaggcatgtgccactatgcctggctaattaaaaataaatttttgtagagtggaagtctcgctatattgccca

SEQ ID NO: 267772 - DNA, 423 bp, Homo sapiens
ctctggacatgtctcactgtttgtatttctctctcctgtcaaagtgaatgatatattcttgaaaacccccaatttcttgaaatgggtgttctgttcattcatgggcaggggtcaggattgaagttcatatatgaaacaactggggatgtagataggaaagaatgtctgctgcaagagtgtatgaagggggattgtcatttacaaaaaaaaaagtacctcatggatggaaggattcatgaatagataatggacataggaaaggaggtcaatggaggacacataacagacatgctatccaccatttatttgtgattttgtaagagggttctcttctttgtcttgttcagatattttcatgtgtgtgttttagtgagaatctgagtttttaatcagtaaagtctgatgttttgataacttgatgtt

SEQ ID NO: 267773 - DNA, 385 bp, Homo sapiens
taggcactgcagctcacattcctattcatggtagaggaacagtccatcttaagtccataccacgttttatttacttactcatcagctgatggacgcttgggttgcttccacatgctggctattatgagcaatgctgctatggaaattcatgtaccaatttttgtgtgggcttatgttttcatttctctgaagtatatatctgatggaatttatgggccataagggaactctctgtgtaaccttaaggaaaactgccaacctgtttccacagaggcttgtgctgtgttattttaatcacaaccctgccctgggactgagccgtgtaggtcctagcatgacccatggataataaatacagacacaggtactcatgccatccacctgg

SEQ ID NO: 267774 - DNA, 416 bp, Homo sapiens
tgaagggatcagagaggatgtcctgtctctgacatagaggatacttcttccaggagtctccatgcaaggccaagagccctcacctcacccctgggctcacacatgccttacaatgaaaaggcagtcttccagccagaatctaatgcttgagagatttggatgggttaagtggttgactttttttacttccatagatcaacattaaccttcatggattcctaaggagaagatgtgctcctccacttattctgattaatattttaaattcaagattttgaaatttgaaaacataggctttagagtcacacagacctggtttaaatttggcactgccatttactagctttatagattcagagaagtaatttatactccttaaaccttagttctctaattgttaaattgacacaagatta

SEQ ID NO: 267775 - DNA, 751 bp, Homo sapiens
cacctaacgtgcacacctttgggatatgggaggaaactagagtagccagagaaaacccaagcagacatggggagaatgtgcaaactccacacagacagtggcctaggctgggaatgttttttctcatcaacgttataaggaaatggcattgaatgaaatgaggttgtctgaggacctgctgtatttgtattggaggaggaaacaggtgaagtgcctgcattcctttttcctgttttaaaacagcagttagccctcaactttcaacatttgtctcaatctcaaatgagtcaaatttagctaaataaaactcaccactaagcaaaataagggaggaaaaaacctctagaacagaaagaaaaatgaaaatggataaaaccttgctctttactgatgctaacgtacttcataaagtacagcgcttaacttcattgctaaaaaggctataatgaactctatttcgctttagtccttaggggaaaaatgtatttaaaccaaattcctacacaagaaagccatacggagacccacagagaacacagaactctgctgctctcagttcacagcagcaggagagtcctaccatcacaaacaccacaagtaaagttccatcttactgagcctcttactattcagccttgatctggctacttccaaacatgggactgatgatgcagaatagctagtttgacatttttcccactgaaaatttatttttgccggagactgattttctaaatctggagaaattggg

SEQ ID NO: 267776 - DNA, 1123 bp, Homo sapiens
tgcgtttaaagcgcagacactgacagcaagtcttccagtctctccagtataacttaagtgacatgccagcaagagatgcaatttggtccctcaacagtgttaaaaatctgttatttgaaagaataacttctaaaaatcaaagtttatctaaccactgaaacaaacattgacatcggccagattccactctcatatgacaatcaatgacagactttttcaatctgccaaaaactggactggaattgcaaacattcatttggccaccttggaggagaaactgaacaaatagcagcaaccccctcttccagaatgtgagagctccctccacctaagagctaaaagaagcaaatgcaaagtttttcactggttttagagaaataatgctttagatataagcaagcatcacctatagaattaggtgagccctgtgcccatgaatctagtcctttctacctctgatcacttgttcagtacagtcttatctgctaacttccctaaagtaatttatttaccaattacaatggaaaaacccaagacaatattctcagaagacttcagaacccaagttctcctcctttacacgctcagctactaagaaggctttcgtttccattaatccagtatttaactgaacaaatttttaagcccttatcaccaacataaaggtgcagtagaaagaaaatgagtataacacagttcccattaccatcaagcttatggttatgaagtgtgtatgggagagatgggagaaccatatcatatggtacactatgataagagtcacaggaccgcctgttcaggctcttcatctaaggagaaacatacgtgcagacagagcgacctacagtctgtgctacaacgacatcttccacgcatcctgagctcggtgttacttaccctacagtggaaatccaaatagtccaaatatcaaccagctgtttcagtgggtatgaaaaatgggacagataatccaaagcagccttactagtaattaactattgcttctacaatgtattatgattcatcaaagcttttaatcatttatattttgcttacactattaataaaactacaatatgccctgagaacatagtaaattctagagaaatgcctatttaagatt

SEQ ID NO: 267777 - DNA, 494 bp, Homo sapiens
tgcgtttaaagcgcagacactgacagcaagtcttccagtctctccagtataacttaagtgacatgccagcaagagatgcaatttggtccctcaacagtgttaaaaatctgttatttgaaagaataacttctaaaaatcaaagtttatctaaccactgaaacaaacattgacatcggccagattccactctcatatgacaatcaatgacagactttttcaatctgccaaaaactggactggaattgcaaacattcatttggccaccttggaggagaaactgaacaaatagcagcaaccccctcttccagaatgtgagagctccctccacctaagagctaaaagaagcaaatccttactagtaattaactattgcttctacaatgtattatgattcatcaaagcttttaatcatttatattttgcttacactattaataaaactacaatatgccctgagaacatagtaaattctagagaaatgcctatttaagatt

SEQ ID NO: 267778 - DNA, 860 bp, Homo sapiens
ttgtctcaatctcaaatgagtcaaatttagctaaataaaactcaccactaagcaaaataagggaggaaaaaacctctagaacagaaagaaaaatgaaaatggataaaaccttgctctttactgatgctaacgtacttcataaagtacagcgcttaacttcattgctaaaaaggctataatgaactctatttcgctttagtccttaggggaaaaatgtatttaaaccaaattcctacacaagaaagccatacggagacccacagagaacacagaactctgctgctctcagttcacagcagcaggagagtcctaccatcacaaacaccacaagtaaagttccatcttactgagcctcttactattcagccttgatctggctacttccaaacatgggactgatgatgcagaatagctagtttgacatttttcccactgaaaatttatttttgccggagactgattttctaaatctggagaaattgggggttggagataggagagaggttcagttcgtgaaattctatttatagtgatgcaataatgcaggtactattgcctttaaagcgcagacactgtgcgtttaaagcgcagacactgacagcaagtcttccagtctctccagtataacttaagtgacatgccagcaagagatgcaatttggtccctcaacagtgttaagtgagtagaaatcttaggaatcaaaaagaaaaggaataccatgtagactgaattccagcttactacttaccacttgtaagttcactgaagctgtgaaatttcagccaaacaatttcaaaagtagcatctccttgatgaaaaggaagcaaggaacttatggatgtcagaatgacaagagtctc

SEQ ID NO: 267779 - DNA, 677 bp, Homo sapiens
tttgtcttactgtatgtactgttagaagtcagttggtgctggaagggagacggagggctgtttgacccctctcccagaataaattatttagcagtagcagtatttttctcactccatgatcttggcttttgttggtttgcaactgtattttaaacgattgagtttcttgaagcgcagaacattattctacctattaacttttaaattaaaaggttgtttaaaatcttgatttccagctaagtaaggctgatagtaagcattgatttacatcttttttaatgatataagaaattacataaatataaaatatggctataaaattcttcgtctataaagtgaagaatgtagactaggtgatattttaaaagctgcattcagttctcaaaaatttttactcttaaaccagctttaaagggcgtttctaaaaaaaagcaaaataaagcctcctttgaataaataaaatggaaacagaagatttgtagtgctcttttgcgtttttatttataaatttaaatttattttataaattactgtactctctccaattgctagtaatgttttttctttaagagtgaggcatgaaaaaatcatttggacccactcaaacacaatgagcaagcatctctagtacctagattgtgccatttatcactaaataaccaaaaccaaaaaaaaca

SEQ ID NO: 267780 - DNA, 519 bp, Homo sapiens
catctaaaaaaaaaaaaagaagaagaagaagaagaagacattcctcacagatatagaaaaaaaattctgaaatttatatggaaacatcacaaagtcaaagctatgctgagtatataaaacaaaactggaggaattccattacctggttttaaattatactaattaaaacaacatgacactagcataaaaacagacataaagacagatagaacgaaatagagaccttagaaagatactcatacagttaaattaattttcaacaaaagtgccaagaacatacaataaaaaataagacagtttttgtaataaatagggctggtaaaactggcattctgtgtgagggacaaacattcagaccctcatagcagtgttctggaatcctatgtgagggacaaaccttcagaccacagcaggagtgttctggaatcccctgtgaggaacaaacattcagaccctcgtagcagtgttctgaaatcctatgtgacaaacgtttagaacccagcaacagtgttctggagt

SEQ ID NO: 267781 - DNA, 292 bp, Homo sapiens
tgaatgaccttgttggggttgactaagtcttttccagggaggtcaacatcacctcagctatttcaaaacagagctaaagttccagtccagggaatggctgattcttcaggtgtgtttctgtgtgcacaacttgttctttcaacaacctccccatgagtttctggaatgtgaagactacttttgtctgaagaaaccactggcctacatatttttgttatacacacatgaaaaaattgttacaagaggtactgctgtgacaagcaatataaagtcttggactgtttcctagtta

SEQ ID NO: 267782 - DNA, 552 bp, Homo sapiens
caatttggtaatatctattagaaaattttgcatattcataccttttgattcagcagttataattctggcatcttattctgtgcagacactcatactgcacgaaggtgtatctaattgaattttttggtgttattcataagagtgaaattttgaagttatccaggtacctatgagtaggggattggtgtacatcaataagatgaaattccttgtacctgccagaaagaatgaggttaatctatatgtactgatgtggaagagtatacaagatatcttgaatgggggaaaaaagcaaattgtataatacttttttatgttaatgattatttatatttttgttaaaacatatatatatgttagtatatgcatactaaaaaatgaggctataaataccaaacttgttaatattggttatctcagggagggatagtagattatgatggactttcactgtctccattatatatttctgtaatgtttaaatttttcacaaagagcctgcattatttttgtaagtagaaaaaaaataaagatggaagtctctccaattta

SEQ ID NO: 267783 - DNA, 428 bp, Homo sapiens
tggaagccccgcggtcatcctgggcaggcagagcccgtgccggcttctcctccgcggtggccgagtgcgggagtgcgccgagctctcccggcagtacagccaggttgttctggaggcattcccagcagcagcggccctgcgtcttcgccgccgcgcagctcgctctcgcctgggcccctgccgctgcagctgcgggcaccggcggcctctgtccgggactgcccttcgatccgccgcccttcccgggcgccctacgggagccgctgcccgggagtccattgcaagctgcgtcggcggctctggctgctgcacctgctggctcctcctccggctccttctcgcgccgccgccgcctgggctgctgctggggcggctccccccggcgcgcgcctcgcggggagcagggcgcagctccccctgcactgggg

SEQ ID NO: 267784 - DNA, 338 bp, Homo sapiens
atggttgtgtcacagactcctcggatacttgacatctcatgaagcatcctcacataaggccactggcagaaatcaagtgaagggaagacgaccaaacctccaccagtatagagaggcccctaacaggccttcctccactgaaataggatgaagtcctctagtggccagggggtgacaatacaactcctcttccaagtccttacacaggatgcccctccgttgctggcgacctctagttgggtttgtttttgtcaagcgtgtcaggagagaatgcagggctccttctatccccttgctgagactgaaagagtcaaaatacatttcctaagaccaagtat

SEQ ID NO: 267785 - DNA, 472 bp, Homo sapiens
agtgaaagatttagtggtcagacatttgtacaagattagtataatagttttaccatataaagcttataaattttaataggaaacactgtaaagaacatttgctatttttttattgatttgccaatgaatatattttccttgtggtcagaaacaaagtttacttctacttaagattttaaaaaaagagttttagttggctgggcacagtggctcatgcctataatcccagcattttggaaggctgagacgggcatattgcttcagcccagaagtttacgaccagcctgggcaacatggtgagaccctgtctctacagaaaataaaaaaattaggtgtggtagtacacgcatgcctgtgattccagctcctcaggaggctcaggcgggagaactgcttgagtccaggaggtcaaggctgccatgagccactgcattccagcctgaatgaaacagcaagaccctttctcaaaaaa

SEQ ID NO: 267786 - DNA, 246 bp, Homo sapiens
ttccagcgcctggttctaaacattaaatctagtccttactttttggaagtaactatcaagcaatcaattaatcaatcaggcattcagcattgaagcaccttagaaaatttttcattggataacaatgaataatgcatggccctccagtatattgactgtggtaaatggtctttaaggtaaggtgctgcaacaagtacctttaaataaaatcaaataaaaagtttaccacaatcataataaattgtt

SEQ ID NO: 267787 - DNA, 293 bp, Homo sapiens
taatgtataacccatttgttacctgcaactgaaagacaatgaaattgattattatccaggcatgactgtggcttatttaaatcagatactttctcttttcagctgctgaagatacttgcaatcacctgtggcttttgtattggtagatacatccaagaaaatattgacttgaaaaaaattgtgcttagagccctgatctggacattttaaattcacttaaattgttttaaaaattgtgatatattaatgaaatttttattttaaaactaattatgaacctttatctgatcctg

SEQ ID NO: 267788 - DNA, 659 bp, Homo sapiens
acatctcactttgttctcacatagtcctcatagaggtatcctgtggctgctgtccttgaagcctgatagcatggagctgaggcctcagactataacagggcacataattttcatgaagttcaagaagaggctgggctgggcgcggtggctcatgcctgtagtcctagcactttgggaggccaaggagggtagatcacctgaggtcaggaattcgagaccagcctggctgacgtggcaaaaccctgtctctactaaaaatacaaaaattatcctggcatggtggcaggtgcctataatcccagctactcgggaggctgaggcaggagaagcgcttgaatccggggggcagagcttccaatgagccaagattgcactatttcaccccagcctggacaaaagaggaaaactacgtcttaaaaaaaaaaaaaaaaattaggctgggacacctttcctggaagggctacttactacaggggagctgtctaaggtgctgaaatgtcctagccctgcgctgtccaatatggtagttatgattaaattcaaataaaattacaagttccatgtcccagtcacaccagctatgtttccagtactcaggagctacctgacactgatggtgccatattggacagcacaactccagaacttttccatcctca

SEQ ID NO: 267789 - DNA, 344 bp, Homo sapiens
ggttggatcatgggagtgaatttctcatgaatggtttagtaccttcctcttggtactgttctcgcaatagtgagttctcgcgagatctggtcgtttaaatgtgtgtggcacctccctgaccctcctgcttttgctctggccatgtaagacgcaccagctcccctttcaccttctgccaagattgaaggtttcctgaggccgccccgaaggttcccatacagcctgcagaaccatgagccaatttaacctcttttccttataaattacccagtctcaggtatttctctatggcaatgtgagaatagactcatacaactatatattacagaatgaattgtgatact

SEQ ID NO: 267790 - DNA, 421 bp, Homo sapiens
ccgcgcctggcccctttaagctgaattttaaaggaacttagaatctcattctcttacatttttataaccaagaaatgaaccctgacggtaaagactattaatatactaattattcccagcattatacacttcatgtgaaaggcagatgaagaaaatgaagaacctgtcttctgttcaactaaaagggaaatttagctttacttagttgtatctgtaattgtccttttgtttttaagaatataagaatataaagaatataaataattgcaataaaacaacataagaagttgaccaatggaacaagaatagtatagcacttagtaagatgtacagatactattttaagtaccttgttttaaagttaagtaatgacagcctccagttaataaaccagaaataaactctaaccattatttcttgg

SEQ ID NO: 267791 - DNA, 436 bp, Homo sapiens
atatactctctcactcattgaaaatatgcatttttgcaacctttcagaaaatctatttgacaccatataagaggaatcttaaaacatgtaatcctgttgattcaataatgccaatgattccatgtatagcaacatattttaaacaaataatcacagatgcagatgcctaataaaaatattatttgcttatatatgttagagttttaatgtggcactaacctaaatacccaattggggaatagattaacaaattatgcaataatcacaagatgtaataccctacaacaaataaaaatgtgctctgaaagtttatttaacaatataaattatttgattatacacctaccctatgactctgccactcagccattctactcctaggcatttacccaagagaaatgaaagcatatctttacataaagacttctatagaact

SEQ ID NO: 267792 - DNA, 461 bp, Homo sapiens
taatcaaaatgaaccaactagagagacatgtttacaagaaatgtatataacaaagaaaataaacaaatttgagctgattagataatactcacaagtgtaagaggatctatccatagtgaaaaacattcattttaattccatttatataaagttttcaaaaatatatctttaatacattgcaatttattacattggtgacaaaactctaaagtgaaacatatgagtgactattacaacaatatggatagtagggaggaggaaaacaagaggagaatgggatcaacagaaggcatatatggggagtgtctggatggctggaaaattctattttttgaccaagatgtggtaaacacggggagtaaagttataactttttctcttactgtgcttttaggttttgttgctttctgtctgtatgctatgttccacaataataaaaatatttaaaaggcaaaaaaaaa

SEQ ID NO: 267793 - DNA, 248 bp, Homo sapiens
aaagggagggagaccaccgctctgtaaaactatgccatctcccaattgtcttttcatggacgatgccatatggtttcagcaagtagctcctccctgtcagcatctaactctactcatggaaaactcatctctcaatgcccaactaaatacacagtagtacatgcctggtaactctgtcaaattgggctcattttttctgattgtgaccctagatatgatgataaagtgatgaatgatatttttgtaaa

SEQ ID NO: 267794 - DNA, 433 bp, Homo sapiens
ttcaggcatcccctgggggtcttcaactatatcccctgtggataaggagggactactgtatattttgttaagtttatccacaagtgtttcatattttttgatgctattgtaaatggtgtttgtggcaaccagcctccagattgtcccccagtgatccttccctcctggtattcatacccttgtacagtccctcctatcccccacatggtaccagggttggtctgtgtgaccaggagaatatagcagaagtgatagaatgctacttctgagactaggtggtactaaaagacataaaagacatcatgtcttctttgctcttgtttgaattgcctgttctagaggacactgggagcagctctattggaaggtctatgtggaactagattttcctcaacgaggaaactagaactttcctcaacgaggaactgaggtc

SEQ ID NO: 267795 - DNA, 198 bp, Homo sapiens
ctctgtgattgtgattacgccaccttccctgtgtggacttgaggtttctcacttatccatagcgaggaccaaaccagataaaccttagtactctattgtgctcaaagagcttaggagtctcaattgttggccgcacagggcttgtgctcttgggtcagcctgatggaagtccaacttgccttctgccatcagaggcca

SEQ ID NO: 267796 - DNA, 383 bp, Homo sapiens
gagccgatttttccagcctcatttaaattgctcctcccctttcacctatttgttcagggaaagaaggctcaaaaaatatgtctcagtgcctccccatattatcatgagaccagtagaaatgagctaagattttagcatttgtgtaaaacaaggactcaaacttgaaagcttgagaggaaaggaacttgttgacattcttctcaagcaaacatgggcagcaaaatctaaatatcaagacaccgctgaagaaagagagaaatattcggatctgtagatcccaatcatcatttccagcttgtgtatattcaaagtgattcatttattctttagtaaatggaagatttatgaaggttactgaatgtgaagtagagtagtttattcac

SEQ ID NO: 267797 - DNA, 618 bp, Homo sapiens
  misc_feature (5)..(5): n is a, c, g, or t
  misc_feature (21)..(21): n is a, c, g, or t
taggnatttgcctcgggccangattcggccgaggtcctgaatgcattaaatatacgtacatactagtctattttaccatttacaaccatgaaatacatacaaatctattataagaagttaaaatctatcaaaacttacacaaacccagactgtatgtggtgtcattctctgtcaagagaaacgcaaatgtaaagatgcagtattgaatcataattgcatgaaactaactgtagtccattcagtgctactgtaaaatttcctggtcactgctcgttcctactgtagtgagcccaagtgtttcaagtgcccaattaaaatgctgtgtgacaccgatcacctctgtggcaccagctcattcctccagtcagttgcatagcctagtgaaacgtgatctctggtatttttcaacgtgtttggtgcaatactgtaaacctcgagtagcactgcaggacccatacacaatgccactggtgatgctggaagtctcccaagaagcagagaaaagttacggcattagaagaaaaggctgagttccttgatatgtcttatagatttcagtctgcagctgcagttgcccaccatttcaagataaatgaatccagtgtaagaactgttgtt

SEQ ID NO: 267798 - DNA, 650 bp, Homo sapiens
tgaaggcaagtcatggagtttttcacattatgggtgtggtcaggcaaagggagagtgagaggctgccgagaagaaagcaggaagagcccagcagagagaggagcagcaagaagaaccaatgagagctggaacggttccaatatgggacagggaaccagggataatgaccacagcaactccttccagcaatacccagcacttaacatacacagcgcttccgacagaactttctggtgcaatggaaatgttgcgtgcctgcactcatccaataagatagctactaagcgcttcaaatgaggctagtaccatcaagaaactgaattttttgccgggcatggtgcagcgcgcggagctgctgcaggtgctgcagagcctggaggccgtgctcatccagaccgtgtacaacaccaagatggctagcgtgggacttagcgacatcgccatggataccaccgtcacccatgccaccagccatggccgtgcccacagtgtggaggagtgcaggtgcccgagccggcagggctgggaaccacagagaccctagcaaggatagaggagaaacggcagggcctcaccgtccttgcagcgactcttttggtcctgtccccacagatgccccattggctattctggctttgtcctgcgagagc

SEQ ID NO: 267799 - DNA, 650 bp, Homo sapiens
ggctcggtccgccttaggtggtatacattatgggtgtggtcaggcaaagggagagtgagaggctgccgagaagaaagcaggaagagcccagcagagagaggagcagcaagaagaaccaatgagagctggaacggttccaatatgggacagggaaccagggataatgaccacagcaactccttccagcaatacccagcacttaacatacacagcgcttccgacagaactttctggtgcaatggaaatgttgcgtgcctgcactcatccaataagatagctactaagcgcttcaaatgaggctagtaccatcaagaaactgaattttttgccgggcatggtgcagcgcgcggagctgctgcaggtgctgcagagcctggaggccgtgctcatccagaccgtgtacaacaccaagatggctagcgtgggacttagcgacatcgccatggataccaccgtcacccatgccaccagccatggccgtgcccacagtgtggaggagtgcaggtgcccgagccggcagggctgggaaccacagagaccctagcaaggatagaggagaaacggcagggcctcaccgtccttgcagcgactcttttggtcctgtccccacagatgccccattggctattctggctttgtcctgcgagagc

SEQ ID NO: 267800 - DNA, 347 bp, Homo sapiens
tggcaatttctattgctgttctcaggcttcaaaactggcagatacgggaaaaaaacgttaatacagagagttagacctaccatacccttgactgaaatgaacatcatatagcaggacttacatacagacacaagtaaggaaatactgatggccaacaccatagaagtaatctttgcatactcttttaatgaatagtcttacaattcaaaagaatggaaactcaattactattacagggttttatcattagatattcatggtagcctctaatcttgttttctttcatccctgagattcccaactattacattaaacaaagctcaattacctttctgataatcattttt

SEQ ID NO: 267801 - DNA, 462 bp, Homo sapiens
tataataagctgtgtatatgtgtgtttaccctttttaaaaacccaaagtcttccaatcaatgatggagaatgtttctagtttgatgtattggctatctactgctagataacaaattaccccaaacttgggtgacttacaacaacagcactattatctcatggtttttgagggccaggaattggcactgcttggcgccagctgcatcacaaggcagcagtcaaggtgttgtctgggactgcagtcatctcaaggctggaccagggaaagatccacctgacctcactcacgcagttggtggcaggatgcagttctttgcaagttgatgggtttagggctttagtttctcaagagctgttgctcagaggccttccctggtttttcaccatgtatgcctctccacagggcaggttccagcacggcatcttgcttcatcagagtgagcaagtgagagggcgagagag

SEQ ID NO: 267802 - DNA, 445 bp, Homo sapiens
gctctgtttcttttttgtcactactaattgacaagttttgtcaaactctgattttggtgtacactttgcttcaaaaagggagatgggaggaaaaagtaaaccatctattaacaacacctttttttgctaaagatatcctttcagctcttgaatgtgggatatgatcagtttcctgttaatgggtaaagaagcctgctgaattaattgggttatcatggataaatggaaggaatatatgacaccatttctctgctcaaaaccctctgattgcttcctgtctaaagataatgaaatccagtcttcaccgcaatctataagacaaaatacaatcatatccctgacttcttctccagttcattcctaaccatactttcttgaacactcttctctggctttattagcccaattgctgtttcttgaatacatcaaatatgatattgtcaca

SEQ ID NO: 267803 - DNA, 415 bp, Homo sapiens
ctcccacaaagattactccttaagagataaattcttccagaaagtggtaatagaggaaacagttcccactcaattcatatggcctgcatgattgtaatccctgaacccaacaagaatgtgaagagaaaggaaaattgcaggctgatctctcttacaaacaaaggcataaaatccccaataacatattagcaacctgaatccagcaatttataaaacagggataacagatcataactaaattgaacttattccaagaatgcaaagttggttgaatattgaaaaatcaaagtatattgccatattaaacagataaataatttttaattatataaaatcattttaataaaggcagaaaagtatttgataaagttccagctattcattgagaaataaaaataaaatcctaagccccaca

SEQ ID NO: 267804 - DNA, 1126 bp, Homo sapiens
attatattatttttaattttttaatgtgttttttaaccaagtaggaatttgggtgtatggataagaggccaatctgcttctgtaggctatagaagaaaaccagttgtattttatggtcataatttgtccccctattattttggagatttaaatttaagtaaagtagccatcagtattttaattgaaaaatactaaagccacataactgagtaggatgtcgtatgatactttcaacaaattccctaatgctgcctaagcatatggatgttttaattctttgctgttataaacagatatctaatacgccagaattactgatggtaaaattgaagttgtgtaacttgtgaatttttttatcaatgttttaaatattatttaaatcttaaaatcatttaaagacttatgttgccactgggtggcagccatggcttctcccactaagcaacagaagtgaccaaatataattaagacaaattttcatctctattacatctgcttttaaaacattttagttcatattctattatttttctaactcagtactcctttgttgagggtaattattagtagttaagtttttaatggaaataaaaatcatgtatgcttatctttgctgtaaaatcaaatgaatataaattgaggaaaactttaaattgttgtaggatgactagtagtaaacatcatcttaatttttaacataaaaaaaaaaaaaaaaaaaaaaaaaaaaaaaaaaaaaaaaaaaaaaaaaaaaaaaaaaaaaaaaaaaaaaaaaaaaaaaaatgtggggggggcgacggccagccgcagaagaagttgttaaaaaacacaagctggtgggggggcggggcgcacaagagagagagaacgaaaaccgaggagaacagaagacgggctgcctctacacgagagaaacacactgcgcgggtatgaaagaacgggggcgggagtagcaccaccaaccaaaaaatagaaaaccggcggcggggaaaaaacacgacaaggtggttttcgtaaaaacaaacaccaacgaaggagagtcatgaggcggggtcaacaacgagggggagctactacacaaggggggggtagtacacgggagcgacgcaaaataaatagaatagcccgg

SEQ ID NO: 267805 - DNA, 393 bp, Homo sapiens
agcagctctttactcagtgctaacactgggtcatcaaatgatcaccacagtagagggctgttgtaaaatgctagatctgaagttcttctaaaataaatcctcagaaaatatgacctcattatttcctgaacttcagagctctttgtctgcttcgtagaggtagaaagaaggttattaaagcagtagcagagagaaaatgaatcattcaaaaaatatatgcccccactctatccttcagccgtgatgcctggccctttacatccctgggccactgtttattgttgttttctgtacatccctggggttggatcaggacagcaagacaacagtacctactaatacatcatcttgtcaggaactgccacatttgtctgtagttaatttttaaaatac

SEQ ID NO: 267806 - DNA, 579 bp, Homo sapiens
catattctggacataagctttttatcagatatatattttgcaactattttctcccagtctgtggcttatcattttctgaaatgcttaatgccattttaaatggactcttaagatgatctcagtatcatcaatgtgaccagtacaatgtatgtcccaaatcctgaagaggccaatgtaaaaatgctgtctcctcactataacggcagtgttaaaaaacatagtgctagattccaaaaaatcaactctagaaagacatctttgagacagttggagaaatctgaatttgggcaggctattacaggatttgctgttagttttgttagatatgataatggcatggtgattatacatattttaaaatgtcctcataagttatacactgaaatatttatggacaaaaaatccaagatgtctagacttctttaaaatgtttcagaaaatatagtatggggatagatgaaacaagataggcaaaattgttaaagctggctgatagatatatggtagctcattatactgttctttctacttgtgtgtatatttgacaatttcaataataaaaacatttaaaaagtagta

SEQ ID NO: 267807 - DNA, 903 bp, Homo sapiens
attcctctatttatttcttttttgctcctttttagtaagtacagcccttattaatttgtgcttttcaatgaaaaattattatgttatatgctttggataaatactactgcactgtaagtgcacacatctgcatcattattgccaaaaaagaatgctctgctgaggaatgtactggggtcttgaacatgaacattttcttcatggcagcagagggagcacaagagtgcttaataaaaccagtgcacaggtctctccaaatcatgacagattttacattgtagtatatgttttcattggaagtagcctgttatgtagttcaaaatgaagcaaatcaactgagcaaacacagataggcttaccaggtcataacaactatgtaactgaacagattgaaagttgaataaaataaagataaacttctttagagttttaggcttgaattcttaaaagaaagtggacctcaaaagtgaaaaagatgccttagctttgctcaaaaacaaagataacacaacacagaatcaggcaaccctaagatgccttagctttactcaaaaacaaagataacacagaatcaggcaaccctaatagtagctcctgtttatctaaaaacagagtcagttcactggaccctacatcaggtaacttaatttcatttggtgtcatacatgttggttaaggtccatgcgccttttgctgtgtttacactcagaataattttaggggtttctccttaatgcttgcagtggtgaggatttaggtttcagttatacctacgtagtatttcatacttttcactactcttccatattgcatcctcaaaaactcccttgaagcagataacatacttggtaaaagccaagtatccaaaaagttatggaaccacatcgtgctttcataacattg

SEQ ID NO: 267808 - DNA, 164 bp, Homo sapiens
agatgtttaaaaataataataataattttttaaaagcctcgcgtctcgatttccaaatgggtctctgacaactttgtccgtctctaggatctgctctccaggaccacgcgtttcggatttattgtccgccaacagtgtatttttaatacaagaaatgaagtctt

SEQ ID NO: 267809 - DNA, 482 bp, Homo sapiens
attaatgcagaaaggatggacttgaacaacactaaggaccaaatggccttaacagacatctgtaaaacatttcatccaacagcaactgagtatactttcttctcaagtgcacatgaaacattctccagaatagatcacgttaggtcaaaaaataagtgaacaaatttaagaaaatcaacatcatactaagtacctttttcaaacacaatggaatgaaattaaaattcaataaccatgagaaaacaaatacaaatatgtggaaactgattaacacattcttgaacaaacaccagtcaaagagaaaatcaaaagtgaatttttgaaatatctcaagatgagtaaaaacaagaccacaacctactaaaatttatgggatacagcaaatgcatgaataaaaggaaactttatagcaataattgcctacattaagcaacaagagagatttcgaatgaaaaaatctcactttacagctcaagaaactg

SEQ ID NO: 267810 - DNA, 351 bp, Homo sapiens
ctactcaggaggctgaggcaggagaattgcttgaacctgggaggcagaggttgcagtgagccaagattgcgccgctgcactctggcctgggcgacagagtgagactgtctcaaaaaaaccaaaaaacaaaaaaaaccctgaaaacatgcttggagtatagcaatgaacaagagattgagctgaaaaaatgagtaaaaagctattagctgggtgtggtggcgcgcctgtgatcccagctactcgggagactgaggcaggagaatcgcttgaacccaagaggcagagattgcagtgagccgagatcgagccactgctctccagcctgggcgtcagagccagactcaaaaaaaa

SEQ ID NO: 267811 - DNA, 409 bp, Homo sapiens
ttcctttttttgtcctatcagagtgcccttttttcaatcctccctgccattggctacttttaggatcctgttgcttggtgtattttagagcgattggtgcattttacaatcctcttgctagctacagagcgctgattgctgtggttttacagtgcactgtttggtgcattttacaatccccttgctagctacagaaacgttctccaagtccccactcgattcagaaagtatagctcgcttcatctctcaatgtaatataactgggtgtgattgcttgaatatcctgaccttaaattctatatgcacctgatttgtgaatgtgctgtgacattctttttacttttaattgttgtgaccagtgtcaagccagaaataaccatggcatgttaactgatgagttcaatgatct

SEQ ID NO: 267812 - DNA, 867 bp, Homo sapiens
tgtctgcgatcctggtctgggcttcccaggcccctgtatctgctgccttcaaaaccctgcatgcgggtctcttgtgtctcccccacccccccccatctcccagctcagtgagaatcatctttcacagtttgatcacatcactcccagctctgcttatctctcctggcttcccttctcaaagccaaacagctagctctgcccccagggcccttctcctgacccctggctcctgacagcctactccccaacccctgctcatcacttcccaggaatttgctttaagcaagggacctgcctgtgcactggcctccactcagcacgagtctgagagagtccaagtagaaaacaggacacttagctaccatctactcccaacctctctcctggggaggactcaccctaaaggtaagctggctgagtccatcagaatttgctcccatgactcgagtaaccgggagctcatgcacacctgtacggaagaaaagcagacagaggacaaggcttgcagacgaaaagtgtacatccaaacccatctctcccagctaccagctgtgccatactgggcaagcgatgggtcttctctggggctcagaccttccgtctggaaaatgaggctaatgagtcctacctcatagccatcaacgacatcaggaacatcatcatcatcatccctggacaatttcagtgtgaaaggaacgtggtattgcagctagtaagacctgaattggaatcccagctccagaacttggggaaatgagtcaacttctctgaccttcactttccccatctataaagtagggatagaaaggtctccctcaaagggtgactgtctagattgaataagatgacacatgtaaaaatggcttt

SEQ ID NO: 267813 - DNA, 530 bp, Homo sapiens
cctttaagaaaggcatggtttcataaaatacaacccggctacatataaattctagcggaagattttatggcacctcttaaaggccaggtagaagagaggcaaccgaaagttactcagtagaacagtacagtcctcatttcttcaaggcagacagccttaaccacctagaggctgatggcctggggagtacttttcaagttctgaagcagatttgtcaaagtagccaaaatggcatttccctcctgaagattcttcactacctcgattcttatgaaatagtctaaggaagttctaaagaaataagacaagtgaattctattttcgttaccagagaaatacaatcgtactagacggggctgtaatctggtaactgtatgtattttagttcttcagtccctgggaaggagacaggagaaggtgggagggaggaaggggccagctgaaatggaaacagatccctgatccggggcggtcagtggaacccttcttggtgtgcgagagcctgtgcatttcagaggcagcaaaaaagt

SEQ ID NO: 267814 - DNA, 915 bp, Homo sapiens
tcactgcagccttgacctcctggacccaagtggttctctcaaggaatctacttagtccgtcaagtagagctgggaccaccagcatctgccaccacacccagctaattaaaataaacttttttttgtagagacaaggttttgctgtgttgcctagactggtctcaaattcctgggctcaagcaatcctcctgccttggcctcccaaagtgaagaaattataggcatgagccaccatacctggccacccagctttttcttgattcatccaagttagggctgctaggaagatgaagaaccaacattaggaggctggaatatcttaagtactagccgtggactgttgctggcattctttgatctgtggctgctgtggctaggcttcaggtgggacccaaaacctgtagtctaaaatccattaattatttcattttacttttatttctttaaaaaaaaattatttattttgaatagagatgggatgtcgcgatgttgcccagcctattattttctttttcaggcaagccagtttctgtactaaaagggtcacatttacacgttatgggcaggaagaatatagggtgaaggacacccttcttttctttttatcaagaaaacaatagctttcctggaagctctacccattagacttctaattatgtctcactgagtgggacatggccactcttattttcaagagagtctaggtggtaaatagatttgtctgggcaccttgctgccctaaacaaaatcaagattctgaatgaaaattggttaggcaactagcggtgtctgccataggaactagctttattttcttctagttgtatactcaattatgctagcaccataaaataaataaagtaaaaaataaattaataaaataataaaataaataaaataaaatataaataaata

SEQ ID NO: 267815 - DNA, 2389 bp, Homo sapiens
tggggagtaagagaccatcgcaagccagggatggggtggcgcacactgtgatctcagccagtctggaggctggggctgggcggtgggggggtgcgggtcgcttgtgtctcagagctggagctgtggtgtgcgaggccgaggtccgcgcctataaatggccgctgcgctctggcccgggcaacactgagactccgactctggaaaacaacaaaacttaaaagacgaacacagatggaagtttgggagcctggtatgcggtaagcactccgcaggtgtcagccgccagcccgcagtcccggacaggtcaggggaaggcccgcggtatgcagcaggctgccggcttcagtcactgcctggtggaaaacaagcctgtctttggggccagccagctaacaagtgagcccttcaccccatctgaaggcgaagcacccaaaggggcaaccgtggacggctaaataaaaatcaagactcctgggacgccttctcgggacacattcttaaagagatacgtgcctgaggacgttgtgtgtatttctgtgtaacaggccaccccaaacctcagagggcgaaaacctctcttcactgctcatgactctgtgggcctgcagcttaagccggttcagctgggacggcttgcctcggctccatggggtgtctgctgggcccacttacaggcaggcgccccgggcagatccgggccacatgtcacccacccaccgcaggctggccgggcctccctcccgtggtggctgggctccgtcggcagcaagaaaaagcaaatccccatggtgcttccctccatctccccaggagggtgagatggccggggcctgagtggacgtgaggcaccgcacaggggacgggcacggcaagcatggttcatcggggctgtcactgcagaagtcttccacaggccttcgctgaggtgcgggttggtgtggggaatacaagggaactccccagaatggaggctgcttgtgcaagtttcaacttgtcctttttctccctccagagcagcagagagcggatggcgcccaaggccgggaccctctgctgctcccacaggcctctcaggcggctctgcaggaccagccagcagcctctgatgctcccttcctattccatggcttcaggtgccatcctctccacagagacggtttctattgtgacgctctccctgacttggaagaatggcactgggaacattccccttggtgctgatgtcggggaggaaagcagtttccagtcgcctggggccaggacatggcgttcccagctgttgtagagcatgaagcaccaggatgcccattcgggtgcctgctgagatcaggctctttgagaaggaatcctgtggtcgcctgaggaagtccaaaaaaatttcgaggacatctcagccatccatcccctgttcactgtggaggttgaacaccggggctcctggaggggggccctgggtctccacagaagtgctggcagccaccatccacttcctggccttccgtgcccgctccacctctgttctgttgtttactgtctcctttgtgggaattatggaataaacaatcactctggtgtcctggaaaataaacctgatgctggagggcttgagtgtaggaatccagctgggctcccactgtctgccccagggtgcggagttaggctttgcataagcatgtgagatgccaaccgctatgaaatgtggtctacacagcaccaaaaatccatttcccacgttttcccttcagtgcagttaaatggcatgaccctgtgactgtctcccacgagaagaactaaaaattacgctggtcctgccaatgcctacaggatacggtggcacaaaatgatttccacggtcttaggatatagacccaggccgactcgagagattaagtggatttcaaactgtggtcttgagccttctgggaactgcccgaaaggaggggaaggcgccagcctcggagtggtccagctgcccggcctgttcacacactggcctttcagttgaagacagtgttcaaagcttacccgtgtaaatgccactgatctgtgaacccccttcctgtcatgcccagggcctggcagactgtggctagaacggtgggatcagagcagtgggtcacgtgacctgcgcacgggtgtgctggcctccctgggccgcggtggccaggacagccttcctttccctttccagccacacagggcaatccgtgtgctcagatttctgtctcatcaattacagagcgagctgccaacctgctgtgctgagactgtggcctggtcttggtcctggtgtcctagggctgatgactgaccacagcctttgtgcttttgaagcctatttgactatagtccttgtgtgcaactaaaaatgtagctttaaacaatcttg

SEQ ID NO: 267816 - DNA, 503 bp, Homo sapiens
ataagcctttaggatttaatggcaggaaagtcactcagggaggacctacctcaaggagaagctcaaagcattttgcttcagctcatcaaacagagctctggagcattgcgaaaacgattttaaaaatggcaagacaaaaaaagtagaaaactatggaataatgttttgcttcaggtgtagctaatccaaactgccacaaaggaaaattggggcactggtggtgtgggatgagagggttcagtagtcaggagacaatcttttgttgaaatgatcttttatattgcttgaattcttaccatgcatatatgaccttttcagaaatgttgttcttactacaaactaaaacaaaatcttgttagaaattgatgtctaggcatggtggctcatgcctgtaatcccagcattttgggaagctgaggaggtggatcacctgaggtcaggaatttgagaccagcctggccaacacggtgaaaccccttctctactaataatacaaaaaaaaa

SEQ ID NO: 267817 - DNA, 828 bp, Homo sapiens
aagtacagaaacgtgggttgaaactgcagctcttttttctgcaactggtcaagctgatatttatgacttcatccctcacaagtcattctaggtttccccttggccttcagccagcacctcagctggttatggaggctcaggagtctgagtccttggagagcccttttagggtggggttttggaggtttgccattaacctttgctgtgctccgacgggcaccacctaaggaggtattttaggagcacgattgggtcctaatcatcttcctttctgttgctattgcatagcagcgaccctaatttgccttttagtcagaattaatctctgcacagaaagggacacttacccggtgctcaaagccccctgctggtgtgttggagcaacctgctactgcagtgtcttgtggacttgaggcgtgctctaccaggaaagcccacaggccccaagacctgtactcctggggccctgagcagctgcgacttggacctgggatgtcaactaagcccatcatacactcgtgcccagtactttaaggctggagggagaaagtcagagaagtgggggtcctgaatcatttgtccccgtgctgctgtggtgattatgttggtggcagcaggggcggcagcagtggtggtatggggcggcagtgatgtgggttccgtgctgacagtgctggcggccaatagctcctatggcaggatgtggctgtgtccttggctgcccagttcccttgctcctgccagtttctgattctccagcctctctgacaattccccaagctcctctatagctttccaataaaacttttctgattcaattaaaaaaaa

SEQ ID NO: 267818 - DNA, 296 bp, Homo sapiens
aaaaaaagaacagcaactgtaaatccagtggtcaaggatggcctccctgggaaggtgacatttctgctgagacctgaaggaatccaagaagagaagcaggtgaagagcttccaggtggacagggagaacagagagccaggagggaatgggccaagcacgcccacccaacatgacaaagtggctgcaggagcatggcacgagtgatgcaaacagcaggtgctcaataaatgtttgttgccctggacatctgcacaaggacagcgtgggcttgggaggccccacccatgcttattgct

SEQ ID NO: 267819 - DNA, 503 bp, Homo sapiens
ctcttctcctctccctacaccttacaaccacattactaaatgctcatttacaacagttccttttacctagtacatcatgtccaagctatcaagaaaaaaattacagggcataataaaaggtaaaaaacaagcaccaggaccagatacagcagggatttggaattatcaaacttggaatctaaaacaactatgattaatatgctaagggccctaacgaactgagtaaacaacatgttaaaaaagtagagatgaaaatcctaagaaccaaaaggaagtgctagagataaaacacaaacaaaaacaaaaaacagaacactgtaagagaaatgaagaatgcctttgatgggcttattagtaggctgggcatggatgaagaatctctgagcttgaaaatatgccaaaaaactacatctgggcataaaacgttgtaattacagaaattcaaggataagaaaaaaatccgaagtaagccagagggaaaaaatcaccttacctgtagagga

SEQ ID NO: 267820 - DNA, 451 bp, Homo sapiens
tgcatcctggttccagaccatggaggtgtcctacagctgaggatagggcaacatcacttaatagaccccacccttaagtctcagagacacagtgcctacctaagattaaagctgaatcacaacagaaaatgccatcccttctaccaccaccaaaatatcaaatgctgagtcaataagaacagcaatctactgctaaaagaaggataaaaacatggagaaagacccctctctgaggtacaggaatgaagggaaggcctaaaggtaagagtggtgcaaacattgagaaaatctcctttagcaaaccatcccacacactaaacttaaggtaatactagaagaatttgaagcctgtggataaccatagcaacaaaaacacctaaacacagtttaactcctgattagatcaactcaagccttcacaataaagatctaccgaaagaaaaagtaaaaa

SEQ ID NO: 267821 - DNA, 530 bp, Homo sapiens
tggtataaaatacatctaaaatctaaaatataataacttgtaaaatttgttttataaactatacattgtctgttaaaatgcaacatcttctcatgctggctggtaaattgcagtcataattttaggcacactttcttgctactttttcaatagaaaagatatgacaataaggtcactaatttccttaaagttatgaaatgtgaggcaatactgtattatgatcagacataccaaatttactagtttaatgacagaaactgccttgttttcttagttgtaaatggttaagttacctacgtttctcaggacacagaagcctacagataaacacaggatcatgaaatcattctctagctctgcttttctttcttcaggaactaaaaccctttcaaaattctcctgaaatatcagagagcttgcatggtgtcacattctcagctaatcagtaaattagacccctcagctaaactatggcaatgaacatttccaacttcctcaattttggtcccatgtgataccatgaccactag

SEQ ID NO: 267822 - DNA, 665 bp, Homo sapiens
aatatattgggttggcattctatcatgtatgaacgcttttgagactagcagtaccctcatttctttccccatttctgagctaatttagaaggcttatgctcttaacatgtagataataatacattataataaaattgtttttctctattatcatatgtattttatttgaaggatttagaacattattctgagtagaggcctacaggttttagcagactgctaaaagagtctgtaaaacaaattaacaaaaagttaagaacctctgctagacaatgtctctttagaagtaagcttatgaaatggctactgtacatatccttatgcagagatcaaagtcatttacatgttgcattgaattcagtctttgtcttggctcaatgaagatcataactttatatgtgatgtgataaatatattattttctttctttcaggatttgcagcactgagcctttcaacatatatagccatatcaatggaaattatgtcttgagtttaaacacccaggccaataatgttgcatatcttggccctgatttgttccatttttatgtagggtcttccctttcttagggtctggcaagccaagcctaggcccttcaagactagtctcctagctacataatgccactgcatcattttatctagcactcatgggtgtcatta

SEQ ID NO: 267823 - DNA, 214 bp, Homo sapiens
tacgtgcctccacacctgaataatttttgtatttttagtagaaacagagtttcaccatgttagccagtctggcctcgaactcctggcctcaggtgatctgcctgcctcggcttccccaagtgttgggattacaggtgtgagccactgtgcccgacctatattctatatattcttaaatcacatattgcagatgattgtcggtttgaataatatg

SEQ ID NO: 267824 - DNA, 461 bp, Homo sapiens
acttgcctggtctgacagcccacgcacgacagccccaggacagtgggtctaggccttgccggtggtgctaggagacagagtcctgagatcttcatttcctttctaggctctccattcttgaccctttcaagaacccatggtttctccaggggactaacaccctcttgtttactccaggcctttcagtggggaacggagaggggcaggagctcgccgctgtgcctgaaagccctaaacgcagtgtctccttagtttaatcttcgtgaccaaccacgcaatgggcaagccttcaccaccgttttacagatgaacaaacagaggctcacagaggccgaggcacttgtccacagccacagggtcagtatgtgggagagctcagactagaacctaggattgtccagctataaagcctgtgctgttttttaaacctcaaataaagagacttgagtgaatcacattca

SEQ ID NO: 267825 - DNA, 310 bp, Homo sapiens
gaaggtctcagacacgtcaggtggccttctgcacacacacctcactgtctccacttcagagagggctccctcctctcctcttaacccttcagaccagggcagataactgtccctgccatcactagcccctgggggtggtgccatcccttgtggtttccctgtacttcaactatgcatttataaactgcccctttataaaatattccattaatgattaaatttcagtgagtcatctatgggctgctgcaaatcttacttaaacatgacccaaggaagtggccccaaacaatgctagtattccaagatttcc

SEQ ID NO: 267826 - DNA, 402 bp, Homo sapiens
aaaatacctgctctacagactttattggattattataaacacaaaaggggtacatgaaggttaagtgaagacgcaataaggcttgttggccctggagcccaattctatgggtttgtatcaagtcaccaaccatcttcctttttgtttcttttttaatgagacagtgtcttgctctgtcactcaggctggagtgcagtagtacagtcacagctcattgtagccttgaactctggggctcaagtggtcctcccacctcagcctcctgagtagctgggactataggcatatatcaccgtgtctggctaattttttctatttttttgtagagatggagttttgctatgttgccaaagctcgtctcaaactcctaaaatcaagtgatcctcccaccttggccttgca

SEQ ID NO: 267827 - DNA, 455 bp, Homo sapiens
agcaaacacttgcagtggccgtggaaagcctcccgtttcctctggaccctcagcctctccctcgcagggcaccgggctctctccctcggggacaatgaggcgagagaggcttttgtttattcttcaggagtctctgagagttcacagtcatgttaaaaattaacctggggccaggcgcggtggctcatgcctgtaatcccagcactctgggaggccaaggcacaggcgggtcacctgaggtcaggagttcaagaccagcttggccaacatggagaaaccccatctctactaaaaatacaaaaatgagtcgggtgtagtgatgggtgcctgtagtcccagctactcaggaggctgaggcaggagactcacttgaacccgggaggcggagtttgcagtgaaccgaggtcgtgccaccgtactccagcctgggtgacagagtgagactctgtctcaaa

SEQ ID NO: 267828 - DNA, 440 bp, Homo sapiens
ttctagaagtctaattagattgttggtgtcatggtggtgagataatttagtggcaactgaaagcaactgtgttaatgagaagggggcactgtgcattgggttttctgtaattaatggagagtttttgaaaaacttcttggttccaataaagttggcatagtgagcccagctgcaggagtagggggtggcagggcaaaatctttcccattcattgctgcagaaatggtctcaggcaatgcagaagaactatgtaatgactgtcattaagaatgatcttgagtggtccaggcaggctgtagtcagtctaagacagcagagagacagagaagaggcatggagagaaaggaggcagggacagagaatagagtaaagattgtgagacaggtgtgacaaagacagagagagagagagagagatcactcacctgtctgctctctcca

SEQ ID NO: 267829 - DNA, 428 bp, Homo sapiens
acaatatttgttccttaccatatttgcataattgtcttataaaagtttctttggtttttaaatgtttgagagaaactaactggacatgttagaatttgtgtattagtgttggaggcaacattaatcaaagttgtgttttctctttatattgttctttacattagtgtaactctaagtgtaatcttatcaaaaagtattgtttaattgaaatttgttaaatgttgttttaactatctagtccattttttaatgctttcttgttatatggcattctgatttatcattactaaatgttgatcaaatacatctataatacattaacttttatgttttaacttacatagtcaaactaaaaaaaagaatcaactaaattctctattaaaaatgcacatgtaccctaaaacttaaagtataataataataaattt

SEQ ID NO: 267830 - DNA, 847 bp, Homo sapiens
tgaaacccgatatgtcaggcaagctggtgggatcctgggatccctcatgtaacggcactcattctgacagaagcagagataaaacagactaagtacacagaggagtttaaggtttcgtgaatgtaagtgctgagtacagaatggtgctcaataaaagcttgttaattgatggaccacaggtttgtgacaagacttctcagagtctgattctttcaaggtgggatataagagtaagataccttgactatgaataatagtttcaataaggaagacagaatgagttctgacacgatggttgggagctgtgacaggcagacgaaaaatggagccaaatggcatggaggtgtgtcatcactgctggattttaccttgatctacattcagttatctacttcttttcaaaatgctgggcattcattcaagaaacagcatatatgttctgactttgaagtaatggatgaactgtcatgtgcagtatatggaaataagttttattaccttcttcccacattaactcatccatccattcaatagccatttattgagaagctcactctgtgttaggcacagtggtgtcatgatgttggaacagtaacaataactcaaccaaccagggcttgtctgaatacaatcctacagcagcaggagctgtggagatatagaaggcaaggaagaccaggttgtgagggaagacgaatttactcccaggaatgttgggattgagagtaatattctccaataatggtggaagacagaacaataaaagcccaccagctccttctgcatggtgggataagagaaaagccaagggcagaagtgagaaaaataaccatcaccaaactgaaaa

SEQ ID NO: 267831 - DNA, 429 bp, Homo sapiens
tgaaacccgatatgtcaggcaagctggtgggatcctgggatccctcatgtaacggcactcattctgacagaagcagagataaaacagactaagtacacagaggagtttaaggtttcgtgaatgtaagtgctgagtacagaatggtgctcaataaaagcttgttaattgatggaccacaggtttgtgacaagacttctcagagtctgattctttcaaggtgggatataagagtaaggtaagcacctcagaaaatgcctggggcaggtcactcagtgttgctgggactgatggtgttggcttggcttgactaggatttaataatacagatgtgcctcaacttatgaaggagttaagtcccgataaacccatagcaaacttgaaataccatgagttcaaaatgcatttaatacacctaactgactgaacatt

SEQ ID NO: 267832 - DNA, 428 bp, Homo sapiens
caatatttattttggaaagctgctgaaaatgtctttttcaaaattaattatgcttaagatgtatggcattaaattcaattttatgaggctttctgacatatttactaaaaaaacctggaactgagactgaatttggaagacatttaattttgtagtgagatatctatattgtagatattgtacttttaaaacctgtcattaagtgtttggcatgtggttaatactttctctttagtcacaactggtattttaataaatgttataaacgtaagtgccaagatatgcatcactaactgttctatgaaatttgtctacttctcctttatgttcccaaagtcacagagaaagcagtgtactttatgacagtatatttatctttttatcattatgaattataagcagtgttaattttgagaaataaaagtcca

SEQ ID NO: 267833 - DNA, 484 bp, Homo sapiens
ataagtcaccatctatctctatcttcacatggaaggtgccatagactgccagtttcccatgtcccctccaatccattctcttctttctggtcaccaggctgtccaataaagactacatttcccagcttcccttgcagctaggtatggccatgtgactaggttctcagtaatgatatgtgagagagctaatttgtgtaacttcttcctcatttgcctgaaagaaaattgttgccttagacttttcttttctttctccccgtactgccccctaacggctttcctttgggctagaccccagaaatgccaatgatccagcttcagtgatgcaaatgaagacctcagggatcaacagagcaatgagagaaggaacctaggtccctgaatgactctggagcagagatgccccagacatcttaccatgccccttacctcgaatggtaagaaatttacatatatgagaaataaacttctatttaagttacta

SEQ ID NO: 267834 - DNA, 366 bp, Homo sapiens
gagccctcatcaatgggattagtgcccttataaaaggagccccagagtaatccctcatcccttctgtcacgcgaggacacagtgaaaagatggccatctctgaaccagggagaggatcctcaccagacaccaaatctgatgtcttgatcttggacttcttagccttcaaaatgaccccagaaatgccaatgatccagcttcagtgatgcaaatgaagacctcagggatcaacagagcaatgagagaaggaacctaggtccctgaatgactctggagcagagatgccccagacatcttaccatgccccttacctcgaatggtaagaaatttacatatatgagaaataaacttctatttaagttacta

SEQ ID NO: 267835 - DNA, 459 bp, Homo sapiens
acatatataatgaagggaaataattcctagcagaatccataacaaatgaatagtgtgtttccctttgtatcttagcctacctttgtgaggccagttttttactctggggctcaatttgtagtgctgctcaagaatgaacctagtgctgctcaagaataaaccatctcagctgggtatggtggcttatacctgtaatcccagaactttgggaggctgaggcgggcagatcacttgaggccaggagttcaagaccagcctggccaacatggtgaaaccctgtctctactaaaaatagaaaaattagccaggcgtggtgatgcgcacctgtaatcccagctactcgggaggctgaggcaagaggatcacttgaacctgggaggcagaagtttcagtgagctgagatcattccactgtactcgagcctgggtgacagaatgagactctatctcaattaaaaaa

SEQ ID NO: 267836 - DNA, 870 bp, Homo sapiens
tgctccttgtgtcatctgatttgaggacaaaaggaaccagtgctggaggcttgtcttctcacctgcgggtgaactgcacctgcccggccaccccgtggttgagcagcttgggaaatggcctggcgctgaatggaaagcagtgagcactgtggcaggcagacaggctgcaggtggcgcgctccaggtgcggccggaatcctccaggctcttggagggattgccgcattcgtaggaccaggcagcctttcctgaatttgcaggtcacttgcacaggcagtgggggtggtcacaggactgtgaggccaggcagcctggagtcctggaggtgtggctgccctgagctgtggctcccctagaaaagggtgctgttgctgctgctgcgaggattcatccgcgggcctaggacagggcctggccctccgcagtgctcactctgcaggggtgcccgcctcttctcctgtcatttctttgtggtttgtgccttttttgtccctaccaattcaccttccctaaaggtcctgcagagccgggactaggcaggcctcagagtagccatgtgagggatatcaccctctgttgccaatcagttgccgggtttcccagctgcgtttctgaacggtctgttctctgtcctgtttgcgagttgctctgtccagggttcaggggcagagcctgagtttgggccttgtgggttcatgtggtcctcctgtctgtccttgaagtgtcactcagtctttggaaagagtcctggagtccaggtcgagcctgtcctcccctcgtgttctgggtgccctacagaaggctgggatgtgccctgatccacagttttggtgccaggccttccctcggctgagatgtcctggacttttc

SEQ ID NO: 267837 - DNA, 439 bp, Homo sapiens
ggctgccaggtcgggtgccctttgagttcagcctggtcactgagttgctaagagaaggtgggcactgctgaccctctcagagcttagctttgacttcagaaggtgaggaggctggacaagatggcctctggggtcacctggtcttcacccctgtgttccacatgggctgtggtgtgagtttacgttgtatgtgcccagccagtgaccaggcccaggctgctccccgagctcctgagatgtgaggaaggctgggtgcagtggctcccacctttgggaggccaaggcgggtggatcacctgaggtcaggagttcgaaaccagccaggctaacatagtgaaaccccatctctactaaaaatacaaaaattagccaggtgtggtggcacatgcctgttatatcagctacttgggaggtaacagagcgagactctgtctcaaaa

SEQ ID NO: 267838 - DNA, 496 bp, Homo sapiens
ggctgccaggtcgggtgccctttgagttcagcctggtcactgagttgctaagagaaggtgggcactgctgaccctctcagagcttagctttgacttcagaaggtgaggaggctggacaagatggcctctggggtcacctggtcttcacccctgtgttccacatgggctgtggtgtgagtttacgttgtatgtgcccaagcctcagaagtgagtgggtgtctttcagcatcatcactgcgacccaggacttccatctgcctgccccacagcctcctcatctggctgggccattctgcagtgtttctctgagctccagaggcctcgtgcccctcgccaagccccccacactgtggaccatgccacagggagaggctgccaggaagctctgcccagcgtcccaccgtctttcctgagggcagcctcccctggagggaggagccgaggctgcacaggctgaatggggccctttattcccggctcccacagggagggtaca

SEQ ID NO: 267839 - DNA, 581 bp, Homo sapiens
ccattttggccaggctggtctcaaactcctggccttaaatgatcctcccacctcggcctcccaaagtgctgggattacaggcatgagccactgcacccggccactttttttttttttaaagaaaaatgctctgcatggattggagacacagcaataactactgttgccatggaagggttaacagtgtaggagctggtttatcagtccgctttgacatacagctaaaggaaatttatgtttgggggaaaaaggccctctgttcactttaaaattcagtgtggacttatgccaaagggggctgtttaagttgaaagaagccaagttaagtttggcctcttgcctggaatcacttgaattctgaaatttcactgcgacggacatgtgccttgtcacattttccattgcttaatcctgaagtttggtgcaagtctctctgcacctattaaaaagtgatgtatatacttccttcttattctgttgagttgtatagaattgtcttttgtatttaacactttgtaattttcacaatattttttaatttaaataaataaacacattttttccctcctgggaagtcatga

SEQ ID NO: 267840 - DNA, 440 bp, Homo sapiens
ttaaccaggcgaatgattacttgtacttccttaactgatagtttacgttttgcatttattattaatttttttgattgctaagccaaagtttgctgctcagtatacattctgtttattatattctaggacataagcattaattttaaaaccgtcacagctttggtaaggatattgtggattagtaccaggattggtagatttcttctgttatactagaatttcagtgtaatgctgatagatcaaagtcagaatgcctgttggatactctgttcaatacttgcacgacgggatctttcatactccaaacctcagcatctggcagtatacccaggtaataagcctgcacatgtactcactgaatctaaaataaaagttgaaaaaaacaaaccaaaacaacaacaactacaaaaagtcagaatgcgtaacaattgaaaaaaaaa

SEQ ID NO: 267841 - DNA, 465 bp, Homo sapiens
tgagacagagtctcgctctgtcacccaggcaggagtgcagcggcgcgatctcggctcactgcaagctccgcctcccgggctcacgccattctcctgcctcagcctcctgagtagctgggactacaggcgcccaccacgacgcccagctaatttttttttttgtattttttagtagagacggggtttcaccgtgttagccaggatggtctcgatctcccgaccttgtgattcgcccgcctcggcctcccaaagtgctggcattacaggtgtgagccaccgcgcccagccatggattccttttttaaaggtaaaaataagagtatttttaaaagtagcggtatttctcaaggggggaaggctagtcctgttcatgactattttacaggttgaatgagtcctccttttaattgagttaatatttttagttctaaagtaaacaactgacatggtcccaacatacacaca

SEQ ID NO: 267842 - DNA, 348 bp, Homo sapiens
ctactcctgacctcaagtgatccacctcagcctcccaaagtgcttgggattacaggcttgagctaccatgcctggctctaatctcttttcattgggcatttaagtgacttctattttttatgtttatagtttttttgtcttgactttatttttatttttatttttattttgagatggagtcttgctctgtcacccaggctggagtgcagtggcatgatctcagctcactgctctaccctccaagttcaggagaatcacttgaacctgggaggtggaggttgcagtgagcaaagattgcaccactgctctccagcctgggcgaaagagtgagactgcatctccaaaaaa

SEQ ID NO: 267843 - DNA, 496 bp, Homo sapiens
ctcagacgctggaatgctgccactggatgccatgttgggcatgggcttctccttggggtccacactctggaaagtcaggcaatggtctcttctgttcagggattccccagacttggctgacccatccactccctgagatgacccaaggaatggaggacttcaggaaaataataagaaaacatggaagagaaaatggctaatgttctgttttaggtaactgtcaatgttgcttactggtattgttttgatctagatttgagggaataatgataatcaagtttacataactcttaggagggttcatacacataattttatttcattcttcacagaaaccttttggagggagtggtattattccccaggtaaggaaagaggctcagggaaattaagtggctttttcagggtcgcatatggtgtggttttatcttgaagagtgcaattttaaaagagaaaagattcaaaagagaataaatggggctgtgtttttaagttg

SEQ ID NO: 267844 - DNA, 526 bp, Homo sapiens
ttaaaggcttctgcctgctgaaactgtccatacgcaaaatagcaccaaagctagttgaagttttttcaagttttgtctgggaactactataaagcagacaataaaaaataattcattttcaagacagatggcaccataatgttgcactattttctagtgtgcattttttcctaaacactagaggcagcgtctccatacaaaagaaagtccatccagctgcagccagttagctttcagattgctgtttctgtagaacatcacacacattaaaaaaaaaaaaaagtcccttttttcccccaccatagtcagctcaaccctttcttctaaaactctacaggagctattatttcatgcattattattgtcagtgtttctgatctctttcccgcttgcatctgattgttcacacctgagaacacctagaagtggtttgtacttgtaaggttaaagtttagttagatcttcctacatgctgtctgcaattcagaagggtgcctggtgcacacaggtaatgatacagtaagtt

SEQ ID NO: 267845 - DNA, 382 bp, Homo sapiens
agctgtcttcttcgtcttatttgttttgtctgtgcattacctgtggaagaaatggaagaaacaccaaaaaaagctgaaaaagcaagcctccttagaaaaacctggtaatgatctagaaagcccattgatcaacaacattgaccaaacactccacagagtggcaaccacagcatcagtgatatacaagatctgggagcacaggtctcaccatccttcctctaagaaaattaagcactgcaaattaaagaagaagagtaaagaagaaggagccagaagatactaaataaatgcatatgcaaatgtagcttagtcaattatagatatcacaaaagaaatctatcatctaaggattaaaaattgttctttggaaacctttataaac

SEQ ID NO: 267846 - DNA, 347 bp, Homo sapiens
cgtgttcacaggccacaatcaattcctcactaacagcaaactttgcgcacatttccgcgggctagtcctcagctcccaaactgtggagtctcccttccacgtccaccaatgaggagcctggaaacctctgtcgagagccaactccccactagtgccaaagccggagttcgaacaaatgccccccggtaactgcgcgcacgcactccccatccttcggtcccactctcactagaagcctctggctcccacttccagagaacctgtcccacacaagtggaaagaagagacgtgcaaaagaaggaaaaagcataaaagaaggcgaactgcatgggctgcatctactcact

SEQ ID NO: 267847 - DNA, 803 bp, Homo sapiens
tgccaggtttatacttttccacaggacagagattgtcttacccatctacctccaaaggctgtaaaacttggtggaatcctgcattctctaaatcaacttccatacttaattcttacagatactaaaataataggaattggaactgaatattttctcatggctttttcttttcagtcacaagtgaaaggacttttttaaaattaaatttttttttcttcaaatactgcaaaagggatgttattgaaaatattttaggtgtttggaaacacttattttgtagtttacaaactggcaccagtgctagatttggccctgagatgtgttttgtttggcccctatgcttttattgttaattaaattaattcctaacttttagaaccaagttatttctgttattgggaggatggaaggatcagactattcctttcagcattattggatttgaattcctgcttgtccagagaagataccctcttggggctcatgtctccagttcactgcattcaccccattccctattgctcctttgtgccgtgaccaagggtttgttgccattcagcaatgggcttaccctgttccatcctgacaactttcttcctgtattttagctgcataacccctataatcatttgatttttgacctgatttttacatgaataaaccaatcctagataaatcattggaaaacttttacaccactggcaaaatgaagtgcatagtaagatttcatcatctctactatttaaaaataaaaccattatgtacttttccttttttggaaataacatttttaaaaatcccat

SEQ ID NO: 267848 - DNA, 486 bp, Homo sapiens
gaattgttccagaattggagacaccaaatactgaaaacaggaagattacttggaagtctgtatgaaaggcaattagatgcctgcaccccctcccccactctctcaggagataggaagtttagtcttagatactgaaccagaggctccgaatcaggcacaccaagcataggagaaagggtgcaatatggaacaaaactgaaaagaagggctttaagataagagttatcagtagtgcatggtagaaccatccacctcttagacccagtttccagaatatctgtaggccgacagatatttccctgcaagagactggaagatcgtgctctgataaaattaactccagagaaaaagtcctgaagatactgaatacttctaggggtcctcaatcaaatggccgattcttgcctgatcaccctaatgtgaagcccacaaatcaacaagcctaccccctagccaagtgtcaccagacatttaaagaaaacctct

SEQ ID NO: 267849 - DNA, 309 bp, Homo sapiens
tcaccctgtctccctgatgcaatttctagcgctgcaggacgaggaatgaactttggccttcagttctgaaggcctggactgagtccacctcctgctccctgcccctcacaacaagctgaacctactccagtggctgcagaattccccaactagcagggggagatatagagagaccaactcagggccctcctgtatctagaaagagtaactgaaaagccccaagccaaggagttatgcagctgttgacggtttccgttccgggaatcactgtctccaagaaatgacctgggcacaaggaagccttgggag

SEQ ID NO: 267850 - DNA, 474 bp, Homo sapiens
atattaatatcacaaggagttatgatagaaacagtgttggagctaaaatattcaggcaacgaagcacggtattttgggtgggggagaagatggctgcagccaggtaagtggggtcataggtagcgctgtctgcacagggtctctgtgaggatgacatgcattgatgcatgtgatgctcttcactttgagcctgacaaatagcatgtgttagaggttcagtctaacacttgctagaggcaacaagtgttagaggttcaccatctgagtctatgtggctccagtgagtagatcttgctctgttgtccaggctggagtgcagtggtgcaatctcagctcacttcaacctccgcctcccggattcaagcgatcctcctgcctcagcctcccagctacttgggaggctgaagcaggagaatcgcttgaacctgggaggtggaggttgccgtgcgattgtgccactgtgtactccgcctg

SEQ ID NO: 267851 - DNA, 398 bp, Homo sapiens
gatttccagggacacttgtgacttcgcgtattcaccctccattttaaaaagtcacatttcccatgaagtgctgggtacagcattcaaagcgcatctcctggactgctgtgtgctctgggcagctgccagaggagaccgtggcaggatgtatgccactgtcaccagatgaataaccccttcttagcatacgttgcaatataatcaaatcccatcgtgcctgtttggtgatgttaattccagaattttattttatttttattgtggtaagaacacatgagatctgtcctgctaaaatgctaagtgtccaccgcagcatcgcgactatgggtgtgatgtcctgcagcggagctctagagctcattcatttggcttaattaaaacttaatgcctgttgagca

SEQ ID NO: 267852 - DNA, 243 bp, Homo sapiens
atgttcgtcatttgtaaatctgacattctctttagggtgtaaatttttaataatgagcattgcaaatggaattctacacatttgcttagatgtcatggaatagctgaagagagcttgggcttttaataggcagacttgctcccaagagggtgaagagtaagacaaaagatgtttgtgcctagttgtttccctgtgcttacaaatcaaatgaatcattctatttccttaggggcaaattaaatg

SEQ ID NO: 267853 - DNA, 545 bp, Homo sapiens
atgacaggaagtacttcgatggtgctattatacccaaaatagcattttttaccgagcagagtggttaaacatttgtttctacagcatttcctaaccagcaggaaacagtaacagaaaaatttccagtatgtttacacacttttaagttacatgcttatttacacagtggaacatggttgatacttaaccaaacgatactactgggtcctttctaatgctgctgagacacgtatgataagggtttggaaatagtctaaaaagaatttcttcttggtatttgactccattagaaaggcaaaccatattttaaactgatagtgtcctgaaaatttctctccagatgtggtagaattgtattaccatttcttaacaactttgtgttaggcaaatatggtaaaattatactttttatttaaaatattttgaaaagatgccttgtaatttattagaatactgatgttgtttaaatgcttgtgctttttatatttcctgcagagaacaagttgatttgacatgaaaaaatcctaaaaccagaaaaatgaaaa

SEQ ID NO: 267854 - DNA, 397 bp, Homo sapiens
tatgtaaattgtttagtaatatatgctaactttgatttttccagaactcagaaacgagaatgcttgcaaatacttaaggagacatttcagtttagcaagccatcattagcggtgttttataaagttctggaactatttaaattacccatgcattgctctttccatgttttcatgcagtgagcaatgtatttccctttttccactttgtgtgaagattgaggctagaaaacacccataattctatattttgcagaagtatggaacacgttcatcagcttagaacaacctcaaattaaattttttgtcctcattttggtctttgttgtgagcagtttgtaaatgtgtatttaaatataatactttttaaaaaataaaaacatatgaactccagatgaaa

SEQ ID NO: 267855 - DNA, 452 bp, Homo sapiens
agcgtgtaccattcctgtgtccttactatttcagaagtttgaatactgtaaaatagcctagggtggccttttaatttggttataagatgttggaaaaattcctggtagtatctgagatttgttaaagtagacttttgtagactaacttttttcaatttatatctaaggcagcttgagatgaggttgaaaaaattctggcagacattgggcataaataacacattattgaaaatttgttgattctttattaaattaaagaaaaggtatttttaatatttatgatctatcttcatagataatttcagcaattcccagaatattacatgagcctattacaagtagctttctgcctaaaggcatgtggtctttatcaaccctaagaagaaatattaaagggttttaagatgtgtaagagattacctgcaggaaaataacccagggagaatatacag

SEQ ID NO: 267856 - DNA, 356 bp, Homo sapiens
aaataagttacagtaaatttgttgctaacaatctgtgtaaattattgatttctttgtaagtgtatgaacactttcattaggttaaattgttgatattttaaagtttttgacctcagtggcagtttcatatggtttgacctattgcattatgaaactatggctataatcactgccctgtatataaaaatgttatggcacttaaacaaaaatacattataacttatttaaatagcataaatttgtgcgtgctttggcagcacatatactaaaattggaacgatgcagagaagattagcatggcccctgtgcaaggatgacacacaaattcatgaagcgttctgtatttttcagactct

SEQ ID NO: 267857 - DNA, 177 bp, Homo sapiens
caggcctctgccgttcccatgcagggcaggccaaactgttttcacagcatggaaagttatgtgagggaagccacaccggccgcagatacaggcaccagcacatccactcgcatgcacactcacggctgtggcccgcggcagatggaggcccgctctgccttgtctgtccctcagtag

SEQ ID NO: 267858 - DNA, 274 bp, Homo sapiens
tggaggtgaggagtggcctgatagtttcctagttccttgtcctaggtgggttcactggtgaatcctaccaaacatttaagaaaggaataacatccattctctgcagtaccttcatgaaaatagaagcagaggaaacacttcctaacccattctatgagactggcattaccctgataccaaaatgagataaagatactacaagaaaggaaaaccacagaacaataattgccataaacacagatgtaaaatcaataaaatgttagcaaatcaaatc

SEQ ID NO: 267859 - DNA, 441 bp, Homo sapiens
ttgggggcatgccattgattttaaaactggggataaaagccaatggtaacaattcataggtccaaatttttattagaatgaaggaagaggaaaaatccagacattatagtgtgagtgtggttggtaggaatggaatttgcaggccattgaggggccatgatataattaagatttaggacatctggagaagggagctaagagagagaaatagggatacagagataggaaaggggctttggccaaaaactaggcagaaaaaacctaacaccaaacccaactcgaacaaacaaattaacacgacctatataataacaaaactttcccctgacctatgataataatagtagtagtagtagtaataacagcaatgccaagttacacttgcagactgcttcttctttttcttgcttacaaaagactctcctaatccttactttctta

SEQ ID NO: 267860 - DNA, 672 bp, Homo sapiens
tgtcaatgcccctcttaaaataaatgcctggaatggaatattccacatggggtctgagcagtgcaaccaaataccggactggacttccctttgtggtggcgtccttagcagctccatcacctgttgcctcaaagaaaacttaacagtcaactaaaaaaaccccaggcttcctataaaccatgtcaaaatctcgccctgcccaaccttcctttttttttttctttaaaattagacatcgattatagtcatttttttttttttttttttaaagacagattctcgctctgtcacccaggctggagggcagtggcgcatctcagctcactgtaacctccacctccaagtttcaagcgattcttgtgcctcagactcccaagtagctgggattacaggcatgcaccaccgtgccactaatgtttgtatttttagtagagacagggttttaccatattggccagggtggtctcaaacgcctgacctcaggtgatccacctgcctcggcctcccaaagtgctgggattacaagtgtgggccactgcacccagccaacatggattatggtcttctgattataaaagtaacattcattttagagtcttaggaaatacagaaaacatctattcctacaacaaacattcattggataccttctatatgaaagaatctcagctg

SEQ ID NO: 267861 - DNA, 419 bp, Homo sapiens
tattaaaaagtaccgtgaactgagtggcttaaacaccagaaattattctctcacagttctggaggactaaagtccaaaatcaagctgtgggcagggtgggtttccctgagagctgcaagtgaaggatctgttccaggcctctctccttggctgatttcctggcaaacagaaaaagctctcttggtctttaaagttcatgacagattccctaagtgtttgtaaaacatctgccaaccacactgatgggctctcacacaaaggttttggaaatacagactgatttcctttggttactaaaactgatttttttttttttttttggttactacaattgattttatctctataattttcttctctgtcatcttattttaaacaaaaaccgtggcacaaaaataaagtgatggtttttgaggaaa

SEQ ID NO: 267862 - DNA, 507 bp, Homo sapiens
aaattcttatactaaaggtattttactttagcttgtataacttgataccatatatttgtcttttaacaaaaaaattagaaggcacatcaaaaagcaagcaaaagcagtctcaaaggaccaagcaagtatcagaaccaaactcagatatgatacagatattggaatttcagacaggaccttaaaatatttatgattaatatattgagggctataatggaaaaattagaaaacatgaaattaataatataagtagattggtaatataagtagagacatataaattcttcaaagggatgaaaatgaaatactaagaatctaacagaaatagataggctcatcagtaaattcattatggctgggttattgaactcagtgagtttgaagagatgtcaataggtaattctaatataaatcgcaagatataaaaggatttttaaaaactcagaacattgaataactatagactacttcaaaaagatgtagcatgaacataattggaatatgagg

SEQ ID NO: 267863 - DNA, 411 bp, Homo sapiens
tcagtgcttctcctctttgtcccgatttgcattgtcagtctcccagccccatcctttcaaagtgagtatttcttgcagtgggatcagattcagttcccctctcctttgcctggaagaatggatccagtttgcactgaagctttgcagagacatgctttataggcagtcttctccttgctggttaattttagggagacaatacaaaacctgagtgtcattgtgtgctcccttttgctgtgtccttgagccggattaatgttagtttctcacaatacgtactacactgcttatgtgcacacttccccactaccttctacgaggccttttagtagtgatgtccttatcgaagggaattgaggacatgtttctgtgagatgtatcattttcacaattcctttgtgcagaaaaaca

SEQ ID NO: 267864 - DNA, 303 bp, Homo sapiens
gaccccaaatccctctccaactaatttatggtaaaattccttgaaaaagctgtctattattactgatcccagctttggagcggtggtggcttcctgctgctgctaatctcttggctcaacaaaacccatctgtcattgcaactcttctctcacacgtggaaccaatttcttgcgctctatccccccaaccctgtgttaaataattaaagtggttttcctttctttgggtgactcctgactgatggacatgtaggagactattttagtaacagccattagattgtgtttattattcttattgtt

SEQ ID NO: 267865 - DNA, 326 bp, Homo sapiens
agagacttgatgtgcacaacttggaaaacatctgaatttctgcatgaaattaaatctgccccagacgtcaggattgtcaccacatcacctgcgggctaggagaagcggcaaggcttagatgcatttattggtttatgttctctcttttcatgggatagtgtcctcttttccccagaggcgggttgcaagagcaaatgatgtaagtaacgtgaaagaacactgtgctcgggcaagtcaggtggtccatggatagaattatgtcgtcatgttacattaatgccctgagaggaagggatagcactttggaatgaagatggaattcggct

SEQ ID NO: 267866 - DNA, 404 bp, Homo sapiens
gaccagtctgtctttgtcagactaacaaatcagccacaaaattagagattgtggttcaggggccatgcagcctctggctgtaggagtctgaatctccccaaattgctcctgggaataacatcactgttgcaaaacttaagataggtgcttgagatattttgcaatcccgcagcagataacaccactcaggccaataatctggctcaaccaatttggcgatcccacccaggaacagaagtcatcaagaataactcacttcgacccccctatgatttcatctttaaaccgaccaatcagcactcccacttttctaggccttacctgccaacttatccttaaaaactgatccctgaatgctctgggaggctgatttgagtaataataaaactggtttcccacacaga

SEQ ID NO: 267867 - DNA, 451 bp, Homo sapiens
ctgatttggagtttggaaatcctgatttttaaaaagttccttggttctcatcctctacgaggtatgggagccattgctttatgaaacatattctttaataggcttgatagattttcctctttggaatattggatagacccagctttgagaagtcatccatggaatctgagggttagttagtattaatatagcatcatagaaatggaaagggtctcaaaaagtcctctaaataatccccgtaataataaaaggtcctgtaggagatcccagaatatagtgaaatagtcagaaattgctctgagaagttcacacacggcccagtatcagtgtatttgagtattctaccaatttattgagaaaagtcaatgaacttctcacagaaaagaattgtatgttttttgtttgtatccatgattatttaccatgctaatacagagtaaataataaaaaa

SEQ ID NO: 267868 - DNA, 429 bp, Homo sapiens
gatcgcaccactgcactccagcctgggtgacagagcaagatcctgtctctggaaaaaaaagaaaaaagacatattttgtatgttatatatattatgtgctgtattcttacaataaagtaagctagagaaaagtacatgttactgaaaacattattagaaagagaaaataccttcacagcactgtgctgtatttatcaatactgtaagttttgttgtctgtttataagagaagttgtctgtctcaagcggcagtaaccgcggctgcagatctcaatctgtggtagatatcaagcagttcaacccttttttataatgtcatgacttttctttgcttcttggaagcagctctggcatcactagtggccccgcatttggggccaagggggttattcaaagtttacggtattgcattaaacatggtgaaacata

SEQ ID NO: 267869 - DNA, 414 bp, Homo sapiens
ctaagactccgattaaaagaccgagatagtgatgttgaatttaaaaagcaagacccaaccatatgctgtctacaagaaacccgttttgaatccaaaggcacaagttacaaggatgatatggcatggtaatactaatgaaaagaaacctgaagtagctatgttaatataaaatcaagtatatttcagaacaaagactatgtcatcaagaggatatagcaattctaaatgtgtacacttctaaaactagagcttcaaggtacataaaacaaaaattaaaagaacagacaaaacagacaaactcacaatcatagctgaagattttaacatctctctatcaacagttcaaagaacaaccaggaaaaaagtctgtaaggacccagtaggcttgaacaacgctattaaccaactggatcc

SEQ ID NO: 267870 - DNA, 366 bp, Homo sapiens
cgcctgctccgaggtgatctgggttgctttgacagctgcatgtgtggcaggagcttataagcatggtcttacctcccccaggggatcttccctgagagccagccccgtcacagagctagaagagaagcctggcctaatgcagacagactaaattgccacctgaagtgtccaccaggcccataattgtggccttgccgtggcgagtatatctagtctcccgaaatcattacgtggtgtttctcatctgcagcaacagatacagagatggtcagaaagtgagattaattctacttttagccccacggagggctccccatctaaagggagtttaataaacaaaggaatggccaatgtgatgaagcctcc

SEQ ID NO: 267871 - DNA, 761 bp, Homo sapiens
tttaataatcagataaatccaagtgacgtacaaaatcctgtttagccaggtaataaggtcttttctccaaccccctaagaaatggccacgggttaaggacttatgactctgctctcacccccatgcccgaacacccacacatacattttccactgtcatctctatgcgaaacctgatgtacgacctccagaagccactgtcactgtcttcgcctgagcagtcacttttaattcttataccaggaataagtaaagtagggtgtgggggcagggtggaatgccaaagagatgaaccaattatcctaaaagatccaatgccattttacattagcctactctgaaatcaaggaatgtacgagacatgccagctagaaatgccaaagagagctccaaagtgttttgcactgatttaccaagttagtagaaatgcaattatttgtaattacggtatcaatgttatctgaaacccattaacacctttctctgtgaactgcacatattaatctgtgactatatacagcagaatagaaccatcttactggtgtgaggataaattcaacttgctgaaaattcagtacttatttatttcaaaagaatcaatttcaattctagatttccttaagcttcctgattacaaagtaattttaaaagctgaactcatagtttacttttagccttctgtttgtgctatgaaacaaaaatagattttactaaaggagatggccaaaatcattctaaaaaatgttttggggtacttcatta

SEQ ID NO: 267872 - DNA, 602 bp, Homo sapiens
acctggtacatataagaggacatgccagaaatgaggacgagatcaatgggcagatagatgaaatgtttagcttccttatttacctgaaacctcatttttggaagtcctaaaacccataaagaatatttggtgctttcaaaaatatcttttacttggccaggtgcagtggcttacacctgtaatcccagcattttgggatactaaggccgctggatcacttgaggtcaggagttcgagcccagcctggccaacatagcaaaaccccatctctactaaaaatacaaaaattagccgggcatggtggtcccgcctataatcccagctactcaggaggctgaggcatgacgagaatcgcttagacctgggaggcagagagggtgcactgggccaagatcacaccactgcactccaacctgagtgatggagtgagaatctgcctttaaaaaaaaaaaaattagctgggtgtagtagtggatgcctgtaatcccagctactcgggggctgaggcaggagaatcgcttgaacctgggaggcggaggttgcagtaagccaagatctcagcaccgcactccagcctgggcgacagaacgagactccacctc

SEQ ID NO: 267873 - DNA, 440 bp, Homo sapiens
tattcttatctgttcccattttttttaatggtccattttgtattatctcttgttcctttctttgatgatatttttcccacctttccctttagaattagatttcctattggtaaaacattttggctgttataatccttgttttatgtttatagccttggcttcctgacaagtgcacaatttgggattttctaagaagttgacatttgttgctgaaaacccagtaaggctttccactgcctataggataaagtttaattctttaagtatttaaactctgtcccctctcccccacacaaatcttaaccatttctgaatttatcatattttcagtcaaaacaatttattttctctctcttgaacttgattgatttgtttcggcctttaaatttttgctgttatggccaggcacggtggctcacgcctgaatatgggaggccgag

SEQ ID NO: 267874 - DNA, 706 bp, Homo sapiens
ttctcaagatagagtgcaatggcaggatcttggctccgcaacctccgcctcccgggttcaagcgattctcctgcctcagcctcccaagtagctgggattacaggcacccgccaccatgcccaggatcttacctagccatatggcctgctgcctctgccaacttaaaaacagcattgaggctgtctgcaagacagtcaagctgcattgcaacagtgcatgtctgacaaacaccatacattgtcgtgagtccaaattgcgcggtgataaattgttacattaagtatttgtttttaaactttttatttttaatgatgataaaattttaagctaatgacataattgctttatttttatttactcattcagagttaaactccctcaatttctgaactactcccttgctgagagtcaggttctcagttactattacaaaatttaataatagaactgttccatatgcacaaaggaccaagacaaaggaatgggaaggctagagaataacattaacatccacacactgtgtactgtgctctctgcttgatgctttgcccacagtgataatttcttcatatagtgcaatgtagtttgtaaggtggttttaaattcatgaggtctcaagtactctctgccttataggacagatgtagatacggtttcggtttttctgtttttacagttttatgagagtacaagtgatgctgtttta

SEQ ID NO: 267875 - DNA, 439 bp, Homo sapiens
agaggtaagtagagagataatttggtgccaggtttcttcatggttttgaatatcatgaaaagaaatttaaatttatcccatcggcaaggaaaaacaatagaagattttcaagcaggggagtgacagtaggcctgttttacaaagatataaagatatagtttgtgtcattatagcagatggaattgtgaaagaaatcacatgcaaacaagcagctacttaacatttcagatatgaagagatctacaaagaaggtaaaattagaggcagctttttgtttcccaagttgaaaagttaataaaaatatattattattaccagttcatagtcaagatttaaagacaagaatataaataagcttacttaaaagtcattagagagctgagggatttttgagaagcatttacatagaaaggaatgaaaacctgttctcaaatttaaa

SEQ ID NO: 267876 - DNA, 323 bp, Homo sapiens
aggccaacatccccccatgcttccgcgtctcagccttgactgcctattgcaatcacatggagaactttaaagaaaatgctggggcctggtcttacagccagagtcttgtctagttgttccaaggcatagcctggtcattgagagtcttagaagcaggtaggctgatgccccctcacctcccacggcacagacatcccctcacctcttcgctggctgaaatagaagaaccctagtgtccatcagctgcttatagatgactcatcttcttaatcctttcttgacgaaaacttgcttcagatgttaataaaaagtacaaaatctgc

SEQ ID NO: 267877 - DNA, 265 bp, Homo sapiens
ccgcgcagatgccaggggcggaacctcctctccagcctgggtccctgctgtcctcagcttgagaagagaagggtatggtgccttcaaggaactggaagaaaaccattattgctggtggattgtattgctgcttttaatggagcgaatcccccctccccaccagaaacagcaaagaaacagcaactggaagataacagaatcatgaaagcatgattgaagaacaaaaaaatgggacagctgacacttccacttctgttaagagttc

SEQ ID NO: 267878 - DNA, 666 bp, Homo sapiens
aggcctgaaaggatccatacactgtccaactctttttcatgccaaaattaatatagtaaacatatctttgtttcagcaatcaaaacctggcaatttgccatgtcacccccattccacagccacgtgtctgaagaacatatgctttcagaatggcgtttatgatctcaatgccatcttgctgcaagccttccagctaggatgttccctgtagttgaaataaacggaaaggaagtttctgagttgaagtaaaccgaaaggaaggagggtcacagccccgcggcacagttcccaggatgactgctgtgccactcacaaaatgagccttttgactgactccagcagcaggacgggactgtcgtttcacgaggtgagctacgggcagacagatgtatccgaatcgcattaattggaacgtcttgtcacaggataagagaatttccatttctctgcggatgcctgtatgctacacatggtatctggcaggtgtgagaacctcgtctttgattgcctatattcccaatctcctttctttgcctattttcctgctgcaaagcaattacggctgaaaatcagtctgcaacatgcgctcatccatattcaactctttccacttcaggcaaatcttgcccagaaaaaaaataataaaagagagagacttataaatcc

SEQ ID NO: 267879 - DNA, 565 bp, Homo sapiens
caatatcctggcttatacagttgatgttagggtgatttctaccagtcagcagttaaacgttaaacactcatctaacctgagctaagagggtgtacatgatcttatgctaacagaattaaaagcctgttgattaaaaaacaaaataagataacacaattagaaatgcttcttaacctgataaccatttacctccagatctaagggttgtcttctgggactctactaaccttctaacacttgatgcaaattgttatttgggcaagggagttattggttttcatcacattttcaaaggggttctgaggcccagaagaggttaaagagcagggtacccgaaggcagtaagtacgagttatgtactagcgggtgaatgagtgaatcaaatgcaggaaactgtttcccatgtgtaagtgattaaatattaatcaagtctactcatatataaatctatttaaagctgccagttaatgagagtttacagcaaggagtaacgcgtccacttaggaatcaggactgtaccctctcttctgtatccctcatcaaaaaatatgtttaaacttttcca

SEQ ID NO: 267880 - DNA, 137 bp, Homo sapiens
tattttcacctcttacagtccatcttaaattggtctgctctttcttctctgtcccatctggcttgactttatttcaggccccatcgtctctcttctggtcaactgtaacggcctcctggttcctgcttctttctggg

SEQ ID NO: 267881 - DNA, 634 bp, Homo sapiens
ttttttttttcagtagagatgtggtttcatcatgttgcccaggctggtctcgaatgcctgagctcaggcaattcgcctgccttggcctcccaaagtgttaggattacaggcgtgagccactgcgcctggtcaatgatatctttttctaattagtttcaaacccaaatgtgttgccaatttaagaaaatgcagtaccccttctaatggttaaaaatgcaagctttgaagtcagactggtgagatgtctatctgtgttacatcatttaccagctgttaaactttgggcaaggttactccatgcctcagtttcctctactataatgtgggactaataataacaccgactttataggtgttacgggctaaatcgtgcaccctcaaaattcatatgttgacgcctggcttggtccattcaggctgttacaacaaacaccataaactgcgtaactgataaataagagaaatgaatttctcacagttcagaatgctaggatggccaaggtcaaggcactggcagagccggcgtttgctaaaggccccctttatggttcgtagatggtaccttctggctgtgtcctcatgtgatggaaaaggcaactctctggggtctcattgtaagggcactaatcccatt

SEQ ID NO: 267882 - DNA, 510 bp, Homo sapiens
cagggtgttctgctccagagcaggagcttgcaggcttgttggggccggtggggaggaatgtggtttcagaagcccacaccgccaggtggagggctcagtgcagacagccttggggccagtgtgtgtctgaatcgcacagggcagtgtttgaccagcctcacggtgatggtgcccgctttaatcgtgtcccaaaaaaattattgccatcatccagcgaggccaagagacatttctttccagttggaatatggccaaccctcctttgaaaatcctcaaagtgcaaactgtggaatcagaaaaagaaaactacccttctccaagaaacagggaggccctacgcacttggcacgtccccttctgtgagaaagactcagcgttctggagttggattcccagctgttgcttcatctgaagatgttcagaccactacggaggccagatggctgggacattagagggtgcacatgttcatcattgttttgtacttgagaaataaatatttaaacctga

SEQ ID NO: 267883 - DNA, 430 bp, Homo sapiens
aatatttatttagtcccacagtaaccagtttccaggcaccagggatacagcaatcaacaagacagatgcaacccatggattttttttccatgataatgagactaatttatttccaccgatgtcttcacgctgcccttgtaattcccgagggcttcctctccactgacttcagcaggtgtgaaaacactagcagactgcgctgagccaaactggtttcagaagcaaacagagaaagtggttccttgttcatattatgttgatctaccagttttaaggaacatttgttgaatttttctcattatgaaaatagcacataattgttattaaaaaaggaaaatatttttaaagtgtaattattcataatcttgtaaatccaaagataatgagcaccatcatctttaatgataaagtctgttcttcccctaaatca

SEQ ID NO: 267884 - DNA, 366 bp, Homo sapiens
agccaaacaggcaagccacacccctgtcacacttcctgtgaggaggatcagggaagtctctcattttaatatgatatggtttggttgtgtccccacccaaatctcatcttgaattgtaactcccactattcccacttgtcatgagaggaacccggtgggaggtgactgaattataggggtgagcttttcctgtgctgttctcatgacagcaaatgagtcttatgagatctgatggttttaaaaatgggagctctcttctcttttctgtcaccatctgagatgtgcctttcacctcccaccatgattgtggggcctccccatgccatgtggaactgtaagttcaataaaattctttcttttgtaaat

SEQ ID NO: 267885 - DNA, 381 bp, Homo sapiens
tgagaacggagtcttgctctgtgtcccaggctatagtgcagtggcacaatcttggctcactgcaacctctgcctcccgtgttcaagcgattctcctgcctcagcctcccaagtagctgggattacaggtgcccgccaccaggcccaggtaatttttgtatttttagtagagacggggtttcaccatgttggccaggctggtctccaactcctgacctcaggcgatctgcccgccttggcctcccaaaatgctggcgattaccgacgtgagccaccacgcccagcccgagcctgtactcttaatgtgcttcccccatgtgaaaagttccccaacaaatcaagggcaaatcaagccagtacattctggtgaattctcaggagg

SEQ ID NO: 267886 - DNA, 421 bp, Homo sapiens
atatatatatatatatgcaaaagaattgaaagcagggtctcaaaggtatatttgtacaaccatatacatagtagcattactcacaataggcaataagataaagcagcccaagtgtccatccacaacaaataggtaaacaacctgttgcatgtacgtacagtttaatatttcagtttttaaaaggaaggaaggccaggagcagtggctcacacctgtaatcccagcactttaggaggctgaggcggatggatcacaaggtcaggagatcaagaccatcctggataacacggtgaaaccccgactctactaaaaatacaaaaaaattagccaggcgtggtgacaggcgcctgtagtcccagctactcagtaggctgaggcaggagaatggcaggaacctgggaggcagagcttgcagtgagcc

SEQ ID NO: 267887 - DNA, 161 bp, Homo sapiens
ttttttcaatctttatattttgtgtctgttttttaccaactagcacaggaatctctagagaaaaaaattgccctttgaattttatttgtttgtttgtttgtttgttttggaggaaagaaggtaaaagtattccataagtatactttgagaaaagctaactg

SEQ ID NO: 267888 - DNA, 380 bp, Homo sapiens
tcttttttttgtttgagacagggtctcactctgtcgtccaggctggagtgcagtggtgcaatctcggctgactgcacccttgaccccctgggctcaagtgatcctcccacctcagcctctaagaaatagctgggactataggcacgccacactatgcccatctaatttttttatttttttgtagagatggggtttcaccatgttgcccagattggtatcaaactcctgagctcaagccatcctctcgtcttggcctcccaaggtcctgggattgcaggcatgcaccaccatgcccagcctatagtaacctcttcatggcttttttccactaggtcaaaaacattttgaggactgttttattcagcccaaagttcaaggtg

SEQ ID NO: 267889 - DNA, 729 bp, Homo sapiens
  misc_feature (656)..(656): n is a, c, g, or t
  misc_feature (726)..(726): n is a, c, g, or t
gaatgtgccactgcactccagccggggcaacagagtgagactctgtctaaaaaacaacaacaaaaaaaaaaacccataaaacaaaaatggaatcagactgtcatacttttggttggctgaaaaataggaaaaaaaacaaacccagccttatttatagatggattatcttgatgtttggagtaagctaaaaatagattgatacatcacatcctgccttgagtggctgtgatgtggccagggatgtagagaaatcctctccatggcctgaagctggaccagtacaagtgggcgttacctttgtgctgggagaagtgccctgaggtaaagatacatgtgtgcttttgtgggaaatggtttgtctcgttgttcagaagtgctgcagatcagtgacaagtatatatagaacaagggcatgaaattactggagtgggcaaagtgagtggatatttatgtcccacgtcagtgcctataaaaagaaacccactgcagaagaggggaggggaacctagtagttaaggttaaccaggctcagtcctcagccatcccagtccttgcactctagggatataaaatatagtcaccaaggtgttaggggacggagggttttttttgtttgttattgttttttgtttgtttgtttgttttgagactctgtntaaaaaacaacaacaaaaaaaaaaacccataaaacaaaaatggaatcagactgtcatacttttggttggntga

SEQ ID NO: 267890 - DNA, 803 bp, Homo sapiens
ggtggagatctaaatccaaactttatttcagagcttaacttttgattctgtgttttatgttttaaagtacattataatttagtaaagctgttttctgagggtatttagtgagaaaggtgatcattatgtaagtgaaagattttttatatcatcttcctcttctccctggaagagatgataaaatcagtcctcggccttgatgtgaacatcgcataccttgagttggtgttaacaaattttcttcaaccttttttcaagcagtgtcagctaaatggtgccatttgcttatcactcttctttttggttatttatcctaaagataagaacattagtaagccgtaaatgcccattttgtaaaaactgcatagctagacagatttgcaatccctattagggtaataatccatctgttatggaactggatcaattttgtaaattaaatagattaaaaagggggaaaaagggccatgacttttcccacagtaagccttttctcaaatgctaaaaagatttgggaagactcaaactatttgccattcttcctctctttgcttaactcagagagaaggccaaatatctattaaaaagaggggtgggtgcagttgtttttttttttaattcttcagggtctgattgctcctggaagtttcatatttttgacagagtttattgttaaaaccttttgatgactaccagaacatttctgctgttctcactgatcagtttagtaaatgtgtgactatgtttgaattttcttctgcacttagctcactttactgttactttcatcctgtctgttcaaa

SEQ ID NO: 267891 - DNA, 543 bp, Homo sapiens
ggcttggtgggaagggtggcttactatacagttttaatctctctttccaaccccatatctggttctgtctttctggggttcggcccggtcacttgtctccttctggattctgtgtcaaaaccttaaacacacttcctctaatcttccatttccccactctgttccctttggcaacacatttccatcagtttccactttctagaagtgcatttaagtcacttgaatgctctgggctgctcttccattcttttaactgttattggttcatttcctttggcatttcattttagtgaggttttggaaggggaaaaagacaaattcatgtgctccatccaccatcttgaacgaatgtctccaatattattttaagaaaatacagaaattttcaaatcacactggtttatttttaagtgtaaaacttaaaatattaagtgatggaatttatttgtaaaaagtagccagtgtacctggtaataggtactgttgattccacaaaatgtttatcaataattttaaagcgctcattaaataaagcaagcattc

SEQ ID NO: 267892 - DNA, 248 bp, Homo sapiens
gagaaggatgcccgaaacctttcatcataaaagaaagaataaaagtcaacatttccatgagtttctggattgtgttaatgttaaagaatcctatgtcagtcattcttatgcagatcaggaaacccatctaaatcccctgtgtttgtggctcttggatttaagttattttatttgaagatcctaactcacttctaagaggcttgtgtacccacaacatcctgaatgttaaatatatagtagtgtgtatg

SEQ ID NO: 267893 - DNA, 427 bp, Homo sapiens
tgtgcacatgtaccctagaacttaaagtataataaaaaaaaagtaaacaaagaagaagtaaaaaatagcaaccataaaaaggaatgaaagcatgtcctttgcagcaacatggatgcagctggaagccattatcctaagtgaattaacacagcaacaaaaaactgaataccacatgttctcatttataagtgggagctaaacatcagggacttgtggacataaagatggcaaaaatagacaatggggactattagacaggggcatgatagagggtggcaagagttggaaaactgactgttgggtactatgcttagtacctgggtgatgggattactcatacccaaacttgagcatcatgcaatataaccaggaaataaacctgcacatgcaaccctgaatctaaaataaaagttgaaaaaattagtca

SEQ ID NO: 267894 - DNA, 378 bp, Homo sapiens
gagggaaaaccagcacaggggcaggaggaatgttccagaaggcttgcagagtagaagacagagagagaagacagagtagcatcggcaggctgtggagtcagcaggggcctgggttgtatcccagttccagtgcattttgcaacctcccacaactcccttggtctctctgagcctcagtttcctcatcagtaaagtgggagtgataaaagctcctatttctcagagctgttgtgaggactctgtcaagaactgagcacagggcttggcccagaggaggctcccaggaaatggtgggtctgcagagctggggctgcctggctggagaagggacttgtaggggcctgagagttgcctgtgctgtgggagaagctgccagtc

SEQ ID NO: 267895 - DNA, 512 bp, Homo sapiens
gtgctgcactcgccgctcacctcgggcatgcgcgtcgccttccccgacaccaagacctactgcttcgacgccttccctaacatcgagaaggtgtccaagatcacgtcgcccgtgctcatcatccacggcatagaggacgaggtgatcgacttctcacacgggctggcgctctacgagcgctgccccaaggcggtggagccgctgtgggtggagggcgccgggcacaacgacatcgagctctacagccagtacctggagcgcctgcgtcgcttcatctcccaggagctgcccagccagcgcgcctagcggcggccccaaccggccggacctcaccccgcgccggccccccaggggctgcatgtggacccccgggcggcctaggggaccctgccccgagccaggggctgtggacgatgtacaggcaacagagctacgcactcctttccttttggaagcaagaagaaaataagtgaaaacggaaattaaagatttaaaatttttaaaaaaagaaa

SEQ ID NO: 267896 - DNA, 267 bp, Homo sapiens
tccagactacatccaatgacaaaacaaaacccaagtagtgtccacagagctctggggttcacaatggctctatccactgaacacaccccagatatcactgcgttatagagctgatgtggctcagttggagggaccccctttgtaacagccactagaaaagccataacctacaacgcaagagcattttctctttaagtcacagcgatggctgtagggagtcaggtgcattagctcacttcccgcattaaaaatagcttatgcaagttt

SEQ ID NO: 267897 - DNA, 660 bp, Homo sapiens
aatgcaggaggcggaggttgcagtgagccaagatagcgccgttgcattccagcctgggcaataagagtgaaactctgtctcaaaaaaaaaaaaaaagtggatttttttctctctggctctttgggttaacctaatgttttgtattttaaattgtgttactgtgaactccagttttaccatgggattaaaagctaatgtaaatactttttagtcttcactattttatttaacaaacatttattgaacatcttaagtgtgtcttaaaattgtattaggcactagggaaactagggaacacatatgtggttcctaccttcaacagcttgtaatctcttgggggaaggcagatttgcagtaaatagatgttagaattgataaataggcgctatggtagacatatatgaaattgatggaaacccaaaggaagaataattgataagttcttttcaggagtactagggtagggtcatgggtcaggaacagctttatagaggaatcactctggacttcaggcttggaagatcactagatgagtttgccatagaattataggaacatgctgtggcagaactaattgtatgagcatagagaggtataaggaagcatgtctgcacttagggaactgcagggagttcagtatgactgtgggaatacagtttg

SEQ ID NO: 267898 - DNA, 315 bp, Homo sapiens
agtgtccgatctcccctacccgctgggtatccagccttagcgcgcaccgactacaacttcaactttccacccatctccaggggaaattgattttgaaaaagcaggctgctgccaccacagcattatgatcctttccggctgctgaccaatctgtattttgtgaacttcacaagaggaatgagaacactggctgctgtgttacaactgggtggggggttgcacggagaagagagaaaaggatcagggagaccatttaagatgctctggtgatattacagctgaaagagacgtctaatcaataaatatcgaatgaga

SEQ ID NO: 267899 - DNA, 554 bp, Homo sapiens
tggcggtcttactagtacccaagctggtctcaaactcctgggctcaagcagtcttctcatccccgcctcccaaagggccgatattacaggcatgagtcaccatgcccagcctatgtgattctcttgactgtactataaattccttgactataagatcagggactataatagtttgttcaccattccattcacagagcctgacacacagtaggtgctcagtaactgttgggttaattggttgcaactctatggttgttattattgttgctttaaagatttgggttgtgaaaggtgtgtctgggtgcggtggctcacgcctgtaatccctttgggaggctgaggtgggaggatcacctgaggtcaggagttcaagaccagcctggccaacatggtgaaaccccgtttctactacaagtacaaaaattagctggacatggtggtgtatgcctgtagtcccagctatttaggcagctgaggcaggagaatcgcttgagcccggggaggcaaggttccagtgaactccagcttgggtgacagagcaagacttcatcgca

SEQ ID NO: 267900 - DNA, 507 bp, Homo sapiens
tcggtattgccctgaccacatggctgcatgtgagcatgccaggtgaggtgagcaggagagatgttctaggcagcgttggatgattctctgtcacattcctttgtggtcaactgaattgctctcttcaactgcagctttcactgaggccacttgaggttgcacaactccttccagacacagccatctctgaaactgggagcccagtcagcccccaagcaagtacaacctgcaagtatggagaggtaacgccctaggagccatctctaaccagtgaagaatgagagccagtaagcaagtctagccactcctcttttggagggaacattctagaaggcattctgcacacttgccaaaggtcacagaagaattgagcccctgttgcccaaagcagcaaccttaatgatgcacactcagtggcttttcattcttccctgtctcactctctcccttttctttcacctctgctttttgggatctcctcccaaataaaccacctgcaccaagaac

SEQ ID NO: 267901 - DNA, 426 bp, Homo sapiens
aatgacaaggtttcattctttatgtgaatttaagggttattttccttaagctagaataaagtattgccttatatacacaatggagaagggatttatttgtacagattatttattgattatttctttaagggatttatttgtaaagaccaaatatgtttggattttcagattgtctagcaatattatcctcctggataaccctgataccaatcaattaaccgtcttctaactctcctccttccctcccttaccttttctacacctattacctaagcatttgaggtacgccaaaggaagcagagtacagacaaaagaggtaatgaatactgtaatgatctaagtgctatatattcctatgtgcaaactgctatggaactgtcacgtactagatgctatgaagttaataaaagaattgagtaaaggtcc

SEQ ID NO: 267902 - DNA, 654 bp, Homo sapiens
gcgtcgacataaaataaagacactgcccagtccctccctcaacgtcccgagccagggctcaaggcaattccaataacagtagaatgaacactaaatattgatttcaaaatctcagcaactagaagaatgaccaaccatcctggttggcctgggactgtcctagttttagcattgaaagtttcaggttccaggaaagccctcaggcctgggctgctggtcaccctagcagctgagggactcttcaatacagaattagtctttgtgcactggagatgaatatactttaatttgtaacatgtgaaaacatctataaacatctactgaagcctgttctgtctgcaccgacattttcattgagtacggattcttcctaccagatacagctgctctacaactttcgagggctggtataaaactagcttttacctatttttaaaaattacatgaatagtaaaaacttggattaacccagtattcgggtattttcaatttccttgggagcttagaggacggacaaataaaaagattatttcaacatcaaatatacgctattgtttacatattaatataaccacatatatgtataaattcagttactttttagcaatactataaaatccaacagaaaaaaatagcatttactatttctaaaaa

SEQ ID NO: 267903 - DNA, 1071 bp, Homo sapiens
agttctattttaaagtcacagtgggaattccttagtgaggagggataaaaagttcctgaataagacactgagaacatctagatttattattttctctattttacttcccaacttacagaataaactgtaaattaaagaataactccataggaaataaaagaggtcttacaaacttagtttacaaattccagctacagtagttggagttttacttgatctatgtatttctatgtaccctgtaactaagcttctagccatcttaagtgtaaaccacagatcatttactaaagaacatgattctcaacagttctaggaacagttataaatggtctaaaggtgttctacattttgaggccccaggatatccttttattttatatatctgcaaggtagcaaaggatagctatacaccttgacacggcagagatccagtgtaaaaaggtgcttcactagtttgttttgtcaaaaaaaaaaaaaaaaaaaaaagctcatatatatttagctattaaacacataggcaacataattcattacactcgatacagctttggtataaaacttataatttatgaggtgatgttaatagcataaattaatataccttttctcttaaaatctacaataagtattctgaaagctcattggggaaggaaatttttaaataaaagttttaaagctgtgcgtgatgggaaaggattctgtattctgaagctgagatgagagcctggaggagaaaggaaaaagtcctatgcaagacactgtgggctacaaaaccaaatgtttcctctttcttccgctctcttcaatgatgagtcacctttagtttcttttaaaactattttcttattttaaaaactgccctaatttccacaaggaatccctgagacatactcaatactatacagtgaaaagaactatcactgttgagaggaacagattcaacccttccaaacagatgaagacaatgtcaacaagtgtcagacttcccatcatttcagcactaatccactggagccaactgtaccttaatgatgcaggttggagtcattttagggcaaatcagtctattcc

SEQ ID NO: 267904 - DNA, 240 bp, Homo sapiens
agcaattaaacaatagcttcatttccagcaaattaacaaccctaataggtaattgcgacataaatgaagataaatttgttttaatacaacgagataaaaagaatacagacaagaactgaatttcagattaagaattcagacttcagtacttcaggaaaaacttaaaagcttcactagaagaaatttaagcaagcttggctttttaaccacagcctattttagattagagggttgtttgct

SEQ ID NO: 267905 - DNA, 456 bp, Homo sapiens
acttcccatagcctcatcacatcctgcagtctctgaagacatgatactgattggcagaaaacagagtcatgctaaatggatgcaacattccctaaagttgatagaatgttctgcctacaactgttcctgataaaagtattgagaaaccatgacatgcctttgcatggacatggatggagctggaactaacacaggaacagaaaaccaaataccacatgctttcacttataagtgggaactaaatgatgagaacacatggacacatagaggggaacaacacacactgaggcctttcagaaagtggagggtaggaggaggaagaggatcaggaaaaataactaatggatgctaggcttaatacctgggtgatgaaataatctgtacaataaatccccatgacacaaatgtatctatgtaacaaacctgcacatgtacctctgaacttaaaagttaaaa

SEQ ID NO: 267906 - DNA, 281 bp, Homo sapiens
gactttttcaacaactttggtttggtttcagaccacaccgattcagattgcagcagggggaataggaaatggggcttgggaggagtagaattgataactggcatttccgcctctaatggagattcggttattggagaactcaaatagaaatgacagctctgcccaggtgcagtggctcatgcttataatcccagcacttcgagaggccgaggttggggaggatcgcccaaggccaggagtttgagaccagcctggacagtatagtgaggccctgtctatac

SEQ ID NO: 267907 - DNA, 696 bp, Homo sapiens
tatatatatatatatatatcgagctcaaaacaagctggaaaaaatgtgaatatcaatttcccctctcacaaagcttcagtgtgcctagtccactggctaaatccctgtttagagataattagttcagttggctactgcaggtttgtaataaacctgaaaaactactgaagcagagttaaaacatgaataatactggcaagatgctccagttaaagtttcttcccacagctcatttcattccttcagaaaactaaaggagcaaaaataattttctattctgcatgggttataagttatatttccttgtgaaagtatagttatcacttcagttctaaccatgagatttatttatttaattccttctctctttcccaaaatatctggttaaactcttgggccaaatgtaagaagtaaataataatttagaatatctgacttaatactaaaagatgatgaccacattgaccttataattctctcagagcccagactgtgaacctgcactccctggaggaatggctgattccaagtgtggggaaaatgtacaagataagcatagaacaccagtttccttattttgctctttcgtacaacaccagacaatgtgctcatgtcaaaaggactcagaacccaacatgaagatgcacccagcattcactgcacccagcattcaacgaagggaaaaaataagcacca

SEQ ID NO: 267908 - DNA, 435 bp, Homo sapiens
aaatctgacttcaaagttactcttttcaaactgaagctcgtttttagaactattcatgatataggaaaatacattcataactgaaagctttttttgggttattctttgtaacattacatgccgcttttcaccaatgaaaagaatcctcaagaacctggaaaaagcaattcctttttgcagttaaaatgaagataaagagccttgaaaaatggctgatgctaatagttcatggagattaataagtgatatgtgaaaggcagactgtcctgtagttgcaaaatgttacatagtttgtacaccttgtcagcgttgtgataacatgaagtcatagtttaattggtaaacaagaaaagcttccaataaagtgtcccatggatgatcttttcctttgagactccagcctgggtgacagaacaagatccgtctcaaaaaaaa

SEQ ID NO: 267909 - DNA, 225 bp, Homo sapiens
cctctcccgttgcctaggctggccgtctgcccaaagtcactgccctcgatcagctccctgcgttcccgcccatcaagtgacatcactgtcaccctattcagcccaagtgagaccaccacgagatcctccatattccgagacagacccaactctgttctgctctggggtctccatcaacttcactgcagaccttgggctgctaggccaggtttctttaaacaggga

SEQ ID NO: 267910 - DNA, 619 bp, Homo sapiens
acagtttgctggacctcacagaggtgattgatgcagcatccccccgggagccgggtgaaatcacagactccagcagcagcttctgagatgactgtggctaacaaatttttccagcaacacagagctgagaggattgggatctcagagaagaaggagccctgcattcttggcttcatctgcctggagtggagtttccatcatgctgagctggaggtgcacggggccagggaaggagcaagtcgtagctcaaatgtcccagactcttactattcttattgaaatttagtaggttttcttgaataaatgtttcttcatctgctgtatgcccttaggacaattcccaggaacatacatctatattgatatcaatataaatataaatagataattatgtatgtataactttagcagttttacttgttctgctggaaagaaggtctggaaggtttgcagagctgctcatgccaccattccagaagttatccaccagttcattgctttttgctcagtagtattccattgcatgtctatgccacaatttgtttatccattcacctgttgatggacatttgagctgtttcctgtttgaggctattacaaataaagctgctttacaaat

SEQ ID NO: 267911 - DNA, 330 bp, Homo sapiens
agtttattagcacttgctgtacccatcgtgtgagaggcctcaattcagaagtatttctctctcaaggcatgttgtgaacagcacaaggtcagacataaccaggtccacacacgtttatgtctttccacagggtgggaatatattgatgctatttcaattataaaagccacgagctacgaggagttgcctcgagacaattcccttcagtactacttgttaacttggtagagccatgggcaaaggctcaagccagtccacgtgtcagtcaatactgcaaactatacatcatagtgtacttaaaatacaaacgctatggtttaaacattctcc

SEQ ID NO: 267912 - DNA, 353 bp, Homo sapiens
gtttagattttaattagagatgtgctggaccttaatgtaaatgtatttagatagggaagccaaagacactaaactgaaaaccttgcatttcctacagatggtttattaaattgaaatatgtctcttaacctctggtcttgaccctgctgttgcaaagatgagtcattgaaacatcagcctgtctgttatcctgaatgactggctggagtggcccggctggaggcaccacttggtaacacatgaaactggttagttcatgaggatttttacttttattttcgcctacagtcaaactacctttatccaattagaattttcaccctcatctatttattatctcctgctctgggtaa

SEQ ID NO: 267913 - DNA, 171 bp, Homo sapiens
cccttcctcccgctacacccttcctcccgctatgcccttcctcccgctataccctcttcctcccgctacgccctcttcctcccgctacaccctcttcctcccgctacaccctcttcctcccgctatgcccttcctcccactacaccctcttcctcccgctatgctcttcct

SEQ ID NO: 267914 - DNA, 305 bp, Homo sapiens
aagcagttaatacagactcatctctggcattggccagctccgaaggtgagggcctcaagcagttaatacagactcaggatgagagattctcgtgatttagacaagggtagtagcagtggatgtggtgagaagtggtccagctctggatgtattttaaaggtagaacacatgggattcttctgatggattggaggtggtggggaatgaacagattcaggtctttatttaaagggaaatttcctgtttattgtctgcaaatgatttttctgttccctatattgagtcctataatttttaagtccttg

SEQ ID NO: 267915 - DNA, 471 bp, Homo sapiens
gaaaccggttggctttgctttggttttgagaaccagtggggaagagggtaggcatactgggctgggcgcctttccctctttgagtagttttgcgtgagataaggaagagcagaatgtgtaattgtagggccaaaataatcttgtttgtaaacagtgcctgtgagctcctttagtgcttcctaatggccgtgctgtgcaagttgttggttgggttaatctagacagtcctcattcattcattcattcatttctcacatgaccacaacaagagtccttgcctagaggcaagtgctagacagcatagtggttaagagtaggctttggagccagacttcctgagttcaaattctggctcagcaactttccagctgtgtgtacctgggcacattgcttagtctccctgtgcctcagtgtcttcgtctataaaacaaggatgataacagagagagatattatgaagagtaaaaagtt

SEQ ID NO: 267916 - DNA, 563 bp, Homo sapiens
gttttgccatgttacccaggctggtctcaaactcctgggctccagccatcctcccctctccgcctcccaaagtgctgggattacagtggctctatggaacaaattcatatgttaataccctaggatgggagttagggaacttttctgtaatgggacagatggtaagtatttcaggcttttgaggctatacagattttgtcacaactactcaactctgatgttgtagctgaaagaagccatagataatatgcaaacgaatggactgggctgtgttaaattaatactgtattcacagaaacagacagtggactggatttgtcccaggggctgtagtttgccaactcctactctgggagaaaaattgttttgcttacttatctgtccacagtctacaggggagtgtagtgcttcaggcaaattgcttcttttataatatatgcctaaactgagcatggtggtgcacgcctgtaatcccagctacttgagagactgaggtgggaggatcacttgtgccccaggagtttgtgtccagcctgggcagcatagagaaaccctcatctctt

SEQ ID NO: 267917 - DNA, 833 bp, Homo sapiens
attccatacattccagaagcctaggcgttgatgggagctgtctggagcaggggtccccagcccccaggccgcagactgatactagtccatgacctgttgggaactgggctacacagcaggaggatctctaccaccagtcctatgaatgcgtttgtgtcctcttcgcctcagtcccagacttcaaggagttctactctgaatccaacatcaatcatgagggcctagagtgtctgaggctgctcaatgagataattgctgattttgatgagctgctctccaagcccaagttcagtggggtggagaagatcaagaccatcggcagcacctacatggcagccacaggcttaaatgccacctctggacaggatgcacaacaggatgctgaacggagctgcagccaccttggcactatggtggaatttgccgtggccctggggtctaagctggacgtcatcaacaagcattcattcaacaacttccgcctgcgagtggggttgaaccatggacccgtagtagctggagttattggggcccagaagccgcaatatgacatttggggcaacacagtgaacgtggccagccgcatggagagtacaggagtccttggcaaaatccaagtgactgaggagacagcatgggccctacagtccctgggctacacctgctacagccggggtgtcatcaaggtgaaaggcaaagggcagctctgcacctacttcctgaacacagacttgacacgaactggacctccttcagctaccctaggctgagattgcactcgccttctaagaacctcaataaagagactctggggtgtctggagcccaaagatg

SEQ ID NO: 267918 - DNA, 1309 bp, Homo sapiens
cacagaggtgtgtcctgaaaggccccaagatgctgcactggctgcctgcactgtctggcctggtggccacacgaccaggactgagaatagccttgggcaccgccaccatcctccttgtctttgccatggccattaccagcctgttcttcttcccaacatcatcagactgccctttccaagctcccaatgtgtcctccatgatttccaacctctcctgggagctccctgggtctctgcctctcatcagtgtcccatactccatgcactgctgcacgctgggcttcctctcctgctccctctttctgcacatgagcttcgagctgaagctgctgctgctcctgctgtggctggcggcatcctgctccctcttcctgcactcccatgcctggctgtcggaatgcctcatcgtccgcctctatctgggccccttggactccagaatgagtactactgccgcctggacttcctgtggaagaagaagctgaggcaggagagggaggagacagagacgatggagaacctgactcggctgctcttggagaacgtgctccctgcacacgtggccccccagttcattggccagaaccggcgcaacgaggatctctaccaccagtcctatgaatgcgtttgtgtcctcttcgcctcagtcccagacttcaaggagttctactctgaatccaacatcaatcatgagggcctagagtgtctgaggctgctcaatgagataattgctgattttgatgagctgctctccaagcccaagttcagtggggtggagaagatcaagaccatcggcagcacctacatggcagccacaggcttaaatgccacctctggacaggatgcacaacaggatgctgaacggagctgcagccaccttggcactatggtggaatttgccgtggccctggggtctaagctggacgtcatcaacaagcattcattcaacaacttccgcctgcgagtggggttgaaccatggacccgtagtagctggagttattggggcccagaagccgcaatatgacatttggggcaacacagtgaacgtggccagccgcatggagagtacaggagtccttggcaaaatccaagtgactgaggagacagcatgggccctacagtccctgggctacacctgctacagccggggtgtcatcaaggtgaaaggcaaagggcagctctgcacctacttcctgaacacagacttgacacgaactggacctccttcagctaccctaggctgagattgcactcgccttctaagaacctcaataaagagactctggggtgtctggagcccaaagatg

SEQ ID NO: 267919 - DNA, 1394 bp, Homo sapiens
cacagaggtgtgtcctgaaaggccccaagatgctgcactggctgcctgcactgtctggcctggtggccacacgaccaggactgagaatagccttgggcaccgccaccatcctccttgtctttgccatggccattaccagcctgttcttcttcccaacatcatcagactgccctttccaagctcccaatgtgtcctccatgatttccaacctctcctgggagctccctgggtctctgcctctcatcagtgtcccatactccatgcactgctgcacgctgggcttcctctcctgctccctctttctgcacatgagcttcgagctgaagctgctgctgctcctgctgtggctggcggcatcctgctccctcttcctgcactcccatgcctggctgtcggaatgcctcatcgtccgcctctatctgggccccttggactccaggcccggagtgctgaaggagcccaaactgatgggtgctatctccttcttcatcttcttcttcaccctccttgtcctggctcgccagaatgagtactactgccgcctggacttcctgtggaagaagaagctgaggcaggagagggaggagacagagacgatggagaacctgactcggctgctcttggagaacgtgctccctgcacacgtggccccccagttcattggccagaaccggcgcaacgaggatctctaccaccagtcctatgaatgcgtttgtgtcctcttcgcctcagtcccagacttcaaggagttctactctgaatccaacatcaatcatgagggcctagagtgtctgaggctgctcaatgagataattgctgattttgatgagctgctctccaagcccaagttcagtggggtggagaagatcaagaccatcggcagcacctacatggcagccacaggcttaaatgccacctctggacaggatgcacaacaggatgctgaacggagctgcagccaccttggcactatggtggaatttgccgtggccctggggtctaagctggacgtcatcaacaagcattcattcaacaacttccgcctgcgagtggggttgaaccatggacccgtagtagctggagttattggggcccagaagccgcaatatgacatttggggcaacacagtgaacgtggccagccgcatggagagtacaggagtccttggcaaaatccaagtgactgaggagacagcatgggccctacagtccctgggctacacctgctacagccggggtgtcatcaaggtgaaaggcaaagggcagctctgcacctacttcctgaacacagacttgacacgaactggacctccttcagctaccctaggctgagattgcactcgccttctaagaacctcaataaagagactctggggtgtctggagcccaaagatg

SEQ ID NO: 267920 - DNA, 1106 bp, Homo sapiens
tacttacaccttaagctctacttctaaactgggggtggggtgggggtggtttcaggcatcatggagttggggctgaacactcaggagctgggcttcccctgctctgtgtctccccatggccccgggtgaccctccccagaatgagtactactgccgcctggacttcctgtggaagaagaagctgaggcaggagagggaggagacagagacgatggagaacctgactcggctgctcttggagaacgtgctccctgcacacgtggccccccagttcattggccagaaccggcgcaacgaggatctctaccaccagtcctatgaatgcgtttgtgtcctcttcgcctcagtcccagacttcaaggagttctactctgaatccaacatcaatcatgagggcctagagtgtctgaggctgctcaatgagataattgctgattttgatgagcctgatcctttaactccaaaggcttggggctgggcttctgggagaggtgatggagagagtaagagagactggggacaggactcttctctatatacagctgctctccaagcccaagttcagtggggtggagaagatcaagaccatcggcagcacctacatggcagccacaggcttaaatgccacctctggacaggatgcacaacaggatgctgaacggagctgcagccaccttggcactatggtggaatttgccgtggccctggggtctaagctggacgtcatcaacaagcattcattcaacaacttccgcctgcgagtggggttgaaccatggacccgtagtagctggagttattggggcccagaagccgcaatatgacatttggggcaacacagtgaacgtggccagccgcatggagagtacaggagtccttggcaaaatccaagtgactgaggagacagcatgggccctacagtccctgggctacacctgctacagccggggtgtcatcaaggtgaaaggcaaagggcagctctgcacctacttcctgaacacagacttgacacgaactggacctccttcagctaccctaggctgagattgcactcgccttctaagaacctcaataaagagactctggggtgtctggagcccaaagatg

SEQ ID NO: 267921 - DNA, 1510 bp, Homo sapiens
tacttacaccttaagctctacttctaaactgggggtggggtgggggtggtttcaggcatcatggagttggggctgaacactcaggagctgggcttcccctgctctgtgtctccccatggccccgggtgaccctccccagaatgagtactactgccgcctggacttcctgtggaagaagaagctgaggcaggagagggaggagacagagacgatggagaacctgactcggctgctcttggagaacgtgctccctgcacacgtggccccccagttcattggccagaaccggcgcaacgaggatctctaccaccagtcctatgaatgcgtttgtgtcctcttcgcctcagtcccagacttcaaggagttctactctgaatccaacatcaatcatgagggcctagagtgtctgaggctgctcaatgagataattgctgattttgatgagcctgatcctttaactccaaaggcttggggctgggcttctgggagaggtgatggagagagtaagagagactggggacaggactcttctctatatacagctgctctccaagcccaagttcagtggggtggagaagatcaagaccatcggcagcacctacatggcagccacaggcttaaatgccacctctggacaggatgcacaacaggatgctgaacggagctgcagccaccttggcactatggtggaatttgccgtggccctggggtctaagctggacgtcatcaacaagcattcattcaacaacttccgcctgcgagtgggtgagagacttcccctgctgcagcagtctggtacctcctcaccttcctgagcttgccccactccaagtcctttgttagctgctcccagttcatcctgaagcccctttcctgactcactccctgggatggggtgtgaaggtgctgggcaaggaggtacgaggctctcccactctttttcttaagctacattcctccagcccttagagacccctcctctcctctagggccccccaggctcttctcccttccttccagttccttgtggcttcctcttcccctcttccttctccaagtctgtcattaccacatccctcattagggttgaaccatggacccgtagtagctggagttattggggcccagaagccgcaatatgacatttggggcaacacagtgaacgtggccagccgcatggagagtacaggagtccttggcaaaatccaagtgagggaaccacattggaggcatagggggagggggactaagaatagggccacctccatattccctcgcccccctccaattgtaggtgactgaggagacagcatgggccctacagtccctgggctacacctgctacagccggggtgtcatcaaggtgaaaggcaaagggcagctctgcacctacttcctgaacacagacttgacacgaactggacctccttcagctaccctaggctgagattgcactcgccttctaagaacctcaataaagagactctggggtgtctggagcccaaagatg

SEQ ID NO: 267922 - DNA, 1342 bp, Homo sapiens
ggtgaaaccccatctctactaaaaatacaaaaattaaccaggtgtagtggcccacgcctgtggtcacagatacttggggagctgaggtgggaggatggctccagccctggaggcagagcttgcaatgagccaagatagtgacactatctccactcccacagcctgatcctttaactccaaaggcttggggctgggcttctgggagaggtgatggagagagtaagagagactggggacaggactcttctctatatacagctgctctccaagcccaagttcagtggggtggagaagatcaagaccatcggcagcacctacatggcagccacaggcttaaatgccacctctggacaggatgcacaacaggtacggcaacccttccttacctaccatcctcctctgggctctcattgatgggcttattagtgggacttattcctgtgccctcactggcccaccctggtgggcgggcccattgccaggatgctgaacggagctgcagccaccttggcactatggtggaatttgccgtggccctggggtctaagctggacgtcatcaacaagcattcattcaacaacttccgcctgcgagtgggtgagagacttcccctgctgcagcagtctggtacctcctcaccttcctgagcttgccccactccaagtcctttgttagctgctcccagttcatcctgaagcccctttcctgactcactccctgggatggggtgtgaaggtgctgggcaaggaggtacgaggctctcccactctttttcttaagctacattcctccagcccttagagacccctcctctcctctagggccccccaggctcttctcccttccttccagttccttgtggcttcctcttcccctcttccttctccaagtctgtcattaccacatccctcattagggttgaaccatggacccgtagtagctggagttattggggcccagaagccgcaatatgacatttggggcaacacagtgaacgtggccagccgcatggagagtacaggagtccttggcaaaatccaagtgagggaaccacattggaggcatagggggagggggactaagaatagggccacctccatattccctcgcccccctccaattgtaggtgactgaggagacagcatgggccctacagtccctgggctacacctgctacagccggggtgtcatcaaggtgaaaggcaaagggcagctctgcacctacttcctgaacacagacttgacacgaactggacctccttcagctaccctaggctgagattgcactcgccttctaagaacctcaataaagagactctggggtgtctggagcccaaagatg

SEQ ID NO: 267923 - DNA, 270 bp, Homo sapiens
tcccaaccagaaatagcaggatccacccctttggacgagtcttcccctgactcatccctgggtcagctgaaacccagcacaagccaccactgtgcccaagaagctacctgcctcttcaactcctcatctcctctgcagttcttcttcccaacatcatcagactgccctttccaagctcccaatgtgtcctccatgatttccaacctctcctgggagctccctgggtctctgcctctcatcagtgtcccagtgagtgttcccacatgccct

SEQ ID NO: 267924 - DNA, 332 bp, Homo sapiens
cacaatctgacatttaggagtccccagtgagagtgctggctgcctgcccactctccctaaaaatgagtttgcccgctgatgagctccgccatgcacacggaatttccaattaactttttagagcctcactgctaatataaacatctaaccaaggatcagctgatgtataaggagaatcaagaaatgataggaacaaaagcactaaaataagtgatggggaaaaggcaatctttaggaaacaaagacagtgctatttcagaagactgaaggaacttttccatagttttctcatagagttcaagaggacagtgcctcataaaacaaaaatagaa

SEQ ID NO: 267925 - DNA, 398 bp, Homo sapiens
tagagctggtaaatgagacaggatatcaaacagtatatcaaaatttgttgatggtatggtataaccaaatgaatgatatagtcagcaaagtatctaatcttgaaccactttttctcagagaatagagatttagcccaatggtaggtatttatgtgcttagaatatttgtagttaataaaaccttccccaggattgcataagagttgtagaggctgcagcctggccaacatggagaaaccccatctctactaaaaatacaaaatattagctgggcgtggtggattgtgcctgtagtcccagcttcttgggatgctgaggtgggagaatcagttgaacccgggaggcagaagttgcagtgagctgagattgcacactgcctgggggacagagtgagactc

SEQ ID NO: 267926 - DNA, 696 bp, Homo sapiens
atgaagaattatgtcatagactatctcaaactttgaacagggctctgtaacagatactgaagccacaactaattgatttccttagagagggaagaatgacccagcagcagcctctctccttcctcagtttgcttctattccctcaaatgctcattatttttttctcactaactctactgttagcatttaattcccttttctgttgttaaatttaagggaaaaatgaaatattactgcatatgaaaaatactgagtccttatactgttcagtagcatttgagacttaggttttgtcttggacggatgaattcatatatgttctgtttccagaattttttttttttggtagggggaagggttagatggagggacgatgtcacataattatatatttgcagtttaaagggaaaacattttaagtggaaaaaaaacaaacccaaggtaagttttatccttgtacatgttttaaaattaaccatattgtagactgcataacagattgttgaagatagaaatcaaatttaatgtgctttataaaaactgaaaatacagttttcaatttcatagtgcataaatatgcaggtaccaagaggttctgactagaataattatagtagacagttgttaatgaagattgatgaggaagagaaaaaattagttgagtgaaactccagaatactgaaaaaaaggaaagaa

SEQ ID NO: 267927 - DNA, 740 bp, Homo sapiens
gggatttgggagggtagaatttacaggggtgccagttggcagctgacaggtttagattctggggcttaaaaactaatagatgtgtggcctggttcagtggttcatgcccgtaatcctggcacttcaggaggctgaggtaggcggatcatttaatcccaggagttcgacaccagcctgggacaacaggcatgtaccaccacacctggctggttattttttgtagagacaaggtctcactattttgccaggattgttctcaaactcctgggctcaaacagtcatcctgccttggcctccaaagtgctaggattacacgtgtgtgtgccaccacacgggccctatggaaccattacttattggcatatgaaagaaccatgactcaaggattgcaaaaatccctcatagattgagacctgtaagcaattttggctttagtctgagagagttgcttctctgtgttcctgttgagttagtttcttacaatgtggtgggagactggagactgagaattgttcttgaaaaaggggtaaccaggccgggcgcggtggctcacgcctgtaatcccagcacttgggaggccgaggcgggtggatcatgaggtcaggagatcgagaccatcctgtgtacaaggtgaaacccgtctctactaaaatacaaaaatagccggggccgtgggggcgcctgtagtccagtatcgggagtcgagcggagatggggaaccggaacggactgggaccgat

SEQ ID NO: 267928 - DNA, 503 bp, Homo sapiens
gggatttgggagggtagaatttacaggggtgccagttggcagctgacaggtttagattctggggcttaaaaactaatagatgtgtggcctggttcagtggttcatgcccgtaatcctggcacttcaggaggctgaggtaggcggatcatttaatcccaggagttcgacaccagcctgggcaacgtggcgaaaccttgtctctactaaaaataacaaaaaattagctcgacatggtggcatgtgcctgtagtcccagctacttgggaggctgagatgggagaattacttgaacccaggaaggcaaggctgcagtgagctgtgattacaccaactgcgcttcagcctgggagacgtgagtgagaccctgtgttaaaaaaacaaaagcaaggccagatgcaggctgcacgcctgtaatcccagcactttgggcggccgaggcggatggatcacgaggtcaggagatcgagaccatcctggctaacacggtgaaaccctgtctctac

SEQ ID NO: 267929 - DNA, 1382 bp, Homo sapiens
cgcctcctaggttcaagtgattctcctgcctcagcctccccagtagctgagactacaggcacctgccaccacgcccggctaatttttttatttttagtagagacggggtttcaccatgttagccaggatggtctcgatctcctgacctcgtgatctgcctgccttggcctcccaaagtgctgggattacaggcgtgagccaccgcgcccagcctgactggtgtagtcttaagacttttctcagaatcgtatctcatttttttctgggctggtctggaagaacactgactgcactcaggccaagtgggttgggtgatacaagctgccagattgctgccacgaacctggagtagtttgcagacccttgcgaggagtatttgtctaagcgagatgttgaaaggacccagaggaaattgtcagagttcccttggtcgcaggaactagtgctgcatagggtacacttttgttcctgctccagcaaatgcagcactcaggtgcttgcctgggcaggtccgggatgccctgcctctgtggctgcccattgggactgaatcactgttggcatcccttatttcagaggatgaattcatgtgtcatttgggtttggcagtgagctaagagctaaatggggtaaacattgcccactggcaggaaacatataatcttgtctgaagctaatggaccgttacttttttggttgtttgagacagtgtctcgctctgtcaccgggctggagtatggtggtacaatctctgctcactataaccttgagctttgcagcctcaagtgatccctccacctctgcctcccgagtagcctgggacaacaggcatgtaccaccacacctggctggttattttttgtagagacaaggtctcactattttgccaggattgttctcaaactcctgggctcaaacagtcatcctgccttggcctccaaagtgctaggattacacgtgtgtgtgccaccacacgggccctatggaaccattacttattggcatatgaaagaaccatgactcaaggattgcaaaaatccctcatagattgagacctgtaagcaattttggctttagtctgagagagttgcttctctgtgttcctgttgagttagtttcttacaatgtggtgggagactggagactgagaattgttcttgaaaaaggggtaaccaggccgggcgcggtggctcacgcctgtaatcccagcacttgggaggccgaggcgggtggatcatgaggtcaggagatcgagaccatcctgtgtacaaggtgaaacccgtctctactaaaatacaaaaatagccggggccgtgggggcgcctgtagtccagtatcgggagtcgagcggagatggggaaccggaacggactgggaccgat

SEQ ID NO: 267930 - DNA, 278 bp, Homo sapiens
cctcctaagaccaccgagactcccacttacaactggactctcttcagtgttctattcataaagccctgccctatggctttttaagagaataaacaggccagagcaccaacccagactaaaaagcatgttcctattatattttgctttattctgattaactttgaacagcagtcattaacaagggaaaggctccactttggtctgaactgcttatgttgggaattttttcatccagcggcacctctatttaccttggccctgactctgtggctcagttg

SEQ ID NO: 267931 - DNA, 1015 bp, Homo sapiens
agttaacatcaacttcacaaactcttccaaacaataaaatatggaagaatacttcccaattcagtctatgaaaccagtattaccctgaagccaaaaccagaaaaagatctcacaggaaaactacagaccactacctctttcaaatatagatgcaaaatctcaacaagacactagcaaaccgaatttagtaacacataaaaaggattatacgccatgaccaagtggaatttatcttaggattccaagcttggtttaacatcaatcaatataataatccatattaatagaataaaggagaaaaaatatatgatcatctcaatagacacagaaaagcatttaacaaaattcactaccctttgatgagaaacactcagtaaactagtaatagaaggaaacttcctcaatctgataaactgcatctgttaacaaaaaaaaaacccataactaacatcatacttaatagtgaaagactgactgctttctccctaacatcaggaacaaaacaaggatgtccactctcactacttctattcaacattacactggaggttcttgccagggcaaagacaagaaaaagaaatgaaatccaaattggagaggtaaaactatattttccggtgacatcatactgtacgtagaatattctaaacaacacacaaaagacaattagaactaatagttcagcaaatttgcaggatgcaagatcaaaatgtaaaaatcaattgtggttgtatgaattatcacttaacaatctgaaaatttaattaagaaaacacatttacaatagtatccaaaagaataaaaaatttgggaataaatgtaacaaaagaagcgtaagatttatacaccaaaaactgcaaaacattgtggaaagaagttaaaaagaacctgaataaatgaaaaaacattctgtattcatggattggaagacttaataatggtaagatggcaatactccccaaattgacttatgcattcaatgcagtctctttaaaatcctagctgaaattcttac

SEQ ID NO: 267932 - DNA, 434 bp, Homo sapiens
ttatttttatttcttctgttttccattccactaatatttgcttatctttattaatgtctgcttccaagttcttttactttgataaactttttccagtttttatgatgcatcttatctcaccaatgataagaaaatacagatatatttattattcggtgctatgagcttgaacctccaatgatatttcagtttcatgatggattgtttgtttgactccaatacaaagataattatttctgaaataggcttctcctgagagaagaacaagccttacagttacaggcatgtgtattaacaatttttaaaaaagaaaatttgtctgggcccaaaagaagaatacatagcatgcaagccagcactaaagccaatgagatgaatgtgatttctgagactatgttttctaaaatagaaaataaaatgacatgcacaaatat

SEQ ID NO: 267933 - DNA, 718 bp, Homo sapiens
  misc_feature (19)..(19): n is a, c, g, or t
agataaaagtaaaaaatgngccgggctcagtggctcacgcctgtaatcccagcactttgggaggccaaggtgggtggtttcaccatgttagccaggatggtctcaatctcctgacctcgtgatctagctgcctcggcctcccaaagtgctgggattacaggtgtgagccatcgcgtctggcctgaaatacttatttttaagctagaaatagtttggcaataaggttgtgaaactggacagataatagcaattagttactgatcaagtgaacaatttaataatcgaaaaaactcttgactataagaaacttgaattgcatacagggacttaattacccagaggaactaaatttaaaagaaatttcaggctgggcgcagtggctcacacctgtaatcccagcactttgagaaggtgaggtgggcagatcacttgaggtcaggagttcaagaacagcctggccaacatggcaataccccatctctactaaaaatacatacctgtaatcccagctactcaggaggctgaggcatgagaatcacttgagcctgggaggtggaggttgtagcaagctgagatcgcaccactgcgctccagcctgggcaacagggccagactaattcattcattgattcataaataaatgttatagagctcctttacattgagggatcatttcttgttcctactgtagtagtcaataaatgttttggacaactgg

SEQ ID NO: 267934 - DNA, 349 bp, Homo sapiens
cttttcaggcaaaacaggaaaaccagaccagcagagaggagagagaccagcaatcagaccctcccagagacaatcattgttaacatattgtgtccataagccaaggaatgcaggcagcctttggaagctgtgaaaggcagggaaatggattctctccagaagcctccagaaggctagcccaggcttgtttgcatgttggtggaaaggagcaacaagaatagtgagacctcttaagtcctaggcttcgaactgacacgttgtcacatccgccacttctacggatcaacaaaaatcacaaggtcagccctgattcaagggcttagaaaataaacttaatctctgatgaaaa

SEQ ID NO: 267935 - DNA, 174 bp, Homo sapiens
tttttttaataactgtcaacttttccctaggcagcagggctgtgggcccatctacagctagggagtagagactgacagggactcttccagctacagatgcttctgggaaaccttcaagtgaacactgtctaggatagtatgaatcccctttgctttagcgcagatgtttttgtg

SEQ ID NO: 267936 - DNA, 1283 bp, Homo sapiens
tgagccctggaggtcaaggctgcagtgaaccatgatcaagccactgcactccagcctgggtgacaagaggaagaccttgtccccccaaaaagaaaaacattagtttcagtcaaacccacgttcgttccctaccatgtgtagctgtgggaccctacacaagtgaaattgcctctgagccagttgcctcatgtaaaactgagatgaccatacttaacatggccatcgcaataactagtgttggttacctggccgcttaagtaatttgtgtaagaacaggtttaccccacccaaaagaactgggccatggagagccttcataggaagaaaaggacttatctcctcttggtcaaagtgaccaaatgactgcatagccctcgcagcttccccagtctccccacccccacagaatttgagagaagcagctgagcatctagagacagctgggttacctgcagcttgcgagtggtccatcgcaggacagtcaaggccatgccaggggcactggtgctatatacacaatctgcaggacctgctccaccagggccatggccttgaagtggtgcttgttccagaagctgggttgggggagggtattgcacgggggtcagtactaggggtcatctcagggcggttgcctgcacccaggtccctgaagcactgaggggctaatggcttctaagtagacatcttacatttttgagcatcagaatgcatgcatgtttctgggcccctcatccgtgttcttgggtggctagaggggaggcagtgggcgagaatccttgcatttggccaggcgtgatggccacacctgtaatccaagccctttgggaggccaagaagggaggattgcttgatgccggaagttagaagtcagccaagataacgtagggagacctcctgtctctacaaaaaaaaaaaaaaaaaattagccgggcgtagtgatgtgcgcctctagtctcagctgctctggaggctgaagcaggaagatcacttgagtctgggaggtagaggctacagggagtggtgatcgagcccctgcactccatcctgaacaacagagtgagaccccatttcgaagaaaaaaccctagcatttaacctcaccaggtgttaaacacccgccaccttaggacccctcagcacctacagcaccacacctgtgtgccctgggggacacaaggacccatgacaagtcctgatctccaatcctggctctgcggccttggctgagccacctgccctcacctgctcagtgaggaagggaaatgccccatgccagcccca

SEQ ID NO: 267937 - DNA, 404 bp, Homo sapiens
cagtcaattttttttttttgtaatgctttccatttctcctccttgaggtagaattgagcactctctcctctgtgacatcactataccctatatggactgctgtcataccagctaagataaatttattatgtattttaacgagtttattgagaaataactgacaaattacaaattgtccatatgtaaagtatgcaatttggcatatcagtaaacattcgaaattatcaccactgtattattccattttcatgctgctgataaagatatacccgagactgggaataaaaagaggtttaattagactttcagtttcacatggctgaggaggcctcagaatcatggtggaaggcaaaaggcacttcttacatggcagcagcaagagaaaatgaggaagatgcaaaagc

SEQ ID NO: 267938 - DNA, 756 bp, Homo sapiens
  misc_feature (467)..(467): n is a, c, g, or t
  misc_feature (469)..(469): n is a, c, g, or t
cgcccagtgacctgccgaggtcggcagcacagagctctggagatgaagaccctgttcctgggtgtcacgctcggcctggccgctgccctgtccttcaccctggaggaggaggatatcacagggacctggtacgtgaaggccatggtggtcgataaggactttccggaggacaggaggcccaggaaggtgtccccagtgaaggtgacagccctgggcggtgggaacttggaagccacgttcaccttcatgagggaggatcggtgcatccagaagaaaatcctgatgcggaagacggaggagcctggcaaattcagcgcctatgggggcaggaagctcatatacctgcaggagctgcccgggacggacgactacgtcttttactgcaaagaccagcgccgtgggggcctgcgctacatgggaaagcttgtggcatctgctccctgcagggccgtgccgctgtccccacntnggctcacctggccacctcacctgcaggtaggaatcctaataccaacctggaggccctggaagaatttaagaaattggtgcagcacaagggactctcggaggaggacattttcatgcccctgcagacgggaagctgcgttctcgaacactaggcagcccccgggtctgcacctccagagcccaccctaccaccagacacagagcccggaccacctggacctaccctccagccatgacccttccctgctcccacccacctgactccaaataaagagcttctcccccaaa

SEQ ID NO: 267939 - DNA, 691 bp, Homo sapiens
cgcccagtgacctgccgaggtcggcagcacagagctctggagatgaagaccctgttcctgggtgtcacgctcggcctggccgctgccctgtccttcaccctggaggaggaggatatcacagggacctggtacgtgaaggccatggtggtcgataaggactttccggaggacaggaggcccaggaaggtgtccccagtgaaggtgacagccctgggcggtgggaacttggaagccacgttcaccttcatgagggaggatcggtgcatccagaagaaaatcctgatgcggaagacggaggagcctggcaaattcagcgcctatgggggcaggaagctcatatacctgcaggagctgcccgggacggacgactacgtcttttactgcaaagaccagcgccgtgggggcctgcgctacatgggaaagcttgtgggtaggaatcctaataccaacctggaggccctggaagaatttaagaaattggtgcagcacaagggactctcggaggaggacattttcatgcccctgcagacgggaagctgcgttctcgaacactaggcagcccccgggtctgcacctccagagcccaccctaccaccagacacagagcccggaccacctggacctaccctccagccatgacccttccctgctcccacccacctgactccaaataaagagcttctcccccaaa

SEQ ID NO: 267940 - DNA, 622 bp, Homo sapiens
  misc_feature (333)..(333): n is a, c, g, or t
  misc_feature (335)..(335): n is a, c, g, or t
cgcccagtgacctgccgaggtcggcagcacagagctctggagatgaagaccctgttcctgggtgtcacgctcggcctggccgctgccctgtccttcaccctggaggaggaggatgagggaggatcggtgcatccagaagaaaatcctgatgcggaagacggaggagcctggcaaattcagcgcctatgggggcaggaagctcatatacctgcaggagctgcccgggacggacgactacgtcttttactgcaaagaccagcgccgtgggggcctgcgctacatgggaaagcttgtggcatctgctccctgcagggccgtgccgctgtccccacntnggctcacctggccacctcacctgcaggtaggaatcctaataccaacctggaggccctggaagaatttaagaaattggtgcagcacaagggactctcggaggaggacattttcatgcccctgcagacgggaagctgcgttctcgaacactaggcagcccccgggtctgcacctccagagcccaccctaccaccagacacagagcccggaccacctggacctaccctccagccatgacccttccctgctcccacccacctgactccaaataaagagcttctcccccaaa

SEQ ID NO: 267941 - DNA, 456 bp, Homo sapiens
aagtgagcctcacagaattgtggagatagtgactcttctatgctagtggttctctaagtgtggtcccagaccagcagcatcaacgtcacccggtacttactggaaatgcaagttctcagacctcacatctgatctactaaatcagaatctctggggatggtgtccagtaatctgttttaacaagcccagcaggtgatactagtgtatgttaaagtggaagcacctctggtctatgacttctgctggcatataaatcagccccaagatttgaggtgtccctgagaaaggatgttattaaatctgagtaaaagggaaattgtgactgaaaataaaaataaattatcctccacaatgggtgagcagtaaaatatactatactaatccctattcttactataattgatcattttgtttggttatgcatgagtaaaagaatgaataattattgttttcttt

SEQ ID NO: 267942 - DNA, 900 bp, Homo sapiens
ggcttgattcttttgtccagccctgagattaggttttatcatagctcaggaagtaaacctagctcaggaagtaaacctctgtcgtagaaaggaaaaacaagaatgatttaaaggtccctttaatgccttaaaatttagctgtaaagttagctatatctgaggcacatggagaattcaggtttgggcaaaattaaaacagtttatggcattcatgaaaacatatattcatatattcagtcttatgcattcattcaaaatggcatagcatatttacaagagtacaaaattaatccaacttaaaagttttgattatgagacgtaatgaacaaagagatagaattaggcatttccattttgggccatttgtaaaacatttactataaatgtgtttattagagtggttttcagccttagttgtaaagttatcatagcttttaaaaaaacacattttattatctgtctctgtgagcacaaaaaaaggaaagaaaaatacatgttaatctaccattttatcctcttcatattttattattataatattgctatagaattcttttttctattatctggtttgaattttcaacttactgacaactagtaggttaatctaacagacaataactgtgtttaaagttagaaagaaaatgttctgttccttgcctcattccatatcaggaaagtcaggtgttgtgtttcagacccaaaccaaaaaatgtgttttactgtatgtttgtttaaatgtgttcttggctagagtaatattttagtcatctgtagatttgatgacagtactgtgaaataaatgacaagtcatttacttgtactgtacaaagaagcatatcctactatatggattagaggttaggttaactctctttccacactaccaaagacaaaaaa

SEQ ID NO: 267943 - DNA, 307 bp, Homo sapiens
taggctagatggtgaagtttcccataagtaggctggtctgcagttttgttctattggtcaaaatatattctgacaaaaatgtatttgaagtgcatgataaggtaaaggtgtgttgaatattttgatttcacacttagttccgagtgtactgtgttaagcaaggtgcccctaagttgaaggggtgtaggcacaattaacagtcacttgatatgtctcagagcatcttctagaaactgaggaaataaaagactaaagattggtaactaatcctttgtgcaaatgaggtattttccaatattttgtttag

SEQ ID NO: 267944 - DNA, 381 bp, Homo sapiens
agacctgattttagcaaggatacgaataatatttgacaactttggggggatcttgatgcctctgtaatttactcaaggataatctcaagaaaaatggcattaagtagattacagaaaaaatagaactatcatattgttattattggctatttacatgagcaatgcggagaaatgtttaggattacagcatttagaagcttctcaattgctgcatttcctcactgtaccacaagatggcagatactgcatttaaaatttttttttctgtgtgttttctcttatagtcacttggtggccatgtaacaagcagagcaacatgtattaacagattctttttgaatgcaatattggattaaaaactttgaattaaactacaattaa

SEQ ID NO: 267945 - DNA, 328 bp, Homo sapiens
cagtcattcattaaattgttctcaaatttttcattggtgaattattagcttgctcagttccagcttctgggcattccttgagaatttgatatcctggtggttttcatgatttggagactgttatgtgttcatatagcaatcatatttggagatggctctacatttttctcagaagattggcttcttgaaagaagcttattgtaggagtggggagaattaattaaaatggtatgtgtacagtgttcctttatataatatttctgttttcctagtatctaggaatagagaaaaaataaattggtattcaaattccaagattctatataca

SEQ ID NO: 267946 - DNA, 698 bp, Homo sapiens
cagtttttcattatataccaagatatgctcaacagtagttatccacaggtagcaaaagcagcagctaagctaagttttaagtaggaaaatcacaacagaagagtacaaagccaggggaaaattagctgattcatagaaatctatctttaaattcagtgtggcatcagttcttaatactgagaaagattagcctgcagattcagaaaaatacatattacatttgtaaatactgacatatatgaaacatttctccactcagaattttgatcatcctagtcccttacccaaaactaaaacatttatataaatctatattagaactaaatcagttatttactgcagtgattgatgtgtccatattaactttcatgtaacatttcgaaatatgggtcaagtcaaaacacagtgatgtataaacagtttttgtatttaattttccaactagtttacctaattagaatactgtaataaagtaatgatgctattttaaaaaactaacattttaattctaatgattatatatttgttttttgataagactaatatgacttgctttaactttttatcaatatgcatatacagatacattcattataggtatctataatgaatatacctgcttatgcatatttataataggatgtcatataaaattattattttacatgtataatgctaataaatcaagcataacttct

SEQ ID NO: 267947 - DNA, 499 bp, Homo sapiens
caggaaaatggcatgaacccacgaggcagagcttgcagtgagccaagatcgcgccaccgcaccccagactgggcgacagagcaagactcgtctcaaaaaaaaaaaacccttcattttactcaaaacttatttacatgatgctaaccaacttcaattaacatatgagttggacagacaagtaaataaacacaattcatttttaaatccccaaagttttaaacccagtagttaagaacacttggtaggaactcaaaattgctggataatcttaattaaaaaatttttacatttaggtcttcttaccccccaaaagaacacaaggtagatggggacataaactctcttttaccaagtggctgataggaaaacattaaaactgagatggttgtttctgtgtaaaagaaatcatcctcaaaataaataggaaccaaggctgaggcaggattgcttgaggccaagagttctagaccagcctggacaacacagaaagcctgtgtac

SEQ ID NO: 267948 - DNA, 467 bp, Homo sapiens
cacatgcctgttatcccagctactcaggaggctgaggcatgagaatcatttgaacccaggagatggaggttgcagtgagctgagatcatgccactgcactccagcctgggcaacagagcgagactctgtctcccaaaaataaaaaataaaaaatgaatgtcctatgactgaggtttattgctcctcaattgagctattccaatcaatgaaattttactacataaaggtagatgccttctaatggttttcttcccacagggatggtggggtgagatggggaactgttcaggtagtagacctgttcatgaggaaaaaaactatttaaatgctgagaaaaggatgctagcttttttggatccatcatcatttttgccaaattcatagaatttttggccagtggtgtcaaactttaaaattcataggaaaaagagattcagtaattactctgtaatattagggagggtgtg

SEQ ID NO: 267949 - DNA, 406 bp, Homo sapiens
ctaaggggtttctccaaaagctatcgttggctccaattagctggccaatttaacaggacaaatgaaaccgagttgaccgcctggacatccatgatgagtgaccaggcccaaaactcctgaatctcctcggacccaccgctgcccagcctccagggcaaagaaccccaaacagggtgaagcagatgcctccctcctggggagaaacgagtgtgtaagatgtttcacatgcagcagcagtagccactgcagcaaaaaaggcaagttcaaaggtaattggacgaggagttttaagcacggctgttcccgtagcaaactgtttcatgaatacccatcgggatctgtccatatggacagcagaagggttcctgctgttcttttgctaataaaaactgttgtgattacattt

SEQ ID NO: 267950 - DNA, 237 bp, Homo sapiens
caaagcctgtgccgggagccactgtctgtccagcacctgcggggacagagaggcagttgaaacagccccctcttggtggatgttcaagttgcttactattttcaggtttgcagacagagcggcagtgaacccctgggcctatctatctatctatctctgtgtgcctacctatgagtttttgtaggaaaaatcccgagtacattctatgtattatgttataaatattcaaacccttca

SEQ ID NO: 267951 - DNA, 193 bp, Homo sapiens
tcaagtcccagccaccagtgattggaaggctgatgatgggcaggcccctgtgaacgtcagttcttcaactctaaaatgaggataaatcttacctatctcgaagagctgccgggaccagctcctcctgctccaccacctcttcacaggaggtcagtggagggcctcccagggaacccagaggctggaggccttg

SEQ ID NO: 267952 - DNA, 691 bp, Homo sapiens
cttgaacccaggaggcggacgatgcactgagccgagatcacaccattgcactcaacaaaacaaaacaaaaaatcataaagccatttttttcttttctcttaatatctcaaattttaagagtgccttcctttcaaagagtgcagaaatagtctattttctgctgttgtgtgagtgtgtgtgtgcatcttaaagatacttaacgcttcatctatttagaggttattcttggcaccatggtggagtttaagatttgagactctgcaccctgtcctcttgtgtttgacgctccagctctgccactttccagctgtgtaaccttgggcaagttgtttaaccactctgtgcctcggtttcctcatctataaaacagggaggataagactacctatatcgatttgttgttatgaggattaaatgaataaatataaaaagcagaacaatgcctcgcatatggcaagcactcaaaacgtgagctgctggtatttttatcatgattgcgacatacgatggttgtgaaagtcctggagtatgcaacctggtaaatgatgattttcatttagattgcggtcagaggcaaggtcagagggaagatataagccattagatgtgatcgtgtcataagggaagcacaaatcaaaaccacagtgaggcaccatctcacaccagtcagaatggttattattaaaaagtc

SEQ ID NO: 267953 - DNA, 384 bp, Homo sapiens
ctcccaaagtgctgggattacaggcatgagccactgtgctggcctccagaacttttttatcacccccaaaaggaaaccctgtatgtattaaccaatcacagccaggcacagtgactcacgccataatccagcactctgagagtaggaggcaggagggtcgcctgagcccaggaattcaagaccagcctgggcaatataatgagaccctgtctctacaaaaaacttttaaaaattagccaagcatggtggcatgtgcctgtagtctcagctacttagaggactgaggtgggaggatcctttgaacctgggaagtcgaggctgcagtgagctatgattgtgccactgcactctggtctaggtgacagaacgagaccctctctctca

SEQ ID NO: 267954 - DNA, 330 bp, Homo sapiens
atgtcatcaagatggttgactagaggcgcttggtactcacctcctccacaaagaaggaccagaatagcaagtagataaccacacctcgaaaagagcatctaagagacaatatggggtttttggcagggaagtgactgagaatgtctaagacacagaaggaaaggggaaaggaaagtggcaaatgagtttttgccatgtatatgagtttcttatggacccacatcagaagagcaagccatcttcacactgccataaatcaaatagaacccatatagtttctattatcttcatttcccagatgcactaatataggttttcaaatgtcaactt

SEQ ID NO: 267955 - DNA, 440 bp, Homo sapiens
tagggatgaatcagttaacttgcttgagtttcacattcttcatctgtaaaatctggtgattagactggcccagcaaaagatataatgggcaaaagatataatacacataaattggaatgaatctgcattttccaagcctgatgactttattaaaactgaattaagtcactaactggcagcctgaagatgaaaggaaagaactcagtcatgcttcttaaggtaaaagggcagtctaactgagaattttgttatctctgaggacaaattacaaggagataaagacactcaagatcacatggaaggcttctgctcccacttagagactgcaatgtaaggtatggaaacagaatattctctatagaaacatacatattaaaatatgaacatttttgttcttatttcaatccaaaaataaataaatgaattaaatgtcaaagata

SEQ ID NO: 267956 - DNA, 434 bp, Homo sapiens
aaatacctaatctattaaacaacttagtttataatttttaatgttatgtttttatctttagaatttctgattatttttcagactttcctagttaatattgaaaacctttttctgctcatacttcttttatcctcttatttaaattaaactgattttatcttcaacacctagttattatagcatattctgagaactaattatagcttgatgttttctcaacaaatttttactcattttacaacccccgctccatattttatggctttgatttaattagtgtttttcgttgctgttgtttttgttttctgatgaacttgtatttctttgaacaacatgtatgggaattttttcagaaacctagattttaatgtccagctacagaatagactgtttctgtttaatgttaaggattcccttaagacgataaaaaattt

SEQ ID NO: 267957 - DNA, 424 bp, Homo sapiens
ccttgacaatggttttttggctattggctatcacaccaaaagctcaggcaacaaaagcaaacaagtgagactgcatcaaactaaaaagcttctgcacagcaaacactcaacaaaatgaaaaggcagcctgcagaatgggagagaatatttacaaaccatatatcagataggggttgatatgtgaaatgaaaatctcacacaactcagtcaaaaaacaatccgactgataaatggccaaagtatctgaatagacattatttaaaaaagacatacgaagggcaacaagtatatgaaaaggtgttcaacatcattaatcagaaaaatgttaatcaaaacaactatatcacttcgcaactgttaggatggttattatataaaaaagagataagtgtgatgagggtgtggaaaaaggaaactcatgttc

SEQ ID NO: 267958 - DNA, 1082 bp, Homo sapiens
aagatgagcagtggatgcccgctgccctgctccccctgccccctgcctgggtgtagatgatcctggagctgccacctgtgcaaagatggtgtttgcatgaacctctgtgccccaaggacaaggtttattactgaggaacttggctgttggtctccactgggaaagaaacacaaggatatggaattctacttggaaaactcaggtcttcctgtttgctggataaatacagagacaaaatcacaatgagccctctcacattgatgtgaaaaaagatctttggatagaaacctactcatttattctcaggactttaagtgccctgcttcatgttttggcatgttgcaactgactttattttatttattttattacaagcaagagaaacaaagtctggttcccgtatgatttaaaaaagaaaacaaaagaaaaagacttgggttgggttaggagtttctctgaaccatgaaaatgacctcaatattggctgaaaaatttgacaagaatgaaaaatggcatggtacaagctccaggaagatgttgcagagatgagcttcagatgcatttcattttgcgttgttattaatggcttggaaagaggccataaacctattatggtaattatgtctgcagatgagggtaaataggatggtgttataaacaccagtaagcaagagacgtagtacagagcaacctagggagattagaaatatggacaggaaatgaacaaacgagatcagcctggaaaagtgaaaacatgcatctggagaaatacataatttgaaaaacagagagatacttaaaggcagggtcatacttggaaagcagtaatggtaaataggcctttgagcagatatcagccctggataaatttgtaacatgatggaaaaataatactcagacctggtgttcatatagcctttcaaaatgcattttttcccaaacagaggcatttccattatctcatttgatcatcaacccaaagaggttggaagcaaagaattctccactgaagaaatgaaaagaggttaagtgaattgcttagggtcaatttgttaataaaatagacatggctaaaacttggg

SEQ ID NO: 267959 - DNA, 425 bp, Homo sapiens
agagcaagaagtgtgggagtgagaagagggaggtaacaaaactatcggtagcagcacttctcctcaatttcctacctctgatcatttcgcctaccagctacatctctgattgcaggacacccaaaagccaagcattaactgcttagaccaaaaatggaagaaagagtacatgcaacagagatttttattttttgaagaaaaggaacttctaactgttggggagcattagggtaaccggtgtgagtgtgtttaccagagaataatgctcgttgttttgatattcctgggtttttcattgtactgaaataaaaaagactggttgacctttcatcttcaagtataaaatcttgttaaaagcccttctttttccttagttttaacttgtactttctggaaacattaggaaaacctgtaactcaaaaaaa

SEQ ID NO: 267960 - DNA, 403 bp, Homo sapiens
tcacattatctaatttaaacctcacaacaatcttatgtggttcaatatcccattatcatctccattacacagacaaggaagctaagatttacatatactgaataagtggttggaaccaatatctgaatccaggtctgtttaactctagattgggtgctattaacaattatactatattaataaggtagctgaaaggacaataagctttacgatgctaaaagaatgaaggagaactaatgaatgaatttatagtatctcatttttataactcaggaacaaaactaaagtaacattctcagcatatcaaggaatctgaagccaaacagccaatctatcagcaaccagcatgttccaatatgtgatactgataaaattagctctacaacagggtctttagtattta

SEQ ID NO: 267961 - DNA, 411 bp, Homo sapiens
gcaggggagataacatgatcacgaaggtggttttcccagggcgaggcttatccattgcactccagatgtgttgacccctgcgatttccccaaatgtgggaaactcgattgcataatttgtggtagtggtactgcgttcgcgctttcccctgattttttgtagtttcaagaatacgctgtactctaagggctacttttttctttcattgatttgtgtcttggacgtgttattcttacagtggaaggctgggaaataggaattaagatgtcgcttctcccactgaggagaaatagggagcgtcagccttaacacaaacaaactagcgcgaaggccgtacagctcttccctttctacgcagggctgctttttgcagagattggtccatggtctccagtgtcttgggttctcacg

SEQ ID NO: 267962 - DNA, 407 bp, Homo sapiens
cagaataaatatatgacactgttataatatatggccctgagttggaagcaaaggaaacttgacttgttcttggagattaaaagttattcttaccttcagcaaaggtgatatgagaccgagtagaccctggaaatgcagggaatctaacatggcttaagccagacccaaagatgaggcatgttggggtattgtgagacagctgtcattctgagacccagctgctttgtaggaggttaaatgttgatgttgggactttgtatttttgtttcattgcaaactgtttctctactctacgctcccatggaaggggctttaactggatgtgctgttcaaaggaccccccagtcccttttgttctccttcagcttgtggtatccttcccttgcctccacatcatatatgacagt

SEQ ID NO: 267963 - DNA, 466 bp, Homo sapiens
cacagtggacttaagtaattgatagttcagttattttatgtttcttcactttgtttgacatgtaaatagaaatctagtttcagattttgaattttagaagaatgtggggttcagttgatacagcatgggaacttgagacatttatattttaaaaaattataggccgggtgtagtggctcacacatgtaatcccatcactttgggagactgaagtgagaggattgcttggggccaggagtttgagacgagccttggcaacatagtgagacccccatctctataaaaaaatttaaaaattagctagatgtagtggcatatacctgtagtgctactgcttgggaagctgaggctagaggatgggttgaatccaggagtgtgaggctgcagtgaatgatgattggccactgtactccagtctgggcaacagagcaagaccctgtctttaagaaattaattaataaaataa

SEQ ID NO: 267964 - DNA, 343 bp, Homo sapiens
tcttacaaagcatacttcacccttccttcctagagaaggggatcactgaaagattctcaaaagggtcctcatcacagttcaattcagagtcttagggggacatcaagggaggttccttgacatttcaatcctctgatcccatggaaactgtgaaatcagaagcaagtatgcttaatttacagaatgtcagacctggttaagaatcatcagtttaaccctcatcaggaaattgaggctcagtggagccgtgtcctattgaacatcatccagccaattagcatcaggtctcaagtgggttttctggggtttgcacacacagtttcctcactagttccgtccaaaa

SEQ ID NO: 267965 - DNA, 426 bp, Homo sapiens
ggtgtggaagcctgcaaactacacttcataggctgtgatcagctgccttctggttggctctgccagtgaaaagccttgggacaggactcaaatgctggagggaaggagaagtttgattttgcattgttttggttttgttttacccctgctttcacaaatgcctccccgagtggtgacacatcagcggaagtgcaacttctggccccctgcacagcttcagggaccatctgatagcagtaacagcaactgcacctccagaagatcagaagcacatgcaggctgggcttcttccaaaggctgggaagagctccctggcctctgagtttctcccttctcccttttactcttctacctcttccaaaagattgtaaccaactccctgtattaaatccctctctgctggaaatacctccagtgcaatctaaa

SEQ ID NO: 267966 - DNA, 552 bp, Homo sapiens
  misc_feature (524)..(524): n is a, c, g, or t
  misc_feature (552)..(552): n is a, c, g, or t
gctagttatattttcgttatttgatttctaactttattgtgttgtagtcagggaatgtggtgtttgaaatttatgtgggggctgggcacagtggctcacatctgtgatcccagcacttggggaggctgaggcaggcagatcacttgaggccaggagttcgagaccagcctggccaacatggcgaaaccccatctctactaaaaatacacaaattagctgcatgtggtggcatttgtctgtaatcccagccacttgggaggctgaggcatgagaattgcttgaacccaggaggtggaggttgcagtgagctgagattgtgccacggcactccagcctgggtgacagagtgatactctgtctcaaaaaaaaaaaaaaaaaaaaaaaaatttatggagacttagccttatggcctagtattgagttggtacaatcattttatcttttctgtttctttttccccctttgcttgctttcctctggatttcttatcttctacaaggacctgagcacattttttccagccntgggtgacagagtgatactctgtctcan

SEQ ID NO: 267967 - DNA, 389 bp, Homo sapiens
attatggagttagaagtcaaaatcatagagttgaggaatgttatttgctttgaagatgattttttgctttctgaaaacaaagtcacttgcagaagatctttagtaggcatcttatcctctaaataatcctacatacgtgatgttgggatgatttccatttaagctgtatgggacatttgtttggtcacttttataacctgtaagtctgttagactcagagacattacttttaaaaaaatgttcaaatttcaaattctatattgctatcaaagaaactctacttagaaagtttttaaaaaatattctcaaaatcatgagtttctttaaatacttgtagcactctttgttgacattttgcctattgatatttgcctatctctgattgcaaa

SEQ ID NO: 267968 - DNA, 201 bp, Homo sapiens
ccacacataatctgttctttctacaaagtaatgcatcacctgtgtgatgaattcagcaagcatcaaatgagtatgttcttcatgccgggcgctgtgcaggtgctgaattaaacacaaagactctgcttgctttaaagcaaaaagtttgaagaaggaagccaaccgctagaaaaatacattaccaaataaaaagtagtaagt

SEQ ID NO: 267969 - DNA, 292 bp, Homo sapiens
ttccattgcatgaaaaataattctaatttcttcttacacagtgaagtggagatattgaaaccctcgtgcatgctttatgtaaaatttatttgtaaagataactgccataaaatggaagccaatttatttttaaaacttaggtgaaaagataataggcagagtatgtaataaaaagagaacattcagttttacagagcagtgtttcagagataggaagaaaagcaattccatcaaaatttccagattttttttttccctcttaacctgactaaactactaattcatctataag

SEQ ID NO: 267970 - DNA, 961 bp, Homo sapiens
gggcgagagagctccccaggtcccttttataagggcattagtcccattcagactaatgggactaaatcagactctggctgagtgttgtggattttttgcatgttcatcctccccgcagtttgccaaggcggacaaagccgacacaatgggcctgtccactatcttctttcatatacacaaaatgtcagctcttcctgtttctgactggcaatatcccgcctgatgaccagcttagcaaattagagaccctgcacgggacttcatctctgtcttagttcgggcttctataacaatgtaccataaactgggtgggtgtcccactcagaaatgagagtgtattagtccgttttcatgctgctgacaaatacataacagagtccaggaccaaaaagaggtttaattggacttacatttccatatgactggggaggcctcagaatcatggcgggaggcaaaaggcacttcttacaaggcagcagcaagagaaaatgaggaagaagccaaagcagaaacccctgagaaacccatcagttagtgagacttactcgatatcaggagaatagcacaggaaacacccgcccccatgattcaattacctcctcctaagtccctcccacaacgcatgggaattctgggagatacaattcaagttgagatttgggtgagggcacggccaaactatatcagaaagggatgaagtgacagcatatcctgatgtgtgtgatggtttcatgagttattatctatttcaaaatttattgcaatgtgtggaaaagaacaaggacttgtactatctgactttaaggtttactataagctattagacacaaggcatcaggagtgacaaacggataaacagcctgagttagaagacctgaaattgatccacagctatacggtcaataaatgggttttcaataaaagcagttcaataaaagaaaataagtcatttcaaaaaaaa

SEQ ID NO: 267971 - DNA, 563 bp, Homo sapiens
agtgcttactcaaaacatagaaacatcaatatggagactgcagaccccagaatgataacagggtgagctatatttatatcccacggctggtgatgcctcagcacacttcactctctagaaattccgtcggcttaatttatgtggctcattcctcattccctttcagctgacaggcttcttatctttttcatttggaaacttatctgtaggagttcccaaaccctcactgtcgttcgtttttgaagtacctgcattctgtctcgagtttccggtagataagtagggctcccttagatgctgtctgcctataccccatgactgtcaaaaatgtccccaccctgggatcaggcatcagatcctaacaacactgacagagtgaagggcacgtttctccctttggtgggattttctcttccaagccattaaaacactttaagatgccttttcatatctttgctatctttagattagatgcttaatgcataaatcagcccaaatagagtgatggagtagcggggagaggctgacgcatttcctcacgtacaacccagcgtttgagtaaa

SEQ ID NO: 267972 - DNA, 538 bp, Homo sapiens
ggttcctagcacacagtaggtgcttgatatttgtatagttacaaatgaatgggtggtaagaagtaagaaccaaacaaaaggtttattctctttcccataaaacacccagtgcttggatgggttacacttcaatatgagttcaaaacagtttctctgacggttttaggattgcaagaaagaaagaagaagaaaaagatgattcagaagttagaaacatcagtgagttaggacttactgtaattttatgtattacagatacataattatgtattatgtattacagatacataattgtatctgtaaaatgaatggtagactcttccatgtcacttcttcagccacggaatgaaaagaagtcctcatttatccacttgttcatctgtggtggtgaagagcccagatctgaagcccaaagcctggagaaaaagttctgcccctcactagttagtcttagatcatatttgaccttagatcaaattaattttgctttctctcggttattgtaaaatgggggtaataaaagtacttttcttctaaa

SEQ ID NO: 267973 - DNA, 630 bp, Homo sapiens
acatctgtacttgctggatcaagtctaaagttgttatctctagcctccacccaaaaaatacaggaaatttaattttttcttagataatacattcaagtggcataaagttcaaaaagtgcaaagggtaaacagtgaaataagtccagcgtatccctagtgcagccacctagttcccatgcactaaggcagacatctttgccagtttcatgtgtattcttccagagatcttatatgtaaaacaattatatgatgaattattttggcttgatttcttttatccaagtggtaggacactgtacacactgttcttcactctagttgtttaacctagcaattgtgaaatcatgtttgatgtttgcaatgactcactttctcctcctgtgtagatggagtgtatgagaaattcattgttataacccactgggattttgcagttgttaatgcagaaaatctaactcatatagaaatacatttattgtatatcatactcaaaaatatattttgttgtttttaatggctaaatggtattccagtatatgggtgtaatataatctatttaatctgttcccttgttgatgaatattgaggttggttctaatttatgctgtttcaaacagtgctgccgtgaat

SEQ ID NO: 267974 - DNA, 275 bp, Homo sapiens
ccagaaccttagctggaccggaaaccaggctcactctacagattaggagaggagtagatgcctggaagtattcaacacacaactactgagctctgctgtgggcagcccatgattggtgaccaagatgctttccctgtctttgggaagcttggggtctagtggagtgaattgacagagggaaataattggcgatgtatcgtgctaggtgctattatagaggagaatatgacacacggtgaaggcacagtcgaagaatgtgtcattaactctgtcct

SEQ ID NO: 267975 - DNA, 561 bp, Homo sapiens
agcagtggatgcagagattctgaaactgggcagaggttccagaagacaagtcatttttctagacctcccatagacgccatcgttgatcaagccattttcattttcacgaagtattttattatggaactcctaaagaccatcagccctacctggcactggctttctggttgaaaagcagcattgtggagcctgaaacatcatcagaggcaactgcttcccctccctgtggatttaggaccgctatgtgcagagttctcctgtttgttagtttgctgtcccagttgaattctgagtttccgggaatccctagtgcaatgagaaatgatggagaaccaattctcattatctgatgaaggaaagagccatgtacctacaacagcaaaggctcagacaagccttctcctgccttgggttcatggtcacgtgctgtaggtgtcttgtcttcccatgtgcacctgtctgcatcctcatggtgcatcctcaggatgtcccgtacagtgtcttacctatggttatgcttttataacaatgtgctaataaaagcatggattacaaaacaaa

SEQ ID NO: 267976 - DNA, 803 bp, Homo sapiens
agcagtggatgcagagattctgaaactgggcagaggttccagaagacaagtcatttttctagacctcccatagacgccatcgttgatcaagccattttcattttcacgaagtattttattatggaactcctaaagaccatcagccctacctggcactggctttctggttgaaaagcagcattgtggagcctgaaacatcatcagaggcaactgcttcccctccctgtggatttaggaccgctatgtgcagaggtctgtattagagagccagctagagtagccagcagtgacataactatgtagggagaagacacagttgtcaccttgaccccactggatacagaaatgtcaatggaaaaacaaattctgcatctgctgaattgttctgtcaatgcttgcactttcttgtcatttactatatagaaagaattattagtatcttttatttgtcagttattgatccaccttttttttttttttttttttggtggcagttctcctgtttgttagtttgctgtcccagttgaattctgagtttccgggaatccctagtgcaatgagaaatgatggagaaccaattctcattatctgatgaaggaaagagccatgtacctacaacagcaaaggctcagacaagccttctcctgccttgggttcatggtcacgtgctgtaggtgtcttgtcttcccatgtgcacctgtctgcatcctcatggtgcatcctcaggatgtcccgtacagtgtcttacctatggttatgcttttataacaatgtgctaataaaagcatggattacaaaacaaa

SEQ ID NO: 267977 - DNA, 430 bp, Homo sapiens
catttgatctccaatcattatttatcatctgagagattcagatttctccctcagtctacttttggacgttcacaatgtctgcattttggagtcagaagagaaagccatgaggagaggaaaaagtaacttcaataaactatttaacacaaagaactggatggcagccgtcagcctgaatgaatcatggagtgagagactaaggtgaatagtaccttcaaggatctccaaggctccatacaaagtagtgcatggctttcagattcttcaccagagcaagggtattaaacaaaagggccccaggtgtccccctgtaagctacccaattagggttattaatttgtaaaattattttagggatttaattatgttatctttcttcagagttcatttgtattccctaatttctgtaaaggtctgctgaatatttaga

SEQ ID NO: 267978 - DNA, 259 bp, Homo sapiens
ttctttattttaggtgatggccctgtgaggtgcaattatctgtagtttaaacctcagggaattacatttaagactctcaaaatggtacatttggcaaatcatgaaacttttacattgtattaccccatcattgacctgttttgaattgtgaagataattttagctcgtttctgtcagccatatttaagacaccatgcatatacttgtgtgaagcttgtagaatgaaaataaagctgcttgggatgattatgttgacata

SEQ ID NO: 267979 - DNA, 340 bp, Homo sapiens
gactaagtaagctatggtgcccagatgtttggtcaaacatcagtctagatggtggtttttagatgtgactaacatttaaatcagtaggctttgagtaaagcagattaccctctataatatggatgggccttagccaatcagttaaaggccttaagagagaaaagactgacgtcccctgaagaagaaagaactgtctccagactgccttgggacttgagctgcaacaactcttccctgggcctgcagcctgctggcctgccctgcagaatttggacttgccagccaccagcccacacaagcatgtaaccaattccttaaaataaaatcaatgtgtatcatt

SEQ ID NO: 267980 - DNA, 450 bp, Homo sapiens
tcagtccattaaggcaacaccccacagtaaagttaaaagttcacgagcctattgactctcatccagaaaccagaaccaaccaaaccccaccatataacagggaaggcctgaggtcgcttcggaggagttagcaatcaaaggagaacagacttttggtgactcagttaccaacacacaacactcataaaactaaaattaggtgttttattttttgtctacacgggtggcgtgccactttcctttcctgattagggaagcttctcccagccctttctgacgttcatctgtgtgcctttatgttcaaacagtttaggaagcagcagccctcctaacagtcgacgcggaagcacaaatctctggaggtatttttggacacacttaaatcctatcccaagagactgaacgactgtggtgacaaatgcccacgggtaaaactgagcaagcctcatt

SEQ ID NO: 267981 - DNA, 564 bp, Homo sapiens
tctgaattacatttccccatgtgtttgtgaagtaactactgttattcccatggagaaagatgaagaaagtgatgcataatgcgggtaagtagccagggtcattcagctagccccaggagtcggatgggacccaggtttgggggactgctgcttgtgctacctcctgattactaattcagattcttcaggatcttgatacatggaagagatgtcctggttggcaggcaggagtatcctggtcaatagaaagttatatccttccattgtaagttaatgaatttggtaagcaagagtcagcccttgagcccaagcacctcttaaaagcacctctggccactgaaaaagagtttctcaactgccatcttttattcaacaaatacttattgagcagctactatgtgccaggccactggaaataaagcagagaacgagatggacaaagagctcacattctagtcggggtggacaaacatgcaaccaaataagcaagactagttttcgatatgtgagatgctatgaagacaataaaatggtatgataaataatgactaagggagtcagtaa

SEQ ID NO: 267982 - DNA, 552 bp, Homo sapiens
cagcaaactgtaactttatatgaactcttaacttctgtaatagccacattttaatttcttaaaggtgtggtcaattcagtttaacatgagttaataatttaatattaattttcttctgcatagttagtaactttctaaagtatatattatataggagagataacaaatatgtaatatgatctctagggcctgtagcaaatagttattattaatcaggagacaaaattgttagctaggcagccactacaaatcaatttaagttggtacttaaaatgtaacttcacagtagcttacacctataattcttgggatgccgaggcagaaggattgcttgagactaggagttcaagaccagcctcggcatcatagagctacaaaaaagttttaaagattagctgagcatggtggtgcacacctgtagttccagctacttgaagactgaagcaggaggatcacttgagtccaggagtttggtgttacagtgagctatgatggcaccactgcactccagcctgggccacagagtaagaacatgtctttaagaaaaaaaaa

SEQ ID NO: 267983 - DNA, 493 bp, Homo sapiens
cagcaaactgtaactttatatgaactcttaacttctgtaatagccacattttaatttcttaaaggtgtggtcaattcagtttaacatgagttaataatttaatattaattttcttctgcatagttagtaactttctaaagtatatattatataggagagataacaaatatgtaatatgatctctagggcctgtagcaaatagttattattaatcaggagacaaaattgttagctaggcagccactacaaatcaatttaagttggtacttaaaatgtaacttcacagtagcttacacctataattcttgggatctacaaaaaagttttaaagattagctgagcatggtggtgcacacctgtagttccagctacttgaagactgaagcaggaggatcacttgagtccaggagtttggtgttacagtgagctatgatggcaccactgcactccagcctgggccacagagtaagaacatgtctttaagaaaaaaaaa

SEQ ID NO: 267984 - DNA, 486 bp, Homo sapiens
cagattgacttccaaagattgcggggaaatatggcggcacatcagaggcatacgaacattcacctgcattgagaagagaggctgttctaggggtggcaggaacacatgaaagcccagtgtctggggtagttaagtgtacaagcaaatagagttaaggaacctggcacctttcagatacaggagttctgatgacactgttatcaagaaaagttttgcctatgcttagtattttctatttaagagagttggaaaatctatatctttgagggtttccaataaaagttattttggctgtttatgtgaataaatatccaaaaacttcagttcatcgagcattatgtttcatgttaataccaatgtaacacagtatgactggctaggttgctgaagacagttgaaaaatgtatttttgtggagttcactattttctgaaatttattcaatttatttattataaatagtaaagttcgtaaaagtctggttttt

SEQ ID NO: 267985 - DNA, 112 bp, Homo sapiens
atgtcttcaactctacaagatactacctagaattcaggttttatagttaactatttatcagtccgaattactcccaagccaagaatatagtcagcagaccaccccccccacc

SEQ ID NO: 267986 - DNA, 470 bp, Homo sapiens
acattaggcagggcaatttttgagtgagctaaattctaatttttttaattttaatttttatttatttattttttggctgttcaactaaaccagtcttttgaatgttgggggttttacagttagagtcctgatgactttttcttgtttactgttgttaaaaatcactacctccagtggtcacagagaatgagtaagagaactggctgtgcatatcaagatgaagtatggtgtaagaaatatttcagagcatgtcctttggcccaagattgagccatttggacacctaagcaggattggctgaatgttatcctttctgctgaggcatcagtggagatgatcattagtggtggccgaaaagtgttgtcgaaggtgctcttgcttgacacacttccaatgcgggacatagtttgagtgatagatggctaattcattgataatgtacttgttgccttgcagtcttgtgtactgct

SEQ ID NO: 267987 - DNA, 419 bp, Homo sapiens
tatacatcttactcaaggcccactattattgtagaattcttttacaccagtgatttctgatcatttctatgatatattagtttgggagagattagaaattgaagaggaaggccaggcatggtggctcatgcctgtaatcccaacactttgggaggcagaggcaggatgattgcttgaaccaggagtttgagaccagcccgggcaatacagggagcccccacctctacaaaaaaataaaataaaataattagctgggcatggtggtgcatacctgtggtcccagctccttcaggaggctgaggtgggaggatcccttgagcccaggagggaaaggctgtgtcgagctgtgattgtaccattgtactccagcctcggtgacagaaagagatcctgtatcaaaaaagaacgaaggaacgaaa

SEQ ID NO: 267988 - DNA, 569 bp, Homo sapiens
gaaaggagagctcgacaaatcaacaattacggctggatgtttcaacacccttctttcaacaataggtagaataactagatggaaattcagcaagaacataaaggagcaccatcatcgacaggcagggcctaatgatgtttatagaatatgccacccattgcactgaatgacatgtcacattttctgggatgtagttaaactagtgatgagagagaaagcaccaaatgcatacattagaaaagagacctgagattttagaaagaggaaggatctcaaatcaataatctgacatcagctggatgccgtggaagcacctgtagtcccagctactcaggaggctgaggtgggaggactgtgtgaacccaggacgttaacgccagcctcttggcatcaggcagcacaggaagaccccatcgcttaaaaaataataataatctagctcaagatcacatgaataactaggaaaaaatttaaagcaaggagcagtaagaaaatagtaaaaagcagaaaatgaaactgaaaacaaacaatagagaaacttattgaaacaaagagatggttcttttaaa

SEQ ID NO: 267989 - DNA, 386 bp, Homo sapiens
ctagtttgtagataccaaactccaagtcttacagctcccttagctgttaaattcaaatgtatgcctctgcaaaataacaaataactacatattgtgagcatcgatgtttaagtatgattaaaacattgtcaatgagcaactacagacaaaattgtgatgacatgatgcatctggaaagacgtagaacagctttgttttctgaaaatcaatcatgtgtcagtcactgtgctaggtgttttcagatgtttctcttatttaaatatccacaatgtggactaccaccaataaccaacatttgtgaagcaaaaactaggatattatactttcagtgctctatatacagtatctaattaatgttcacagtaacactgtaatgtagttattat

SEQ ID NO: 267990 - DNA, 1240 bp, Homo sapiens
tgccaacttaactgagattctgagtgtgcaaggataacccccgtcatggccccgggtgccaaggaaatcccttttagcctcctcttggcagacttggccagccttccccagtgacagcctggctctttggattcaagctgcctggtcagactgcaagggtcatctgtacaaagaaggaagcaacagtgccaggttccagcgtgcgttccaagttccacattctgtgtgcagactcccaacgccagagcaaaggcaggcccctggcaggggactgctgagaaagtggaactccagagacactcctgaaattgtcctaagtcaaaggagccaaacggtgtacgagctccctctctgccgtcccctctgagagcagccatggccctgagtgatgtcgatgtgaaaaagcagattaagcacatgatggctttcattgagcaggaagccaatgagaaagcagaggaaatcgatgccaaggctgaggaagagtttaacattgagaaaggacgcctcgtgcaaacccaacgactgaagattatggagtattatgagaaaaaggagaagcagatagagcagcagaagaaaatcctgatgtccaccatgaggaatcaggcgaggctgaaagtcctgagagcccgaaatgacctcatctcagatttgctcagtgaggcgaagctgagactcagcaggattgtggaggacccagaggtctaccaggggctgctggataaactggtgctccagggtctgctccgactgctggaacctgtgatgattgtacgctgccggccacaagacctcctcctggtggaggctgctgtacaaaaagccatccccgagtacatgacaatttcccagaaacatgtggaggtccagattgataaagaggcatacctggctgtgaatgcagctggaggtgtggaggtctacagtggcaatcagagaataaaggtttcaaataccttggaaagccgactggatctctcagccaagcaaaagatgccagaaatacgaatggccttgtttggtgctaacaccaacagaaagttctttatataagcctctgggaagtgaagctagtgttgaaccactaaaccataaaagtttaagttttttggggaaaggaaactagtagtgtttcctcctctttgatgctctgatactgttctgtttttcttcacgaaataccctttggatagctaaagtgttaactttgaaataaagcccaaattaatgctcagaa

SEQ ID NO: 267991 - DNA, 912 bp, Homo sapiens
gtggtggcggtccttgagctggaaagcaggaaccctggcttattgcgtggtcccccccaccaccaccaccccacgccttccgtagcacgagctttaatcatttactatgaaaccggtaactaagggagatacagcgtgttgaaccactgaagcacgcccctccacacacacaccagccagaaaaaggataccccgtcggctccggacccggcaaatgtacctgggctccccctggaggccacattctccgaggtcgcctttcggtccccaatgttcctcaaaggtattccgttgtaatcccggagaactgatacacactagtgctctgaaacttggcctgtgctcgaggcggcaacccctgcccctctgcctggcgatgccggaacacacccatctggccaggtcctgttcactggccaagaatgcagcattgaacactgggcattggggcgggggtgcactctgcgctgacaccgcacccctcccctcaacttgctgactagaggaggcctgaactctcaaactccgaatctgatttccactctcccaggaaggcttcggaaatcactgtggattgtcaatacaggagtccatactgactgaatccctaattttggcctgtattcttctccctctgtgaaccatcttcttagaagtcactgaaccaagagtgccagaaaaccatcccaagactcacacagagttgttcttccatagtggatgttttggccactggacatcagaaccacattttgggtttgaagaatcttctacatggtgagccttggtgggaagaaaagaatatcccttccttatagaagctgaagttacagactcttgctttccttgtctgacttaaaagctagtgtgagccagagttaaatacagggcacattgtctctggaggctgca

SEQ ID NO: 267992 - DNA, 1169 bp, Homo sapiens
  misc_feature (670)..(670): n is a, c, g, or t
gtggtggcggtccttgagctggaaagcaggaaccctggcttattgcgtggtcccccccaccaccaccaccccacgccttccgtagcacgagctttaatcatttactatgaaaccggtaactaagggagatacagcgtgttgaaccactgaagcacgcccctccacacacacaccagccagaaaaaggataccccgtcggctccggacccggcaaatgtacctgggctccccctggaggccacattctccgaggtcgcctttcggtccccaatgttcctcaaaggtattccgttgtaatcccggagaactgatacacactagtgctctgaaacttggcctgtgctcgaggcggcaacccctgcccctctgcctggcgatgccggaacacacccatctggccaggtcctgttcactggccaagaatgcagcattgaacactgggcattggggcgggggtgcactctgcgctgacaccgcacccctcccctcaacttgctgactagaggtaatcgcttcctttcatcgattcacagcgttagaaaaatgcagcattgagaggcagcgcggaggtcaactggaccatcacccttaggttgtagggaagaaaactgagacctagaaaggtgaagcggttgtcccaaaggcttccagctgctcccagtactcaagnacttggagcacacttggggaaatgctcactgttgtattcccgttcctcactatccaggaggcctgaactctcaaactccgaatctgatttccactctcccaggaaggcttcggaaatcactgtggattgtcaatacaggagtccatactgactgaatccctaattttggcctgtattcttctccctctgtgaaccatcttcttagaagtcactgaaccaagagtgccagaaaaccatcccaagactcacacagagttgttcttccatagtggatgttttggccactggacatcagaaccacattttgggtttgaagaatcttctacatgtgatgatccagtaaatgatttcatagtccaccaaacggtcacggttcacacttggagacacccaatgcaggtctctgctggctgagtgcactggcttgtggctggaggtgagtgctcaggaccacagagggataaagaacctctataactcaacaacaacaaaaaaaaaa

SEQ ID NO: 267993 - DNA, 1175 bp, Homo sapiens
  misc_feature (51)..(51): n is a, c, g, or t
  misc_feature (1065)..(1065): n is a, c, g, or t
tattaaattattctttttattggtccggaattcccgggaaggcaggccccnggcaggggactgctgagaaagtggaactccagagacactcctgaaattgtcctaagtcaaaggagccaaacggtgtacgagctccctctctgccgtcccctctgagagcagccatggccctgagtgatgtcgatgtgaaaaagcagattaagcacatgatggctttcattgagcaggaagccaatgagaaagcagaggaaatcgatgccaaggctgaggaagagtttaacattgagaaaggacgcctcgtgcaaacccaacgactgaagattatggagtattatgagaaaaaggagaagcagatagagcagcagaagaaaatcctgatgtccaccatgaggaatcaggcgaggctgaaagtcctgagagcccgaaatgacctcatctcagatttgctcagtgaggcgaagctgagactcagcaggattgtggaggacccagaggtctaccaggggctgctggataaactggtgctccagggtctgctccgactgctggaacctgtgatgattgtacgctgccggccacaagacctcctcctggtggaggctgctgtacaaaaagccatccccgagtacatgacaatttcccagaaacatgtggaggtccagattgataaagaggcatacctggctgtgaatgcagctggaggtgtggaggtctacagtggcaatcagagaataaaggtttcaaataccttggaaagccgactggatctctcagccaagcaaaagatgccagaaatacgaatggccttgtttggtgctaacaccaacagaaagttctttatataagcctctgggaagtgaagctagtgttgaaccactaaaccataaaagtttaagttttttggggaaaggaaactagtagtgtttcctcctctttgatgctctgatactgttctgtttttcttcacgaaataccctttggatagctaaagtgttaactttgaaataaagcccaaattaatgctcagaaaaaaaaaaaaaaaaaactcgagactagtcgatgccntatgtgcttcccaagctgtatgtgaagctacattactgtgtgagttgtgcaattcacagcaaagtagtcaggaatcgatctcgtgaagcccgcaaggaccgaacaccccc

SEQ ID NO: 267994 - DNA, 1716 bp, Homo sapiens
  misc_feature (1606)..(1606): n is a, c, g, or t
gccggcgcacccgagccccactccctgcgagggccgcgcggaggggcgcgcaggaggaggaggagccgaggaccgcggaggggaggaggggagtcgcctggggagccgagggctcctcgcgcaagtgcccgcagcgcccggaagcgtccaaaggccccgatgctgggagaagacgtggaggcctctcggggaaccacgacgacctccacgatgacgcaatagtcatgccaaattatacatgcatatttcacctccacccggaaggccagagccatcctctcggcctctaagtgcacaacggaactagaaatcaaggaggagagaccaaaagggaggcctgaactctcaaactccgaatctgatttccactctcccaggaaggcttcggaaatcactgtggattgtcaatacaggagtccatactgactgaatccctaattttggcctgtattcttctccctctgtgaaccatcttcttagaagtcactgaaccaagagtgccagaaaaccatcccaagactcacacagagttgttcttccatagtggatgttttggccactggacatcagaaccacattttgggtttgaagaatcttctacatgctgagaaagtggaactccagagacactcctgaaattgtcctaagtcaaaggagccaaacggtgtacgagctccctctctgccgtcccctctgagagcagccatggccctgagtgatgtcgatgtgaaaaagcagattaagcacatgatggctttcattgagcaggaagccaatgagaaagcagaggaaatcgatgccaaggctgaggaagagtttaacattgagaaaggacgcctcgtgcaaacccaacgactgaagattatggagtattatgagaaaaaggagaagcagatagagcagcagaagaaaatcctgatgtccaccatgaggaatcaggcgaggctgaaagtcctgagagcccgaaatgacctcatctcagatttgctcagtgaggcgaagctgagactcagcaggattgtggaggacccagaggtctaccaggggctgctggataaactggtgctccagggtctgctccgactgctggaacctgtgatgattgtacgctgccggccacaagacctcctcctggtggaggctgctgtacaaaaagccatccccgagtacatgacaatttcccagaaacatgtggaggtccagattgataaagaggcatacctggctgtgaatgcagctggaggtgtggaggtctacagtggcaatcagagaataaaggtttcaaataccttggaaagccgactggatctctcagccaagcaaaagatgccagaaatacgaatggccttgtttggtgctaacaccaacagaaagttctttatataagcctctgggaagtgaagctagtgttgaaccactaaaccataaaagtttaagttttttggggaaaggaaactagtagtgtttcctcctctttgatgctctgatactgttctgtttttcttcacgaaataccctttggatagctaaagtgttaactttgaaataaagcccaaattaatgctcagaaaaaaaaaaaaaaaaaactcgagactagtcgatgccntatgtgcttcccaagctgtatgtgaagctacattactgtgtgagttgtgcaattcacagcaaagtagtcaggaatcgatctcgtgaagcccgcaaggaccgaacaccccc

SEQ ID NO: 267995 - DNA, 1889 bp, Homo sapiens
  misc_feature (1779)..(1779): n is a, c, g, or t
gtggtggcggtccttgagctggaaagcaggaaccctggcttattgcgtggtcccccccaccaccaccaccccacgccttccgtagcacgagctttaatcatttactatgaaaccggtaactaagggagatacagcgtgttgaaccactgaagcacgcccctccacacacacaccagccagaaaaaggataccccgtcggctccggacccggcaaatgtacctgggctccccctggaggccacattctccgaggtcgcctttcggtccccaatgttcctcaaaggtattccgttgtaatcccggagaactgatacacactagtgctctgaaacttggcctgtgctcgaggcggcaacccctgcccctctgcctggcgatgccggaacacacccatctggccaggtcctgttcactggccaagaatgcagcattgaacactgggcattggggcgggggtgcactctgcgctgacaccgcacccctcccctcaacttgctgactagaggaggcctgaactctcaaactccgaatctgatttccactctcccaggaaggcttcggaaatcactgtggattgtcaatacaggagtccatactgactgaatccctaattttggcctgtattcttctccctctgtgaaccatcttcttagaagtcactgaaccaagagtgccagaaaaccatcccaagactcacacagagttgttcttccatagtggatgttttggccactggacatcagaaccacattttgggtttgaagaatcttctacatgctgagaaagtggaactccagagacactcctgaaattgtcctaagtcaaaggagccaaacggtgtacgagctccctctctgccgtcccctctgagagcagccatggccctgagtgatgtcgatgtgaaaaagcagattaagcacatgatggctttcattgagcaggaagccaatgagaaagcagaggaaatcgatgccaaggctgaggaagagtttaacattgagaaaggacgcctcgtgcaaacccaacgactgaagattatggagtattatgagaaaaaggagaagcagatagagcagcagaagaaaatcctgatgtccaccatgaggaatcaggcgaggctgaaagtcctgagagcccgaaatgacctcatctcagatttgctcagtgaggcgaagctgagactcagcaggattgtggaggacccagaggtctaccaggggctgctggataaactggtgctccagggtctgctccgactgctggaacctgtgatgattgtacgctgccggccacaagacctcctcctggtggaggctgctgtacaaaaagccatccccgagtacatgacaatttcccagaaacatgtggaggtccagattgataaagaggcatacctggctgtgaatgcagctggaggtgtggaggtctacagtggcaatcagagaataaaggtttcaaataccttggaaagccgactggatctctcagccaagcaaaagatgccagaaatacgaatggccttgtttggtgctaacaccaacagaaagttctttatataagcctctgggaagtgaagctagtgttgaaccactaaaccataaaagtttaagttttttggggaaaggaaactagtagtgtttcctcctctttgatgctctgatactgttctgtttttcttcacgaaataccctttggatagctaaagtgttaactttgaaataaagcccaaattaatgctcagaaaaaaaaaaaaaaaaaactcgagactagtcgatgccntatgtgcttcccaagctgtatgtgaagctacattactgtgtgagttgtgcaattcacagcaaagtagtcaggaatcgatctcgtgaagcccgcaaggaccgaacaccccc

SEQ ID NO: 267996 - DNA, 1468 bp, Homo sapiens
  misc_feature (670)..(670): n is a, c, g, or t
gtggtggcggtccttgagctggaaagcaggaaccctggcttattgcgtggtcccccccaccaccaccaccccacgccttccgtagcacgagctttaatcatttactatgaaaccggtaactaagggagatacagcgtgttgaaccactgaagcacgcccctccacacacacaccagccagaaaaaggataccccgtcggctccggacccggcaaatgtacctgggctccccctggaggccacattctccgaggtcgcctttcggtccccaatgttcctcaaaggtattccgttgtaatcccggagaactgatacacactagtgctctgaaacttggcctgtgctcgaggcggcaacccctgcccctctgcctggcgatgccggaacacacccatctggccaggtcctgttcactggccaagaatgcagcattgaacactgggcattggggcgggggtgcactctgcgctgacaccgcacccctcccctcaacttgctgactagaggtaatcgcttcctttcatcgattcacagcgttagaaaaatgcagcattgagaggcagcgcggaggtcaactggaccatcacccttaggttgtagggaagaaaactgagacctagaaaggtgaagcggttgtcccaaaggcttccagctgctcccagtactcaagnacttggagcacacttggggaaatgctcactgttgtattcccgttcctcactatccaggaggcctgaactctcaaactccgaatctgatttccactctcccaggaaggcttcggaaatcacttttttcttcttctctatgagtcaactttctactcagcataccttctttcctggaagcaaaatggttgcaccaagtccaggcatcaccatccatataccatgttttccagaaggaaagagagcttctcttgacccactcattgaacaaagtcttgaacttcttctgattagctcaacttagttcatccctgaaccagtcatggtggattgtcaatacaggagtccatactgactgaatccctaattttggcctgtattcttctccctctgtgaaccatcttcttagaagtcactgaaccaagagtgccagaaaaccatcccaagactcacacagagttgttcttccatagtggatgttttggccactggacatcagaaccacattttgggtttgaagaatcttctacatgtgatgatccagtaaatgatttcatagtccaccaaacggtcacggttcacacttggagacacccaatgcaggtctctgctggctgagtgcactggcttgtggctggaggtgagaaagggggactccgagaaacccccgaaaaggctaaatcaaagggcccaacgggggaaggacccctctgggggcctgggaaagcaaggcccaagagggggaacgcaaacccaggggctagggaggcgaaaagaaagcacgggggaaagaaaaaaacc

SEQ ID NO: 267997 - DNA, 1386 bp, Homo sapiens
  misc_feature (1276)..(1276): n is a, c, g, or t
tgccaacttaactgagattctgagtgtgcaaggataacccccgtcatggccccgggtgccaaggaaatcccttttagcctcctcttggcagacttggccagccttccccagtgacagcctggctctttggattcaagctgcctggtcagactgcaagggtcatctgtacaaagaaggaagcaacagtgccaggttccagcgtgcgttccaagttccacattctgtgtgcagactcccaacgccagagcaaaggcaggcccctggcaggggactgctgagaaagtggaactccagagacactcctgaaattgtcctaagtcaaaggagccaaacggtgtacgagctccctctctgccgtcccctctgagagcagccatggccctgagtgatgtcgatgtgaaaaagcagattaagcacatgatggctttcattgagcaggaagccaatgagaaagcagaggaaatcgatgccaaggctgaggaagagtttaacattgagaaaggacgcctcgtgcaaacccaacgactgaagattatggagtattatgagaaaaaggagaagcagatagagcagcagaagaaaatcctgatgtccaccatgaggaatcaggcgaggctgaaagtcctgagagcccgaaatgacctcatctcagatttgctcagtgaggcgaagctgagactcagcaggattgtggaggacccagaggtctaccaggggctgctggataaactggtgctccagggtctgctccgactgctggaacctgtgatgattgtacgctgccggccacaagacctcctcctggtggaggctgctgtacaaaaagccatccccgagtacatgacaatttcccagaaacatgtggaggtccagattgataaagaggcatacctggctgtgaatgcagctggaggtgtggaggtctacagtggcaatcagagaataaaggtttcaaataccttggaaagccgactggatctctcagccaagcaaaagatgccagaaatacgaatggccttgtttggtgctaacaccaacagaaagttctttatataagcctctgggaagtgaagctagtgttgaaccactaaaccataaaagtttaagttttttggggaaaggaaactagtagtgtttcctcctctttgatgctctgatactgttctgtttttcttcacgaaataccctttggatagctaaagtgttaactttgaaataaagcccaaattaatgctcagaaaaaaaaaaaaaaaaaactcgagactagtcgatgccntatgtgcttcccaagctgtatgtgaagctacattactgtgtgagttgtgcaattcacagcaaagtagtcaggaatcgatctcgtgaagcccgcaaggaccgaacaccccc

SEQ ID NO: 267998 - DNA, 378 bp, Homo sapiens
ggcttcacatccagtaaagtaaaaaggtaaacagaatttttaaagaagagggtgaaggccgggcgcagtggctcatgcctgtaattccagtactttgggaggccaaggcgggcagatcatctgaggtcaggagttagagaccagtctgaccaacatggagaaaccccgtctctactaaaaatacaaaattagctgagcgtggtggcgcatgcctgtaatcccagctactctggaggctaaggcaggagaattgcttgaacctgggaggcggaggttgcagtgagccgagatggcaccattgcactgcagcctggatgacagagcgagagtccttctcaagatatctttctacttatccattgaccaatttgttttggt

SEQ ID NO: 267999 - DNA, 520 bp, Homo sapiens
cgccactacgcccggctaactttttgtatttttagtagagacggggtttcactgtggtctcaatctcctgacctcgtgatctgcccgcctcggcctcccaaagtgctgggattacaggcgtgagccaccgcgcccggcccccttttgttattatctccccacctggcttctttgcacactggatggacttcctcctggttctccttggagcctcagcagactcggaagcctaccctcgtaagaaacccactgctgccaagccagaattctgagaggcggaatcctcttctctccctaagactcacgaaagggatgcttgttgccagggaagatgcttgagtcccctcctctccctcatgctcacagaagatgaagttggagcttcatcttcagcgggaggagggaggtgcaggatcacgtggaccaccggagaggaaaagcccctctctttaaactggagtcttaagaggctatgcttgagatctcaccagctcctagctttacctggtgaaatgagcct

SEQ ID NO: 268000 - DNA, 552 bp, Homo sapiens
ctaagggggaaaaagaggaagcaggtgggtttgaaagaaggaaaaaaggagtatctagcattttctttttaaaatgtcattcttgatttatttggtggcacaaagtgattttcttacgtttctcagactgcttgagtcagtctatatagaggctattcctggatcttagttgaaagctgttgcctttctaattgtttaactgatcacttctgaacgacaattacagttcattgttattccctgttaaaaaaccattgacatccatccaaaagttatagcttacaggtcagggaatatttatgtgatatttatagtctgtgaagaaaaccctggggaactgccagtagggaggattatttaccaatttctttttcttcaagtttgaatttatttgagatttatatccaaaagacattttgtaatcctgtgtaactctgatgtgtgactataattgtgcatgttggtcaagttcaaggaaaaaaaaaatcttttttctttttaatagtgggggctgggaaccctggttgattccactaaaaacatcacagacca

SEQ ID NO: 268001 - DNA, 519 bp, Homo sapiens
cataaacagattttggtcctggactgctgcacggcctaagaatttctttgttttacaataaagcaacttttaacgaatatctccatagaatggtacaaggctggatggctggatttaagagcaggggctaatgtcacagggagcaaattctatagatgcctgttctatgaggcagtatagcttaacgataaggagtagacagacaacctaatgttaaatcctagttcagtaacttgttaacttgataacccccggcaagattcttaacatctgcatcttcatctgtaaaatggtagtaaaatggtagtaaaactaatgattgtatctattttacagggttgttattaagggatgatatggtttggctgtgtccccacccaaatctcatcttgaattatagctcccataatccccgcatgtcatgggagggacccagtgggaggtaattgaatcatgggggcaggttttttttcatgctgttctcatgattgtgaataagtctcatgagatctgattaaa

SEQ ID NO: 268002 - DNA, 634 bp, Homo sapiens
ataacttcctctcctcccacctcctgaagtatatacgtccctaccaacaacttggagaaggaaataagagtcaaaaatcattttttaaataatgaagtagataccataataatccctttttgtcaggtgataaaactgagacacagagagaaaataacttatttcaacttatttcacacagataataagtggtccagctaggatttgaatccagacggcttggctccagagcctgagcacttcactggtacaccctgaaggaagggggcaaccaaggccaaggccccagagtactctacctacatttctctaacacaaaactgtgtgaggcaggtactattaccgtgcacactttttagatgaggaaacaaaatcttggagaagttgctatgggcacagggtcatctgaatacaagtgggcaagtggagtgtaatttagttattttgctatgtaggctgaggtcagaattaaaagcaaaaaattagctggaagaagacttatgcctaggccgggtgtgatggttcgcggctgtagttccagcactttgggagcctgaggtgggaggatcgcttgagcccaggagttcaagaccagcctgggcaacatggcgaaaccttgtctctactaaaaata

SEQ ID NO: 268003 - DNA, 725 bp, Homo sapiens
gtgaaggcggagccaagaaggggaagagccatcactagagcccacggggcgttctgcttgcttcccctgggacccacgcggctcaggcccagggagtcgcggacccgggcgtttcctgggatgctgggtctgccgcctgcgagggtcaggacggggcgaaggccattccgctgcccttccagcttcggaatcacccaatgcacggcaagatgtgccggcaagatgtgcctctcaggttttccgaggctttggagcctgcacagttgttctacaaaaggcagtagctccgccgaacgttggatcgtcccttgctgtctggtgataccagaacgagagttgactgtgtgtctcagtcggttggtatgcttgcttccaagcctggagaagcatgccatacctaagacctactaccctgagaagcagtgaagtgctcctggggcccaccaaggccacacaagtcaaggagtggatggccttgctccagctactgctcagatcacctttgcaagatgacattgtgttgggagatggtcatcagagccagggccatggaagatgctgtcaggaggcacgaggaaaggctatgggagcacaaagcaagaaagtggccttctgcaagccaggaagagaggcctccccagaaaccaactctgtgagctcatcgatctttgacttttggcctccagaacattgagaaaataaaagtctgttgttaaaccacaaaa

SEQ ID NO: 268004 - DNA, 671 bp, Homo sapiens
gtgaaggcggagccaagaaggggaagagccatcactagagcccacggggcgttctgcttgcttcccctgggacccacgcggctcaggcccagggagtcgcggacccgggcgtttcctgggatgctgggtctgccgcctgcgagggtcaggacggggcgaaggccattccgctgcccttccagcttcggaatcacccaatgcacggcaagatgtgccggcaagatgtgcctctcaggttttccgaggctttggagcctgcacagttgttctacaaaaggcagtagctccgccgaacgttggatcgtcccttgctgtctggtgataccagaaaagcatgccatacctaagacctactaccctgagaagcagtgaagtgctcctggggcccaccaaggccacacaagtcaaggagtggatggccttgctccagctactgctcagatcacctttgcaagatgacattgtgttgggagatggtcatcagagccagggccatggaagatgctgtcaggaggcacgaggaaaggctatgggagcacaaagcaagaaagtggccttctgcaagccaggaagagaggcctccccagaaaccaactctgtgagctcatcgatctttgacttttggcctccagaacattgagaaaataaaagtctgttgttaaaccacaaaa

SEQ ID NO: 268005 - DNA, 397 bp, Homo sapiens
gcattaaaaaacaaagaatcagagaatcataaaaaatgaggcacatgcatattatataattttttaagaaaataaataatagaaatcaagtgatgattaactctaggcaaaaataaagaggttctacaagaacgaaagcatggtcatgtacactacttggctctgtagtgcacaatgtttgcataattatcataatgtaaacactgaccaccagattcaaccaaaatttatgatagaatcacaagaggaatgataggtggaaagtatgatgtatgagagttaagtcctcatttctcatggcagtaaactaacagatgctacctaaaattaaaagatcaagaaatctcattatacacacattgttgagaaacatggagataaataccagaaaaaacag

SEQ ID NO: 268006 - DNA, 360 bp, Homo sapiens
gccccatctcctcctatcatcacatttggagttaggatttcaacacatgaacttgagggtggacacatacattcggtccataacaactcctattaaatcaaatgtccagaatgagtcaacctatggagacagaaggtggatgcgtgggtgcctgtggctgggtgtgcgtgcctgtggggaatggggagtgccgcttaatgagtttctttttgaggtgatgacgctgtcctaaaactgattgtggtggtggttgtacaacttcattactatatatacaacattgaattgtagacttatgtgggtgaattgtgtggtttgtgaactatatatccataaagccattattttaaaaatctaatc

SEQ ID NO: 268007 - DNA, 449 bp, Homo sapiens
ggaatgcctgtggggtgtgacagcagcccctgagtgaagagctgtgcccaaccccagctaagccctcaggacccaggacaaggggccttcttctacataggagagtggcctcatcagcatcccacatagagggaggcagacaggccctgcaaaccttcctctaaacttcacgcatctcctcggaagtccctataataatgacaagtaggtttattgagcactaatgggctgggtgcttggctaagtggtttatgtcagcatctcatttaattctccgaagaaccttgtatgctagtattatggggagcctgtctagtgggtcagaaaatatgaccgacaataaaaatttgaagacaataacaacaataataacattaacaaaggaaacaatgcttcccagagatctaaggaagggaaattaatgtctgatgaagggatgattaaagtga

SEQ ID NO: 268008 - DNA, 585 bp, Homo sapiens
gtctcccccacattaggcttttgcatcccagcagttctgacacttcagacttcattgcacagcctagtttccctttagaagaagggaacggtcccattccagttgatggtggcctcgctccacttggttctgattgccatctccactggtgaaaaccgtcgtcttggtccatgtttctcttcctgttggtctctttcccagtgatgggagtgagtatctgaagaaggaatagccagcatttagacccaagcctatgaacaccattccagaggaaaccactaaagaaggacagaagggtgggtgggcaggagtcaggcttggaaaattgtgctcctacaactggttaagcagatggggattcaagcaggtagtgtgttgaaatgccccatacagaatgagtcagtggtagcctgggttgttgtgcatattaggacgtagtatgtgtgttgaaacgccccatacagaatgagtcagtggtaacctgggttgttgtgcataactgttgataagctatgtaatacaccttcccgtaccatgatgtgacacctagaaccaggtataggttactaaatattgtcaggaaaa

SEQ ID NO: 268009 - DNA, 858 bp, Homo sapiens
cgcgaccctcttctttgcgtagagtttttcaggttgctcctggaaaccatgccgaaagtagtgtctcggtcagtagtctgctctgacactcgggaccgggaggaatatgacgacggcgagaagcccctccatgtgtactactgtttgtgcggccaggtggtcctagtgctggactgtcagttagagaaattgcccatgaggccccgggaccggtcccgtgtgattgatgctgccaaacatgcccataagttttgtaacacagaagacgaagagactatgtatctgcggagacctgaaggcattgaactacagtacagaaagaaatgtgcaaagtgtggactgctgctcttctaccaatcccagccgaagaatgctcccgttaccttcattgtggatggagcagtcgtcaagtttggccagggctttgggaaaacgaacatatatactcagaaacaagagcctcctaagaaggtgatgatgaccaaacggaccaaagacatgggcaagttcagttctgtcactgtgtctaccattgatgaagaggaagaggagattgaggctagggaagttgctgactcgtatgcacagaatgccaaagtgattgaaaaacagctggagcgcaaaggcatgagcaagaggccactgcaagagctggctgaatgggaaccccaggaaaagtgaaaatgaaggggacccttgattgacaaccagttcaaataaccaggctttttttctgagccctagactggaggcaagcatttagatcaggagacaaagtaacttcttgattacatagactggttcctatttatatcccagcagaaggctttatgttgtttcccattgattctcctacat

SEQ ID NO: 268010 - DNA, 386 bp, Homo sapiens
aactattccataaaaagcactgtgatgctacacataatatgactttgtcttaattcaggagatgtattacatttttcttgtttttaatgcaaattccatgcatgggccagctaatgtgaaataatttaattaccttgctaggttaacactatcatctaaaaaacagaagttatttttaaaacattctgtgagagtttggacttctctcagcctaaccctaattctacaaatccccaaaattccaactgcagagatccaacatgcagctatctaactcatcccacatggctcaaatctttacatgacttagaagtatagattatcaatcaaagcaaatgggagaatggattgatttgtgaaatggcaacaggtccctcatgggagac

SEQ ID NO: 268011 - DNA, 678 bp, Homo sapiens
gaaagtcacatttctcagctggattccatttcactctcacttaagtggaaccagccaatgtgcacccaggacaggatccaaggtggggacccatggaaggagcacaggcctccagcgctgcgaaggcatgggcaccactccaggcccacatcctcttggagaagagcaagagagtggaagaagcaggaaacgttatttacccgcctcagaagtcacccaagagctcgtgaaattgggcagggactgtggtaacataaagtttcaagttcaaagtttatgtgtccttccttactcccggtggagtgggctcatgagaatatccaagtgtttataaaggataaagaacccacattttctttgcacatctggctggaaagtgagaaatgtataaatttttgaagaaactgaagggactgtcatacatctgtaataatgatacacgtaaagtctgtggaataacatgaaaaatctgtaagatgtaccattaagcgagcaaagaataaaacttgtgtgtttgattttaaccgtgtaaaatcaaatacttttgagtaaaacctggaaaaaacatgaggaaaataaaaccaactatcactgtggtaggagtgtaggtggatttttaaaaaatcctctcgtcttatttattaagaataaaataaggttgttaattcatttttttga

SEQ ID NO: 268012 - DNA, 446 bp, Homo sapiens
atggtctcgatctcttgacctcgtgatctgcccgcctcggcctcccaaagtgctgggattacaggtgtgagccactgcgcctggcccgcatgtattacatttataattaaaaattcacaactcaatgtcaagtgtgaaccttgtgttgaccctgatttgagcaagcaataaaaagatatttttgagacatttagattatgaatttcacatttgatgatagttactattaattttgtgaggtgtgatattggcaatgtggttagatgacttcagagaaaaaggaaggtatagttaagcaagtatggcaacatctaataacttgggtctaggtgatgtgtatgggtttcattatactgtcctctttactgttgtatgtatttgaaaacattcatgacaaaaaaactttttaatcagttaaataaaccatgaagaacggttaaagaagt

SEQ ID NO: 268013 - DNA, 415 bp, Homo sapiens
aatgtctcagcatttcaaaatattaattataacagtagtcaattagaaatgtttctggcaactttctaactctgaaagtgttttctaataataactattggtgatattaataaagaatcttgggaaaaaggaacaactatataaaattatatttctcaatacacattactattatctcttatgtctgttgcatatttttatttgtttacttagtgccaaaatcctggaactgtgcttgtgggacatgtacaaagaaagtgtctctcgtctctgaggtctttcctgattcatcaaaatgtattaggaaagaaaagtgactgtcttggcaaagaaccacagtattttgctgcatttgtttgtttttattaacacaactcatatttgaaataaaaacacattttataccataaaaaaa

SEQ ID NO: 268014 - DNA, 534 bp, Homo sapiens
ggacgtgtctcccgatggatcatgccaactctgtgtgctagtgccagtgcccttgaggaaaagaagagaaacatccaattgaaaaaaaataggcacactctttgttggggggtataagtttaaggggtacaagtgcaattttgttacatggttatattgtgtagtggtgaagtctagtcttttagtacatccatcaatcgaataatgtacattgtacccattaagaaatttctcagtacccaccccctgccactctcccagcctcccaagtcttcagtgtttatcattccacactcgaagttcatgtgtacacattatttagctatcacttgtaagtgagaacaagcaggatttgactttctgttcctgagaagtttcaattaaaatacagacatattcttttaaatttattttctttagtaaaacaaaaacaatgcaatttatttccaagaatttttttctttttgacttacagggtatatgtgttaggacttagagaaattgtgagtaaatgtgctagatgaccttctgttt

SEQ ID NO: 268015 - DNA, 495 bp, Homo sapiens
gctgcttttagttcatcagaatggtcattttcacatattgattctacccatccatgagcatgggatgtgtttccatttgtttgtgtcatctgtgatttctttcagcagtggtttgtggttttacttgtagaggtctttcacctccttggttaggtatattgctaagtatgttttttgtttgtttgtttgttttttgcagctgttgtaaaaggggtcgagttcttgatttgatactcagcttgctcgttgttggtgtatagaagagctactgattcgtgtacattaattttgtcttcgaaaactttgctgaattattttatcagttccaggagttttctggaggagtttttaggatcttctgggtaaacgatcatatcatcagcaaacagcgagaatttgactttctctttttttttttaattaattaatttatttatttattttttttttttcctgagacggagtctcgctctgtcgcccaggctggagtgcagt

SEQ ID NO: 268016 - DNA, 443 bp, Homo sapiens
gctgacacaggagaattgcttgaacctgggaggcagaggttgcagtgatctgagatcgcgccattgcactccagtgtgagctacaagagtgaaactctgtctcaaaaaaaaagactacacattgggtacagtgtacactgcttgagtgatgggtgtaccagaatctcagaagtcaccatttaagaactttttcacgtaactgaacactgcctgttccccaaaaacctattgaaataataaataaataaataaaacaaagttatggttccaatcatcagaacatagtatagtaaaattaatataacaaaaattaaaagatggataaccacatgaaaattaaaattccgcacatgtaaagcaaaagagaaatctataaacaataagaggatggcttgtaatcaatgaactttataatgatgtagttatattttcatgagttttta

SEQ ID NO: 268017 - DNA, 425 bp, Homo sapiens
atttttgtttacttgataaactcagtgctttagctgggaggatgtcagacttaaatgcaattttacagtctcttcgaaggatacagttagtcaaacatcaggcagctaaagtatctgtctggctcctgaatgtcttcaggtcatggaagtaagtgccctggttacaggtttctccaaatgaacgttaggaatatttccttttctctacgtccatgttgaaagttttttctgttttgttttgttttgtttttactttttcctggcattatatactgaactccagaagatgaggatgtggatggttgagatatgcttttggaacttggaattaataaaggcagatgctaaattgctgaaagcattaaaacctgacactgcgtgttaaatcattgtaagcaaggtcctaacagagcgtttgtgattcg

SEQ ID NO: 268018 - DNA, 641 bp, Homo sapiens
cccactttttacagacatgagacaacgcgggctcagagaggtgtgaggcaggctggaggcagcacagccagtcactaggccagctctacccagactgcagagctggagctgtaagcgggaagcagagcaccttgggaccgccatcctcatgcacacacgtgcacacacatgcacacacgtacacatacatgcacacacatgcacacacgtttacttctgcaagtccctggatgtcttttcaaaagctgtataatttgtttttaaaactgtatatttcaaagaattttcctgaggttttagaatatttttaaataaatgaatgccttaccttgcctatcactaaacctcaatatgtttctaaaattaaaaaaaaaacaaaacaaaaacccggcccttctcacatgggtcagccctgcataactggagttgctctggaaagaccttctctgccacttctcccttgtcaggtgcactcctgcctgggacaggtgggtgcagagcctggggtgagggaaacaaccctgtctgacctctcttctcaggagtatgggtcgccaagaggctgtgccctgttctcctagcctaggagagaacactggtgcaggccagcagcagaggaagtggcagagagaatctgctgg

SEQ ID NO: 268019 - DNA, 335 bp, Homo sapiens
aacattaatatcaataatgtttaaattgaccttacaaatttacaagaaggggacacacgactctagaaaaatgggcaaagaaaatgaataggcagttccaaaaattataaaagcatatattttggctcggcattctcacttctggaaatttatcctacacatatatttaacttctgtgcaatattattattgcagtattacttataatagaaaaagactgtgaaccctgaaaatttgagacatgtcttagttaattaattaatttatttatttatttgagacgaagtttcgctcttgttgcccaggctggaatgcaatggcggggtctgggctca

SEQ ID NO: 268020 - DNA, 354 bp, Homo sapiens
tctcaaaaaaattcttccagatccctagactttaaactttaaacaaaactttgagtattgactatttatcttactagtttttaaaaattaaaacctaactagttactaggttatttgtttttctttctccctgtctctcttttttttttttttttttttttttgagacagagtctctctctgttgcccaggctggagtgcagtggcacaatctgggctcactgcaagctccgcctcccaggttcacaccattctcctgcctcagcctcctgagtagctggaactacaggcacccaccatcacgcccggctaattttttgtatttttaatagagacaggctttcaccatgttagc

SEQ ID NO: 268021 - DNA, 445 bp, Homo sapiens
tgccaaaatgaatggggaaactctgctagcatttaagggtgggagccgtggtgccacaatgacctgtatgaggaaaaccagctccaggcccgcatgactagtgagtgtactgctagacattcataaacatgaaaaactcttttgtgggaaaacagcctgttgcatagcaagagtgatccatcttgaagtaaaactgccatgatgaccaatgtttgacgcctacaattcaaggtggtccagtagcacagataagccctcacaacctccccgtggtcatgagtttctaaaggaagtcagggatgatgagcttcctgtgtctttaccctaaaagcttgctatataaaggatactttctggaggttggttgtgagaatccaccatctcttggcctacctagacatcgtttctgtttctaagtctctattaaatatttctttctgagaaa

SEQ ID NO: 268022 - DNA, 505 bp, Homo sapiens
agaatggggccccaaaacagaaaagtcaaactaactctgaggaagcaggcactaagatttcatttatcaggaaggacttgttgacctcaaaatagttcttagcttgtgaccctgaagtttgaattcccatcagtaaaaaacaaaacctttttctttcattccacatttagagggaaagaaggagggacactaaaatgtggctccccttctgtcattgaatccttataagaattcctgcagagtgtcataattcccattttaccaatgaggaaactgaggctcagagaggtgtgggagtggtggaggcaggatttgaacctgggtctcatcccaaaggtcatgcatgctttttccactacactagacattcccaaaccaggccgctcatcgagttcattgggggaagcctacaaaagcgtacctgtttccagatcctacctttgacctattcaaccatatttcttcagtagggcccagaaacctgtactttaaagaattatttgtg

SEQ ID NO: 268023 - DNA, 392 bp, Homo sapiens
tttcccagcattacctttactcttcacatttttccaagatcagtagaaaatgaacagatcccaggtacctgtgtgggttccctcagacctggccccagtacttttgcctttccttgggagccatctgattcactgctggtttcagcagccaccaacatgccagtgactccgcagtcctcagcttcattacgggcttcccttctgagctccagaaccactcatccagctccctcctgaagatccctgcctgcccgttccacagacacttcgagcacaacatgtccgagacccctctagcccttaccttttgcccagcctctttctttgcacttcccagtctttgcaaatggcacctggatttacctggaggctcataaagaaactctgggaga

SEQ ID NO: 268024 - DNA, 347 bp, Homo sapiens
tacacacaaacacacacaaatgaacattggtaaaattggtgaaatctaattaaagttagtagactgtattgtcagtttccggttttctacattatagttacgcaagatattactatgctattttctaacaactacgtgcaagtctaccatcatctcaaaatataaagcttaataaaagtgaagctctgaaaagtatctatagaatctgaatagtaaagggacataattctttttttctttttttttttgagacagagtctcgctctgtccacaggctggagtgaagtggtgtgatcttggctaactgcaatctctgcctttcgggttcaagttattctcctgcctca

SEQ ID NO: 268025 - DNA, 413 bp, Homo sapiens
gaaccacattctgtaacaaaatgactggcagctgttttcaacagacattctcattaaaatatacatgaacaataaacatgttaaaatatgtcaaaactggaagtactaataagatgcaaatataaatcttcaagagaatattatgtggaagaaaaaagttgcaaaaaaaattagtactgtgattcacttttggaacagattgtgtgtttgcgtgcacctcacctacagggacacatctggagagtatgcaccattctgttgacaacagacccttttgggtcagagggtaggcttcaggccagtgagatatgcagattcatttcaatttataaatatacttttatacattgtttgaaattttgtatttagggaaaaaagcatttcaataaatacttttgaatagattggcaaca

SEQ ID NO: 268026 - DNA, 636 bp, Homo sapiens
gcggcggtttccaggacctcagactttttgccgaggcggcagtccctagacgaagcgaaggaggcggcgcctgccccgcccacaagagctgccgcgcgcgggtgttatagctccaccccatctgcaaaggaagggggagcggaaagagcgggatctagcgtgggataaaagtgggactactacagtgtaactgggcatgcgcccctcctagaaatgatgggaatgcaaaagcccttgactgctccaggactcgagggatcctcggtgccaggatgctgggtcaagcgctccgccgggacagaggactcataccagggaaatggagcccagcctcgtgataaactacgacccaagctgggggaggaacctagttttcgaaaggaaaataatatgcgcaagctttaactgagcagtgggatggtgtaagtcagaggaaacagatgacttgaggggctctacaaacttttagttccttcccacaaccccaccccctgagcccaagtcgcggcagcatccttccagtcggccagtccccttgctgcagttcatgaaaactggcactattctatggcttcccccaaataaccgttacttcagttaattagaaacaaaacataaatggttcctgatgacaaa

SEQ ID NO: 268027 - DNA, 536 bp, Homo sapiens
agccaaatgatatggtcagacatggtgagtcctgccaacctcataggaggggtcttagacactaacagagagtgaggagaaaacaccagtagtgttactcttatgacagacccagctgattaaagatttcatcagcgtaaaagattttgctatggcttatgccccccagtggtcatctttaagtttaaaaggaaacaaaacaagtatctactatgagccaagcgaggcaatttactcatctcatttattcttcacaaaaaggtgagattattcctttttttaaagaaaagaaaactgaagagaggttacataaggctatggagctagtgactaaattcaacagaatttaaagcgagttcactgggaggcctgttttctttccattccttgaaaatttggcctcccttgtcaatggttggcttttagtactcctgcactcacttgcacactgcacacttgacaagtaggtcaaaacttaattccctgcatgacaggcaggtacagcacttaaacactcctaacaatgagtgctgaca

SEQ ID NO: 268028 - DNA, 123 bp, Homo sapiens
caaatctcaggacgtcagcaagatcatgacagacatgcaggcccaatatgacaagctggctcagaagaacagagaggagctggacatgtactgatctcagtagattgaggagaacactacaga

SEQ ID NO: 268029 - DNA, 404 bp, Homo sapiens
cctctaggagcgacttccctggggccaccgtcccgggcctgcgcggcgccttgccgcactcccagcgccggaagcccctgtcgaaggcctggggccaccttgaaagccggaatttcagagcggaggcgagccacagagaccacccagccccttccttgtgccgaggggaacacaggccagaacagggaggggacctgccaaaaggcacgtaagcatttggccctaagccagagctggagctcaggcccccagagttccgtccagggcactccaggactcttcttaacaaagctatagaaattccgagctgaaaagacccataaagactctaccgcgaacattttttgctccagacattgtaaaggattcccagacatcgtaaacgctttgctccagacattgta

SEQ ID NO: 268030 - DNA, 350 bp, Homo sapiens
cctctaggagcgacttccctggggccaccgtcccgggcctgcgcggcgccttgccgcactcccagcgccggaagcccctgtcgaaggcctggggccaccttgaaagccggaatttcagagcggaggcgagccacagagacctgccaaaaggcacgtaagcatttggccctaagccagagctggagctcaggcccccagagttccgtccagggcactccaggactcttcttaacaaagctatagaaattccgagctgaaaagacccataaagactctaccgcgaacattttttgctccagacattgtaaaggattcccagacatcgtaaacgctttgctccagacattgta

SEQ ID NO: 268031 - DNA, 353 bp, Homo sapiens
ccttcaggggaccctgtcctatcccttcctctctccacagctccctcagcccctctttcctcccactcccattctgagtgtcactagcaagtcaagagcaagactagatggcagccactagctgcacgtggccaaccacatcattacaattaattaaaattaaagctccaaatctttggtggttaaacttgctccatgtggccagtggctaccgtatcggacagcacagacaggaaacatttccatcctcctgctggtctgaacttaaagggcggtcaggaggtagagggaatgggagagaccagcccaaggggcccagggacagagctgcctttgtgaggagatgaggtttg

SEQ ID NO: 268032 - DNA, 468 bp, Homo sapiens
caggacgtgctcactgtgacctggctgggcatggctgaggcagggattaggattttctgataagcagccacccgatcgttcttcgtatgtttgtttctattggtaatatggttgaaaaaaatccaggagttatagtcttttctaaaaaaccatgtaagtgctactttaaatggaattatcaccacccacaaaacagtggaaggccgcccagagcttggaagtcggggttggagccactgttgctcctgacggaagggagccttctctggagatcctgctctggggagtgtttctccaggggcctcgagctgagctgaaggtggagaacctgcttcaaacatccaggaaagactcgtctagaaactgtctaccgaagggcatgaactgttttaaattgtagtggcagtaaacatagaaacaccatctagatggacataaataataattttcaggaaaaataagttctca

SEQ ID NO: 268033 - DNA, 405 bp, Homo sapiens
tgcgtttgtgtgcctgtgcatgggtggtgtgtggtgcatgcatgtgtgtggggtgcatatgtgtggcgtggtgggtgtgtgtgtgcctgcacgtgtgtggcatgtgtgtttgggtggttgtctttgctggcccagttgtagcagctcttcctgaggtggggacctctgccccacagctgcctgcctggagctctctggtaggcggtccccctgccagccctgcaggctgtatgaggttctccatggttctccccgtctgccatttgccctttgttattgctcttagtgacaggcagttatttaacattctggccaaagtggctttcgttgttttcttcttcctaaagcctttaaaattaagagttaaaaaataggaaagtaatgcgtgatgattataggcatgtt

SEQ ID NO: 268034 - DNA, 394 bp, Homo sapiens
tctgcctagtccccatcttgggagaggagaccacactacctgactaatccaatctgctccctcaaacctgttccttttccatttttttctctttatttattcttttatatatttcaaactcattttactgccacatcaaacctgttcctaaaggctgccctactgtcttggggtcaccccatctattcctatccctcacttcctgccaaacagcaagcactaactatatctaccttgtccaccttgttccacccatggtcctagcctcatctttcgctcgtcttgtcctcacagtacagtgctcagagactatggggttatgaacacttcagccaatgcaaacgtgtttacctatgtgtaaatatcagtaaagcactcagtcattcctggcatg

SEQ ID NO: 268035 - DNA, 434 bp, Homo sapiens
atcatatctgcatattattcccaaatggttcagaaaggccaataattggggaatctgggtgaaggatataaggagctctgtgtactatttctgcttttatgtaaatctgaaattacaggtcaagcatcctaaatccgagaatcagaaatccaaatgctccaaaatcagaaactttttgagcaccaacatgatactcaaaagaggtgctcagtggaacacttcagatttgaaattttggatttggaatgcttaactggtaagtatagtgcaaatattcacaaatcctaaaaaaccccaaatctaaaacacttccagtcttaagcattttggataagggatactcaatctgtatttcatatatgtaaatacaaacacagaaaaccaaaaaccaaaacttacaaacagctgacaatctcagtgagaagctataggtt

SEQ ID NO: 268036 - DNA, 440 bp, Homo sapiens
cccaggatggctttttgcagcccaacacaaattaataaactttcctaaaatattatgaggttttttgctatttttttttttagctcatcagctatcatcagtgttaggatattttatgtgtagcccaagacaattcttcttccaatgtggcccaggtaagctaaaaaattggacatccctggcctagagaataaatttttagtttcatagttgttggttccatttttctttataatagaaaatatagcccagaaaggaacacttatccaagtatacaatttccaaatacctaaaggactttgcccagtattgtactctttgagaaacaaaaaagactaaaggttgggttagctgacttataagccacagaaataatttaatttctgaaaaaaaaattaagaataaaagattaaaactgacctaaacattatgaactgaat

SEQ ID NO: 268037 - DNA, 819 bp, Homo sapiens
  misc_feature (75)..(75): n is a, c, g, or t
cacgaggcgggccagggccaaagcgactttcgctacttggattggtcggcgtagctttgggcggccggaccttanaaagtcacacatctgcgcgcctgtgcggcccctgcttctgcggatgctgaggcacgtaaaaaaatttgaagaagggaatttcgcggcattcttggcctggcttcctggcgtagccagcaagttcggaggtgttaaccgctgctgtcatgtttcttttgctaaactgcatcgtcgctgtgtcccaaaacatgggcatcggcaagaacggggacctgcccaggccgccgctcaggaatgaattcaggtatttccagagaatgaccacaacttcttcagtagagggtaaacagaatctggtgattatgggtaggaagacctggttctccattcctgagaagaatcgacctttaaaggatagaattaatttagttctcagcagagaactcaaggaacctccacaaggagctcattttctttccagaagtctagatgatgccttaaaacttactgaacaaccagaattagcaaataaagtagacatggtctggatagttggtggcagttctgtttataaggaagccatgaatcacccaggccatcttaaactatttgtgacaaggatcatgcaagactttgaaagtgacacgttttttccagaaattgatttggagaaatataaacttctgccagaatacccaggtgttctctctgatgtccaggaggagaaaggcattaagtacaaatttgaagtatatgagaagaatgattaatatgaaggtgttttctagtttaagttgttccccc

SEQ ID NO: 268038 - DNA, 606 bp, Homo sapiens
cacctctaagcctcattgtgaaatctggacagtagtacccatttccgaggactgttatcaatattaaataagatgtgaagtgtttagcatagctcagatcctggcaaaatgcgtgcttaattaatgtcaggcagttttattaatcacatactggcatgtattactaattgtgtttataatatatgacttgttattgcaagtagattttagccgttccccttctttgtatttccagcaggactgttacaagcatttacagctgtacgatacttgatacatgtctgttcattaatggatatatcttaaagtagtaatgaatagaaaattattttttaaacatttgatctttagctattgtaatactctattatacttaaacgttaaaatataatattgttcatctcattttaactacattaaatgtgagatttttaatggtaagggcagactataaatggaattttgaaacttctttctcggtctgacttgtaaatcacaaatgaaaatgtttggctgggagctgtgtctcaggctgggcgccatggctcatgcctgtaatcccagcactttgggaggccgaggcgggtggaccacaaggtcaggagt

SEQ ID NO: 268039 - DNA, 345 bp, Homo sapiens
gattagtgatgtcgagaattttttcatatgctttttgacagatagaatgccagctagactagtaaagagaaaaagtagagatgacccaaataaacacaaccagaaataacaaaaggacattaccactgaccacacagaaactaaaaaaaaaaaaaaagaaatgcatacattcctggacatatacaacctctcaagactgaaccaggaagaaactgaattcctgaataggataataatgagttctaaaattgaatcagtaataaaaagcctaccaaccagagaaaacccaggaccagacacattctaattctaattctaccatagccgaattctaccagatgtaaa

SEQ ID NO: 268040 - DNA, 919 bp, Homo sapiens
gcccttcaggatgccagccttggcaacattgtgagaccctgtttctacaaaaagtaaacgtgtagtggtgcacgcctgtagttccagctacttgggaggctgagatgggaagatcacttcagcctgggaggttgaggctgcattgagctgagatcaagccacggcactccagcctgggagacagagcgaaaccccatctcaaaaaaacaaagaaagtggatgcgcgctgctcctgccattggatcatcgcagcatttttcttttctctgatatgcgcctttttcctcaccgtgggggctcatgttttcgtagtttcttctcgctactagattgtgagctgcgtgaaggaaggttcatagttgtgttgtatgtacaggcacacaaaatttgtccttggatagacacatatcagtccgcttccttctcctctctgaatttctttatttaaaaaaaagaattagagatggagtctcactgtcttgcccaggctggtctcaaactcctaggctcaagcgatcctcccgcctctactaatatgaattattagcctatactaatatgaattcctatactaatatgattgaaattagtttgacttgtataataattgttctcccagattgggcttctgttttgatagtagaactaaattattaggctatttcaagaaattaatatattactggtagaaaaactgaagctacaaaatggcctggtttctcacttcagttaaatttgtgcttctgagtgcttgtattgtaggtgaaaccgcactgagaaggtatttgtggcccgtacgctggttcattgatgagacttctttgcacaggagagccgctaaaaattactgtggtgaacaggtatgaagaagactgttctctgcccttctttttgcaataaaatgttacaaactaaatga

SEQ ID NO: 268041 - DNA, 1468 bp, Homo sapiens
gcccttcaggatgccagccttggcaacattgtgagaccctgtttctacaaaaagtaaacgtgtagtggtgcacgcctgtagttccagctacttgggaggctgagatgggaagatcacttcagcctgggaggttgaggctgcattgagctgagatcaagccacggcactccagcctgggagacagagcgaaaccccatctcaaaaaaacaaagaaagtggatgcgcgctgctcctgccattggatcatcgcagcatttttcttttctctgatatgcgcctttttcctcaccgtgggggctcatgttttcgtagtttcttctcgctactagattgtgagctgcgtgaaggaaggttcatagttgtgttgtatgtacaggcacacaaaatttgtccttggatagacacatatcagtccgcttccttctcctctctgaatttctttatttaaaaaaaagaattagagatggagtctcactgtcttgcccaggctggtctcaaactcctaggctcaagcgatcctcccgcctctactaatatgaattattagcctatactaatatgaattcctatactaatatgattgaaattagtttgacttgtataataattgttctcccagattgggcttctgttttgatagtagaactaaattattaggctatttcaagaaattaatatattactggtagaaaaactgaagctacaaaatggcctggtttctcacttcagttaaatttgtgcttctgagtgcttgtattgtaggtgaaaccgcactgagaaggtatttgtggcccgtacgctggttcattgatgagacttctttgcacaggagagccgctaaaaattactgtggtgaacagacggaggcccattgaggcttctctgtcctccacggggaccagcattgggctaaacctgcagacaccattgcaaagggaattcaggcaaacccggtggtgaagaatgattccagcgcgaggacagaggctgacatttcttgcctgggtgatttaatgttgcgcatcaatttttcactccccccgtaagagtatgacatagccacaaccttgccagggcccgagggagggtggatggacttatccatcccataggtgttgctcgtggctgggtgacttgcttctgccaatgagattttcacagacacggtacaagcagaagcctggaatctgtgggcactgccaggcctgccctctaaggctcttgattttccccacgagatgtgcgtgctccagggaacggcggctctggctgtgggatgagaggcgtgtggagcaggcatggttcccatccttagcctggagtcaaggccagactagatcagcctaagcccagccatgccacaggtgcagtagtgaagagcaaatgctaactgtccatggaattgactttcaaaggggcgtgtcatgtgcctcatcccagcaacagggaaggcatttctctatcagcc

SEQ ID NO: 268042 - DNA, 823 bp, Homo sapiens
agaaaatgaaaaaaagaaagcagagatggggcaagcaggggagagggttggtgctggggtcacagtggaggggctggggatgcacgggaggggctggggatgtgagctttcctgagctcccacagttctctgcccctctcctgtctcatggcgcaagggccccctggggcttgcggtggttttgcgccaagctaatatcttgttcttcccaacagacggaggcccattgaggcttctctgtcctccacggggaccagcattgggctaaacctgcagacaccattgcaaagggaattcaggcaaacccggtggtgaagaatgattccagcgcgaggacagaggctgacatttcttgcctgggtgatttaatgttgcgcatcaatttttcactccccccgtaagagtatgacatagccacaaccttgccagggcccgagggagggtggatggacttatccatcccataggtgttgctcgtggctgggtgacttgcttctgccaatgagattttcacagacacggtacaagcagaagcctggaatctgtgggcactgccaggcctgccctctaaggctcttgattttccccacgagatgtgcgtgctccagggaacggcggctctggctgtgggatgagaggcgtgtggagcaggcatggttcccatccttagcctggagtcaaggccagactagatcagcctaagcccagccatgccacaggtgcagtagtgaagagcaaatgctaactgtccatggaattgactttcaaaggggcgtgtcatgtgcctcatcccagcaacagggaaggcatttctctatcagcc

SEQ ID NO: 268043 - DNA, 401 bp, Homo sapiens
acggagggaccggtggcctgtcgagtctgatggctgtcccggcctagctggggcggccactcccgcgtggcttctgtgctcctgtgaaccacaccccccttgctcccctggccgcaggaaaggttaggtggtgcctgtctggacccagcagtgtccactctgtgcccgcccagggctgggcactgaagtttgccaagatgaaccccagccctcggcctgggctatcctgcccagggtggccttggggacagggcttgggcgcaaggcctcagcagcagccccctcccactgccctgcatccacacagcccccacagcaccccaggccaacaatggcctgaaggatgggctgggacaccaagcactgtgggcaccctggcaacctactcggggcacaggcct

SEQ ID NO: 268044 - DNA, 233 bp, Homo sapiens
aactgtagcagtaggaaaagtggaccaaccctctggcccccaagtggtagacacaggcagcagcaggctgggcaagccagtcctcaggaccccgtgtggcatgcatgtgccacaccctgtgtggcactgccctgccatggcagtggcaggcaggcactagcagcaaagggcatggtggacctgtcctcaggccccttggaggcatgtgtagatgtgtcgtagtcctgctgcta

SEQ ID NO: 268045 - DNA, 597 bp, Homo sapiens
atttgaccttggccctatgtatacattttaaacaaatataaaacaaaaaataaatgtagaagcaattctgaaaaattggaagcattatttgtagatagtataattaataaaaaacgtcccagcatagcctacataatagagttaataggaatgtttaagtttgccaattgtgagatcaatagacataagcaacaaacagaaaacaatgtttaaaaaatgataatatttatcatagcaacaaaataatatatgccacctagaaataaatctaaccaaagatgtgcaagacctttacatacaaagtaggaaacatattaaaaggccttaaagtattattattattgagacacagtctcactctgtcaccaagattggagagcagtggtgtgatcacaactcactgcagccttgacctcctgtgctcaggtgatcctcccacctcagcctcctgactagacggaaatacaggaacatgccaccatatccggctaattttttgtagagatggggtttcgccatgttgcctaggctagaaagagttattattatagagtcagtttttcctaaattgctccaaagatttaagcaattctaatt

SEQ ID NO: 268046 - DNA, 406 bp, Homo sapiens
gcaaagctgtttgacctcaaggtggagatctgagccacctggtcagtccatgcccagttaatttctatggaggtttggtaaagtaggttagggagttggatccaatgttcctgaagtttctgttggtaatatggcaggggtcgggtcgggtgtggggagggttggatcattctaagggcagtacaagacctaatcccaaaggtgagaagttcctctctgtggaggacagcatttagaactcaatacatacatggcttgttcaaaaatggggaagagattagaaaaatttatcctaatgtttgcttgtcaaaccaagccattctctcagcaaagtagtgaaacccttacataagtcctttgaagcctagcagcagtatcctactcaaacacaaaccaccaaaaaaaa

SEQ ID NO: 268047 - DNA, 454 bp, Homo sapiens
ttattaagagggttatcacttacatgcctggcagttgatgtaagtcatcagctgagatgtcagctggggacatccactgaaatacctactcatggcctgtccatgtggtgccttaggcctcgtcacagcatggtggctgggtcccaagagtgagcatctcaagagagcaaggtgaaagtgcatgacattttaatgagtcagccttgaaagtcacataatgttagttctgcactattcttggtcaaggcagacactgagatctgcccagcttcaaggggacgtggcaaagaccccatcatttgataggaggatcgtcgaggtcacattgtagtgaaagcctgtgagacgagtggtgatgtttctgccatgttggaaaatgcaatctgctacactgctcttttcatttaacatatcataccattaaaataatccatcaactctgtgaatacatcca

SEQ ID NO: 268048 - DNA, 409 bp, Homo sapiens
cagaaagtctgcacagggtgcaggtcgaagctcaaaccttacttcctcaaagagacatgtgggggtcaccctgtttttaaggcactttccaaacatgcactctcccacaaaaccatacacacatcttcagttactctattcacattattttgttttattgtcttcagagcattgacattgccttgtctattctttaccagacatagtttcatgagaacagagaggttgttggttttattcacctctgtatccccagtacctagaacagtatataggacacaaattgcaccccaaaactttaattgaatgaatgatttcacttattgtttttattataaatatcagtagcaacaatttttattgactggtttcctgtgttcctttctttgcagtaagtatgcattttcta

SEQ ID NO: 268049 - DNA, 651 bp, Homo sapiens
ccacccggactcagttgactttctgcttactctggcttatttattctccatatgctccccatcatcactgaagtatcctggatcattcatttatggagggaaccacatttttaccttataggctagagctctctgtgggagagcggtggggttttataatttatcaactatgaggagctcactatttcatacccatggctgtttagaatgcttaagagaacacagaagctccctgaggtgcggcccttttttatgctggatctccaacactggaagcaaaaggaagtcccaaacagaaactatatgcagtgctgaatctacagtggctctgagaacttttaactaatgggcacttgtaaatctcacaacatttcctactggcgtgaatgccctgggtaaaatgctcattaaactgtcagccagcagagaggtgtcgttgctggaaagagagtcacagcatccaggggtggaaagaggcctccctgggccaccagggccctcctctcccccattcacccaccaccaaccccagactcaaaccctcctttcaaagcctttcagaggatgttacaactctccttcacctccaccaggaaattattctttttctccaatccaaatatatatatatatattcatgtttaaaaacta

SEQ ID NO: 268050 - DNA, 565 bp, Homo sapiens
atcactgaggtcaggagtttgagaccagcctggtcaacgtggtaagaccccatctctactaaaaatacaaaaattagccaggcgtggtggcgggcgcctgtaatcccagctatttgggaggctgaggcaggagaatcacttgaacctgggaggtggaggttgcagtgagccaagattatgccactgcattccagcctgggtgacagagcaagactccgtctcacaaaacagaaatacattaattaattaaaataaaattataccactgcctcaaccagattctgcactcaggttgagcctctgtctcataacttcagctttggaaccagacagcctgggttcaaatcatcagctctgcaatttctttgctgtgtgcctttgagcacgtggcctaacatctctgtgcctcagtttcatcatctttaaaataggaataaaaatcatatctatctgagctgggctctatggcatgtgcctatagccccagctacttgggaggctgagacagcaggaccgcttgagcccaggagttcaaaaccggacaacatcgtgatatcctttttca

SEQ ID NO: 268051 - DNA, 443 bp, Homo sapiens
cacgaggccaggtcacaacatgtaagtgacagggctggattggaacccaggcctgtctaaggcccagggtctttccaccattccacatttacagaaatagacctccttgaccttctggatactattgtcttttttctcctcctacctttccagttccgtctcacttctgtttcttacatgtagatgtttcccaggattccggctccatataacgttttcccagccataactaactactacactgaacatccaacagctttatggtgtcttttttgtctgaaaaaactttctctatttccttgtctttcacttgtcttttttcttttctttttctttctttctttcattctttttctctcttttcttccttttttgatatgggtcttgctctggttgcccaggctgaactcagactcctgggctcaagcagttctccctcctca

SEQ ID NO: 268052 - DNA, 237 bp, Homo sapiens
gatttgggatgctgattagacatccaagtgtggaagttgagcaggctgctagagctaacaggggaggttcggttagagataatcaatgtgagggtcttcggtggacaggtgacatttaaagctgtggattgggtgagttcctagaagcctaagagatgaaccttggggtacttgagagttagaagaggagtcagccaagtgtcctgagtatgtcagtttcctcatctgtaaaatgag

SEQ ID NO: 268053 - DNA, 331 bp, Homo sapiens
cagggcctctcaaagaccggctttggatgatggcatcgacccccacagagggccaggcatggtggctcacgcctgtaatcccagcactttgggaggccgaggcgggcggatcacctgaggtcaggagttcaagaccagcctggctaaaatggtgaaaccccgtatctactaaatacaaaaaatggccgggtgcggtggctcacgaccgtactcccagaattttgggaggccaaggtgggcagattgcctgagctcaggagttcaaaaccagcctgggcaacatggcgaaactctgtctctactaaaaatacaaaaaattagctgggtgtgg

SEQ ID NO: 268054 - DNA, 235 bp, Homo sapiens
agcttaaccatatttgaattaaacactaatatctaaactaactgttttgtccaagaattcagagacattgtgctctcatataaataagcaatattgggtggtattaggtggtatcacagttccagtggttttgaattggattacccaaccataaaaatacatatacatatttatatttatagtaccttattgttttacagactctgtaaaatatgttctttctgttaggcttcaa

SEQ ID NO: 268055 - DNA, 431 bp, Homo sapiens
ataaaaaaaaaatcctctaaaaaccatagcctttggtaaaggttatagaagtgcaagcatacttttttaaccttagcacacaaaatggatatggttgaaagtcaaatgacagtgtgccaccaggtaatgtgtctaagttgtaactgccttacgggaagaaatttgtgttctatgtttgcaaagtactaaacatctagtgtgtttcttgtgtatcagcatgcaacatgtgtatttgaaaatgttcgttttgttccaaaaataacttgatgtagtttagagaagtagtagttttaatttttctatttttaaattttttctacttgatttcaaaaccaggcctagaatttaggttctaggtgtaaactattggcctatcagatgtatgtctcttaaaaaactggttctttgaataaaactttttatctctttta

SEQ ID NO: 268056 - DNA, 489 bp, Homo sapiens
tgtggatactggcagaagacacaggactcttgggtcagagacaaaagacttcagcactcatgggattgaagttagcctgctactgttttgtggatactggcagaagacacaagactcttgggtcagagacaaaggacttcagtattcatgggacaacagtggccagagcagatactattcatcctgtaggtttgcatcacagtcaaggaagagtaagtttgaataattaactggtttttttcagcaaatggaagcaagcttgttctttgtctggtgagacaccttacctcaatcctcaaggttgctcactgcaaatataaatctcagcaatggcccaactaaagggccttgcattcttggcataacagcaagaatatgcagctgaaggacaaaggcaaattgcgtttcccgacacccaccaagaaagggaggactggagttataattaaaagttataattaaaagtatttcatatttactacatgcaaa

SEQ ID NO: 268057 - DNA, 436 bp, Homo sapiens
ggggagaggacccccccccctttttttgttgttatcacaggaaaaccacacaacaatatttttggggggcaagaaaaacaacctttttctttgggcaagaacccccggggcccaacaaaaatcacattccgagcggaaagtacccccccccgggcggagagagaattttcaaaaattacttttttttaccaaaaaggaacacaagcttgttctttgtctggtgagacaccttacctcaatcctcaaggttgctcactgcaaatataaatctcagcaatggcccaactaaagggccttgcattcttggcataacagcaagaatatgcagctgaaggacaaaggcaaattgcgtttcccgacacccaccaagaaagggaggactggagttataattaaaagttataattaaaagtatttcatatttactacatgcaaa

SEQ ID NO: 268058 - DNA, 282 bp, Homo sapiens
gcatgaatagcttgctatatgtaatttggttaggaacaattcacaggttttgacagctttattagagttccattttagtaagattcaggtgaaagtgaggtcatcactttaaaacaaaaatcctgagaacatacccagatggactcacataaatgatgtatactaatgtcgtcaagtaaatattttaaagagttaattgctttctttattaaaaactggatttaaatactccattatttcataagaataaaacaactacaacaccgccacaacataaaaagt

SEQ ID NO: 268059 - DNA, 488 bp, Homo sapiens
acggtcattcactagatgctgtgaaacacctgaaacagacatttacaaactaatctctgttgctggcaggtgtgaccaatggtttccacatgtcttagaatgtcctggcctagagtaaactgtactcccaaggcccctcccagaagcaacagaggacccaggggcccagtccatggggaaggaaggaagtcccagaccaagttcattgcactgatgacaacccctttccaaagtcaccagcatgggagaaaataatgttcctcttaactcacagccaaaatatttccaggaaaagaggtgactcttcagaatcaactggtttctattacaatagcagttaaaatcacagaaactccttctcacataaagaattctggggccaggagcagtgactcatgcctgtaatcccagcactttgggagggcaaggcgggtggatcacctgaggtcaggggtttgagaccaacctggccaacatggcaaaaccct

SEQ ID NO: 268060 - DNA, 609 bp, Homo sapiens
acggtcattcactagatgctgtgaaacacctgaaacagacatttacaaactaatctctgttgctggcaggtgtgaccaatggtttccacatgtcttagaatgtcctggcctagagtaaactgtactcccaaggcccctcccagaagcaacagaggacccaggggcccagtccatggggaaggaaggaagtcccagaccaagttcattgcactgatgacaacccctttccaaagtcaccagcatgggagaaaataatgttcctcttaactcacagccaaaatatttccaggaaaagaggtgactcttcagaatcaactggtttctattacaatagcagttaaaatcacagaaactccttctcacataaagaattctggggccaggagcagtgactcatgcctgtaatcccagcactttttattttatttattattttgagatggagtgttgctatcgccaggcgggagtgccgtggtgccatttcagctcactgcaacctccacctcccgggttcaagcgattctcctgcctcaggaggcggaggttgcggtaagccaagatcatgccaccgcactccaggctgggagacaagagcgaaaccctgtctcc

SEQ ID NO: 268061 - DNA, 356 bp, Homo sapiens
ccctccaattaagtcaggaactggccctctcttgggtgtggatttatagtccccaacactagagggtcaattttagagatttttaacaaactggaaggttgactttcaaaatgtctccagttccttctaggtcaattccagcatgagatatactttatctttcaatcactagtaggcaaaaaaggggtgctaggaatcagtcactggcttgacttctggcaacaaggaaagcctgaggtgaattacagttgcaacatctgtcagctcaaactgcatggcgtccgtcacaaggagttgaaatttcaaagtgtaataatttttttaagtataagaataaaaaatgtccatccaaagta

SEQ ID NO: 268062 - DNA, 333 bp, Homo sapiens
gcctgattagggaagagaaaagataccagctgtaagtgaaaatgaaagaaagcaagagtctgaatttaagcagaaacaacagggatggaaagaaggggagagatttgagaaatatttattaagtataatggagagatacagttattaattagatatgggggtgctgaaattaaaaagagggtttattcattaaatatttatgtagtgtctactatgtgccaactactggaataggttttggggattaggctttcaacacagagataaaaatgtatacatgcttggagattagaatctagttggaatgggaacgtgagcaaaataaatgctatg

SEQ ID NO: 268063 - DNA, 448 bp, Homo sapiens
ttgtccctcgacagagctccactttgatcagaccaccttcccaaagcagcatgttgccccattctgaccctgagagcacctggcaggtatgtggaaaaaagaaatgtgcattaaaacagagacaggaggaatgtacacagcctgcaatactctagcagtaagtactactactggctggaagataggaagcagtcatcggtgagcatggaaggaagagccattatgcccacgtgcatcaggagtaaatgctgagttctggtcggtcatggcgcaacagtctccaaggggaactcccaattacttccaaaggaaagttgaactcccactaatctgtagtggagcagtttttataccttcttaaaacccagaagaatgagtatcagagtactctatgtgatcctcagaaataaaaaccacaagtctagggctgctaaagtaccctaccaaa

SEQ ID NO: 268064 - DNA, 444 bp, Homo sapiens
gactttcatttttctggttaatcccaaggccagcaggcataggggttggttcaagactctggcatcgtagcatctagattcctgtcctgggtatcaccacttcctatctcagagatcttggccacggtactaactctccaagctccagtttcattatctgtaaaaggagttaattatgcttcccatttcatagttattcagaggattaaatcctcacaagaaatactagctcttgcgggacttcatgttgttttttgttctatgaactatggagaagacagatgatgacctgtggtaaaggaaggagaagcatgaggttcaacccaaagatgttgtcaaggtgaaatgtagacagggcctcttggcttgaaccgataaatacaatctatagttgtaaattttgaggccatccattaataaatcctccattcctcccaaaaaaaa

SEQ ID NO: 268065 - DNA, 595 bp, Homo sapiens
ctgtggctggaaggattttcagtcctgtgggttgtaaccagaggccacaggtggattctgccttaggctcatgagatttccgacttgctgttgaagaaaatgccttgtgaagtgacaacagtagctctgacccaactgccggtgcctcgctagttcctatacgtcccactggatcctcacagccccgggaagcaggtgctactactcttatccccgggaggagacagaggccgagagaggttaagtgacgtgcccaagtcacacagctcggcagcggccgggttgagcatcagcagtctgtttgcagacccctcactgtcaccccctgagccagtgcgccttgggccctgcggtcaggatgtctcaagcgtggaggcatcaccggttcgtggcagtctctggaaggtcactgagctctgtgcccagaatcgagtcgggggagtctgtgcagaggtggccctgtgtgtggggacagtgtgtgacacagacactgctttggatggacacctctcccgtgacctcctagcatccaatcccaaaggaacaactgttgcagagatggaccgctggacacaaacccacgtgcgtttctctg

SEQ ID NO: 268066 - DNA, 460 bp, Homo sapiens
cagaacaggaagggtcacctccctgaggcacctgacctggagaaccaactgcataatcccagaaatttccaaggaaactatatttcttacattgatggaaatgtatggaaagtgtacagttggaccgagaaactaattctcagagaaaataacttgactgaattacacaaggattcatttgaaggcctgctatccctccagtatttagatttatcctgcaataaaatacagtctattgaaagacatacatttgaaccactaccatttttgaagtttataaatcttagttgcaatgtaattacagaactcagctttggaacatttcaggcctggcacgaaatgcagtttttacataagttgtaagtgaaatagaagatgaatacatgtaaacaactatttatctacaaaaactcatacaattattgggtagctgggtataagcccattatcaactctgaaa

SEQ ID NO: 268067 - DNA, 434 bp, Homo sapiens
tgagataaaaaatgtgtatccaatattattctaaactcttgctattattcataccaatcaacatttaataactaatcaaggcaatattttccttttccttttcctagagatttatcctgcaataaaatacagtctattgaaagacatacatttgaaccactaccatttttgaagtttatgtaagttacaaatataacttgattacatttggaatttttataaaacttaattataaacctctttgctattcttgaaatataattaaaattttaccagtagaaagctactaaaattatacagcaaatcctttttgtctctagcaaggattattgtgagaattattacacagatcttagtgaatcatcagagagcagtggttctcagctggtgtgattttgtactcaggtggcatctggtaatgtccggagacagtt

SEQ ID NO: 268068 - DNA, 669 bp, Homo sapiens
aatacaataaaatatatcataattgttttaataaagtcaattcagctgtgcaaattcttttctattaattaaaccagaaaaagatctctatccatgaatttgctatagtcatgcctacatatctatgtttatgcacaagtgtgtttgttcctaatatccagggtggaatttttgctgaaatacagtgacaaagttgtccttcaaacttcatcatcactttgactctcttagtgccattccttctttatcctaaatcatcttctttttcccccccaacctttttttatgatctgagtccattttcaggaaagtttgttgataatcacttataaatattagccactgtgcttattccccaaggagggtggagtttttagttgtctcttaaaacctgactgactgaatctcagcaaagcaatggtggaaaagtttgaaggccaatgcctcagcaagtccatcatgtggaccatgagcttgtccgcttaatcataaccatggacttaactcccaagtctgaggatatcttcaaacatcaaatattttggagttctctggtatggagtcaggaacccaacatctatgaaaacattctgaagagaaaagcagaaatactccgttagatgagaccttatgctccattctcagcaggcatgcagctcaaggacttct

SEQ ID NO: 268069 - DNA, 398 bp, Homo sapiens
caccgtccggcctctagagggcagtgtatggatacatttgtccagattgggggactaggtttgataaattttgtcctgcatcaaatgacaaaagggtaataggaaatgtattatatttatgccccttactttgagataagagactacaaccttcatacttcggggtgttaagctgccattgctcttgttaaggggcagtttgttttttaagagatggggtcttgctctgttgtccaggctggagtgcagtgccgcgatcttggctcagtgcaacctcgaactcctgggcttaagcgatcctcccgcctcagcctcccgagtactgggactacaggcgtgtgccaccaaggggcgattattattttttttttctacgcaaaataaaagacggctattca

SEQ ID NO: 268070 - DNA, 462 bp, Homo sapiens
gagctttttgcaaaataaaatcgcactttttattcaatgcctaccttcccatgcaggcctagttttaagcttctgaactttctgctaattactgtcacattaattaaaaaataaatcctttttaatttcctaacaggtggtttgtgaggctggaagaggagttgaaacttgtttgtaattattgtgtggtgtatttgcatttctaattgcgctgagggacactgaaggccaagcttccagtctctgggctgtctttcacctgcgccgcggtgctgagttgttggcggcggcggcagcgtcttttctccaagcagcacctgtgagagcagcagctccagctggagtcccaagacttccaatcaacatagagagccacagggcctgtgcctgcgtgggtttgctgtaaggagcctgtaacgcatcgaggagcccagcgcccaaccccacacctggcattggctg

SEQ ID NO: 268071 - DNA, 527 bp, Homo sapiens
cagtggtacctttaccttacttcatcagagaaagatgaatttttgaatctgaacttcctctgcaaatatttattgttggtgtctcatcattaccaaaccaagggaaaattgctaagagaaggtgaatagctgagaatcacacacagtggtgaatcttgtaatgttttagtttggagcaagtgacaggaagttataggggctagttaagaaataggagcaaggataacattagattgttgctcactgagaattgatgaaaggattgacttacaaatcaatccttgattgggggctaagtggcagttgaaaggaacattatagacctctgttgccctgttttataacttaagctgggtagctgtgcagaggaacagagagccaggctgtcctcccaaggtattaaattggagcctaagggttatagatttgaagacatgagagcctaagatacagcagaattcaaatatttaaggaattctgcctgccggtgactattactaagctctatagaagatagaagaagcaaa

SEQ ID NO: 268072 - DNA, 430 bp, Homo sapiens
gcttgtctctactaaaaatacaaaaaattagctgggcgtggtggcacatgcctgtaatcccagctacttgggaggctgaggcaggagaattgcttgaacctgggaggcagaggttgcagtgagccgagatcatgccattgcactccagcctgggcaacagagcaagactctgtctcaaaaaaaaaaaggaagaaagaaagaaatttccaatcttaccttgtacttttcctgccccagccctggaacaagtcatttctcaataaggcctgtttccttttagaggaaaacagtatttaggaaccaaaatctgaatattattagacgtgctcaaaattcaatccaatactctgagattcattctagctttcccatgttccatatttgtgtctacttgtctctagcaatgagaaacctggttctaagaagaaag

SEQ ID NO: 268073 - DNA, 450 bp, Homo sapiens
gtatgatatttccttgtgattagattcaggttatgcattcccaggcaaaatactaagtatgtggcaggcatgtacttcccaaggctttacaccctggagcacacagttttcatctgccccttctttatctgttaattttgtcaacctagccaagagattgtttgctttctccactcatatagttaatattttttctccttgctacaattaataagcagtctgtcgggggagatactttaaaatcatgccagtattctaattttgttagaatttcccctgggattgttttgcttttaactttgccatacccttaatgttttaggcacatgtcttataaaaacctagaatttgttttttgttcaacctgacaatctctttttaagatgtcaattttagcctatttattatgaataacaaattcataataaattcataaataataaactcaat

SEQ ID NO: 268074 - DNA, 679 bp, Homo sapiens
gttctttcagctatttgatattggcagttaggagaaataatgggttcaaggaaatagaatttttcaataggaggacaagagtacctttgggtcccgatacagggcccagtggccactagtgatgatatcttaccacagaggcaaggaaagtttactaatacctggagtatgggtgtgattcttaaaaacaggacaaaccttggaggaatgggtctctcaggagatcagttctttatttggcccaaagagccaaggaggcagttcctgtgtcagtgcagaataggcggatgcccacagaaggctcttcagagtccagataggtgaaggcgtgtggtaacagagcccaggaaaggatctgcagggcccagagccaagaagagtaagaactggttttataggcacaaagagattagtgaggctcctgccagatgtggaaacaaccgtaccagttcatctgcaccttgagccaggtgttaagcgtctttgcttcagtaaagcattaatattttcttgcttgtaaagctgctcacctgtgactgtttgggtcttcttttcattttttcactaagaatattggatacctactgtgtgccagtcatcattctaggtagctaataagacaaataagatatcttccctcctggagcatatagactagttagggaatctagacaatagt

SEQ ID NO: 268075 - DNA, 329 bp, Homo sapiens
ggctttctttttccattccttcagttctttacttaaaagcccctttctcagtaaggacttttctggccatcctagaattcccactatccctcctctcaaacctgtaaacatttcattttcctgctttagtttttctcctttaacactgtatattttgcctaatctatctatggttattgtgtttatttcactcccatgagtaggatgtttgtgtgcctagaaaagggcctagcttgcaataagtagctactcaataaatatttattaaatgagcaactgaagtttacccttcggtgtattgttttaaacattagattgattctcaggta

SEQ ID NO: 268076 - DNA, 164 bp, Homo sapiens
catgtaattgaagtcagattgatttctttactttgtaatatgcattttactttattccattttttgtgtgtgtatggcttgatagctcattttatttcagcattgaataatatttcattgttagaatgtaccacactattcacttacttgttgaaggacgtctt

SEQ ID NO: 268077 - DNA, 422 bp, Homo sapiens
gttatagtcagtatcttctctagcctcaaattaatgagatgttgttgaggatgacttaaaattttctttgaaagtctgaaacatgatgcagaatgcttgcaccaaaagagttttacattttccccacgcttgtacttactagagccaagtacatcaaaggtgtgagttaaaacccgtgatgcagggaactctgacacttgtgataacatggatgaacctggaggacattatgttaagtgaaataaaccaggcacagagagacaaataccatatagtctcacttacatgtggaatttaaagacagtgctcacagaagtagagagtagaatggtgtgaacccgggaggcagagcttgcagtgagccgagatctcaccactgcactccagcatgggcgacagaacaaggctctgtctccaaaaaa

SEQ ID NO: 268078 - DNA, 174 bp, Homo sapiens
tcatgctcagttgcagtaactacaccaagccttagaacataacacattggctttctcgctattgttctagttttatcttcttatttgcagtgtaacatcccattgcatgtcccgtatattgaaagctgcctctacttctctctggtaataaaaagtatgtatgttttcacttga

SEQ ID NO: 268079 - DNA, 464 bp, Homo sapiens
ttttatttttttgtagagataaggtcttaactatgttgcccaggctggtcttgaactcctgggctcaagcagtcctcctgccttggcctcccaaagtgctgggaatacagacaagagccactgtatgcagcccctgccccccttttttttaatcatagccattttgacggatataaagtggtatcttattgtggttttcgtaaacacattgggttttaaatgttctgaagacagctgaatacacaaatgttaaatccctcaatgtgagcagtttatctgttaattttggaaatacacttattttctggaaatgacacttgcaaggttaactgcagaaataccaggaaaatccagggtatttatatctataaaaaaattaataagatttactttcactttaaagtttacatgaaattagagaatagaatttcttgaattcatgtatattctaattgctaaatact

SEQ ID NO: 268080 - DNA, 574 bp, Homo sapiens
ggcaggggccacaaaagcaggtgtaaatgggaggaggtgttaccttgttggaaatgtctgagaagtactagctgtgggtctcttttagtgtaagatctgtcatcccaacactcgtcaccactctacctccaataccactcttcctccagatggagcacttctatcattttgaaaggaactaaagacaagatttcactgggaaattacattaattccaactggtatagatggaattgtgtcctccaccaaatccatatggtgaagccctaacgccaaggtgatgctatggtggagatgaagcctttggaagacaatgaggtttagatgaggtcatgagggtagccctcataagatgaatccccttataagaagcacaagaagctgggcacagtggctcatgcctgtaatctcagcactctgggaggctgaggtgggtggatcacctgaggtcaggagttcaagaccagcctggctaatttttgtattgttttgtagagatggggtctcactatgttgcccatgctgttaggggagacctactttatacaggagactttttgcttcgtttgtttta

SEQ ID NO: 268081 - DNA, 311 bp, Homo sapiens
attctagcaggatcgcctctctccacatggtatagatggaattgtgtcctccaccaaatccatatggtgaagccctaacgccaaggtgatgctatggtggagatgaagcctttggaagacaatgaggtttagatgaggtcatgagggtagccctcataagatgaatccccttataagaagcacaagaagctgggcacagtggctcatgcctgtaatctcagcactctgggaggctgaggtgggtggatcacctgaggtcaggagttcaagaccagcctggccaacatggtgaaactccgtctctactaaaa

SEQ ID NO: 268082 - DNA, 506 bp, Homo sapiens
acctgtaatcccagcacttcgggaggccaaggcaggtgggtcacctgaggtcaggagtccgagaccagcttgtccaacaaggtaaaacctcatctctactaaaaatacaaaaaattaaccaggcatggtggccggcacctgtagtcccagctactggggaggctgaggcaggaaaatcgcttgaacccaggaggcggaggttgcaatgagccaagatcgcgccactgcactccagcctgggtgacagagtaagactctgtctcaaaaaagaaaaataaaaaatagtagaatggatacatcaatcattgtatgttaattcaatggaatactaagcacctggaaaatgagtgaactacagctacacgaatcaacatagataaatctcaaatacaggatgttgagccgaagatgctactcacagcaatttgcggagtatagtttccattctgatatattttttaggggtgtgtacacatgtactgctgtgaaaaatacaataaaaaaca

SEQ ID NO: 268083 - DNA, 696 bp, Homo sapiens
aatgttatgagagggaaatcaaagggcccccgctaagcagaatcgttcccatcagccacaggcaccagtgcactgtgctcatgaccttttgtgctaaacaaacccacagacacacatacgcattcctgcttcttggagcccgggtgtggatggatgcctgacctgccccatcaccctttggctactggccacagagttcacattgtcacagagttcacattgccatctacaaaccaaacatgaacattaggactctcgtttttgttttctttgtcccttttgggtgtagctgaaaatgatacttgcagctcatatcaaagatggatttatgtctattgcaaagatggcgacgtgcaccttcctggaggtgctggcaaattccaggcagtgaagccaaaccactctcgtgccttaaataatgttggatcaagatcatgtgaaatttattctaaaacctgtggtttttatttcttcctgcaaagctccattctctgcttcacatgagagaaattagcaatgaagcacctcgtcaggatccaaaacgcctgccacccatctgtgcaaaaccctggcagtcctggaggagacaaatcctcaccttcctggaaaacttccatgaaacctgcagtgagggcagccagaccttaacttggcaaagaaactgtgaaggcagcctggagtgccaaactattaact

SEQ ID NO: 268084 - DNA, 436 bp, Homo sapiens
gaagacagtgagaaatttacaaacagaaaagcatgccgtaaaagctagtatgtttgaaatagttgcaggatgaatttgaatctagcacctgtaatatctgaaatctaagaacttgtaagagtttgttcttttgtccaggtcctttcagtgcttcactctgtgtttctaaacatttttgagatggcataaactttctaaaatgagtcctttttcatggaaacccagaaaaattgtttacagtcttaatgcagaagaccacttagctcaggcctcttactcttccttttccagcacagcactgtacagtgggtacttgacttgaatttaggaaattatttcccttacttggacttaaattgtggcagcacaaatgtatttccggataaactttttctggttatacttaatgtttaataccacctttaagcaggagagg

SEQ ID NO: 268085 - DNA, 319 bp, Homo sapiens
aaccaccaggcctctgcagacactgctctcacctttctgcccttccctccatctgtttacatgtgcatgcataattccacattcactgaagtcctcccaggcactgttctaggatctgagcacgacgctgtggcgctcgtggaatctacattcaaatcaattttgacctatctgaaagagaggatacctttgtaggaggctctagacccacactgtgtgtcacagaaagcacttagcccttatggctattgaatttaacttaagcaaaattcaatacaattaaaaattcagggccgggcgcggtggttcacgcctgtaa

SEQ ID NO: 268086 - DNA, 1731 bp, Homo sapiens
tccactagtgtaggcacagagacagaatttcccagcttgaagggatttgaaacatccataaagttacagaaattcatatctggaggagtcttaacggtcattcagaccaacgctttctcgggtatctataacatccaatgccctagtttccctgctgtctttttttggccactccttttcaatctcctttgcaggctaccctttacagggctcagtctccacactcttttgttctagattttcccctggtgacctcaccgaggcctacagctttaaataccatccatatgctgataattcccaaatttatatttccagtcccaagctctccactgagtttcaggctcatatatccaaatgtctacttcttgccttcagtataccttacaaacctctcaagtttgacgtgcctagaactggactctggattttaccttttgcccgtatcaacaagttcctctcttagtcttccaatcacagaaagggctccaccatcaagatggacacgagcctaaaacccaagaattcttgtttcctgccttcctttccttctctcacattcagtctcctggtagacttgttcatttacttccaccatttctatctacttcttttcatctccagtgccaacattcttgtccaagccatcactctctctccccaaaccactccaatagcatcctaactggttttccctacccttatctcacctcaatccattctctgcatattagctggagtgatcctttcaagaagtgaatacaaaccttaaatctttcaacagccctcactgcatccagaataaaatccaagcacctataactgcctaatatggcttctgtccacatctaacctcaaatcttaccttctgcccttgctgtgctcaagcctttctggcctttcatttccttaaacacaccaagcctttccagcatcagagactttacaattcttcctggaatgctcttccactaatttctttaggtcatagtttgtggtcatttgaaaacatgtccacaaattcttttctatcctaaaaaaagggggaatccaattcccctcctcttgaacatggactagcctcagtggcttgctactaatgaattaaatggtatagaagtgactgtaacttcttagactaggtgaccaaagatggcacagcctccacctggttctctgtcttgtgaggctcacccttggaacccagccatcatgctgtgacaaagccatgtaccacatgcaggtgtttcggggaacagacctgtcagaggtccttgccaacagccaacatcagtcagcatcaaccactagacatgtaagtgaggaagcctccagatgattccagttcccaccttcagctgatgttaggtggagcagagacatgctgtccccacctgcctaaactgcagattcatgagtaatgtaatttctgtcattgttttaagccattaagttttggggcagtttgtcacacagcaatagacaactggaacacagctcatatgccccttctcagaactgccctccctgatcatcctaagtgcccattggcattatccataacctgaaaattattatgattgatcctaaagtccagcctggtgcctggcacgtaggagatgctcagtgaatatttgtggaatgattgaataaggaaatgaatcctcttgtcacatttgaagttatcagtcatcaataaaatggggatttgtttcatcgtttgcagggtga

SEQ ID NO: 268087 - DNA, 963 bp, Homo sapiens
tctagaggatctctgtgcttgggacggcgcagaataaaatccaagcacctataactgcctaatatggcttctgtccacatctaacctcaaatcttaccttctgcccttgctgtgctcaagcctttctggcctttcatttccttaaacacaccaagcctttccagcatcagagactttacaattcttcctggaatgctcttccactaatttctttaggtcatagtttgtggtcatttgaaaacatgtccacaaattcttttctatcctaaaaaaagggggaatccaattcccctcctcttgaacatggactagcctcagtggcttgctactaatgaattaaatggtatagaagtgactgtaacttcttagactaggtgaccaaagatggcacagcctccacctggttctctgtcttgtgaggctcacccttggaacccagccatcatgctgtgacaaagccatgtaccacatgcaggtgtttcggggaacagacctgtcagaggtccttgccaacagccaacatcagtcagcatcaaccactagacatgtaagtgaggaagcctccagatgattccagttcccaccttcagctgatgttaggtggagcagagacatgctgtccccacctgcctaaactgcagattcatgagtaatgtaatttctgtcattgttttaagccattaagttttggggcagtttgtcacacagcaatagacaactggaacacagctcatatgccccttctcagaactgccctccctgatcatcctaagtgcccattggcattatccataacctgaaaattattatgattgatcctaaagtccagcctggtgcctggcacgtaggagatgctcagtgaatatttgtggaatgattgaataaggaaatgaatcctcttgtcacatttgaagttatcagtcatcaataaaatggggatttgtttcatcgtttgcagggtga

SEQ ID NO: 268088 - DNA, 340 bp, Homo sapiens
tgtcactgtttgatgcaacctttttctgcattaatctgctacaaggagtttgaagatttgtgttgtgcccccacctaatcaaaaccagtagatttcccattatggctgcatatactctgtattgaaataggagttcacataagcagagtaatataagcaaagttcctttgtactcataagaagaaatccaagtttttattttactttaactagagttttgatgtgatactgaattttactactgatttatttgcatatgttaaactatccttggctgatgttgagaggatgattgtattgtaaaacagattaaaataatatatgtacccccaaaaaattt

SEQ ID NO: 268089 - DNA, 576 bp, Homo sapiens
agcttagagaccagactgcaaggtgccaggcacacccaaaataatgtaccttcttttcacctcaggaaactggttagtgtggtacatgtttggattttagtatagtggctaagccaaagctctgttagtaaattcctacaggagctcattggcaacttggtgcatgacagaaagagcaagactttgagccaaacagacctgggctcaaattccagctcaactacatagcagccttgtgaacttcacctctgcctcagcatcctcatctataaaattggtgatagtggcagagatttcacaggcttgttgggaggattaaaggaaatattacctactatggagcttctcgaagggaagcaattttgactttgtttttacttctttgttcaaactctcacttcagtcccaaaatgattgagttggcagcttagatattattacagttgtttgccctacttcatgtcttttttaaacattggagcatctgaaacttcactttggaaaaagggaagcagagtaggtatttttggcacaatgacctctatcctatgtggggtttgtttaaacaaaaaaaag

SEQ ID NO: 268090 - DNA, 547 bp, Homo sapiens
atagtggttaccagggataaaggggggaggcaatgggaagttattgtttaattggcacggagtttcagtatgggctagggaaaaatttctggagatgaatgatggtaatggttgtataataatgtgaatgtacttaatcccagtgaactgtacacttaaagatggttaaaatggtaaattaaaaaatttttactttttgtgggtacatagtaggtgtatatatttgtggggtacatgaaatgttttgatacatgcatgcaatgtgaaataagtacatcatggagaatggggcatccatcccctcaagcatttatcctttgtgttacaaataatccaattatactcttttagttataaaatggtaaattttatgtatactttacacaataaaaaatttgtccaaaaatattgaattgttttaagatactaaataaaagaaaaaggaactgaagaaagtcatgattgtttttttccccgaagttttataataatcactaaaaagctgactgttactgcctgttgattcttttaatcaagtaaaaaaaaa

SEQ ID NO: 268091 - DNA, 347 bp, Homo sapiens
caaaaccttcttatgtacttttgatgaagcttgaaattaggtttgtaggtaccaaaagcagagcctcagaagagggtgaactgatgacagcaacttctactgagaagaaaacaccaaagctgagataacgctgacctcaaatgcaacactgtaggcaataaagaacaatggcattcgaacataaagctgtttccaaaatctacagttatgtatcggccgtacttgcatcttcagaactgttagagggaaatcaccaacacttgatgcctctaacctactcatacacgctaaatttcctttctcttaatcttaaggaataacagataaataaaaagagaaacagcttt

SEQ ID NO: 268092 - DNA, 328 bp, Homo sapiens
tatctgtcctcagggagcttgccagccacttaaaattgtcccagatgggccaggaatggtggctcacacctgtaatcccagcactttgggaggctgaggcaggcggatcaacttgaggtcaagagtttgagactagcctggctaacatggggtgaaaccgtgtctccactaaaaacataaaacattagctgggcagggtggcacatacctgtaatcccagctactcaggaggctgaggcatgaagattgcttgagcctgggaggtggaggagtcgagattgtgccactgcactccatccagcctgggcaacagagcaagactgtatca

SEQ ID NO: 268093 - DNA, 242 bp, Homo sapiens
tggatttaatagtcttaactcagcatgaaaaagatgctgggatgctcctggctatttatgcaccctaagtgccatagagacatgctgttggcaaggcatggtggctcatgcctgtaatcccagcacactgggaggctgacgcgggcagatggctggagtccaggagttcgagacaagcctgggcaccatggtgaaatcctgtctctactaaaaataaaaaattagccaggggctgtgacgca

SEQ ID NO: 268094 - DNA, 353 bp, Homo sapiens
ggaaagaaggccgcctttgttgtcaaatctggatgtcttcatttgccccctccatctgctctccacctttctctcccctgcctttgcatcaacagccatccttgctctctgacttgtctgctaatctgggtagtggtaggaatggaggcaggacacaagaagatcaggccacacgaagctctttttttcccctgtgttatacacactacatatgtgcacttgagggacttccctgtcaactttcttatggatagcctgtgaaaatgaaggcacagagaaggccatttctcacccaccaccggtacctaatagcagtaaagaaaataaagctcaattcttgcaaatgacaacca

SEQ ID NO: 268095 - DNA, 398 bp, Homo sapiens
tcgggatttgaaaaaattgctgagcttgacagatttttttttcctcctagcgcttgctcggttccagaaaggggtggggggaaatcctgtacgtgctctgttctgtaaaagacgtctggcctcagcagtcaacctaacccgaaaagaaatgtctggacccggagaataattgacgatttgatcctctaatcaatgggacaacttgggagattgacaaaagctttatccaatcataaggaagcttgggtgtacaatagttctcaatagccagagggggcggggcagaggagatctgaagttctctgcagctctgaaggggatggtgtggttcaagctgtcaaagctacaagcgcttccggatttagcaagcacaataggaaagaattttcgcgtttaag

SEQ ID NO: 268096 - DNA, 453 bp, Homo sapiens
ttccaggaggcccattgtcaccagaagtgtatagtttctaacagatttatacattggaagttgattttgctcctaatttcaacatgcctaatgaaataaataatcaaaacagtctaaaattcttcctcctctctgcctcctgcaaaaagacagcgtctggtattgtccacccaagctggagtgcagtagtatgaacttggctcaccgcaacctccgcttcctgggctcaagccatcctcccacctcagcctctcaagtagctgggactacaagctcacataaccacaccctactaatttttgtatttcttgtagacatgggttttcatgttgcccaggatggtctcaaactcctgagctcaagcgatctgcctgccttggccccccaaagtgtggagattacaggcatgagccactgcacctggctgatttaataaaatatcttgtaatcaat

SEQ ID NO: 268097 - DNA, 468 bp, Homo sapiens
agtcaagattttaaatatttcatttttatattataatgaaactaatggttactttgagagttgtcttctgtgagcaaatgttgtggaattgtatatagtaagggaatcatagatttcttataattcaccttagtgagatagatgattgagaacatggaggagtctgctcgtactttttcacttattgaagacaagtatagttttaggtttttaaatgtcgtgtttactttggaattttgggtcaagagaattcttgtgttctagaccagtctggccaacatggtgaaaccccatctctactgaaagtaaaaaattagtcgggcatggtggcagacacctgtggtcccagctactctggaggctgaggcagcagaatggcttgaacctgggaggcggagtatgcagtgagccaggatggtgccactgcactccagcctgggagacagcccgagactccttctcaaaaaa

SEQ ID NO: 268098 - DNA, 503 bp, Homo sapiens
tgcttcactgcagtaaccattttgctttctatatgaatcccataacatcatgttgtatgctttaaatatatacaataaaatttatttaaaaaatgaaataaaatatatggttgatataaaaagaataaaagctcaccaggtagtgctgatgtccacctagagttgagaatcacttttctagagcaagagtgggcaggtgtttcctgtaaagggccagatagtaaatattttaggctttgcatgccatatggtctgacacaattactcaactctgctattgtagtaagaaaaccatagatgatatgtaaggaatggatgtggctatgttttagtaaaatgtaggtgaggggtaagaaaatagcaagtatgtaggatgaaagagcctagagatctaatgtgtaacatgtagctaataagaggactgtagctaataaaattgtactatatttggaattcctgctaaatgaatagatttttagctgtccttgccacaaaaacaaacc

SEQ ID NO: 268099 - DNA, 499 bp, Homo sapiens
ccgattgtagaggagagattcctgggcaagtgcagagttatatagagtgccctttctacctgacacacgaaagaaatgagctgtaacagacgccagcggcaggtgcaggacctgtgagcttcactcactgtgccccagtgtttgggttcctgcgctttgaaccgccttactttaagaagccttgtcattggaaaattgaccgcagctgatggcttctgtcatttgtgctgttgtttggagggcagggctctgcgtcgctttgtcaggccgcacagggaatgcgccacctccggcccgcactgtctgcctacccagacccacaaggctcctcaaagcctcctcaccaagggctgactcttttgccttgttctttctttttctttctgtttattctttcaaaacatgtactccttttaggcagttgcgagaacttctacaataatctgtgttctaaattttaggagccacaataaaaacctctctttttttcctgcattga

SEQ ID NO: 268100 - DNA, 469 bp, Homo sapiens
tagtgttggccaattaataataataataggccaggcaaggtgcaaggggacaaaaggctgagtgtgattaggcattgagcgtgcatgcatatagaacaaaattctggaaaaatagtcagaaactatcagcaacgattacttctgagggaaaggcctagagtgagacaacctcttcattgattgccagtttgaactgtttccccgccacccatgtgcttatattacaaaatatccatgttggaaaaatatattcttattcaaaccaaaccctgctcgtcaaagcattgcaacggcctccccactgattcttgtagactgagcgctaagacctgttaagccctgttgctctgcttcatgcaaagttctgctacctaatgtgcattttcatataggaggtaaggaggtaaggatcagtatctcaattttatagctgatgaaacgaacttgaaaaaattaagtgaaggttagt

SEQ ID NO: 268101 - DNA, 333 bp, Homo sapiens
agctgagattgtgccactgtactccatcctgagcaacagagagagaccctgtctcaaaaagaaaatagtactctgtttggtgtatggtatgtaggagttactgaaaagatgctgttgaattcacaggacagtaaattgaaacaatttatgtgaatatactttataaactaaaataacatacaaatataaatcattaaaaaatcttgaaatgtacttttgctgatttaaatgctatagtggttttatgactgaattctgtatatttcactttattcatattagtctttaaaggtctactcttagtcataacattctttgagaatatacatgttt

SEQ ID NO: 268102 - DNA, 593 bp, Homo sapiens
caggctggagtgcagtggtgtgatctcacctccacctcccaggttcaagcgattctcctgcctcagcctcctggtagctgggaatacaggcgtgcaccaccatgcccggctaatttttatattttcagtagagtcgcagtttcaccatgtttcccaggctggtctcaaactcctgacctcaagtgatccgcccgccgcagcctcccaacgtgctgggataataggggtgagccactgcacctggcctttctgtactctttattctatttcactggtctgtttcttttggtttcagtatcatagtacttttgtttctgtagcttaaaatatatatattttaagactggaggttgcagtgagccgagatcatgccattgcactctagcctgggtgacagagcgagattctgtctcaaaaaagaaaaaaagaaaaaaaatacaaaaattagccaggtgtggaggccagtgcctgtaatcccagctactcagaaggccgaggcaggaagaattgcttgaacccggaaggcagaggttacagtgagctgagatcacgccactgcactccagcccggtgacagtgtgagactccatctc

SEQ ID NO: 268103 - DNA, 280 bp, Homo sapiens
gggatcctctagagatttcagtctgagtcaggccccactttctgtccaagtgtcgtttcctgcctggtggcaatgagtatcttcactccaatggcctccttcaaccatgcccctcatccatgtccctttgcccatacctgccctgctgtcaacctaagcaacagcctcagcccctggtgtgtgtctggtttaggagagcaacacccaaggttcttctcaccatgtagaaagtggggcctgactcagactgaatcgtcgacctgcaggcatgcgagcttcc

SEQ ID NO: 268104 - DNA, 529 bp, Homo sapiens
gttgttgctacaacaggtgtttaataaaagccttttaaacaagtgaattgcaaaatttctagggagtatgattttctgaaataatccttgattattcagccgctaaccttgaatatttgacttacagttcagtagtgactggctctgttagtagcagatttagcatgaaatgaaagaacagctttggaacatagaagactttgcatgtcccatttgttctgttcctaagtccctccttatctcagtttcatcattacaaaaaaaaagtgatgagatgccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagc

SEQ ID NO: 268105 - DNA, 416 bp, Homo sapiens
catgtcattatgctaaaataatgttatagtctgagcttgcttgactagtagaccatgtcctaccttctcctcataaatacacagtctatgaaaatctaacaaaagcacatatagtagatattaaattgctcctaattctactcctgtatttacattatttctgggttatgtggacacactttagctaacatagtattgctttgtctaaagaaaataatttggttgtgtttgctttgtcttcttaaaaactttgaaagatgcttcagctgcctcgggttatacttcatagcaaaaatagagtgcatgttattatatgaatatattgtggaaaattttgaatgcacaaacttagtgtgttcaacatttattttgagtgaatatttgacatattaaataaaactctctggtgcacaaca

SEQ ID NO: 268106 - DNA, 640 bp, Homo sapiens
ccatgtagaccaaggcctgccctcggcgccccccactcttgcctctgctctgcacagtccacgtgcactgcaggaccggagcgacacatgtcttccctgaagggtgttcagtacaaggcgtgtcagtttgtccgacgagttgtccgagttactccttgtctaacctgactgacatatatttgaatactgtggttttctttctttttttttctatttgctgcccttcctggaggcagtgggttccagaagccaactgattgtccccctgccaagtcaccaagggaagctgctaagctgcttagtcccctcggtcctgcttgtagggtcttcctgattgtcaacagctgtctgggatgcttcagtctcctaaaactggaaacgcagggtgcgagcagcacacactgcctcccgccactgccagccggagtgagcggcccgagagtctctgcaggttcccctgggggctgggggccgctgaggcctaatatcaagagccaggaatgtcatgtacatggaggtgcctacggacgtgtctggtgtggtttgcagaccatcaacaagatttcaaggctttgaagaaaggagctgcttcaggaagagacaaaataactcggacaactcgtcggggatcctcgaagtt

SEQ ID NO: 268107 - DNA, 267 bp, Homo sapiens
tagagacggggtttcaccatgctgcccaggctggtctcaaactcctgagatcaagcagtccacccagcttggcctcccaaagtgctgggattataggtgtgagtgagctactacgcctgtcctggacatgtaatttttaaaagaaaatgtggccacaactctcctagagttaaatggttttctttttgttttttttttgttttttttttttgagaccatcaacaagatttcaaggctttgaagaaaggagctgcttcaggaagagac

SEQ ID NO: 268108 - DNA, 385 bp, Homo sapiens
tggtcaccaacctgggccgagcccacctcgccccacccctgcttgccggtcctcagctgccatgccagggctgcccttactgtcggcttccacagcccgcctgtagggaagcctgggcggggctgtgtcagaccgtgtagtgtgcggtgaaagcacagcgggtgcgttagtgtgcaggggctcccccgcacctcccctagcagggtcctgcctctgatgaggacttcctgtctggttggaggccccagacttggccccagggccagggaggcatcagagagcataggccttgtttccagcaccagctggggcacctgttgccgcagagctggcccaaggtgtcaccccctcctgccgcagccacccatccccaggaggcggccgc

SEQ ID NO: 268109 - DNA, 630 bp, Homo sapiens
aaataaagccaaaagaactataaagagaaatcaatagtggtaaagctgtgagtaatgcctatttttgcctcgttagtcattatttccacaaaatttattgcacaatgtcttatttcatgtttactttttgcgtgcaatttttgttggctattccttagttggtcactaaaatgttatttttttaaattgaatgtagaataaaaagttgataaatatttgcctagacggtttatcattatttgctcatcccagtagacattgttgtaccttttactcacattcactaatatgcatttacgtagtgcaggtcctttgtttcacagttactaataaggcagaagtggtgtgactgttgcaaaatatgtttacactttttaaaaagcaaggtacttagaaagggataaactatctaaacaaaaattaattaaaattaaaaattataattaaaaatcagaaaagtcataccaggatacacagacatcatcaatatgtgaattactgatcagaaacaagaaattctggaccattttactttcagttagttcatgtagagctggagataaaaatgtaaagcaaaaattattgccagacagagtggacagaactggctaaaggtaaaccaaatatgta

SEQ ID NO: 268110 - DNA, 365 bp, Homo sapiens
cattataggtactgaatacataatatttgtcaataaggactgaattagtgaatacacaataaacaaaaatataatctgctatagaagagctatctgtaagagtaatacaaacattttttcctgtgtacagctgtgtgtccattttttctcttgcttatttcttttctcacgtcctctgttacttgtatctttactgtttcctatataacaactagcttttcaatttctattttaataatttctcagactttgaaaaattgacatttcaataccctctacgaaattattatgcttttgcacatttatcttataaaagaaactatagttgaaatgggattactcaccatagaaaagccccttttctt

SEQ ID NO: 268111 - DNA, 409 bp, Homo sapiens
gcaactgtttgcagaacgcctcatttttcgacatctcacttgaatagacacctcctcaatcggcctgtacccacctgctgccacggcaatgaataccatccagctaccatgttgtacactggatgggctgggcaagcccgtcggttgcaggtctcttccaagtccagatttggtttcttaatattacggcatcttcgctctgggaaagttatcagctttccctggaagcccttctcgctgcacttcatctccctcttcctcacacccaaaccacaggttgcagaacactaggagccaagacaggatgtgtaaaagtgaagactgccaggatcacatcttctggacagaggcagtttgacataaggttgcaccatccacatgaaataggagggatgggattacacaaggt

SEQ ID NO: 268112 - DNA, 1289 bp, Homo sapiens
agacaaatcatttgaaccaagttgcggacatgaatcttgttatttgtgtcctacttttgtccatttggaaaaataattgcatgactacaaaccaaaccaatggatcttctactacaggagataaacctgttgaatcaatgcagacaaaattgaactaccttagaagaaatctactcattttagttggtattatcatcatggtttttgtctttatctgtttttgttatctccattataattgtctgagcgatgatgcgtccaaagcaggaatggtcaagaaaaaaggcatagcagccaagtcatctaaaacatcattcagtgaagccaagacagcctctcaatgcagtccagaaacacaacccatgctatctactgcagacaagtcatctgattcatcgagtccagaaagggcatccgcacaatccagcacagaaaaattaatcagaccctcaagtctacaaaagccatccataccaaacagtgcaggaaagttaactaggccatcatatccaaaaaggtcatccaagtcatcatgctcaaaaaaattaagcaagtcatctcacctggaaaaggcacataagaaaggcagcctagaaaaattatgtaagctagactatgcgtgtaagctagccagttcagataagccagtcaggccacctcagctattcaagccactttattcatctcatccacaaaatgaaatctcaccatccaagccattcggtccacaggaattggctaagcctcccaaacattttaatccaaaaaggtcagtgagtctaggcagggcagccttattatccaactctgaattagctgaaacttgtcaaccctacaagaaaaaacatcttgttgccaaaacttataggcctttggtcaatgatatttctgaggcaaaggagaaaaacactcaaaacctacatgtttcaagcaaagtcaagtcctcttccaggtcctttcgtaagttagattccaggaacaatgcatacggtgatcatgtgaatgacagtgatacgatgaaatattatagtgaggttgacagtgataaagttataatcattacgtgtgacagagggtacaatcaagtcacctctgaagtaaccctaaatgattaggagctcaacaaaaataaaatccaagtgtgaaagagcaaacttataccaactattttatgctcatcatcccttaagaaaccagtagagggaaaaatcactatcaagatcacccatatctgtcttggaggcgatttattttaaaaatatcaataaaatgcatgacataaattacta

SEQ ID NO: 268113 - DNA, 491 bp, Homo sapiens
aatgccctgattgaagcaggggcccacatggacgccaccaacgccttcaagaagacggcctacacgctgctggaagagaagctgctggccaggggtaccatgcagcccttcagctatgtgaccctgcagtgccttgcagcccaggccctgggtaagaacaagatcccttacaagggcttcatcccggaagatctagaggcattcatcgaactgcactgacctgcccagaacatctgcaccctcacctctcccctctcctgctgagacgggggaaatcagcctggggtatagcagatgctcgttcttgcctccttcaggcaccaatcaggagaagggttctgcctcccatcccctttacctgaagacaggctctgaggtgttagcgagcctttggtgctagaagccttcagggtcacatgccaagaggacagtctttctccgggagcccactgactcagaaattctgagttaggaaaagtcacaagaccttc

SEQ ID NO: 268114 - DNA, 342 bp, Homo sapiens
gtcactcttctgcctgggtcctgcataaagagggaattatgacacactgctggccccagcaccctgatgatgtgactctcctgcatgtgctggagccacagaaggaattaaaattgacctgcaagacgtctttacttcatggagatctgtagaagctgaagtccaaaatgtgacgatgaagctcggcaattacaaaatctatagataaagaaagactgccaaggaagagtaagatattcattgacacaaatgctgttgtatgaaccatgtcccaatgaaagtagacaactgtaatgtccttgagaatattttctgcaatatttgtggcaaattcagtgggca

SEQ ID NO: 268115 - DNA, 281 bp, Homo sapiens
aaaacaggagaaaaaggccctattactttcgtttatgttgctgcaattctcatgaagtatctagtagagatttcaacatctatgttaattcataattctccaagtagacatagggtaggtagatctgaaattagaactctttttttaatttgaatttttatttaaggatatctggaagaatgtttcaaattctgattagagtttattatgtgaaataatggaacacaaaaaataatgtcaataacagaataaaaacagaatcatggaaccaaaaaaatgaa

SEQ ID NO: 268116 - DNA, 263 bp, Homo sapiens
ctccccgacgctctctctggtgggggacgcttccgacgaccctgagacacccttaagaacaccatggagaccatagacgggaaggtcaggctgcagatgctggggtgagccaggccttggagctgagaagggtcttcagctggggatgcctggtactctcctccctctccttaatcctacacaaggcagattcctggccccgcccttttcccctcctcgttcctccccagagtcccccacagagagcgtcgggtaccgagctc

SEQ ID NO: 268117 - DNA, 1711 bp, Homo sapiens
ctatgctttcacccacctcagcctgcaggagtttcttgctgccctgcacctgatggccagccccaaggtgaacaaagacacacttacccagtatgttaccctccattcccgctgggtacagcggaccaaagctagactgggcctctcagaccacctccccaccttcctggcgggcctggcatcctgcacctgccgccccttccttagccacctggcgcagggcaatgaggactgtgtgggtgccaagcaggctgctgtagtgcaggtgttgaagaagttggccacccgcaagctcacagggccaaaggttgtagagctgtgtcactgtgtggatgagacacaggagcctgagctggccagtctcaccgcacaaagcctcccctatcaactgcccttccacaatttcccactgacctgcaccgacctggccaccctgaccaacatcctagagcacagggaggcccccatccacctggattttgatggctgtcccctggagccccactgccctgaggctctggtaggctgtgggcagatagagaatctcagctttaagagcaggaagtgtggggatgcctttgcagaagccctctccaggagcttgccgacaatggggaggctgcagatgctggggttagcaggaagtaaaatcactgcccgaggcatcagccacctggtgaaagctttgcctctctgtccacagctgaaagaagtcagttttcgggacaaccagctcagtgaccaggtggtgctgaacattgtggaggttctccctcacctaccacggctccggaagcttgacctgagcagcaacagcatctgcgtgtcaaccctactctgcttggcaagggtggcagtcacgtgtcctaccgtcaggatgcttcaggccagggaggcggacctcatcttccttctttccccgcccacagagacaactgcagagctacaaagagctccagacctgcaggaaagtgacggccagaggaaaggggctcagagcagaagcttgacgctcaggctgcagaagtgtcagctcctaggtccacgatgcggaggccctcatagccctgctccaggaaggccctcacctggaggaagtggacctctcagggaaccagctggaagatgaaggctgtcggctgatggcagaggctgcatcccagctgcacatcgccaggaagctggacctcagtaacaacgggctttctgtggccggggtgcattgtgtgctgagggccgtgagtgcgtgctggaccctggcagagctgcacatcagcctgcagcacaaaactgtgatcttcatgtttgcccaggagccagaggagcagaaggggccccaggagagggctgcatttcttgacagcctcatgctccagatgccctctgagctgcctctgagctcccgaaggatgaggctgacacattgtggcctccaagaaaagcacctagagcagctctgcaaggctctgggaggaagctgccacctcggtcacctccacctcgacttctcaggcaatgctctgggggatgaaggtgcagcccggctggctcagctgctcccagggctgggagctctgcagtccttgaacctcagtgagaacggtttgtccctggatgccgtgttgggtttggttcggtgcttctccactctgcagtggctcttccgcttggacatcagctttgaagccaacacatcctcctgaacgggagc

SEQ ID NO: 268118 - DNA, 1663 bp, Homo sapiens
ctatgctttcacccacctcagcctgcaggagtttcttgctgccctgcacctgatggccagccccaaggtgaacaaagacacacttacccagtatgttaccctccattcccgctgggtacagcggaccaaagctagactgggcctctcagaccacctccccaccttcctggcgggcctggcatcctgcacctgccgccccttccttagccacctggcgcagggcaatgaggactgtgtgggtgccaagcaggctgctgtagtgcaggtgttgaagaagttggccacccgcaagctcacagggccaaaggttgtagagctgtgtcactgtgtggatgagacacaggagcctgagctggccagtctcaccgcacaaagcctcccctatcaactgcccttccacaatttcccactgacctgcaccgacctggccaccctgaccaacatcctagagcacagggaggcccccatccacctggattttgatggctgtcccctggagccccactgccctgaggctctggtaggctgtgggcagatagagaatctcagctttaagagcaggaagtgtggggatgcctttgcagaagccctctccaggagcttgccgacaatggggaggctgcagatgctggggttagcaggaagtaaaatcactgcccgaggcatcagccacctggtgaaagctttgcctctctgtccacagctgaaagaagtcagttttcgggacaaccagctcagtgaccaggtggtgctgaacattgtggaggttctccctcacctaccacggctccggaagcttgacctgagcagcaacagcatctgcgtgtcaaccctactctgcttggcaagggtggcagtcacgtgtcctaccgtcaggatgcttcaggccagggaggcggacctcatcttccttctttccccgcccacagagacaactgcagagctacaaagagctccagacctgcaggaaagtgacggccagaggaaaggggctcagagcagaagcttgacgctcaggctgcagaagtgtcagctcctaggtccacgatgcggaggccctcatagccctgctccaggaaggccctcacctggaggaagtggacctctcagggaaccagctggaagatgaaggctgtcggctgatggcagaggctgcatcccagctgcacatcgccaggaagctggacctcagtaacaacgggctttctgtggccggggtgcattgtgtgctgagggccgtgagtgcgtgctggaccctggcagagctgcacatcagcctgcagcacaaaactgtgatcttcatgtttgcccaggagccagaggagcagaaggggccccaggagaggtagggcccgatttcaccccaactccatgctcagtcagggacattcccctctctaccctccacagctgggcagtgccagtcagtcaactgccagggtgacctggacaaattcacggaagagcgggaagtgagcaggcacagcaggtggccaggaggcaacaggagcgaaaggctgtgtcaaagaggagccctgaggctccacagccagtgatagctatggaagagccagcagtaccggccccactgcccaagaaaatctcctcagaggcctggcctccagttgggactcccccatcatcagagtctgaggctgtgaga

SEQ ID NO: 268119 - DNA, 792 bp, Homo sapiens
ctatgctttcacccacctcagcctgcaggagtttcttgctgccctgcacctgatggccagccccaaggtgaacaaagacacacttacccagtatgttaccctccattcccgctgggtacagcggaccaaagctagactgggcctctcagaccacctccccaccttcctggcgggcctggcatcctgcacctgccgccccttccttagccacctggcgcagggcaatgaggactgtgtgggtgccaagcaggctgctgtagtgcaggtgttgaagaagttggccacccgcaagctcacagggccaaaggttgtagagctgtgtcactgtgtggatgagacacaggagcctgagctggccagtctcaccgcacaaagcctcccctatcaactgcccttccacaatttcccactgacctgcaccgacctggccaccctgaccaacatcctagagcacagggaggcccccatccacctggattttgatggctgtcccctggagccccactgccctgaggctctggtaggctgtgggcagatagagaatctcagctttaagagcaggaagtgtggggatgcctttgcagaagccctctccaggagcttgccgacaatggggaggctgcagatgctggggtgagccaggccttggagctgagaagggtcttcagctggggatgcctggtactctcctccctctccttaatcctacacaaggcagattcctggccccgcccttttcccctcctcgttcctccccagagtcccccacagagagcgtcgggtaccgagctc

SEQ ID NO: 268120 - DNA, 1137 bp, Homo sapiens
  misc_feature (15)..(15): n is a, c, g, or t
  misc_feature (68)..(68): n is a, c, g, or t
  misc_feature (72)..(72): n is a, c, g, or t
  misc_feature (81)..(81): n is a, c, g, or t
  misc_feature (92)..(92): n is a, c, g, or t
  misc_feature (97)..(97): n is a, c, g, or t
  misc_feature (111)..(111): n is a, c, g, or t
  misc_feature (202)..(202): n is a, c, g, or t
  misc_feature (223)..(223): n is a, c, g, or t
gcctttgcaaaaacnctctccaagaacttgcagaaaaaggggaagctgcaaaagctggggttaaaaanaaanaaaaaaaangaacgaagaanaaacnaaatggtgaaaaanttgcatctctgtccaaaactgaaaaaaataaattttcgggaaaaaaaaataaataaaaaagtggtgctaaaaaatgtggaagttctccctnaaataaaaaggctccggaaanttaacctgagcagcaacagcatctgcgtgtcaaccctactctgcttggcaagggtggcagtcacgtgtcctaccgtcaggatgcttcaggccagggaggcggacctcatcttccttctttccccgcccacagagacaactgcagagctacaaagagctccagacctgcaggaaagtgacggccagaggaaaggggctcagagcagaagcttgacgctcaggctgcagaagtgtcagctcctaggtccacgatgcggaggccctcatagccctgctccaggaaggccctcacctggaggaagtggacctctcagggaaccagctggaagatgaaggctgtcggctgatggcagaggctgcatcccagctgcacatcgccaggaagctggacctcagtaacaacgggctttctgtggccggggtgcattgtgtgctgagggccgtgagtgcgtgctggaccctggcagagctgcacatcagcctgcagcacaaaactgtgatcttcatgtttgcccaggagccagaggagcagaaggggccccaggagagggctgcatttcttgacagcctcatgctccagatgccctctgagctgcctctgagctcccgaaggatgaggctgacacattgtggcctccaagaaaagcacctagagcagctctgcaaggctctgggaggaagctgccacctcggtcacctccacctcgacttctcaggcaatgctctgggggatgaaggtgcagcccggctggctcagctgctcccagggctgggagctctgcagtccttgaacctcagtgagaacggtttgtccctggatgccgtgttgggtttggttcggtgcttctccactctgcagtggctcttccgcttggacatcagctttgaagccaacacatcctcctgaacgggagc

SEQ ID NO: 268121 - DNA, 669 bp, Homo sapiens
gatggggattgagggaggactccagccccacaatacagtgcattgggccccccgtctcagcctctcagggaaccagctggaagatgaaggctgtcggctgatggcagaggctgcatcccagctgcacatcgccaggaagctggacctcagtaacaacgggctttctgtggccggggtgcattgtgtgctgagggccgtgagtgcgtgctggaccctggcagagctgcacatcagcctgcagcacaaaactgtgatcttcatgtttgcccaggagccagaggagcagaaggggccccaggagagggctgcatttcttgacagcctcatgctccagatgccctctgagctgcctctgagctcccgaaggatgaggctgacacattgtggcctccaagaaaagcacctagagcagctctgcaaggctctgggaggaagctgccacctcggtcacctccacctcgacttctcaggcaatgctctgggggatgaaggtgcagcccggctggctcagctgctcccagggctgggagctctgcagtccttgaacctcagtgagaacggtttgtccctggatgccgtgttgggtttggttcggtgcttctccactctgcagtggctcttccgcttggacatcagctttgaagccaacacatcctcctgaacgggagc

SEQ ID NO: 268122 - DNA, 371 bp, Homo sapiens
catttaaatgattgactgcaaggtttccagctttgagatgaataggataatgatgtcatcatgaacacagaagtaaatgcgtgtttggcaataaaagagatgggttcaaaatgaaaataataggctgggcgcagtggctcatgcctgtaatcccagcactttgggaagcagaggcaggcgtatcacttgaggtcaggagtttgagaccagcatggccaacatggcaaaaccctgtctctactaaaaatacaaaaattagccaggcatggtggtgggcgcctgtagtcccagctacttaggaggctgaggcaggagaatcacttgaacccagaaggcagaggttgcagtgagccgagatggcaccactgcac

SEQ ID NO: 268123 - DNA, 469 bp, Homo sapiens
aactagccaagcggagtgataatgtgcctgtagtcacagttactcgggaggctgaggaggaaggatcacttgagccggggaagttgaggctgcagtgagacgtgatgatgccactgcactccagcctgggtgacagagtgagaccctgtctcaaaaaaaaaaaaatatatatatatatatatattatttttatgaggtgaagtgcatcaaacttgggaaagatttgaggaggctgggaacctcctggaaaaccactccttgaagaaagatatgagagacatttagaagtgattcctgctttcagaaggaggtggattcaaatacatcaaaagtcccttcctctgctaagtgtttatagttcaatgaataatttcaatatttttatgtgttcttgtcattttatttttttctgaaaaacttccaaaaatttgaaaataaaattacagccttttcttcttaaaaaaaaaaa

SEQ ID NO: 268124 - DNA, 1048 bp, Homo sapiens
gcgaaccccaaatgtgtgcgctgagccgaggcctctaagcggtaggagagaatctgacctccgacattcttttcaagacacgcgccggtggaccgggtcctgggattggcttactcccgggctggaccttggggttcgcatatttgaaagcgtaaacttgaggaatgacggcggggtgatgggtattttatagagtgggactcaatcgtgctcagcaacagatttctccaaattcccttttaaaaagagcctcccagagctgtcgaaatctccgcggggtgaaagctaaacttttggagtcgctgtgtagccgggtagaggacacggcggcgcgagccggaaagataagtgtccaggcgaatgggaaaggaaagatcttaatttttgttcctactgttagctgaatgtccataaaaatcaaagggaatgcggggaagtttttattccagagcgtttccatgacacccgcagagatttaaaaaattacattcctccccctacgcaggtttaattcggaaagaagagactgcagaggagagggaagaccgtgagtctgctttcacctaggtttaaagcgaatcaaagacggctgtaaaaagggaaaccgggaccaaaaacagatttggagcctcgaaactctccattgaaggtttggaagatacgttgctgcagacttgaaaccggctccaaatccggcccaaacatgggctgaaaatatggcgcgctaatctgctgcttcccctcctcctcaagttctttctgactcttcccacctttcccagtttcccttccagacgtctgcggctccccactccacccccaggatagctactctacatcccgacaattcccagcttctacacccaggaggaggaattctggaaccacccagagcgaactcgtgccggggcggggtggggaccggaggaaggtcctgctccggaattctctccagagcagaaaagaattctagaggctacatgtgggctgctttccccccttcttccttttttccctcgcaaaccaacaaccaaaaagtgtttggtga

SEQ ID NO: 268125 - DNA, 402 bp, Homo sapiens
ctctgaagtgagactaaaactatattttcaagtgtcactactgttttgaaatcaatgatgtctcacacttgacttcagtcttgcctccctgtgtctaagtcccagtcctggtgacattcttaatatgcaggtaatttagataggcagttttaaaataccattggctgagaaggtaatttactgacaatttccagttagttaaatgcttcccctgccatgaacaacaatgactaacatttattgggcattactgaatgacaggtacttaacatcttttacctcatttaattctcagaacaatcctatgaaggtggcacaactattattattgtaccctgtttatagatgaggaaattaaggtcaagatcacaatgctaataaatggtagagttgagactcaaa

SEQ ID NO: 268126 - DNA, 623 bp, Homo sapiens
tatgcctatgtgtgtatgcaaatacatatttccatatatctgaattacttgaggatatgtttctattttttattttatttatcttatcttttggttatttggccctattttctggtatgcctgttaatatttgattgaatgcccgacattgtataggaaaaaattgcacactctgggactctggttgatgtgatctttcagcaaatatctaaatatttttggtaaaaaaataacttttatctcagtataattagtagttaagaataattgaggctttatctgaggaagaagagcctattaatgatttgctcttctaggatttcaattgaaaacctggcatgtataccaggaccccacctagactctaattttttgcctgtcttttttttttccctaagactatgcaatagaggaattaacaaacaaaacagaaggaaaaacaaagataatttaaaaggctcacctacatggtttttcttatatctaggatcttgatcccacaagtcctagaagcctttgttactcacttatgtctttaaccatatttttgagaaattttttccagcttctatttcttttctcagcaggaggattttttgatatgcttcatagctggagacaga

SEQ ID NO: 268127 - DNA, 679 bp, Homo sapiens
gctctccatctgtacctgaggccctactaagactcattcagttgtgactcataaggaaaatagccattttcattttctgactcatgaacacagtgtacagcttgtagttcaccttctatcttcctcctgaaaactcactttgggacacttttctatcttgagaaaactaggaacactaccaggcaatagttacttgtgtctttttcctaaggagacttgaagaagttaaaaaaaaccctgcacatctttataatttagtggaggttgtttagcagagtacaaaaaaatctctgttgactttaaccgtaatacccatctaaggcttccttcgtagaatctgggcttatcatcatctgcaaaggaagttctgcttttgtggccatgaccagtttggactctctgatagactgaaacccatggctgtaggtccgctatgtgctttggatccagaaattgtgattcatttttatgcaaggtttctgtgcattaaatatacagaaatatttgagcaaatctgaattgaccatcacctcaaaacatgttcaagagctgttcccttttccttacttgcatatacttgtgaggaaattatagatatgacacataagaatacccaggaatagatttacaacctagaaatctgatggatagctgatgataaggtaggtaagttccttta

SEQ ID NO: 268128 - DNA, 571 bp, Homo sapiens
gtgtccaaaagtattagaaacattagtattttgggataaataataatagccaaggatcaaatcttgctttatggcaggggatagtataatttatgaaggagcagcctggtgtagtggagtgaatgtggacttcagagtcaagctgactaatgtttgaaattcatttttatacttattagctatgagaccttgaagaaattactttagatcctgacagataatgtatgtgcttgacacatagtagatatttaataaatggtccttctttacctgtacctcttactgatctttgtaactccactatctaaaacatgttagacaatgtatatttcttgaatgaatagaatggataaatgctagtttatagttgattaatttgttaaatatttaatagtatctattaagtgctaggccctattttagctgctgggatagaataaataatctctgcattcttagagtttaaactctaaaagcagtaattggacactgatatgtgatgtaagaaaaagtagagtatgttaaaagaataaaagtgtatggaggaaaaagtagagcagggtaaagagga

SEQ ID NO: 268129 - DNA, 219 bp, Homo sapiens
gccagtgcagtacaaaccttagtcatgaacataacagtatgtggtttactgggttgtttgtctcatgaggccaaacagaagctcccaagcttctgcataaatggctttatatcttccttttagggtagggaatgataagagggcaggttagaagcaaaatatgcttttatgagcaattgggaggatgttggagactcctgagagtttcctgtgtctcct

SEQ ID NO: 268130 - DNA, 309 bp, Homo sapiens
cagctaataacaaaagaaaggatgaacattggcactgtagatgttgacagcattatgcaaacttttcaatattcccttgcatgctcaactttaacttttgtttataaattccacttagacataatttacaacttctgttaacttaagctgggttctgtaaatctgtctaaaaaaatcagggcagagtgctttgagatgttacaaatatatctagatatcaaacattgagctgcacaaattgtatccactttggaaactctaagtttgtatttatgtccataatatattttagttctgatgtttttaaaa

SEQ ID NO: 268131 - DNA, 170 bp, Homo sapiens
tcttcagtccaagtctctttgtttgagaaagactcttggcagagtgtgaggggtgaggacatcactgttggcctggaagaaacagatgatggtaatcatgttgggaaagggttatttccattcttttgttgtgcttgtcttcctaattaaaggctcctttataaagcaac

SEQ ID NO: 268132 - DNA, 381 bp, Homo sapiens
gtgcttcccacagcagctctaaccacagctgtatctcagtgcagaacactcaaatcagatggaagtccagtggtctcaaccttggcctgttttcaggaaaagcagagaaagagattcaagaactcttagtaaaagagatgtgagggacaaaatggacttgaggtgggaagtcatcagacagcagctcctgccactgctttacctatgttccatcccctgcctccggctaagaaatggagcttgcgctggtgtgcacagttgagtcctctagaagagcggctatttcagagaatgtacacattgtggggtcagcctcaaattgtaccacagattaactgctgctttgagctggattaaaatcacagcctctgactgccaatt

SEQ ID NO: 268133 - DNA, 271 bp, Homo sapiens
acctcagccaatccccctgcctcagcctcccaaagtgctgggattataggcgtgagccaaagtgcccggctgcagattactttttattttgtatatttaaaaaataatacatgacttaaaaacattcctgctagaacgtctgagtggggctgggcacagtgactcactcctgtaatcccagtactttgggaggctgaggctgattgtttgagcttaggagttcaagactagcctgagcaacatagcaagatctcatcgctactaaaactga

SEQ ID NO: 268134 - DNA, 698 bp, Homo sapiens
aacagcatactttgtattaggtgaacccacaaagtacaggggccaattgtaggtagtccacaaacacttttaaatctttgtgcatttattgtatgttagaaaaatttatacatagcatattaaagcattaatataaaatatcttttaaaaattaaggtatatcttcaaaagaaaggaaaacatcaagtaaacaattatagataaataaagtacaggtaaaaggcagatgtggtaacaattgtatgaagaggaatacaagtgtctagggcttgggggccacacactaaacctggcatcagaaggcccagatctgggacccggctcatttgttttctagcactaggttgtttttcatccttgtataacaccatggcccaggtactactctaagcactttataaaaattaactcctggccgggtgcggtggctcacgcctgtaatcccaacacttttggaggccaaggtgagtggatcacctgaggtcaggagttcaagaccagcctgaccaacatggagaaaccccatctctaccaaaaatacaaaattagccaggagtggtggtgcttgcctgtaatcccagctactcgggaggctgaggcaggagaatcacttgaacccaggaggcggaggttgcggtgagccgagatcgcgccattgcactccagcctgggcaacaaaagcgaaactctgtctcaaa

SEQ ID NO: 268135 - DNA, 375 bp, Homo sapiens
agccgagatcacaccactgcactcagcctgggcaacggagcgagaccctgtctctaaaaaagaaacaaaacaaaaaatacacacaaaaaaatggaatgactgacagacactacagcagtgctgcagctggaagacatgctactgaaagaagccagtcacaaagggcagtgtagcgtgattccacttacgtgaaatgtccagaataggcaaacccatggagacagaaaggggattagtggttgccgaggactgggggccggcgatcactgttaggaggttcagagtttcttttggggatgttgaaaatattctagaattgattgtggtgacaggtgcacaaccctataaatacactaaaagccattgaactgtacg

SEQ ID NO: 268136 - DNA, 474 bp, Homo sapiens
gaccaaagccagcaagacagatttcattctgaggctttttcttttggcttatactggttaccctctcatggtatgctcatatttacctcttttcgtgtgtgcttggggttgggtcagggtggagagcaagatctctggtgtccctttttataaggccactgttaccatcatgacctcatctaaacctaattatctcccaaagattccatctccaaataccattttattgaggtttagagctgtaatatatgaaatctgggggacatagtccatagcaatcaatatacaaaaatatgctctagtctattatagcaatgaataatctgaaaataaattaagaaaacaattctatttaccatagcatcaaaaagaaataaatctaacaaaataagtgtaacacttgtacactgaaaagtattaaatattgttggaaatactaaagatctaaataaatagacatttcttatttaatga

SEQ ID NO: 268137 - DNA, 955 bp, Homo sapiens
cagataaggaaacacacctcgtctaggaagcaaggggaaatatgacaaagcacacagaaactagaaataaaagtcaaaaatctacaccatcgaacccaaataatcttcttcagttttaatgatggacccaaaccaaaacagttctcacgttcacatgttagaaactaactccatctgcatcacttacgataggctgtagtaaactgaaccaaataagaaaaatcccagcagcaaacttgctgacaaaactttagccgattgccagggtagtccggtacaggaacgtcaaatgaaaccaatgtgctgtaaataaacctttattgtattttgtgatacggtttgaatttaaatccctaggtagcgccacgaaacaaaagacatattgatgctactgccatggagcagcacagtttgtctagaaaataaacgagacgaaacagcagtctagaagtaggcaccaaatccaagttttcatgtgcgatccaggtattagggtccatccaggaacagcctgctggaattgctagcctggcattcacagaagattgtgccacccacgaggaatgtgttttcagccctgaaattcctgggagtgagaggtgaagccagctggatttctgggttgggtggggacttggagaacttttcttacaagaggattgtaaaatgcaccaatcagcactctgtagctagctagagttttgtaaaatgcaccaatcagtgctctgtaaaaacgcacctatcagcactctgtaggtagctagaggtttgtaaaatggaccaatcagcactctgtaaaatggaccaatcagcagggcatgggcagggacaaataagccaataaaaactggccaccccagcctgcaggggcagcctgcttgggtccttttccacattgtggaagctttgttcttttgctcttcacaataaatcttgctgctgctcagtctttggg

SEQ ID NO: 268138 - DNA, 397 bp, Homo sapiens
ggaggtgattgggtcatgaaggctatgccctcatgtatattttaattcattaatggattattggattaattggttattgaggaagtgggtttgttatcacaagtagatctgttgtaaaagccagtttggccatctctcgtgagctcctcctgcctgtgatgacttctgccatgttataacatagtagagctcaccagaagctaaccataaccaccttcaccagaagccacctgatcttggactctccagcctgaagaaccatgagccgaaatacatctcttttcttcataacaaacagagtacctgtttgttatataataccagtttgttataacaaacaggtattgtgttataacaacagaaaatggactaaaacagtctgtcttcaaatttcccc

SEQ ID NO: 268139 - DNA, 381 bp, Homo sapiens
gagctggaacccttcctttcacagatacctggaaattgagccagatctgcatccgagggacactagaagggatggggaggagcgcttacccctgaactctgttttgtctcatgtttggaggcccaaggtcatttggttcttcagatttccagcaaactatagctctcactcccttcccgcatgccctcaccccacggcttttacacttaagaggaatggccctgccttctctgggcccacagctcctgtggcttgaggttccagccgtcttgttaacaatttttctccctgcgatgtaggaatgatggctgtgttaacaggtcggggggcggttggggagacactaacaagatgataaaccttggtatttggctctgctgc

SEQ ID NO: 268140 - DNA, 199 bp, Homo sapiens
agaaagtgagttctgccaacagtctgcatgagccttgaaacagttctcctctggtccagcctctagatgagagtgcagtatggccgacactttgactgcagcttcatgagaccctgggcagaggacccagctaagctgtgcctggatttctgatccacagaaactctgagataataaatatgtgttgttttaagcagct

SEQ ID NO: 268141 - DNA, 332 bp, Homo sapiens
atgaaattatatatatatggggccatatcctaaactggaccactatgctactgggtattaatagttgtacacatgttcaggtgtttggaaagtgctggattatgtgttaacagatgccttttgttttaaaccacagggcacttcagccattaatgaatgtgctctccagaggggaaggatgtgatttgtagtatatcccaaacttaactacatttttttgtgtgtgtgtatggcatgcattttaacacttcacacagaccagcgtttgtaaaagctgacccagaggtattctgtatcatctccttcctgtggttttccataagaattaaaaa

SEQ ID NO: 268142 - DNA, 204 bp, Homo sapiens
agagagcagggagacaaatgaacccagaacacaaatggtaaagaagaaaaatgagagaatttgtaaaagacagcattcgaacatgccgaacaagagcagggtactggtgttcaaacacctgtatctcccccgtgtaacccgtcaactaatatctttccatatttgctccagatttgtctttagaaataaaacccacgttctgaa

SEQ ID NO: 268143 - DNA, 457 bp, Homo sapiens
ctagtaataatttggtttcctataaagggttcagattccattgactttctgaagccaccaagtcagcaaaacagattatgatcattacttctctaccatttaactgtgagcaatctcaaagttagtctgaaagagtctgatggtattaaatctgaaagttttaacaactattaaagatctccttcataggcagtaggagctcaaaatgagtctgaaggttgattcttctgtctcatgaactttatcttagataagtgattaggtagaatcaccctcagctgaaatcctgggagggctcagtgtaactctttctctacagaaggtgacagcaactttattctgatctcaaaagactgaatttagtagggaaaggaacgctctccccattttagagcaggtaggccagctggtaggggtagaacaatagaaataatgaaaaacaacaacaacaacaaca

SEQ ID NO: 268144 - DNA, 377 bp, Homo sapiens
tgcctaggaattattctttgttcactattgaacactatgtgtagctaccagcaaaatgctaaataatacagcaagattgtataattgtggtgtaatttccagaaatccttcttcttcttaagtttctttaaatgacttttttttttttttaccatgaaaagactaccaaatgactcaaagaactcagtatcctccctactcttgcctccaaaaatgcatattaatctcattgtggttttaaactaaggagaaagtgtagtcagacagaagctgtagggtgcaggatgataatagcataagaagatgaggaaagctgtggggataacattagtgtttcaaagatctgtttccattatcattgcttttgttattataat

SEQ ID NO: 268145 - DNA, 337 bp, Homo sapiens
actcagtataatttgacactgaatatgatctaaccagaattacaatatcagggagatgggtgagaggaagtaaattcatggtgggcaggaggaagagaggattcaaaagataatggtggccgggtgcagtggctcacacctatattctggatacacattttttattagacttagctttgccaaaatttcgtggttagtcttttaacagtgtcattggaaagcagttttttattttggtggtctaatatattagtttggtctttcatggatagtacttttggtattatatctgaatttttgcttaacccaaggtttagggttacatttcttctagaag

SEQ ID NO: 268146 - DNA, 264 bp, Homo sapiens
tgttctctttttgttttgctttgtttattacaaaaaggatttgaggatttaaaaaaaagaagaaatgtgaaaatagagacaaaggggaactaaagataaggaaataaggccaggtgcagtggctcccacctgtaatcccaatactttgggaggccaaggcaggagaatggcttgaagttggagttcgagactacagtaagccatgatggcaccactgcacccactctgggggacagagcgagaccctgtctctaaaaaagaaaa

SEQ ID NO: 268147 - DNA, 399 bp, Homo sapiens
caacatggtgaaaccctgtctccaaaaaataacaaaaaaaaaattagctgggagtagtatcgtgtacctgtagtcccagctactcaggaggctaaggtgggaagattacctgagcccaggaggtcaaggctgcagtgagccgtgttcatgccactgcacttgagcataggtgacagagtgagacattgtctccaaaaaaaaaagttaaggacacttccactaaaaccacatataggaaatcttaagtcaaatagcaaatattaataaaatctggcagaatattgaaagattcctaaatgtgaccagttaagatttggctcacgcctataatcccagcacttggggagcccaaggccggtggattacctgaggtcagcagttcgagaccagcctggccaa

SEQ ID NO: 268148 - DNA, 497 bp, Homo sapiens
ctctttgttatttgagcagctggatgagattcctgatttccataatctgtacctggaggtttatacaggagaggatcactggggcagacttgaaccatggtgcccacaagtggggagggtgctccagcggccatggaaagaacttccttctgcagttggagacagccttctgtgtgggctgaaggacagagtgtgattttctacttggaagagactccagggctctgcagagagggaagccctgctgacccatttcagcagactgtgacacttcagcgacctgcaaattctacacattagagttcatattttatacaaactccgtacacctagatgtggacttaacatttctaccaacaacatccaacttccaacaaaagatgcaggcccatcagaagatgaaagctactaatgaagatgcattaaagatgatatttatggccaccccttagggaaaaaaagattcataaataatttcatggaaattacacccaaaa

SEQ ID NO: 268149 - DNA, 177 bp, Homo sapiens
gaagaaattacctcaatataataaaagccatatatgagaagcccacagctaacatcatactcattgatgaaaacataaaaccttttcctgtaagattaggaacaagacaaggagatgtccactttcatgacttctattcaacatgataatggagttcctagccagagcaattaggca

SEQ ID NO: 268150 - DNA, 522 bp, Homo sapiens
cccagctattctggaggctgaggcaagattgctcgagcccaggagttcaaaaccagggcaacatagtgagacccctgtctctataaatccacccctcattgttatccctgttttatttttatttttaatgtatcaacctacctgagctggaacaacatttcccaaaatccttccctgagttagcatggctgcatgaggtttggaaggtgagaatgcagcatctgccatactctttttgtgctggaaaatcagtgcagagccacaggcactgttggagatcacctgctcgatcaccttgttagtgtggggcagcagccgagactttagtcttttggctcccaccaattttcttctagcttctccaactcctgggctaggtacatgctgagtttcaggaagaaagacagaagtggtgggagattgtcgtgggttccagttcatcatcattctcccccacttcacatccatctttttttcctgattcccatcccactgacttcaagctccagcatcagacacaaa

SEQ ID NO: 268151 - DNA, 454 bp, Homo sapiens
ttggaaagacctaaagtgggaatgctaattcctgtctctatactgtcattagaatctatggagaaaaattgagtcaatatgtatcgatctatttcagaactactaatcttcttacaaagacatcaaggaaaaattacatagaatataaattgctgaaacatgaattggattttacttaacataatatacaagaaagcatgtaagactgcaaggttaggatacaggagttttacaattttgctacagattatgtaacttcaggtagaatgacactcaatacttggatggtgttactatgaaattcatgggtaagaagttgggctagataatttctaggattattttgggttattactcaatttctaatcctcagagtctatattaatttcctcttgctgctataacatattaccacaaatttagtggtttaaaacaacacaagtttattatcttc

SEQ ID NO: 268152 - DNA, 495 bp, Homo sapiens
atcgactccattttccatttccttgcaatatgtattgagcttttcagtcctgttttgtcatcatgcaaacaagtaaaattcttcaggatgcagacccacctaatagtactaaaaaggaatctttaaaaaatatggagatgtcttctccctatggagctacaggggaaaagacaccactctgtgtcataaaatctatttaaatggttgccgggcgcggtggctcacccttgtaatcccagcactttgggaggccgaggcaggtggatcatgaggtcaggagttcaagaccagcctgaccaatatgatgaaaccccgtctctactaaaaacacaaaaattagccgggcgtggtggtgtgcatctctaatcccagctactcgggaggctgaggcgggagaattgcttggagccaggagatggaggctgcagtaagctgagatcatgccattgcactccagcctgggcaacagagcgaaagcgagactccgtctcaaaa

SEQ ID NO: 268153 - DNA, 880 bp, Homo sapiens
tgtcctgttatattgactggtttcataggagaatatatttttggattgagttttaattcttcagtagcagctgaataataaaataacgttgttacatttatgattcagcttaatgaatgattacattattagtattcctgcctgtgttttttgtttaaacatataacgtctttcaagaatagtgtacatatctgtctgggcactgtggtgcatgcttataatcccaacattttgggaggccagggtgggtggattgcttgaggccaggagttcaagaccagcctgggcaacacggtgagaccttgtctctacaaataattttttaaaaatcagctgggcatggtggcatgcacttgtaatcctagctacttaggaggtggaggcgggaggatcactctagcccaggagttagaaggtgcagtgagctatgattgcacagctgcatccatcctgggtaacaacaagaccctgtctaaagaaaaaaaaggaacatacatacattattttagcttcttttataatcccctagcttaggaactggtcagtaaatatagagtgaataacagatttatactggaattatctttactagtttgttatacttcctctttaagatgttttgtcaaagaaattctgaatttattttgtttctctacatgttagctagactcatgtatcatttagcaacaacaaaaacttatttcatgtgatagactgactgtttacttctagctattgttggctatgtcagagagaccagataccttagccaagaatggttatcaagactggagaaactgaatatgtgtgtgagtaatcttttgagaacaggctggtattatctttttgtaaagggatcatattacatttctagaatttc

SEQ ID NO: 268154 - DNA, 377 bp, Homo sapiens
gtctggaaatgggaccgccttcacctttcccaagtgaaaagtcaaatttcaacccacccctattattcactccatccagccttcactgagtacttacattgtgctggggactagggacacaagaactgataagacaggaccctgctcattgtcctctgctcattcccctccaaaaaagtctaggatctgaatgcatgccagtctccacctcatccagtgtataaatctattccaaccctgtggttatgtcactgtgctgagagtgcattgtgctatgtcttgaagacgtctgtcttgtacgttttaaaacatgtcaaggttattataaaataaatgcatcaaagcaatacttttgccagctttcaacttatgaatat

SEQ ID NO: 268155 - DNA, 722 bp, Homo sapiens
aataagtgttttaaaaggtgatccaccttaagcggcaatacttgttttaaaaggtgagcaactttaaaaggtgcttagctttggtcatcagtaaaatacaaatttaaacaacaatgtaattttttacacacctgataagatggctaacatagaaaattacagcaatacaaaggtaattgaagatgtggagccattggaatttcatatggtgttagtggaagtgtaaattattgcaaccacttttgaaaactggcaatacctactaaagctgaacatgcatatttcctacaactctatgacctatgcatctaaaacctagtataagactatttcatagcatcactgttggtaatagtccacattaaaaacacctcaattcccatcaaccatagataaaagtatggcatacacatacaatggagtactatatagcattaaactaacataaaaatttcaaatctcacacagaaaaggaagttcaaagcagttacttttaaatgttaaagtcttgagtccaatgttgaattttatttttggtgaaaagttggatttgacatactcttataacctaaaatcatcaagcactttctattgtcatatatgttatacattggggatagtgtaaaggggaataattttggagaaaaatgctcaatacctatttctgataaatgttttgtttaagtgttatacacaagtccatggagaaaatcatgtttcat

SEQ ID NO: 268156 - DNA, 318 bp, Homo sapiens
gatttattttctgaaagcctggagagtagggggttggggaatgacttataagttaaccagggattatgtgtatataattataagctgcaatcaccatgattcaatgatattcaaacttttaaagtttttttgtcaaagaaagaaggaagggaggaaggaaagaaagaagaaagaaggacagaaagaaaattaggtcttgcctacaagattacttatgagacttaaggaatttacacattcatggctgagtgctcgataatacattcccagtggaatggtctctagaaatgtctacaattaaaaacagaacagtagaaa

SEQ ID NO: 268157 - DNA, 383 bp, Homo sapiens
tgttttgttttgttttttgcttgtaccatagaccacaagggcagaaaaaccaaatagatgagaagggaatcccaatagggaaattcctgaggcgagatgtgagggaatgaggactttgctacttggcaaatttgaatgaggtgggagcccacatccatagccttgtctgacctccctcaggtggggctgcctggggcacagacacactttctactgggacatgctctgcttgctgctgggaggaagtggtgggtcttgaagaccatattggggaccagctctgacactaactgtgtgatcttaagcaaaattactcacccatctgaacctgttttctctcttctgtacaataagcaatacttgtcttgtccaacctacagagt

SEQ ID NO: 268158 - DNA, 595 bp, Homo sapiens
tcttcaccccacatctttctctccaccacggccctagccctgatgcactgcaggcctctctgtccccctgcctcacactagaggtccaccaagagcgggcactgtcgcccttttcacccatgtatctatcctccaagccaagccgcagcctggtataaacctggttcctcaatcagtgtggactgaattggatgcgcatcctttcagtcttcaaaagcaggtgtggggcagcgtggccggagaacatggtggtgcagtttgtggacaatccgaggcagcaggggaaacgtgtttccccaacttcccccaggaaattgtttttcagtgggaagtgcaataaaattgctcaaagcacctgctatgtatcagcatatgtaaactgtaaaatacacgtttttttctttgttaagagtataaaaaaatagaatcacaattttttcatgaagactgaaagcaaagcaaactataagcccggagaaagacagggagaagcctcagccccagagctcccggggccgaaaacaggactggttgaattcctaaagtctgctccctcctgggattggttctattctgccgggtgggataccagata

SEQ ID NO: 268159 - DNA, 465 bp, Homo sapiens
  misc_feature (34)..(34): n is a, c, g, or t
  misc_feature (48)..(48): n is a, c, g, or t
gcgtgaccaaggccacagagctatggtgtcagcnaccaggatttgagnccaggtgaatcgagccccttttcccatatcatctgtttgttctgttgtctaaaagcacactgcaagccgggctcagtggctcatgcctgtagtcccagcactctgtggggccgaggcaggcagactggtctcaaacccctgacctcatgatccgctcacctcggcctcccaaagtgctgggattataggcgtgagctaccacacctggccggaactggtggttttaaatgtttcctgtggctactggctgcagaaggggctttcctgggcactggtggagatggaaagaaggaggaagtgaggtgggggtggaggacagtgtcaaggtgggagggacaaaaatgagagcccaggtgtggaaagaaacatggatatttggtctgcgtagtggctcacacctgtattcccagtgctttg

SEQ ID NO: 268160 - DNA, 400 bp, Homo sapiens
cagatcagacaaggaactctgcacattgcagagatgtcaagaagaggaggaatacaagcatctatacagttaatgtcctgtattcctatctgtaacaagggtaacaactgtataattaacactgccctatgctaactcttaaaaccctgtttacattaaaattcctttaacatgttatccacttattgccaatagtttggtgagatatgattttccagacagaaatggaaaatatctgaaatactcaacattgcccaaaaactggtttctttttgagtcagagtctcactctgtcgcccaggctggagtgcaatgacacaatcttggctcactgcaacctccgcctcctgggttcaagcgattctcctgcctcagcctcccaagtagctgggattacagg

SEQ ID NO: 268161 - DNA, 417 bp, Homo sapiens
caatcattattaaacctctaaagtgctagataaggaaaattcttaagcttgaaaaaataaaatgggagcaggaatttagagaagcaaataagctgcctgagggcagaagttatgctggagaaatccaccagtgaattccgagctagttctttgggtttaccattttcatacttcatatataggagacagcttctaaggcactcaagcggtagagaaggctactgctcagtaaaacagtaaatgagaaaataaaaatctagcctgcaaagggagatagaggggaaacttttctggcttagcattggcttcgggtgaaggaaacaaataagcagtaaaagccttccgtgagtcataaccttaaaccaaacatcatacaggtttgcaacttcagtttgttatccacttatgtgatttaaa

SEQ ID NO: 268162 - DNA, 535 bp, Homo sapiens
gcgcgtctgcgcctccggccgccgcggctcccggggcctccgcctgcagccggcggcggaacgagggcaggcggctgagacaggcgagctatttgcattccccggcagtcatttttatatgcggagaaacccaacacacagctattctgtcaggctgccgagaaaaggctgttcggcagttgcagccctggtgaggcaatgaggaggaaaggtggacgcacctgcctggagtggttgaaggaaggcagtgaacatccacgctcctggggttggttttcctgaacctctgtagctgtgctgctcactggggcagccactgaccacaagaggctgccgagggcttgcagtgtggccaggccagaccaggatgttctccaagtgggaaatacacaccccattgtaaagaagactgtatggaaaaaagaatgtgaactggctcattcatcatttaaaaacattgattgcatattgaaatgataatattttgggtatatggggtgaaataaagtatcatgaattaaatctttttttaaaa

SEQ ID NO: 268163 - DNA, 818 bp, Homo sapiens
gcgcgtctgcgcctccggccgccgcggctcccggggcctccgcctgcagccggcggcggaacgagggcaggcggctgagacaggcgagctatttgcattccccggcagtcatttttatatgcggaggtaatgaagttgtcagcggcgccccgagtgtggcagagcctgatattcaaatcgccctgcccgctccgcctgctcccgcccgctggtcccgggagccccaggctgcgcgcgcccgcaccgcatcgccgctttgccccgcgaccgcgcgcgcctcctcgtcctcccccgcgcctttgtttccgtctccttctcctttccctcctcttttgtgtcgggccagactcagccccagaaaccagccaccctgccgcgtccgactgccagggatccctcacgccgcgagaaacccaacacacagctattctgtcaggctgccgagaaaaggctgttcggcagttgcagccctggtgaggcaatgaggaggaaaggtggacgcacctgcctggagtggttgaaggaaggcagtgaacatccacgctcctggggttggttttcctgaacctctgtagctgtgctgctcactggggcagccactgaccacaagaggctgccgagggcttgcagtgtggccaggccagaccaggatgttctccaagtgggaaatacacaccccattgtaaagaagactgtatggaaaaaagaatgtgaactggctcattcatcatttaaaaacattgattgcatattgaaatgataatattttgggtatatggggtgaaataaagtatcatgaattaaatctttttttaaaa

SEQ ID NO: 268164 - DNA, 271 bp, Homo sapiens
tacccagtagtggaattttaaaactgtaatagaaatacaaaaagccaaaaaaaaaaaaaaaaaaaaaaccaagcattttaagatcaaacaagcaaaaaaaaccaaaaaaaaaaaaaaccccacaaaatttcaagatacttcaccaaaaaaaaaaatatatgaaaagcaaataggtaaatgaaaacatgtgcaacatcattaaccattaagaatgtgcaaattaaaaccattaagacaccactacacacctattagaattgttaaaaataaa

SEQ ID NO: 268165 - DNA, 894 bp, Homo sapiens
agcatcaagtcacatataatatgggtactttctattctggaatttgtaatgatagtccaaggcaatgtcaggagacctgtgttctaactctagttccaactctgtgacattgttgggatcactaaaagatctagcaccaggtctatcttggaatctctgggctctagggttcagccaactccagaagtctaaggtagactgtgagagatattgtggcagcagtagcttcaaaggtttcaacaataagggaagagttaaaatttgtatgggtgggtggatgagactcaattgtaaagctgtgttatcttactactcctaaactcctaaagactcagataattcagatattactcggagggttaagtttaaccactgctggttaatgcagctttctataaagaataaagtgctaattgcaggcaatctttgacttctagcacttcgactaaaactatgtggtaactgaagttatgggagtagagttcagaggtgtttgaaatgaaatgggctacttaactggaagtgacttccaagtctacagagatgttcagatagaagctagatgcccattactcaggagatttttaagagagattaaagtatctgataggggttggactagatgacttaaaagaatctcttctaggtctatggttccatggcaggaatcaattcacatagtgcatcttcagtcacttataatgagatcaacctcatgtcaatttgttttctaaagtgttctgtataaagatccctgtcctctggctcagtctaattccaagtggccttaagccaccctttgcactatcaatcaacactggtaactcttactggctcaagtatgctggcagcaagaagaggtgacagatataagctaacatatgcaaacagaaa

SEQ ID NO: 268166 - DNA, 453 bp, Homo sapiens
gcaaaactccatcccccccccccccccaaaaaaaaaaaaagagatacacaaagcttcagaataaaatttgatatggtttggctcgtgtccccacccaaatatgttgaactgtaatcccattaatccccatgtgttgagtgagggacctggtgggaggtgattggatcctgggagcggtttcccccatgctgttttcatgacagtgagtgagttatcatgggatgtgatggttttataagtgtctgacagttcctctttcataccctctctttcttgcttgccaccatgtaagacctgtcttgcttccccttcaacttccaccatgactgtaaagtttcctcaagccatgtagaactgtgagtcaattaaaccgctttcctttattaattacccagtcgctggtagtatctttacagcagtgtgaagatggactaatacaaagctttatttaaa

SEQ ID NO: 268167 - DNA, 515 bp, Homo sapiens
aattcaggggacccagaataaccaaaataatcttggaaaaaaacaaagctggaggactcacacctccagattttaaaacttactgcaaagcaacagtaatcaagactgtggtactagtataaaggtggacaatatagaccaatggaataggattaatccaaagtaaaccctcagttgctaattagttgatttctcaagtgtgccaggaccatccagttggggggaaaatagtcttttcagtaaataatgctgaggtgactagatttccaaatgaaaaagaatgaagttggaccccttacctcatatcatgtatgaaaattaactcaaaatgaatcaaaggcctaaagtgtaagacttaaaactatagaaagaagcatatatattttttttacgaccttgaatttggctgtggtattttagatatgccaccaaaccatcagtaaccaaagggaaaaatagataaatttgacttcaacaaaataaaaaacgttgtgccccaaagggcatcatcaaaa

SEQ ID NO: 268168 - DNA, 347 bp, Homo sapiens
tttttttttgtgtgtgtgtgtagagaccatgcctaagctggtctcaaactcctgggctcaagcaatcctcccccttcagtctcccaaagtgctaggcatgcctggcctcatggagtacgtatttctttttttttttttcagacggattatcgctctgttgcccaggctggagtgcaatttctaaaaaggcttctatacgtcaaggcagttgtaaaagttttacttaccagaatcaagtccacttatgcttaggcccaggctctatctaaaaatattgactaattatagaaagtgtcccaaatgtagctactgtcgagcggccgcgaatttagtagtagtagggtcgc

SEQ ID NO: 268169 - DNA, 600 bp, Homo sapiens
cgtgcccggcccaaaattattttttatatatggtgactttcccccaccctttcatcttacagtagaggcagctcagaaaaaaatcactgaattaagtcattcagaggtcgtttataatagctattcagcagtgagctggttctcagtcctggttatccattacaatttcccagcatttaaaattctgataccgtgaccatacccaagaataattaaataagactttctgtaggtgggacctaggcatctgtttttaaagcccttcaggtgatcttaatgggcagctaagtatgagagctactataggacagtgttgtatggcctgattaggtaggaatgagagggagaggaagaaatcaggacaggagatgtagacttattttgataagttttggtagtgaaaggcagaaaagagatgggactgtaacttaaggaattagcaggaaactccatctctactaaaaatacaaaagttagcagggcattgtggcttgtgtctgtaatcccagagaattgcttgaacccaggaggcagaagttgctgtgagctgagatcgcaccactggactccagcttgggcaacagagcgagactcagtctc

SEQ ID NO: 268170 - DNA, 610 bp, Homo sapiens
cgtgcccggcccaaaattattttttatatatggtgactttcccccaccctttcatcttacagtagaggcagctcagaaaaaaatcactgaattaagtcattcagaggtcgtttataatagctattcagcagtgagctggttctcagtcctggttatccattacaatttcccagcatttaaaattctgataccgtgaccatacccaagaataattaaataagactttctgtaggtgggacctaggcatctgtttttaaagcccttcaggtgatcttaatgggcagctaagtatgagagctactataggacagtgttgtatggcctgattaggtaggaatgagagggagaggaagaaatcaggacaggagatgtagacttattttgataagttttggtagtgaaaggcagaaaagagatgggactgtaacttaaggaattagcaggaaacacaacatacctgagaaagaacattctagcatatatatatatattagcatatatagtagtgagtctcagctactcccctagggcagtgtatcagcaatttaggaaccagggatgaacatgcatttggcaaaacttcctaattttgatacacctttccctttct

SEQ ID NO: 268171 - DNA, 459 bp, Homo sapiens
gaggatgctggagcaggctgggggaccagaaccacaaaccagccctggcttagctctggcttagctagctgtgccccagaagagctgggtcctcagggagtcttcttgcggcccggtttggatgttcctaagcatagaagactctgccagtgtgtccctcattcgtttcacatttggaaatgtaccaagagaagtgggaaccagctttactctttctgatctagatgggaatcctttcctttgcattcaagctctctgtgtacaggtgtaacttgccagtgagagacttgggatttctcacaaaatagaatgtgataacgacataatttgatatgaatatttgaggaactttatctctggacaatatatactttaaacatccccctccccaagtcacacacacaaattgtttttatgagaaccaattaataaatgctaattcattgaggcaaatcttca

SEQ ID NO: 268172 - DNA, 456 bp, Homo sapiens
acctagttagtaacatcagtcacgactatcaaattatcagcccaatcagagtcactttatgtcataaaatgtctgacttcatttttgaatttaagtaaatggactaatagacgtttcagaaatattgttaaaaattactcaaccatatatcgtggaacttgtgttttttaaggtagcatactaaaagcagtcaaatcaagattatgctgatacaaagcgaatatagtctattcatataatttataaaaacaacaaacacttatgctgcttctcactacttaatttgaagtaatgcagtgtaatctgcagcaaatatgtgttatttatggaccaagaagtataaaactctcgttagtcctttggtaaatatgggtgcatgtatgaattgaatctgtctctcagcttttgaaaatcattaaatcacaattatgaataaaatttcagaaataatgccat

SEQ ID NO: 268173 - DNA, 707 bp, Homo sapiens
gaaaaaattggaaaaatgctctggactttaacatctgcttactgagattcttttaaaaaaatttaactcatctggtagcatcactaaaattataattttaaggcaactgaaaattcatctaggagaagaaatggaacacttaaaaatttaagtctgtacctagtaattaacttaaactcctgaagttcaatgcggaaaattattttaaattaacttaatcaatgcactttgacaagctttcagattacatattgttttattctggtaacatgggataatgctcccttgaatcctaatatttgccaatttttattaggtggaatgagcagattttttttggctaacaatgaatgttttaagaagtgttttctaatatgtagtaagaaaaaatttaagttcccagacttcactgattaaacctgaaatatgctttataggccttaaaagaaaaagtgtgtgctccttgtagttcacatcagaagactgataaactcgttgctctgtttgtaaagcatgggttctgacagcagggctcttccagattgcgatagaggtctgtcctaaaagggcttcagattgggatagaggtctgtcctaaaagggcttgaggtgcaatttgcaagatgtgattttaggaccatacccaaattgcatctgactgttgggtgactccctttcttttctgaactctcaatgcacctgtaatt

SEQ ID NO: 268174 - DNA, 515 bp, Homo sapiens
atgtatttgactatagtatttagttctgaaaggaattttttaatacagtgaaacattagttaaaaataaatgttaactccaaaaagaataataaaatcattattttttaatcagaggctgccagtgtttttctgcttaatctatacagcatcttagctgtaaaaatgatagaattcatgttattttactatgcattctcagtaacaataaatgtgttgctcacttctacattttagatagctgacataaggcctaacatggaaagcaaaaagctatccaggaaatatttccctgctcatgcatatttcctttggcatacaaatcattgtaaatgatggtgagttaacttcaaacatttcaagctacacaactaatgtaattaaaccctaagtccaatttactattggcccttggtacttctgcaggctgatgttaagtgtcatttttcaagtctttcattccctataaacaagatggtggcaattttctttattttctgaacacttgcaatttcc

SEQ ID NO: 268175 - DNA, 181 bp, Homo sapiens
gaggcattagaaatacctaattgttgagagtaagaaatcttcttgacatcaatattcataaaacttgatttcttttaaagaaaagattcagattacagacagaaaacaggtatcacaatttttaaactattatacaaaaaaaaccactactttatctaaaaggtatgaccacaaaaatgta

SEQ ID NO: 268176 - DNA, 267 bp, Homo sapiens
cgccccgatatgagtacctaattgaataaatatcaatcatgggggagtacagaaaaatctcctgtgcaaaataattttaactaatctatgttgccacccttaccctcaagaagcataactcctcacttcttaggtatggcctatatatggtgacttccttctaaagagcacagtgtggaaagtggggagtggagggaggaacttcccagtggggaaactagataaacactaccagatgaccaggtgaccaaggtcaacagcaacagt

SEQ ID NO: 268177 - DNA, 575 bp, Homo sapiens
aaaaataccatagtggaaacttcaccagaattgagtgagttacaagcttaaattaactgtaactagttgagtattagaagcctttaaaatgtaactttttaagagtcatcaaaatactaaatgaatcataatgtatttaacctggctttgtgcaaggaggctgttctttatcagagccctctcctgcagcgcacatgtgcctgcgtctgacagcacctctcgggtgggagccttcctcctccaggttgggtgggagagaagagcacagcaaagccaggggccttgtccacagtagcgggttaggatcctccaggggaagtgccttcatccaatgtgaacaatgcctaaaactaatgcaggagagctgcagagactggtggctgtgaccccacccctccagagccctgctgacttcctttgatctctttcataatgtaccctatgaaacatcattatcttagagaactcatacaagactgctactctaactataaagataaaaatttcacaacacttaaaggacattaccgtaagtcacaaataaaactgatctaataaaaagtgagttggaactg

SEQ ID NO: 268178 - DNA, 690 bp, Homo sapiens
gttctgcccaaaacattctaatttcttattacagatttttctaggagtgggttaaagaatatgactattcttaaggctcttaatcctgtgaccttatgccttctagaccagtggggccagttgacactcccaccagctgtctggacataacatagatttggttgaagactcatggttcaatcacaaccatcagttctgtctcatctgttctcaactgtcacttcaggtgtcagtgggcccctttcattttgctgtttttaatccatttctgttgtttccaaactcagaaagtccggtttgtgtttgggacttgttgggcagattgacccagtgtggcaggtgtgaaagtgcaggaagccagagccagctgccggggccacatcctggttctgctgcctatagtggcacgtccctgggcacatggcctaactcactctcctcgccttggttccttacctgtaagtggaacttgctggagtcacctcacaggattactgtgatgatcagttaaggaaagcgtgtaaggcgcagggcctccgtcaggattggcagtggcagtcactggggatgatgttgatgttcccagtgaaaacctgagggcccttctgctgagcccagggcagaagcagctacagactcttgctgcttcagcccctaggcttttgaatctctcccgtcttgacctcattc

SEQ ID NO: 268179 - DNA, 313 bp, Homo sapiens
taaatggaaaattctagaaatactaaggtttaaatactgtgctgttctgagtaatgtgataaagtgctgtccctcttagtcctggctaggatatgaatcctccctttttctagcatatccatatgctatatatgctccctgcctgttaatgacttagtagctgtcttggttatcagatcaactctcatggtattgcattgcttgcattcaagtaacccttgttttactctcaccccaaagtttgagagtagtgatgccggcaatctgaatatgccagagaagtaagtcataaagtgcttcctctaagtgaaaa

SEQ ID NO: 268180 - DNA, 172 bp, Homo sapiens
cctctccttaaaactgattacttcctaaaggcttgtaacaaaattgttatcagctatcagtactaccattatcatgcttagataagatactgcaattttagtctttcaggttgtatttctggatgacattccattaagaatagggttactcacttgtcttggttttagcact

SEQ ID NO: 268181 - DNA, 505 bp, Homo sapiens
tttgaagcaaaacaaccatttactcctctcctaaagattccagttaatgaggtgcgcacaggcccctttgcagagcgccagccatttccagggaggcacagtggtagcatttcagtgccgttctgctcaggaaagacgaccaaacagccctcctgccctcacctttgcacaccacacatctcagcttcaactcgccatcacggtggtcccaggcacggtcgctgcaacatcagaagggcggcatttcagcaagcatttgtttttggggtaggggtagtggtaattaccagcacatgattattttattttgtctgaattatttacaatggaaggaagcagtttggagggaaggggatattagggaatgagttcaatcccacttgcattgattctacccagagcaagaagagcaagcctattgagaagaaaaatcacttccttttcttcctctttcctctccacccctaagtcttagaaataaataaataatgcaaagaaaagccct

SEQ ID NO: 268182 - DNA, 461 bp, Homo sapiens
ctcatattgtgcattgctcgttttatttctaagacttataatgagtaattattcaaatattcatcaaatccttgatcatccaaaaaccaaagctttcataactcatggtggagccaacggcacctatgagaggatctaccatgggatccctatgtggagggggcttcctttgtttgcagatcaacctgataacactgttcacatgaaggctaggggagaagctatcagactggacacaaaaacaatgtcaactacagatttgctcaatgcattaaaagcagtcattaaagatccttcatgaatgtacagggtttttttaaactacatagcatggattgatgagttcttacatgaagaccgagggagcagcagtgactctgaacatgaacacaatgctgagtacatgtatgtattttctaatgcttgaagacaatagtcaataaaccattgtgagtgtcaca

SEQ ID NO: 268183 - DNA, 413 bp, Homo sapiens
aaatgtttgtcacctgttctagaatataaacttcgtgaagacaaggaccatgtctagcatgggagaaggcacgttgccttgtgtgtaagaggtgattagaaatatttatggatagataattgaatatgtggtatcttcaggaaggttcagagaacaccatgtttcttactttagtatcattctagacctgtagattagcaataagtaatcttactgatggaggaacatagaaacttctcactggaccatggcttaaaaactagagtcttgagtctggttttgtgattctcactacagcccttagtcctatcatgagaatattttccacttttttcttttcttttttcttttttagtaaaaatatgtaagaggagcttatagaaagttttgtgaacttcagcaataaaaaatgt

SEQ ID NO: 268184 - DNA, 538 bp, Homo sapiens
caacatattccacacacatttaacatgtaaattagcctgaacccagaacccaaccagccagacctggcaagtaaggtgagagctgtggaaggtaactgagttctagttttaagtggctgcatgcagagtgatgctctgactgaaatgactgggttgacatgagaagaccaagttggagcattgaggataatgagttctgcatcagaaatgctgcacttgggatgcttctggaatagtcaggtagagatatctaagctgcagtaggaaatatggttttgaagcatgaagaataaattagggctaaaggtaaatggcaacatcatttcatcattccagcaattatgaaagcctacagttctatcactgcttttatgttacaatgcagtgtgagggtttcccagactggaagggataaaagtgcagttgaccttgtattctagacttacttatcattaccctggcacttcaatctcagaatgattcatcaacttaggaagagaagagcgcaggacagctgagaatgctgatcattttctac

SEQ ID NO: 268185 - DNA, 393 bp, Homo sapiens
cacacatatacacatacacactcatacataaatatgtaatgtgtgtgagtgtgtgcgtgtgtgtgtatgtgtagttttatcaactggaaaggggtacaaacaatgaccaacacaataacaatgaacatgcttactgcccagattgtggtcttgaaataccatttctcactaaaaatcagggcttcttgaaggagtagcttgtattagtctgttctcacactgctaataaagacatacctgagactgggtaatttataaaggaaagaggtttaactgactcacagttccactccccagtggaactggggaggcctcacaatcatggctgaaggtgaaggtggagcaaagacatgtctttgcaggcaagtgagcatgtgcaggggaactcccctt

SEQ ID NO: 268186 - DNA, 391 bp, Homo sapiens
acaatattatgctccctcataactggatctccctggtgtttttacctccttgagttgtccatatggaaccttcagcaattcaccagttatagttcaagattttctactccagcactggttcctaaggtggtttcagtagtgagtctctgttcctgtaagccataaattcccatattcacttctctatctctccaatcttgggggcagtggtttgccctatgtcctctcttcacattcaaatccaaaaaggattgttgatttttcagtctcttcacttttcatgtgttgttaaggtggactgattacttccattctttttttttttcttcctttttttgagatggactctcactccagcctgggtgacagagtgagactccatctcacaaaa

SEQ ID NO: 268187 - DNA, 565 bp, Homo sapiens
cccctctcccccggagctccggtggtctcagcgtgaccgcagcaggggctttgcctggacggcctttctaactcgtgctgaaagcaggacccagtattccgtcacgttctgtcccagcaagaacgtgtctcacttcaagaaaatgagggtgcccactctgccctgccctgcggtgccccagtcactctcaccaaccctgaagccctgggagggccacacgccttttgacagatgcagacttaatacagctgactaaagtgtggctttatttctctatgacaagcagaggaaatctgaaatgaggtattgcactgtttataactccatggccacctccagtgaggacgtggggccagtggtgaatggcacactaggttcctctcacccaggaccacatcagacactaggacacatcagacaccaggtcccgtatcttctcggtgtctggcaacgatcaaaagactcaatttacatgggaaagaaatgaatgactcgtttttaaactatttttcccttggagttcatttaacaaaattaggaaagaaaataaacgttaagttgaggg

SEQ ID NO: 268188 - DNA, 483 bp, Homo sapiens
ggtacacatttgaatactcaaccatctgtggctataaatgggcagctttctcccaatattcgtgtctttttttgttccccttcaccaaactcttttgtgctgttcagaaccaagtcattagaatgatgattcttctccttccctccaacatgaggtagcatgcagcaagagcttgctaggtgttttgttaccagctgcaggaacttctagcggaaaatggctcagccatgttagtgggcatgttgcctcctgtgtgctcagctctgtaggaagactttacttgcctcattccagctaatccttacaacgatcttaggtagaatagactcctgtttctgctttacagacagacaaactcaggcccagaaacttgcttaaggtcctctagtcctctaataagttagccgatagaaccaggattggaacacagttcttaaccaatactctatgaaatctagtttctgtgctggtttggtaaaaaaa

SEQ ID NO: 268189 - DNA, 1106 bp, Homo sapiens
cacgagggcgataggcacagaggaaggtagatgaagccccgcgccccccgggcggagcccagccctgttcaccgcgtgctgtgcgggtgcctgtgccaggatcagctggctggacggctatagccccacgcctgcaggccacatacctgggagagtgtgggccttccgagccttctggctcccggccccacagaggaattacggtcccatgtccctcacaaggacccttgcagagggagcagtgcatcggcacagagcaggacacaggggagccgggctgaggctgcgggtcccttgtggccgccaggtgctcacgcgtgcctcggtggggatctggcagccagatttggggtgaggatttgatgatgtgggtatccctagctggtcccacagtgacgatgggtgttgcgttgtgagcatgtaaaacggcagtgacgtctgagggtccctggacgtctttcacacccagcctcaaagcggagcctttccaggcagagcagcagctgccgccactggattgacagccccagagcagcgggatcaggccacgcggacgaggaggtgcgaggcctcgggtcggggcctgtgttctgcgggagccgcacccatcattgctgtggcggtggcagtggagcagctgctctcgtgtctgagctgctccggcgtctctgtccacagtatagggtcttctgatgcttcctggaggtctcggaggggcttgctgcgtgtagtacccacacagcccacaactggggtgttgtcaagtgttatgacgtaggttgcctgtggagtaaaagttggccgctaagaaatgctctagacaggccgggcacggcggctcacacctgtcatcccagcactttgggaggccgaggcgggcggatcacgaggtcaggagattgagaccatcctggctaacacggtaaaaccctgtctccaccaaaaatacaaaaaattagctggacatggtggcgggcgcctgtagtcccagctattcgggaggctgaggcaggagaatggcatgaacccgggaggtggagcttgcagtgagctgagatcgcgccactgcactcccgcctgggcgacagagcgagactgtctcaaaa

SEQ ID NO: 268190 - DNA, 692 bp, Homo sapiens
  misc_feature (390)..(390): n is a, c, g, or t
  misc_feature (692)..(692): n is a, c, g, or t
cacgagggcgataggcacagaggaaggtagatgaagccccgcgccccccgggcggagcccagccctgttcaccgcgtgctgtgcgggtgcctgtgccaggatcagctggctggacggctatagccccacgcctgcaggccacatacctgggagagtgtgggccttccgagccttctggctcccggccccacagaggaattacggtcccatgtccctcacaaggacccttgcagagggagcagtgcatcggcacagagcaggacacaggggagccgggctgaggctgcgggtcccttgtggccgccaggtgctcacgcgtgcctcggtggggatctggcagccagattttggtgcctgctggcgatgtccttttggcacatgtatgtgcanacacactgcattcctgcatctcggcccctccactgcccacaaatgctgccacaactgtgtgaccatgccgtgagccagcctggaaagcttgaagcggggatcaagacacgacagactgggcgacggtgcattcgctcattgggccctgatgctgtgggaccactgccaccgtgcatgccggtaacgtggaacacacgggttgtccccagaactatgcggaccggtgagcagctttttcctttaagcgactatcaagctcttgttggtggccaaacagggagacgtcggctctccctgccaan

SEQ ID NO: 268191 - DNA, 448 bp, Homo sapiens
cttttttcttttcctccctttcctctccttccctccccaatgctcctcaccacacgcaagtgtatgtcttaaaagtagttgaagcttaagttcatctgtctatccatccatctatccgtctatctctacagatctatcccctgatcccctgcactggggaatttttgtattttttgtagagacgggggtttcaacatgtttcccaggctggtctcgaattcctggactcaagtgatccgccctcctcagcctcccaaagtgttgggattacaggcctgagccacagcgcccggctggctgttgcttcttaacacctttattacttttgtaatcatgggtatgagttgattttctggtcagaaatttcagtagagctaatttcatttaaatgtgtgagatgtggtaaagttttgacaataaatacaaattttgacaaagcaaaaaaaaa

SEQ ID NO: 268192 - DNA, 271 bp, Homo sapiens
aaagattggtcagaaaaaataggttgaagatagctgtacttcaccatgatacagtaagaggaactaaactaaattctttacaaaacaaacaaacaaaaaacaaaaacacacacacacaaataaaaactaactgcagacaaaatataatcaacagtgattttttaaccattgacaagaagctgaggatgctgatccctgacaaaagaaaaaataaaatctgacttatcccaagctttctctcagtttccagaaaacacagtgaaaggataat

SEQ ID NO: 268193 - DNA, 351 bp, Homo sapiens
tgaagtcatctgaggtcgggaagcagtttctatttttgaaaagtgagagctgggccgggtgcggtggctcacgcctgtaatcccaacactttggaaggccgtggcaggcgaatcacttgaggccaggagttcgagaccagcctggccaacatggtgaaaccccgtctctactaaaaatacgaaaatcatccaggcgtggtggcgggcgcttggaataccagttactcgggaggctgaggaaggagaattgctggagcccagaggcggaggttgtagtgagctgagatcgtgccactgcactccagcctggggaacagagcaagactctatctcataaataaataactaatt

SEQ ID NO: 268194 - DNA, 514 bp, Homo sapiens
ccaccaaaccacaaagagaaaaagaaacaaagaatttatcaaacaactagaaaataattaacaatatcacaggagcaaaacctcacttatcaatattaaccatgacataaatggattaaatgctccacttaaaaaatacagattggcagaatggatggaaaaaacaaaacatgatttaactatatgttgcttacaagaaactcactttacctataaagacatatatggactgaaagtgaaagggaggaaaaagacatttcatgcagatataaagcaaaagtgaacagcagtagtgatacttagataacacagactttgtatcaaaaacaggaaaaaagacaaagaaagtcactacataataataaaggaatcagttcagcaagaggctaaaacaattctaagtatatatgcacccaacaccggaaggctcagattcatgaaacaaatattactagacctaaacaaatattactagacttattactagacctaaagagatagacagcaatacagt

SEQ ID NO: 268195 - DNA, 2058 bp, Homo sapiens
  misc_feature (1592)..(1592): n is a, c, g, or t
gtaaatttaaacagaaaattatttagcagtttccattttcaaatgtcctgcttagaaaaaaaagataattgagtccaggattattaaacatacaggacatcatttttgcaaaccagatgggatggtcatgataaataaatgcttactgctgtatttcactgcttgtctgtgcttctttggctataggctaaaaacatggaatgctctctcttgcctaaggacacaaaattgtgcagtaaacaagggttcaaataaacctttggtctgaacaatttgagcagatgcttatgtttggatttccaaacacctgccaattactttgaagtcaaatagacctcataacttccagtagggttaaatgtagtcaaggtagcattaaaaattaatgagtaagcctggataatatggtgaaactctgtatctacaaagagtacaaaacttagttgggcatggtggcatgcacccacagtaccagctacctgggatgctgaggtgggagggtcgcttgggcctgggaggtcgaggctgcagtaaaccacggtcacgctactgcactccagcctggcatgacagagtgggaccacgtctcaagcaaaacaaaacaaaacaaaacaaactaatgagttaataaatgaggtagagagaaacagattttggaaatgcagataaaaatctttggagtttattttaaagtaatcattctagatgaaagtagtggttcataaacaaagagcatgcaaaccaaaaatgattttaatcaggataaaaagtttttcttttctttttctttttttttaaaaaaaaaaaacctttgaaaatgtggctttcaattatcctcagaattcactataatacaaatactataataatcccatctcttaaagagagaaatctcaaaatgagctcagaaattatatgatcttccacctttaaaagaatcacaaagatataaaaatcctttacaaataaatgctgcttacttggacttgggggaaagaggaatagtgtatgtttctatgaactcagactttagtttcagcttttgcatcctatttaaagtgtaaattgtcacgcttccactattctgagaacatgaatatctctggaaaaatgggcaagtattctttgacaaagttttcaaatatgtgctgctaaaaaggagacactttttactttaacaatcttagcaaataaagattatatatttaccaacaaaacaaactcatttaaaatgcatgaattgcacatacttgatatacatgtatatacatataagtagacatgtgtatgtttgggcatatgcatgtataatatatgcatgtgtacttatgtgtctgttaatatgcacgtatatatttgttataatacatgcatgtttgtatttgttataggacgctataagtaactttttgttgcttttgatttggggagtggggcccaaagctgaggacaaaaagaagctaaatatattcatgttctgtagtgatccagcaacaactggatcaaatattacccaatttttgctaattgacacgatctttggccttgtggaatttgtagtgcttattctgcgaggcagttccttttcttcngtatgagtgtatgactgcacctaaacaggttcattcagagagatagggatgcctccaagagtggcattttattccttctcattggtagcctccttgttgggtatcttaatagaaattttcctgttcagcctgtgctttcctaaggagtgaggaagatagtagcagcaggacacagagagggaatgacagaggagcagtgtgtagtcccctgtttgacagggctgggacaggtgaaatttctttgagcctagtggttacttgggaagttaactaagcttgggtggttttgccagtttcttcctccccacacaggaagattgctccaaaggaaagaaggtcaagccagaacctctagagaattggaaggtgaaaaatgttgagtccagtttgtttcccaaatcagcggactgagaagttggaggcactaaagggaatttgaagaattatctctctcacacactccaca

SEQ ID NO: 268196 - DNA, 352 bp, Homo sapiens
tgctcatttttggaataaccatgtatcatttactaaaggaaaaagtgccccaaatgttgatagaattctctagagaaatgtgtttaggcagtgaaaggattcctggcagtgattgagaaatacagtaatggggaactgcacttgatctcttttgaggttgattctgatgtgtgtagtctttacatcctattaaatttttgaaagataaactgatacaagaatgatttgccaaggccatatgaggttaactgaattcaaatagaaggttctctcaagttattgcattccttagaaaattcattgcgcatatggttaagattgatcaagtattctgtatgcctgattacttccc

SEQ ID NO: 268197 - DNA, 384 bp, Homo sapiens
gaaaaacttttgatgatgtcctgttcgtttgatccctgtggaggaccactgttttcaaacctccagaaaagatgagctttagatacaatataacttattttatctcctcccaacttctctttttcctccagagtctgccttttctaacattgctcacatactgcttgtggttttaggtcttcgagtagcactggaggccaagaaatctccagattctaacctacagacatgtggttgatttttggaagataacttccttctgtctttatctacctcgggaaaatgtattttcaaataccaggcttatgttattgcctcaagcatattatatgtcataagcttcctaaatggatcagtttttgatcaaagatttctgaactctga

SEQ ID NO: 268198 - DNA, 463 bp, Homo sapiens
aaacgtgctttttctcccctagggaagggcattttctcagccacagctaagcaaagagttgctccactctgggttagcagccctagaaggaaatgctgagtcagtcatttgctagctgtgccacctgtggcttggatcccagctgctctgagacagccctgcaccctttatgcaggcagggaggcagggcacaatttataaatacttctgtcttctgagccttcgctttctcctgtgcaaaatcagaatcatgagaatgccagccctacctagattggtttattcagcagatatgtaaagagcacctactgctgcactgggcactatgaatatacagccaaacaaaactgggcacaaaagcaagtaagccagagtccctgcctgaggtccacatcgggaaatgcataggaatgtgctgtgaagattaatgttagttaataaaggcctaaaaaccaaaaaaaat

SEQ ID NO: 268199 - DNA, 436 bp, Homo sapiens
gccagccctgttgacatttttgtattaccatgacttccaaggaaaggagcagtatttccaggcaacttctgctatccctgtcttggaatccagtcaccatgtaaaaaatgccactgccctgagaccacccaccatgctgttaagaagcccaagcaagtgaagtcaccgtatactagaatgaatacagcttggaattctgaacgtgtgatgctggagccaggaccaactgcaaagatcctttggcattgtgccgtcgaggaaactgaggtatgctgttctgaggtaaatttatatgcctcttcagaagtcctggtgggattgtgcaccagctgtctgcagtgagggtcaactcaataatatgtctttacaatccctttttctctgtctctaacttccttcagtgaccccctcactctggctctctgaataaattcct

SEQ ID NO: 268200 - DNA, 424 bp, Homo sapiens
agcaagcgaaaagcataacacatttatttaatataagttttatataacatgggagcctttagaaacgaagaccaaaagccccagaaatgaagacccaaagccccagaaacaaagacccaaagccccataactattcttatgtttaggcttgataaagaatggacagccatatagaactatgattggacaaagggtgtgacctaatggcagtatgactgaggaggaacctcagcaagggctgttggttcagattcttattggtctgtctgtgtagcatgtcttcctcctggatatagggcaggactcctctggaaagagggtctttggggagaaggaagaaggaagagagtgaccttcctaggtttcatggtttactttggtggagataggttctagtttctatgacccactttgtggaagagga

SEQ ID NO: 268201 - DNA, 2267 bp, Homo sapiens
  misc_feature (19)..(19): n is a, c, g, or t
aaagcaggctggtacgccnggaagtaaggattgattgtgaagccctctttttctctccttctatttctctctagagcactcaagactttactgacgaaaactcaggaaatcctctatcacaaagaggtttggcaactaaactaagacattaaaaggaaaataccagatgccactctgcaggctgcaataactactacttactggatacattcaaaccctccagaatcaacagttatcaggtaaccaacaagaaatgcaagccgtcgacaacctcacctctgcgcctgggaacaccagtctgtgcaccagagactacaaaatcacccaggtcctcttcccactgctctacactgtcctgttttttgttggacttatcacaaatggcctggcgatgaggattttctttcaaatccggagtaaatcaaactttattatttttcttaagaacacagtcatttctgatcttctcatgattctgacttttccattcaaaattcttagtgatgccaaactgggaacaggaccactgagaacttttgtgtgtcaagttacctccgtcatattttatttcacaatgtatatcagtatttcattcctgggactgataactatcgatcgctaccagaagaccaccaggccatttaaaacatccaaccccaaaaatctcttgggggctaagattctctctgttgtcatctgggcattcatgttcttactctctttgcctaacatgattctgaccaacaggcagccgagagacaagaatgtgaagaaatgctctttccttaaatcagagttcggtctagtctggcatgaaatagtaaattacatctgtcaagtcattttctggattaatttcttaattgttattgtatgttatacactcattacaaaagaactgtaccggtcatacgtaagaacgaggggtgtaggtaaagtccccaggaaaaaggtgaacgtcaaagttttcattatcattgctgtattctttatttgttttgttcctttccattttgcccgaattccttacaccctgagccaaacccgggatgtctttgactgcactgctgaaaatactctgttctatgtgaaagagagcactctgtggttaacttccttaaatgcatgcctggatccgttcatctattttttcctttgcaagtccttcagaaattccttgataagtatgctgaagtgccccaattctgcaacatctctgtcccaggacaataggaaaaaagaacaggatggtggtgacccaaatgaagagactccaatgtaaacaaattaactaaggaaatatttcaatctctttgtgttcagaactcgttaaagcaaagcgctaagtaaaaatattaactgacgaagaagcaactaagttaataataatgactctaaagaaacagaagattacaaaagcaattttcatttacctttccagtatgaaaagctatcttaaaatatagaaaactaatctaaactgtagctgtattagcagcaaaacaaacgacatccaattgtcatgctgcatgcaaaactacacagaattcatgttttgcagagttttgccaaaatgagtaatcatataatatttactgtaatttttaaaatacattatcgttcacaattttattttttcataatcaactaaggaagaacgatcaattggatataatcttcttaccaaaaatgatagttaaaatgtatatatatcctagtcccctaaccaaatcctgacctattgggatacttataaaaatttaagtaagtgggatacacaaagaataataactattaacttttcattattagcaaaaacctaagggatttaaactaattgaaactgtatttgattggacttaattttttatgtttatttagaagataaagatttaaagaagacctttacaataaagagaagaaatatcgaagtcattaaaataaggagacttacttttatgacattctaatactaaaaaatatagaaatatttccttaattctagagaaactagttttactaattttttacaacttcaataataccatcactgacacttacctttattaattagcttctagaaaatagctgctaattaggttaatgaacattttaccttagtgaaaaaaattaattaaatatgattacaaagttgcacagcataactactgagaggaaagtgattgatctgtttgtaattacttgtttgtattggtgtgtataaaatacaaaatttacattaaactctaaatcattaaaaaaaaaaa

SEQ ID NO: 268202 - DNA, 2258 bp, Homo sapiens
atcacaatcagaagacaggagctgcagaacagaacactttctcatgtccagggtcagattacaagagcactcaagactttactgacgaaaactcaggaaatcctctatcacaaagaggtttggcaactaaactaagacattaaaaggaaaataccagatgccactctgcaggctgcaataactactacttactggatacattcaaaccctccagaatcaacagttatcaggtaaccaacaagaaatgcaagccgtcgacaacctcacctctgcgcctgggaacaccagtctgtgcaccagagactacaaaatcacccaggtcctcttcccactgctctacactgtcctgttttttgttggacttatcacaaatggcctggcgatgaggattttctttcaaatccggagtaaatcaaactttattatttttcttaagaacacagtcatttctgatcttctcatgattctgacttttccattcaaaattcttagtgatgccaaactgggaacaggaccactgagaacttttgtgtgtcaagttacctccgtcatattttatttcacaatgtatatcagtatttcattcctgggactgataactatcgatcgctaccagaagaccaccaggccatttaaaacatccaaccccaaaaatctcttgggggctaagattctctctgttgtcatctgggcattcatgttcttactctctttgcctaacatgattctgaccaacaggcagccgagagacaagaatgtgaagaaatgctctttccttaaatcagagttcggtctagtctggcatgaaatagtaaattacatctgtcaagtcattttctggattaatttcttaattgttattgtatgttatacactcattacaaaagaactgtaccggtcatacgtaagaacgaggggtgtaggtaaagtccccaggaaaaaggtgaacgtcaaagttttcattatcattgctgtattctttatttgttttgttcctttccattttgcccgaattccttacaccctgagccaaacccgggatgtctttgactgcactgctgaaaatactctgttctatgtgaaagagagcactctgtggttaacttccttaaatgcatgcctggatccgttcatctattttttcctttgcaagtccttcagaaattccttgataagtatgctgaagtgccccaattctgcaacatctctgtcccaggacaataggaaaaaagaacaggatggtggtgacccaaatgaagagactccaatgtaaacaaattaactaaggaaatatttcaatctctttgtgttcagaactcgttaaagcaaagcgctaagtaaaaatattaactgacgaagaagcaactaagttaataataatgactctaaagaaacagaagattacaaaagcaattttcatttacctttccagtatgaaaagctatcttaaaatatagaaaactaatctaaactgtagctgtattagcagcaaaacaaacgacatccaattgtcatgctgcatgcaaaactacacagaattcatgttttgcagagttttgccaaaatgagtaatcatataatatttactgtaatttttaaaatacattatcgttcacaattttattttttcataatcaactaaggaagaacgatcaattggatataatcttcttaccaaaaatgatagttaaaatgtatatatatcctagtcccctaaccaaatcctgacctattgggatacttataaaaatttaagtaagtgggatacacaaagaataataactattaacttttcattattagcaaaaacctaagggatttaaactaattgaaactgtatttgattggacttaattttttatgtttatttagaagataaagatttaaagaagacctttacaataaagagaagaaatatcgaagtcattaaaataaggagacttacttttatgacattctaatactaaaaaatatagaaatatttccttaattctagagaaactagttttactaattttttacaacttcaataataccatcactgacacttacctttattaattagcttctagaaaatagctgctaattaggttaatgaacattttaccttagtgaaaaaaattaattaaatatgattacaaagttgcacagcataactactgagaggaaagtgattgatctgtttgtaattacttgtttgtattggtgtgtataaaatacaaaatttacattaaactctaaatcattaaaaaaaaaaa

SEQ ID NO: 268203 - DNA, 2204 bp, Homo sapiens
atcacaatcagaagacaggagctgcagaacagaacactttctcatgtccagggtcagattacaagagcactcaagactttactgacgaaaactcaggaaatcctctatcacaaagaggtttggcaactaaactaagacattaaaaggaaaataccagatgccactctgcaggctgcaataactactacttactggatacattcaaaccctccagaatcaacagttatcaggtaaccaacaagaaatgcaagccgtcgacaacctcacctctgcgcctgggaacaccagtctgtgcaccagagactacaaaatcacccaggtcctcttcccactgctctacactgtcctgttttttgttggacttatcacaaatggcctggcgatgaggattttctttcaaatccggagtaaatcaaactttattatttttcttaagaacacagtcatttctgatcttctcatgattctgacttttccattcaaaattcttagtgatgccaaactgggaacaggaccactgagaacttttgtgtgtcaagttacctccgtcatattttatttcacaatgtatatcagtatttcattcctgggactgataactatcgatcgctaccagaagaccaccaggccatttaaaacatccaaccccatactctctttgcctaacatgattctgaccaacaggcagccgagagacaagaatgtgaagaaatgctctttccttaaatcagagttcggtctagtctggcatgaaatagtaaattacatctgtcaagtcattttctggattaatttcttaattgttattgtatgttatacactcattacaaaagaactgtaccggtcatacgtaagaacgaggggtgtaggtaaagtccccaggaaaaaggtgaacgtcaaagttttcattatcattgctgtattctttatttgttttgttcctttccattttgcccgaattccttacaccctgagccaaacccgggatgtctttgactgcactgctgaaaatactctgttctatgtgaaagagagcactctgtggttaacttccttaaatgcatgcctggatccgttcatctattttttcctttgcaagtccttcagaaattccttgataagtatgctgaagtgccccaattctgcaacatctctgtcccaggacaataggaaaaaagaacaggatggtggtgacccaaatgaagagactccaatgtaaacaaattaactaaggaaatatttcaatctctttgtgttcagaactcgttaaagcaaagcgctaagtaaaaatattaactgacgaagaagcaactaagttaataataatgactctaaagaaacagaagattacaaaagcaattttcatttacctttccagtatgaaaagctatcttaaaatatagaaaactaatctaaactgtagctgtattagcagcaaaacaaacgacatccaattgtcatgctgcatgcaaaactacacagaattcatgttttgcagagttttgccaaaatgagtaatcatataatatttactgtaatttttaaaatacattatcgttcacaattttattttttcataatcaactaaggaagaacgatcaattggatataatcttcttaccaaaaatgatagttaaaatgtatatatatcctagtcccctaaccaaatcctgacctattgggatacttataaaaatttaagtaagtgggatacacaaagaataataactattaacttttcattattagcaaaaacctaagggatttaaactaattgaaactgtatttgattggacttaattttttatgtttatttagaagataaagatttaaagaagacctttacaataaagagaagaaatatcgaagtcattaaaataaggagacttacttttatgacattctaatactaaaaaatatagaaatatttccttaattctagagaaactagttttactaattttttacaacttcaataataccatcactgacacttacctttattaattagcttctagaaaatagctgctaattaggttaatgaacattttaccttagtgaaaaaaattaattaaatatgattacaaagttgcacagcataactactgagaggaaagtgattgatctgtttgtaattacttgtttgtattggtgtgtataaaatacaaaatttacattaaactctaaatcattaaaaaaaaaaa

SEQ ID NO: 268204 - DNA, 429 bp, Homo sapiens
tttgacctaatttgacatactttatttcaagcagataccctttgctaaagctattaaactttaagattacattttgttttaaagggaacttaaaagagcattgatttaaatttgttatccctcagagcgtccatttaaagacttagcatttctcggccaggcatagtggatcacgcctgtaatcccagcactttgggaggccaaggcaggcagatcacttgatgtcaggagttcaagaccagcctggccaacatggtgaaaccctgtctctacttaaaatacaaaaattagctggtgtggtggtatgcaccagtagtcccagctactctggaggctaaggcatgagaatcgcttgaacctgggaggcagaggttgcagtgaaccgaggtcctccaacctgggtgacagagtgagactccgttatattta

SEQ ID NO: 268205 - DNA, 467 bp, Homo sapiens
ttatctcatttcctcactatttctgagaagggcaagacctgccaaggagactgggcctgaaaatagttctgctcctatgacgattccaaagaaagatgtctcacatttcctaatgccacttggctgactgcttgaggggaaaaaattgtcacagtctatgggggtgctaattagcatcaattaaaactcagctagcctgccctggcactgaattacctgcaggacttgctcagtccttgtgaaaatcaaagggaaatccagagacaaagagattctgcggtgataggaatatcaacttactttccccactgaacatttcaaccaacgcttggctagccagtatcctttcattcaggaagtaaaatctctgctggatttgtcaagaggataaaatgctcaaagttactaaggccattacaaactattcccccattaaaaataaataaaagacgtacaatattcttttt

SEQ ID NO: 268206 - DNA, 485 bp, Homo sapiens
acaaagaagcccagaaggtacaactgaggggctctcccaggagacagagggaagaaatctttataataaatggactgtccactttgcctctaccatgattacaagctagaagaaatatataatgaatagaggcaatgcacagctattagagaaacaaaaagaggggtcagggttcaataaaatgtcatcgggagaggtgagcaagaccagaagcaatggatgaggacagaaacacgacaaaaatgggaagtgtgaataataaacattattttaaaaaaactatactccaggtgctatgttatgtgttccaaaatcagcctaatcctcatgacaaccctgcaaggtacccacaggaggctccgagaggtttggtaacttgcccagagtcacacagctaaaaaactgcaaaactccattttgaactcaagtgcagctgattccaaaacatgtacttttagtaacgacaccaaactaaactatttaaa

SEQ ID NO: 268207 - DNA, 211 bp, Homo sapiens
ctctggcagttcagcaagtctcagtgatttgcaggcccctcagtgggctcagagctccagccacagcagtcagggttttctatttcaggattccatggttgctttgccttttcctaagtgctttcaggcagccggcccaaattaacctctttcctcttattcttcacttatggcccaagcaataaataaagtgccttatacactgaggtaa

SEQ ID NO: 268208 - DNA, 382 bp, Homo sapiens
aagatataccatattcatgggttgaggactcaatattgttatgatttataagtccttgttatggactgaattgtggcccctgcctaccaaattcctatgtcgaagccctaacctccaatgtgactttatttggagatgaggcctttaaagaggggaacgttaaatgagattctagggatagagccctcatctgataggactgatgtcctcgtaagatgaagagactcctgagatgtgtgtgcacaggaggaagtccaccacgagaggtacacagtgagaagggggccgtctgcaagccgggaagagaggcctcaccgggagccaaccctgccagcatctcctctagaaccgtgaagaaataaatgtccattgtttaaacccg

SEQ ID NO: 268209 - DNA, 587 bp, Homo sapiens
ttttcttctccctcctcctgaatacctgcatcttcttcctgactgacatggctttaggaaacacagcacattcacaaacatctgaagccaactgcaaggcacccgtcactcagcgagaaaagcagaaaggtgccaattcagatggctgagctacttcgcctgggtcccgacctgtatcaccacagggtcacagaaatggaaccttctccgtcacacctcctgatggcagtcagctgtgacccgctgaatccaggacatcatgcattccagtttcatttgcgagaacatttccaggtccggctgaagcctagtggctccagcagaggtctcaacccctttgggatgctcagtgggagacagaatcaagggccaatgatccatgacctagtcctagtgcccatgtcagtttgtcaaaggccctcagagcagattgtgttttccctggcgggggcttgacttctttgctttaaaaaggattcttaagtatttattgcagtaaaattaaccaccttcaaatttctgccagatcccctggaggtatataccttattaacacaaaacaaatgtgacacttgaaaggcaggaga

SEQ ID NO: 268210 - DNA, 467 bp, Homo sapiens
gcctctgcgcggcgctcgcccgggactgggacgcagagccgcggacggctttggggacgccagggctccggacttccccggcggcgcctcacgggcggcaatcgcccgcgagccttggggcgcggcacccagggcctccccaccgggctccgagggacgcagcggcctcgccaccgcattaggccgaatccggtgccttctagaaatggcctcctgcagctccagagcgcctgcaggatattatcagccaagctagaacacaaggcagcccaccaacccagcacagatttgaacaggcagctgaggagagagcctgggatgccagctctgaagtgttcaccgctagaagtgttcccttgtcaaagaaagaagccatcccttgtcagtagatggtcaggagttcaagaccagcctgggcaacatggtgaaaccccgtctttacaaaaaaatacaaacattagccaggc

SEQ ID NO: 268211 - DNA, 545 bp, Homo sapiens
gagctagcctgacaaagccagcccctaaactcaccaaaaataaatctataatagttgtcttccgtcacacctttgagtcaaggtgtggtatcctgaaagaccttgataaaatacggataaattagccagaaaggacatcatactagctactctataccaagaggagtatagtgaggtgaataagagcaaggactctaaagctggacacacctggcttcaaatcccagctctgtcactttctgctctgtgacctcagccacaatctctctgcttcatttttcttcctcctctgtaaatagagaggtaaaagtagtatcttcatcaggggattgttggtaggggttaaagacttcctagatgtaaagctcttagatcagtgcctggctcactgtaagcacattttcatcatctcataataaatcctgtacccattagcagtcactccccatttctacctccttccaatgcctaacaaccacaaaattactttgtgtctctatggatttgtctatcctggacatataaatggaatcatacaataatgt

SEQ ID NO: 268212 - DNA, 1001 bp, Homo sapiens
ggaatattcgaaaccccgagcttttacaacataaagcgcatggtgtggccgcggcgggtaatggcgctctgggagccctgcccaggcggcctctgctcgccctcctccacttccagctccgagctgggtgtgttgcaagtttcatactcctacatattataagtgacactaatatcagggacaactaagtgctggggaacttcaatgaaaacctggctggtaaagtcaacacccccagacttctctgtgctacatttctttaattaattccggagtggtgtgtggacgggcgtctttgcagttattatacacgtaagtgaattaggccatttgaagctacgaagtcatacccaacattttccattaagaatattatttttttagctactgctggcaacttttagaatttaattatgataattttcctcttttcctcattatcccagatatggctggttgtgagatactttttcactaaatgtgtctttttaatgattttggaattaagcaagtatgccaaatgcgccaagacatttataactttagaaattgctgtatagtatatatttttggaacaccacaggtttagttgggaaaatattttgcagctgagttagaaacttgaaagttaggcttataatcaagatgctgattttcaaccttagcatcggggaaggtaatgatagtttagttggcaaagactttttgcagcaaactgtatttgagacagcagaatccaaggatatctttcaagattcacttatactacattctttttagccccctctctaggggtggagggggtggcttagaaaaaccaaaggtaatctggtttcaattacatgctgtaaaaatagaatttgtggccagaaattaatttggaatattttttatgggggcaacattgtgggttgtatgagtctttcaccaactttattgcttttctttggttctggatctaaaatatgaatgagtaaataaaatacagtttcctttttcaa

SEQ ID NO: 268213 - DNA, 406 bp, Homo sapiens
gcttgacagaaaatggagccgatgttctcagaggtgttacagcagtatttcctaatgagcagccggagcctctctctagcatctcagaaaaccaaatgggaatggaggataagaaagtggaagtaaagacaaaagggaatatttatttgggattaacttgtagttacttgagctgatacacctatactaaaggaacaaaggaaatgatggatcttttaaccatcaggcttattgtgtaaacatcattctctttcattccacggtgggaaaaacaaaccttttcctcaaatttgactttgtatataaaatgtgttaataaaactaaatgtgttttaacaaatgtgttttaataaaaactaacatatttaataaaactaaaaataaatgatcatatttgttcaaaagt

SEQ ID NO: 268214 - DNA, 446 bp, Homo sapiens
ctcagcctgtccctggattccctttcatggggaatgtaaaagctccctatttaagctaacgtgtaggctggtggggctggatgtgagggaggggcaggtggagaaggaaagggcagcatccctcagatctgtgtggagcaggatcggaaggaaaggcacactcgagtcggccaggacccggggaaatgagcgagaatggtcagctctggggcggtatataaaactgggggtgggaatacttccatatactcccaattccacagtgggtgaactgagtaagtttaaaaataagataaagacataacgaggtgaggcaggtaagttcaaaaataaaaatgaaggccaggcactttgggaggttgaggcgggcgaatcacaaggtcaggagctcgagaccatcctggctaacacgctgaaaccctgtctctattaaaattacaaaaaaa

SEQ ID NO: 268215 - DNA, 386 bp, Homo sapiens
acctaataaactttggtcagaccggttgatctcaaaaccctgtctcctgataagatgttatcaatgacaatggtgccaaaacttcattagcaattttaatttcaccttttgcatctccttgaaatgtctgcctttgcacactctccctgaaagaggagggcaagggagccaggatagaaagtgaggtggagaagtgtagagctctggacggacaagcaggagatacgcagcacaaggaagcacactaggtaacacaccaagcaggggaacctgtctttcactacataggcaagatgctacgggaaatgggctctgggtttacacagattatgactcagttctctactgttgtgaagctgtgtttggataaatccctcaacttttct

SEQ ID NO: 268216 - DNA, 390 bp, Homo sapiens
gctgacattcagcgcacatttaaacgagtagatcaactgctccatcttcccccagaagctctgtctgtccctccacaacttggctcatgccatctcttccataagcgccgtgtgctcttctctctcagaaaaaaactatttgtttcttgacagctcagctcaaatatcagcttctctcgaccccaggcacgagcgtgggtcccgaaaccctggtgccctccacagtgtgtgttcagtaaatgactctacgtttatccctgtagctgccagtgttatcaactttggcctatgttttctgaattatttttgaatctttattttgtaatccaatctattagtgacccataacaggccgtgtcatccacaattaaataaatgtgcactctctat

SEQ ID NO: 268217 - DNA, 509 bp, Homo sapiens
tatgtcctgtgcttgtgagaagtatgttgctttatttgatgatatggaaactgttaatgaaggaaggagttaacattggtaactgacaaatagtgaaagaggccaaactaaaaatctctttcttcctgagaaaaagaggaggaattgatttgcttttctcaaaaatgatggcgttctcatttgtttccctaaaacttaaagtagaagaagttatgaaggaatttcaatgtttcttggtgtctcttcaactctgagacttttgtgaaaataatatggagtcccagaagttttaaaatatttatttctttgtgaaatgagataattcctgactaagcaatttgggtggaattaaaaaacaatgagacatggttggaggaactaggtgtgggtatataagactttttatatttgcatcttgttcggtgcatagtttttacatccatgaatttagaaaatcattgcatttaatactgggaaataataaagctgaaaatatgtagcagcaaaag

SEQ ID NO: 268218 - DNA, 458 bp, Homo sapiens
agctcaacatcactgatcattagagaaatacaaatcaaaaccacgatgagataccatctcacgcaagtcagaatagaagttattgaaaagtcaagaaacaatagatgctggtgaggccgtggataaataggaattttttacaccattgggcactgtggctcatgccctgaggctaggagtttgagaccagcctgtgcaacatagcaaggccctgtctctagaaaaagatttaaaaatcagcctgtgtggtacagtagtcctagctgcttgggaagctgaggtgggaggaacgcttgatcccaagaatcaagcaagaatgtaaatgtaaattagttcaaccattgtggaagacaatgtgacaattcctcaaggatcagaaccagaaataccatttgacccagcagtccgattactgggtatatacccaaaggaatataaatcattctgccataaagaca

SEQ ID NO: 268219 - DNA, 301 bp, Homo sapiens
tgaggcctgccttctccccacccctggccttggtgctatgtctgttttggggtgtcccaagcctgagggggcagcttgaagtcatcgaaggagtagggatcctggagccagctgattcagggttgaaatcctggctttgtcacattcctgctgtgtgaccttggtgagttcacctaacctctctgaacccgcagtctcctcttctttaaaatgggacctcagggttgcttgagaattagtaatataaagtaataaagtaaataaagtactaaagtaaataaggagcgggctgctcctgcaa

SEQ ID NO: 268220 - DNA, 599 bp, Homo sapiens
gtgtgatttgacagtgtctgagcaatgagatggaaagggcctgggtctccaacattatggatgtcccatatcagcctgggacttctatgctctgctgtgacataagggagaaatgaactgctctcttgtttagaccactgttgctttgacatttgatatgataggaaaacctatattgtaatacatataactgtttatgaaaattaagtcaaatgcattggagagagtaagagtaagttgctaatactacttttttttttaagtgtggacaaaactaaaaaggtttggggggatgagcagaaaaatttagaatgatcctttacttgggtttgacttctgtcattaaatccttgctccttttttaaataaataaaactagaaatcatgcctaatacatcaatttatttgaagccctaaatcaattggcaatttgataaccccctcagtccccgcacctaagtgaagatttattggattgaatcgaataccacaggggtggactgctaggtttgttagtccccagtcagctacttgggaggctgagatgggagaattgtttgaacctgctgcattccagcctgggcaacagagtgggactc

SEQ ID NO: 268221 - DNA, 600 bp, Homo sapiens
ttgaatctccatggctaatcatatgccaatacctggctctcaggaagggtgggatgttctgtatagcaggactgcatcatgtccagctaaaaactggggttctcaaactaaggaaggaggggaaaatagctagcagaaggcgactagcaaactgccacacctgcaaaaggataattaatggaaggcaaaaatgaaggggggaaaaaataagaagtatggtaattagaaagcatgttagaacatgtggaaaaagggggaaaaaaaagaaacctgaaataaggaggctggtctcgaacttctagcctcaagtgatccgcctgcctcggcctcccaaaatgctgggattacaggcataagccacggcgcccggccaaaaaaaatcaataataggccaggtgcggtggctggccaacatgctgaaaccccatctcttaaaaaatagaagaaaattagcccggtgcagtggcacatgcctgtaatcgtagctgctggggaggctgaggcatgagaatggtggtggggattgcagtgagcctagatcgtgccactgcactccagcttgggcgatacagtgagactctgtctcaggagaaaaaaaaa

SEQ ID NO: 268222 - DNA, 735 bp, Homo sapiens
ttgaatctccatggctaatcatatgccaatacctggctctcaggaagggtgggatgttctgtatagcaggactgcatcatgtccagctaaaaactggggttctcaaactaaggaaggaggggaaaatagctagcagaaggcgactagcaaactgccacacctgcaaaaggataattaatggaaggcaaaaatgaaggggggaaaaaataagaagtatggtaattagaaagcatgttagaacatgtggaaaaagggggaaaaaaaagaaacctgaaataaggaggctgaattaaattcagtgaagtctaataacagcattagaatcactgtagatgagttaaatttaccaaactaaagacaaactctcagatcagactttaaaagacaaaccacaccagggatacagtggtatgtgcctgctggtctcgaacttctagcctcaagtgatccgcctgcctcggcctcccaaaatgctgggattacaggcataagccacggcgcccggccaaaaaaaatcaataataggccaggtgcggtggctggccaacatgctgaaaccccatctcttaaaaaatagaagaaaattagcccggtgcagtggcacatgcctgtaatcgtagctgctggggaggctgaggcatgagaatggtggtggggattgcagtgagcctagatcgtgccactgcactccagcttgggcgatacagtgagactctgtctcaggagaaaaaaaaa

SEQ ID NO: 268223 - DNA, 543 bp, Homo sapiens
acactcaggggttttgtttttttgtttttttaatagacggagtcttgatctgtagcccaggctggagtccagtggcatgatctcggttcactgtaacctctgcctcctgggttcaagcaattctgtgcctcagcctcctgagtagctgggattacaggtgcatgccacccatgcacagccaatttttgtatttttagtagagacggggtttcaccatgttggccaggctggtctcgaacttctagcctcaagtgatccgcctgcctcggcctcccaaaatgctgggattacaggcataagccacggcgcccggccaaaaaaaatcaataataggccaggtgcggtggctggccaacatgctgaaaccccatctcttaaaaaatagaagaaaattagcccggtgcagtggcacatgcctgtaatcgtagctgctggggaggctgaggcatgagaatggtggtggggattgcagtgagcctagatcgtgccactgcactccagcttgggcgatacagtgagactctgtctcaggagaaaaaaaaa

SEQ ID NO: 268224 - DNA, 352 bp, Homo sapiens
cggggtgactctagagtatcccttatccccaacacattgatattctgccctgaaaactaagtaaatgatgctttattaatataacaaaccaatcattgatcattgtctagatggaaacatactgatatgagaaaatcatggaaaatctgagagctaggggccctggaaggaccagtgctgtgaacaacatgagcttaatgaggtcatggtcctaacacaagaggaaagctctgaagtgctggttttaataccctagagccttgctccttctggaattcttctgtccccatcatgaaataaattaggaaacctaggtgtttgtgttgggcgataacatcacggaacctctaga

SEQ ID NO: 268225 - DNA, 515 bp, Homo sapiens
gcggccgcttcgcactgtggctcctgccgaccgccaggcgctgttacagtggatgcgaactaaccgtaagtatgcagcagcagccggaacccacagttcaccttggtgcattcctttatgatgaagacttattgattcattatatgagaaaggaaaaatgagcagaaactactgtatgatgtgcagctcacaccagacagcaactttagggttatctttccagttcagcagtgcaactctatggagtagaattgaaaggagacttttcgccaattgcaggaaatggtcataaaaaaatacctgctcactgacagaataaagagtaatttatccctacttacagagagattgccctacgtgtaacagctgcatacaaaaaagttataaaattatcattggtttaacaaggataagtgaaaaacattaaaattctccaactgaacaaggtgtgtctgtttcattgattggctgactgtcaaatcggaatctgatctgccccattgacaatgccttgg

SEQ ID NO: 268226 - DNA, 678 bp, Homo sapiens
gcggccgcttcgcactgtggctcctgccgaccgccaggcgctgttacagtggatgcgaactaaccgtaagtggtaatagatgagatactcaagttcagagaggtgtggaagtcatttgacagagcagtcgggcccgagtggtttccttatgccaaggcagcacgtcatcctttttcctcaaaaataacagcaacaacattcctgcaccttgcctctgcagcattatatcgtactgcagaaaccagctcaactatgcaaaactaccaccaggactggccgacaccaggagggattccagagaccacactgcagggagcatacagaaagaaaattaagagatcagatgcagcagcagccggaacccacagttcaccttggtgcattcctttatgatgaagacttattgattcattatatgagaaaggaaaaatgagcagaaactactgtatgatgtgcagctcacaccagacagcaactttagggttatctttccagttcagcagtgcaactctatggagtagaattgaaaggagacttttcgccaattgcaggaaatggtcataaaaaaatacctgctcactgacagaataaaggtaccttttaacttagtcaaatctcttttgcattgttttccaatctgttcttggttgccattgtatagaaacagattgaattctc

SEQ ID NO: 268227 - DNA, 318 bp, Homo sapiens
acagaaagaaaattaagagatcaggtcagttagcattcactgatgagcaatgggaaagtctcagcttatggtgtcacaccagaatgcacctgatgtgcattctgataatgcaacacttagatcaaaaagcaagaggagaagtgaatgtctgacatcattgactgaggatagttcatgaagagacaaataaaagtaaatatgttaaatttactgtgagtgcttcttaaagtttctcctattcttcctaaccccacagtctctttagcctaatcagccctaaatttggttttaaacagtttttcatgtagtgcttcagcc

SEQ ID NO: 268228 - DNA, 316 bp, Homo sapiens
atcccagaattactttaaactaaatttacagcttgaggattcctggaccactccactaatgtgagacagggctgaaaatccatgcaagagttcacttgtggttaccagttttaagggacaactttttaaagattcgatttcccccttctctgctcagcatgaaatctcacccttagaaagttccctacatgtggattgtgattaggaaagtgcatttacttagttcagagttttagtttaatgtgcttgtctcctatttggattctcatggatctggaccttgacttatataccccatgccccttgaggccctcta

SEQ ID NO: 268229 - DNA, 333 bp, Homo sapiens
taagattagattaagattagattaagattaatcttaagattagattaagattaattttaagattagaaaaagattaataattagattagattagaaaaagattagaaaaagaaagattaaagattacgattagattaagattagaaaaagaaattcacgcaagtcatgatgcatgattgggtaaataaaaatattctattgaggccgggcacagtgactcatgcctgtaatcccagcactttgggaggctgaggcgaggcggatggatcatgaggtcaggaggtcgagaccagcctggccaacatagtgaaaccccgtctctactaaaaatac

SEQ ID NO: 268230 - DNA, 141 bp, Homo sapiens
taacatctggttccagccttccctttgggattccttcatgcttcctggtccctgaggggttcctgttttcaaaggcaggtgacagaatcatccaggcactgggacttagcggcccaggctctggcccagccgacccactga

SEQ ID NO: 268231 - DNA, 585 bp, Homo sapiens
gtaagattcatacctgcttcaccagtgattttcaaaggaggcaaatcctatttgaagctaaagtcacataaagagatttggaatgaggaaacaaattatagcagcctgcaagttgtagaatgaagaaatgcaaatgtaaagtactgaactttgtcatggatggatttaccaaagagaattactctgcataacatgaataatggagttcagaaggaagcccatatcccagacttcctcggttgtgctgttttactgaggttgggtggagtcaacacatcatggataaagaagtccctaaaggcagtcccagggagcccgcactgaacatcaagaagtcagacaaatccttcaaacgcaagaagcccaccgaaaatgtgctgatctttttaatcaacagacaactgggcaggcacagaagtgacatcgacctgtcaagatgggtgtggatgctgtcataaagcaactctagggtggacatggccttggacaaaaagtcatgtggcttacatgctgaagcctgcccatatttttgagaaattaaatataattagaacaataaactcctcccatgtttgagtcattaaa

SEQ ID NO: 268232 - DNA, 550 bp, Homo sapiens
aagcatgcctggagtgttaaagagataagagaaagctcttgtggctggaaaattgaagaagagggtaagtcataggaactaagatcaaaaagatcatagaagtgctagattttataggaccttgtgggcttttactttgagtaaaatggaaagacattggagaggtttaagcagaagaataacattgtttaacttatgtcttaatagggtaacttatgtctgtggagtgttacatggagaatgaatgaagggcacaaggagagcagttaagagactactaaaatattctagaggagaaaagagaatggcttggatctgttggtagcagtagaaatgataaaaatggatcacattctgaatctatttgaaaaatagtacccagaggagttagatactgggagtgagagaaaaaggcaagttaaggataattccaaggatttgggcatgaagttgcctttttaaaaatagataaagaactctttttgaggaaaaaaaagaagtaaagaaggggaacagaaaatgatggagtcagtataaaactgaacttgaa

SEQ ID NO: 268233 - DNA, 462 bp, Homo sapiens
gctaccactcctccatatgcacaggcaataagtcaggtattccttccagtaattggggctacaatgtaaacttagcaaagcttccagattaacacatttgtaaaaacaagacttcctaataacctgtcatctgctttcccaatttctctataattttagtctgtagatgacattcttgtggagttttaggtgactgtcatattgcagccatctggcagcctgtttaagaagcacaactctgacattataagatgatgaatcagtggttaaaaacaaaacaaaaggtggttgatgtttattgtaatacaatcttataaaatctgagagtattaactaattagtatttataaaagcatcttcaaactgaaatatccattaccattgaaaatcattttaactagataaaatatttccccaagttgtttttttgtgacacaaaataaaatagtggacattcaatga

SEQ ID NO: 268234 - DNA, 439 bp, Homo sapiens
ttggtagaaatagaaattcagttaaaattttaacagaatttaattacacaaataatacacaaatgtaatctttaaaaaattcattctacacaaaggcaaatttccttgatgccaacccaaacccccactctctcttgtggaggcacctgctattgtcagtgtggtgtataagtttccaggtctttccctcttttacacatatagatatcctagaaacatgtagcttttatcttttcataatatacattttttattttttgcaaccaacaccttgtttgccttttatcttttttaaaaccataaaatgttacacaattacattgtttgcaatttttttaaactaataataaagtgtggagcattttccatgtaactgtggttcacttcctcgtttactgctgtagaacattccatagcatggggttcgttctgccataat

SEQ ID NO: 268235 - DNA, 677 bp, Homo sapiens
  misc_feature (672)..(674): n is a, c, g, or t
gtctgtgggaattatttcctcccattggtattagattatatttttccaagtcaactcttcctggctgcccttcaaggttctaaagattttctactgttgtagtgtaactagtaagaggcaaaaccatgagaatcagagagaacttcccttcatgatgctatgcaatccccaggagaagcacgttgaaagctgaaaagaagactgactgagatgtgttggcgggcttctcaagatccctatcgatggcagaatgctgacatgagttgcccatagtccaggtttcccaatgtagcagatgactctagcggctccagcttcagcatcatcttaagttcaagtgaaaaggaaaagagaatctctttttcttcaaacaatttcaaactaaaatcttgagtctgacttttcctggccagaattaagcttgtacttatccctgaaaaatcatcaatgctacagtgatgaatttaccaattgaggcagaatttaggtcacatgacgctccaaagcctcttcaaaaccgcatgactcagagtgaggcagaagtatttgggatatttgcaacaggagaagggtaaatgaatggagagtgccaaaacaacttatgtcaattatacaattataaatacaaccaaaataaagtatggaaatcagtattttcacctatcttaaaannnaaa

SEQ ID NO: 268236 - DNA, 748 bp, Homo sapiens
  misc_feature (743)..(745): n is a, c, g, or t
gtctgtgggaattatttcctcccattggtattagattatatttttccaagtcaactcttcctggctgcccttcaaggttctaaagattttctactgttgtagtgtaactagtaagaggcaaaaccatgagaatcagaggtaagtgcttatcaaaggaatagaaccaagaggacaaattctacttaaacaatgccatccttaaatgagagagaacttcccttcatgatgctatgcaatccccaggagaagcacgttgaaagctgaaaagaagactgactgagatgtgttggcgggcttctcaagatccctatcgatggcagaatgctgacatgagttgcccatagtccaggtttcccaatgtagcagatgactctagcggctccagcttcagcatcatcttaagttcaagtgaaaaggaaaagagaatctctttttcttcaaacaatttcaaactaaaatcttgagtctgacttttcctggccagaattaagcttgtacttatccctgaaaaatcatcaatgctacagtgatgaatttaccaattgaggcagaatttaggtcacatgacgctccaaagcctcttcaaaaccgcatgactcagagtgaggcagaagtatttgggatatttgcaacaggagaagggtaaatgaatggagagtgccaaaacaacttatgtcaattatacaattataaatacaaccaaaataaagtatggaaatcagtattttcacctatcttaaaannnaaa

SEQ ID NO: 268237 - DNA, 456 bp, Homo sapiens
gaggtttatagcaagaacgcgaggttggtttactcattattcaatgtaatcatcatcattcaatgtaattcaccatattaacaataaaggagaaaaaccagacaattatttcaatagttgcagaaaaacatttgacaaaattcaacacccactaataataaaaattctcagtaaattaggaacatacaataatttcgtcaacctgataaagggcatctataaaaaacctacagctaacttcatactcaaaggtgaaatagtgaacacttacctcctaagactaccaacaaggcaaggatgtctactcttgccacttctcttcaacattgttctgatacccacaataacgtgggtgaatctcaaaattattatgttaactgaaagaagacagacataaaaagagtttatagtatatgattccattaatacaaaatacagactaatctaaaatgacaa

SEQ ID NO: 268238 - DNA, 393 bp, Homo sapiens
taagagctagggtgggcaaccccactgggcactgtggccaggcctgccatgtctccttgttcagctgccacattctgatggggagggcgggaggtgtcgagagaccacaatctaagttcttattacctgattttatttcacctccactgagtgctcactctcctctcacctaacggatttactctcatctgcaggtggtttaagtgtgaaggtttactgaagatttaaagagtgttatcacagttgggatgatttaaactaacagtacacgttgcattttaagaaaataattaatcctcagaggagatatgggttatggagccatgacaaattttcagcattacttcccttacttgttgtttccaaataaaagatttttgattccccattgat

SEQ ID NO: 268239 - DNA, 717 bp, Homo sapiens
aagcagctggtacggtctgggaatgtacggatctggatccctgcctgccttccacctacctgactcagacctgccaggaatgccctgccccagggccctgagtcctgctgggtgagccattgctctgcctgagccatgccagtgcatgtgtgactggccctggctggggtcagcaagggcatgtcgacagaaagaagcatgccaacaggctccttgggtgctgacggccaggtagggtttggtgcaggagaaggcgggcagctagcaggaggggacggtcaccaggcttcagaagcccactgagcagtgcccagagtcttagctgtgcttgctggacatttttccttgccccagcttctcttccttgtgtgtgtggtgtagtagagcctgtctgagctgtggagtcagacacacatagccaggtgctgcttcacctgtaagcctcttcgtttcatctgtaaaatgggggcattccaccccttctcagaggcaggtggcaagggccgggtgggaatgtaaacaggtgccaaggagcatgcctttcctccccttttctgtgggagacacaccctcaaaggagcagggcagggtaaggtggccgcaagctgacctttgccctggttcttggcagaggaccttcctggggactgggcagccttcgcacttaatctcagcccatccctgttccccctcccagtcagctttcagcgcagccaa

SEQ ID NO: 268240 - DNA, 970 bp, Homo sapiens
tggaggctgggttgtgaatcggccgaggctcccctgggcccacccctctttccccactcctgcctgagctgttaggttggcccaggaaggctggttgccctgtgggcagacacaccccttcagtgcctgtggttgtattgtccttggcattgaagcatggccagtggtagtgggatcaaggggaggaggtgggtgctagaaatccttggggcagttggggcatggactgcctgggtcctggagagtgcctctagaactgggctcccatgtgggctctggttccgcctggatccctgcctgccttccacctacctgactcagacctgccaggaatgccctgccccagggccctgagtcctgctgggtgagccattgctctgcctgagccatgccagtgcatgtgtgactggccctggctggggtcagcaagggcatgtcgacagaaagaagcatgccaacaggctccttgggtgctgacggccaggtagggtttggtgcaggagaaggcgggcagctagcaggaggggacggtcaccaggcttcagaagcccactgagcagtgcccagagtcttagctgtgcttgctggacatttttccttgccccagcttctcttccttgtgtgtgtggtgtagtagagcctgtctgagctgtggagtcagacacacatagccaggtgctgcttcacctgtaagcctcttcgtttcatctgtaaaatgggggcattccaccccttctcagaggcaggtggcaagggccgggtgggaatgtaaacaggtgccaaggagcatgcctttcctccccttttctgtgggagacacaccctcaaaggagcagggcagggtaaggtggccgcaagctgacctttgccctggttcttggcagaggaccttcctggggactgggcagccttcgcacttaatctcagcccatccctgttccccctcccagtcagctttcagcgcagccaa

SEQ ID NO: 268241 - DNA, 398 bp, Homo sapiens
cacaagtgagggtgtccacagccctggctgggccccaagctgcaggctaagcttctgcctgaagcctagggacttgcctctgtcccctccctttctccaaaaccactcagtcagcacattcctgaagcagccaagtggaccccctccccctgggcccacccctctttccccactcctgcctgagctgttaggttggcccaggaaggctggttgccctgtgggcagacacaccccttcagtgcctgtggttgtattgtccttggcattgaagcatggccagtggtagtgggatcaaggggaggaggtgggtgctagaaatccttggggcagttggggcatggactgcctgggtcctggagagtgcctctagaactgggctcccatgtgggctctggttc

SEQ ID NO: 268242 - DNA, 646 bp, Homo sapiens
aaaaaggccctgagtggaactgtattatccagaagtaagctagtttttacatggaggattatgcagtttacataattgaaatgtgtttttctctgtgtgctgttctcatattccaatattcttttttcctctcatggtcatgatgttttcttttgagatataattcacataccataaaattgatgcttttaaactatacaattcgttagctgggtgtggcagcacacacctgtagtcccagctactcaggaggctgaagtgagaggatcacttgaactgggaggcagaggttgcagtgaaccgagattgcgccgctgcactccatcctaggcgacagggtgagcccctgtctcaaaaataaataaataaacaattcagtggtttttagtctattcacaaagttacacaaccatcaccactatctaattccagaacattttagttaccccaaaaagaaacctcatactcattagcattctctcccctttttctcttccatctagcttctggcaaccagtaatctactttctgtctccatggatttgcctattctagacatttcgtacaaatggagttgtagtattgtggcgttttgtgtctgccttctttcatttagcacagtgttttcaaggttcatccacattgt

SEQ ID NO: 268243 - DNA, 505 bp, Homo sapiens
tgaggtgaagagcaattgggtttctcagagtctgagctggtaatggagacagggtgggttagaaccatattaatcatgtgaaagtatttagtgttaccattctctgcacttgttccttgcttgctaacttttgcttttgctggttaatgttttcttccttgaaatgtaatttttctgagtttattactgaaataactcttgaaatcttgtctttggtacagtgtctttcctgacactgcattacacacagacacaggtgtttttccctatattctacttccaaagaaaccctgtggtgaggagagtaacatatttgtacattttataaagttaacaatttacttactgtgtgttgacatttagtcataataaagatggcttttaagttctcctctagttctaacactgatgatacattcgtaacatcatggcatgtaaatgttctttacccagactgtacactgctcagattaaccaatgcattgggctgtgacctctaaaactg

SEQ ID NO: 268244 - DNA, 360 bp, Homo sapiens
cagcctggagtgcagtggtacgatctctgctcattgcagccttgacctccctgttcaagcaattctcctgcctcaacttcctgagtagctgggattacagtcacccaccactatgcccagctaattttttgtattgttagtagagacggggtttcaccatgttggccaggctggtctcgaactcctgacctcgtgattcgtccacctcggcctcccaaaatgctgggattacaggcgtgagccatcatgcccagctacatctctgtttctttttgcaaaaataaatacatatatttgtttttggactaatgtaaacatactgttaactgaaatagtaaatggactgtactgttaaagaga

SEQ ID NO: 268245 - DNA, 418 bp, Homo sapiens
gtaggtaaagatgagttcatgccaacgtaggaggcttgaagatgtttgccagaagacatacttcacaattccagtcgttaagtagcaacatagatgccaagtaagaagaaatagtcactgctgttaaagaactccagtctacctacattctggtgagaaaagaatgaatgagccagagtcactgtcctcagagaactcacatcctagccaacagaagcttctgtagaagaataacttcaggtctgtagatcatgatacaacagtttcttacagtatgtagtagtgaaactctagacaccaaagttataatgagatgtgattagaaaaaaatgtaatttgcatgaattgtttttaagatcaaatatttttaaaaagaacagatttccagttaatgaaataaatacatttggatatgaca

SEQ ID NO: 268246 - DNA, 537 bp, Homo sapiens
gagagtataaaggagaaaagaaactaactttgaacaattattcatttatctaacaaaatttattaagtgctttttgtgttccaggcactgtgctatgccctgtgaattcagggatataatatgttttcagattagatatcaaagtattgtttaaatacaggcatacctcattttattgtgtttcgctttattgcagtaaaaagtagtgtgtgttctgactgctccgttgagtggccgtttctctgtctgtctccctttcctcgggcctccttatttcctgcaacacagtgatattgaaattaagccaattaattaccctacagtggcctctaagtgttcaaatgaaaggaggagtcatacatctcttactttaaattaaaagctagaaacaattaagcttattgaggaagggggcatgtcaaaagctgagacaggccgaaagctaagcctcttgcatcagttagccaagttgtgaatgcaaaggaaaagttcttgaaggaaattagaagtattactccagtgaacacatgaatgatt

SEQ ID NO: 268247 - DNA, 1874 bp, Homo sapiens
  misc_feature (919)..(919): n is a, c, g, or t
aagttatgctctgtacttactcaaaaaacgtacaatctaattggcaataaacaaaggaatgaccatgtggacctccctaagttagtgagccctggtttgcaaataagtgttgcttacatcctaacacaggtttgcctccgccccacccacacttccttcaggtgccaagtcctgcagcttggcagccccagaggcctgctggccccagcttttcacctccatggcctccttacacaggtgaccgcactggactggccggccatgggggacacacttttgttcttccatcagttggggttgattaattgaaagacaatgacttctcgactgtgcttgtttatcttcttaagtcctcttccccgccggctcccgtccccctgctttctaacctcaggaaacattttcatgatcaattcattctcttgtatcctactttggtaacatgactttttttttttctaccgcttttcagctgagttgtggagtaggcagaactttattatctgacctgggaagctaaccactatgtgatactgttttctgaggaaaatatgttagattccacatggtaacttgacaaacaaacttgaaacatggctgtttgaaagctgagatggtttgtgagaaacattgtgaggcagtgtggcgtgattaattgtcagataacaccagtaagtacctttgagtttaggggaagaagtgattagtggctagagaggtctgagaaggttccactgaggcaatgaaactagctagttcttaaaagtagggtggcatatagaagagaaaacagagtttctaggcatgggagaagggcaaatatgtgattctcagctgaggctgtatcttttaaaatgttttgaaaatacctttgtacagaaagcaacactggccacacctaagaaagcgatgcttccantccccctccttgccctcacttctctttcccctctcacacagtccctttctctcaaagccattccccatgtctccacctcaatggcctgtggtagtttagagcaggggtccccaacccctgggccatggaccactaccgtggcctgttaggaacctggcccacagccagaggtaagtgacaggcgagctctgcctcctttgatgtaagcagtggcattagattctcataggagcacaaaccctactgtgaactgcacatgtgagggatctaggttgcatgctccttatgagaatctaaatataaatgtgatgcacttgattcatccagaaaccatcccctccatccccatccatggaaaaattgtctttcatgaaaccagtccctggtgccagaaaggttagggaccactggcttacaggagaaatgaatggttgagatatcatggatgggagtagcctgcacttgtaaatagtgtagaggcagaaaaaaaggttgggaaaaccttgaactagatagagatcaggagaagccagcattgtttatgttactcttctgcttaaaggccaattttagatatttccttggggattttagttatttcctgtgcctttgcaggttctaaaatgattcttttcagacttagagtcaaagtagctaaagaatattaaattctggctggttgcagtggctcacgcctgtaatcccagcactacgggaggccgaggtgggcagatcacgaggtcaagagatcgagaccatctggcaaacatggtgaaaccctgtctctactaaaaatacaaaaaattagctggatgtgctggtacgtgcctgtagtcccagctacttgggaggctgaggcaggaggattgcttgaatccgagaggcagaggttgtagtgagctgagattccatgccactgcactccagcctggcgacagagtgagattctgtctca

SEQ ID NO: 268248 - DNA, 298 bp, Homo sapiens
cctctaggactagataatgactaaatgaaatcatattcaacagtaggggaggattcaaaaataattaactcctggcaatgatttcttgaatatgacagcaaaagcacaaaaaaacaaagcaaaaatagaaaaatggcactacaacaaacttaaaaacttatgtgcatcaaatagcaccatcaacaaagtgatgaaaaggcaacatataaataggagaaaacatctgcaaatcacatatctgataaggggttaatatccagaataaataaggaactcctacaactcaacaaaaaaaaaa

SEQ ID NO: 268249 - DNA, 628 bp, Homo sapiens
aggagctctaggcaagagacacttaggagatttgcttttctgagtggtaaaaatgtttgaagcaactctaaatagctttgaaatgttagtaatagtcttactgtcttcatgacatttaattagccttctgtaagagtttgtttagcaaaggtaaaccataagcctagccctctatatgcatgtgtggttgaatgtgtgtgtgtttttatataaagcaattttcagttaaatcttccacttaatgaatgtagtagaggaagatgtctcatgtcattttggtgaccttgacctatgtctattcatgtatttattcctgctgtgttccaattcatatcttcaggataaatgctgtatctttattgtctttctccaatttttttttgaaggaaccaaagaccctatttaaatgcaataaggttgtaatactggtgcccacttcaccctggtcatgttttttctgaacaaatatttcatagcttttcctcatcaaattccagtcccactgctaagatacccatctatgacacagtctttgggaaaacccaaggaaaggataacttaaaaatgatttgtattggaatcatgacacttcagagctatgaataaataaatataacatagtctttaa

SEQ ID NO: 268250 - DNA, 506 bp, Homo sapiens
tcagcagacagcccttgttagatggcagaggtcgccagatgttcctgaggaactggcatcaggacttctgggacgtaaccacttcagtttccaatcactgacttccctgaacctggtatcttcagatctgggttgaagctgaaggctcagttggggaatcaggaaaacaagggaatcggagccagcccaagccaactgacaataactttcttttagtgactgcattagtttggggtaatgctgtaacaggcagcatttcaaaaacggatccaaatttgggttgaaaataactcacctgggtctccaatcagacctaacagagccagaaagaggcctgtacacggggactgggcagaagatctaatgccgtttaagactcctcccttgagaccagagaaaagaaactgcagacacagcctgaatgatacaaaagtgcatcattgatgaaaaaacaaagcctactgttccttcaaggtgtgggaataaacaagctctgctaaaacaaa

SEQ ID NO: 268251 - DNA, 310 bp, Homo sapiens
agttacctgcctctgaagggcaaggccctagagagatgcttaactaggcaggtatgatgattgcagtgcccttagggcaagagcaaaggcagagattgtcaacacataggcaataaaggctgcctactcaaactctgggcactcttacttggcttgttaagttgtatcctacgtgcatgagtgttttggctcaggagaaaaactctagtgctattagaaaatgtctctttcacatagacagtatcaaaacggctttattagtcttaaataatgaaaaagtagcagaaacagatttagaatttaatctctt

SEQ ID NO: 268252 - DNA, 363 bp, Homo sapiens
tggtgaaccattttcacctcaggccatttaggggaagagccccaaacatttttgaccataaaactctcttctctcagagctttgctgagactggagttgaaactggactaaaagtttaaaccttgctttcttttagttccattctgttttggttgctttgatgtcaaaacaaaacaaaacagtccatactgtttaagtcatggtgatgacttatttccctataccaggaacctgatgaggagagcgaaatgaagaaggggtcctctagaatctgggggtctttggaaatgagtgagttaactggtgggtaaataagtcttaatcttggctgtggaagtctgtagctgggaaggtacattagtt

SEQ ID NO: 268253 - DNA, 659 bp, Homo sapiens
gcggccgccggcgacctgggcctacttccacttccggggtcaccagggaagagacgggaaggaaaagaaatagcggttggctgagaggcaagccaatccagctagggctgcgtcgactccaaggaggcggtcctaaggaagtactggccccgccatttaaaggcccctccctccgcgtgtgggaatgggattcccgcaggttgcaccgcaggaagcaagacaaaaccagggagctcagaagagtcactgccctgatcccttccgtgccggcagctgcgaggacacaggcccctttgtatcctgcggtgcggaggtggagcagaggagagggtgccccggctggccccctccctcgccccgcagcactgcccctcctttcacagcaacccacggcctcccccgcgcttgacccagctggcgagctgccccttatacctggatccgcccctcgggtcgcagctccccaggcccgatcaccgagcggtgcctaggaactgggagcgtaacttggctcggctcagaactttgcccgtgagccaaagaacactgaactcatctacctgctgcttgacatctcatctgcataccaagctatttggtggacgtccacaagcgcccccgcccccacgtagacccagttgggtccccgttccgtcggt

SEQ ID NO: 268254 - DNA, 793 bp, Homo sapiens
gcggccgccggcgacctgggcctacttccacttccggggtcaccagggaagagacgggaaggaaaagaaatagcggttggctgagaggcaagccaatccagctagggctgcgtcgactccaaggaggcggtcctaaggaagtactggccccgccatttaaaggcccctccctccgcgtgtgggaatgggattcccgcaggttgcaccgcaggaagcaaggcaggtggactctgcaccaatgcctgcagactaagggcagactctcaggattgctctgggtgtattcctaggctttgtattcctgggagatggagggcagccaccgagccacatatagtctttttcccttgcagacaaaaccagggagctcagaagagtcactgccctgatcccttccgtgccggcagctgcgaggacacaggcccctttgtatcctgcggtgcggaggtggagcagaggagagggtgccccggctggccccctccctcgccccgcagcactgcccctcctttcacagcaacccacggcctcccccgcgcttgacccagctggcgagctgccccttatacctggatccgcccctcgggtcgcagctccccaggcccgatcaccgagcggtgcctaggaactgggagcgtaacttggctcggctcagaactttgcccgtgagccaaagaacactgaactcatctacctgctgcttgacatctcatctgcataccaagctatttggtggacgtccacaagcgcccccgcccccacgtagacccagttgggtccccgttccgtcggt

SEQ ID NO: 268255 - DNA, 418 bp, Homo sapiens
cacaaacaggggcttttagtccctaaagacctggggaccatgggcatgtggctggctcagggctggctgccccaccctcctgagccagagttcaggtgtggccaccaaaggtggctgtcaggactgtggtattcctgcacaaaggacagcccaaggaggggagccaccacagggtgactgcaatgacagaaacccaccgctctagctcctagctgttccctgcagctgccccatctcacaatttgcacattcatccgtggctcattgccgccgccttcctttcttccctttccagtaacttctctcaggctcctgtcccccgacacctccctcttcgggattacttccttcagagaccccaggactgtgcagggtcatcattgagaaagcaaagccttccctggcagtcagaactcct

SEQ ID NO: 268256 - DNA, 276 bp, Homo sapiens
catgaatgctcttcccccaaatggaaggcactgcaagaattgacagattctggcattattggagtagcagcagtagaaacataaagagatatttgtttaggtatggcataattaaaatgaacaggggaaggggggccaggaaaaaaaacccagaaacacttagatgctgtccttggtcctgaaccagcagtacctggtgaatggctatcttacttatcccaagaatctggtaacttctcttctagggcttagactttcatttttacccttttacca

SEQ ID NO: 268257 - DNA, 448 bp, Homo sapiens
gaaaattagtaaaattaaaaactaaaaaccacacatagttttgctagaattaaatgaaaaaaaaagttattagccctgttcttatctgaatacatgatacagtagttattttttggagtgtaaatcctgtcggtatatattgagcacatatattgtgttgaagattactagaaggaaaagtcatcaaaaagcaacaatttaccccaggaaaaggggagggaaggcatgctgatatgagttgcctcatgggacagtgatagccattccctgccttcccatctccatggtacagcagatcttatatcatgttaacttagtaatatttccaagagagtagaaaaatgagtaaggaaatggggaatctgatattattctctctcatctccagagcaacattggtgctgttgtaaagatgtactgtagaaaagtattcttcacccagcatgac

SEQ ID NO: 268258 - DNA, 1320 bp, Homo sapiens
ctgcaggggctgaggcagaagaatcgctcgaacccgagaggcggaggttgcagtgagccgagatcacgccactgcactccagtctggggcagagcaaaactgtttcaaaagaaataataattttattctcttgtctatccattcggtagacaagtgtagcgttactgcctcctttttgcaaataataaggatttaggagacagacattatcagttcgagagcccacaggcactggactagagacacagaacctacactcagacccaaacaggaaacggaggagtcaaatcaacttgcatttcccctaccctcaccgccccctttccttcccaaggcaatagtgtaggggacgcccagtaagttacggaaaaggcggagacagaggtttcgttcccgcccctccaattcagtctccaaaaggtccgcataattgatatataaggggcttcagtgtgtagcaaagttgcaaaagttaagagttgttgtttgtcttcgatcatgtctggtagaggcaaaggtggtaaaggtttaggaaagggaggcgccaagcgccatcgcaaagtgctgcgtgacaacatacagggcatcacgaagcccgccatccgtcgcttggcccgacgcggcggcgtgaaacgcatttcgggcctcatttatgaggagacccgcggtgttcttaaggtgttcctggagaatgtgatacgggacgccgtaacctacacggagcacgccaagcgtaagacagtcactgcaatggatgttgtctacgcgctcaagcgccagggacgcactctgtacggctttggtggctgagcctcaccccggctttttatttaacagctcacccataaaaggcccttttcagggccacctccttcgtcacacgaagggctgtaactgatgacgacttgggtttcgttttgtaaatttgggattctaactgagttaaaccgagccgtttttagcgatcttcctaagatggcggatgtgctaaggagaaagggaaggcgaaacattagaaacttgttcaggtatttcgatcgcaaacattcacaggaaaagatggtggaaatggtttgggaataccagcagccttttatgacgtatgtgatgtgttttattcccacgtttctgaaatttactcctatgttaggtggctgggacttaactacactagcattacatgtttagtttttgagatggagttgctcttgtccaggctgtagtgcaatgacgcaatctcggctcaccgcaaccaccccctcccgggtttaagcggttctcctgactcaacctcccgagtaactggggttacagcatgcg

SEQ ID NO: 268259 - DNA, 206 bp, Homo sapiens
tgtagagatggggtctccctgtgttgcccaggctggtcttgaactactgactttaagtgatcctcctgccttggcctcctgaagtgctaggattactagcatgggccactgggccttgccttgaggtttagatttcctcattttactattttgtttttaattattgggtgaaacgttttactaaattaaaaaaaattattaccact

SEQ ID NO: 268260 - DNA, 332 bp, Homo sapiens
cgataagctctccctccctaaacccttaaatacccttagtctgtaagagagagtgctcctgacagcaatcggccagaagcccctctcaggtttattctccaaaataaacctgtcttggactgttgagccacttttcgtgtttctttcttctttcttcaactcttacactcaggagttcaagaccagcctggccaacatgcaaaaccccatctctacaaaaaaaaatacaaaaaattagccaggcatagtgatgcacgtctgtatcctcagctacttggaaagctgaagctggaggattgcttgagccagagaaggtgaggctgcagtgagcc

SEQ ID NO: 268261 - DNA, 368 bp, Homo sapiens
ccttgctatgtaattgacgcataaccagtcagccttaccggtggcattgcccaggctccagtatttctcctctggctgcttgcctctggcccagtgttccctcagtcactctcttagcctttcatagaatcccactgccccaaagaagagctgcttacagagccctggggtaatcctctaattttgaatgggcctgtgtagcttacaaagcacttgtcaaaagacaaaattataacaaacttcattatagatctaattggcttttatttgtgattcatgaatctgggcagcctccattctacaaaatagaatgagagctcccactgggcagtggtagaacagcgggttttttaaggtgagatcaagga

SEQ ID NO: 268262 - DNA, 433 bp, Homo sapiens
aaagaacacatgtcacctataaagacacatatagaccaaaaataaagggatggaaaaagatatctatgcaaatggaaaccaaaaagagcaggagtagctatacttatattagacaaaatagattttgagacaaaaactgtaaaaaggacaaagaaggtcattatgtagtgataaaggagtaaatttagcaagaggatataacaatagtaaatatatacgcacccaacactggagcacccagatatataaagcaaatattattagagctaaagagagagatcaacctcaatataataatagctgcagacttcaacaccccacttttagcactggaaagatcatccagacaaaagcgagaaagaaacatcagagttaatctttactatagaacaatgtatctaattgatatttctagaacatttcgtccaatggc

SEQ ID NO: 268263 - DNA, 520 bp, Homo sapiens
acttgcagctatgactcaactggtccttcactgccaaacatacctggggttggatcattggcctgacgtttgcaaattgaggaaccttagggcaaatcaatgaacttctgaactgccttcgtcttcagttatatggggatttccccacttttgaggtacttgtaaggattatatgagatgaagagatgagacaaggtatataaaagtcctagcacagagcgtgtcatataatatggcttcacaagtaccctcatctcctttccagtcgttttttgtttttgtttttgtttttttgagaccatctcactctgttgcccaggctggagtgcctcttcatttttatttctttattctttcaaagctcttaccaccacctgaagtcatccagcctgggcgacagaatgagactccatctcaaaaaaaaaaaagaaaccaaggatatagaataaaacaagagtgtagatttgggcattgaggccttcaaattggattgttctcaatgtccagaagaaaaaaaaaa

SEQ ID NO: 268264 - DNA, 380 bp, Homo sapiens
  misc_feature (296)..(296): n is a, c, g, or t
aaaaagatacttacacacttatgtttatagcagcataatacacaattgtaaaaatatgaaaccagcccaaatgcccatcaatcaacagtggataaagaaattgtggtatatatacaacatagaatactactcagccattaaaaaggaagaagataatggcatttgcagcaacctggatggaattggagaccactattctaagtgaagtaactcaggaatggaaaaccaaacaacgtgtgttctcactaataagtgggagctaagctatgaggatgcaagggcataggaatgacacntaagcttcccaaaaactagaatagatttttactgaatagtggtatatctgatggtatatgtttcttaaaggtccaaatgtaata

SEQ ID NO: 268265 - DNA, 402 bp, Homo sapiens
attgaattgtatacttgaaatttgctgagagtaggttctaactgttctcaccacatacacacacacaaagttgactatgtgaggtgacggatgcgttaactaacttgattgtggtaatcgtttcagtatatatgtaaagcaaatcatcatgtggtgtactttaaatatatacagttttattattcaattatgcctcaataaagctggaaaaaataattggtcacatgcaacgaaaatatagataagttttcatttttcttttccaaataagagaactcacaaaattctagtattttaaagctgaaagcgtttaaaaaggacatttaaactcattattttacaaataaatgtactgaagcccggggaggttagctgacgtgcctggaggtgtcaccctaggcc

SEQ ID NO: 268266 - DNA, 480 bp, Homo sapiens
gagattgcctcttttccaggataggaattaatcatggagaattttataaatctctttgtggcctttacgcgtgccacggccacatcaaaacttagttatttctagtagcaactgacgattgggagctcttaccttttggagtcccttctatcccattgaaagtgtgcgggtggtggtataaaaatgtttcagctgctctgcgcttcagccccacccataatgacatctgctccacaacaataagaccgaggattatattatctccaaagtaaccatcggcctatttttatgcctactttggttattgaaggtgggcttttggatgatttactgtgtccatgaaattctcaacttgagcggggcctccattgggaagacgtttctaatcctggctgagtttacgcctgtcactgagttattcatgcaccctgccctttcaatagatactattcctataaaatgaaatttagaagtttgtat

SEQ ID NO: 268267 - DNA, 360 bp, Homo sapiens
cttagaatgatgagggatttggagtgatagttgggtcctgatatggtttggctccctttccccatccaaatctcatctcgaattttaatccccatcaccccatgtgttgagggcaaggcctggtgggaggtgattgactcgtggggctggttttcccctggctgctcttgtgatagtgagttctcatgagatttgatagttttatgaggggctcttctccctttgctcactgtctctcacctgcgccatgtatgacatgcctttgcttctctctcaccttcctccattattgtaagtttcctgaagcctcccagtcatgcagaactgtgagtcaattaaacctctttcctttataaatta

SEQ ID NO: 268268 - DNA, 367 bp, Homo sapiens
agtgggttctctctggccactccctctacggccagttctgttttctccccatttttggaaacccaaattcttgatgtttctgttattcacattgccattaagaattatgggctttgcactgtgtttttaatttgttgtgtaagggttttacacaaacacagctagatgcctagaaaagacaatgtatatgggcatgcaggctgtgcactgcacaactccagagggcttcattcatgaccaggatgtgagtggcgccctggaatcatgcaatgtggttaccggtattgccagagaggaaatgatgtcttacatgaccccatatccccgggaaaaggccagccatgctaataaagatttgctaactaac

SEQ ID NO: 268269 - DNA, 788 bp, Homo sapiens
agatatgccaaagagaagccatgaagtgcatcttttaaattaaaagcctacctattctcccagagggcatgcattctatggagacagagctgaatgtgtgccatcagaagaccaaaatcaagcgacattttaaaaagaaaacagactcttctgggaaaaatggtgactccacaaagtaagaagccaccaagacttgtaggacattccttcatcttctcctggatggggcaacccagccatggatatatgcctccaatcagcataaatgcccattgcttgataaagtcaacacacgtgtaagatggtatgtagatcttctgggctcctggccttagactcttgcccttgtgtttaccaactcgattgtaaatcctttgagggcagaaaccatattttagatttcttcatatcctttcccttcctccaggtcactaacacttcatgtactcaacaaaggtcaacacctttgagaggagtgacaggagacactcccacagtgctgaactatgtcctgcccttgctcaacatggtgggactctgcctcccaatccaaagaccccgaaaactgccaccaatcctgtccttttcccccaaatgaagctagaagtaagaatggaaagagatctaaacaccatccagcccaatcttgtcatttcacaagcatggaaactgaggccacagaaaagaattgacttaaaatcaagatcatgcatcccattagaggaagctctaactctagaatcagataatatgactctagttcaatgtccataagactctattgcaca

SEQ ID NO: 268270 - DNA, 539 bp, Homo sapiens
tcatatgctgaggttgctaagatctatggcaagaatgaatcttctatctgtgaaactgtgaagaaggaaaatgaaatttatgctagttctgctgcatatatagggttcagtattatctgcagtttcagcctacctattctcccagagggcatgcattctatggagacagagctgaatgtgtgccatcagaagaccaaaatcaagcgacattttaaaaagaaaacagactcttctgggaaaaatggtgactccacaaagtaagaagccaccaagacttgtaggacattccttcatcttctcctggatggggcaacccagccatggatatatgcctccaatcagcataaatgcccattgcttgataaagtcaacacacgtgtaagatggaaattctgtttcttgaagggaactcctcagagaaaaggaccacaagcaaattgctgctgctacaaaatgataccataatgagaatggaaataatcctggattctctgctcatttcgacaagtaaaataaggcacatatttttcaatggataa

SEQ ID NO: 268271 - DNA, 502 bp, Homo sapiens
agatatgccaaagagaagccatgaagtgcatcttttaaattaaaagcctacctattctcccagagggcatgcattctatggagacagagctgaatgtgtgccatcagaagaccaaaatcaagcgacattttaaaaagaaaacagactcttctgggaaaaatggtgactccacaaagtaagaagccaccaagacttgtaggacattccttcatcttctcctggatggggcaacccagccatggatatatgcctccaatcagcataaatgcccattgcttgataaagtcaacacacgtgtaagatgacatattgcaggtatctgtcacatcaagcaaggtttgaagaagaaacaactggagaattttacttatgtggatgaaaaagcaaacagaagttagtccagcatggaagtcacatgctttgggattgtagcattgtgttctcctgtaggaggtgatccattgtcatttatcggaatccatcttcactcaaaaggaacagg

SEQ ID NO: 268272 - DNA, 351 bp, Homo sapiens
ctagcagactaacacagctggcaagtcagaagcctcagactccaagaccctgactgcagtgctatcacacctctgtcagcagagttggctaatgaatcttggaaaaatcagaggtcttctcacaaaataaggatcctgtgaaggagagtaatcaaggaaaagttgcaatctcttcagacctctatcatcaaaaaggaggcccagtgcattattggcaccgagaagttctctgtaggggtgatcataagggaccttcaaatgtttgaggaaacatcatcagtagataatgtagccctcagacaactgcactgtttctctgcagtaaagctacccttggtcactcgggagctt

SEQ ID NO: 268273 - DNA, 1116 bp, Homo sapiens
cgagaggaggaaccaccattggagaagttacaagttgatgattgacccggctctgaaaaaggggcatcataaactgtaccgctacgatgggcagcatttcagcctggcgatgtccagcaaccgcccggtggaaattgtcgaagatccccgggtcgtcgggatctggaccaaaaacaaggagctggagctgtcggtgcccaaattcaagatcgatgagttctacgtgggcccggtgcctccgaagcaggtgacatttgccaagctgaatgataacatccgtgaaaacttcctgagggacatgtgcaagaagtatggggaggtggaggaggtggagattttgtacaaccccaagaccaagaagcacctgggcatcgccaaggtggtctttgccacggtccggggagccaaggatgccgttcagcacttgcacagcacttccgtcatgggcaacattatccacgtggagctggacaccaaaggggaaacccgaatgcggttctatgaactgttggtcactggccgatacaccccccagaccctcccagtgggcgagctggacgctgtctctccaatcgtgaatgagaccctgcagctgtcagatgccctgaagcgcctcaaggatggaggcctgtctgcaggctgtggctccggctcctcctctgtcacccccaatagcggtgggacacccttctcccaggacacagcttattccagctgccgcctggacacacccaactcctatggacagggcaccccgctcacaccgcgcctgggcacccctttctcacaggactccagctactccagccgccagcccacaccctcatacctcttcagccaggaccctgcagtgaccttcaaggcccggcgccacgagagcaagttcacggacgcctacaaccgccgccacgaacatcattatgtacacaattctcccgcggtcactgcggtggccggggccacagccgctttccggggttcctcggacctcccgttcggagcagtcggcggcactgggggcagcagcggtcccccgttcaaggctcaaccacaggattcagccacatttgcccacactccaccacccgcccaagcaacccctgctcctggattcaa

SEQ ID NO: 268274 - DNA, 919 bp, Homo sapiens
  misc_feature (919)..(919): n is a, c, g, or t
cgagaggaggaaccaccattggagaagttacaagttgatgattgacccggctctgaaaaaggggcatcataaactgtaccgctacgatgggcagcatttcagcctggcgatgtccagcaaccgcccggtggaaattgtcgaagatccccgggtcgtcgggatctggaccaaaaacaaggagctggagctgtcggtgcccaaattcaagatcgatgagttctacgtgggcccggtgcctccgaagcaggtgacatttgccaagctgaatgataacatccgtgaaaacttcctgagggacatgtgcaagaagtatggggaggtggaggaggtggagattttgtacaaccccaagaccaagaagcacctgggcatcgccaaggtggtctttgccacggtccggggagccaaggatgccgttcagcacttgcacagcacttccgtcatgggcaacattatccacgtggagctggacaccaaaggggaaacccgaatgcggttctatgaactgttggtcactggccgatacaccccccagaccctcccagtgggcgagctggacgctgtctctccaatcgtgaatgagaccctgcagctgtcagatgccctgaagcgcctcaaggatggaggcctgtctgcaggctgtggctccggctcctcctctgtcacccccaatagcggtgggacacccttctcccaggacacagcttattccagctgccgcctggacacacccaactcctatggacagggcaccccgctcacaccgcgcctgggcacccctttctcacaggactccagctactccagccgccagcccacaccctcatacctcttcagccaggaccctgcagtgaccttcaaggcccggcgccacgagagcaagttcacggacgcagacgcgctaatggacgagctcgan

SEQ ID NO: 268275 - DNA, 918 bp, Homo sapiens
cgagaggaggaaccaccattggagaagttacaagttgatgattgacccggctctgaaaaaggggcatcataaactgtaccgctacgatgggcagcatttcagcctggcgatgtccagcaaccgcccggtggaaattgtcgaagatccccgggtcgtcgggatctggaccaaaaacaaggagctggagctgtcggtgcccaaattcaagatcgatgagttctacgtgggcccggtgcctccgaagcaggtgacatttgccaagctgaatgataacatccgtgaaaacttcctgagggacatgtgcaagaagtatggggaggtggaggaggtggagattttgtacaaccccaagaccaagaagcacctgggcatcgccaaggtggtctttgccacggtccggggagccaaggatgccgttcagcacttgcacagcacttccgtcatgggcaacattatccacgtggagctggacaccaaaggggaaacccgaatgcggttctatgaactgttggtcactggccgatacaccccccagaccctcccagtgggcgagctggacgctgtctctccaatcgtgaatgagaccctgcaggactccagctactccagccgccagcccacaccctcatacctcttcagccaggaccctgcagtgaccttcaaggcccggcgccacgagagcaagttcacggacgcctacaaccgccgccacgaacatcattatgtacacaattctcccgcggtcactgcggtggccggggccacagccgctttccggggttcctcggacctcccgttcggagcagtcggcggcactgggggcagcagcggtcccccgttcaaggctcaaccacaggattcagccacatttgcccacactccaccacccgcccaagcaacccctgctcctggattcaa

SEQ ID NO: 268276 - DNA, 666 bp, Homo sapiens
  misc_feature (36)..(36): n is a, c, g, or t
  misc_feature (38)..(38): n is a, c, g, or t
  misc_feature (118)..(118): n is a, c, g, or t
atttgccctcgggccaagattcgccacgagggagangnactgcatctcgaggcgcggagagagcgaaggagttaattattccaaattattagcaaaaaatattcccaaattgtgggangggaagcaaatattcatccaccaatgaagaagctctataaattttacgtaagataacccaaatgacaaaaaatgtgacacagtttaaaaccacattgcttgaaataaaagaggctttagaaaacagaaagaaaaggaacagatttctcagcagaaggttttcagttcagaaggcacagggattgtattcaatggtgtgtggtttattgacagaggttctttttgagaaatgtgtccctgggcaatttcatcattgtgcaagcatcaagggtgaattttcacaaacctacaaggaataccctactacacacagggtatgtggattagcgcagggttcccagacaactaacctgtacagcgtgttactgcactgaacactgcaggaaatggaaacaccatgattttacagatgaagacttgcttggttgtgcaggctggagtgcagtgtcatctattaattttatagcataaatagtctgctaaaatagtcatatatgataatcttgagatattaaattgaaaaaaataactaatttgaaaatgaaccca

SEQ ID NO: 268277 - DNA, 389 bp, Homo sapiens
attatttgaattaattatcacttgtcttacatcaattttggatgtctgaaattctccagtcattttctatttcgtttgttaatttagttttaatcatggaagaatagtaggtaaaataaaagatccaaaaagttctcagttctgtaaacattaaaaataaagatagtttctatacatgaaactaaatttttttttttttttttttttgagacagccctgggtgacagagcaaaactctgtctcaaaaaaagaaagaaagtaagtaagtaacaattggtcaataagtattgaaacattgtttctcatacagtaagtgttccagagttatttaggttgcagtgagtggacatcgtgcccccctgggcgacagagcaaaactctatctcaaa

SEQ ID NO: 268278 - DNA, 222 bp, Homo sapiens
cagctagctgccgccataaatgtcacatgatgaggtgttgcaagttcatggtaaactgataaactgcctttgtgcctgttcctaactgataaactatctagcggcaaagttaactcccttaagcccctctcatctcacataaacccctcactttgtaagctcagggctacctcttctgattgctgtggaccagcccggtaggttaataaacttacttgcctg

SEQ ID NO: 268279 - DNA, 561 bp, Homo sapiens
ctggcaacagatggtgctggtctacttcacagcaattctgctccatcctggtgccctcataatcctcctatagggaacaagctcagctgtgtgtgctcccagctcaagttctctcttcagtgaatacaaccatgctcagcaattgctcccaggacatagacactatacccatcagaatagctgcatttggaggaacttttataatagcatcagttttgtgctagtccaaaccagctctcttccacaaattctggggactgggctttagtcttggttaccagtttggacacccatttcctcaagataatttttgaaatagactttattttttagagcagttttaagttcatagcaaaatcaagcagaaagtagagagttcccatctagtggtatacagaatagtttactgctcccagaatctttctatgtgctgcctattctttctccctccccactatctgctgatctttttatctctttatagttctgcctttcctagaatgttgtgaaattgcaattatacagtatttagcttttttcgactggctgccttcacttaac

SEQ ID NO: 268280 - DNA, 409 bp, Homo sapiens
ggtgaaggttgcagtgagcagagatcgcaccactgcactccagcctgggcaacagagtgagactcgtctcaaaagaaaaacaaattttggtacatccatccatgcaacagaatagtaacaactaccaatacacccatgactgaatctccaaaacattatgctgagtgaaagaagccagacatcaggagatgtccagcatgattccattcatatgaaactccagagcaagcaaaaccaacctatacagacaatgcagattagtggatgtctggggctggagagggaggtggaaattgactgggaagagagagaaggaatgctttggggtgatggaaatgtggccatccagtccaccagccggtgcactccagcctgggtgacaaagggagactctgtctcaaaaaaaaaa

SEQ ID NO: 268281 - DNA, 491 bp, Homo sapiens
gagaacagattctccctcatagcccttcgaaggatccaagcccatgataccttaattttggacttctactctccagagctgtgagaggatacatttcggttattttcagccacccagtttacggactttgttatggcagccttgggaagcaaatgcactcagtacatgttaatttgtatcttacctactttgtacttgcaaggtgtctctgggtctctggtgtacaccacggcctgcccttgagcatgctggggtgctcagcacgggggtagccctgcagcctgactctctgtagacagatcaggatcggtctaacatggaattatgaagtggagccagggtcagctttgggccacgcctgccttctgtgccggccttggattatgttcaaattcatctcatgctaccccagcagaaaagagtgtcttcaataaattcactcaaaaggaggtaccagtgaagaaattgtccctcccaagtgaatgagtcac

SEQ ID NO: 268282 - DNA, 273 bp, Homo sapiens
cacctctccatacctttccctttctgaagtgtcttttctctttctcttagccttttaagattatttcttgagatcccattaagtgttaacttctttcatggaacattttgtgactgtgtgttcatttatttgtttgaattatttcagcatctcaccaactctggtttgctccatgtgtgtgaaattgtgcactccaattgcatgtgaccttgtattttccatttgaaagctagtcttgtttccccaattaggtttcgtcttttcctaaaaaca

SEQ ID NO: 268283 - DNA, 530 bp, Homo sapiens
cttttttgtcaaagtcggctgtatcaggatttgtcatcttatgcatactgattaggtataacatgattgcttggtgggaacttggatttcttgcccccctgtcccactgacaaagaaccagtaaggagcctactgtggtgggggagtgggagaggacatgcagaagtggtggcagagtgggaactgccagctcctggtattgtttttgacactcagatgctctcctgattcaaagtggactgtgatccttttgtgtttgcgtggagcagggactacctggagcggggatggttttgactcatctttaaatgtttcaaattcctaagccttatattgctaagccttttagtcatggaagtgaagataaccagcctccctcagactgggcaccacatgttggattgattgattgattgattcatttaatcaaaatatctttattgagcacctatttgcatatccaacatgtgcacaatagagacaaagtccctgccctcgtgatctgatatgtctaatgggtgaagatagac

SEQ ID NO: 268284 - DNA, 293 bp, Homo sapiens
gaaaaactcctgtgaatatggcctctcctgaacatttctacaacatgaatggcagcttcccaatacagattccccatcctcttaagtgtgaaaacacaggaatcagcacaacattttctcaatctgattcatacaaatgtgtatttttcccctggtgtctggactgtcttgggttataccatgaatgcctacagaagtttcaaatactcactgaccctgctcatatagcctaaccaaagtgaactaatgctgacccaaataaagtgtagcaataaatttcaaactggattaaa

SEQ ID NO: 268285 - DNA, 838 bp, Homo sapiens
cttgtgaccatgaagagaaggacaccgatggacactgtgagacacagctcacatccaaagggaactatgctgaaaaacggaccctggtgccatccttcgagcttccctgataacgtctgccgttaagaagagcgacttctaggttcctgccatctacagcatggacaattccaactcatcctatggactgacagttacagcatggcttgtggccgcctgaccgcgcggagcatggtgcaccaggagcgaagccctgccgtgttggtcacaggacctgtagcagagacaagttcgttgaaaaggacgtgtagtcacagctttaatagtgcttgcttatgaatttgaaagtagagcaacaagtcgaatgaggtagcgttaggcaataggccccttggtttcattccaaagagtctatcaaaagcaagttatcttccagttctgggccagaccaagtagaggtcaaaagtccaaggccttatttgggttctgtattgggttttcagccaagaataaaaagctggccctttatgggcctcagaggcaatagccttttctctctgttcaccctatattcattctcagggcttagcacatcagcaagtttctaataagagctcagtaaatacatgctgaataaaataaatgctgaaaatgcttttatttaactgtagaatacgttatctagatttttaaaaattctgttataatagcttgtctaatccagtgtcttcaaagcagaaactttgaggcaaatcacaagactggatgcccaatgccaacattttaatggggagctcaataaagttctcaaaactcatcacctgagctacagaaaaaa

SEQ ID NO: 268286 - DNA, 420 bp, Homo sapiens
ggttcaatcttttcctttggaaaatctatacgtggtgttgtggcctttcaccatgagagacataatttccagctgtttctttttgtgatgttagcaaccattgatactaattgcttaggtttgttaatttattggggattgctaaatggtggtattctgtcattttttcttcattttatgctttattaatgctacaaagagacagttcccttcatttactagtgaagagacacttccctccacttactagtgggctacttagtggtacagtggaaaggcaggatcagtgtttgacccccgtctctactaaaaacacaaaaaattagccttgcgtggtgcgtgcgcctgtagtcccagctactccggaggctgaggcaggagaagcgcttgaacctgggaggcggaggttacagtgagcca

SEQ ID NO: 268287 - DNA, 684 bp, Homo sapiens
gaggcttaaagatgaacaaatagcctgctattatctgaaaagcatttctgaaaatattgctttgagcaggatgatagacttgttatagggaagattccattcattgaaagcttacttaaaaatatttccctagttatatttttatttttattaatagttttttaaatgacatttatttctgggttttcacacatgtgctttacatgttcttgttttcctttacaattgaacatacactctatcagccagaggccagtgagcatttgatgggggccaaaaaaaaaaaaaaaacgagttttggcatagctaatacttttcatctttgactcatccatattaagtttgagtcttgggcttattattaatttgagcactttcatttttttctattttccactcgttataaaattacaacaaattttttttttttttttgagacagactcaatttgttgcgcaggctggagggcggtggcataatcttggctcactgcaacctctgcttcccagtttcaagcgattctcatgcctcagctacttggtaggccgaggcaggagaatcgcttaaacccgtgaggtggaggttgcagtgagcagagatcacgcaactgcactccagcttgggcaacagagtgagacttaatcttgaaaaataaataaatgaaaaataaaattcttgtatttt

SEQ ID NO: 268288 - DNA, 402 bp, Homo sapiens
tgtgtccatctttggtgaaaatgtttggtcagattcaaaatggtgtgtcaccaaggcaaccagcacttatttattcaatacaaacttattgaggtcctgctctgtgtaaggttctatactgtctattctctgtgtgtgggagagtattcacattataccctcacaaatttgaagtctgatgataattattaccaagtattttgcacttcttgtgtaccagacactgtgctaagcatttcatggacaataacttttccttctcatagcagccctgttaagtaggtagcattccctttttacccacatgtgtcatgataaatacaaaaccctagttctgtcatggagcagctgctcatcttatccaggttctgaacccagctaagccccagtgcttgagaaggt

SEQ ID NO: 268289 - DNA, 963 bp, Homo sapiens
ttactcacatttacaggtttattgaaaaggatattacaaaggatgtgtagatgaataacagagggaagaggtgcacagggtgggtctgggaggaggggtgcagaccttccatgccttccccagctgttctgccctccaggaacctctgcacatccagctctccaaacccagtccttttgggtttttatggaagcttcattatgtaggcatgattgattaaatcgctggctattgatgatcaactcaaccttcagcctctctcttttcctggaggttgggggtaaggctgaaagtcccaactctctaatcctgccttggtcattccagtggccagcctccatcctgaggcgatctaggggtccccagatccagtcatctcatgaatacacaaaaatcactcttatgactctggaaatcccaagagctttagaagatttttttttgccaggattcaggatgatgaccaggatgatatagacttcacaacatcacagttgttgaggaccctgccaggctccagggagacttgtttccctgggtccgctgtgactccaggcaggactcaggtgggtggctctcggtggcagtgcccctgcttcatactttccttccctcccctatggagtccccatgaaagccagagagtggtggcagcttcaaagacagaggttatttgtggctgcctgttacagtgaacaatgtgagtgatgagtaaccatcgtgaagtcagacttgggtgggtttcacaaagctccttggatgagctgagctctgaggttcctcccagcaataaaacgctatctctacctgctgtttatgagctgtgggaccaaagacaacaagaagaaagtagctgtttgttgctgttaaaactcaaggaggtaacaatggaatcattgccttctgttttttttttatgttcagagccagtttctttggaaataaacactcatttttatcaga

SEQ ID NO: 268290 - DNA, 575 bp, Homo sapiens
aagcatacaaacctcatcaaataaaacggaggaacaagtccactctggcttctgagaactccaggaactcctggaagaaggtgcttcatctctgcagtgcttggaaccctggctgacaaggaaaacgagaatgctgagtgtaacaatgaccccaggaattcaagccaaggagcccaagaggggccagatggcgccttcattcctggtgccagaactgtggcgtttctctgaatcaagtggctttcattttcatggtctccagatggctgctgcatccccaggtgtcatggaggagggagtgaggctgaaaggcagagaatctaaaatattcctggaaatggagagtcctgacatgatggccccatgatgaaaagaacccaggttcctgagtcacgacgtggacatgaggcaccaaggagaaaacacgtgaaccttaataagtttggggtgagagagaaataaaccttaagtatgttaagcttctgtcatttcaaggtaatacagtgtggaaggcagaaaaatgacccactctcccctgatatccattaaagatgtccaaatcctcaaaaaaagaa

SEQ ID NO: 268291 - DNA, 610 bp, Homo sapiens
aagcatacaaacctcatcaaataaaacggaggaacaagtccactctggcttctgagaactccaggaactcctggaagaaggtgcttcatctctgcagtgcttggaaccctggctgacaaggaaaacgagaatgctgagtgtaacaatgaccccaggaattcaagccaaggagcccaagaggggccagatggcgccttcattcctggtgccagaactgtggcgtttctctgaatgtaagactttcacgcagactctaaaatattatcaccaagtggctttcattttcatggtctccagatggctgctgcatccccaggtgtcatggaggagggagtgaggctgaaaggcagagaatctaaaatattcctggaaatggagagtcctgacatgatggccccatgatgaaaagaacccaggttcctgagtcacgacgtggacatgaggcaccaaggagaaaacacgtgaaccttaataagtttggggtgagagagaaataaaccttaagtatgttaagcttctgtcatttcaaggtaatacagtgtggaaggcagaaaaatgacccactctcccctgatatccattaaagatgtccaaatcctcaaaaaaagaa

SEQ ID NO: 268292 - DNA, 654 bp, Homo sapiens
cagtgaagaaatatatatgagatactccagccaaaaatgcacacaagtcaaatcaaaatgaaaagactcagaaccatcatcaacaccaagatcaaaagggcaagaatccttcaagaaacaggaaaaaactgctaaaacaccgaaaggacctagttctgtagaagatgttagagcagaaatgcaagcaaatatagaaaaaggtgattcttttcccagagaggaagcaaagttcatcaattatgtgaagaattgcttctggatgactgaccaggaggctattcccgatctctggcagtggaggaagtctctttaagaaaatcatttaaacaatttgttaaaaattttccatcttatttcattcctgtaacaggtgatatctggctgtcctttttgtaatgcagagtgataaatttccctatcgtgtttgataaatgttgtccaggtttcattgccaagaatgtgttgtccaaaatgcctgtttagtttttaaagatggagcttcaccctttgcttggtcttaagtatgaatggaatgttatgacaggacatagtaatagcagtggtcagacatggaaatgatggggagacaaaaatatacatgtgaaataaaactcagtattttaataaagtagcacagtttctattgacttaata

SEQ ID NO: 268293 - DNA, 433 bp, Homo sapiens
aaatgtttccagatgaaaacttgaagatatgtaggaatgaagaagggaaaatatgcaagtgtggatcaataataatgataatgtcttctaggatataagaatatatatatataatcaaaactcgtgacaataatgtgtaagtttgaagggaggagtgaaggtttgaaatgttctgaagccttgcattgtccaggaaatggtaaagcactactttattttcaactataatgtgacaaggatacagtctgtagtaaaaaaacatagttaacaagacatagaggggaaaaaatggaataattttaaaataaagaaatcaagaaaggattttttaaaagtacagagaacagatgagataaatagaaaataggataacttcagcatgtctattattatgtgaaatgttaaagactaagcactacattaaaaaaaggaa

SEQ ID NO: 268294 - DNA, 580 bp, Homo sapiens
aggcatgcagtgtgtaataagcacatcagggtaaatggggtatccatttcctcaagcgtttatcctttgtgttacaatccaattatattcttttagttattttaaaatgtacagttattattgactttagctacttgttgtactatcaaatactagtttttattcattcttactatttatttgtacccattaaccatccccactcccccaccacctccccactatccttcccaacctctggtagccattcttctgttctctatctccatgattccaattgttttaattttcagctcccacaaatgagtgaggacatgcgatgtttgtctttctgtgcctggcttatttcacttaacataatgacctccagttccaactgtgttgttgcaaatgacaaaatctcttttttatggctgaatagtactccattgtgtatatgtatcatattttctttatccattcatctgttgatggattggctgttgtaatcttgaccctttaaaaaaaagtttatttctggcacttagatggtagagaagtaactgggaccttggaagaatatagcaatgggattctcaat

SEQ ID NO: 268295 - DNA, 382 bp, Homo sapiens
tagaaacttgaggagttatctttacctgccccttcctgttactcacttatataattagtttctaagtttccatcttcccagggacccttgaatttttcctttcctctgtattttcccaatacatccaagtgcaggtccttattatttctcacctagattattacagctgtttcctacctactctgattccctcaacccctaaaccccttgccagttctaacatgtgttttccctactttcatcctacttgctgccaccatagtattcatcttcaaccacaaatgaccatgccagtgccctactgaaaatccttcagtgattttccattaacacaacatgcactgttttcctcctttccctccccctcagttataagccatct

SEQ ID NO: 268296 - DNA, 377 bp, Homo sapiens
aggcgagccctccatttatcaaggcgcctaacagttagaaatggtgtcaggctatctataactctgctaggatgtgagagaaaatagcaaatgacttaaagtactaaatggaactatgagggctctgtgtggtggctcatacctataatcccagcactttgggaggctgaggtgggcagatcacttgaggccaggagttcaagaccagcctggacaacatggcgaaacaccatctctatgaaaaatacaaaaattagctggatgtgatggtgcatgcctgtaatcccagctacccaggaggctgaggcacaagaatcacttgagcctgtgaggcggaggttgcagtgagcagagatggcgccactgcactccagcct

SEQ ID NO: 268297 - DNA, 443 bp, Homo sapiens
gacacggggcggggtttggggccccctaacgtccccctggggtcaaaggtgacagaaaaggcagaagctggggctttctggaggatttaaccacagaggggtgggcttcacaggaggtggctgccacggcggggccgggtgcccgtgccccatcctgaggccgtgcatacgcgggtgccccttcgcctccctcccctccgccagagctgcctgtggccagacacacggtggagggaagtgcacgcgaaacagacacagcggcttcaaatagatgccgcccctgcccgcgctttgcagctagtccctgcaaaccttgatgatggggctgggcgcggtggctcacgcctggaatctcagcgaggccaaggagagtggatcacctgaggtcgggagttccagaccagcctggccaacatggtgaaactccatctctcctaaaaaaa

SEQ ID NO: 268298 - DNA, 477 bp, Homo sapiens
cctgttgtccacctcctcaatatctaggtgggacccctacaatatcttgattttttaatgttgacaattgtggtcagctgaaaaatccccccccccccacccccaccgccctaaaagaaaaacagcccgtgaaggtgaccttatttggaaatagagtctctgcagatatgatcaagttgaaggtctcaagatgagatctttcaggactagtcataggcccgaaatccaatgggaagtgtccatatgtaagagggagatggagggaggttacactaagatgaagtgaagatggaggtggagacgggagtgatgtgggcgtgagccaaggaactggaggctggaagaggcagtgagggctcgtcccctaattccccggagggagctcagccttgccgaccccttgatttcggcccagggatactgatctcagacttttggcctccaggactgggagagcataaatgtctttcttttaag

SEQ ID NO: 268299 - DNA, 610 bp, Homo sapiens
tcagatgggaaagaagtcttttaattggatgttgtagtgatgtctgttttgaacagaactcaaaacattttgtctttaaaatatactggctcttggtgaaaagagtaatttcaaaataaggctttaaaaggaagcaaaagttttaaacaaaaggcaacataatttaccaggcaggttaataacttacattatttgtcatgagattagttttttaaaaggtaatttacaaaagtgtaaagcactcaagtccataggaggcacttgatacatgtagatccactcaacatacacctattttagtattaacagataaagatacttaaaaactgccaaagtgaaattaataaatgtttaaatatgtacctagaaatattaaaaaatggtaagctttccaatgatgttacactgtagtcttttaaatggtttagtcacaaacagaaaagtgtatttgtgatgtttagacaataatagctaatcgtgaggatcagtgaaattgtttacttttatacaccactgtggagttggtaccaccattctacaaagcagtttgactgtatcaagaatgtttgtttttaccctttgacccagtaattgtattaaagttgattct

SEQ ID NO: 268300 - DNA, 544 bp, Homo sapiens
ccagatcagcctgtgagaatgagggctccataagggtggctgccgttctacccccacccaaaccagagtaagccatccctggtttgggtgggggcagaacggcaactaccctcagggaagcttcaatcttcatggctcttagtaggtgctcaataaatatttgttgaatctgcaatatctactcagtttgcacactgtgtagtcagtagcagacacctattcatctctgcaacctacttctaccattttctcttcatccagaacctcaaaagtcacacaactgtagagccaaaagagacctatgagagcatatgaggaacagagaagtcctaagcactttgatgtatttaggcatttcactgtggcacctttccaatcttgaaataagtatctgttttcttctgataaatgataaatatctgggccccttttgattggtgggggttttagtgatatgcagtgttagaaacactcatggctagactcaactggcaaggccaggcagatgaggcagctcagccaatcagtggtgtatcagtagtta

SEQ ID NO: 268301 - DNA, 605 bp, Homo sapiens
cccatgactagattctaagctgaaggacagggcagatcagactcacctctttaatctttaaatttgttgaaagaggaacgttctctcaaatatagtatctaaattaatcctttcacggccattgaaaggattcagccatttctaggaccattctcattttctagatgaggaagcacggattcagagaagcaaatgacctattcactatcaaaataataaaacacaggtcttttgacttcaaattctgttttaagttatctcttttttttctatatagctattataattaccacaagaattacagaaattctgtaagtcccccagtataaaagatgaggaaataaaagtcttatatcattttagtactgtgaaagttttatgctttagagccaaatgatgtttttatttattgattgatcttttcacattggtttagtctgttctcaccctgctattaaagatatacccaagactgggtaacttatagaggaaagaggtttaacggactcacagttccacatggttggggaggcctcacaatcatggcagaaggcaaaggaggagcaaagtcacattttacatggcggcaggcaacagagcatgtg

SEQ ID NO: 268302 - DNA, 315 bp, Homo sapiens
cagtcccaattacaaaagagttaaaaggaataaaatacttaggagtcaatttaaccaaggaagtgaaatatctgtatactgaaaaccataaaacattgatgaaaataaaaggtgtcacaaataaatggaaagataccccatgtttgtgaattgaaagaattaatattgttaaaatgtccatactacccaaagcattctatagattcaatgtaataactatcaaaattccaatgtcattcttcacagaaatagaaaaaaaaatcctaaaatttgtatggaactacaaaaaatcctgaataactaaagtaactttta

SEQ ID NO: 268303 - DNA, 383 bp, Homo sapiens
  misc_feature (64)..(65): n is a, c, g, or t
ttctgcagtccctcgtccagccacccccaggtactgaagaaggagaaaaagggccgggcatggnntgtcacgccggtaatcccagcactttgggaggctgaggcgggcgaatcaccaggctggtcttgaactcctgacctcatgagtcgcctacctccgcctcccaaagtgctgagattacaggcgtgagccatcgcgcccagcccataaacatttttaaacatacagaaaggctagaacaccatatactaaactagattctacaattaacattatttgttctatttttaaagtgttcccaagtttatttactcgtagctgtgtatttagtaaatgtttattgatgtgatcatatctgaggtataataattataaaaaagaaa

SEQ ID NO: 268304 - DNA, 335 bp, Homo sapiens
gtgctttgtataccctagcaagatgaaaatcttagctgcagcatcaggaagaggacacctcactttatcctacattcctatctcagtcaggaaagtagctctagagaaggaactaagaagtcaaggccttttgtgaagttgctctgttatctctgtggccccaaagaccaaaatgatggagaaaatgaaaccaggatgatttctgacatctgcttccactccaccttctttaaccacttcatccacatctctcttagcttctcacataagtctcacctggaatcatcttatttacaccaataaatttacctaccacctgcctgttgattgccaaa

SEQ ID NO: 268305 - DNA, 1146 bp, Homo sapiens
cacaatgcaattaactagaaatataatgtaatgactataaaacctcaaatttttggaaattaagaaacatacctctaaaaccatgagttgaagaaaaaatgacaacagaaatcagaaaaattttgacctgaacaataattaaaatactatatatcaaaacttgtaggatgtagttaaatgagtactttgaggaaaatttgctgtgaggtatgtattacaaacaaaaaaaaaatccttaaaattattgagctaaatattcatcactagaaattgggatatattcaccctagggaagctgactgaaaaaaggaaaaaaaagagttaaaaaaaaacaaagaaaaaatagatgttaggatataggcggaaggagattaaaaaaaggggttggttaatgggtacaaaatacagttagaaggaataagatctggtgttcagtagcacaatacagtgactatagttaataatttattttatatttcaaaataacaaagagtgaaattggaatgtttctaacacaaagaactgataatgcttgaggtaacagataacccaactatcctgatttgatcattatatattgaatacttgtatcaaaatatcacacataccccataaatgtgtataacaattatttatccataaaaattaaaaataaaagaattgtaataagtcagcatatagtaatcacttatcagccttttggctaagatcaagtatagacattatagtaaagataaaagcaaaaataataaagaggaaataaatttttaaaagggtcaatcaagataaaggttgaattttttaaaagattaataaaattgaaaactgtggagttcaatcgagagtaaaaaaaagaagctacaatccactaattttgagaattaaaatgaggatagcattacagctatgtcagatgtcaaaaagagaacaactttattcaatacatttgaaaaggcagatctaatgaacgaattcctctaaaaacatagcttgccaaaactaacaagaaaatagaataccttgttaatcctattcatttaaagacattaaataaataatccaaagcctttcacaaaaaaactcttggcccacatggcttcacctatgaattctactcaacattcaaggaagaaaaaagtctctttt

SEQ ID NO: 268306 - DNA, 211 bp, Homo sapiens
cacaatgcaattaactagaaatataatgtaatgactataaaacctcaaatttttggaaattaagaaacatacctctaaaaccatgagttgaagaaaaaatgacaacagaaatcagaaaaattttgacctgaacaataattaaaatactatatatcaaaacttgtaggatgtagttaaatgagtactggagtatcgtgagggggacctctag

SEQ ID NO: 268307 - DNA, 287 bp, Homo sapiens
taaaatgtattcatttatcactattagagcacccgtaaagttacctccctttccatgcctgaaagatgtcagcaatgctaacttacagaaatcaaatattcactgatttcattactggactttcggctaagaccaagtgaaatattcatggatttcaatcatattaatagctaacattggctggcatggtggcccacacctgtaatcccagcactttgggagacagagttgggcagattgcttgagcccaggagtttaagaccagcctggacaacatggtgaaactc

SEQ ID NO: 268308 - DNA, 215 bp, Homo sapiens
ccttccaagatgcctgggtccagcttgtgggagggactgtgaatcctgaggacagcaccagctgagcttcggatccttctcaatggtgccttttcagttctgcagggccctcctctcctctgagaatatgggttctctgacatccagactgaagtgcagtgagccgagattgcatcactgcactccagcctgggcagaagagtgaaactccatct

SEQ ID NO: 268309 - DNA, 513 bp, Homo sapiens
acaggctaagtccttcccctccctcaggaattcccagaaggctccggtcatcagcagttaaggagacacacttcatattctgattggtgatatggacccagaggaagggcagcaggcactgtggtctgcaaggcttcggaggcagtggctggttcggaccgcatgcaaattctgatgcccttctaataatctaatacccagatgtggatccaagatgcccattaatatctatgcctgctttttagtggtagggggcttgaaaaacaaaagcctctatctggtccagggtgaattcctctagcgggcagaggcagagccaaactgcatcttggagggcgcctgaattttctcatgattgatggcacatccctttcagtcaaaaaaatcaagggaagacagagcttcaagcacagttgtttctgaattacccctaattaatttgtcatcgttgtacagaataacttcagtatctgaattaggccacctattaaaatcctgctttatcagattatg

SEQ ID NO: 268310 - DNA, 396 bp, Homo sapiens
agaagagataggatcaaaaaattcaccaacagaaggatggaagcctgttattctctgcctcaaaaaagaaaacttcaaagctcaagtgcctgttctaagggtttagagatgaaaatggtacttggttagccactgatgattacaaaatttttatgtataaaaaacctggaggcagcaatagtgttggaaggaagcctaaagttggattcacacagcactttacctaagtttgagaaagtcagctgtttctctcaaagaataaggggtgatggagattactggtattggagtaagggtgggtaaagctatcctagtctctttttttttttggtgtgccaacaaggatactcttccctgaagcagattcacatgtctcactaaaatgtccataaaacc

SEQ ID NO: 268311 - DNA, 375 bp, Homo sapiens
ctcataccagatggatttagcagagtgatttaattcttcccatgctgctggctgtagaaagatcttgagtcactttaccgagcgtatgttcttgctaagcttccttgtaataacttatcttcatgagcttgctcagctgggtgggtcaggagggagctgtgtggcaccatctgtttgcatatcataccactgattttgaggccagattataaagaccagaaaggacttgtgtgtatctgcaaagaacctggggccactgtcactttaacccaaactgtaaattggttactggggtaaatgaagagaaatcaatgcattcattttgaccttgatccatgtttcacatacaaaatgtaatcattcccacttcctcat

SEQ ID NO: 268312 - DNA, 465 bp, Homo sapiens
gtacttcaaacgtccccgacctgtgaaatatagtttgagccttcagaaacccaggctacaaaccttaatgctgtcctgaccaaacccaaccctctgctgaacaatttctccttgggttagaagaggaaaatgatccctgattcccatgcatacatgcaggattaaaagagataatgtctgggaagaggacttggattcttatttatttatttttttgagacagagtcttgttctgttgcccaggctggagtgcaatggcgtcatctcggctcactgcaacctccagaaacccagtctctactaataatacaaaaatgagctgagtgtggtggtgggcacctgtaatacaagctacttgggaggctggggcatgagaatcgcttgaacccaggaggcggaggttacagtgagccaagatcatgccactgcattctagcctgggtgacagagcgagactctgtctca

SEQ ID NO: 268313 - DNA, 536 bp, Homo sapiens
tgtaatttataattgaatttatccacagagaaacaagtggtcacagtaaacgaaagtatcttctagggagcaaatttacaggtgtagcttttacaactaccagtggcttagctccaagaaaattcaaattccaaagtgataactttccacaaaaacgtaacttcagagttgagtatttgtattaataaaattctcaccaagtagcatttttgtagctcaatcccccactagtttaatatatactcaagttaggggaaataggcctaatgtgtaaagaaggtggccctaaacagagtttccatcatctcctcctagataatctttaaataacaatggttggatgttgtgtgttttgtatacgaatcaagaaaggtaaaacctacaaactatattcatcttacattaattgattacaaagaaaatactgagaggtaaacattaagaatgtcttaaagggaaacaaattaatatcaacattttatgcagcaaagctcatatgaacagtcataaatgacattgctaaatttaaacattgc

SEQ ID NO: 268314 - DNA, 627 bp, Homo sapiens
gttcaatatatgcaaattgattatcttgatataccacattaacagaatggagcataaatattttgtgatcatctctataggtgcagaaaaaacatttgataaaatttaacagtattttgtgtaaaaactcttaagaaactaggaatagaagaaaattatctcaacataataaaagtaatgtatgaaaaactcagtgaacatcactcaatggtaaaacacaaagtttttcctctaagatcagcaacaaagcaaggatgctcactctcaccacttctgttcagtgtagtactagccagagcatttaggcaagaaaaaaaaataaaaggcatataaatataaaaggaagaagtaaaatgatctctgcagataacatgatcttatttatagaaaactctaatgatttcacaaaaaaacctgttagaataaaatttagtaaagttgcatgacacaaaatcaacataccataataaatttcgtttatatatgagcaacattgaaccatctgaaaaagaaattaacaatctcatttacaatagcatcaaaaagaatactttgaaataaatttaaagaggtaaaaaacatataataaaaactacaaaatattgatgagagaaattaaagaagaca

SEQ ID NO: 268315 - DNA, 423 bp, Homo sapiens
caattttcttcattttaaatgagcattcataaagcatttattaaactgtttagggaggtaaacaaaaaaacatagcacatacaattatatatagtacataataatcatcatcaacagttatatcactgttttatggtatttatactttttattgttattttggagtcaactccttctactgattaaaaaaaaccatctaaattaactgtaagacagactcaggaatttccatcaggaggtattctagaggaaggcactgttataggagataatgctccatgcacgttattgccccctgaagaccttccaatgggacaagatgtggaggtggaagacagtgatattgacgatcctgaccctgcgtaggcctaggctaatttgtatgtttatgttctagtttttaactaagaaaatttaaaagta

SEQ ID NO: 268316 - DNA, 914 bp, Homo sapiens
caaaagcacaagtcaggcatattggacctctccactatggcagagtctgggttactagcttgtggcgtgcctaagaatttaaactcacctattctgcttaagtagctggtccactttagtgggctggaagcatctggccagttgcctgtggctaccatttgtatcactgaaagcgggatgtgctatgctggccgacttgggccaattaggaattttatttaaagcttgatgtaattaattatataaatttgacctgttaaatttgaggaagggttgtttcaaaacactcaatttgtacattaaaaataatgaggccaggcacggtggctcacacctgtaatcccaacacttgggaagctgaggtgggcagatcacttgaggccaggaatctgagaccatttggacaacatagtgaaacccgatctctactaaaaatacaaaaaattagctgggcatggtggtgggcatctgtaatcccagctacttgggaggctaaggcaggagaatcacttgaacttgggaggcggaggtttgtagtaagctgagatcacaccactgcattccagcctgggagatagagactgtcttaaaaagaaagaaaaaaaaaaaaagtctccctactatacccttagatatatgcccttccatagataaacatggttaacaatttcttatgtaaacttccagaaacttcctatgcatattaaagcatatctatattaaaatatgtatcttgtctatcctttaacaaaatagaaatgggggccgttctacatatacatactgttttataccctgctttttggatttactgtcttacagccatctttgtatgctagcacatgtagatgttcttcattctttttaaaaacaatgttgagtaatgttacagctcttttagaatttgtctagca

SEQ ID NO: 268317 - DNA, 165 bp, Homo sapiens
caagggaggccttccatcatggaaggaagaagcagcctggcacatgcatctagctggaaaagtttctgtaagtcttgattggttgttgcttggctggatgatactgatggcaaaagtaacattccaaagcagtaaatataagactctgaataaggcttggcgctg

SEQ ID NO: 268318 - DNA, 308 bp, Homo sapiens
catattcttgaatgcaaacccattttccctatggactttgatataaactgagaagcactggctgccccaaggaaagaatgcagcgatgaaggcaccattcctaaagtccgtcagtcatctcttcctggaacagataactactaagggccaacgatggtgcccagctctaggctggaccctggtggcttagatacctgctcttgtggagcttatgttctagtgaagggaaagatacaaaaagcaacaacaaaattcccagtgttctaggcagagaattattaataaaagactgtgatatgtaaacataa

SEQ ID NO: 268319 - DNA, 2326 bp, Homo sapiens
  misc_feature (448)..(448): n is a, c, g, or t
  misc_feature (1203)..(1203): n is a, c, g, or t
  misc_feature (1243)..(1243): n is a, c, g, or t
  misc_feature (1283)..(1283): n is a, c, g, or t
  misc_feature (1322)..(1322): n is a, c, g, or t
  misc_feature (1363)..(1363): n is a, c, g, or t
  misc_feature (1617)..(1617): n is a, c, g, or t
  misc_feature (1809)..(1809): n is a, c, g, or t
  misc_feature (2007)..(2007): n is a, c, g, or t
gcggccctccacagcagccgaacaccttgtagttgtcaccgtggacgcgggctgcagggaggcccggacgcccatcccaggtttcggcctcaccctcaggctgatgcagcgtgcccagcggggagcagcaggacgggatctccttgctggcgtgcctgcatccagctgtttactgcacgttaatcctgaatctggggggccatctgtttgaaagatgctattccaaggtggcccccttgtgtggcggcccagggatggtgactcaaggctttggttcgggcagatctgaaggacctatcggttattttgtctacacagagggaaggttacaataagctgatgtcattgtgacggccattggtctgttcccgtccgaaagaattcattttcagcagtggggggtatctgttagttctttgtttatcttgcagctgaattctcagccagntccatggaattttgagtcaccaacttgtgtgcaataatccagaggattaaagaattctttttttcttcttgatacaaaaaggtattttttttaaattcacagaggagaaacataatttaatttttgaatattttctttaacattttcaaatacatgtgaaagagagagggcttggctggcttcaacaattgaaacaaatgcagcatctctcatattaaaagtgttacataaaatgtaagcacaatactacaaatgctaatgtaatttattctaattgaggaattactctgattcactataactgtgtataactatatataaattaatggtatttttaaaagagtgtggtaaaaagatatataaataggaaacactagaaatgataatatgatatttatttaatgactatttgatgtgtcggaacattttgattctgaataaatatgagtttagtgtatcagtaatatataaatatagcatcatcaaatatagcaaaactaatataattcaaatataatatataattatattatatacaattatatattttatatataatatataattatattatatacaattatatattttatatataatatataattatattatatacaattatatattttatatataatatataattatattatatacaattatatattttatatataatatataattatattatatacaattatatattttatatataatatataattatattatatacaattatatatttnattataatatataattatattatatacaattatatatttnattataatatataattatattatatacaattatatatttnattataatatataattatattatatacaattatatattntatatataatatataattatattatatacaattatatattntatatataatatataattatattatatacaattatatattttatatataatatataattatattatatacaattatatattttatatataatatataattataaatgtatattataagaaataattatatatcattatatggtatataatataataattatataataacataattataattcaaatatagttcaaattaaatatagtcaaattaatactttgataacaaactaattaaaaataaaaacaagtcncagaggcttaaaatacaaaagaatatttctctgccacgtttggtgagcagaatcaattactaccttaatagcattatatttattaataaagagcctaaataattttctttcattttagaattactattgcatttcaactttcttattcagaaacaataaattagcatggcagagatggctaattgcctcctngtttgggggcattggtctggacattctccattttcttaataacaagaccccaattttattaacatttatttattaagggctaagcatgactgtgtgctcagctacatttcctgcctctcttgcagttcacagtggccacatgatacagttctggtcaagtgagacttctgggaaagcctttacaagtgaacagatttntctagattgtcccttttgccctttgccatagtctttctttgagccaggaatgtggatgtgatggcttgagtgccagtagccatcttgcacacatgacacaaaagctcacaccctgtggactatggatggctacaaaatccctagaaaggagatttagaatgaactagagtccctaataacatctattgcttattttcttgttagtgagacatgaacatgtatcttctatgaacaactgttatggaattttctgttaaatacagccaaacgcaatttccacatgatacaattaagacaaggaataaactactaagatgat

SEQ ID NO: 268320 - DNA, 307 bp, Homo sapiens
ctcagaggcatcggctgggtagctaccacggtcaccaagcaaacatgaagtgaggagcgtctgaggagctggtgggggagacccaaggcaaaaagtttcatgtgcggctcctccacttcccgcaggcagcatccccataagtccatcctaagtggaaaatgcttcgaatacaccgaaactgccaagcgtcatggctcagcctcgcctgcctccagtgggttcagaacacatgcattagcctacagtgggacaaaatcatcttacacaagcctgttttataataaagggttgagcacctcacgtcact

SEQ ID NO: 268321 - DNA, 447 bp, Homo sapiens
ttcagagttgtagaataagtcatagaatcagataaactgcaagagtgtcctatagacaatgtgcttctactgtagcacaatttttttttctgcaatactagattttggataatttaacatatagtttaaagacaactgtgatactttggaaataaaatgaactctgctgtcaaatggaagctagtattgccttcatttgtatcctttttcaatatttgttcaaatcttgttttttgccatctagtatctgcatggagtcatcagtcacctaccgcttctgtggctcagtttcctcctttgtaaaacaaataatataaatgcatgtaatgcaagccctttaggaggaggagcaagggactacatggcacaacatatggaaaataccctaaatgaatattataaaagtatgctacatcattcttacaataaatatttcagttagatatt

SEQ ID NO: 268322 - DNA, 477 bp, Homo sapiens
agcaacacagcccccgaatcagacatcctagaccaggagagagaagacgacttcttcatggcattccacaccctaccgcggagaagcagcccgcaccccttcgcccagaacggaggggaggacggcggcggaggcctgcagggaggcgtgggtgcgcttaagcggagctcgtccatgttcatcccgcagctcttgaccagcatcgacgcccgccccacgtgcagctcctccgtgcagatctccctgcagcgcaaggccacggacggggccacggacgggtgcgggccgcccgagggcgccgacgatgggcctccatgcgcaacgcccgaccccagggaccaggcctccgccactgccaccacgagggcctcgccccagagtggctcccgggagccctcgccgagggacacccccgggagctcccctccgagggcagcccgggacccagggctccaggtcaacggcacgtgcggccgc

SEQ ID NO: 268323 - DNA, 248 bp, Homo sapiens
gaaaggcctggtgcagagccccaattcctacttcatggatgtgaaatgcccaggatgctataaaatcaccacggtctttagccatgcacaaacggtagtttggtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttggatt

SEQ ID NO: 268324 - DNA, 386 bp, Homo sapiens
taacaatagcaacacaaaatccaactctagctcaactcttgactaacctgactctacctccctaatatggtttggctttgtgtccccacccaaatgtcatcttgaattgtaatccccgtgtgtcaagggagggaactggtgggaagtgattggatcatgggggtgatctcccccatgctgttgtcatgatagtgagttctcacgagatctgatggtttaaatgtgtggcatttcctctctctctccctctctccctccctcccctcctgctttgtcgtggtaagatgtgtttgtttccccactttgcttttcgccatgattgtaagtttcccaagacctccctcgccatgcagaactgtgagtcaattaaacctctctccttataa

SEQ ID NO: 268325 - DNA, 421 bp, Homo sapiens
ggctttggggcaagaaaaaatggcagccctaaggcctgaagggatcaatatctctacatgtgtaacccattctcagcgtaagatggaaacctctggactctaaaccaagaagtgcatgtctttcccactgccacaattaccagttcagcgtgggcctatgatcaagcctggccaaggaaactgacaagaagaacttagaccccatcgtatcttcgtctgtcttactagatgagaagaaggacgaccattgccctaattgacaccaaccttaggatgacactaactctgtggatggtagaaaatgtcatctaaggaacctggctctgacaaaactgcagagctgctgcatcagccaaccctgaagcctaccctattctagattccctgttaaggagataataaatgtcttcattgcttaagc

SEQ ID NO: 268326 - DNA, 809 bp, Homo sapiens
cagtgcaggaaagtctgtccagtgcaggaaagggcaggcagagagctggctcccagccccaaatgcatgtctccctccctggggcccaggctggcacagaagtcaggcctgccagtgggaaacttgggggaaacttggtgccctggtccagcagcctgccctgcagcagcaagcatggcctctggaggctgtcgtcctcctggcctccaggattgcttttcctttcttcctagaactccagcccttaagaaaatcagaagccctggcaggcacattgcctctgtgctgtgcttttacccagcgaagcatcagggcagacagccaatttcaacactgctcttggctgggaagtgccctcatctctggcagcccccacagagaaagtgcagggccccggggctgtggctgcctcagggcaggtctcccttgtgacagcctcttgtcatgggcctgggagtggacccctcccatccctgccgtgcatcctgttgagtagacagctcaggctagtacccaagagggtggccagcagatcacaggggatgtcccttttgtcttagctgtttatgggctggaggaaccactgttcagccacatctcctctcctgcccctcctgcattcacccgaggttgatgggagctctgtggggggagacaggcaggggaggggccaggcaacacctgggcatatccccagggtgcctcctctgatccccaggaggggcagcacccaccctcttctttttccaatttgtttttattgtggttaaatatacataacgtaaaatttaccatcttaattatcttta

SEQ ID NO: 268327 - DNA, 394 bp, Homo sapiens
cattaaacagcacacttgataaagccttcaattgtatataatactgttatttcctttgcacaatagtatgtcctaacaaacttgaattataacgggcttatttattttctctaaaaatctccttaagtcacattgtgcatcctcacattgaatggtctctttaatccttcacaccctgaaaaactgcctgtcttagctcacaaaagtaacacggcaaaaagtaccatatgtaatccagttggagtgagggaatattaccacagcaagtgttagaattataacaatttgatttcttatgcccacggacttgttagattctgggcaaattgtcaggaaatttttgttactttaacatgctgtagcatactttttgaaaatagaaaccaaatcaaaa

SEQ ID NO: 268328 - DNA, 440 bp, Homo sapiens
gataaccagtttggagtctactgtagcaattctggtaacagatgatgacgtcggccagtaacagcagaagtgaaaatatgtggtagattatgggtatattgtgagggtaaatctatttgaacttttttatggtgtgagaaggaaagaagaagcatggacgactctaagaaaacttgatttgatatgagctaaaagggggaagaaaagtaaaaagcagatacagatattttgcccttttggaaactgaagataaaacagaaaaagaaaagaattttaagatatgttaatctagcaaaactaacataagaatggccaccgtgaatttcatgaaattttgccacagagcaatactaaaaactgaatgattatgcctttttccatattttaattaaaactgaaatgaaaatactcactgttggaaagtaaagaaattaagccat

SEQ ID NO: 268329 - DNA, 420 bp, Homo sapiens
tagacatgagataaatcaaaagaagtttgacaaaagagttttatgcaaagcagatgtggataaggaagaggaaggagataaagttgaagatgaacaggaaaaagaagacagaggaaagaaggaagacgggagtgaaggaggaggagaaggcctggcatagaagcactgtcattcctggccccagggcctgaagctcatgactaatctagagaaaggtggagcctcaaagttgaaaaactgtgcttatgtaggctatgtgacacttgttatgtgcagcttatttcaatagactgtagtatgttcgatgttgataggtgctatggagtaaatttttcttttaaattggcatgtgaagagcagctgagggaaagtttactattttaaattgtgttaaactttgttatctgttaccacgttttt

SEQ ID NO: 268330 - DNA, 352 bp, Homo sapiens
tctagtaatattatacaaaatagaacaaatgtgtttttacttgtgtagttaacattataatgctggaatgaatgtccccaaaggcaaattattaagatagatgataaaagccagagttataggcaaaagttgctatttcaacagcctttgcgcttttggtgagtttggtaattgaagggtaataaaaaaacaatacctgtatacttgatcttgcatgaggcaggaagcttgaactgtgttccatcctatgtaaaattatccaattctcaatcccataggaaaagatagacttaaaaaaattacctgttcacagacaaaagagcaaggaatgtttgtgccatccttaattcta

SEQ ID NO: 268331 - DNA, 424 bp, Homo sapiens
gacaaaaggaaagggatatatgtctggatgagtccattatgttaccagataacatgcatgtggactaagcgctgacaatgcacttacgattatataaatcaagatattctacacgactctaaaagaaaagtagaatatagaattggaccacacaggtatataactcacgttaaacaaaacaaagcaaagcaaaaacttattctgtcaaaatcaggtgttgtaaagctatagtccatgggccaaatctggtgtacttactgttttcataactaaagtttaattaattaattaatttttggagacaggttctcgctttatcccccaagctggagtatagtggcacaatcttggcgcactgcaacctctgcctcccaggttcaagtgattcttctgcctcagcctccccgtagctggggttacaggc

SEQ ID NO: 268332 - DNA, 623 bp, Homo sapiens
cactgtggctgagctacttattcaataaatatttattaagtgctgctctgtgcctggcagtgagctggccctggggaaacactgacagacagagctgccttaaagacttagtttctgacctcccagagtctgcagcagcagcacaccgagatctagccaggatccaccccaggctcctaacctgcatcctgggccctctccacttcaggtccctgtagtttgggcctgtggcttaggtctagactgttgcagcccgtgagcccttatcctggagcatcttggtataaagcaagccaaggcataagtctctgcaaaccgaacttcaaaagtaacaaaagaggctgggcatggtggctcacgcatgtaatcccagcactttgagaggctgaggcgggcggatcacctgaggtcaggagttcgagaccagcctggccaacatggcaaaacccaatctctactaaaaatacaaaaattagccgagcgtggtggaacatgcctgtaatcccagctactcaggaggctgaggcgggagaattgcttgaacccgggaggtggaggttgcagtgagccgagatcgcgccattgcactccagcctgggcaacagagacaagactctgtctca

SEQ ID NO: 268333 - DNA, 443 bp, Homo sapiens
attttattagaagtgagtaagggcagtgtagaaaatacagtgctgcagatatttgagtgtgaatgaaggcctgaatgcttcattctttatttggttcaatttcccactggaagtctgcctcctatttcttgactctttcagccacgaagttaacataagccctataaatgttaaaaagtaaaatgtcacacaaggccgaagtccagcttctattctgaaggtccacagggaaagttacagaagaaaacaaacctttctatgggaaggcaaaagcaatttaaggctcagctcaaaactgaagagggctggagcctgggaatattctagaagctgaaagtcctagaacttgtaggcaactgcttatcctttcaatttcttcatctgtctgcccgggaaactaaaatggagcactttggaaattaaatgatgaagataacatagaa

SEQ ID NO: 268334 - DNA, 513 bp, Homo sapiens
aatttcctaaaggactgtgttatctgagatagccttggctaaactttagtccctttaggtttcattcactaattcaactaatattttttgggtactgagttgagacaggcacatacagcttctaaactggtggtggataaaacaaatgagattgtgtccactctcctgaagttgcaatgtttgcttcctcaatctgtccatgtttcttttctattgttttcatgtttttatttatttcaaaaaattttaaatagattttattgatgtataatttatagtaaaatttgaatctttaagtgtacagttctatttattttgataattatataagcccatgtaaacaaaatcacaatcaagatattaaatgtcataacccctcatacctgtttgtagtcaagcacaccaacaacctggcattcttgcaactactgatatactttatgtcacttaagcttaaacttgtattttctatgattttattaagatggaaataaacatatctacttggtattg

SEQ ID NO: 268335 - DNA, 444 bp, Homo sapiens
gacagcatgaaccaagggctggcacttaaaacttttactcagaagtcctgcatgccacttccactcacaagccacacagtcacacctaagttcaacgaggcagggatgtataatcctcccacaggaaagagcactgagagggagaagcaccaacctatttcgtgaaaaataatacaatataccactacatatcactggactcagttcactaatattttattttgaatatttgcatcaaccttcataagggagacaggtctatagtttctcgtttcataaaaataatttggaagtgaaaaattactttgtcattaagactgcaaggtgactgatgtggtagctcaagttaaaagataagtgttaaaagataagtgttacatgttttaggtgtatagtagggggtctaatttctgccttggcggcttattatttaataataaaagg

SEQ ID NO: 268336 - DNA, 450 bp, Homo sapiens
tattcattccctgcacttcatcccacatcctgggctcactgcccacacggccaagggattctggctgagacttcagcaggcccatggggcagaaggctcctcctgacccagcagatgggtgggtggggagatggtgaaggctatgtgttccccacccttcccaggtccccagtgcctctctgtcacccctgcttccacatctgcccactgggcttggaaacccaggctctgtattctgagaccctaaggccttctgggagcccatcaaaggctgctttaggggaggggtgctaccgagctttactgtcctgctaaaagccctcataggattttatttaaacagagtgtttcttgactaatagcgatttttttttttgaggcagagtctcattctgtttgttgtctaggctgaagtgcagtggcatgatctgagctcactgcaacctctgc

SEQ ID NO: 268337 - DNA, 997 bp, Homo sapiens
  misc_feature (918)..(918): n is a, c, g, or t
  misc_feature (921)..(921): n is a, c, g, or t
  misc_feature (928)..(928): n is a, c, g, or t
  misc_feature (930)..(930): n is a, c, g, or t
  misc_feature (933)..(933): n is a, c, g, or t
  misc_feature (943)..(943): n is a, c, g, or t
  misc_feature (945)..(945): n is a, c, g, or t
  misc_feature (947)..(947): n is a, c, g, or t
  misc_feature (955)..(955): n is a, c, g, or t
  misc_feature (957)..(957): n is a, c, g, or t
  misc_feature (974)..(974): n is a, c, g, or t
  misc_feature (977)..(977): n is a, c, g, or t
tgtggccacgagagtctagaggaaaccaacccgcaactcactggagctgaagggctggtagtcaggccgaatctcgcgagaattggaactatttcagagccagaggaggatagtggcggcggcgaactttgcccggtagtttttactgactggggtgctggcgcgcgcctttttctcggccagaatccagttattgggatagtcttgacttctacctcagcccaacttctgtggtcgtaatattagtttagcttgggtttgccgtgaagtaagaagactgacttccgcaaacgtactgaacgactgggtgtaggtgccagggcatggacgtgaagctggaaccgcgaaatgagttagttgtgggccgctggcctcaaggagcgaacgtcagcgcgaagaggagaagcttgtgcatacgctctgataagggttttaatagaggtattaccacagtgctgcgtgacacggttgagagagtggtcagaagaagctaatgaaaggaattgaagcagtgccttaggggagtaggagtacttttggagatagcaaaggactttctaggcaaagtggaagtcaaagcacggatgcctgaaaattcatagtgtgatagtgcagtgagtaatgtatctagagaaggggtcttaaacccagatgcctagactggcgagagaaaataaattatcttatgcaagctgagcctaaacaaatggtggaagttactacgatggataagtgagcattaagttcatctgaaaggagaatttgatacccaaatccaacccatttctctaggagaatgagcacccagtttctgagatgtcttcgtttctcaggaaaatccagaaatcctgggttttatgtgaaacttaatttataagtgttgctaactaattaaaattcaaatgtcaaaaaaaaaanctngggcttntnggnggaaagggtntnangccggctngntcggccctttggaaggnaangcgccaaggggatatgacgc

SEQ ID NO: 268338 - DNA, 785 bp, Homo sapiens
tgtggccacgagagtctagaggaaaccaacccgcaactcactggagctgaagggctggtagtcaggccgaatctcgcgagaattggaactatttcagagccagaggaggatagtggcggcggcgaactttgcccggtagtttttactgactggggtgctggcgcgcgcctttttctcggccagaatccagttattgggatagtcttgacttctacctcagcccaacttctgtggtcgtaatattagtttagcttgggtttgccgtgaagtaagaagactgacttccgcaaacgtactgaacgactgggtgtaggtgccagggcatggacgtgaagctggaaccgcgaaatgagttagttgtgggccgctggcctcaaggagcgaacgtcagcgcgaagaggagaagcttgtgcatacgctctgataagggttttaatagagagatggaatctcgctgtgtcacccaggctggaatgcagtgactcgatcataactcactatgacctcgaactcccaggctaaagcagtcctcaagcaatccttccacctcagccttctgagtagctgggagtagctgattaactaatgcgtgtcaccacgcccagctaatttgtgtatgtgtgtgcacaggtgtagagctaggggtcttgctatgttgctcaggctagtcttgaactcctggcctcaagcagtcttgtcttgacctctcaaaccagtgggactgtaggtgtgagccattgctcctggctgagcactgttttttttaggacagactgtattcattg

SEQ ID NO: 268339 - DNA, 577 bp, Homo sapiens
cagaccctctcagcctctttgtacgttctatttgggtctggaaaattttcccctgtggttgagagcttgggctgctgcttggctgtgtgaccttgagccagttcctcaccctctctgggtgtccactgtgtcatctataaaaggagcgtgacaatgacgttgcgggcctcgtcgggaccgtgagaggtgaaggctcgtgagactctcagagctagcgttaccgtgccccctctaacttctgttgttcctataatgttactataatgttgcttatttccccccaaccagatctgcaagggtggtttcatcacccccttcttacagtcaggggccctgatgctctcccctccccgcagcatcacagagagctcaactcttaccaacttccctgcccctcaattcaatgtcctcagcccctatgaaagtttacggcttcattgaccaggcacggtgggtggctcatatctgtaaccccaagcactttgggaggccgaggaaggaggattgcttgagcccaggagtttttgagaccagcctgggcaacatagggagacccccgtctcaatttaaaaaaaaa

SEQ ID NO: 268340 - DNA, 268 bp, Homo sapiens
tataaattttatcattcttgctgttagggaagtcattaatactggctagcagccatactgccttatcctgtcctagcgcatgtattctctcaccgtcctagatgactatttcatacctttcagtgaaaggttttgattgatcatttaggaaaaaaacttttttcagttacatttagttgtattttaataattatcaccttatcatttacattgtagtttactatttttgtcaactttgttgatgtctgataaaggcaggctgtcatta

SEQ ID NO: 268341 - DNA, 278 bp, Homo sapiens
aatgaaccatgacgattcaaatactgctttttactaagtacttacagactaatgacataggagacctcataggcacctggctgtttttaaccaggcaggcctaaatacactgcccaagtggcccttctgtgtggcaacaaaatggctgtcataaaattgtgtctgtgtgcatttatcttatcactgggggtggtgaacatttgagaaggcacttgacctttgaaatgtgaagttttatggatttcagacttgtattttaaaaactatttgttaactgt

SEQ ID NO: 268342 - DNA, 499 bp, Homo sapiens
ttccaaagacttaaaatgagtaatctatacttaacaaaaatagaaatttttagaaagttttgaatgtaatacaaatatatttgttttctgtattaagtgctgtagagatttgagtggtttatcttgttagatttgtttttattacaggaattttactatgggggttttactttttacaaggaaaattttaaattaaacattataagaaaaatgtgattttgccctaaaaaaacactgacaaatatataaaccttgtaatattcatggttcaataggtaattgttcaatgaatgaactgatggtaccatagaggagattggaggaggagacaaaaaatacaaccatggctctcatttgaatctataattcttcctgaattcaatattaaaactctcttgcctgtagaccagactgaagacaagatttgggggtgtcaacgggagtcctgggatacattttttcttataaagtctggattaaactttttagcatggataat

SEQ ID NO: 268343 - DNA, 564 bp, Homo sapiens
aagaattcggcacgaggtttttttttgagacagagtcttgctctgtctcaaataaaaaaaaaaaaaagaaaaaagaaaatagcaagtaagatcagtttcaacaccatgctcagtgaagtcaccagactgtttatgttgaatcaccataaagctaacaagcagaaacatgaaccttagcttttcaagcgatcaaacccctgtcggcaaatggtaaggccaaatgaaaaacacggggcctggtttacacaaacttcccctcatccttcaaaagtctcgaatcagctgtttccttctctaagaaggtttccaggtctgcctttgggtttgggtaacgaggctgttgttttctcatttgtatgtttctccaccagactgttaggtcctagaaacaaggactgtgtcttttcattttgtaccccaagtgaggctggcacattctgagggtgcaatacatgtttcatactttccaaagctcatgcctgttgagtacttactgtttgctaggtcctatgtcagatgttttgtctacattgtctcattaaatcctcacaacagaaaaaaaaa

SEQ ID NO: 268344 - DNA, 331 bp, Homo sapiens
ggttgcagtgagccaagatcgtgccactgcactccatcctgggcaacagagcaagactctgtctcaaataaaaaaaaaaaaaagaaaaaagaaaatagcaagtaagatcagtttcaacaccatgctcagtgaagtcaccagactgtttatgttgaatcaccataaagctaacaagcagaaacatgaaccttagcttttcaagcgatcaaacccctgtcggcaaatggtaaggccaaatgaaaaacacggggcctggtttacacaaacttcccctcatccttcaaaagtctcgaatcagctgtttccttctctaagaaggtttccaggtctg

SEQ ID NO: 268345 - DNA, 404 bp, Homo sapiens
ctttgctgcaatctcagctactcccttccccaccctcactctgtctctcctctgagctatgtttgaatccctgtgtctcctgggcttctcaggaagtccctggactggtcaggcaagttcccaggtgtcccctccaggctctgagcactagagccagagctcccaccagtcagaaaggcagagcaaacacctctcaaaggtaggaggacagcgtaacatcatcacttcctcaagttctgtgatgacgggaggcagccacaggctaactgggcaggaaggtgggcctagatctcatttcccgagggggaaaaaaaagcccaaacaggatgttttaggtgaaatctcccaattttggctgggtgcggtggcttctgcctgtaatccagcactttgggaggctgagg

SEQ ID NO: 268346 - DNA, 440 bp, Homo sapiens
cagctgctcctcagcttcaaaagccacgaggttaacttaggactacaaatcccagaattcctcaagggaagtacaaatctcagccagtcttagctccaaagaacatcaagtaccaaccacaccaaggcctgtgtgactgaccacctgccctgaaggtccaggacccatcccaaacccagtcctgccttgccttatgcgtggagaaatccaccacaccggagtaaaggaagctggccgacctctgatgcacaggactacggccaggcccggtgtgcatggccacccacggaaaccgaggcccaggcaggggtcagcactgtgggaaggaagccctgatggcctgcctctgggttcctctttccctccacagagtagagtgatttgtttttgctgagtgggggcaggacattaaaacaactgtaataggtgaaaatgattca

SEQ ID NO: 268347 - DNA, 617 bp, Homo sapiens
cagggcacctggctgtgctgcttggggtttagtctttcctaaactcttctcccatcttcctttcccttagttcctccaccagcatttgcttcttaatttcttctattgggcagtccatgcctccctgattggttctttcccagcaggaaaattcccaagtactcgcttgtgcctgtctctcgcagtggacgggagtagctggggttcagggtgagtgagagattcgaagggaggtgaactgtagggcacagtgagatagagccagatcccccagggagggcaaatacctggctgaggaatttggactttaatcctaaagtatctgggagccataaaatgtttctgggaggggagaaactcaaggtacttttgataaatgacatggacttggtccataggatctctagggagaggctttgcctaagaatcttggaaagataagtctttaagtctcttgaagataaaaggatctggtcaaatacaaacaacagttaatggctgttgatgtttactgagtatgcatcacagctggcacattcatttattccttgacaaatgcttatgaagtgtcaaccgtgtgccagacacagttctaggtatttgaggtatgacagtga

SEQ ID NO: 268348 - DNA, 1062 bp, Homo sapiens
taaccaccaccaccttgaatgttctacaagaaacattactgtccctttaaaagacaaaggttaagtggaaagctatttgttaattgggtaatgtgtgtgttttggggacaataaggtttttaaaaaaggcagggggaacattcttataatctttaaataagaggaagtttcttcagctatcctacttgttttgcaaggagcagtagaactactcaaataagggcaatgccacgtagattcttctagacccactgtttttactttcaaggagaagtgcaggacactagcccagaacttctgacgtcatcccccaactatttctgctgtgtgttcctttattcgagcttgtggagaggaatatttctttatgtcctggccaggaacattctaactccccactggcaggacttaagttatgtctttatattttcgcctgtcttttgtaaattgtaaacctgtcccctcataaatagggcatcttcttgtacctgccacatgtcgggccggtcagcacaggttttctgcagggcttctggctgggctggcaaaaagcagcagggagcagggcaaagctttttttctggcctgactcccccttggtgcagcccagcgctgccacctgggtggatggtccccggggccctattcccagttgctccagagccactatttaggatccaggttgtgccaccaagttcaaggctggttgtgatggtgagaacagctgctttcatagaaaaatcatcatgtcctagcacagatggccccaagcaggggaagtacaatactgcaggctgcaaatccatgtcacaggtggcaaccttggtcacagagatcgggggaagggtaatgtttacaaaggaaccttttaaaaaagattttgactggagcacattggagttctcgggagttcccaaagctaatttgtgtctcctctctgactactcacgtagttttgagcaagtgcctaccttgatttttctgtcttttaatagaattgaatcatacttgctacactttccctcatcatttagcattttgagaccttgaccttttaccaaa

SEQ ID NO: 268349 - DNA, 326 bp, Homo sapiens
cagagggattgcttcatcctttgagcaattagtaccttttaaaaattctgacatctttcagaccctgtcctgcagaccccactaaagtgcttttgtcagaacagttttagcagtcctagatcatgttttgccagctgctccagccagcggtacagagaaaacacttaagcatatggttcagatgcttgcatttttatctgggtaaaatctgtgtgaaaaggccccagagtttaaaaagccaatcagtgtatatgatgtcagaatgctcactgtttgtctcattttcttaacatcctggtgtgatcttctaggtgtgtctaattgtt

SEQ ID NO: 268350 - DNA, 401 bp, Homo sapiens
tctttgcatcctcagtgtccagcatagtccctggtgaatgatgataaatgaatctagataaagaaaacaaaaaccttcagtggggcaagaatgacttcagaaaagcagcatgtgtcagcagacacaacagtatctcatcgccaaagaccaataccaatacaaccagtgcaacatgaacaggctgctttactcattctttacgtgagattttgtttttactatattaaaatggtaaattcacttacttaaaatgattatatgtagtagatgttaaatcaatgttaattgccttccccttcctttcacctcctcctctttttatagtgaaagataaaggtttatgaacatgaaaattattaatgaatagttttcaaataaattaaaaaatatataaaataata

SEQ ID NO: 268351 - DNA, 303 bp, Homo sapiens
caggcactgtactatattctggggatgcaatgatgatgagcaaaaatgcacatgttccccaccctcgtggagatctgggaccatactggggaggacaggtgaatcactcactcactgcaaacagatgagaagttgtcactgtgaggttgttataaaggagacatgggtcgggcatggtggctcacacctgtaatcccagcactttgggaggctgaggtgggtggatcacctgaggtcaggagttcgagaccatcctggctaacatggtgaaaccccgtctctacaaaaaatacaaaaaaaaaa

SEQ ID NO: 268352 - DNA, 602 bp, Homo sapiens
aactaatagagaaattatgtgcatctttaccaaacaatttgtaagttaacatgtaaccaagactgcaacctttaatcagcattaaatagcaggtggtaattattttgccctataactttgagtggcttttgctttttatgacatttaaaggatgtgctgcacactttttttttaccgtatttccaagtttcaggtcatctttctgacatacttgttagaatccagggaggtggaaataggagcctgagaacctttaattagcctgtaagtgattctaacattgacttgactttgagtaccaccaaataagagaaaactgagaggctttgagtgcccatctgaggctggaacccattactatctgatgacactcatctcctgggttttgtgagttttttctctttctatagtgctcaactctttgacaaagagaaattatttaatgatctagggtggagcttttgccaggcagatatatgctcaagaagaatacagtggctagaaagcgaagatatcagaaagagtgtagttaatgtattggacgtgaggcccagactaggtagagaaagaagtgaggccaggatcagcttaacagatggaga

SEQ ID NO: 268353 - DNA, 436 bp, Homo sapiens
taataaaaatggactaattttaatatacttgttttaaaaatgatttattatgattatcattcaatcagcaatgctgctagaaagctgttatttagcctgaattttagaaaatgtgttaatttttttaaaggtacattgattttttttgataggaataaattgaatgcagtgacggtggcagctttggccatgattatttaggtaaaccacaactaattcataaagtgctgaggaccctttaatacctaccaaaaatgggcaggctgtcaatttggaagtttccatgtgaaacatattctttgacttggcctctgaaaaactttcctgcagttccctgcgtagaatgtagtttatttactgaagggctgatttttataccatgtaacataagtttattttacttggtagtatgtaaattttactggtgaaagcagga

SEQ ID NO: 268354 - DNA, 370 bp, Homo sapiens
cttattaaaaaagtcctttgttttggtgcatggatgagagaatctgggtcttcggctcgtgtggatgattattggaggagtgttccatctattaggataatagttccgtggaattccttttaatataattggatactccagttggtgattttgcaacagatgcacgtggtaaagaggtcctctgcatttgaatagacttttccattaagaaagcatgcttttctggagagagagagagagagagagagagactacagcccacactgaggcttcttaagatcataatgaatgaaaactgataaaagaatggtaaaaaaaaaaaaggaagatgaccacagaggcagaaagcagtcttaaaaaacgaaagaaa

SEQ ID NO: 268355 - DNA, 214 bp, Homo sapiens
gtgcagcggatagggtcccagcttctccaaacatacagccttgcctgttcagcttctaacagcattcatccatttgcaaaagggatccacatgatttctataaaattgggcacaaaaaaatttaactcaaaggagaagatgataagtactcattctcccacaacccaggaatttttataatgcctcatatccctcaagaatttatgcattcata

SEQ ID NO: 268356 - DNA, 476 bp, Homo sapiens
ctcgctctctctcaaaataccataccttagtattttcagactatggttgatcatgggtaattgaaaccatgaaaagggacactgtggatggggggattactttacttagataagcttttggtcacagttgctctatgttagcgaacaacagtcaggtgaccattttaactgaaattaagaaagctataaacaatgccatctacttatttagttctacaatgtgttgccattgaaatctgtagataatctgattatcatttaaatagcaatgactcaaagagtctaaatattgcttattgaggttttctaaggttccaccaagtttgcagcagtggtcatcattttcacagtccggagtgcccctatcttttacactgtttaacacagtgaaaaaatagtactttgaattttctccctcttctgcaagatttgcaagggcaggtaatacataggaaaaaaggatgcttctccttttc

SEQ ID NO: 268357 - DNA, 528 bp, Homo sapiens
acatttctccaaaggtaggctaatcactgttattattttcagctagaaatataaaaggtattttctatttttgatgactttgaaacataacccttggaatataatatctgtgtataatatctgtggaaagcatgaaagtaatattcaaacagtatgcattttttccagaatgaaaatttcctctacaataacattcatccttttttcctgatggacacataaaagtcaacatttctaacattgctggacgttatttacattaaacttgcctcagcttcaggtgttgcagaaactgggcaagaggccacaaggtacacaatacacacacacacacacaaacttgtattattatacttacctaagtgtctaaagaggtggataaatatattagattgctccagaacaaggatttttatggggcctattggaaagtatgactgcagtttgagtgagatgcctgtaagagattcaatttggccactatttattgagtatccaattttaaaagtactgacagaaggctcatga

SEQ ID NO: 268358 - DNA, 447 bp, Homo sapiens
ctctgaacttttcattggcctcctggctccccaaagggtacactgcttctgctggcttaatgtctcagaactttgatgtcgctggtctcagacaccactttgccatccactatcctgggagaggtggtcttctggatggtttgcctggagttgctgctgtctggggtatcaccaagactgaagtcctcaccatcttccagcaggtgacagtaggtggtgatctcagtctccagcttgaccttgatgttcagcagggcctcctactcctgggcctggcgctgtccctctgcagggtctgtgccagctctgactctaggtgcagcaggatccagtctacaggatctgccccatctgcagggtgtagtgggcctccacctccctcaggctgttctgcaagctggccttcagatttctcatgcagtccaggtcaatatccaagaactggac

SEQ ID NO: 268359 - DNA, 409 bp, Homo sapiens
ggagttgaacaatgagaacgcatggactcagggagaggaacatcacacaccagggcctattggagggtgaagggaaagggaaaggatagcattctgacaaatacctaatgcatgtggagcttaaaacctagatgatgtgttgataggtgcagcaaaccaccaagtcacatgtatacctatgtaacaaacctgcaggttcaacacatgtaccccagaacttaaggtaaaattttaaaaaagatagaaggaacattgaggtattaagaaaactattctgaattttggaataatatatattacattgtgagagacctaattataaaattggataatgaaaaggcaaggcaaaacaagaagatgtgcataaaagaatgaaaacaaaagaagctctcctctctttttttataag

SEQ ID NO: 268360 - DNA, 470 bp, Homo sapiens
gactaaactaaaccatgggaattgactccttaacattcactgcagctgtagtagtctctacatcatattcatagttttagagcaacagtccaaagcaagattactctgataatatatatgggtgtatatatatatatatatgtatatataaatataggagcagtacatagcattagtacacaaaacgctaaaggtggaaagtaataagcatacagcaaattactccagagcagatcacttctacagtgacaaaaataaacacgagccaccaaacagacactgactgccaacactggacatccaactccattaagtaggcaaagttaaaacatttaagagtaaagtctctcttaaacaaatatattaactacatttgtggagcttgaagtagtaaataggatgttatacaggcctaaaattgtttcttctcttttttttaaagattaggtgggcctgtaaaagatatcggc

SEQ ID NO: 268361 - DNA, 392 bp, Homo sapiens
gttttctggtattcttggttttatttttagaaataaaaaaaaacaacatagacttgaaggacttcaatagcacataagaaaaataagttgaatcaaaaggatgagaaaggattgaaaaagactagaacaatctttatcagagaattattaaccatgttaagggccaggcgcggtggctcacgcctgtgatcctagcactttgggaggctgagacaggcgggtcacctgaggtcaggagttcaagaccagactggccaacatggtgaaacctcatctctactaaaaatacaaaaattagccaggtgtagtggcaggcgcctgtaatcccagctacttgggaggctgaggcaggagaaccacttgagcccaggaggcagaggttgcagtgagcc

SEQ ID NO: 268362 - DNA, 462 bp, Homo sapiens
actgctgtttttgcaactctggactatgtcttccttcatctatctccttaacacgcttattccattaacacgatatgcgtggataaaagatgaaaccttcagaatctaaggaggtcaatccctgtggctctggctactagccctgtttcccagtttttacgaagaacccagctagagcagccaccctcaacatgagcagcttgtctccaggaacagtttcctatctcaggctgtctgccctttccttcctccctttctttcttccacagtctctggctgccttcttctcctcacacatctgccattattctctctgcctcttctccccaaccccccatgccatccatccagaaaacaaaaggtgctaaccccatgtctccacctttactgccccaaactcagacacatggaactcttctctctttttttttaattaaattaaatttaatttaattttaagtt

SEQ ID NO: 268363 - DNA, 289 bp, Homo sapiens
tgtggagctctgcaacctggagccagccctgcctggggtaagaggaaaaaggactccttccccccagccccacagcctgtacgcaaacacaccaggagacatgacctgctcagaggagacctggaaccaagggaataaaatgagagtgggttgggggcttggctgtttgttatttttttgcttgtaagtggacaatttgtggtgtggtgtgtgaatttggggtcttaaatccagatagctgtctgctgtggacagccactgtttctgaattacagggcatttcaagtga

SEQ ID NO: 268364 - DNA, 1404 bp, Homo sapiens
cccttctctactaaaaacagaaaaaattagccaggcgtggtgatgtgtgcatgtaatctcagttactcgggaggctgaggcaggagaatagcttgaacctgggaggcggaggctgcagtgaggcaagatcatgccactgcactccagcctaggcaacagagctagacttcatctcaaaaaaaaaaaaaaaaattgtctctggaaaccgaatttgtctctgtcttgtaattttgtttgctttctcatttcttctctattgtttcagttattttgtcagggaacctttaatcttttctaagaaaccatcagcagtgttattccacattatcttcttaacagcatttaaaaatatataaacacgtgattgatggatgccttgagaagttaaacatgatacttcctgcagaatcttggagcagtcatttctctagagtttaagcccaccttgtctaagtttgaacattagtcttttgtggttatggcaaatgtttgcttctaatgcttacttaccattatgtccatgtttgagttcaagtttcaataaagattcctcaatttggagtctatatgtggagcccataacttttagcaaatacaaaagcaccacatcagtttctacattgtaattgctcacaatatttaacccatctcctggcctattcgcccgatttgcttgcttcttcctctgtgtggactactgtgtggatatcattcaaataacctatcaagtggttttttggacaatatttcttgctttgggagtgagtggaatttctctttcctgaattgaggaaaaatatgaattcagaacagttaaatgtagattatcccttcgttatatagagttacttaaactaaagaaacattttaataccatgtagaaatacttaactgggtcttaactgaatctatgaatataatacaaatatgaatttatatatgatgttgctaaaggcactaagctaaaagcaattttaaatcttgaagcctgggcatggtgattcatgcctgtaagcccagcactttgggaagctgaggtggaagaatcccttgaggccaggattttgagaccagcctggccagcatagcaagtccccatctcttaaaaaaaaaaaaaaaaaaaaaagactctccatggcggcttgtgcctgtagtcctagctgctgtggaggttgaggtggaaggatcacttgagctaaggggtttggggttacagtgagctatgattgcaccactatactctatcctgggtgacagattgagaacctgtctcaaacaaaaagaaaaaccttctcgagatgattactttaaattttcttttgctatcttattttctacttctgacatttttggacataatggtcaccatgcctttatttgtgaagttttctataactgaactta

SEQ ID NO: 268365 - DNA, 161 bp, Homo sapiens
agataaaagcaaaggtagcaaaatattaacagttggtgaacctgggtgaaaactatatactgttattgcaacttttctgtgagtttgaaatttttcaaaatgaaaacattgaaaaaaatattaaaacctcatgaaacttagtaaaaatttattgaatgata

SEQ ID NO: 268366 - DNA, 555 bp, Homo sapiens
agggaggggttatttattatttacaactgcagaggtgtgagtggagtctaggggagctattaatacaagggccagtgggcacctgggggcagcagcagaactgttcactgctctttcccatgtgggcatccaagtgtttctggagcctagaaggagagttgggtaaagtcagccccagaggagcagtgaccttctgtcagtcaggccatgcagccagttggaggcagctttgcagggaagggggctggggaggacgcactcggaaccttctccgctcctctctctgctctcctgctagggctccccatgaatcaaacccaaccaaaggccagagggcatgaaaggccatcgccttggtttataccaagtcccctggggcagagagcagagaatctggaggggcaaacggaatccctccagcaatcccacctaaaaaataattcagggattcagagagcttgtgagcaaaaagaaaaatgaaaaacattcaaaatcaagcacagaatcaaggcaagatgactctccgaggaacctaatgtgaaatgattactggga

SEQ ID NO: 268367 - DNA, 410 bp, Homo sapiens
  misc_feature (138)..(138): n is a, c, g, or t
aaggcaagactctcttcctgtgagtccttcacaccgcctgcacctgtctaagccaccattccactccctttcccacctacagcctggtgatatctcccttctcctctgcactttatttctctccaggatcttcgcacntcaggccctcacatgcacctgctctcccccgcccccccctgcgctatcccctctcatcgcccttcctccctcccccttcccccgctgcgccccatcctccagccccccccgacccgcctcccctatccttccccctctttaccgcctatgccccatctctctccctcccttcgtccccacttccccccctcccccctccccccccctactctcctccctcttcccctccgcgctctcccccttctctctcctctctccctcccgcctccgcc

SEQ ID NO: 268368 - DNA, 128 bp, Homo sapiens
ggtgccagctgctagggcccctatggaaacaggaagctgcccacaggtgcacctgggctgtggtgggggctggttccatccaggttcagtttgtgcctctgagaaaccaacccagggttccactagct

SEQ ID NO: 268369 - DNA, 496 bp, Homo sapiens
tgtgcttcccgcttctgctactgctgtccggctggtccgggtcagggcgggccgacacacactgtctttgctatgacttcatcatcactcctaagttcagacctgaaccacgatggtgtgaagttcaaggcctggtggatgaaaggccttttcttcactatgactgtgttaaccacaaggccaaagcctttgcttctctgcggaagaaagtaaatgtcacaaaaacctgggaagaacaaactgaaacactaagagatttctcccttctctcccacacaagcacactaagacaaactgaaacactaagagatgtgggggatttcctcaaagggcaactgcctgacattgaaatggagaatgtaatacccatcggtaagtttaaaatagtccaggacagcagagagcagacacagtagtgtcttagaggcatttattggtttcctgtaaaaaataaatcagaagtttgtgtcacccaagaggttgaggagcatgggcc

SEQ ID NO: 268370 - DNA, 369 bp, Homo sapiens
ccatccacaagatgcacagctggccccaggggaagaggcaagcagccttggcttgctgggcccctgggctttgttgctcatggagcaggcaccatcttggcatccttgacgcacagcaacggttactggctcttgacaggccctggacagacctcagtccatgcacttctctcttctctcatgactcactctgctagccaagagtttggcaaacagcttctacaaagggaagtacattcacctttgtgggccacgtggtctctgccatgacctctgaaccctgctgctgtagtgtggaagcagccgtaacaatacctaaatgagtgagcatgctatgttcctataaaactttatttgtggacattgaaa

SEQ ID NO: 268371 - DNA, 731 bp, Homo sapiens
tgggactttttacagttgtttgtagtaagagaactcccattttcatcagtggaactggacaactacactggtccaattcaggcaaatggatagagttcacagcaccaaaccagcagccacaggaaattaatataactgcgaaggaaaagatttcccctgctcgagtctccctgcactcctacccatctgagagaaacagaactgttgagtagctgatgcaatttcatccataatattgtggattcaccattgattcagcatctgatcctcagcactgtatatctaagaactcattctccttggttcatcaggcatgatcagattaaggattcatacacactgacctaactcacaggagagagttataaatcagaacaccaatttattgccttgttcatggaaatagaaacactacatgtgtcagcttactcagatcagcagctaaacactgttcggtgttgattgggaaatataaagccagaatgaaggcagctggttcatcttgatagcaaatgttaccaaatctcatagtctggtgccctaatctccatgggattagaacatgtacatcgaccagagaggttctctttctcctgactatgctgggacattctggcaaattctgactcatcactccctttctagaatccttaaagaccatcatcacgctatttcaagaatattccttcagatgtgttacaaagattaaatgttgatttatggtatctcta

SEQ ID NO: 268372 - DNA, 1085 bp, Homo sapiens
agggaggctaacaagcaactactgaagccattgcagagtgaggtaagccatacaaaggaaataaagagtgctatgacagatcatcacagaaatggtcctgaaaggcctcttaggagggaacttgcaaggtgagaatggaaggatgagttaggaattaaaagacctaggaagtatgggatatagaacaatgcggtaaaggaaatagcaagtgcaaaggcccaagttataaaagagcttgttgtgctgtatcaacagaaagaagtcctgtgtggttgaaagaataaagagcaataaagagagttccagaagatgacattgccagggcaggtagaagcctgatcatgttagacagttagacatagtaaaggttttattttggagtgatggatttcagacttctgacttccagaattaggagataaatgtgtgttattttaagtcaccaagtttgtggtgtttttttacagcagccacaggaaattaatataactgcgaaggaaaagatttcccctgctcgagtctccctgcactcctacccatctgagagaaacagaactgttgagtagctgatgcaatttcatccataatattgtggattcaccattgattcagcatctgatcctcagcactgtatatctaagaactcattctccttggttcatcaggcatgatcagattaaggattcatacacactgacctaactcacaggagagagttataaatcagaacaccaatttattgccttgttcatggaaatagaaacactacatgtgtcagcttactcagatcagcagctaaacactgttcggtgttgattgggaaatataaagccagaatgaaggcagctggttcatcttgatagcaaatgttaccaaatctcatagtctggtgccctaatctccatgggattagaacatgtacatcgaccagagaggttctctttctcctgactatgctgggacattctggcaaattctgactcatcactccctttctagaatccttaaagaccatcatcacgctatttcaagaatattccttcagatgtgttacaaagattaaatgttgatttatggtatctcta

SEQ ID NO: 268373 - DNA, 275 bp, Homo sapiens
ttctctaatgtcaagtatacaatttaatgatattttcagtaaattcaccatacatcagttttagaacattttcatcccctccatcagacccatgcactgttaatacctattctcaccccctgcttgaggcagcctctaatctactctctgtctttatggatttgcatattctggagattttatataatatgtggtctcctgtctggtttctttcacttagcatcatttttagcatgaatgccatagcatgtatcagtactcattccttttcattg

SEQ ID NO: 268374 - DNA, 439 bp, Homo sapiens
ttttgaatattttatgtatgccacacattaccctctcttagacagctgtatgttgggaagcagcatgaaaaaatgcaaagaaattgaacttgcactttaaaaagtgctgagattttgcctctatttagatgtggaatagacaacataacatgacatgctaggtggagggcaatgggttcagttaggattttatcaaagtaaaaaatgaaaaagttgataattactttcaataaagaaatctctcacttgcaaactgtacgttagaatctcaattttaaatacagagaaaagaaaatatacttacaaggacccgtgtattttatatattgcccattgctatattgccgcttggcatatgggcaccaaaggaattattattatacacagcattaatgtagaaataggaaacatttaatttcctgaggtccctctctctctt

SEQ ID NO: 268375 - DNA, 401 bp, Homo sapiens
taccaagagctgaagaacagggtaggtgccacaattctctaaaacagtaacacacatgcctgcttcctcactctgaaaatcagaaatggaccctatctcccaatgccatgtcatcaccaatgaagtcacagaatcttccttaaacccaccaaacaggtttcagaaccaggactgaggtacaaacttagcatcgatggatttaggagaacaggggaaggcacctatgagaatggacagggtcattggtgagggcctggcgcatgtccaccccgagtttctatggaagtcgggcaggtggtaagaacagctagtgtgaggatggcaagcacacgttcagtttctatgacattctggcaacatattcaggcagtagagagaaacgtagccatcacctgcagaga

SEQ ID NO: 268376 - DNA, 631 bp, Homo sapiens
ccctggcatgggagggaagagtgataactgtaaaatacccctaggctttctccatgacaatggttactctccaagggaaaacactttgcaagagccttgtctcagctgggaattcccaagggaattcctcaagttccagcaccctcatcactttatcacttaaaggacaaaaaactcatagtcaacaggggtcagcgcttcaaggaaattgttacagaatggtaaaggggtcgaatatccaagaagacataacaatcctaaatgtgtatgtgcataacaacagagcatcaaaatatgcaagacaaacactggtaagactgaaaggagaagtagacaaatcctgtcttatagttagagattttaatctctttctcacaaaagttgatagaccaaatagataggataaaaatgacctaagcagtactgtcactcaacttgatctaattgacatttataaaatattccattcaacaacagaaaaatacacattcttctcaagctcacttggaatattcaccaagatagagcacattcttggaaaacatgttaacacatttgaaagactaaacgtcataccaattatgttctcagaacacagtataattaaactagatatcaacaacaaaaagat

SEQ ID NO: 268377 - DNA, 401 bp, Homo sapiens
ataacataaaagcaccttattttccaatagaagtagaagtaattgcagtagagttaattttacagtagaagcaattacaatagatttcccattagaagaaactactacaggaagcaactactgcaattttccagaattaattacaatggtaaaattaagttggccaaagtagataaaattataacttaattccacaaaataagctaactaaatcaagcactgacaactttgaaggaataatctaaatagaaatgcacggcataatttgcccctgacttatgatgattcaacttaagattctttctttaatcttagaattttttttttactttatgatggtgcaaaagtagaaattataatttaaattttgaattttgatttttctaggctagtgatatgtg

SEQ ID NO: 268378 - DNA, 449 bp, Homo sapiens
tccagataaaagtttacttttgttaattttgaatatatttctgcattgtggtgttctaaaacccaggaaacagccaaatcacaagttaccatttaacataaacatacatagtggatcctatattaagcaacccatttggaaagcactgatgtacccaacagttacatatagcatttcataaagaactgcacggagtttaccattgctaacacccagtacctatagtcacctaatgtctggaacacagtaatgcagatggcaagtttcttttgaaaatgacttaagtagttttcttgtggaacatcaaactttattattccaagaaattaagatataggtaagaaaaaatgaaatgccaaccctaatttaaattatctacatcttcaagtctgttaacagtaggaggttagatgtctgtggccaattttaaattaggtttcagataattg

SEQ ID NO: 268379 - DNA, 579 bp, Homo sapiens
attctcaaaacaacatgcaacactggcctgcatctttaaatggagctctaaagttcaaaagagagaagagagaaaaattgtgcagtcacttctcaggtggcaacagttaacattaaagctatgggtccaaagtaacgtgaggtgaccctgttgtacaatgagtcctggaagctaagtagactcagacaagcagcagaaaatgtccaaggttcttttctcagctccactaggagccatttgcccctggctttccagtctgtatcttgatgtctccacataccctcctcccctctcccaaggtgaaggcaaacaaagcgaatcacaggggtttgctctgacattctggtgatcccccaacccccacactagtaagtggcaccctgggggaatgaacagtgcctggagagcacagctggctgcagccttaggccttctcatttgctgccttagactcggtctctactcgaggccctgaatgactgcgggactttttaaatagggaagaaaaagaaaacccagatgtggcagtaataggaacatggctaaaagtctagtaaagttttctgagtgaacatgtgc

SEQ ID NO: 268380 - DNA, 476 bp, Homo sapiens
gggtgagcaaaagttaatataacattatgtaaacaattagatagcttttactttctagaccaggggttcccaacccccaactggtagtgatcatggcctgttaggaaccaggatgcacagcaggaggtgagcagcaagtgggcaagtcaagcttcatctttattacagccactccccgttgtgacattactgcctgaactccacctcctgtaagatcaacagcaacattagattctcattggagcactaaccctgttgtgccctatgcatgtgagtgatctatcttgcatgctccttataagaatctaatgcctgatgatctgtcccccaagatgggactgtctagttgcaggaaaacaagctcacagctcccactgattctatattatggtgagttgtataattgttttattatgtattacaatgtagtaataatagaaataaagtgcaaaataaatattatgcattgaaccatt

SEQ ID NO: 268381 - DNA, 562 bp, Homo sapiens
gcctcattcaggcaaatgaagaccaaagctgggctacggtccctcaggacgaggggcacacagggaatgctgcttgcatttcagctcaggcacagcatcatggagttctgcttcagcttgtactgaaacgccttcagaacatgccttgttccttttcaaggcagcagctccaacacgacccagctggtccctccgcagtcatacgccagtccctctcccacctgggtaactagggaagcacctgccaccccagcgctgcacccccaagctcagggcagcttcctggtcccggccacagggggcctctgcagggagtgggtgcagaaggcgcagatgaagacaggcccgagttgccaccacagctgctcattctcaggaggggaggggcggcaggcaaggccaccaaggcctgagcgctggtgcggaggcaaaggcagcccagactcagccgtcatgtgctgcagaatgaaagatctggggaaaaaagaccactgctatgtggatttcacagcaagtggaacttaattccctctaaaataaaaaatgcccacatatagtaaaa

SEQ ID NO: 268382 - DNA, 350 bp, Homo sapiens
gtcgggctggtcccgacctcaggtaatccgcccgccttggcatcccaaagtgctgggattacaggcgtaagccacggcacccatccaggttatcctgccttctatgggttgagaactgccccagttactaagtagaacatagaagtatatgtaggtttctgttcttataggccaaggcaggaggatgacttgagcccagtagttcaagattagcctgagcaacacagtgagaacctgcctctacaaaaaaagaggcaggaggattgcctaagcctaggaggttgaggctgcagtgagccgtgatcacatcactgcagtccagtctgggtgacagagcaggaccctgtctc

SEQ ID NO: 268383 - DNA, 510 bp, Homo sapiens
agcaaatgattatctgatcttttgctgagaccaaatgctaagaatgtgttgagatcttggaacccaaaggtattagatgaacattgagcaagaagcatttaatcgcaaggctggttgcccagtccaaggttctttgaatgttgttccctgctagtgctagtactatagtcttcagaagtccatagtcaaaggtaggtagatgctggagtactcacagtcagatttctgagcagttgaatacaatggcttttcttccctttactatgatattttagaaatagaaatgactagatgctaacatattttagttcaatatatatcacttcttgtcattaattcaattctttggtttattttgtttctaattgcacagataacaagaatttcctaacatttttctcataccctttggccacttaatgttcccatgctatttattcctgttcatttttcactgtttgatgatggttattgttgaaatttagcaaataaaatgtcagctgtggcacc

SEQ ID NO: 268384 - DNA, 418 bp, Homo sapiens
cagtaaatgacacagacatgtagattccatatctgctaatggtgtacataggtcagcactcttgtactgaacctgaagatcctttaattatgccagttccccttctcttccacttatggactgcctctccaagagcagggggtctgtttcccatctgatggaccacttaccttcttttctttaactctactttctatctccaaaaatccactgagtattcacattactgattagctgtgttttccagagccattgctaatcgcacgtcgaccttacataaaaatggaatattcatgcattttctatgtatttttaaagccattatttgtggcacaagctcagtgtgctttcagagacactgaacactctgttgaagaaactcaaatggcttttaaaataaaaagacaaaatcattatc

SEQ ID NO: 268385 - DNA, 803 bp, Homo sapiens
tgctatattaaatattacatataatacatgtgtgcatattcatacgtgaatatatgtgaatgtcagttactccctgcatttggaatagcttttattaaatgatacaatggtagtggcatatttatttatgaaacattaactgaatgatttaaatctttgcaagtctgtccagtggatggagacttaaacacacttgtttctactatcttgatttaagtcttaccaaaaataaaccaatgtgactaaacagtaattattgttaatgtaattaaacattagtgttactgtaaattttacatttacataaaatgttaacatttatattagtgttaatataaacacattaacagtacttaaaaaagattcttgaaatctgcttttagatacctctgctatccaaaaacaaatatccagcaactgtactatctaaactgtagctaaaaagaaggaaaaagatttctttgctgctgaaatttatgtcacagtttatgaatcaactcatactttattaaaagcagagcccctttaggtgttctctaattcaggctatttattttccctcattttacaactttaataagcttagttgtattccctaagcctccaatataataagaacaaactgcaacaagacacaaggaggtaccaatcaataagaagtgtcagttgcgagcaaagaaattgaaaaaagcatacatataaactctcaaagtaatggtctagggctatttcatataagagcaaatagcctgtttagacagtagtaggccctgtctaaacaaaacattttatagtatgataca

SEQ ID NO: 268386 - DNA, 442 bp, Homo sapiens
cctgcggccgccggagcagctcccgcggcggagcaggagccggatggtcagaggagcccggcagccccagcagccgcggagtcgcctggcccccagactgactggcacagtggagaaaccgcctcgaaaacggagaagcaggactgaatttactcttaaagaaatcatgtcctctggaggtgctgaagatgatatcccacagggagagaggaaaacagttacagatttttgttatcttctggataaatctaagcaactgttcaatgggttaaggctggagtgtgatggtgcgatcttgctcactgcaacctccgcctcctgggttcaagtgattctcctgcctccaagcgattctcctgcctccaagcgattctcctgcctcggcacccaccgcccccctaccccgagtagctgggattacaggtgcctgtcaccatgcccg

SEQ ID NO: 268387 - DNA, 910 bp, Homo sapiens
cctgcggccgccggagcagctcccgcggcggagcaggagccggatggtcagaggagcccggcagccccagcagccgcggagtcgcctggcccccagactgactggcacagtggagaaaccgcctcgaaaacggagaagcaggactgaatttactcttaaagaaatcatgtcctctggaggtgctgaagatgatatcccacagggagagaggaaaacagttacagatttttgttatcttctggataaatctaagcaactgttcaatgggttaagagatttgccacaatatggacagaagcagtggcagtcctattttggaagaacttttgatgtttacaccaaactctggaagttccagcagcagcatcgacaagtcttggataatcggtatggcttgaagcgctggcaaataggagaaattgcttccaagattgggcagctatactatcattattacttacgcacatcggaaaccagctatctgaatgaggctttttccttctattctgcaatcagacagagatcatattattctcaagtcaataaagaggacagacctgaattggtagttaagaagttacgatattatgcaagatttatagtagtttgtcttcttctcaacaaaatggatgttgtaaaggatctggtaaaggaattgtcagatgaaattgaagattatactcaccgatttaatactgaagatcaagtggaatggaacttggtgcttcaagaagtagcagctttcattgaggcggatcctgtaatggtattaaatgatgataataccattgttatcacatcgaatcgccttgctgaaacaggagccccattgctggaacagggcatgattgtgggacagttgtctctggctgacgcactcattattggtaattgtaataatcaggtaaag

SEQ ID NO: 268388 - DNA, 583 bp, Homo sapiens
ggacacaggcaatcatatcattgtgatgacttttagaatctgtaatttgcacccctcttgttggtgccctaatgatactgccatgaacttatgtaacagcatgaagaattctggatgttaaaaattaagtctcatatttgttcttatatccaatttaacctgaattaaatgtatgctttgggagaaattgtagttggagcagttttaggttgcttgggtgcatctgaaaagtcacgacataccatagaaataaaacagcttcattttgtttagtaagcacttactaaatgtctgctcagcaaaggtataaggcaatggaagtatgagaatgaatttgtaattacagtaaaatgaccagacagccaatttcctcaatagttttgacttttctttctcctttttcctcttacttggctccgcttcctgctctctctcttactagtccgttttcccgtttatatataccattaatcatgcttatctttctccacttctttttctcctccttttattctcgtcttttatttctctctattccttctcttttttttttgtcttcccccacgtattacctgcccgtccg

SEQ ID NO: 268389 - DNA, 133 bp, Homo sapiens
cactcagtaaatgttagctaatcttgtatgccaggagcattggccaccatatctaatgtaattacaaggcaaattttagccccttttttaccaaagactggatgaacccagtccctggtggtctagtggctag

SEQ ID NO: 268390 - DNA, 304 bp, Homo sapiens
tacagaccagcaccgtccatggcctgttaggaaccgggctgcacagcagcaggattatgctaaagtcgccaggcaagagaccgagatgagcccacctcacaaacccagaaacctcagatccaaggcagctgtataaggtacagatcgttccggactgtagaagagagggttaatccaacttcatcaggagagaaatgccattatccactgaactatttcttgactatctcctgtatgctggtcagtttcactcacattgtctcatttaatctttgacaaactaaataaaagtgtgaagtaaata

SEQ ID NO: 268391 - DNA, 524 bp, Homo sapiens
tgctgtatttgacaatagatgtccataagcagttaaggagttcagtctgcccttagggaagctcaacacaggcccatgtgcatgcacacacttgcactccttcacacccccaaacaccatcccactccatacatgtatacccatcttcccttcccagatccctccccaaacagttaagttaccatggaggtatgcatctaaatgagttatagaaaagatgggaagtctcaagggggaaaaatggctgtaactttggatgatcaggcttgcctttgaaaaaagaatttgaacccttgtagaggatggagatgctttgtgtagaatgaagccaccttcattcctctcccacagagggtacatctagaagaagaaactacttgagcaaagtctgagctcagagatggggaggtgtgacaggtgggaggaacagatgggagaaggcttttaattccaggctgaggaaattgacatttatcctgcaagcagccgagaactttggtacagacaaatgacaaaattgcaaa

SEQ ID NO: 268392 - DNA, 352 bp, Homo sapiens
ttttaaaaaatgtatggccaagaatttccaattccagaaagtagtagtcacttctattattcttttcatagcttagtgtagtaggtatacaaaacataagcacatcaccacctatcaatttggctaaattattttttataaactattttttttttcagagacagggtcttgctatgttgcccaggctagactcaaactcctgggctcaagtgattctcctgcctcagcctctccagtagctgggactccaagcatgcaccaccatgcctggttcttaaacttattttttaagaaaaatataagcattctataggtagttaaaaaaaaaaatcatagttctggatacataaaa

SEQ ID NO: 268393 - DNA, 253 bp, Homo sapiens
gcctatgtaaattaatgttgaaagtctagtatgaatagatcatctcttctttctttctggctgctttaaagattttgctttgtttttaggagtctgtgatttgtttatatctaagtggggaaactccttctctcccaacttttccctccctctttttctccctttctcccttccttccttccttcctccctccctccctccctccctccctcctctcccctccctccctcccttcctccctccctccttcctc

SEQ ID NO: 268394 - DNA, 516 bp, Homo sapiens
gatgacaggcgtgttgagctttttaacactgcctttggatgggcgtgctggaaggtagggccttggctgcctctgctgtgactgcccatcacactgcttctaggcctgggccccaacatcagaatgtatgggctttgtagaccaagtgcagatattggcagactacataagcagcactggaaattgtttttcaatgttacgttacttgtgtataaaatgaaaagagacggctgggtgtggtggtcacgcctgtaatcccagcactttgggaggccaggatgggtggatcacaaggtcaggagttcaagaccagccggccaggatggtgagaccccgtctctactaaaaatacaaagaaggttggccaggcgtggtggcgggcgcctgtaatcccagctactcaggaggctgaggcagagaattgcttggacctgggaggcggaggttgcagtgagccaagatggcaccactgcactctagcctgggcaacagagcaagactccgtctcaaaaaaca

SEQ ID NO: 268395 - DNA, 458 bp, Homo sapiens
accatcgtaagttggggaccatatgtaattaaaaatacagccagtccgtattaacattgtgtactcatataagacttcattagaaaaacaacttgctaccttaactagaacatctgattgacttatcagaaatgatttaaaatattgataatgctgatgatcaatttgttttaaactaaatttattcctgttaattgaaatgattttgataaacttttgattcttttgactggttttgtgttatcctataagagatatggtgataggcctcatagtcaaaacttgttattgttttatttgtttcttagtttcaaatgattcctatatttggactgattttgatggccaaatttataggcttgttctttgtgaagcccttgaagatcttctgaaggaaatactgttaaactaaaagtatcagttttctaagtcaccatagtgtttgcagaaaaaataaa

SEQ ID NO: 268396 - DNA, 264 bp, Homo sapiens
ctgtcctttaaaatatctttaaaatcaaattataatattttcagaggaactagaggacaacattatcttttaatgtaatggttccaaattaacaacatttaaacaaaataacagtatttatgactgtgcaaagtcaaatctacagaacttcattcaaaagggatgagtgaattttagtagttaggaaagattcaaaagcatgtttgtaatgagaattcttctttctcttccacattgaaggtatcacatttatgtacctctgta

SEQ ID NO: 268397 - DNA, 332 bp, Homo sapiens
gttggtgggtataaaggaaaagaatcaactggctttggccaaagtaatgaaaaggtcaaccagttttctttcacctttgttctcttactaatcatgggaaggacacagatggctccagtttaacttcctctgttctcacaggtgccggtccattaacttccaagagaatcccatgagtatatagtatggtttcaaaagaatggaagctagaataacacaaatgtgaactctagtcccaattcttctaattcctgggttgttgatcccaaacacattatataaagttatctgttcttccatttcctctaataaaataaggctaacatacaggt

SEQ ID NO: 268398 - DNA, 430 bp, Homo sapiens
acctctgcagtaatcaaggcccccaggagtcccttggtgagatccggagctcccaagcccagcccaagctcctgcttaaccctgcattttctggaagcacatccccacagactccacgcctggagaggagccggggttgtccctttccgtctctaacaacaccggctgtcaacaattttgtaaagtgagttctgctctcccacagacttgcaccatgaacttggaaatctctgactccacatcactgcccagagtgcaggctccctcctttcccttcaagaatccagtctccaaatccaacagctgggttcgaatcccaattccaccacctagtccctgggtgatctcagataaggttcttcacctctctgaacctcagtttctcatctagaaaatgggatgatagcaaagactacctcataaggttgcg

SEQ ID NO: 268399 - DNA, 555 bp, Homo sapiens
tttggagagctcgtgtggctttagcaggtcctgggcacccaagccacaccccctgtatggggtccacacaccttgctgacgggcaagggaggtttgtgcgaaggtgccggccatatcgcctcccacctacagcccccacaaagagcctgttagtgacagcagtgagtcattgtcatttgattctactctgcagctcctgcttaaccctgcattttctggaagcacatccccacagactccacgcctggagaggagccggggttgtccctttccgtctctaacaacaccggctgtcaacaattttgtaaagtgagttctgctctcccacagacttgcaccatgaacttggaaatctctgactccacatcactgcccagagtgcaggctccctcctttcccttcaagaatccagtctccaaatccaacagctgggttcgaatcccaattccaccacctagtccctgggtgatctcagataaggttcttcacctctctgaacctcagtttctcatctagaaaatgggatgatagcaaagactacctcataaggttgcg

SEQ ID NO: 268400 - DNA, 517 bp, Homo sapiens
cctcagcagtgtcacgacagctgaagtgtcacttattcctcatcctgggcacaccatgatggagtgcagccccactgattgggacccatgcagccagcctggcccagggccactctctctcccagaatgtgcacaagtcaagggatctctacttccatccttattttcctcaaaagctggtgccagcagtaatcaaccagacttctagaaaagaggagataatctgctctcaaggctgctgtgggctccagtgttgtaatctactacttgaatctagttgtttatttcattctataataatttaatacagcagatgtcaggagaaatctttgtttagatattatgtcatatctggatatatctgaatcctgaatgattaatctaaatattaacaatattcacttctgccaatgtcaagagtattttctgctactgggcttaaatcaattttaaaatttgagagttttaaaagcatatctttctgtgttcataaataaacagaacgaagattctttga

SEQ ID NO: 268401 - DNA, 949 bp, Homo sapiens
aaaggcaattcaaaagaaatgtaaatggccaacacatatttgaaaatatgctaaacttcattaatgctcattaaaatgcaacttaaatatatgatatgatatcctctttcatgtagttgagtaacacaaattaaagagactactaacacactgcaatagaagtggaggagacatggccaccttcattcattgctggggaaatgtgacatctgtaactattagggaaaaaaaatctgccagtatccatcaaaaattaatccactaatcacatttttgggaatctagtttatatatgaaaaaaaccaaaaaggctctagtatgacaggatttgcaagaatgtttattatagcattcccgatagagacaaaagttgcaaaaacctccaagtgcatcaatagtagaataaacaccatgaaatatcatgcctttctaaaaagaatgcatgtgatctgtatgcactggcctcgagggatggccatgatatactgcgcataaaagcaaattgtactttgattagtgagtctcattccttgaaaagagaaaaaaaatagacagtgtttatgtatctgtatacatttgggcgtagaaactgcttttaatactgttcctttagaaatggtaagagatcggggttaactattatttatctttatataacttagtactgtctaagctgttttaaaaaaggggtatttttccattcttattaccttatttcaaaaatcagatactctaaactatgattcagagtcaagtagagagaagcagagagagaatgtcatagtctggtgtgctatttctgattctacataaggaatgtgataggtaataggataaatctttataggtctttatgggaagagcgaactctagataaactaaactctattagataaaagtgaaatttctggcttggcttaaaaatatactgtacttgcaaataatttag

SEQ ID NO: 268402 - DNA, 1301 bp, Homo sapiens
agcggagaggcgcagagagagctgggagctaaggggtggcggcgaccggaagcgcagtgcacacccccatggcccgggctttggtccagctctgggccatatgcatgctgcgagtggcgctggctaccgtctatttccaagaggaatttctagacggagagcattggagaaaccgatggttgcagtccaccaatgactcccgatttgggcattttagactttcgtcgggcaagttttatggtcataaagagaaagataaaggtctgcaaaccactcagaatggccgattctatgccatctctgcacgcttcaaaccgttcagcaataaagggaaaactctggttattcagtacacagtaaaacatgagcagaagatggactgtggagggggctacattaaggtctttcctgcagacattgaccagaagaacctgaatggaaaatcgcaatactatattatgtttggacccgatatttgtggatttgatatcaagaaagttcatgttattttacatttcaagaataagtatcacgaaaacaagaaactgatcaggtgtaaggttgatggcttcacacacctgtacactctaattttaagaccagatctttcttatgatgtgaaaattgatggtcagtcaattgaatccggcagcatagagtacgactggaacttaacatcactcaagaaggaaacgtccccggcagaatcgaaggattgggaacagactaaagacaacaaagcccaggactgggagaagcattttctggacgccagcaccagcaagcagagcgactggaacggtgacctggatggggactggccagcgccgatgctccagaagcccccgtaccaggatggcctgaaaccagaaggtattcataaagacgtctggctccaccgtaagatgaagaataccgactatttgacgcagtatgacctctcagaatttgagaacattggtgccattggcctggagctttggcaggtgagatctggaaccatttttgataactttctgatcacagatgatgaagagtatgcagataattttggcaaggccacctggggcgaaaccaagggtccagaaagggagatggatgccatacaggccaaggaggaaatgaagaaggcccgcgaggaagaggaggaagagctgctgtcgggaaaaattaacaggcacgaacattacttcaatcaatttcacagaaggaatgaactttagtgatccccattggatataaggatgactggtaaaatctcattgctactttaatctatgtttcaaactcaaatgtctaca

SEQ ID NO: 268403 - DNA, 1097 bp, Homo sapiens
agcggagaggcgcagagagagctgggagctaaggggtggcggcgaccggaagcgcagtgcacacccccatggcccgggctttggtccagctctgggccatatgcatgctgcgagtggcgctggctaccgtctatttccaagaggaatttctagacggagagcattggagaaaccgatggttgcagtccaccaatgactcccgatttgggcattttagactttcgtcgggcaagttttatggtcataaagagaaagataaaggacccgatatttgtggatttgatatcaagaaagttcatgttattttacatttcaagaataagtatcacgaaaacaagaaactgatcaggtgtaaggttgatggcttcacacacctgtacactctaattttaagaccagatctttcttatgatgtgaaaattgatggtcagtcaattgaatccggcagcatagagtacgactggaacttaacatcactcaagaaggaaacgtccccggcagaatcgaaggattgggaacagactaaagacaacaaagcccaggactgggagaagcattttctggacgccagcaccagcaagcagagcgactggaacggtgacctggatggggactggccagcgccgatgctccagaagcccccgtaccaggatggcctgaaaccagaaggtattcataaagacgtctggctccaccgtaagatgaagaataccgactatttgacgcagtatgacctctcagaatttgagaacattggtgccattggcctggagctttggcaggtgagatctggaaccatttttgataactttctgatcacagatgatgaagagtatgcagataattttggcaaggccacctggggcgaaaccaagggtccagaaagggagatggatgccatacaggccaaggaggaaatgaagaaggcccgcgaggaagaggaggaagagctgctgtcgggaaaaattaacaggcacgaacattacttcaatcaatttcacagaaggaatgaactttagtgatccccattggatataaggatgactggtaaaatctcattgctactttaatctatgtttcaaactcaaatgtctaca

SEQ ID NO: 268404 - DNA, 692 bp, Homo sapiens
tctgctggattaaatccaacctggggttcggaatgtttcacaagatgggatacaaactaaacttgaatttaacgaaaaattctgggaacggctagtgtcttttaaaatacagataggtgtaacattcccttttgaaactacagataaatttgagaattgtccttcattggagagcattattacagagcttagaacattttgttcccaatatattataagtggagtgtgggggtacctgcgagattaactgcacattttcctaagttatcaaatgcttttctgtgtctgaggaaattaaaagacatttttattttcaaaaataaaggtagcagttaagaaaaagcaaagcatacatatctatgtaatataaaaagagaaagcacatacagtgaaagattaacagttgggaccctcaggtgaagggtatctgcgtgttcactgcatgattttttccccaattcttctgtaggtttggagttttatatataaagagttgagggaaggctaaagtcaacagttttaatttagtactcggtctgatgatttgcttcaacctaacatctagctcatgatttaattacttcattactatacatgcctcatgacagatgctcttgtatacacaattcaggtaaaattgacttgaagtccactcagcgtcactgtatgtctaaaaataaagaagcttggaa

SEQ ID NO: 268405 - DNA, 454 bp, Homo sapiens
gaaaattgaaaaatgcagaaaactatgaaaaagaaaagatcccaccccagagataatctatttcctacctagataggcgtttgacaaaaatggctttgtattgttttgtagtatgcttacattttattctgttttcccgtgccaccaaatatccttccaaaacaattgtactgattgcatgatgtttcaaaattaaaggcaccataattaatttccccaaccttttcattgttcaacattttatacactcagatcttcagattccaagtccaccacaattaatgtgggctcctttctccggcctctgttccagtgtaatatgtcaggctccagaataatcttcctcagatgtcattgtccactgtccactaagaacatttagtggtggctttgccttgagtgtcaaatcccttaagaattaccttggccaacaaaagcaaaactccatctcaaa

SEQ ID NO: 268406 - DNA, 273 bp, Homo sapiens
ggcatgaattagaatcaaataatcttcctgtgtacatcttctagcatgacccacatccactgagaatgcctcatacatgcataaagctcaccagcgggtcctcccccttctctgcatgcatgccttatatgaaagtactgagcctagaatgtccggggcacaatcaccatccaataggcattgaaaacagagacaggcaggaccctcgggtctgcagttaggagtgtggacactctgcccatctccattgaattaaattccaaaccacaaata

SEQ ID NO: 268407 - DNA, 461 bp, Homo sapiens
cccatgttttttatattctctttgaactaggagttaggttgtctaagaataagtatagagaacatagagcgggtaaggaaattcatgagtatttcaaaataaatgttgtagaaattgaaagagtaacctatgaatttagggtataatttccttcagaaggactcaacagcctaggtttgtgaattcctaatggtcagacaataaggttgatatttgccctctgcacactcatcctttcattctcttgtttgttccatctttcataaataaaatgtgtgtcaagtatcttctatgtactgggcctgcaggacaacactgagcaagacaaacagcacccctgcctgtagagtcttataacagaagaaacaaacaacagaaaatcacaatagcaatgaataatatataggaggagttcatagtactatggagaaaatgtaagatgattgcctaatcctgactag

SEQ ID NO: 268408 - DNA, 631 bp, Homo sapiens
gcactgctgttggtagcacattttctactgggactcaggtaagctaatttctgtgttagggcctttccagagcttcacctccctcatgttttgtattcataagagagcacttcaggttcttactctgaacctttgcatttttatttttcacctatttttgaagagtcataatgtattaggtcccccttttcaaaagaaattggaaacagctacatttatttttagtactaggactctgctaactgtactctagaagcaagaagttgtatcttgatggcaaaaaatacttaaaaagcaatcctaagacctcacaagcagtttggggccacttagtgtcagagcaaacatcctgacccaagtgtcattcatgtcttaaagggatccctctgttatatcagttttcaataattagtgttgacagtaacatgagtaatattgtcagtaagaagattttaaaagtatgttccatatactctgtttaaggaaattacattcatggactttctttcccaatgatacaaatgttgagtattattcaatgagtgtgtgtacacacacatgcacacacccatgcgtgtctgtattcctctattggttacatcatgttattcttctatttaatttttatttg

SEQ ID NO: 268409 - DNA, 383 bp, Homo sapiens
acgtcgtgctctgcgcaagagggaagtcctgatttttggggtgccacaagcctgagacaaaacaaatttccattttcaaccagaatgaaattaagaaaacagataaaagccacatacaaaatctcattgagagtctttttgctttttaactataaaaatttacaactaaaatgaaaagtgcctcggaatgaaatattaaatccaagctggtgtctgtccacctgtccttaggaagtctcaacttacgaagtccactaaatttctcaaaaaagagttttatcactttgaatttgtcccctgcttaaaatcccccaaaatatacaatatctaataaaaatcagccttttacttataaaataaattcatttatcagcatgagaata

SEQ ID NO: 268410 - DNA, 343 bp, Homo sapiens
tcgcggccttggaagggtggttgatttactagatgaaccagataccaccggagaagtcttagatttcgttactttacttccttccagtttggaatgtacatgctcatcagctgagaaatttacaactaaaatgaaaagtgcctcggaatgaaatattaaatccaagctggtgtctgtccacctgtccttaggaagtctcaacttacgaagtccactaaatttctcaaaaaagagttttatcactttgaatttgtcccctgcttaaaatcccccaaaatatacaatatctaataaaaatcagccttttacttataaaataaattcatttatcagcatgagaata

SEQ ID NO: 268411 - DNA, 505 bp, Homo sapiens
cagaagaaaagaaataattagagcagaaataaaaaatgggacactgatagaaaaaagttatcaaaaccaaaaactaggtttgaaagattaaaaaaaaaaaaatggataaggctctagccaggctaattaagaagaaaagaggaaggacacaaattatctatatcagaaataaataaggagttgttactacagatcccatggatgctaaaatggacagttctatgtccacacagaggatcaatcacttgagagacataatttgtctaaactcatacatggagaaatagatgacctaaatatgtttacatttattacagaagttgaccttccaaaacagaaagcaccatgtcaagatggactcactggtgaattcaaccaaatatttaaggaaaaaattataccaattgtctataatttgttttagaagttagagccgagagaatacttcttaactcattctatgaggccagctttatcctaataggaaaatcagattaagacatca

SEQ ID NO: 268412 - DNA, 857 bp, Homo sapiens
ctggtaagactcacaggaaagcaagtcaataaagtaacttctctgccttgttgtttcaatggaaaagtgatgggagtgagaggaattttgtgagaaaaagattcattttctccctgtggtctggggattgctggcgagcccaaggcataagctgaaatctgttgattttatttacttgctgcttcttactgagccactgttggcagagttgaattgaaaaggtgctaagggaataactttctgattttttttttgagctggatattttgctagccaacctcagcacaggacacccagaagaaaaatgaacctacataaccacccggacttggatgtgaaatgtccactctgccttcgctgtgtgtgtgtatgccagagtccttcaatttgatggcattaaaaaaaaaaaaaaaaaaagacaggagacagctatggaaagagaatacaaaccatgacttttagacgtgagaaaggacagtaagccttcctttaatttaataagctcaggtgaaagaactagaggcaagtccaagtgtttgctgagatcatggaataatcagaactcttatactttaccggcaagaataatcaatttggaaaacagtttaacattatctagtgaggctgacacagacacaaggagatatgtgcaaaaatgtccatagcagcactatctgtagaagcaaaatactgaaaacaacccaaatgtccatcggcagtggaatgggtgaataacacgtatatgatgaaatactatgcagcaatgaaaaagaataagacacaattgagcatatcaacatgggtgaatctcacatacagcgttgaatagcaaaagtatgtttttgcaaaatacatac

SEQ ID NO: 268413 - DNA, 1721 bp, Homo sapiens
cggcacgagggtcttgctgtctgaggggggctgaggcagaagtattgcttgaacccaggaggcagaggttgcaatgagctgagatcgcatcactgcactcaagcctgggcaacagagcaagactgcgtctcaaaaaaacaaaacaaaacaaaacaaaaatccatgaacaagtggacctgcccagttcaaatcattgttgttcaagggtcaactgtatattattttcactggaagttttgaaattccagaaatatgcttggaaatccccgcttgaaatctccttggttggaaaccagtccagtgggtgactggcccagaatgatgcttctcctcggtggaccccctgggctgagcagcctgtgttcctgcctcaactcccctgaaccctcctgaactttctacacacatgtgggcactggctttgatactggcatttggaagggcacttgggaaattcagagaagtacccattattaagataaatgatgttttatcaatgaagcagacttttcatttctttttattgatcttcatgttttcacatcttgagatgcaatttgttagcacaggctgtcattccaagacacacaaatgtcattaaggcaaccgcttaaaggagtgtgatattttattgaggtagacaggacaatagataaatatttaatctgttacatgtttgctctgtgtggagccagggttggggctgcacaactctctggctgctatgtgtcttcctggaaaccctgtcaaaggccttaccgcctgcctggagaaacacagtgcctgcccttggcaaatatatgttggtgtatctgaaaaacagctcctggaagctttttctcattcaggctttaggggttaccccatctttccttatgtgtgtaatattggagaatgtacactctcactgaactggggatgtttgacttaaaatgatggacaataagatagtgagcagtaagtgtgctctaggctaggctacgagaggccatgagctcctcatctcttctctgttctgagctctctgatccactgcacttggggcagggggtgcattctctgtgcctctcctgagtctactttctgcatcattggttctcccagctcacttccataatgtcctcctaggctgcattggaattgtgtgttgtctagacccatggccaagactgtcattgcctgtgagggagaccaagctcaccaccaagggcttttgccagattgctttcatttacagaatttgcccattcatgtgtctttgtgtttatggattaaatggctttctgaccagcatccctttggtgtgctttgtcaataagatacagagctttctctcccattcttttcatgtgattccaattcccacatggcagcacagacccgccctaacactgatgaagtggaactccaaacaccatgggacaagaattcttgtcactgccctgggctggaccccaaacctctcacaatcagaatgcagtcaagtcagcgaatatttgtggaatgtctgttctgtcttcaaccccactctctgcacaaaatgggttgggaaagtctccgcacaaaatgggttgggaaagtccagggtctcttcccaaatgactctcccatcttagtggggatgacaggtgcagctcatttgaggtaattcaatgacatgatgagatagcatcagataccactgagggtccctagttagattcttccagaaaataccccag

SEQ ID NO: 268414 - DNA, 1776 bp, Homo sapiens
aatgggaatttggccctcaagcccaagatttcggcacgaggccaggtgtggtggtgcgtgcctgtaatcccagctactcggggggctgaggcagaagtattgcttgaacccaggaggcagaggttgcaatgagctgagatcgcatcactgcactcaagcctgggcaacagagcaagactgcgtctcaaaaaaacaaaacaaaacaaaacaaaaatccatgaacaagtggacctgcccagttcaaatcattgttgttcaagggtcaactgtatattattttcactggaagttttgaaattccagaaatatgcttggaaatccccgcttgaaatctccttggttggaaaccagtccagtgggtgactggcccagaatgatgcttctcctcggtggaccccctgggctgagcagcctgtgttcctgcctcaactcccctgaaccctcctgaactttctacacacatgtgggcactggctttgatactggcatttggaagggcacttgggaaattcagagaagtacccattattaagataaatgatgttttatcaatgaagcagacttttcatttctttttattgatcttcatgttttcacatcttgagatgcaatttgttagcacaggctgtcattccaagacacacaaatgtcattaaggcaaccgcttaaaggagtgtgatattttattgaggtagacaggacaatagataaatatttaatctgttacatgtttgctctgtgtggagccagggttggggctgcacaactctctggctgctatgtgtcttcctggaaaccctgtcaaaggccttaccgcctgcctggagaaacacagtgcctgcccttggcaaatatatgttggtgtatctgaaaaacagctcctggaagctttttctcattcaggctttaggggttaccccatctttccttatgtgtgtaatattggagaatgtacactctcactgaactggggatgtttgacttaaaatgatggacaataagatagtgagcagtaagtgtgctctaggctaggctacgagaggccatgagctcctcatctcttctctgttctgagctctctgatccactgcacttggggcagggggtgcattctctgtgcctctcctgagtctactttctgcatcattggttctcccagctcacttccataatgtcctcctaggctgcattggaattgtgtgttgtctagacccatggccaagactgtcattgcctgtgagggagaccaagctcaccaccaagggcttttgccagattgctttcatttacagaatttgcccattcatgtgtctttgtgtttatggattaaatggctttctgaccagcatccctttggtgtgctttgtcaataagatacagagctttctctcccattcttttcatgtgattccaattcccacatggcagcacagacccgccctaacactgatgaagtggaactccaaacaccatgggacaagaattcttgtcactgccctgggctggaccccaaacctctcacaatcagaatgcagtcaagtcagcgaatatttgtggaatgtctgttctgtcttcaaccccactctctgcacaaaatgggttgggaaagtctccgcacaaaatgggttgggaaagtccagggtctcttcccaaatgactctcccatcttagtggggatgacaggtgcagctcatttgaggtaattcaatgacatgatgagatagcatcagataccactgagggtccctagttagattcttccagaaaataccccag

SEQ ID NO: 268415 - DNA, 1922 bp, Homo sapiens
gcaggtctgatgcgaagtatgcttaaaccaggcggcagaggatagcaatgagctgagatcaggtggctcacacctgtaatcccagcactttgggaggccgagacggacagatcacaaggtcaggagattgagactatcctggctaatatggtgaaaccccgtctgtactaaaaatacaaaaaattagccaggtgtggtggtgcgtgcctgtaatcccagctactcggggggctgaggcagaagtattgcttgaacccaggaggcagaggttgcaatgagctgagatcgcatcactgcactcaagcctgggcaacagagcaagactgcgtctcaaaaaaacaaaacaaaacaaaacaaaaatccatgaacaagtggacctgcccagttcaaatcattgttgttcaagggtcaactgtatattattttcactggaagttttgaaattccagaaatatgcttggaaatccccgcttgaaatctccttggttggaaaccagtccagtgggtgactggcccagaatgatgcttctcctcggtggaccccctgggctgagcagcctgtgttcctgcctcaactcccctgaaccctcctgaactttctacacacatgtgggcactggctttgatactggcatttggaagggcacttgggaaattcagagaagtacccattattaagataaatgatgttttatcaatgaagcagacttttcatttctttttattgatcttcatgttttcacatcttgagatgcaatttgttagcacaggctgtcattccaagacacacaaatgtcattaaggcaaccgcttaaaggagtgtgatattttattgaggtagacaggacaatagataaatatttaatctgttacatgtttgctctgtgtggagccagggttggggctgcacaactctctggctgctatgtgtcttcctggaaaccctgtcaaaggccttaccgcctgcctggagaaacacagtgcctgcccttggcaaatatatgttggtgtatctgaaaaacagctcctggaagctttttctcattcaggctttaggggttaccccatctttccttatgtgtgtaatattggagaatgtacactctcactgaactggggatgtttgacttaaaatgatggacaataagatagtgagcagtaagtgtgctctaggctaggctacgagaggccatgagctcctcatctcttctctgttctgagctctctgatccactgcacttggggcagggggtgcattctctgtgcctctcctgagtctactttctgcatcattggttctcccagctcacttccataatgtcctcctaggctgcattggaattgtgtgttgtctagacccatggccaagactgtcattgcctgtgagggagaccaagctcaccaccaagggcttttgccagattgctttcatttacagaatttgcccattcatgtgtctttgtgtttatggattaaatggctttctgaccagcatccctttggtgtgctttgtcaataagatacagagctttctctcccattcttttcatgtgattccaattcccacatggcagcacagacccgccctaacactgatgaagtggaactccaaacaccatgggacaagaattcttgtcactgccctgggctggaccccaaacctctcacaatcagaatgcagtcaagtcagcgaatatttgtggaatgtctgttctgtcttcaaccccactctctgcacaaaatgggttgggaaagtctccgcacaaaatgggttgggaaagtccagggtctcttcccaaatgactctcccatcttagtggggatgacaggtgcagctcatttgaggtaattcaatgacatgatgagatagcatcagataccactgagggtccctagttagattcttccagaaaataccccag

SEQ ID NO: 268416 - DNA, 1706 bp, Homo sapiens
gattggcattatcacgaactcttgctcggtacccccaatcaacatccaacccgttgcaatgagctgagatcgcatcactgcactcaagcctgggcaacagagcaagactgcgtctcaaaaaaacaaaacaaaacaaaacaaaaatccatgaacaagtggacctgcccagttcaaatcattgttgttcaagggtcaactgtatattattttcactggaagttttgaaattccagaaatatgcttggaaatccccgcttgaaatctccttggttggaaaccagtccagtgggtgactggcccagaatgatgcttctcctcggtggaccccctgggctgagcagcctgtgttcctgcctcaactcccctgaaccctcctgaactttctacacacatgtgggcactggctttgatactggcatttggaagggcacttgggaaattcagagaagtacccattattaagataaatgatgttttatcaatgaagcagacttttcatttctttttattgatcttcatgttttcacatcttgagatgcaatttgttagcacaggctgtcattccaagacacacaaatgtcattaaggcaaccgcttaaaggagtgtgatattttattgaggtagacaggacaatagataaatatttaatctgttacatgtttgctctgtgtggagccagggttggggctgcacaactctctggctgctatgtgtcttcctggaaaccctgtcaaaggccttaccgcctgcctggagaaacacagtgcctgcccttggcaaatatatgttggtgtatctgaaaaacagctcctggaagctttttctcattcaggctttaggggttaccccatctttccttatgtgtgtaatattggagaatgtacactctcactgaactggggatgtttgacttaaaatgatggacaataagatagtgagcagtaagtgtgctctaggctaggctacgagaggccatgagctcctcatctcttctctgttctgagctctctgatccactgcacttggggcagggggtgcattctctgtgcctctcctgagtctactttctgcatcattggttctcccagctcacttccataatgtcctcctaggctgcattggaattgtgtgttgtctagacccatggccaagactgtcattgcctgtgagggagaccaagctcaccaccaagggcttttgccagattgctttcatttacagaatttgcccattcatgtgtctttgtgtttatggattaaatggctttctgaccagcatccctttggtgtgctttgtcaataagatacagagctttctctcccattcttttcatgtgattccaattcccacatggcagcacagacccgccctaacactgatgaagtggaactccaaacaccatgggacaagaattcttgtcactgccctgggctggaccccaaacctctcacaatcagaatgcagtcaagtcagcgaatatttgtggaatgtctgttctgtcttcaaccccactctctgcacaaaatgggttgggaaagtctccgcacaaaatgggttgggaaagtccagggtctcttcccaaatgactctcccatcttagtggggatgacaggtgcagctcatttgaggtaattcaatgacatgatgagatagcatcagataccactgagggtccctagttagattcttccagaaaataccccag

SEQ ID NO: 268417 - DNA, 2670 bp, Homo sapiens
ctctgggcatcccgtcctcctcctgctgctgctgatggacaggcactcctggactacccccagcctctccacaatgtgtcctgagaagagctaggggaactggacagagtggacgaggctccatgtgtggagggaatgaaataaggggcctaccaggccagaacgctgatccatggagaccagtgcttccagccctctcacctcggaggaggactcctgttttaccaacggcaggagcaggaatcccaccattcagcctgtgggcttgacaaactataagcaagcctcctggatgtggaataatacattttcaaaattcatactaatcagcatgaactataactgctccaatgcccaccacattatataaaatctaccaaaagggggtcacttaatgtttcacaatgtttggtgaaacaactttcatatgaaagtacggttgatccttgaatgatatgggcaccgacccctgagcagctgaaaatttgcatgtaacttgactcccccaaaacgtaactataatactaatagccttactgaacacggtcaattaacacatagctagtatgttatgtgcattatatactatatccttaccatacggtaagctagagaaaaaatgttactaagaaaaacataagcaagagaaaatatatttactattaagtgaaagcaggtcatcataaagtcctcatcctcatggtcatcacattgagtaggcggaggaggaggaggaggaggaggagtaggggttggtcttgctgtctgaggggtggcagaggcagaaaaaaaatccatgggccgagcacggtggctcacacctgtaatcccagcactttgggaggccgagacggacagatcacaaggtcaggagattgagactatcctggctaatatggtgaaaccccgtctgtactaaaaatacaaaaaattagccaggtgtggtggtgcgtgcctgtaatcccagctactcggggggctgaggcagaagtattgcttgaacccaggaggcagaggttgcaatgagctgagatcgcatcactgcactcaagcctgggcaacagagcaagactgcgtctcaaaaaaacaaaacaaaacaaaacaaaaatccatgaacaagtggacctgcccagttcaaatcattgttgttcaagggtcaactgtatattattttcactggaagttttgaaattccagaaatatgcttggaaatccccgcttgaaatctccttggttggaaaccagtccagtgggtgactggcccagaatgatgcttctcctcggtggaccccctgggctgagcagcctgtgttcctgcctcaactcccctgaaccctcctgaactttctacacacatgtgggcactggctttgatactggcatttggaagggcacttgggaaattcagagaagtacccattattaagataaatgatgttttatcaatgaagcagacttttcatttctttttattgatcttcatgttttcacatcttgagatgcaatttgttagcacaggctgtcattccaagacacacaaatgtcattaaggcaaccgcttaaaggagtgtgatattttattgaggtagacaggacaatagataaatatttaatctgttacatgtttgctctgtgtggagccagggttggggctgcacaactctctggctgctatgtgtcttcctggaaaccctgtcaaaggccttaccgcctgcctggagaaacacagtgcctgcccttggcaaatatatgttggtgtatctgaaaaacagctcctggaagctttttctcattcaggctttaggggttaccccatctttccttatgtgtgtaatattggagaatgtacactctcactgaactggggatgtttgacttaaaatgatggacaataagatagtgagcagtaagtgtgctctaggctaggctacgagaggccatgagctcctcatctcttctctgttctgagctctctgatccactgcacttggggcagggggtgcattctctgtgcctctcctgagtctactttctgcatcattggttctcccagctcacttccataatgtcctcctaggctgcattggaattgtgtgttgtctagacccatggccaagactgtcattgcctgtgagggagaccaagctcaccaccaagggcttttgccagattgctttcatttacagaatttgcccattcatgtgtctttgtgtttatggattaaatggctttctgaccagcatccctttggtgtgctttgtcaataagatacagagctttctctcccattcttttcatgtgattccaattcccacatggcagcacagacccgccctaacactgatgaagtggaactccaaacaccatgggacaagaattcttgtcactgccctgggctggaccccaaacctctcacaatcagaatgcagtcaagtcagcgaatatttgtggaatgtctgttctgtcttcaaccccactctctgcacaaaatgggttgggaaagtctccgcacaaaatgggttgggaaagtccagggtctcttcccaaatgactctcccatcttagtggggatgacaggtgcagctcatttgaggtaattcaatgacatgatgagatagcatcagataccactgagggtccctagttagattcttccagaaaataccccag

SEQ ID NO: 268418 - DNA, 2851 bp, Homo sapiens
gctgggctagaggctgagcacctttggaaccaacatttaagggaatgtgagcacaatgcataatgtctttaaaaagcatgttgtgatgtacacattttgtaattaccttttttgttgttttgtagcaaccatttgtaaaacattccaaataattccacagtcctgaagcagcaggaggaggacctcctgctgctgtcctcctcctgctgctgctgatggacaggcactcctggactacccccagcctctccacaatgtgtcctgagaagagctaggggaactggacagagtggacgaggctccatgtgtggagggaatgaaataaggggcctaccaggccagaacgctgatccatggagaccagtgcttccagccctctcacctcggaggaggactcctgttttaccaacggcaggagcaggaatcccaccattcagcctgtgggcttgacaaactataagcaagcctcctggatgtggaataatacattttcaaaattcatactaatcagcatgaactataactgctccaatgcccaccacattatataaaatctaccaaaagggggtcacttaatgtttcacaatgtttggtgaaacaactttcatatgaaagtacggttgatccttgaatgatatgggcaccgacccctgagcagctgaaaatttgcatgtaacttgactcccccaaaacgtaactataatactaatagccttactgaacacggtcaattaacacatagctagtatgttatgtgcattatatactatatccttaccatacggtaagctagagaaaaaatgttactaagaaaaacataagcaagagaaaatatatttactattaagtgaaagcaggtcatcataaagtcctcatcctcatggtcatcacattgagtaggcggaggaggaggaggaggaggaggagtaggggttggtcttgctgtctgaggggtggcagaggcagaaaaaaaatccatgggccgagcacggtggctcacacctgtaatcccagcactttgggaggccgagacggacagatcacaaggtcaggagattgagactatcctggctaatatggtgaaaccccgtctgtactaaaaatacaaaaaattagccaggtgtggtggtgcgtgcctgtaatcccagctactcggggggctgaggcagaagtattgcttgaacccaggaggcagaggttgcaatgagctgagatcgcatcactgcactcaagcctgggcaacagagcaagactgcgtctcaaaaaaacaaaacaaaacaaaacaaaaatccatgaacaagtggacctgcccagttcaaatcattgttgttcaagggtcaactgtatattattttcactggaagttttgaaattccagaaatatgcttggaaatccccgcttgaaatctccttggttggaaaccagtccagtgggtgactggcccagaatgatgcttctcctcggtggaccccctgggctgagcagcctgtgttcctgcctcaactcccctgaaccctcctgaactttctacacacatgtgggcactggctttgatactggcatttggaagggcacttgggaaattcagagaagtacccattattaagataaatgatgttttatcaatgaagcagacttttcatttctttttattgatcttcatgttttcacatcttgagatgcaatttgttagcacaggctgtcattccaagacacacaaatgtcattaaggcaaccgcttaaaggagtgtgatattttattgaggtagacaggacaatagataaatatttaatctgttacatgtttgctctgtgtggagccagggttggggctgcacaactctctggctgctatgtgtcttcctggaaaccctgtcaaaggccttaccgcctgcctggagaaacacagtgcctgcccttggcaaatatatgttggtgtatctgaaaaacagctcctggaagctttttctcattcaggctttaggggttaccccatctttccttatgtgtgtaatattggagaatgtacactctcactgaactggggatgtttgacttaaaatgatggacaataagatagtgagcagtaagtgtgctctaggctaggctacgagaggccatgagctcctcatctcttctctgttctgagctctctgatccactgcacttggggcagggggtgcattctctgtgcctctcctgagtctactttctgcatcattggttctcccagctcacttccataatgtcctcctaggctgcattggaattgtgtgttgtctagacccatggccaagactgtcattgcctgtgagggagaccaagctcaccaccaagggcttttgccagattgctttcatttacagaatttgcccattcatgtgtctttgtgtttatggattaaatggctttctgaccagcatccctttggtgtgctttgtcaataagatacagagctttctctcccattcttttcatgtgattccaattcccacatggcagcacagacccgccctaacactgatgaagtggaactccaaacaccatgggacaagaattcttgtcactgccctgggctggaccccaaacctctcacaatcagaatgcagtcaagtcagcgaatatttgtggaatgtctgttctgtcttcaaccccactctctgcacaaaatgggttgggaaagtctccgcacaaaatgggttgggaaagtccagggtctcttcccaaatgactctcccatcttagtggggatgacaggtgcagctcatttgaggtaattcaatgacatgatgagatagcatcagataccactgagggtccctagttagattcttccagaaaataccccag

SEQ ID NO: 268419 - DNA, 500 bp, Homo sapiens
ctctgggcatcccgtcctcctcctgctgctgctgatggacaggcactcctggactacccccagcctctccacaatgtgtcctgagaagagctaggggaactggacagagtggacgaggctccatgtgtggagggaatgaaataaggggcctaccaggccagaacgctgatccatggagaccagtgcttccagccctctcacctcggaggaggactcctgttttaccaacggcaggagcaggaatcccaccattcagcctgtgggcttgacaaactataagcaagcctcctggatgtggaataatacattttcaaaattcatactaatcagcatgaactataactgctccaatgcccaccacattatataaaatctaccaaaagggggtcacttaatgtttcacaatgtttggtgaaacaactttcatatgaaagtacggttgatccttgaatgatatgggcaccgacccctgagcagcaggaggaggacgggtacagcag

SEQ ID NO: 268420 - DNA, 708 bp, Homo sapiens
cttctcctaatctataagcagcaagagcagatgtgcttgtaagaaacaaagatcttgttttcatacaaatgcgctcaaaataaaacacaaaggaagaaaaatacccagagcacataatgcaaagaacaagaattgcttctaaatagaatgttttacaaagttttccataaagcctcagctgctcctcaagccacaaccggcttgaacatggatggcagacatgaaattacagtattcacaaaattagtattcagtttgcagaatctctctttccaaagccttcaggcatactttatgcatgcacaattacagaagcaggaaaatcacatggagagtgaaaatatcagaaagtcgctaatgttgggcttagaactgatcaaagagttttgtgtacgatagactgcctaatggtaccaggcctgacagcctgcagtgtccccctcacatcaagaatgacctctgaaggcaatatttccaaagacttgcggcttaacaggattgttaagcaagtgattagactttgctttactgtgaaagaattttggtttataaagagttgaagcttctcacaaacactggtgccaatctaggtcaacaggagtaagtgagaccattgttccatatcccgcttaaaaagagaacactacttcaaagacaagaacaacatcacctgacaaaaataaaagaagttatcggttttaaaacatt

SEQ ID NO: 268421 - DNA, 808 bp, Homo sapiens
cttctcctaatctataagcagcaagagcagatgtgcttgtaagaaacaaagatcttgttttcatacaaatgcgctcaaaataaaacacaaaggaagaaaaatacccagagcacataatgcaaagaacaagaattgcttctaaatagaatgttttacaaagttttccataaagcctcagctgctcctcaagccacaaccggcttgaacatggatggcagacatgaaattacagtattcacaaaattagtattcagtttgcagaatctctctttccaaagccttcaggcatactttatgcatgcacaattacagaagcagcctgactctttgatcattctctggtattatcccttcatttcacataggaagaaacaaggacaagagcaatgaagtcacccaatcagagtaaaacagtcaggaaaatcacatggagagtgaaaatatcagaaagtcgctaatgttgggcttagaactgatcaaagagttttgtgtacgatagactgcctaatggtaccaggcctgacagcctgcagtgtccccctcacatcaagaatgacctctgaaggcaatatttccaaagacttgcggcttaacaggattgttaagcaagtgattagactttgctttactgtgaaagaattttggtttataaagagttgaagcttctcacaaacactggtgccaatctaggtcaacaggagtaagtgagaccattgttccatatcccgcttaaaaagagaacactacttcaaagacaagaacaacatcacctgacaaaaataaaagaagttatcggttttaaaacatt

SEQ ID NO: 268422 - DNA, 700 bp, Homo sapiens
tgatgttccagttataaacaatggtgcttagtacatagaaggtctaaaatgatatttattgaatagatgagtggaagcagtgcactgttctccaaatgtctggactctttcatgtttgcattttaaaaatagatgctgttgttttgtagatttgtttaaaaacatcttggtattaagactgacatctattcttttataacactttacatgtggtcatgtacccacagatttaggctgttttattttatagttttcactacagtttatttcacctgattatttcatttgggtctctaaaatcacattatgaaataccttaattatttaaattaggaacagattaattatctccagtgtacaaactcaaattaatttcattataaacctgaagtttaaattgattaatcttggagtgtttaaggaataaaatgggtttttcttcatccttaaggagaaaggcatatttgatttgatgagtctctcttcatcacaccagttatgatactaggcacaagatatttgcaagaaaacttcagatggattttataaaccagccagaaacctgtgtgtctggggcttctgggggaacaatctgtgagtcattttaaaaaacaaacacactcataatcacggtgcatgttgttaccatggtaattaggcctgttgagttggcttgcttatgttcctgcaaaagcaagag

SEQ ID NO: 268423 - DNA, 386 bp, Homo sapiens
tagtttttcaggttcctttgggtccccttggctgagagtggagtccattcggtcagctgggggaatttagacttttacttttggtttacaggtgaataacaacatcaagaagaaaatggaagctatcagaaaagcctctaccatccccaccacatctacctgtctacctgtgtgtgttcctaaactccagcttctctcatgaaagaactctccatgcatctggcttaaggtcatcccatccctgatctccacttaagagaatggattaatccaaaagaacgaatcttctcaagaagaaactttgtcagcactcaaaagaaacaatgttttttatatgtagttctcataattgtttgtggtaattaaaaaaaaatcattgacgaatt

SEQ ID NO: 268424 - DNA, 622 bp, Homo sapiens
ccccgactagcccgacagtccccgactagcccgacagtccccgactagcccgacagcctccaccagcccggctcctgcctcacgctggcccctctgggcccagctcatgcctcgcggtggcctctccgggcccagctcccacccagcctgacggcgcctcccggccccaagctgccttcctcgatgtggcccaaagtggcccaaagcgtcccaaagtaggcctcgccaggcccacctcctgcccggcgtaggccctgaggggcgcggcccctgccccatactggcctcttttgggccctctcttacaccagcccctgtctcaggattgtctcttcacgcccatcttctgcctcatagtggtcactcaaggcctcgcttttgcctgatgattgcgttttctggttttgctcttgccttgtattcccttcttcgggatacagcttttacgtcttccatggtgaacctcatcaaggagactaaatcttccctggtctgtcatttttttcacttcacaccagagtgccttgggaaaaccccatctcttcttttaaccttgagagtggatttctgacgaattgataataaattttttctctgtggtttcagtgatttctgttttatt

SEQ ID NO: 268425 - DNA, 608 bp, Homo sapiens
  misc_feature (308)..(308): n is a, c, g, or t
  misc_feature (343)..(344): n is a, c, g, or t
  misc_feature (366)..(366): n is a, c, g, or t
  misc_feature (373)..(373): n is a, c, g, or t
  misc_feature (404)..(404): n is a, c, g, or t
cacgaggcgtcaaaatcctgctgacttgagatgcactgtgctgcatgttttccccgggcacagcaggctaataatcctgttacaaagagaaatgctgtacatttcgagcagtgctggcccctggggctcaccgcggccttttctaagtgcttacagactctctgtttaataatccattccagaaattttccagggctcattgttgagcttggtgttcgcaactttgagtgatcagcccttctcctttgtgggagcaccaggacagagcagcctttgtccctccccagtctcagttccctcccactgcncctgtggacctcgaatgcagagcttatgcacctanngaaggtcgtgtcagcacccaangcagaangaggctgccctgggaactagggtcaattaanacagcttgtgctggaggaccctttacagcagatgaaggcctctccccagccagaaaagatggagcacacgctgggtggtggccccgcttcctcactggaaggagatggtgctcttcttttttctttctgaattgtggccaccttcataccagtctgtcatggaacacttaagccgcttgagtgtctgctggtactcccagccct

SEQ ID NO: 268426 - DNA, 211 bp, Homo sapiens
gtgtttatgtgggtgcatatgtggatgttggctccagttgatggcaagctgatttctagcagtatttgataaaaaaattccagttcctcaaattaagttgaatagttatgttacgtttttgccacaaaggatttcacatgtgggtccaaagacaggacattcctaaacacgttttcccatgaatactaagaaaaccacaaaaccctccaga

SEQ ID NO: 268427 - DNA, 355 bp, Homo sapiens
aaccaccctacttcatgccctgtctctctgtccaaacaccaggacagtcctctcaccagtctcaaccacccaatggattgacaaaggtgcaaatatgattcagtggagaaggcattctcttgtcaacaaattgtgtagaaacaacttttttttacacaattttttttttatccccaaaggaaaaaaattcacctgaacctcaatactaactcaaaaactaactcaaaatggattatgcaactaaatataaactataaaactagaaaaagtatagcagaaaatataagacaaaatcttcatgacacagagttaggtaaagtgttctttattatcaataaacacaaaccattaaaga

SEQ ID NO: 268428 - DNA, 670 bp, Homo sapiens
catcttcatttacaacccagtttattaacttatcctctctaggcaactttcctcttgtccatgcccttatgccgtatcatccagaaatatataacatactgcttcagctgcacagaggtaaatgagctgataaaacagccaaagattctgagataaatgaaaaaggctcccacacaatcaaatgaatgaccatgactaagggcatctcacatgagcatagatgattaaataccaagtccctgaaccgctatcactagaaggtatagaaaatgaattttctgtaagagttcacatctttaagcaatgagagatgcattttcaagctgaactcacctgaatgtcactctctgtcaacaaaagccatggaggtaaccaacaacctcttctttctacagtacagaacagagaagggcaagaggaggagcaggtgtagcagagaggcaacactaggacacgttgtttctgaagtgatttacgaatgacaagtagaagtagtgaatacaaaatgaaaattagaggaggtagttcttccagttgtttaaaaagagagagaaataagcaacagctgcagcttgtgttctgctatttgaaggtgaactcttcctttagaatttcagacttttagcaacagcttagcggttgaaactacagaaatgatgttgatacactt

SEQ ID NO: 268429 - DNA, 134 bp, Homo sapiens
agcccatgacagagttgtgattcagagatatgaagagtaaaatcaatgtgaattaaagtgataatctgttttgctggtagtttatatgtggtaaagcagtctattaaatgagagaccttagggaggcagctttg

SEQ ID NO: 268430 - DNA, 144 bp, Homo sapiens
gtttgctacctcttgcactaattcttcttataaaataaccagtaaagcctcttcttcaaacccagcaccaggagtgaggcctttacctcctctaggacctgacactaggaacccactgttgcctttgtcctggtggctgaccag

SEQ ID NO: 268431 - DNA, 453 bp, Homo sapiens
taggcattaccctttggccattttcaaagtgagcctttttgggaactgtcatcttaatttagggcaacaaaaattattttcaataaaaataatagtagagccccattctttgtgtctgaattctaagatactcttttaggatcctatagtttaagaaacagattaccggccgggtatggtggctcacgcctgtaatcccagcacattgggaggccgaggtgggcagattacgagatcaggagatcgagaccatcttggctaacatggtgaaactccgtctctactaaaaatacaaaaaaattagccgggcgtggtggtgggtgcctgtagtcccagctactccagaggctgagacaggagaatggcgtgaacccaggaggcggagcttgcaatgagcggagatcgcgccactgcactccagcctgggaaacagagctagactccgtctcaaag

SEQ ID NO: 268432 - DNA, 552 bp, Homo sapiens
attctacctaagtatatacaatgaaaaagtataggaatttagatgacattgagttttaaattttaaattgagttttgaagtacatatagaaatttattcagcaaagggatgagagagggacaatggcagtacaagggcacagtttaccaggaactacttagcctggctggaatgtataatgtgaagtggagaaagctttggggtattgaggctgaggcaggagaatcgcttgaaccctggaggcagaggttgcatgagccgggattgcgccactgcattccagcctggcaacagagtaagactctgtctcaaaaaaaaaaaaaaaaaaaaaaaaaaaggatacttaatgaattcaaatcccataattgaagactttctgtgatgatttttttttaagaaatctactcttcagacaggcctattctatctataagttgctgctcttcttcgcagcttctcctttgcctctgttcctgaaaccacacacaggatttcttctgtagattctcattggttgcaagggctttggtgctaagggagccatatgtgtat

SEQ ID NO: 268433 - DNA, 424 bp, Homo sapiens
ggcaccccgccagcagccagctgtgacattgtaccctgccagctttgtgaaggccctgctcgcgggattgtctcagctctgttgacaaccacctcctgcccggccaatgtcccattccaattgtcctcaacttcccttgtttaatgctgttttgcaaattattaagcactggaagtctgttaatcacagttcacgtcccgtgtaaggccacacagggtaggcagggctcggggggaggcctgctggcaggactgaatgtcttgggtggtggcccattcacacccctaacgagatcattaccactaactaaatacaggcctggccttgtgaccctctggggaatcgagtgggctggtgcgggacatcagtatcgtctccaactcccactgcactgccttccagcactgaaagctaagcccgggat

SEQ ID NO: 268434 - DNA, 629 bp, Homo sapiens
  misc_feature (391)..(391): n is a, c, g, or t
aggagatagggactcactgaattttctggagagcagcactgacaacgcctaagtagagggctttcaaaaggaaagagcggttagtgatagcaaacgctcaggaggataaagaaaatgaggccgctgagtttacctagggggaagtcagtttcagtagactcaagggggccaaagtgaccctggtggagattcagaagggactgtgtgtctggataccccctcccaacacccccaccgcaggagagctacatttccccctctcccctcagcccactggtccctcccattgtctaccttcctgccttcactcccagttcctcagtgctgaccaccaagttggtggtctccttgggtggcatggctgaatcactcttccccggtgggaaaggtnggggtagtctctcagcagggtgcagctcctcagcggaggccaggcccacccaggctggccagcccactgtgagagcagcctgcactgacaatgcgtctgcctggcaggtgcaggagaaccaaggtgctgctctggcaatgacagcctcacaggccctaaggttgcagctgaactagggaaatatattttacttgacatctgaatgccatggttccagggggcagaaggcgagctggga

SEQ ID NO: 268435 - DNA, 152 bp, Homo sapiens
aggcctcaaggacgtgttgacatagctgggagtctcgatggtccatctctgtcatttaacagctctgtagggttccctgctgtagccccagtgcccactcacaggtatttgttgaacaggtgaaaaagatactcaacaaatggtgactctca

SEQ ID NO: 268436 - DNA, 342 bp, Homo sapiens
aaataaggtcattgtagatgtaactaattaaaatgaggacaggaaggccggcacggtggctcacgcctgtaatcccagcgctttgggaggccgaggaggggggattacgaggtcaggagatcgagaccatcctggataacacggtgaaaccccgtctctactaaaaaatacaaaaaattagccgggcgtggtggcgggcgcctgtagtcccagctactcaggaggctgaggtaggagaatggcgtgaacccgggaggcagagcttgcagcgagctgagatggcaccactgcactccagcctgggcgacagagcgagactctgtctcaaaaaaataagtaaat

SEQ ID NO: 268437 - DNA, 355 bp, Homo sapiens
caataagggctgatattcagccagtatgcatcagtacagataatgttagctgttagaatactgaagtagtttcactgtggttggtaactaactgctgtttacaccactgtgcggactgtctctttcactgtccaggccactctccagaatgccccatgatccaacaaataacacagttactccccagcacaagtgaccttcaggaccccgctccatccataaataggcatcctttctgattagctagttcttgtacaagtcagtcccgcaaaatcttcccagttaaacactacctacaatcttatttatacttaattggcagagctaacattcaaacccaggcagcccaacaaag

SEQ ID NO: 268438 - DNA, 1068 bp, Homo sapiens
gaaggctgggctgggggaagaggcgtggcggcgctgtgcgcgtgcacaaaagagagctgaggggcgggggcgctgcggcacagctggtttgagcaactgaactggaaacaagatgcaggaccccaacgcagacactgaatggaatgacatcttacgcaaaaagggtatcttaccccccaaggaaagtctgaaagaattggaagaggaggcagaagaggagcagcgcatcctccagcagtcagtggtgaaaacatatgaagatatgactttggaagagctggaggatcatgaagacgagtttaatgaggaggatgaacgtgctattgaaatgtacagacggcggagactggctgagtggaaagcaactaaactgaagaataaatttggagaagttttggagatctcagggaaggattatgttcaagaagttaccaaagctggcgagggcttgtgggtcatcttgcacctttacaaacaaggaattcccctctgtgccctgataaatcagcacctcagtggacttgccaggaagtttcctgatgtcaaatttatcaaagccatttcaacaacctgcatacccaattatcctgataggaatctgcccacgatatttgtttacctggaaggagatatcaaggctcagtttattggtcctctggtgtttggcggcatgaacctgacaagagatgagttggaatggaaactgtctgaatctggagcaattatgacagacctggaggaaaaccctaagaagccgattgaagacgtgttgctgtcctcagtgcggcgctctgtcctcatgaagagggacagcgattccgagggtgactgaggctacagcttctatcacatgccgaactttcttgtgacaaattgtctggattttttaaaaaaggaaaaagcaagaatgaatccttgtggtttttagttttgtataaattatgtttcaaatctttacattttggaaataatcattgctggagattctgttaaatattttggaactcttttttttttaaattatagtatttcctctaaaaaaaattaaaaccagccatttgtatggca

SEQ ID NO: 268439 - DNA, 1566 bp, Homo sapiens
gaaggctgggctgggggaagaggcgtggcggcgctgtgcgcgtgcacaaaagagagctgaggggcgggggcgctgcggcacagctggtttgagcaactgaactggaaacaagatgcaggaccccaacgcagacactgaatggaatgacatcttacgcaaaaagggtatcttaccccccaaggaaagtctgaaagaattggaagaggaggcagaagaggagcagcgcatcctccagcagtcagtggtgaaaacatatgaagatatgactttggaagagctggaggatcatgaagacgagtttaatgaggaggatgaacgtgctattgaaatgtacagacggcggagactggctgagtggaaagcaactaaactgaagaataaatttggagaagttttggagatctcagggaaggattatgttcaagaagttaccaaagctggcgagggcttgtgggtcatcttgcacctttacaaacaaggaattcccctctgtgccctgataaatcagcacctcagtggacttgccaggaagtttcctgatgtcaaatttatcaaagccatttcaacaacctgcatacccaattatcctgataggaatctgcccacgatatttgtttacctggaaggagatatcaaggctcagtttattggtcctctggtgtttggcggcatgaacctgacaagagatgagttggaatggaaactgtctgaatctggagcaattatgacagacctggaggaaaaccctaagaagccgattgaagacgtgttgctgtcctcagtgcggcgctctgtcctcatgaagagggacagcgattccgagggtgactgaggctacagcttctatcacatgccgaactttcttgtgacaaattgtctggattttttaaaaaaggaaaaagcaagaatgaatccttgtggtttttagttttgtataaattatgtttcaaatctttacattttggaaataatcattgctggagattctgttaaatattttggaactcttttttttttaaattatagtatttcctctaaaaaaaattaaaaccagccatttgtatggcaaatgtctgttttcctcatttatattttaagtaagccataaaacctagtcactattttttgacatataactataaaaagaaatacagttttaaatgtgaataaattatacagtggaaaaaaaaaaaaaaaaaaaaaaaaaaaaaagggggggggggcaaaaataacccgggggggccaagtttggttaccggttttttttcaaagggggcccctaagggagggaataaaaagagggaggggcgccggttaacaccgctgggcgtggacacacggccgctggactctggaaaggacctcctctgtgggtgtccttcgccccccccaggaaatataggccaggcaaaataacttcaggtcacgggtaccaggcaatctggctaaatgcccgggcgattaaatgcgcgcactaaataagcaaacagagaaaatgaccacaaaacaccaggacaatacactgacacaccaccacgccacctcaaactaatcctccctctaata

SEQ ID NO: 268440 - DNA, 1512 bp, Homo sapiens
gaaggctgggctgggggaagaggcgtggcggcgctgtgcgcgtgcacaaaagagagctgaggggcgggggcgctgcggcacagctggtttgagcaactgaactggaaacaagatgcaggaccccaacgcagacactgaatggaatgacatcttacgcaaaaagggtatcttaccccccaaggaaagtctgaaagaattggaagaggaggcagaagaggagcagcgcatcctccagcagtcagtggtgaaaacatatgaagatatgactttggaagagctggaggatcatgaagacgagtttaatgaggaggatgaacgtgctattgaaatgtacagacggcggagactggctgagtggaaagcaactaaactgaagaataaatttggagaagttttggagatctcagggaaggattatgttcaagaagttaccaaagctggcgagggcttgtgggtcatcttgcacctttacaaacaaggaattcccctctgtgccctgataaatcagcacctcagtggacttgccaggaagtttcctgatgtcaaatttatcaaagccatttcaacaacctgcatacccaattatcctgataggaatctgcccacgatatttgtttacctggaaggagatatcaaggctcagtttattggtcctctggtgtttggcggcatgaacctgacaagagatgagttggaatggaaactgtctgaatctggagcaattatgacagacctggaggacctcatgaagagggacagcgattccgagggtgactgaggctacagcttctatcacatgccgaactttcttgtgacaaattgtctggattttttaaaaaaggaaaaagcaagaatgaatccttgtggtttttagttttgtataaattatgtttcaaatctttacattttggaaataatcattgctggagattctgttaaatattttggaactcttttttttttaaattatagtatttcctctaaaaaaaattaaaaccagccatttgtatggcaaatgtctgttttcctcatttatattttaagtaagccataaaacctagtcactattttttgacatataactataaaaagaaatacagttttaaatgtgaataaattatacagtggaaaaaaaaaaaaaaaaaaaaaaaaaaaaaagggggggggggcaaaaataacccgggggggccaagtttggttaccggttttttttcaaagggggcccctaagggagggaataaaaagagggaggggcgccggttaacaccgctgggcgtggacacacggccgctggactctggaaaggacctcctctgtgggtgtccttcgccccccccaggaaatataggccaggcaaaataacttcaggtcacgggtaccaggcaatctggctaaatgcccgggcgattaaatgcgcgcactaaataagcaaacagagaaaatgaccacaaaacaccaggacaatacactgacacaccaccacgccacctcaaactaatcctccctctaata

SEQ ID NO: 268441 - DNA, 499 bp, Homo sapiens
ctcacctgttctttctgagacaaatcatctgccaggtttccgcctcgggacacccaagctcagcacagacagcctagcagcctgggtgacaggatcccaggggacaggattctctccttgccatggggatgaggacaaattctcccttcatccttgagattggactcccgccacacatcctggaggagcctacagagaagccggcaggtctccctcacctggatggtgccagcgggtggcctggaccacccagaggccctctcctgcacctgacaggaagcccctggggcatacgtctcccctgccacttccactgtggccactggaagtgtggcagagaaaatagctaggacaaaaagaagtcaatgatttcaaccaacggaatttctttgtcctttgtaaaaatcaacacatgatctgttactgattgggatgtgaaataaaactaaaaataacagcacactgagcctggctcagggctcagctcacctttaaaaag

SEQ ID NO: 268442 - DNA, 444 bp, Homo sapiens
gggtgcttgcaaccatcttcacctcttcccagggaaagattctgccccgggagattctctccttgccatggggatgaggacaaattctcccttcatccttgagattggactcccgccacacatcctggaggagcctacagagaagccggcaggtctccctcacctggatggtgccagcgggtggcctggaccacccagaggccctctcctgcacctgacaggaagcccctggggcatacgtctcccctgccacttccactgtggccactggaagtgtggcagagaaaatagctaggacaaaaagaagtcaatgatttcaaccaacggaatttctttgtcctttgtaaaaatcaacacatgatctgttactgattgggatgtgaaataaaactaaaaataacagcacactgagcctggctcagggctcagctcacctttaaaaag

SEQ ID NO: 268443 - DNA, 498 bp, Homo sapiens
ctggaatcagtgctgtcgggctggggaccagtgtctctggcctgtaaaaccttctcccaaaaccttctgggaggctttgagggtctcagaggaacctggcaggaaggattctctccttgccatggggatgaggacaaattctcccttcatccttgagattggactcccgccacacatcctggaggagcctacagagaagccggcaggtctccctcacctggatggtgccagcgggtggcctggaccacccagaggccctctcctgcacctgacaggaagcccctggggcatacgtctcccctgccacttccactgtggccactggaagtgtggcagagaaaatagctaggacaaaaagaagtcaatgatttcaaccaacggaatttctttgtcctttgtaaaaatcaacacatgatctgttactgattgggatgtgaaataaaactaaaaataacagcacactgagcctggctcagggctcagctcacctttaaaaag

SEQ ID NO: 268444 - DNA, 410 bp, Homo sapiens
tgcggtggggctggaacatgggtattgtggtgtcggagcagggggccctgggccaaaaataggtgcggccgggaggagtgggaagtcgggctgaggaaggagccagcctaggggcccccaacctgctttcacgcctcctaccaccggacggaacgtagcctagcgtttcattttccgtatcctcccgtcaggcgaccccgttatagccggcatcctctctttagaatatcgtttttctttctctggtaaaccctccaaatatttaccgcgggaatcccacctttttccaaagtgaccccgtctctgtgtcagaaccacgggaaaaagaaaaatggagcagctactccttgaaatacttaatgtttaataagcttttcgttgtaacgtttccacgttgcttacgggaaaaa

SEQ ID NO: 268445 - DNA, 581 bp, Homo sapiens
aaggtgggttttggggaagttacaaaattaagaaggtagaaggtaaatgaatagtaagtacgtaggtgactaatttaccaatcacagaacattacacttacagagctaattcttggagacagcttcagaatctgcattttcaaaaaatggacacaaaggtttttaaaagcagcatcccacccacatcatgatcatttctttacacatgaggaacagacctcaacccaaaaaaagccaaaagaaacaaagaggtttgcaagtcaagtttttaaaaagtagagataaaatagcaaaatactggaatatttaatatcaggaagataaaacatataaattaaggttgatcagactgtgaactatgatgtactgagttttaaaatgaatccaggcagggataggagattggaggttgatggctaaagggtaaggcacttctttcgggaagacaaaatgttcttctaaaatttattgtagtaacagttatacaactctgaatatgctgaaaaccaactgtgcactttaaatgggtgaattatatgctacgtgaacaacatctcaatcaagctattaccaaaaaaaaa

SEQ ID NO: 268446 - DNA, 401 bp, Homo sapiens
aatctaggactagtaataagtcctctctttcatccagaaaatattgaaggccggatgccatcacctgtaatcccagcacttgaggctgaggcaggctgatagcttgagctcaggatttcaaaatcagtctgggcaaaatggtgagatcctgtctctacaaaaaaataaaaaattagctgcatgtggtatgcacctgttgcctcagctgtttgggagactgaggagggaggatcgcttgagccttggagattgaggctgtagtgagctgtgatcatgccactgcactctagcctggtagcagagcaagaccctgtctcaaaaagaaaaaaaaaaagaaagaaagtattgagaagttaacttatttcattaccttaatgtgctgaggtgggtggatcacctgg

SEQ ID NO: 268447 - DNA, 461 bp, Homo sapiens
agatttattgctaaatattctttaaaactgcagcagttcagataagatactgtcgaaaggacgtttggcccagcagcaggacctccaccaatgaacggactccaattcttgatttgagccttgggaaccaatcaactttgtttccaagagtttatgtgaacttccctcctttaccagtaaaatcttccccctattcttcccttctccagacccgtggcttgccatagctgtacatcttggattataattctttttgttcactcccaaagaaactcagtatctttggagaattctttctttgttgtcttttagcttcccagagccaaacaagaaatattttaggttttgtgggtcatgctggcttggtcacagctattcaacttgtatcttaaaattagccatagacagtatgaatgggtgggtctctgttccaataaaaccttatcctaaacactgaagtt

SEQ ID NO: 268448 - DNA, 390 bp, Homo sapiens
cctggtgtgaaatgtaactatattggtagatgactttaataattagagatactaataataaaattaagtagctgacatgtttgtgttcaataaatgttatctcaactgtttaaatatactagcatataattttccattttatatttcttgtaatttttcatagttatacaaataagttgttgattttcaaatatttctcccatatgtatccaggaatttatattcttatgtaaacttcagtggtttgttcttgtcccagtacgagcactttaagctaagacattccattgaagaaatggatgattgacataaaatgagcacagaatctgaggggctgtcctcacgggtcagtgttgggttctattttgtttaacaacatcattagtgagc

SEQ ID NO: 268449 - DNA, 319 bp, Homo sapiens
tactactgatatccagggtgtgaacacactgtgttagcaccctgtgatattattcataatatccatgatattactactgacatccagggtgataatgcagtgttaacacactgtgttatgtttgtaacatcatcgatatcactactgacatccagtgtttcacactgtgatattaatgaaatatcgctgttacatttataatatacagtgtttccacactgtgctatgtatgaaatatagtatccagtgtttccacactgtgctatgaatgaaatattatactatccagtgttttcataccgtgctatgaatgaaatat

SEQ ID NO: 268450 - DNA, 959 bp, Homo sapiens
acagctctgctctacaagcccattgaccgggtcactcggagcaccctagtcctacacgacctgctgaagcacacacctgtggaccaccccgactacccgctgctgcaggatgccctccgcatctcccagaacttcctgtccagcatcaacgaggacatcgacccccgccggactgcagtgacaacgcccaagggggagacgcgacagctggtgaaggacggcttcctggtggaagtgtcagagagctcccggaagctgcggcacgtcttcctctttacagatgtcctactgtgtgccaagctgaagaagacctctgcagggaagcaccagcagtatgactgtaagtggtacatccccctggccgacctggtgtttccatcccccgaggaatctgaggccagcccccaggtgcaccccttcccagaccatgagctggaggacatgaagatgaagatctctgccctcaagagtgaaatccagaaggagaaagccaacaaaggccagagccgggccatcgagcgcctgaagaagaagatgtttgagaatgagttcctgctgctgctcaactcccccacaatcccgttcaggatccacaatcggaatggaaagagttacctgttcctactgtcctcggactacgagaggtcagagtggagagaagcaattcagaaactacagaagaaggatctccaggcctttgtcctgagctcagtggagctccaggtgctcacaggatcctgtttcaagcttaggactgtacacaacattcctgtcaccagcaataaagacgacgatgagtctccaggactctatggcttccttcatgtcatcgtccactctgccaagggatttaagcaatcagccaacctgtactgtagcctggaggtggattccttcggctatttggtcagcaaagccaaaaccagggtgttccgggacacagcggagcccaattggat

SEQ ID NO: 268451 - DNA, 561 bp, Homo sapiens
ctctagaggatccatgcaccattcgagacatgagctggaggacatgaagatgaagatctctgccctcaagagtgaaatccagaaggagaaagccaacaaaggccagagccgggccatcgagcgcctgaagaagaagatgtttgagaatgagttcctgctgctgctcaactcccccacaatcccgttcaggatccacaatcggaatggaaagagttacctgttcctactgtcctcggactacgagaggtcagagtggagagaagcaattcagaaactacagaagaaggatctccaggcctttgtcctgagctcagtggagctccaggtgctcacaggatcctgtttcaagcttaggactgtacacaacattcctgtcaccagcaataaagacgacgatgagtctccaggactctatggcttccttcatgtcatcgtccactctgccaagggatttaagcaatcagccaacctgtactgtagcctggaggtggattccttcggctatttggtcagcaaagccaaaaccagggtgttccgggacacagcggagcccaattggat

SEQ ID NO: 268452 - DNA, 199 bp, Homo sapiens
gtaagtgccctggccaggacgaggttgggtgggccattgtggattctgcactgctctgcccaggatggggccctgccagcacgcctttagacatggggcattcccctggaggccagaaaccagctcctcttggcagggaggtcacccctggcctttgtctccaaagtcctctttctcaagccctccctgaagctgtctg

SEQ ID NO: 268453 - DNA, 254 bp, Homo sapiens
gactgttgtggggtggggggaggggggagggatagcattaggagatatacctaatgctaaatgacaagttaatgggtgcagcacagcaacatggcacatgtatacatatgtaacctgcacattgtgcacatgtaccctaaaacttaaagtataataataataaaattaaaaaaaaagaaaaatacttttaccctagagtattacatccagcacaaatatccttcaaacacgaaggataaatactttcccaggca

SEQ ID NO: 268454 - DNA, 502 bp, Homo sapiens
cagaaatctgcttctgctgaaggggtcggtgctgttcgttttctgaattttctgacaagactggttagatcctccaaggggatctgctccggtcatgtcctcaggagctagtgatgcccggactgatgccatcactagtccagcagtggtactcagtctcagggatgcagtgctgccgagggaggcctcgcagcagggagtgcaggaaccagcacaggagattagaaccaagttttgagcagcagcaagacgctggaaataaagtgcatcctagtgtctaattcaaacagatcatcacggtgtggtttcaacagaacattttcccttcctttcttgcatgggattcttatgtgaaataggagcaattcctacaatggtgctggccctctgggggtttcttagggccagctctgcctctccgccttctctgaacaggctgcctgggcagggctctgctttctcatttcagatctgctaacttcacatgtcacctactgccgag

SEQ ID NO: 268455 - DNA, 453 bp, Homo sapiens
gaaaatattaaggtggtgacagtgcacggtatgggtggcacatggagatggcagaggctgggaaggactaaagtttcagccactgcagctggaaactcctctcaagtttaaaatgtttgggtcaaggtgacactttcccgtctgtggtccctgctttcttaacactatcattcagaaaggccccaagtgtaggccgggcacgctggctcacgcctgtaatcccagcactttgggaggccgaggtgggtggatcgcgaggtcaggagatcgagaccatcctggctaacacggtgaaaacccatctgtactaaaaatacaaaaaattagccaggcgtggtggcgggcgcctgtagtcccagctactcaggaggctgaggcaggagaatggcgtgaacccaggaggcggagcttgcagtgagccgaaatcgcgccactgcactccagcctggccaa

SEQ ID NO: 268456 - DNA, 147 bp, Homo sapiens
gaaatatcctgatggattgcctagctttgagttagaatggggacttaacagatatggtcaaggacaatattttttgcagtttttctgaaacagcatcttgcaagatgcattctttataatattacagcaattgctttattcatgaat

SEQ ID NO: 268457 - DNA, 257 bp, Homo sapiens
catgggcatcccagccagtttctggacatggcatcaaagctcttcctttgttcatcacctggggccaggagtgctggctaggatggctaacagagttgttgggcaacagtgactggttctaacagggaataaggattccttccttggttcattgccttgggaccatagggaggaccaaatttttaagattttctctttgtaacttattatgaatgaagactaataattatataattattaatgaggcctcagtaatg

SEQ ID NO: 268458 - DNA, 387 bp, Homo sapiens
acctctctcatctcccaggctgccggtcagcttgggagtcggtgtccctccccgttctgctgcagtcccctgctgtggggcactcggcaggagaacaggatcctttacgagtgggtagcttagctgagaagggaaggctgtttcaggcaggtcggggacaaggcaggaaaaggaaagggtctgggtcacacctcactgtcgggtccgctgggcacactcgcatttgtcctgagtatcagtccctacagaacgaataagaaactccccaggacaaaagggcctgattcctgggataccaaagctgtgacctgacttccactccagcccctcccttccccagtaacaggcgacaccgttctcctgcgagggattcaacgcctcatcctt

SEQ ID NO: 268459 - DNA, 164 bp, Homo sapiens
ctctcccagtggattcctagaggataggtactaggtggaaggaggaggttaggatcacctcaactttttgtgatgaatctatggaagaggattcttataggacagtatgttcttccaggacagaacattctttgctattttgtactggaagaacatgcaaaact

SEQ ID NO: 268460 - DNA, 470 bp, Homo sapiens
cagcgaaatcttatttgcctatagcaaatctacaaaaaattttcctagaccgtcttttctacaactggatggtaaagttgattgaagtgtgcctcatgtagctttatgtttggggcatttgaagggctatggctggaccagagtgtaatataaatgcttaatagagaggggaaaagaagagtgtaagaaccattatagggctgggctcacgcctgtaatcccagcattttgggaggctgaggcaggcggatcacgaggtcaggagttcgagaccagcctgaccaacatggtgaaaccccatctctactaaaaatacaaaaattagccagtcgcggtggcacgtgcctgtaatcccagctactcaggaggctgaggcagaagaatcacttggacccaggaggcagaagttgcagtgagccaagatcatgcctctgcaccccagcctaggtgatagagtgagactccatctc

SEQ ID NO: 268461 - DNA, 423 bp, Homo sapiens
ctttacatgaagggtttttcaaaatctagccacaaacagatatgaccagatttcaaaaaattttgagaaactaggaggaatctattttgacaaagccaagccacacataggatagaggcagacatgcgtgccctggaaagaagaaagtagaaggatcaactaaaagagctctcccactaaatggctgtgggctcctctaagaaactgaaacatggaagaaggaaggaccagccagccagaacagcagtgggtatcaaggaatgatataaaagcaagctcaagacagtcaagattcaaggagctatataccttgcttcctttccagagctgaaatttgagtcaagagtccatttcttccatctggccagatgatctccaggatactctcatgtatgtcaataataacttttcttttataaattt

SEQ ID NO: 268462 - DNA, 490 bp, Homo sapiens
cactagtaaaaatgcatggaatgcagttctgggatgcttcctgtgaagtgaagacacttaaccaaaaataatatattattttggtgggcttgattttatagtttctcttaaaaattgtttggttgccatccagagggctcttttatgaagaatctatataaactactaaaacatttcttaggacctttttggtgaatttgatcataaaattaaaaagcgtgtatgtgttttataaaggcatacctctgttaagaaggctggttttatgtttgccttttcttctctactttgatcaccaccctagctgttcctttctccagaccaccttacttttcaaacttgattcttgctatcacagctctctgtaacatcagttaaaatcagctgcctcaactctttgaggatgtttgtgcataggacggcattgtgaaacatagggaaatggcagtcttactaacaaaacaggacctatctctggccaaaaagaaaa

SEQ ID NO: 268463 - DNA, 809 bp, Homo sapiens
aatagacattgcaaactctcatgtttttggaaactagtggcaatatccaaataatgagtagtgtaaaacaaagagaatttaatgatgaggttacatgctgcttgcctccaccagatgtccacaacaatatgaagtacagcagaagccccaagcaactttcctttcctggagcttcttccttgtagttctcaggacctgttcaagaaggtgtctcctaggggcagcctgaatgcctccctcaaaggacctgcaggcagagactgaaaattgcagacagaggggcacgtctgggcagaaaacctgttttgtttggctcagacatatagttttttttttttttacaaagtttcaaaaacttaaaaatcaggagattccttcataaaactctagcattctagtttcatttaaaaagttggaggatctgaacatacagagcccacatttccacaccagaactggaactacgtagctagtaagcatttgagtttgcaaactcttgtgaaggggtcaccccagcatgagtgctgagatatggactctctaaggaaggggccgaacgcttgtaattggaatacatggaaatatttgtcttctcaggcctatgtttgcggaatgcattgtcaatatttagcaaactgttttgacaaatgagcaccagtggtactaagcacagaaactcactatataagtcacataggaaacttgaaaggtctgaggatgatgtagattactgaaaaatgcaaattgcaatcatataaataagtgtttttgttgttcattaaatacctttaaatcatgaatgttaagca

SEQ ID NO: 268464 - DNA, 213 bp, Homo sapiens
tgtaatcaatgctatagaaagaaagaagacatcatttcaaatttgggtgggcccaaaagttttggaactttaataaagtctagatccacaaatagaatttatgtaaatttatgtaggggaaaagtattccaagtgtaataaacaatgagcaaaaacaatgaaagtaggaatccagagtaagatatcattaattttaaataacgacaactaatt

SEQ ID NO: 268465 - DNA, 548 bp, Homo sapiens
gtaaatttcaggctgctaaatccttgggtgaagcttcaaattttagcttatgcaactgaagtccattgcaaaatgagacatatttacactgtttatactgtaatttatgctgcataaagttttgtagtgaatgtgtatgagagttttaggtttgcttcaatgtatgtttatatttatgtgacttatacaacttgacatagtagtctgttttaatttattaggtatatcaatatttgttagatttaaaataagagtctaatgctggatacaaactcagtttatttcactgttctagaaccatggaggaatgaagactcccactgaaatgaatgttctaaatatttgttctaaatcttttaatttttgtttaataatttctggtgaatatgtgttcaatctgttatgttaaatagaatataataaacataagacttttctttactgatacatcactgaacataagctgcaatactttaacttatttctgttccataatttcagtaggggctaatgacccacccctgctacattaaagacttcagactgca

SEQ ID NO: 268466 - DNA, 155 bp, Homo sapiens
ttatggaaaaattgtcaaacattcaaaaaagtaaggagaatagaaggataacccccagatttccaattcccagtgttcacaattatccacatttcgacattctggttttacctatcctccccaacctttcttacttgaatattttaaagtaaatc

SEQ ID NO: 268467 - DNA, 476 bp, Homo sapiens
atggatctcaatctaatcttcacatcttatgcaaggattaatttgaaaataatcaaagacttaaatgtaaaatgtaaaactgtaatgattttagcaaaaataggtaaaaacctttagcatctagggctagtggtataattcttagccctaacatggaaaacacatgtcaaaaatgcaaaaattgataaatttgaccttatcaaaatttaaaactttactctgtgaaagctcatgtgaagagaattaaaagacaagttatagatgggggaaatattttaaaatcacatatctgacaaaggactaatatctaaaatatataaagaactctcaagactcaacgagtcaaacaatccaactgatgcagaatttttgttccttagttcagctaaaactgtgttcttgtcatatgacaggaaagattaagcacatggacacactgaaaggtgaggggagcagaaagtattgggcgaaaagga

SEQ ID NO: 268468 - DNA, 396 bp, Homo sapiens
tgtgttgagatgacacctcaaccagtaggacactttggggtgaatcttagacaaatggaaagatgggtgtttaatattaaccacatctcttcagttggagagggagaagttaatgcattagcagagggagcatttgaaaatgggaaagggatctaattaaatcaagaatctgtcatatcaaaagagtaaaaagaacacatctataaatctgtttctagaagattaaatggtttgtttggccataaacagaattctaggagaggtgtcagaagagtacttagtggcagcaaccctatgtgtctgtcagagatcttaccaggtggttttctcttcttttgggtactgtttaagcattcaaatttcccactgctcttggcacataactctctaaaaaaa

SEQ ID NO: 268469 - DNA, 399 bp, Homo sapiens
cttcctatgctgtctaatctgattcggtacaagagataaggcaggtactgctaaatgataacttagatgcaggggccatcatgaaaatattcatcccatatcttacattaagcaaactactagcaactgtttgttgaaaagtataaatgaataaatgaaaataggacagataggcagtgtgggaagctaaaatatggaagtgttattgctttgctttatgtggtataatgatctgactttatcttcccagctctcccaggaagtatgcagaataatatttatctcatattgtggatgtggcaatcaagacagagaggctagatgctttacctaaagtcatccaacaaatatttggtagaaccagtgctagaatgcaataaatggaaacagagtttattt

SEQ ID NO: 268470 - DNA, 534 bp, Homo sapiens
agccgagaatccaacatgtccagaaccagaaccagaaagatagtatttgaatgaaggtgaggggagagagtaggaaaaagaaaagtttggagttgaagggtaaaggataaatgaagaggaaaaggaaaagattacaagtctcagcaaaaacaagaggttttatgccccaacctgaagaggaagaaattgtagatagaaggtgaaggagattgctgaagatatagagcacatataatgccaacacggggagaaaagaaaagttccccttttacagtaatgaatgtggcctccatagtccatagtgtttctctggagcctcagggcttggcatttattgcagcatcatgctaagaaccttcggcataggtatctgttcccatgaggactgcagaagtagcaatgagacatcttcaagtggcattttggcagtggccatcagcagggggacagacaaaaacatccatcacagatgacatatgatcttcagctgacaaatttgttgaacaaaacaataaacatcaatagatatctaaa

SEQ ID NO: 268471 - DNA, 523 bp, Homo sapiens
caagtggctgaaccagcaatcaatacctgacctgaaggcaaccctctataggctggcaagtggcctacaaagttgctcagtgctagagaactgagcccaacagaagtacattctaatgtttagtgattggccaatcgtattctttgtgatggtgctgatgggaaggtagtgatgtgcatcagacatgcagagttagtagcagctggagcagacacagaagcctccctaacaatgggcaatggagaaaggaacaacagacagttctgaaagaataccaagtgctcctaagccaaaagctatagttaggctgctggaggtactgccagtcctaaatgatggcaatgatggtccatttttctgtgaaacttgactgtatacctgttaagatttttttgtgttctttttaaggctccatgaatgaatctttccaataaacaagtttgtaacaaaggcaacctgaacatttctgatacttgaaacttgaaaatatctaatacaattttacatcactttcaaatcatga

SEQ ID NO: 268472 - DNA, 978 bp, Homo sapiens
tcccactctctctataataaaccactcccacaaagtagcgggggatgaggacgctgactctgcctctttccttcttatgtttgagctccaagatggctgttaagctcctatttatcaaacattgttgctctgaggcttaaagaaacatgacaaaaataagtaaaggcaggtgcaccctttccagcctacaacatgacagttgtgtcaggagacttcacaatagccataccctttaatctaggaactctgttttatgcttaaagatgttcactgcagtattatttataatacagtaataaaaattggaaacacagataacccacgataatgtctagtaaagggtcctacagccatagaatagaatggctttggccttttaaatattttaagaagttttactaataggagtttattgcttggggtgggggggtcactggcttcaaagcagaagacagattgtatataggtaataatctctactatgttaaaatccatagaaagaaaatgatacaagtgatgtttttcgattttgctattatactcaacattttcttctttaaacattagtgtattttaaaaaatttaattactgtattttttttaaaatgttataacaatggtaatcatttttttaaaaaccacaaactatctagaaataaaatgataattcatttggtttaagtgcttgctgagaagataatgtccaaaatatgctccagatatcccacaaagttcttgccatatagaccgagaagtgcctggggagaagtgctgaggtcataaccttcacagcccctgaagtttatattttcatacatgtcctgtggtcttgccaggggcaggggggggccacagattgggataatttctttcctcatgcagaatatagacttggagagacacacttcatatatgcatattaaaaccccttggagttgacctggcaggggtaaaatcatgggtgattgattttcacac

SEQ ID NO: 268473 - DNA, 449 bp, Homo sapiens
ctacattaataatcatcacattggtctcttgagcttatacatgacacaaaaataaagacaaatgagtatggcaagggaaaaaggcaaattgcatctaattgttagtttcttatggggctatagtttgacgcagggcaatgagggatactcagtctcattgaagtttctatgatgtagaactgcagttatatcagagtcccatgcttcgggttgtaaaacaggtttaggaagtctttgaaagctaggcagaaaaaagtaaaggactttttttctagtaagacattttatgatctgcttagtatgttaaatgttagcttcccaccatgcaacttgcaatcccattacttgaatatagtggattcaactagagggaatttctcaccctttgtatctccattgagttcaccgcttcatattgaaaacaccaaaaactaaaagcgatgaaaaca

SEQ ID NO: 268474 - DNA, 577 bp, Homo sapiens
acctgtcattaggcagggcaagtgggagccgcttcatggtgatcttggagacagattttcaccatcaaccactccccatcagctcagctctgagaaggtacaaggtgttttcgttttgtataattactattgtgggccaagtgtggtggttcatgcctgtaatctgagcactttgggaggctgaggcaggggatcacttgaggtcaggagtttgagactagccgggccaacatggcaaaactccatctctactaaaaatacaaaaattagctgtaaatggtggtgggcacctgtagttccagctactttggaagctgagacagaagaattgattgaacctgggagttggaggttgcagtgagccaagattgtgccattgcattccagcttgggtgacagagtaagactctatcttaaaaataaaataaaatttatttatttttatttattttttttttgctttaaaaattctttaatttgatacagtcaagacttcatatataacttctagtttacaggaaatacaggtgatatacaggttatacactggagaaatacagggaaatacaacacgaag

SEQ ID NO: 268475 - DNA, 791 bp, Homo sapiens
cagtgaccatctttgtgagcataacttacataattgtttcgtaaaaaattcaatgagaatacacattttaaatattcattgccagtcatgatggctcatgcctgtaatcctaggactttgggaggccaaagcaggaagatcagttgaattcaggagttcaagaccagcttgggcaacatagtgagacctcatctctaccaaaaatttaaaaaataaataggcatggtggcacgtgcctgtagtcccagctacttgggaggctgaggtgggaggattgtttgagcctgagaggttgaggctgcagtgagctgtgatggcaccaccgtactgatgatgcctgggcatcagagtgaaatcctgtctcaaaaaaaaaaaaattgttttcaaagtatcctacaaaaagaccttatcagtcatatttctgatagagtatcagaatataccttcactaagtattatcaatctttttcatctttcttggtctaattggagatgtttgatcatttgtggggtttttgtgaattgtctgttcactgaactctcttcataagcacaatgcctagtacataatgcctagtatataatactgcattgtgtggattgtgttgctgttcccttatttgggcttgctgcttatttctactttttttcttattataaataatactgcagtacacatctctgcatgtctttttttgtatctattttatgttatctccttaaaataaattcctgttagtggaattactgggtcaaggcagtgaatattttgagactcatggtacagaatg

SEQ ID NO: 268476 - DNA, 352 bp, Homo sapiens
aaatgtctcttagctacacttctttgattaccagtgggttattgcatctattcatgtttgatcatttgtggggtttttgtgaattgtctgttcactgaactctcttcataagcacaatgcctagtacataatgcctagtatataatactgcattgtgtggattgtgttgctgttcccttatttgggcttgctgcttatttctactttttttcttattataaataatactgcagtacacatctctgcatgtctttttttgtatctattttatgttatctccttaaaataaattcctgttagtggaattactgggtcaaggcagtgaatattttgagactcatggtacagaatg

SEQ ID NO: 268477 - DNA, 463 bp, Homo sapiens
tctgtttaaaaagtaagtttaatgattacattattcagttttttccatatttgcttcttgtactaaatttgtccaattctgaaactgtgttttgaaggttgccactgtcatagaactatggtctagttctttttttatttctagtagatctcagttcaaatatttagttccatgtttttggtaaatagagatttgtggctgttacatcttcttcataaattatgccttttataattgtctactacctctctgtgtcctgtttagtgcatttatctataaatactgcagctgttgtaatctcaatactatcaaatacataaggaaaagtatgctaagtgtatagcctgatgggttatcacaacatgagtgtggccatgccgaagggctttcagagtagaaacatcacccgccctcggaaaaacatcactggctgtcaccaactcctcccctagtcctaggggag

SEQ ID NO: 268478 - DNA, 375 bp, Homo sapiens
  misc_feature (339)..(339): n is a, c, g, or t
  misc_feature (352)..(352): n is a, c, g, or t
gaaaaaaggagtggtcactggaaagacctaggcaggattagagggttaggactttgagctccatgccctagcttctgtttaaaggttgggttatccagtggccaatgatgttaatcagtcatgcctatgtaacaaagcctaaaaccctaaaaggataggattctgggggctctgggttcctgaacatgtagcagtttctggagggtagtgccctcagagggcatggaagctctgcaccccttcccacatactttgccctgtgcatctctccttctgctgttcacctgggtcctttgtgatagcctttacttaaagcagcccttccggcttagcctccgngcttggattacanatgtgaagcccatgcttcgcctg

SEQ ID NO: 268479 - DNA, 508 bp, Homo sapiens
agatttgcagaaaattatccatcctctgctaaccactcagtgacgggcctcggggttcagggtcagtgtttacaggggaggagggaggctgggcatgctgggtcctcattgtacacaaataccccgggcctcaacctcacccatgtgccacactgtgccaagggtgttacataacatttctcttttaatcctcacaacaatctatgaggcaaatactgttctcgtccccattttgcagaagaggaaatgagctcaaaggtcacttggctagtgtatagtcattagtgctgtctccaaatatttccggctctctgccttctggcacaaggtaggactgcatgttctcactctttgatgctagctgtggacatgtgaccaactttaaccaataaaacgtggcggaactgatgtgcgtcagctctagtggaagcattaagactctggcaccctcacacctatgttgttcatagagtgtaaatgagaaataaacttttattgttaaaccact

SEQ ID NO: 268480 - DNA, 134 bp, Homo sapiens
attttggttggaaatattcagcagcaaaaaaatgtcaacaaatacttgcaaagaaatggtgttactttatattctctgtcaaaaatgcttactgaataaggcaccattataataaacaatatgaaggctacaaa

SEQ ID NO: 268481 - DNA, 397 bp, Homo sapiens
  misc_feature (149)..(149): n is a, c, g, or t
  misc_feature (373)..(373): n is a, c, g, or t
atttatatgcagtatgataacaatttctttttctggcacaaattaagaatttctgtatgataaattctttaaagaaaaacaccaaaagacatatcattcctaagattgacataatattttccattaattccagtaaagcttgttttttnggggaagtataagtaggagggattaggataggaaattaattaatcttttttttttttctcagttttgctgaaacggctcatagttttaaaagtctgagtgcttctactcctagaatatttaagcacaggccgggcacggtggctcacgcctgtaatcccagcactttgggaggccgaggcgggcagatcacttgaggccaggagttcgagaccaacctgggcanacatggtgaaaccccgtctctact

SEQ ID NO: 268482 - DNA, 478 bp, Homo sapiens
tcactgcattctagcctgggtgacagggcaagaccgtgtctcaaaaaaataaagtaaaagaaatgaaataaataataataaataagataaataaataagagtaggttgaagactttgggctgaaagagcctttatggatcccacatactcagagtcaattaggatgatccaggaggatttttgtgtcaggcctaaagtttctaggaggtcctggagaacagcttcactaggatcaggcaggaagcagggggtaatggtggtggtagagatggttttttgtggtattcattgaaagaaattctaatgcagagttctctgtataaacccttcccagagttagccattgctaatcagttgatccataagctaacagacatttttctagtccattggtatccagaatgggatatgcataatttaatgagatatgagaggaagatgtttgaacctcacttgatttttatatttgcttttcaaa

SEQ ID NO: 268483 - DNA, 427 bp, Homo sapiens
tagtccctgtgtctgtcttttctgtatttctgacagcatccattgctaaatagagaaacagaaaacctcacctcggcatgcatggtgtggatttggttcctggctcaatttgagacaaactagatcagtgacatagggttttcttcgctactaaacacaaagatctgcctcttagtcaatagagaaaacagggtcccaacttcaaagagcttgacatataataacataatggataagacaaaaattagttatttaaatttacagttatttttatataaagttatctgactttaaggttatctgacattacacaggcaagacttttttcatatttcagtcattccgtttttcattgacaaaatgcataaatgtttctattttaagcccttttaacatgtcagtaaatatcaattaccttcaacataaa

SEQ ID NO: 268484 - DNA, 451 bp, Homo sapiens
aaggctaacctgatccgtgttttttccactgtgctctcactaaggactacattcagttatacatgtatattttatttttgagacagagtctcgctctgtcgcccaggctggagtacagtggcaaaatctcagctcactgcaacctccgcctcctgggttcaagtgattctcatgcctcagcctcctgagtacctgggattataggcgtgcaccaccacaccaggctaatttttgtatttttagtttgagaccaacctgcgtaacatggtgaaaccccatatctacaaaaagtacaaaaattagctgggtgcggtgcgcatgcctgtggtcccatctactcggaagactgaggcagcagaaccgcttgagcctgggaggtggaggttgcagtaagatgagatcatgctgctgtactctagcctgggcaatgagagtgaaactcttatctcaa

SEQ ID NO: 268485 - DNA, 332 bp, Homo sapiens
cacaggtttattttttaaattaagacataattcccatatcataaaatccaccctactaagatgaacaattcagtggttgttgatatatccacaatgttgtacaaccatcaccactatgtaattctaaaacattttcaccaccctaaaaggaaatgctgtacctattagcagttactcctcattgcccactcccctcagccccaggcaaccagtaatctaccttctatctctgtagatgtacttgtttggggcatttgtataaatagaatcttgcaagatgtggccttctgtgtctagctcctttcactttagcataatgctttgaaggttta

SEQ ID NO: 268486 - DNA, 258 bp, Homo sapiens
tggtgctttagttatccctgatgtcaagacctttactctattttgcccaaatttctcagttagataacagcaaagagagagagccagaagacctgggtgtgcatcctagctgtaccaatcactgaccatgggatcttagattcagactctgagaacctccatttccttctccataaaaatgggcagatatgtactgtactctgttgggggaaaactccaactcaatgagataaagtaggtaaaaactataaacccagt

SEQ ID NO: 268487 - DNA, 489 bp, Homo sapiens
tgagacacaatctcactctgttgcccaggctggagtacaatgacacaatctcggctcactgcaatctccgcctcccgggttcaagctgaggcaggagaatggcgtgaacccgggaggcggagcttgcaatgagcggagatcgcgccactgcactccagcctgggccacagagggagactctgtctcagaaaacaaaaggccaaaataataacacatctttgcattggagttattttttggatatagctcccccaatgtacacattgggtgttgttaactcaaacagaaagtatcagagagactcttgaatcttggtttggttcctcattggctgtgcaaacttgagcaagttccttaacttctctgagtgcttattccctcagctgtaaaatggagcaaatagtgccttcctagatgagtgtcaggattaagggactcagtctagtccctgccgtattgagaataagcaataaatggtcattattgtta

SEQ ID NO: 268488 - DNA, 358 bp, Homo sapiens
ccagaaacacacacacacaagcacaaacacacacacacaagcacacacacacacacacaccaagtaagagaatactaaaagatcagagaaaatgtaattatacttatcaaaatgttttaatgcagtggcctattagtttcagaatataaaatttatttgatttgttgagcaacttggagcttattttttaatcctttcagataataggaacttgaaacatacttggctgtgtataagatatatgtgatattagaaaatcatatatatctgttaatatatattcaaatatattactaagcaaaaatatatttacatgtttatatcaatgatgcaattaataaatgttttcacatcctgt

SEQ ID NO: 268489 - DNA, 282 bp, Homo sapiens
gcacaggggggctcaagggaagctgaaagtgaggagacttggcttgtatcctgactcccctcagtgaggtgctccatctctgtgagcctgctgctgcccctcaccccaccaagatgtctgacaggatggatttgagaaggaggtacaacacacaccccatgatgcacggttggcccccacagactctgatgcaggccacaccctggcgctccctgagctggcctggttcagtgctctttactctcttagaagaacattggccgggcacggtggctcacacct

SEQ ID NO: 268490 - DNA, 2459 bp, Homo sapiens
  misc_feature (3)..(5): n is a, c, g, or t
  misc_feature (7)..(7): n is a, c, g, or t
ggnnngngggtgagccggagagggtgaagcaggcaggaagctgcaggccggcggtggatggggccaggaagcatgcagggggagtgaggaccgtgtatgagagaaacactgcccaagagagaagaaagaaaatcacaggacccgaggaaaaagaatgagtggtgtgttcagagatgacacatgacaacaaattgtttgcttggaggattttcttacgcgtgcgtgtttaaactggcctcaaggaggaagaagaaacatgcgttcctggatgactgagttctggaatattctgtcataagactttgcaactggagtagccccagaaaaaggcaggcagtgggagttggctccctccccaaagccatccctgagttggctttgttttgggttcctcccaggtggaatttaggcaaaacttacagtattgttctgggatctgggcaagttgtgttggggatggacatgggtctcagagagatgtgcgttggcgagaaacggacagtgatcattccgcctcacctgggctatggggaagctggcgtggatggagaagtgcccggcagtgccgtattagtgtttgacattgagctgctggagctggtggctggccttcccgaggggtacatgttcatatggaatggtgaggtgtcacccaacctttttgaagaaattgacaaggatggcaacggagaagtctcctggaagagttctcagagtacattcacgcccaggtggcatctggcaaagggaaactcgctcctggctttgatgctgagctgattgtgaagaatatgttcaccaaccaggaccggaatggagatgggaaggtcacagctgaggaatttaaactcaaagaccaggaagccaaacaggatgaactctaaacctggcacgaaccagatggtgccagggagtacgtgacaccaagccaactgtgtggcagaacgtgcagtgagggtgcaagggtctttcagaagttgcatcattagccagtagtaggtgggtcacatagtacctggtgtacacatcggggtgggttgatatatggggtgagaagtttaggctgatcgccagtgatagtaaacaaaatctgtgcagagggccttagcatgggatgtgtccagtattgaaaaggctgcactgccaaccatgatttgtgaaccttctgggaaattttgttattaaaagaatatatagtgtcagacggaagttataatcatcttggaggaaccataagaaaaagtgtccagggtatctatataaagagggttaaatttttttttaacttgctggttaaaacattttagaaatattcttgagatgggcaggagagtcaaagggcttgcttgccccagcagagttcccagcagacagccatggctcttcccagcagcctgtgcaaattctgatgatgaccccacccccgcacacgcacacgcacatcatgcttttccagctcatcacaccccgccccactatgggcctaccattaatagtgtatatcttggaggttaaaagagccttttggacagaaaactgggccaggaaaaggcatctcagaccacaaatagagaatttgattcctcatttgccacataagtcatctgcttagcttttcctttcttttttttttttttttttttttggaggcagagtctccgtttgtcgccaggctggagtgcagtggtgccatctcggctcactgcagcactgtctcggctcactgcagcctccgcctcccgtattcaagcgattctcctgtctcagcctcctgagtagctaggactacaggtgtgcaccaccacgccccgctaatttttgtatttttggtagagacggggtttcaccgtgttggccaggatggtctcaatctcgacctcgtgatccgcccacctcggcctcccaaagtgttgggattacaggcatgaatcaccatgcctagccacttagttttttgtcattcccacctttctatcccatagaacactcttttttatcttccctgaaccatattgatgagataaatagggctgggggctgggccccgctggtcactcaacagagtatttcccttggccgagatggaagttttgtcccaatagatgagctgctgagcatcaacaaggtgacatttttctgctgcccatttgtgtcctggagacggtggtaccctgaaggcagaggccagctgctgcaagacagcaatgacagtccacctgccggcctgattcctgcatcatggaataaccacatggctaccttctatcctctgttcccaaatggtggtggcacttatcctgaagtcatcaatgatttccctttgaaactactttattttactaatttaaactattttgtactgatgtagccctgaggtagttcatgaaaatgctgtgcactcattccatggaataaatgttggaaagctgatcttttctgatataaaatgttgaattata

SEQ ID NO: 268491 - DNA, 1545 bp, Homo sapiens
tcctgtcaaaaacacgctgctgtgatccggaacgatcagtgtggctgtttcctgatttaaaagttgcatcattagccagtagtaggtgggtcacatagtacctggtgtacacatcggggtgggttgatatatggggtgagaagtttaggctgatcgccagtgatagtaaacaaaatctgtgcagagggccttagcatgggatgtgtccagtattgaaaaggctgcactgccaaccatgatttgtgaaccttctgggaaattttgttattaaaagaatatatagtgtcagacggaagttataatcatcttggaggaaccataagaaaaagtgtccagggtatctatataaagagggttaaatttttttttaacttgctggttaaaacattttagaaatattcttgagatgggcaggagagtcaaagggcttgcttgccccagcagagttcccagcagacagccatggctcttcccagcagcctgtgcaaattctgatgatgaccccacccccgcacacgcacacgcacatcatgcttttccagctcatcacaccccgccccactatgggcctaccattaatagtgtatatcttggaggttaaaagagccttttggacagaaaactgggccaggaaaaggcatctcagaccacaaatagagaatttgattcctcatttgccacataagtcatctgcttagcttttcctttcttttttttttttttttttttttggaggcagagtctccgtttgtcgccaggctggagtgcagtggtgccatctcggctcactgcagcactgtctcggctcactgcagcctccgcctcccgtattcaagcgattctcctgtctcagcctcctgagtagctaggactacaggtgtgcaccaccacgccccgctaatttttgtatttttggtagagacggggtttcaccgtgttggccaggatggtctcaatctcgacctcgtgatccgcccacctcggcctcccaaagtgttgggattacaggcatgaatcaccatgcctagccacttagttttttgtcattcccacctttctatcccatagaacactcttttttatcttccctgaaccatattgatgagataaatagggctgggggctgggccccgctggtcactcaacagagtatttcccttggccgagatggaagttttgtcccaatagatgagctgctgagcatcaacaaggtgacatttttctgctgcccatttgtgtcctggagacggtggtaccctgaaggcagaggccagctgctgcaagacagcaatgacagtccacctgccggcctgattcctgcatcatggaataaccacatggctaccttctatcctctgttcccaaatggtggtggcacttatcctgaagtcatcaatgatttccctttgaaactactttattttactaatttaaactattttgtactgatgtagccctgaggtagttcatgaaaatgctgtgcactcattccatggaataaatgttggaaagctgatcttttctgatataaaatgttgaattata

SEQ ID NO: 268492 - DNA, 363 bp, Homo sapiens
ccttaaatcttattttagtcatttgtctgatctttaccacctccaaattgttggcagaagctattagagcaaatttaactgagttcaaatttcacttcctatattctacttattttctgaaaggaggatgaaagaaatgcaaaaacagaagattggagatgagagcagggttagtcacaaacccagttcatatcaagaaccaatgttgagattactgagatctgttgtaattttttaccattcccaatagtaataagaatttttttctcaagaattacttattaaaatatgggcagacatcagtgatagactggataaagaaaatgtggcacataatacacgatggaatactatgcagccata

SEQ ID NO: 268493 - DNA, 415 bp, Homo sapiens
gctgtgctgacagacggcctggtgagggaacccgggaggcctccagcatctgcacccctctcctactttgatctctgtttcaccaacattgcaccccaacttaaggtcacatagctactgtcaagccaacaaggtgctgcctctcccgccgtgtgagggtggaaccccataagccaccactggaggcatccaagcatgttgattccttctctagttcagacaccacctctcctggacatcctgtggcctaaagactatcctagaatcaacactccttaaataggagtggggaaagaaaaggaaaatgtgtgtaatacatgtgaatcacagataacgtagtcattggttaatatatacaactacgcgtatttacattctgtatgcgtcaatgagtaaaatactgtggttggtgctt

SEQ ID NO: 268494 - DNA, 244 bp, Homo sapiens
tttgatgtagtttttgatcaaaaagctttggtgtttccaaactcgtagcctgtactagaacataatgttgaaaaacatatgtgtatagaatcaaaccaatataaagtaatttttccaaaacgggtaaggcagacagaaggtgaagtcattaaaaacacatggtcaaagaggtcctccaaacagcttagaggaaggcggcccaacgaacgcatttaatcaatatatattgctaaagataatgggg

SEQ ID NO: 268495 - DNA, 159 bp, Homo sapiens
tcttttgaaagtattagtttgtttggccagttgggccaggtcataaatattacggaattattagtcagctcttgaagacaggaatgtttgagggctttgaaagctagcccagcaggaagcttttcgtggtctgtgtattttccttcctctcaggaatga

SEQ ID NO: 268496 - DNA, 412 bp, Homo sapiens
gatgggttcaatagaagcccaaaccccagccttatgtaatatatccatgtaacaaccctgaaaaagtatcacaccctcccccaattctaaaattaaaaaaaaaaaaaaaaggtaggactgtatttaccaaaaactcactaggtgattttgatgtgatagcaccagtcttccagttgaaaacatctgacttaatatattttctccctttgtgaaaaattacaattcaaataagaattctgagtgttcagaaaagtctacaatttaggccaggtgtggtggctcacacccgtaatcctagcattttaggagggaggcctaggaaggcagattacttgagctcaggagtttgagactagcatgggcaatatggcaaaatccagtctccaccaaagaaaaaatacaaaaaaattag

SEQ ID NO: 268497 - DNA, 387 bp, Homo sapiens
attcaatagaaacataaccgtccaatttattttctgaatattttccatctgctgttgctgaatccacagatgcagagctcctggatatgagagccaagtgtgctttgagagtagggtgggtgaggttgctaatgagtacaggggagcaggtgttgatcaggaggaccctgcactggggcatctggacgtactgcctcaggacttgagactccagttggatggcacaggcagactcggcacaggcagactcagcccaggtcaaagccgtccccttgaagtttcattttatcccaagctctttctggaccctggaatttggcatcccctaggccataaattttagtaaagagatatgggtatggaaacatgttatgcatagcaatggga

SEQ ID NO: 268498 - DNA, 372 bp, Homo sapiens
attcaatagaaacataaccgtccaatttattttctgaatattttccatctgctgttgctgaatccacagatgcagagctcctggatatgagagccaagtgtgctttgagagtagggtgggtgaggttgctaatgagtacaggggagcaggtgttgatcaggaggaccctgcactggggcatctggacgtactgcctcaggacttgagactccagttggatggcacaggcagactcagcccaggtcaaagccgtccccttgaagtttcattttatcccaagctctttctggaccctggaatttggcatcccctaggccataaattttagtaaagagatatgggtatggaaacatgttatgcatagcaatggga

SEQ ID NO: 268499 - DNA, 164 bp, Homo sapiens
gtacaggcatcctctctcctggtgagtgattttctactgtattcccagcagtttatattctaatttctatggagatttaataatttctgtaatcaaagctatattcctaaatacctcaagtttttgaaacctcatcaaaataaagtttatttggcaacttagta

SEQ ID NO: 268500 - DNA, 635 bp, Homo sapiens
aggagagatggatatgtttgctgtcttgggtgtggtgatagctttatggtttttacattgtgtgtgtgtgtgtgtgtgtgtgtgtgtgaatgacagacttttatgtgttcccataaagtctagaaatttgctatcttatcctttacggaaaaaatttgatgacaactggataagatcaatcattattcacctgtgtgttttcagagccctagggtctgctattataggaggtcaaggagcagccacacaggatgggccctgtctcaacagagcagttctaatatatctgtggcatagatttggcttttggctttccagtaagatttaactggggaaaagggtggttaaagtctcagactaggtgactgctgcatctgagatagaatcccattctgttaatgcaaaattgggaatgggagtcatttggagaaatgccattttatttcatagtaggaattaactgctcttagctcattgttttaatgaaccacccaagacctttgtaattaaagaatgtactgaaacccttgaaaagaacacatttttgtaagtagattaaaccttgtcattctgttttgttcttcaggctacttagccaagcttctctgcccagatgatgtagagataaataaacc

SEQ ID NO: 268501 - DNA, 423 bp, Homo sapiens
accacagcccagtcctggcctctgggctgcagtctgcttactctgttgcttttttttagttctatctcactctggatacccatttattcagctctgccccttaaacctctggatagttatgcttgagggctgttcctttctcttgcacaaagggattgcccttactaggattattactcagcagagccactcatatccattctcattctcattttcatccaaaagcctaggaagggagactgctccttccagtacagatggagaggatcaaattgggttggggacactaagggatgctgtgaattccatgctccaaggtttaagctgagggcagtggggaggaagggcggagaggtacctgtatccacctggcctgttcactacttaattttcttttgcaccacgcaccagaggatcatctct

SEQ ID NO: 268502 - DNA, 377 bp, Homo sapiens
gtaagtagcaggttgttgtatgtacgttcttactgataacccactggtcagtgtttttgcgttggtcttatattttggtaatttcaaaaatactcagtaatatgttgttattaatgcacagaagggatgtgtgtgtctaaatgcttagatttgcttgctttgtcttaggtttggtgtgtctttttaaacttgggaatctagttgttatcttagcagtgtaatcaaaacaaatattataacctcaggactaattcttaatgaactttgctgaaattgaaagttgttgctgacaacttaagagcatttcttctcatcgtcatcagccattatgaacgcccttgttttcttgctgtcagctgtttgagattgtcatgatg

SEQ ID NO: 268503 - DNA, 424 bp, Homo sapiens
caggaaccaggttctgtcctcattgtgtctcctcgctcactgtagtgatttcactgaagaaaaccatttaagagatatttccaaagaggagcgttttcacattccccgcgcatttctctctgagcttgtggctcgtccagtcaatggcccaacttcagttaatgttgagatattgctttattgaccgaactcctgctctcctcaatacagtacacatttatgattgagttttcctgtatgaatctttttgtgataaaatgaattgcattctgaagggctggcgggggcgtcctgggttgacaggacaattgtaaaacatccgtttaatagaaggctcttgctcaaatgccatttttaccctggtggcggcaaattttcttaagaatttgacttaatcaaatgtgtctaaaaagttttcactagg

SEQ ID NO: 268504 - DNA, 355 bp, Homo sapiens
gaaataactgataagtcacccacattaccaccttcttaaatggcttaaattctggagactttcttggtaacttgacataggtgaactagattgtggccacattaagcttttaccctggagttcatttaaatttcctctgaatagtttcagatgtcagaggaaagcctagtaattcaaagtacctacacagcaagataggtaaatgtacagaatcactcagcagagtgcatggtgatccttttcctctgtatgtgtgaaaaataagttttagactcacttttctcttgtttcatttataacattttaattctctataaaaatgaatgttgctgagggaggcggaggttgcagtcga

SEQ ID NO: 268505 - DNA, 289 bp, Homo sapiens
aaccaactatttagtaataagtgttttttttacattcacctcaatctctagaaagatcattataattttcctttaattatcaacaacttgattatatgaaagttttatttttttaataaagcctcttattgttacacagaccattcatgatacacttggacttcctggtttgtcctgaacattcttctttcttaaacaaccagtcattttattacaagactaaatttaccataaaagattctttctcataaaaaattatttctctttaagcttacttaccaaaaaaatc

SEQ ID NO: 268506 - DNA, 523 bp, Homo sapiens
ccagtctctacttctgtcatcctgatgcaaactcagctgcttctctcttgtggggacccctgtgatcgtctccagcccacctgggtaattgagagcacgcgctccatcccaccatccttggctgcgtcacatccacagagtcctttttgcaggaaacataaagaaacccattggccggttcctgggcttaggatgccatggacacctttagagggctgttgtgcagggatcaggacgaggtggaggggttctatggcgtggaaccttgtaggtcatttataggagataagattttattctcagtgcaatgacgtagtccagatttatgggttttttaattttttagatttaattaattaattatttcagagacagggtcttactctgttgcccaggccagaatgcagcggcatgatcatagctcattgtagcttccaactcctgggcttacacaatcttcctgtcccagcctttcgagtagctgggactacagatgcatctcaccacaaccagctgattaaaa

SEQ ID NO: 268507 - DNA, 334 bp, Homo sapiens
tatcaactgtatacccatatttgcttatgataaacagcctctaattagagaagagattacaatgtcatggctatgcacaagagttctgttgttaggacataataggaaaagctcatctcaatggaactaaaacttacagactaaaaaaagaaaaacagaattttggcaaatgaaagatgaggcatgtagtattctgcttctatggaacaaaaaaattcttttattattatgctttaagttcgggatacatgtgcagaatgtgcaggtttgttacataggtatacacgtgccatggtggtttgctgcacccatcaacccaccatctagattaggt

SEQ ID NO: 268508 - DNA, 355 bp, Homo sapiens
cacgccactgcactccagcctgggctacagagtgagactctgtctcaaaaaaaaaaaaaagggctcatttttcagatgagagatttgatgttcagcgaggggtgagcttactaggaacttgatgcccagagtggagcgcacctctcacctctcaggtgtgagtcctgagaggagccagaacaccagccccggagcacttctgcgtccactgaatcatcaacactctcaagctgtgggggcagggttgtgtttgatcatctccacttcacctctgtgacagcctgttagatttatgaatgaatttaaatctcccagatttttgttgttgtttagcaaaagcttgggttactcagaa

SEQ ID NO: 268509 - DNA, 634 bp, Homo sapiens
acagcaggagtcttaaactccagtactggcagtgggcctgaggccatggggatgagtgcatggtccaagaataacacagtgggtctgtggtgaatgggaaggcacagacaggtcctgcccgaacactttctaaaacaccatgtgggcttaaaacataagtctgtcagaagggagccccacgaggacccggatctttgtgtctgtccgattcgtcgtgtcgtcccggacatgttgtaggcctcaagaattatttgttgtcatgaagtcggtctggggcctcgctttctatttgtgtctgtagtttgtaaactttatgccaaataaagctgtattttttttttcgtctacctgttctgacaaggacaaaaagaagtgtattcctgtgagattctagcagccagatggtattttaattcacagtaaagttcatgatttgtgttgtgtctggatactatgtgtcatccatagtgaaacagccgttgggttggaaggtagcgcatgtggcatcgttgagagccgggtgtgaagcctggcctcagctctgccagttgtctccaagtctcattttcctcatcttcaaatgagcttgggttatttctccccccagcttactgtgaataataaatgaggtgct

SEQ ID NO: 268510 - DNA, 735 bp, Homo sapiens
gttttctcatgtgggacctgaccttacatgctccttggatgggccacactggtgaccacgcgaggctttgatgctctcatcacagggacctgttctgagttttatgttgtctttgttggtttcaacattttatgccaaatcagcaagaaatttaaatcttttttcatcatgatcattgtattcattctccttcattcattggtgagcctgttcctggaagccatctgtaccctcggacagccagcaacgactgagctacacatggatagaaccatgaaccacaagaaatacccctgaattctgaactatttccatatcaacttctcccaaaatacccacagccagtccaacaccatccaactggatgggagcagggaaggcggggaatcagagtggaaagagacttagctgagttatttttattatttttaaaagccttattcatagacatatgtgtatatttagagacagagtctatcactacgttgcccaggtttgattctttttttagagacaggtctggagtacagtggtgcaatctttgctcatcacagccttgaactccagggctcaagccatcctcccacctcagcctcctgagtagctgggactacaagcatgtgctgtgccaccaagctggcttggtgtgactaactgatgtctcacctttgcaaactttacagaaacatatgacataggaacacattgcaattacatattgcaattcagcagaaa

SEQ ID NO: 268511 - DNA, 353 bp, Homo sapiens
tgtaaacttggatgtttaaaaattaatgtcatatttacttatcatgagcctaaaatcttgtgatgtccaccaggctaagaagattattggttacaaaatattaagaaacatgggctgggcatggtggtttgtgtctgtaatcccagcactttgggaggcctaggtgggcggatcacctgaggtcaggagttcaagaccagcctgaccaatatggtgaaaccccgtctctactgaaaatacaaaaattagctgggtgtggtggcatgcacctgtactcccagctactcgggaggctgagacagaattgcttgaacctgggaggcagaggttgcagtgagccaagatcgtgccac

SEQ ID NO: 268512 - DNA, 390 bp, Homo sapiens
agtgaggggcaggggccaatcctggaggctcacagatcagaaggtgcttaggctcctccccctgcttccctggaaaacagaactgtaccccctccccatctctgggaaagtggattctaccatttcccttggcagccttgaatctcccctcaattcttcctgctgcagctgaaacagtaggactgccagtgctcaggtaacaccacaggctgcaaacagggaaccaataaccaagacaggaactgctccaacaaagaccttccctcaggccttgggatttttcagacatgttatctcaatgagtcctaacaatgatcctattaataataaagtagtattaaaagaaccaataaaatcaccaataaaaatcatctctttgacatatgaaaa

SEQ ID NO: 268513 - DNA, 371 bp, Homo sapiens
ggttccccttctggaggccattagtgcttgtcacagcagcgtgttgggagatggagtctgagggccgtgatctgtgctacctctgggagtgtggtctggaagggacagaggaaagaggagcagaaggagccagaaaccaagcaggcgcggtggctcatgctgggattataggcgtgagccaccacgccaggccagacctggctaattaaaaaaaaaaaaatactcccaaagcactgggctgacaggtgtgacctgtttaattcttttgtttgtttctttacttcttattgtctgcctctcttcagaagctaattcccattagagcaggtgctgtattctttgccaccaccatatcaccagtgtctacaact

SEQ ID NO: 268514 - DNA, 511 bp, Homo sapiens
gtgtgttattagtaaaatgaggtttcaccatgttggtcaggctggtcttaaattcctgacctcaagtgatctgcccatctcggcccccaaagtgctgggattacagccaccacacccagcttttttttttttttgagacaggatgtcactctgtcacccaggctggaagtgcaatggcccgatctcggctcactgcaaccctcgcctcccgagttcaagtcattctcctgctgcagccttcagagtagctggaattacaggcacgtgccaccatgcccggctgatttttgaattattagtagagacagggtttcaccatgttggccaggctggtctcgaactcctgacctcaagtgatccgcccatctcggcccacaaagtgctgggattacaggtgtgagccaccgcgcccggccagagctttaagttttcttgttctgaaaggcagatgtgaatttaaaactcattgacttttctgtacttttcttctaatctcaacagcattgagttc

SEQ ID NO: 268515 - DNA, 501 bp, Homo sapiens
aaaatgaaaacatgtccacacaaagacttgtacactaacgttcaaaacacttgcataccaatgttcaaagcagcattattcctaacaggcaaaaactggaaaaacctcaaatgttcttcaactagtgaatgcacgaagcatccacataatgtaatattatttatgataaaaaggaataaagtactagtatgttacaacatggatgaacttaaaacacattaatgaaaaaaacacagaaagatcacatataacataaaatgtacagaaaaagacaactctagagacacaaagtcgactgagtagtgggtgcctgggattagaggttggacgggagattaactgtaaactggaataacggatcttgctgggatgatgttctaaaaaatggattatggtaatggttgcacaactcagcatatttactaaaactcactgaattgtacacttgaaatggttttaatgatatgtaatttgtacctcaataaattcctttaaaaaaaa

SEQ ID NO: 268516 - DNA, 290 bp, Homo sapiens
ctggagacaaaactctcagagaaagagcttggaataaatggcattaattcacatccatcagggaagccagttgtggtgcccacaggaggaggcttttgccagtttcatctgtgttgaccacttcccagttccctgcggtaagggaagcatatgacttactgcagatacgtgtgggaatgcctcctccttacaaacaagttgtcaggaaagcagtttttaaaatgtgatcaaaagcgagaagaccccatgaatggtctttcacacactcttgttaattccttgggtcccat

SEQ ID NO: 268517 - DNA, 1104 bp, Homo sapiens
ccatcttactacctgcttcctcaccgccgccatcttacttccttttttctctgccaccattttagttcttctgccgccatttggccgccattttaattcctgttagttcccatttgttcttttaaccctgcccacctaactccttggcttccgtcttacccccattcttatttccacctccctgtagtgccataccagtccactacatctacaactcctaacacattcgctgcgggcagtgatatccgctaatcctggatgaggcagcggagggcccccaaacccctatccaggacttagtaaagctggcgttcaaagtttttaattcccgagaggaggcggctgaggtacaacgacaggcaagactgaaacaaaaagttcagctccaaacccaagccctggcagctgccctgcaacaggcattccctaagagccccagcaggagaggtagaggtacaatctcccaggccccgtctggcacctgcttcaagtgcggcaactcaggacactgggccagccggtgccctagccaacagcaaccgtcctgcccgccttgcaactgtttcaagtgtggcaatccaggtcattgggcaaaacagtgcccaaaccccaagccgccaacacgcccgtgccctaactgccaacaaatggggcactggaagtcagactgccccggcctcggagcggccgcatgtgtctccacatggcgacccctccccggatggcgaaggtgccctccagctcctccaactggatgacgactgaagaggccagactcgggaacccctctcacccttgccgagcccagggtaatgcttcaggtagcgggtaagtccatttcctttttactagacacaagggctacctactctgttttgccatcttttagcagacccagccgcccctcctcaatctctgttataaggactgatggcattccctccacctaccgccagacaccttcactgcccttccacctagaccactatataactttcttgaacccataatctaccatccttccctttattccttactaaagcaaatacatcaacttatcttcttactttagtaaacactttctcaggttaggttaaagcctgc

SEQ ID NO: 268518 - DNA, 626 bp, Homo sapiens
accatggcattcatcataacaactaaaaagtacagcaaggtaggtttccaaagagtgaaatttaatcgagagtagacattgaacatgattgcagctagttccatcataacatgttggcagaaaacttcactctttttaattcacatcggaaccatttttggctaaagggcaactggagcatattaaagtagcaaaggataaagcatttctccaatgtttccctgtactcatagggcaagtcatggatcataaattagaaaaagaatttgggaatcagaagtcaaggaggatgctacaggaggacaggtctcagagagctgggaagaatccagggatttagcaaggcctgaaggagcaagccaaacagctgtatccaggcatcttgattaaaacagtttcctgtcctgttcacagatttatcatcattattaggattctttcacagctgtaacaaatcctagcctttctgattcaggcaacttgaaaggccctattttaagtggagagtgtgcaggctttcaaaaatggacctgccttctgtcagccggctccatctttcacacatataataccagcaggattcaaggaagcagagttcctgacttccagaaggttttggtttggaa

SEQ ID NO: 268519 - DNA, 189 bp, Homo sapiens
gggatgctgacccctgaactcctaactggggttggaattcaggtcccttgggaacactgggcacctagggatgtgggagcaggactggccacagccaggtttcccttagaaacagactggttgaattaatgaactgaacaaatgaaccaatgtgttttgccccagagaaaagtgagctttgtcctgggt

SEQ ID NO: 268520 - DNA, 445 bp, Homo sapiens
ctcacatctaagtccaagtgcaaggacctgaaggtccttgcttcatgcttcatgctgcccagctgcgggctcaagccctgtcagattttgagaaaaattatcaactaaaaagcagacagatcctgggcatgcgctagccgggtagagagacacagagctgtgtacaggatgtaatatcaccaacttttggagactgatgttcaaatgctgtagcgttacatacttggttccatgagccgtgcctttttgtatagtccacatgatatttcagaattggtgttgctgttcttcagcaactgttgtacaaaatgttcacatttaatttttctttcttcttttaagaacacattataaaaagaatactttcttgtttggttgggcttttaatcctgtgtgtgattactagtaagaacatgagatgtgacattctaaatcttgggagaaa

SEQ ID NO: 268521 - DNA, 142 bp, Homo sapiens
taagaaggaggcacagggcttggttggcccatttagttagtgacacacctatattactctccttggcatcttaccccagcccatccattgggttgtgtcagtcttttatttctaagtgaggatccagtcaacaggaggcaca

SEQ ID NO: 268522 - DNA, 389 bp, Homo sapiens
accagctcttccagaaatgtttatacaaaggatttagaggttaacaatgcatgtgctctacatattaaaaccgaaaggtgctacaaataaatggatgttacccacagttaagggtttgcacacttgctgatgaacttgaaaatctccaagtttaataagtcatggctaatgtagtatgattcattcttataaataagcctcaaaaggaaggaaggaaggaaaagagggagggatggagagagggagggaaaaaggaaggaaaaactggatagtttatagagatagacatattgatgcaactgaatgggcttagtaaattaatttttccatctttaatttggtactaattggcgagttatcaccgagtgagcctgttggttcataggttt

SEQ ID NO: 268523 - DNA, 982 bp, Homo sapiens
gttgagctgtggacgcgggtctctgttccgcaggatggggtttgttaaagttgttaagaataaggcctactttaagagataccaagtgaaatttagaagacgacgagagggtaaaactgattattatgctcggaaacgcttggtgatacaagataaaaataaatacaacacacccaaatacaggatgatagttcgtgtgacaaacagagatatcatttgtcagattgcttatgcccgtatagagggggatatgatagtctgcgcagcgtatgcacacgaactgccaaaatatggtgtgaaggttggcctgacaaattatgctgcagcatattgtactggcctgctgctggcccgcaggcttctcaataggtttggcatggacaagatctatgaaggccaagtggaggtgactggtgatgaatacaatgtggaaagcattgatggtcagccaggtgccttcacctgctatttggatgcaggccttgccagaactaccactggcaataaagtttttggtgccctgaagggagctgtggatggaggcttgtctatccctcacagtaccaaacgattccctggttatgattctgaaagcaaggaatttaatgcagaagtacatcggaagcacatcatgggccagaatgttgcagattacatgcgctacttaatggaagaagatgaagatgcttacaagaaacagttctctcaatacataaagaacagcgtaactccagacatgatggaggagatgtataaggaaagctcatgctgctatacgagagaatccagtctatgaaaagaagcccaagaaagaagttaaaaagaagaggtggaaccgtcccaaatgtcccttgctcagaagaaggattgggtagctcaaaagaatgcaagcttcctcagagctcagaagcaggctgctgagagctaaaccaaacaattttctatgatgatttttcagatacagacaataaacttatggaca

SEQ ID NO: 268524 - DNA, 1603 bp, Homo sapiens
aagactacaaatcctagtgagtatcgagttggtcttattatcgcgtgaactgggagcctttgtttcctgcgtgtcgcaggaagtgacgtttcgggtacagccgctaccagagtccctttctcgcgaggcggaagaaccccgatcgctgaggagcaagggggcgctaggaaagggaactgggttgcgacggtccggcgagagagagctggggtgctggggtgcggggaagttggggagcagaggccgcttggtgtccgagtagggtaagaccgcaccgacccagtccgttaggaaagaagggaaacgaggcaattgtcgggcggatccccggacggagggctaaggttgtgtggaaggcgctgctccccggatggcgaccgcagatactccggccccggcctccagtggcctctcgccgaaggaagaaggggagcttgaagatggggaaatcagtgacgacgataataacagccagatacggagtcggagcagcagcagcagcagcggcggcgggctgttaccctatccgcggcgaaggcctcctcactcggcccggggcggtggatctggcggaggcggtggctcttcctcgtcatcgtcctcttctcagcagcagctgaggaatttctcacgctcgcggcacgcgtctgagcggggccacctcaggggacccagcagctaccgacccaaagaaccgttccggtctcatccgccttctgtacggatgccttcgagctcactgtccgaaagcagtccccggccgtctttctgggagcggagccacctcgccttggaccgtttccgctttcgaggcaggccttaccggggtgggagtcgctggagtcgggggcgaggagtgggtgagcgaggaggcaagccggggtgcagacctcctctgggaggaggagcaggatccgggttcagcagcagtcagagctggcgagagccctctccacctcggaagagctccaaaagttttggaaggtctccatcaagaaaacaaaattattcatcaaaaaatgaaaactgtgtggaagaaacttttgaagatttgcttttaaagtataaacaaatacagttggaactagaatgcatcaataaggatgaaaaactagcattgagtagcaaagaagagaatgtgcaggaagatcctaaaacattgaacttcgaggaccaaactagcactgataatgtcagtattacaaaggattcaagtaaagaagtagctcctgaggagaaaacacaagtcaaaacttttcaggcatttgaattaaaaccactcaggcaaaaattgactttaccaggagataagaaccgtttgaaaaaagttaaagatggagcaaaaccactttccctgaaatccgacactactgattctagtcaaggtatcccttatcgggtaaaggagggttttactcctattcctggtttgaaattttcagcgtgaatggatgttgaagtttacaaaatctgttttcttcattattgggatgagcatctaatttattttaatttgttagtgtaatgaattatataatttatttctagtattaaaccacccttgtatgcttgcgtttaatacagtttatgatataccattttt

SEQ ID NO: 268525 - DNA, 1727 bp, Homo sapiens
aagactacaaatcctagtgagtatcgagttggtcttattatcgcgtgaactgggagcctttgtttcctgcgtgtcgcaggaagtgacgtttcgggtacagccgctaccagagtccctttctcgcgaggcggaagaaccccgatcgctgaggagcaagggggcgctaggaaagggaactgggttgcgacggtccggcgagagagagctggggtgctggggtgcggggaagttggggagcagaggccgcttggtgtccgagtagggtaagaccgcaccgacccagtccgttaggaaagaagggaaacgaggcaattgtcgggcggatccccggacggagggctaaggttgtgtggaaggcgctgctccccggatggcgaccgcagatactccggccccggcctccagtggcctctcgccgaaggaagaaggggagcttgaagatggggaaatcagtgacgacgataataacagccagatacggagtcggagcagcagcagcagcagcggcggcgggctgttaccctatccgcggcgaaggcctcctcactcggcccggggcggtggatctggcggaggcggtggctcttcctcgtcatcgtcctcttctcagcagcagctgaggaatttctcacgctcgcggcacgcgtctgagcggggccacctcaggggacccagcagctaccgacccaaagaaccgttccggtctcatccgccttctgtacggatgccttcgagctcactgtccgaaagcagtccccggccgtctttctgggagcggagccacctcgccttggaccgtttccgctttcgaggcaggccttaccggggtgggagtcgctggagtcgggggcgaggagtgggtgagcgaggaggcaagccggggtgcagacctcctctgggaggaggagcaggatccgggttcagcagcagtcagagctggcgagagccctctccacctcggaagagctgtatccttaacgtggcggtcggcgctggatgctgcacttaaaaggatgcttgttttgatgtcctgctcattgttttccctatgaaccaaaagttttggaaggtctccatcaagaaaacaaaattattcatcaaaaaatgaaaactgtgtggaagaaacttttgaagatttgcttttaaagtataaacaaatacagttggaactagaatgcatcaataaggatgaaaaactagcattgagtagcaaagaagagaatgtgcaggaagatcctaaaacattgaacttcgaggaccaaactagcactgataatgtcagtattacaaaggattcaagtaaagaagtagctcctgaggagaaaacacaagtcaaaacttttcaggcatttgaattaaaaccactcaggcaaaaattgactttaccaggagataagaaccgtttgaaaaaagttaaagatggagcaaaaccactttccctgaaatccgacactactgattctagtcaaggattacaagataaagaacaaaatttaacaagaagaattagtacctcagatattctgtctgaaaagaaacttggtgaagatgaagaggaactatctgaattacagcttcgccttttggctcttcagtcagccagtaaaaaatggcaacaaaaaggctatggaaaacataggagaactgaaacaggaatcgaagagatgaaaaggaaaaagtgagttagagacatgatatacaagatatctgagaagtgaaggggaatg

SEQ ID NO: 268526 - DNA, 770 bp, Homo sapiens
gtgtttattcaatactattttgggcctctaccatagacctttattaattggtaagcttgcatgtttttattagtaaactggcatatgatgttgcaaaaaaaaaaaagtaccagaaaatatccagtctgcttgtgtgactttgatttccgtagtaacttgtcataaataagatatcttgttgtttttcttttcacagatgctgcacttaaaaggatgcttgttttgatgtcctgctcattgttttccctatgaagtatcagtaatccatcctagaggtggtgttctttttaagaatttgagaaggaaaacgtagttcccagctacttttatataatgtgagcaaacaaaatatttgttacaacacttcattcaaatttatttaatatcaaggttgtactcagtttaattcatatttccactatgtgattataataataccttttttattttacaaatactgtataaagaaagaatgcaggttactctgtggcatatttctgtaatttagaagtaaagtagcctgagtatagggtttatttctatttttgccataactcctttcactgtaataactaagatatgctagttgcaactttaaagaaatagaataaactagattcaattgcagttcttattttcacccttaatttttcttaatgatagacactttgtcagtacatcttagcatgtctcccttgaatgactactcttttaaactttcaaatctgaggagagctaacataattaggctagtgtctctcatcagtaaa

SEQ ID NO: 268527 - DNA, 536 bp, Homo sapiens
agtcataagtcctggaggagtctcttgcaattcttatgtgacactaggcatgaaaaatacaaaaatcaataatgagaagactttaccttagatctagactgtgaacaccactcttgagaataggaccttgtagtaatcaagacataaccctgccgaagattgctagaccagacaaagaaacaccaggatcattcttcttaaaatgtaaatagtaagtaataccaattttcttcaaggcaaccaccttatcagagtaagtctgcgaaagacacggttgtttaacaagtcaccaggggaatattttggaattgaagcactaacatcacagcaaccagatagtgtatatgtatataaacaccttgtcaaatgtaagtagtatttttcccagtagacacagtgaaaaatatacttcactcttggtcaattctaattgaaaaaataactaaatagctgctagatgaagaattcttggaagagttgctctcctagcactgggtcttgcaagataatgccagcgtcctgaagacaaaattggg

SEQ ID NO: 268528 - DNA, 1079 bp, Homo sapiens
gggatggggaatgttgaagaagataatctagttttactgacctttattgagcattcactgtgtgctaggcaccgttctcagaatacagtatctccacttaatttctcataactcagaggtggctgctgctctcaccattttacagatgaaacaggagaggataactcacccagtgtttccaaagctattaagggggaagagctgagatttgaacctaggaatctccagaattcaagtatctgagctccacagtttaagtcctgggggtggagagaggagagagcagctggtagatattatctatttttataatctttattagagttgatcttcaacatgctgaactggttacggaaagttaaggattttagctagaaaatcagtaaagaaaaggggaatgggattaaactgatcttttcaaatactcctatctagctttaatcccaaatgccaaccaagtttccattttttctgggaaagactgctttctaaatgcaaagctctttcactatcagaatgtgtttttaagcagggaaaacttttttttggtaaagggccaggtaaaaaatattttaaactttgcaagccagaaggtttctgtagcagctcctcatacctcttcattgtaaagtggaaggagtaaagtgtaaacaaatgggcgtggctgtgttcctaaaaactttgacactcaagtgtgaatgtcatatatcttgtgtcagaaaatattctcccctccccccaaccatttaaaagtacaaaattcattctcagcttgtgggcagtacagaaacaggtggcgagctgaattgacccacagccttcccagcttttaaggaaaacagtcagcaatgagccagacaagtgaacaagataccgtatttcgcttgatagtgtatgtgtaaaataaaccaatagtctttttagaaaattgttttattgatgtggaagcaaactaggaaattatgtagtccatcatatccatcatgcattttaaaataatgcattcctggagactctttggctctgaagagaatcatctttttttttcccctcttacagattctgtaattaaaaaaaaa

SEQ ID NO: 268529 - DNA, 876 bp, Homo sapiens
gttcatacttacctggcaggggagataccatgatcatgaaggcgcttttctcatggtcgcggcttatccattgcgttccagatgtgctgacctctgcgatttccccaaatgtgggaaactcgactgcataatttgtgatagtgggggactgcgttcgtgctttcccctggcgcttttgtggtgcgaatagtagatgagccgtaagtgtttttgtaattcagggtgcgggctcgtgttttgtggctgtgttctgtccggtcagttgtttccgttcgcaacggttagttttcctttgtgaggccatgtttagggacaggttagaattatccacttactctctcgggaggcgaatttcagtctctgttggttggggtattctcccaggttagctgccgcggtacttgctaggtggagctcagggatcaagggtcgggagctttctggtttgttcagtgctcccagggcttctaacatctcttaaaaactctggtgttttctgtcatcctcggagttacctcttagcctctgttttttttgttgttttttttccccccctccctaagacaagtctcgctgtaccgtccaggctggagaagtggcgcgatcttcccatctcaggctcccgagtaggacaaccgcacgccaccacacccggctagttttttctctttttttttcttttcttttctttctctttcctttctttttcttttttcgtagcggtttcaccattctgctcaggctgggctccaactcctgggctcaagtggtccgcccagccttctgaagtgctgggattacaggtgcgatccatcttgccctggcagctcctgcttttcaccacagcattcacgggagtttgtaggatttctgtgc

SEQ ID NO: 268530 - DNA, 576 bp, Homo sapiens
cccgagccccacacctgccggacagcaggtgctggacgtcgacagctgcctggactcatccgtgctggacagctccttcctcacgctctgaggcctccacgctgaggtgagggctctactgggggtcctgccgccttggcgcagcttggactcaagaccctgtgcacctctcagcaggcctttgctggacagatgaagagtgacttgtttctggatgattctaagaggttatcaatactctggctgaccatcgtcatcgtgggactgactttggtggaagtccttggttacttatcattactgtgtttctgagaagttataaatttgccatctccctctgcacaagttacctttgtgtgtctttcctgaagactatcttcccgtctcaaaatggacatgatggatccacggatgtacagcagagagccaggaggtccaaccgccgtagacaggaaggaattaaaattgtcctggaagacatctttactttatggagacaggtggaaaccaagttcgagctaaaatctgtaagatgaaggtgacaacaaagtcaccgtcatgacaaatcatggaaag

SEQ ID NO: 268531 - DNA, 457 bp, Homo sapiens
gatggcttgagtccaggagttcgagaccagcctggacaacatggcaaaaccctgtatctactaaaaatccaaaaattagccaggcatgtggtgtgcacctgttgtcaccaaaaaagaagaatgtatatgccgtcatggcatggaccatatttatctttttcgaagttcctagcaataggaccaggtgcggcattggcactcaatgaatatttgttgaagaaataaatgtgtttggtacttgttcacatttatatgacaaacacctgcatttatagctctcatctttttgtcagttttccagctttgcggtagagctgttattaaactgttttgtctggttgttatagcaacccagaggcttccagaactacaggttgtttctgatgtgcatattctaccagacaaccaaacacacacagtgtttttaatcatgaaataaagatgttactataaatca

SEQ ID NO: 268532 - DNA, 500 bp, Homo sapiens
ggccagtgcagagctgtgacataagcaggtgactttccctatcagaactttcagttaagtcacttccatggaagaaggggctcttctatgaagagcctctgtaacagtactgactccatgttagaggaaagcttgcttgcttgaatacaattattgctttgcttgagtctttagattattcactaaaaacagcctcagaaaaagaggaccttcaacagagattttttaaaatgtgccaaccaacagctctgggaatgaattggccggcctgaccatacccacagaaggccacaaagcattgaccaagaaggcaaggattaaatgcccacctgagaatgcccacgtttcacaagaatgttttcattattctccctaatttcccttaaaaacccctgatttagaagcatgactcagaaaggtgatctttgaaccctagttcactgccttccctgggttgctggcttcttgaataaagctaactttcctttcaccaaagcttg

SEQ ID NO: 268533 - DNA, 375 bp, Homo sapiens
agagacaaaacagactgaaagacattgtttaaatttatgacttttattatcttacttgaatgctatttttgcccctctcgctattattaaaccctttgcttcctgttttcagttgctcctgtcaaggtatgaatttttctttggatgattgtcatctatttcatattatctagtattcctctctattatgagaaaatcaaaagtagacagtgtatctatagctatagatttaaatgcactaaggtaattatatatttgaatcagagacctaaggaataatctagtgtagcatttaccaaatttatttaaacttaacatgcttacatgaagacagacctatttatgtttccaaggaacaccagtttgagaaatgct

SEQ ID NO: 268534 - DNA, 448 bp, Homo sapiens
acagctatattctgagtctgagaattttcttagataaatattttcagataaacaccctaatccctccagatactaaattttcccaactcttatttttaaaatacagctgcatccttcaggcaatttattggcatgtctagttagttctgcagtttcacaaacatctaatgtcatggtcaaacacatgtgcccataaggccaaggtcctcaaactttgtattgctttatattacttatattctaccaggtgagtgtgtgttggaggggaagagttcttcttttctcaaaaaagtaaaatagtaaagtatacctttgtaatacaattgattcaaaataaataggccctaagcgtgcatcactttagaaagcaattattttgattttcagtagttttataattactattcactaaaatttcatcttattccagcctccaacagaagttaaa

SEQ ID NO: 268535 - DNA, 265 bp, Homo sapiens
gtaagatatatacttttaaaaaataaagaaccagagttacttttaaaattatgtatgaccttgtaactagaattataagtattaaatacagagcttaattactaacaaaataattatttcagcatttttttgttcattcactatgtactttaaacaacaacaacaacaactatgttaacacagattaggacaaaaatttttgtaaattatttattatgaagtatatcctaatgtgtttaaaaacaagtcattatgtttatctcct

SEQ ID NO: 268536 - DNA, 369 bp, Homo sapiens
cttcacgtggacaggcatcttttctgctttgtccactactgttttcccttatcctaaaaccatgcctgccacatcatagctactgcatgctaaataaatactatatactcatgtatttttaaatgaataaatgtttattagccatttgtattttttcttctgtaatttgccagttaccatttttctgcaggttatcagaatcttaaaactttatctagtatgctacaaacattcttctttcaatcttttccttgtcttttaaatattttgaatgccctcactataaaatggaagtttaaaatttttgtatagtaggttctgtcagtttttgtttttgaaacagattctccgtctgtcgcccaggctgga

SEQ ID NO: 268537 - DNA, 511 bp, Homo sapiens
acaacactcaggactatcataggaagacctacagtgatacagagagttgataacagggcctagctaacagctgagattgtgactctcatatgcagacccagcctacaggctcttcattcttacacataaacagagcctatgaatgtggcacttaatctcacacataaacacagttgcaagttggatttgttactctcatatgtggatctggtttccaggtggtttggtgactctcaaaccatgattcagcagacctgtgaggctgtgagttccctatcagaacacaatctgcaggttgtattgtgccatatacctgggaccaaattacaagcacaatgatgaatcttttacctggagtcaagacatgggcaggatgatggaacttatcactggacctttccacagtgttattgtgacatatgcctttgcccaacatgtggtgatttgactccccagactgggtccagttcacaaataaaattgtgccgtatacttggccaagaacctaaag

SEQ ID NO: 268538 - DNA, 448 bp, Homo sapiens
aggcatgccttcaagcatctccctcaggagggattcgcaacccctagacttccctcgtgccgcctcgtgccgcctcgtgccgaatgatgactctcttacctggacacagccagtgggaaatattttgacttttgtagccaggcttagggccacaggtggtttggtgactctcaaaccatgattcagcagacctgtgaggctgtgagttccctatcagaacacaatctgcaggttgtattgtgccatatacctgggaccaaattacaagcacaatgatgaatcttttacctggagtcaagacatgggcaggatgatggaacttatcactggacctttccacagtgttattgtgacatatgcctttgcccaacatgtggtgatttgactccccagactgggtccagttcacaaataaaattgtgccgtatacttggccaagaacctaaag

SEQ ID NO: 268539 - DNA, 403 bp, Homo sapiens
atacatagactcaaccaaaacaacagatttttttactcttctggctagacttagggacacagccagctgacagtaagaattgtcacccacacatgtgggcagatcccactagtgacatcctgactttgccttgtggacacagttcacagttgaaattgtgactgtcatatgcagatctgaccacaggttgtattgtgccatatacctgggaccaaattacaagcacaatgatgaatcttttacctggagtcaagacatgggcaggatgatggaacttatcactggacctttccacagtgttattgtgacatatgcctttgcccaacatgtggtgatttgactccccagactgggtccagttcacaaataaaattgtgccgtatacttggccaagaacctaaag

SEQ ID NO: 268540 - DNA, 355 bp, Homo sapiens
taagtgacgtgactatcattttatgtccacagaaggcgttgtaacatctcactaagcccagcactcaggcgatgtggctttcctgctatggcactgcacacaagaagaatgttgacatattcctggcccagaattcaggttgtattgtgccatatacctgggaccaaattacaagcacaatgatgaatcttttacctggagtcaagacatgggcaggatgatggaacttatcactggacctttccacagtgttattgtgacatatgcctttgcccaacatgtggtgatttgactccccagactgggtccagttcacaaataaaattgtgccgtatacttggccaagaacctaaag

SEQ ID NO: 268541 - DNA, 560 bp, Homo sapiens
aggcatgccttcaagcatctccctcaggagggattcgcaacccctagacttccctcgtgccgcctcgtgccgcctcgtgccgaatgatgactctcttacctggacacagccagtgggaaatattttgacttttgtagccaggcttagggccacaggtggtttggtgactctcaaaccatgattcagcagacctgtgaggctgtgagttccctatcagaacacaatctgcaggaagcattggaacatatcacttagcccagcacctaggtggatgggattccctttcttgcctggtccctgcccactggagagattgtgacccattgctgagcccagcaccaaggttgtattgtgccatatacctgggaccaaattacaagcacaatgatgaatcttttacctggagtcaagacatgggcaggatgatggaacttatcactggacctttccacagtgttattgtgacatatgcctttgcccaacatgtggtgatttgactccccagactgggtccagttcacaaataaaattgtgccgtatacttggccaagaacctaaag

SEQ ID NO: 268542 - DNA, 627 bp, Homo sapiens
ctttattttcccttttcaatacacacctcctcctaccctataaatatctaacttggaaggagtagagtagctgataagaggacagaatcaaaataaatatttaagtgacagtatgcaggactccaaaagggtaaaaagtaaaaagaataaaaagaaaagaaacaccattccaataagcatgttgttagacattagttagacagtgatccagcttagttgtgtgtctcaagcacattcaggtctacctcaccacattatgtaccaacagacaagggcaaatatttgcatactatcccactagtgcagcaaagtaaaatttctttaaatattcacatattgataaatagctgtggagaaaaaactttaaaatgttatgttcccatatgtgtttttcaggcttgttgtataacctagaatatgatctatcctggaaaatataaccatgcatgattgagaagaatgtgtaatctgatcttgggtagatagatgtctgttaggtctacctggcttttgtgttgttcaagtcttctatttccttgttggtattctacttgtcctatctattattgaaagtgaggtattgagtcttcacctgttattcttgaattttctgtttttcccttcaat

SEQ ID NO: 268543 - DNA, 505 bp, Homo sapiens
  misc_feature (273)..(273): n is a, c, g, or t
  misc_feature (298)..(298): n is a, c, g, or t
gctttttcgcaacgggtttgccgccagaacacaggtgtcgtgaaaactacccctaaaagccaaaatgggaaaggaaaagactcatatcaacattgtcgtcattggacacgtagattcgggcaagtccaccactactggccatctgatctataaatgcggtggcatcgacaaaagaaccattgaaaaatttgagaaggaggctgctgagatgggaaaggctccttcaagtatgcctgggtctggataaactgaaagctgagcgtgaacgtggtntcaccattgatatctcctgtggaanttgagaccagcaatactatgtgactatcattgatgccccaggacacagagactttataacgtgattacagggacatctcaggttgactgtgctgtcctgattgttgctgctggtgttggtgaatttgaagctggtatctccaagaatgggcagaccagtgagcatgcccttctggcttacacactggatgtgaaacaactaattgtt

SEQ ID NO: 268544 - DNA, 409 bp, Homo sapiens
gacctcagcaggcagggccctggggtcccttccttcagttctgtgagctcctaggctactcacctctcctccgcctctcaggctcacccacctcatctgaaaatggcaatgatagtgggcgtgtaggcggggctcagtggctcactcctgtaatcccagcactatgggaggccaaggcaggcggatcacctgaggtcaggagttcgagaccagcctgaccaatatgatgaaacccagtctctactaaaaatacaaaaattaaccaggtgtgatggcatgcacctttaatcccagctactcgggaggctgagacaggagaattgcttgaacctgggaggtggaggttgcggtgagccgagatcatgccattgcgctccagcctgtaaaacaagaacaaaattccatcaca

SEQ ID NO: 268545 - DNA, 143 bp, Homo sapiens
gagtaaatattagcagatatcacaaacgggatgattggagtaccaagaatcttagataatgatcaacaaagcaaaagaagccataacataatatgttaaatgattgaagaaaaaagtttcaggaacaacaaggaaataaaacg

SEQ ID NO: 268546 - DNA, 371 bp, Homo sapiens
aaatatgcataaatcacatatccaaaaaagccttatattgagaatatataaagaactctcaatactcaacaactcaattttacatggtcaaaaggcttaaacaggtgcttcaccaaagaggttgtgtggatggcaaataagcacatgaaatgaagttcaacaccattactaattgggaaaatgcaaactgaaatcacaatgagacatcaccactgccttagcccattttagctgctataacagaaaaccacagactgggtactttataaagaacagagatttctttcttacagttctgaacctggagtgtctaacatcaaggggccaacatctgatgagggccttcatgctgtgtcatcccacatcccaga

SEQ ID NO: 268547 - DNA, 708 bp, Homo sapiens
ggattaagagaaggcaggctgccttgctgaagctatgtggtcttcaagtgagagttgcaggcaatagaactactttccttttggagtaaaaggaggaattcattttcagtagccacaagaaaagttttttttttttccagggtggctggcaaaatggccaaatagtaacagctccagtctgcagctcccagtaagatctacacacaaggcgggtgatttctgcatttccaactgaggattcttagtccctgtacttgtgctaacttcaagttccttcggtggattttagttcatctcagctgtgctgaaggagaaacaaggccacacagtcttgtcacctctgctctgggtgtgaggacagcatggagatcatcaggtcaacgcaagtaagatgaggacttgggccaggaagcagagagaatgctgggccgctgtccttttcttcatgggatggtgtttagacaacattctctggtgacaaggactctcttcttgcccaaaccctagtcaggctcctctgggctcctttttcagtgaggccccattttggggtgtgtcccaagaccccagttttagcaagaatcctgttacctcaattcagccagaatcccccacccttgatgtctatcaatcaccctcagcttcaatatctggccaggttctttgtccctcaccatccccaaggaatttgtggccaccctgagctgc

SEQ ID NO: 268548 - DNA, 482 bp, Homo sapiens
caactgtctgactctatgtcagacactgtatctgacagacaaggaaattcttaccttctgatcaaatcttgtatgactgtgaaggaagcagggagtgtgaggaaaggtgtctctcctttcccattcccttggtatacacatactgaagtactgaagttgaagaaaacaagactgctttcgtggttattttcaaacaaatataaatgtctgtaagcgtgtgctttggtaagtcactcaataagcataatgtacactttaggctctggttgagtatggaatatctccaagtagctgcttcttcaaggatatatcacaatgttcagtaataagggcatgttttcatattaatcagatgaatgatgacattttaaaaactaatagtaaaagaggccatttccatcctcaactgggttttataaaaaagaagacatttaccttctgagccagtttattcaagtatgaaatatagaaaaaaaattcaa

SEQ ID NO: 268549 - DNA, 403 bp, Homo sapiens
agttctgggatcacaggcatgaaccactgtgcccagccaaggtctttaaaaatgtcaatgaatgaagcatagttgttaagaatgcaaagtttggagtcatgaaaactttattataggccaggcacagtggcttacgcctgtaatcccaacactttgggaggtcaaggagggcggatcacttgaggtcaggagtttgaaccagcctggccaacatggtgaaacctcatctctactaaaaatacaaaaattagctgggcatggtggcacatacctataatcccagctactggggaggctgaggcatgagaatcacttgaacccgggtggcagaggttgcagtgagccaagatcacaccagtgcactccagcctgggcgacagagtgaaaccttgtctcagaaaaa

SEQ ID NO: 268550 - DNA, 417 bp, Homo sapiens
ggtcagagccccctctgtgctcctagcacgtgagtcttcaggagtcaggccttgaagagtgtctgccattcgttccgagacaggaagtaagagatgattggccaggaggctgcagctgcaagtcccaagagcagcgcctggcgccagctgccaccctcaggcttggagcagagaagagatggaaaccaaataaccgagggcctggctcaggaccttcacgcagttttcaagaaattcatcttttcttgccgttttccctgtgttaagtgagtcaggaaattgaaaaacagaaaaaataagcgtgaaagtaggtagttgactctcatatttattcagttatttttaaagagtttatcctactgatatgagtaaaataaaattttcgttaggaataataagagcttattttctatctag

SEQ ID NO: 268551 - DNA, 346 bp, Homo sapiens
gtggactaattatacaattgtttagtgccttagtttttccctcctcagcatgtgtggatttatattggtgctaattgcatccaggtgttctaaacaccacagttaagcacaggcaaagagaaactagaaacacttcaaaatctgaaggtatattggggcagaattcattgaacattttctattgttgttggcttaaatggctctgtcttcagacttgagtgttttttaatgttaataactgaaaaatgttttctttttccaatgtaatcttgaaatttctaaaaattgggttattatcttgcagttcttgataaagaatagagtcagaaaaacataaactaaaaaa

SEQ ID NO: 268552 - DNA, 448 bp, Homo sapiens
cacacctactggaaaaatatatgtcagccccagaaaattgtgggcaagatgaggcaagtcctgagcaacacaggaaactgccctcctccttttctggccccgcttccactgtgatgctaaagatcgcatcaaggctggtcatccaatcagcaggatgtaagagggtcattcttcactgtggccatttagaagtttcctggaaacctggctttctcctgaccattgccccatgagcatggtggtgacaagcttgggctctgaaatcagacagccccaagtttgaaacctcaatattcttacttgctagctatgagactttgggcaaattcacctctccaaatctcaatttctcaatctgtataatggggataatattgggtaatgcactaagcaccatgtcaggaatgtagttagtgttcaataaacgtttatctttattgctgcgaaa

SEQ ID NO: 268553 - DNA, 455 bp, Homo sapiens
taagaattggatggtgaggtcatttaatagtaaaaagaatagaactagtgataatatcaagtgctgttgatgagttaaggtattagatattgttgtgcactgttggcagagtgtaaataaccaaaatttttgaagggataatttagcagtgtccatcaaaataaaacacagatcatttccagccaggtgtggtagctcatgcttgtaatcctagcactttgcaatgtcaagttgggaggattccttgagctcaggattttgagaccagcctgggcaacatagatagagactctgtctcaaaaaaaaaaatcatttctaggactctattcctacagatgtacctgtaatcccaacactttgggaggccgaggcaggagtatcacctgaggtcaggagttcaagacctgcctggccaacatggtgaaatcccgtctctactaaaaatacaaaaattt

SEQ ID NO: 268554 - DNA, 425 bp, Homo sapiens
tacagagcacccacaaatcgtaatctcgcccaaagcactctaacaggataatttaaacaaggttaggtagcctgcgacctttaaaaaaatggcatcccactaacccgcatggaccccatagttgcgtggttcgtgctacaaatcactggggtggtttcatctctcttagtatggaaactaatcagcaacataaagtgatgaaagcaaacggatcaatatcagtggcactaatcagtggggggtttatttgtaaagtattgaaagtttaaccaaaattccttaaaaggcaaattattccttccctgcattgctcttgtatcttaatttaaggattactgtatattgatgcaaaactctggttgttgatgccaaagaatggagggtggaggaagggactactgcttttcttggatacaaatttgcat

SEQ ID NO: 268555 - DNA, 156 bp, Homo sapiens
gcatagcccatgctcacagtgtcggggcacaggggtggtgcccgtgccaacagagcccacgctcacacagtgtcagggcacaggggtggtgcccgtgccaacacaaggttgtctgtttattcagtcaacaaacgctcactgagaagctactctggg

SEQ ID NO: 268556 - DNA, 197 bp, Homo sapiens
gacctcgtgatctgcccatctcagcctcccaaagtgctgggattacaggcgtgagccaccgcacccggccatcaccttgaaattcttaatttttgagcaaggggctctgtatttttattttgcactgagccctacaaattatacagatagtctgtggtcagtgcagatccctggtatttaacagcatcaattaagag

SEQ ID NO: 268557 - DNA, 489 bp, Homo sapiens
gacctgcctctccctgagatgcgtggaggttgcagttgccagtgatgacttacaaggggcaaaaatcccttccccttgcctcaaggatgactattcttcggaggagttacactcagagtatctgtgaatcaggccaaagtatgatgtgcctttacatggacacatcctggcttggcaacttcctttatcctgcttttcacattcccttcttcagtaaatatgcaccaaattgaactcaacatgagcaaagacagtaccaaggctgacaaataggcctgcgttcaggagcagtaagatagaaacctgcagtcacacaaggttgggctgggctttggcaccagtcaaaagggttttagcattggtccggttggcatcaaacaccctgctacagggcctttggctgggattgctctggggccaacttttctctatttccatgcacttcaacatggggtatcagtgctataacaagggttctagaacatgaaa

SEQ ID NO: 268558 - DNA, 391 bp, Homo sapiens
  misc_feature (1)..(1): n is a, c, g, or t
  misc_feature (13)..(13): n is a, c, g, or t
  misc_feature (30)..(30): n is a, c, g, or t
  misc_feature (34)..(34): n is a, c, g, or t
nttcggaacgagnggaggattaagtgaaancatntggtcaaagtcgcttagcttggcccctgatacatgataagcactcgaaatgctatttaattcttccaaaagctatttctctatttagctttcctaaatactgtttaattcaagtctttcatcctgcttaaaacgcttcaacgtcttctgaggttctttagggccacgtcctatgagaccatttcagcagcagcagcctgcatccccattcagtggcatggtgaagccattggcagttccagaagcattctcggggccccgggcttcgtatacattttgctcagagagcatgccctcaaccgtcccctgtcctctggctatgccatttgtccaccaggtagagcctcctctgaaagca

SEQ ID NO: 268559 - DNA, 338 bp, Homo sapiens
atggctgctgaaaacagttaagcctttgtaacaatttagacagacatatatgtatggacatggaaggatatcgtatacatgtcgctaagtagaggaagtaaggcatagaatatgtattagttgtacacacacacataatataggtgtatatatgtatcatgcataggatcccaataaactatattgccaatatctaccaggatagcccttgaaatgatagcatgctacttttggaacagagaataagcttaaggatagggtgagaatataggtgaaaattgactttttttggtaattgaaatttttcacaaggcaaatgtaattcatatagtgtaact

SEQ ID NO: 268560 - DNA, 510 bp, Homo sapiens
atatgaaatgcccctttttccttctcaccccaatttagggtgatcagccatctcaatttgcctgaaactgcccggtattagcactgaaagttccacatcccaggaaacctctcagacataggcaaactgggatgactggtcaccctacagtcttttcccatgaagtgaaaggagccaacctttgttgagagcccgagatctctgctagataaaccatgtaatacagcaaccttgcaaaggaaacttgctatgctcactttactgagaggagacagactcaaagagaccttattcaaagcctgtgcttattaatgcatttgacagtatctgttgaatgtcttccatgtgtgagtccctgcatggagtgctggggatgctgtggtgggcgagtcagacctgtccctgcccccaagtgcatgtatcttaacagcagagaccggcatctaacaattacttaaatacaaaatgtgatacatattttgaaggaaaaatagaagaatttatgaactg

SEQ ID NO: 268561 - DNA, 448 bp, Homo sapiens
tcaaatgatgcaggaaaagcatttgacaagctccaacaccctttagtgataaaaacactcagaaaactatgactagtagaagggaacttcctcaacataataaaagggtatttattttttaaaaaccacagttaacatcatactcagtagtaaaagactgaaattttttctaagatcaggaataagacaaggatgcccattttcaccagtgctattcaacatcatactagaacttctagccagagcaattagaccagaaaaagagagtgcatccaaattgaaaaggaagaagtaaaaccattaacagatgacatgattccatatatatatataaatcctaaagaatctacaaataaaattattagagctaacaaattaactcagcagagttagggtacaaggcagaaaatcagttatatttctatacactagcaatggacaacccaaa

SEQ ID NO: 268562 - DNA, 648 bp, Homo sapiens
aacagaagagggggaatgagaccctaagatttagagatgaagtctgaaacttaggactttatatttatctgaacatcatatgtaaattttactattatgggactggtattaatgcttccttataaaaatatatttagcctcatcagtgatcagggaaccatatttgggaccagtctgttcagttggcaaaaattaaaaaggccatcatatcagaaaggagaaggtaaaatgatttgttcacagacagcatgatcttttatgtacaaaaccctaaagattccacccaaaaaaccctgttagaactaaaaaacaaagttgcaggatgcaaaaccacacaaaatttagttgcatttcgatgtaaaatttaaaaaggaaatcttaaaaattccatttgcaacagcatcagaactaaaatacttgtgaataaatttaaccaaagaggcaagacttgtacactgacaactacaaacattgctgaagcaaattaaagaatatagaaataagtggaatgacgcactgtgttcatagattgaaacagttaatattaagatgttgatactactcaaagtgatctacagattcattaggtaatccctgtcaaaatcccagtgactttttttcagaaatagaaaaattcatcctaaaatg

SEQ ID NO: 268563 - DNA, 673 bp, Homo sapiens
tgacgctgcagggcgggcggggtaaagaagggagcgagcccttctcaagcttggaaagtttccagactgctgggccagcctcctccccagagggaaactgaggtccgattgaggtttctccaagaccgcccactcctgctcctgtccccaaacccctttctgcctagggttcctggaagccaaggaaacagaacgaactgttccctgggtgggcgagccactgcagagtacaaagctttcaggccgcctgcctcattagcactaatggctgctcccttccgccctgtgtcgtcaggactgtctatgcctggtctcatcagcacaaggctggggtaaggactgcccttttgtggagatggcaggacatacaggaccctgctgcccctgccttccctcaccccactgcagagctgtttatcacacacgtgtccatctgggaaaggaatgcaggctgaatcagctttgagaggatcgcaaggccccagtgcacaaactgggttggcacaaggcagtggaaaaaagatgaagggggccaggtatggtggctcacacctgtaattccagcattttgagaggccaaggtgggaggatcacaaggccaggggtttaagaccagcctgggtatcatggtgagaccccgttgctacaaaaaataaaaaaatagctgggtgta

SEQ ID NO: 268564 - DNA, 769 bp, Homo sapiens
tgacgctgcagggcgggcggggtaaagaagggagcgagcccttctcaagcttggaaagtttccagactgctgggccagcctcctccccagagggaaactgaggtccgattgaggtttctccaagaccgcccactcctgctcctgtccccaaacccctttctgcctagggttcctggaagccaaggaaacagaacgaactgttccctgggtgggcgagccactgcagagtacaaagctttcaggccgcctgcctcattagcactaatggctgctcccttccgccctgtgtcgtcaggactgtctatgcctggtctcatcagcacaaggctgggtgtactccccttcaagggccctgttcccaccttgtccaggggagagggtggggggtgcagggaaaaactgcaagcacccgtggctctgtcaatcagggttgattttgaaacccctacccagcccattgcccctgccccagagagcacagccatgtgtttcctgtgaatcatctgtaggatttcctaaggcagaggttgcctggagaggcacggtctcctcagtcattcagggagaggagaagatggatgggggttctctcgggctggtgtattgagccctgagctagagaggatctgtgattgttaattttgtgtgtcaacttgactgggccaggaatgcccagatatctggttaaatattatttctaggtgtgcctgtgagggtgtttccagaatcatccaatcctttgagggttggaataaaacaaaaagataga

SEQ ID NO: 268565 - DNA, 391 bp, Homo sapiens
aatgttcagtcttttactgttaagtatgatgttaactgtgggtgtttcatagatgcactttatccaggttgaggaagttcccatctattcctagtttgttgagagtttttaacatgaaagagtgttagattttgttagaaggtatttctgcatctattattgagaggatcatgtagtttttgtcctttgttctatcagtatagtatattacactggtcaagtttcagacgttaaccaaccttgaattcctataataaatcccacttgttcagagtatataatcctttatatatgttgcagaatttggtgtattaatattttgttaagggatattattctgtaattttattttctggtaataaaaatgtctttattaactgttctcactgaa

SEQ ID NO: 268566 - DNA, 587 bp, Homo sapiens
cactgttattatattaggctgaataaccaagaaccacaggcagcagagatgtggcactttaccaaactccacaacctgttgggactattaacgtgccgtgtgcaaacaaagcagatgtcctaggaagatccttctgctccccttcccaagcagggcccaggagctgctagtctcacttatcaagcaattaacatgccatttaacctttagcttcttgaaccccgaaactgatccgggcagtaaatccttggctttaacaaagggtagggtgattatgagctgttagtactgtgatcacttcccgtaaggcctttgaaggagatggaatttccagttatcaccagatgttgagtttgataatgtcattgttctgccaggatggaacatttcatacgattggagaatgaaagaataggaattagtaattcagggactaaaaggtgaaattacatctttatgaagaatttttctttccggcacaaaaccaaagttagagttaaaaaaaaaaaacctcacctaatggggccgaatttgggctaacttgccttcgccctatagtgaggcgtatacttcctggcccccgtttt

SEQ ID NO: 268567 - DNA, 357 bp, Homo sapiens
acaccctctctgttctctccccttgtttgtctttgtttttttcctccccccccccagacctcccgatcagcaatgactgttttggccacctatgcccctggcccccagggcaaggcctgtctcccaggagcagctcgataaacccctgtccagtgaatgcctgaaaaaaagcccagccggaagccccagagctctctcaggttgcccaattctctttcctgaaatccaatcgtgtggcccctggaaattgcagccgatctcatcacttgtttgctcgctcactcactcactggctaacgtgcagtaagcacgtcctgcatggctggtcctgtgctgggctgagccacagggaggccg

SEQ ID NO: 268568 - DNA, 551 bp, Homo sapiens
aaatatcagttttaatagattaaaaaataaaatgctttgctatataaccaataaaataagtccctatctgtgtggagaaatgacaaaatgctaatgaagacaattcaaagaggtccaagtaaatatatgaacatattatcttcatggactgcaagactcagtggagatgtgtgacctataccaaagctatctgtagattcaaagtcaatgctgtcaaactactagcaggaatttttgtcatgtagacaagctgactcaaaaagtgtatggaaaggcaaaggatctggaatagttaaaacaattttgaaacaaaaaccagaaaatcatggtggaatcatactgctcaattttaagatgtaatataaacctacagtaatcaaaacagtatggaattggctaatggatacacatatagattaatggaatagaatggagagtccttgaatagacccacacaaatatggccaatggagatttttagaaaggagagacaattcattatatgttaggcttttcaatcagtgatattggaacaattgaatatccatatg

SEQ ID NO: 268569 - DNA, 1783 bp, Homo sapiens
gaaacagaacaacaaggtgacagccttttgctcaagtcaaaaagaaaataagtccctcatcttagtttaaagttgttcattcagtagtacagacttgcatttgaagacttattcttgatcttctgtagctttgacagcaaggacatcactacaatgggtacagaaataacacattctgatccttgctgagatccttgtatgggcctatcttaaatctagcctattgtctgtcttaccctttgatttttataagtagaaaacaggaaaaggctaaccaagcaagaggaaggcatagattcatcttcctttcaatcttgactatagtttaaagagaataccatgatctttctgttctattcttggcttacttgaatatttagccaggtctctgcatcttattcagtcagaaaacagacacagattcagataactcaaaggatgttacttgcttgagtaatccttgggcctcgctttaactttgtagatccaggaacagaattaagcagacagttcggtctacactgccaaatttcttagggaaaaagagggcaagtcagaaggaggaagttggcatttggctcaaatgaccaaattatttaaggtctctacacttcactttgcaccaagtagacccaagaatgattataattcagctacgtgtggtggtgcagatcagtagtcctagctattcaggaggctgaggcgggtggattggttgagcccaggagtttgaggctgcaatgagctatgatctcgccactgcgctttagcctgggcaacagaacaagaccctgtctcaaattaaaaaaaaaaaaaaaagaagactctaattctatgagtggcagggtcctagaattatcaaaaatgggttatcaaacccatatgcataccaagcattgtctatagaataaagaatgttttgtccacatgtgtacttgtattcttaaaatgtttgtagcttctgctataatgattaaaaatacaaatctgattgttttcatcatgatgcagttcccaaacacttcaaaactactattgtgtggaggccagccaacattttttactttaaaagcaattctcagatttcaaaatgctgggaactaccagtgaagacttcactctaaggagttcatccctgagaatgaagactgaggctagaggttgcttggttactaaaagagtcaaaaacaagggagacagtagaatcaaaagccaagacacaaatttagcctaccaaaacctagggactcttgtttcttttagttttatttcaggcgtgctaaaacaagaagcatgctgcacctttctaatctgatctatcactaagttgcatggcaggtatttgtaaacttataattctgcaaaaggccataagctttctgagagttgaattcaatttttttttcaaagatttaagttaagtacccagcctgtccgaaacataagaatataaggtttcaattgcattatgaaaaactctacggtctgaacttcgtggccaggcacagtggctcacgcctgtaatcccagcactttgggaggccgaggtgggcagatcacttgaggtcaagagtttgagaccagcctggccaacatggtggaaccccatctctactaaaaatacaaaaattagccgggtgtggtggcaggtgccggtaatcccagctactcaggaggctgaggcaggagaatgcttgaaactgagaggtggaggttgcaatgagccaagatcatgccactgcgctctagcctgggcaacagagacactgtttcaaaaaaaaaa

SEQ ID NO: 268570 - DNA, 789 bp, Homo sapiens
caccatgcactggctaccaacttgtctgagtccggtgggacagaacactcatattcacaagttacatgaagcagatttattacttacagataggagcaaaggacaacagaagcctggtcccccaagcctcaggaatgctgcccaaggtggataatgccttgactgtgtatgcctcacttgcactgcagcagtgggaccctggaagtagcttggcttgggttttatgacccagggcaatgtgatcactgggctaaagcactgaaggacatcctgttcggggcgggctttggggggattggaacagagcccaggaagttctggctagtcccttcctatgtcaagatattacattccagcacattctactgttgttttagagaattgtaaacaagaaagtggggagaactggatcagtccaaggacacccagagaactgtcctgcagaagtaatctcttacccagttcagtgccctggggcccatgaaatgtagggaaggctagatctccttgagaaaagttcctgtgactgtcacaagtataaactattttcctttaagctcttcagaggagcctaacacttacctgagtgtatcccagagaaaaggaagaaatttcaagaaagagggaaatacccagagctttcaaggtatattctacactggctctgatttgaagctattccctggggacccaaaatgctactataatcacaagcagggcttatttccaaactcattctatgaggtcagtattaccctgataccaaaaccagacaaagacacattaaaa

SEQ ID NO: 268571 - DNA, 492 bp, Homo sapiens
agaaaagcagccctttcagattttattgttggaagttccttgggttgcagagatgcagattcaagtgccaaaagttgtttctgatgagacttacctttttagccttaaaatatttgtatagttggctctaataatttctcatttttgatgaatttgaaatcatttcacttctaaatgagattggtcatctcatgagtggtcaagttggaacatggaggtctatcatgtttttaacctccaagatccacttatggggatgaggccaaaggcacaatagttacttctagaagaaccagattaatttttctgccttccatcaccgcagtgtattacctttgaccctcgctggtcatctggtaagtgtagttcatcaaaagagcagaaataggcacaaagacagtgccaggcttggtacaacctgttaacactgttgaggaaagagctcaaaacatgcattactttggggattaagtcagtgtttaatctcaatat

SEQ ID NO: 268572 - DNA, 281 bp, Homo sapiens
gagacactccctcacctaggttgcagtacagctcatggccacttccacctcccaggttcaagcaattctcgtgcatgagcctcccaagtagctggaattacaggcacgagccaccacacctggccagctttgtgtatttataatcatcgtttctcttgttatattttcctaagttttgaagcaagatgtatttcactttgaaccatctgttcggaccggtgtctgttaggaaactgtgtttggatacaacaaaatccataaaagcagtagctttaatcaat

SEQ ID NO: 268573 - DNA, 385 bp, Homo sapiens
gacactatcaaggatctcctcccaaatgtatgcgcttttcctatggaaaagggcccttgtcaaacctacatgacgcgatggtttttcaactttgaaactggtgaatgtgagttatttgcttacggaggctgcggaggcaacagcaacaacttttcgaggaaagaaaaatgtgagaaattctgcaagttcacctgattttctaacaagaacacagccctccatggattcgggattgctctgagggccatagaaggcatttgggtgtgtgtgtgtgtgtgaacaagaggttcattcctctacccccacatttattctccctgatgtgctcctacaagtgcttcatctctgtgcctgaaattctataaatgttgcaatcatgaaaaaa

SEQ ID NO: 268574 - DNA, 468 bp, Homo sapiens
aaggtggtagtgactgctaatgggcgtgagggatcttgcagtgatggaaatgctctaaagttggattgtagagatggctgcacagctcagaaaatgtactgaaaatctttaactttatgttaaaacagatacatctatagtatgtaaattatattttaacaaagctttttgatttaaaaaaaaaagaaaaatgtgtttattacatcagcttagaaacataccttgtttccatagaggtgagagatgatttactttgagagaagacattgtgtcacctatgacattttattaggcacagagtcatattttaaggtagatagtcctgtagtgctgaaataataattttaatgtctttatgttgccacatgttaagaccatgatgaaggtataaatggaaatgtttacacctgaaatgagtgttttcaaattaaaatttaattgatttgcttcaacacttaattgtagatt

SEQ ID NO: 268575 - DNA, 532 bp, Homo sapiens
agtccacaggggaacatcacgcagctgtgcagacacatgcacgccatccacataacacgcaggtacaaagggacggagggacagagagaaaaaagtctgggccggggtaactgtaagccaccgtatatgtcattgggaacactgactcatttaccctgggcctgatgtcactgacttctacctcctgccccaagacttagagtgaaagatgaaaagatgacctgttaactcacctgtgggcaggatgtgtagaccatgtagcatatgtgattgaatacacagccagtccctccattaactccaaaggacacggctccttcggcagctgctggaggccaggcggaagccactcccaggtgggtgcatcctggctgactttcctggaaagtcccgatgctacactgacaactacattctctttagcaattgtaggatggccagcaaggacactgtggttatcggcggtggaaagtaaattcttggcatcctactgctattccaggctattaaactacattacggtaaaatgtgt

SEQ ID NO: 268576 - DNA, 269 bp, Homo sapiens
ccaaggagttgataactaagttatcaactaatgatcaatgatcaattatttagtcaatcatgcctatgtaatgcagcatccataaaactccaaaagcacagcattctgggagcttccagatagctggccacatggagattcctggagggaggcatgcccagcaagatcatggaagctccgtgccccttctcccattccttgccctaagtatcgcctccatctggttgtttgtctgtatcctttattaataaacaagtaaatgtaagtaa

SEQ ID NO: 268577 - DNA, 457 bp, Homo sapiens
cctaataaccaaacctataacagtctattgcttttgatcgaatcttgatttcaaggagcagttggaggacaactgaggaagtgtgaatgtgtattagatgataaagaggaacttctattaattgtgttatgttgatgacatatactatggttatatagaaaagtatcctgaaattttagagatgcctatttaagtatttaaaggtgaaatatcctgatattggtatttaccttaaaatattttttaaaaagtaaatacggcaaaattacttaaagtgttaagtctgggtgttacagactgcatgtctgcgtcccctcaaagttcatatattgaaccctaacccccaagggaatggaattaaaaggtgggcctttggagatgactggatttagatgaggtcacaagggtagagcctgcatgatgaacagggtgggaccgtatctcaaaaaaaaaaaga

SEQ ID NO: 268578 - DNA, 681 bp, Homo sapiens
tctctctttgttgtacaaagctgctccatcttaagcttgatgaggaaatgaagaaaagttgaggaaagggaggcatctctcggggaggatcagcctcggcattatgagcaacaggggatcctaaagagtgccaaattgggtctggatcattcaatttagtagttacatatccaccaccttatgttgctaaataactgtttctagcacatctgatttccccaattcatttgtttaatcaacaaatattcactgagcactgctatgcatcagatactattttagggcttaggtacaacagtggactctaaagattgcaaatatctctgaaatagtaactgtatcctccacggcactggcacagtgctggctccagagcagacattcctgtggaatcaatgatgaaagaacatccttgagatctgctgatctatgaccaattgaccttgaataacctgctttacaaatttttcacttgagagtgtattctgccatatatttcaggttccccacttggataaatgtgggtaataacattatcttaccttgctagatttcagactctatctcaggtatggcaaatgtatggtacaaacagtggctcttatttcacctacagccatggcagacattgcttattaatctcaatactctttccagataagattgaaaggagcaaaccag

SEQ ID NO: 268579 - DNA, 374 bp, Homo sapiens
taaaacaaaacaaaacagaaaaacaacaacaaaataaggcagactggacaagcttgtgacaatgctgccttttaagaactgatgacggatggctgggcgtggtagctcacgcctgtaatcccagcactttgggaggccgaggcaggtggatcacctgaagtcagaaattcaagaacagcctggccaacatggtgaaaccccgtctctactaaaaatacaagaattagctgggcgtggtggcagggacctgtaatcccagctactggggaggctgaggcaggagaatcaccctaatccacaaggcggaggttgcagtgagctgagatcgcgccattgcactccagcctgggtgacaagagtgaaaactccatctc

SEQ ID NO: 268580 - DNA, 452 bp, Homo sapiens
tgctgggatcacaggagtgagccacaccgcgcccggcctgtgctgctcttattaagcaactgcctcatatgaggctctaaatagcttcttttagtgtttgaaacctcataaactgtagtcatggcaactggtgtctgatctaggtgggagccagcttctaaggtaactggacatccagcagatcactccacagctttgctcccagcctgtccacctcaccctcggtcaacttcccctgagcctgctgctgtctcttgagcccactgtgagatccagatagatacccactgaggaggaagcaggatggagacatgggatcaggcgttgctttcttgtaaatatgtgcatttcctgttactttacatgtaagcttctaggttagtaaccagtacagtgatactgagatgacactggtcacctttagagtgacaatatgatatccttcatctcta

SEQ ID NO: 268581 - DNA, 530 bp, Homo sapiens
tgctgggatcacaggagtgagccacaccgcgcccggcctgtgctgctcttattaagcaactgcctcatatgaggctctaaatagcttcttttagtgtttgaaacctcataaactgtagtcatggcaactggtgtctgatctaggtgggagccagcttctaaggtaactggacatccagcagatcactccacagctttgctcccagcctgtccacctcaccctcggtcaacttcccctgagcctgctgctgtctcttgagcccactgtgagatccagatagatacccactgaggaggaagcaggatggagacatgggatcaggcgttgctttcttgtaaatatgtgcatttcctgttactttacatgaaagcatgagatgtcaatctctggacctgccttctggacgccatttatctaaaattcactgtttgttttttttttttgaaaggtaaagcactagtttaccttagctacaactttcatggtatataaaccttgcagaaacttcattaaaactaactgaaggaaca

SEQ ID NO: 268582 - DNA, 522 bp, Homo sapiens
aaacttttttttaacaaaatgtatcattcgataaagtgaattttaaaaaagttacataactcttcatttttttatttccaaatcgtaggtttttttaagctgtagaactgttatctgtaatatcttgctgtagaaatatcaaatcatttgaaaatttgcacatttttgtgcaaaactcaatctacagtatcagtctcgtcagatatattaattttacacttcagttttgattggtgagaaagtacccattctcttcaaataatcaaagataattattattttgttttgtttttggaatcaacagggaggcgcaaagtataaagttgctgctaacatatatacatatatatccatattttataagggtgtctatgtatatatagacagtgtgtccacacaaaaaatagatacagttatcagtcagtcagttcttccatgatttagtttttttaaacgtagaaaagctattgtaaacatctctttccatttattcttaattttttgacatattggtatttcttt

SEQ ID NO: 268583 - DNA, 827 bp, Homo sapiens
ggtttgatttcctgcgctgaactgatgctgcttccagaatgaatctgctccttggtgggttctgctgatgtggccagtgctagcctaggccacgaccacctagcccaccacccagaaggcagcatcccctgctcctgctttaacaagctggcccattttcatctctcctacctctgggagtagcaggggcgctcccggaagctgacaccccctccacaggtccggctgcaggggctccactggctccagggtccccaggtgtcactctgccgcctcaccttgggagcctgcagaagacaggaccatgcatcagcattgcccactcacagcctgagcccagaggcccctccaaagatgctctgcctaaaaccctcccctacccatcaaggagtctgggattctcccttccagggcccacctttaggactcagcaacactgccgggcaccccaaaacatattccttttcagaattagcctgctttcctcataaggagctgagagccaggcctggagggcgggagcaggagcagctgggaagagtttggagtttcaggggccactggaggggagggaccctacagccaggggcagtttgagggtccaggcatttgtaggttaaccgtgatgtaggggaggggggcctaaaagaaaataaagggaagcaacgtggggggatcctgctaatctggccgagactcccaggagtaccccaatattcatcccctccttctcccattgtgagagaatgcttgaaaacttgactcagctgggtacctggctgcccaaaatttaaaaaaaaaatacatttcctggactgcctgcagct

SEQ ID NO: 268584 - DNA, 513 bp, Homo sapiens
gccggcctcgaactcctgacctcaggtgatccgccagcctggacctcccaaagtgctgggattacaggcgtgagctgccgcacccggccctgtgtttcttttctgtttgacaatctctgacttttaattgagatgttttgacaaagttatatttaatgtgataattgatagattcaagtctgtcatcttgccatttgttttctgtttgacccatctcttctttttcttcccttttcctcatgtctttggttgaagaacttcctttgatatttctttttttttttttttttttttttttttttttttttgtggtgagatggagtctcactctgttgccaggctggagtgcagtggcgtgatctcagctaactgcaatctccgactcccgtgttcaagcgatttcatgcctgtaatcccagtactttgggaggaggaggtggacggatcacttaagtccaggagtttgagaccagcctagccaacatggcaaaatgctgtctctactaaaaaata

SEQ ID NO: 268585 - DNA, 538 bp, Homo sapiens
gacttcatgcccacagatacattcaagtcccagatggaaaggtgatctggatcaggcaaggtgctgaccatgggaacaggagagagtcaagggaatctgaggaagcacatgtttgtgtccaatatagtcccctccttgtgccactcagatgtgctcatgccctccaactgtggctggttttataagcagatgccttgtgtagttgcacgcagtcttgtgcttgaggggctttttgcttggattaatgttctgcacttgcatttttatttttcagacagcagatactcctccgctgaagagggaatagttctgcagtaattccctaggggtttgctttctcctctcctacgggcttgatggagacaggcacagagtcctataatgcccacgatgcatgcctctagcagctttgaattctgctggatcatctgactcaatgggcagagcaggttgggccacagcctatacctgctgtagagatatcttatgttctggattccacttgaaaccactagtctttgcattcattctgtaaccc

SEQ ID NO: 268586 - DNA, 164 bp, Homo sapiens
aggaattcagaactgcttaactggatggttctgagtcagaatctctcatgaggttatagtcgagattcagctgaaggcttgactgcagttagaggacccacctgcaagacggcttgctcatctcgctggcagactggcgctggctgctggcagaggcctcagct

SEQ ID NO: 268587 - DNA, 498 bp, Homo sapiens
tggatttattcagtatttctcacatctgttcctttcttctcatttttaaagtattttcaaaactgtttccctctgtctctccagactaattgggtaactagcaactacataaagacaacctatggatttcaaggatctttcattactgtaaacctggtaatcaaactggtaactctttctgaggcctgaagaagttgctgttctgagagttctgttatgcagccatcactgtttttaggtgttttcctttgctatagaaataaatgagaagtatgtatgtggtttatttcacttcattttattctgaccaacacagtagtgaagcttcaattgaagacagagtaattatacatgtcatatccagtaaagaattaatggcatcttttcgttcctcaccaaaaggggtaaatcagaggctaggggagtcatctggataaaagagaatattttactcatttagaatttagaatgcatcgtatgcctgtttagtattttact

SEQ ID NO: 268588 - DNA, 568 bp, Homo sapiens
tgacctcagatgatccacccgccttggcctcccaaagtactgggattacaggcgtgagcccggccagcagaacctgtctttaggagactcacaaaattgccctgcgtgactgcttactttctaaaagagaatgcagtatttgaaatacagaatcacaaattaaatcaatattagtaaaaataaagcaatactaatataggcactaccaaaattagcagattgttttcacagtgccggagtcaatagaaatgtacactttttttttttgccttatatacaaatgtgctgtttcgcttcacaccaatgatctgaatgaaaatgacttccttgataactgcaactgtgctactgccttgtaattactctgtaactcagagctccttaacagcagggaaacacacaccaaataatgattctcaactcttccagaattcctcccttgtggtcatgcttgcagttgtctgatttgtaccttagtagtatcatcttacatgttctaataaagtgttcccaaaccatgctctctgtaacactagagttcagcaagttagtactagatgttctgtaa

SEQ ID NO: 268589 - DNA, 570 bp, Homo sapiens
agcacttcgggaggccaagatgggtgcatcacctgagatcaggagttccagaccagcctgaccaacaagagtactgagctgtctccgaagaattcagattattgaatgtaggcacccttttctgatttccttcatcaattcaattcaggagatgtgatgcaatgtgatgtgtcaatgtatgtatgatcgaagtgtcagtctctataagtactccgctccatgatcctggggtgaagtgctacaaaacacatttttggtggagcagaaatagtgctgcctttcctgtgcttcccacggctgttgtagatagaaagcaatgaattcagaattctcaagtcggccaggccatcttctcagtgagctttgcctcaggcaccctagatattaccacatgagagctatatttcatctgttcttaaatttttgcagctaaaggaccacatttgagggtcgaaatccctgccacaaaaccaaccttaccaccttttactactcataagaaaaatccatcagaatttactggaatttattgcaagaatgaccttccatttcatgagttgaaaaaaaaaa

SEQ ID NO: 268590 - DNA, 433 bp, Homo sapiens
gaggctgtttcttctctaatgatcacataatatccaaattatatcaacttcattatttccctctttccttttcctaaccctttccctttatttcttgtttctcttgaagactacttcaaattacctatttgtcttcattactgcccccaaaactctaataattgtgacccctaactgttcatttctcttcctttctccaccccattctgaacatccttctttaagttttatttaatgaaagaacactaaagtgagtgagttcataaacttgagactcgtaggcagagtgaagcatgtcttcattttagcttcagagtttaaaagttatcaatattcttttgagagtgggaggacctgagtcacagttttaaatgtcaactgtactagctgaggtcattaattccccttaccttcacgtttggccaaaaatgaa

SEQ ID NO: 268591 - DNA, 434 bp, Homo sapiens
tgtgacttagttgcgttacaccctttcttgacaaaacctaacttgcgcagaaaacaagatgagggcaaaggggaggaaatggggttctgtttgaaaaaatgagggagaaggaggagagagcccatgtgtggtgtgtgtgcccctgagaactttgtggtgactgcctttgggagcccgcaggtggccagaggcaggggtagctgagttcctggagaccccttttttgcccccaggttccccagagggcaacgccatcagtagcagtgtggtgtttcaggcagagctctggccaggctgtgccagtgtgtcccggacgcatcactaaggaagagagagtttatttagtcaactggcccaaggcagcgaggcttctacagtcccacaccccatagccgcctgggcttgggcttacttggggcttgaaggttctggac

SEQ ID NO: 268592 - DNA, 347 bp, Homo sapiens
gcagccaagaacagatcattcagccactttagggtttataaaaatcatatagatggccgggcgcggtggctcatgcctgtaatcccagcactttgggaggccgaggcgggcggatcacgaggtcaggagatggagactatcctggctaacacggtgaaaccccgcctctactaaaaatagaaaaaatcagccgggcgccgtggcaggcgcctgtagtcccagctactcgggaggctgaggcaggagaatggcgtgaacccaggaagcggagcttgcagtgagtcgagatcgcgccactgcactgtctgcctgggcgacaaggcaaaactctgtctcaaaaaaaaaaa

SEQ ID NO: 268593 - DNA, 422 bp, Homo sapiens
gagaaggcctggctcttttgcccaagctgaagtgcagtgatgcaatctcagctcactgcaactcctgctccctgggctcaagccatcctgccaacctcagcctcttaagtagctgggaccacaggcatgtaccatcacacccggctaatttttgtattttttgtagacatggattttcaccatgttgtccaggctggtctcgaacttgtgagctcaaacagtctgcccacctcggcctcccaacgtgctgggattacaggcgtgagtcatcacacctggcctcattttagccatttttatgtgtataatacggtggcataaagcacattcacattgctgtgcaaccatagccatcatccatcttcagaatctttcttttggccttggttcaggctttgggagctatacaggatttattcact

SEQ ID NO: 268594 - DNA, 194 bp, Homo sapiens
atcatatttccataagccacgatgtctcaaccatgtctccttatgaaagggtttgaagtttctagctcctgaagagaaagcttgtttctcttgggagaaagaatgacatcattaactcctcagagtaagaccctaaatctttgttggtgtgtggagaacaattactctagtctctatttgccacttcagcccag

SEQ ID NO: 268595 - DNA, 478 bp, Homo sapiens
gagactagctgggcaatgtagtaagacgctgtctctacagaaaataaaaataattagctgggcatggtggcacacttctgtagccccagctactcgggggctgaggcaagaggatcacttgagctctggatttcaaggttacagtcagctgtgaccgctccactgtactccagtctgggcaacagagcaagactctgtcaaataaataaataaataaatggatgaatgaatgaatgaatgaatgaagctaaattacctttttctcccaaacagtcccagaatcaattactgttggtatagtttcatagttttatggatattccagaaggttgtcttccataagaagaatgttaatgtttcttgcaaagcagctattggcttttgaattttaaccttcttttgagtgaaatttataattaatcatgagtacatgtaaactcatttaaaaatgaaagcatcaaaaatgaacctgatgctg

SEQ ID NO: 268596 - DNA, 836 bp, Homo sapiens
gcaggatggatactggccagcattcttgaggtcctaagtcagatctggagacaaaggggagatagacggctcagacccgtgcagcacctctgatgatgcttgtgaaggctcttgcctcttaacccctctagctaagcgctgggagaggtcatttgttacattactgcttccacttaagaaactgtctctggctaagtggttggattaataccaaagcagaaataataataatggataatagtatattagactgagcagtgacctcagaaaccatcccctcactttgcagatgaggcatctctggggtacagagaggtgaagtggcttctccaaagcagcgtagcagagaaaagcagagctggaatcacagctaaagctcccgtgccaagtccacagtttgactatgcgggatgatgttacctcccctgtgacagcaagtcacagagatattgcccctcatcaaccctagggagttttaagatgacctttatgttacaggaaccttctgggcttcctttgctcttctggggctcgttatttagagaacatttgtggtccctcacatgtcacctaggtggactgcacacaccctccttcttgaacttcttttccttcccccagacactcagagtagcctgcattcttcattagggtgccccagcacttccaagaaccacatgggcccgtgagagggaggtcaaggtcatcccttttgtctcttgttatcatagtcataattctgctgaaaagctacacgatgcagatcccaagatgagagtgaacagcaccagtcaatacctgtagacacacagagctaccagagggagggccatcta

SEQ ID NO: 268597 - DNA, 209 bp, Homo sapiens
cacatccttgatttccttggcacgagggaacgaaccttgggtattaccccagatgacgacgattcttcacccccactggttgtgaaagatgaagaatgcagcccagattgcagctggcagccactttgtgatcagaggggaatgagcctgtggatgaagccaacacagtggagggaaggatggagacatggaagaaactgggccttgtt

SEQ ID NO: 268598 - DNA, 635 bp, Homo sapiens
tggagaacacaaaaggcactgggatcgaggtaaatgcctggattttgcagaaggtaccaagaaatcctagaccttcactgtacagtgtaggggccacgggacacgtggctgcccagcactggaaatgtgcctggcctgaattgagatgtcctcctgaaagtgtaagaacatgccagattttgaagattcagtttgagaaaagaatgtaaaataactcaataatttttatattaattacatgttgaaagggtaatattttggatttattgggttaaatatattatcaaaattaacttcacctattctttgatttaaaaatatgtctacatgaaaacttaagataacatatatggttcacatttgtggcttacattatatttccatgggatggtgccattctagactctgtaattcattgattttgctccatctccttggcagcattctaaaacatagtgcgaagcagatggttgtgtacttgtaggaaagaaagtagtaataactgaaagcaagaataattctactaagaacaaatcatgccaaactgacctcatttttttttctttttatagggttacttggctagtgtctctgatcagtcggcattttagagagcatgagttgggttgatgccg

SEQ ID NO: 268599 - DNA, 448 bp, Homo sapiens
tgaaagggtgagaataggaagaattcattattcttgtgcctgactattgaaaaatatataaaaatgtgtaacacattttagacctgggaagagatttgaactagtaatctgaaaacttgagtttgcattctagctccacctctagctatgggactgtgagcaagtgtctttaaactctgaaccttggtttttctcatatgtaaaataagtgtaataataactgccctgttctgtgttcctctcaggataattgtcaggatcaaaattcatcttattcaactaatattttgggcatactttgtaccaaccagatgctggggatacagcagtgaataaaacaaagtccctgctcagtggagtgaaatgaaatacctgtgacagtgttttgaaaattgtgaaggaatttagaaatttaagtttttatgccatccaacacccataattttac

SEQ ID NO: 268600 - DNA, 499 bp, Homo sapiens
acagacaaggaagtggtgtcaaatggacagtaaaggtgaatcacatactcagctatagcctgctcccagctggggcactccaggcccctcctctggtcactactgtagaaattaactgcatgtgtctcaatctgcgagtgcagctgcttctagatggtggcaccttccagagcttggttcgccctgtgtctacccaacaagtacagatgccatcccggtgctgtgatcttccagccatttctccatttctgtcacagcccagaaagtgacgccgcaaggccttagagcaagggccgttccatcagccctggcctacctggggctccatggctcctttctttttctttttgttttgagacggagtttcactcttattgcagaggttgcagtgagccgacattgtgctactgcattccagcctgggtgacggaatgaaactctgtctccaataaataaataaataaataaataaaataaaaagttatactgtttgattcat

SEQ ID NO: 268601 - DNA, 508 bp, Homo sapiens
ctttttttgatttcactttttaaattaaagtattgtaaaactggctttttggtgcacagttttgagaatttcagtacatgaacacatttgtgttcccaccaccacaatcaagacagagggccgttttattgtccccaaagctccacatgctatcctttcaggtctacttcctttttactgtttttgtaatcactgcacttttaaaaacaagttgtacgccaggtgcagtggctcacgcctgtaatcccagcactttgccgaggaggagcacttgaggccaggagttcaagaccagcctggacaacatggtgaaaccccgtctctactaaaaatacaaaaattagttgggtatggtggtgggtgcctgtagtcccagctacttgggaggctgaacaggagaagtgcttgaacccgggaggcagaggttgcagtgagccgacattgtgctactgcattccagcctgggtgacggaatgaaactctgtctccaataaataaataaataaat

SEQ ID NO: 268602 - DNA, 1051 bp, Homo sapiens
  misc_feature (76)..(76): n is a, c, g, or t
taatgtttatctttcttgttatagcaaactcattcaagaggaaacccctattaatatagtaaatgtggtaaagccntcatgtagataccaaaggtcactaattatatcagcaaactcatgtggtagataggtccttctgaaacggaatgtggaaagcttttgaaagtgacatatgcatcagatacttaaatcagaagggaaaacgatagagttaaacttggccattggccacaaaacccattgcatagcaggaaagaattgcagtgattgtctaaaattctttatttaaaattcagagctgaattgccccctaactcagttatcagaaagatcctattctcgaaggcaataatatttaggttcaatgcaggtataaaatcctaatggagccatatctattctgcttcagcagagtcatacatttactctaaaagcaatggttctggtcacaggaaataatttctgtggaggattagatagcattaaacatcacaagcttttaaatataggagcagaatttgctccatacagagattttatgaatgcagtgaaagtggtaaaagcatcagtgataagttattttttatttcatggattcacttcttcacatcctaccatgtcttaaattgtgaagcatcttatgatctggaatgtcatagtaattgtcagggctttttaaatgtgtgatggcactttagatttgagtaattacccttgcctgtatatataattttataatggttttgcataattattatagaaaggattccagagaatattctataaatattagacatttcattgtcaaatattccttttgaatatatgaaaaataagaatataataaggattagtcgaatagtgacaaaggatcttaggggttgtgttgtggactgtactatgtgacatgtactttatatatttataaacttcattgtttacttggaattacacgaagaaacaattttcagggttaaagaaattctcaacataagacaaaatgttgaataattcaatgtagtgcaaataaaatgtttttttcttatgaatc

SEQ ID NO: 268603 - DNA, 1170 bp, Homo sapiens
cggggtttcactgtgttagccaggatggtcttgacctgatctcatgatccgcctgccttggcctcccaaagtgctgggattacaggcatgagccaccacgcctggccgctaggctttcttaatactcacctccaaagagcttaaggtattctagaagcttagaaaagaaaggagcagggagaaataattaaaaatgcaagtatgaaaagaaaacaaagactagaatgatgagaacctctggcatccttacctggtaagaagcccctggagcattgcttctaatatactccaatagaaaataggcccccacagttacaggaggcgggaggttaaaatagccggttctcccgggaatctttagttgccaccctttcctgggaggcagtcagataggaaattaaagaacagtttcagaatatagtacataaaaaataatggtatagcagtgatctaaaataatggagccctgggtttacaaccaaatgtttctcaactggaaaaaaatgttgattatttcgtgtacaggttgttgctatggaagtgtagttactaattttgggggagtgggaggttgggggaactcagactcctttgatagctaatgaattctagaactcttttcagaaaattgcaaatacatacaattttggattctaggttaacaaatctctgctttaggaaacaggaggataatttataaatttatcaaagaatgaattgcttaagagattatgttaaaaaatgtatcaaagggccttaaaatttgggggacactatattaattaaactttccttcaactcttgtttgaagacgtgtccctaaacccctagtttatattaactggttctccctgcaccagttgagggaccacccagtcaagaaagacacctgttcagatggtgtcattcttcactttggccagcctatacagcaatagaagaggcctatgagctattccctcactgacaccctgctatcccctttataatgtagatctcaaaaacaaccaaaccgattccagctactttattacttgacttatagtaagtggcagagtaaccttatgttttgaatatatgtgtaataatagtatcttttatgttttttcagagaagactattcaaggacctcaagtaattaaaacatataggccttaaaccaaaaaaaaa

SEQ ID NO: 268604 - DNA, 510 bp, Homo sapiens
agaggcagggtgggaagatgcccagacttgcacagcgtttttgaaggaacagataaaggccaggaagaatctgggatcctactgaccaactcttgcgtaaaaagagaagaatttttatccattcagtgggtgcaggcacaataaatgccttgctggattgcctattagaggatgaagttattagccaggaagacatgaacaaagtgagagatgaaaatgacactgtcatggataaggctcgagtcttgattgaccttgttactggaaaaggacccaagtcttgctgcaaatttatcaagcatctctgtgaagaagaccctcaacttgcctcaaagatgggtttgcactaagagagaagatggaactctggagcacttcagagacttcccagagcttcttccaagggagaagatattctcgtgaaagaaaaaaacaaaacaaaacaacagtgcttttttcaaacctgattaatttcatcaatttccaataaatctttcattctctcataat

SEQ ID NO: 268605 - DNA, 477 bp, Homo sapiens
tccacacagatgtaccacacctaacctcctctgcatagacccctacttccaaccaactcttgcgtaaaaagagaagaatttttatccattcagtgggtgcaggcacaataaatgccttgctggattgcctattagaggatgaagttattagccaggaagacatgaacaaagtgagagatgaaaatgacactgtcatggataaggctcgagtcttgattgaccttgttactggaaaaggacccaagtcttgctgcaaatttatcaagcatctctgtgaagaagaccctcaacttgcctcaaagatgggtttgcactaagagagaagatggaactctggagcacttcagagacttcccagagcttcttccaagggagaagatattctcgtgaaagaaaaaaacaaaacaaaacaacagtgcttttttcaaacctgattaatttcatcaatttccaataaatctttcattctctcataat

SEQ ID NO: 268606 - DNA, 294 bp, Homo sapiens
ttcattccttaaggcaaatttcttgaagtggataatgctgggtcaaatattgacattccatggaagattgtcccatgtacataccaaaaagaaaaataaaaaacctggactgctgtgtctcctatgacaactcttgctgctgaaagatgtctcaagttatccactgctatgtttcctttcctgttttgtgtccttccaagtgaagccagcaccaagtacagcctacttaagtcccattttgtctttttttatcactccctactgaaataaagtccacccaaatgagagctggaa

SEQ ID NO: 268607 - DNA, 267 bp, Homo sapiens
tccatcccctcatcaatcaatcaaccatttattgagcccagatgtggtacagccccagccggagatgacccagaggtggggtggggaggagagagatggggaagctgagtccggggccacaggtgcagccaggaggtgcaggtgagcagcgctcagaccagcctgtcagcctcagtcctgagcttacttctggtgatggagggagatatacagaaaagatcctgcagcctgcaggtgtggcacagctgatcttgggccaaggatgca

SEQ ID NO: 268608 - DNA, 1033 bp, Homo sapiens
caccagtacctctttctagaacatttttatcacccccaaaaggaaccctggacccattagcagtcactccccattcccccaaattccccagcaccaggctctcccccgtctactttctatctctatggatttacttattctgaggaatgaatagaaaaggttgattgtagaacatgtggtccttttaagactggcgtcgtttacttagtataaagtttccaaggttcatccgtggtgtagcctatgttagtatttcatttctttttatggatgaataatatttcgccgtatggataaatgtcaattctgaaaagtacaaatctcttggaagctgaaatttcttgtggcacatttgtcctttctccccagccttaccccaacctttgtctttttgaaaaaaatttgtttccttgctgcttctgcctttagtaccactgttttcatttcatgtttatactctgagactgcagaagcaaagcttttctccacttcaaatctctggccagctctagaaagtacatgtgtggatctctcagtgagaccttctgcaaataatgtcattgggagaccctctagctatttgataacattagatgagcttatattcaaagaaacttcaaagctatttattctagaagattcttaggaagagtcagtgatttcaaaagaaatctagacttacatgcagggatatgcagggtataaactttattgatggctcaggaaacaggtttgaaagagcttccggtacacaaaggggattcttctactgcagccgcttttgaaaagctaaggcagagtcagagtgaggaacacagaagcatccaaccgcttctgtcacgtaagcatgctgaggctgcggaaaaagagtgcgtctgactgtagtccgggagaaagggatgggctggcagaggaggaggagaaaatgcagagggtacaagtcttgtaaatgctctaattttaaaactgacggtaagttatgccatttccctctaacaaaaatgaggtaggattcgctattttcaaggtaaaa

SEQ ID NO: 268609 - DNA, 546 bp, Homo sapiens
ataaaaaatattttcattaaaagctatgtctttaatttctgatggaattagtagagattttattactaattcatttagtatttatgagtccactatggttgtcagttatcctttatgacataatttataagattactgataggagcacattttctaagctgaaacatttagaataccattatacaattctttaatagctggagacggaaaagagagtgctagatggagaattaacctctgaatcatgttatgcactagggacttagggttacttttggagtagtatggaaacaaatttaagaatagagtgtgcagtataactttataacacggctcattttcagtgtcagagatcaaataaataatgtgaaatatagcattactgtgcagtagaaatccaaaataatgcaggtagcatatgatataggcattatcataccccttaacgcacaacaaaaggtgtttattattatcataatgttattttccctaatatttatttgctttaataaattattattgcaaaataagtaatataaattaaat

SEQ ID NO: 268610 - DNA, 1366 bp, Homo sapiens
cgaaacggtcgccacctgagtctccattctgctgcagtggcccctgcgttaaagctctctcgtggtgcggctgccgaggctgcggtagctcctgcgcccccgtgctggtggcgcagcctctgcttgctgccgacctggcggaagggtgcgggagcgcacgctacgggcagcgtcggtctgcgtccttcctcctcctattccgacccccgcatcccacgcccccgcctcgctctacgcctcctccctggctgcaggcagaccgcttcacacagccgcagtgccctgtgtgtggacagcctgtgggagactcgcacgcccacactcaccccgcctggctgcacccctgcccagcatgtcggcgctcgagtggtacgcccacaagtctctaggcgatggtatcttctggattcaagaacgtttctacgagtcgggcaaccgtgccaacatctggctggtgcgcggctccgagcaggacgtggtgatcgatacaggcctggggctgcgcagcctcccggagtacctgtactcctccggcctcttgcaggaccgagaggccaaagaggacgcggcgcgccggccactgcttgccgtggccacccacgtgcacttcgaccactccggcggcctctaccagttcgaccgcgtggcagtgcaccacgccgaggccgaggcgctggctcgcggggacaactttgagaccgtgacctggctttccgatagcgaggtggtgcgggcgcccagccccggctggagggccagacagttccgggtacaggcggtgcagcccaccctcatcctgcaggatggggatgtgatcaaccttggtgacagacagctcactgttatgcacatgccaggtcactccaggggcagtatttgcttacatgacaaagaccgaaagattctcttcagtggagacgtcgtgtatgatggatcactgattgactggctcccatacagcaggataagtgactatgttggaacttgtgaacgtctaatagaattagtggacagaggtctggtagagaaggtgcttcctgggcacttcaatacctttggtgctgaaaggctttttcgattggcttctaactatatttcaaaagctgggatatgtcacaaagtttctacttttgccatgcgatctcttgcaagtttagctctacgtgtaacaaattctaggacctcgccctagtatctatactgataatatattttgattaattatatacattaattcattctgtgctatttaactgattaatagtgagcatttcatgaagtgcttttataccactattatatatcagagaaagattgagaatgaataagccaaaaagaaaattgttagtttaaattgttttctttc

SEQ ID NO: 268611 - DNA, 240 bp, Homo sapiens
gcccggagacctaggagccaccggaggtctgacccagagaactcaccaacagggtgcgccccatggtgaaaataaaatgaatctgttagagagagagagacagagaactccctccactttttttccccaagtcaccaccacttctgacactatctttttctctagcgttctgctgttgtggtccctggcgcatgcttgtttcacaaaacgccaagagtagatcagtggatgtcattggga

SEQ ID NO: 268612 - DNA, 686 bp, Homo sapiens
tatttgggttttcccagagggagactgtaactcaagtatttaagtccagatcatttatctgagagccacagaaaacaaacaaacaaacaattaccagggttgtgaagaagtgacacagagaagagaaggcagacaaaaacagatgagttttttggccagttatcaaaattgctgatgggctcaatactgtgtagcaccatggaagttgtatgatatgattattggagtcaaatgaggtaaatataaaaataatcatcagtgtctctagtaagacagcattgaaatttctaaaactattttattcttatatcaagaatagaactagagctccgataataccaactaaattattattgtcttttgttacatgaagagccttagaatgcctaattgtgctttataaaatataacactgtcagctgaagttgaatgtgctccaaggcttaataattctgagaaaaacagcttatattaaagaatgtctatgtactctcttgtccagcctctttttaagtcacaagaaagggcttaattagacttttaggtagaaagagtttgacacagaggatattttaatatttgctggtgcaaatttgtttcagaaagtattgagactattcagttcatatgtgtctaatttcattttttaatgtctgctaatataaatcactttaaataatttttat

SEQ ID NO: 268613 - DNA, 390 bp, Homo sapiens
cattgctcctgttgctcgatcatctgaccaaagaagatggaaatccagcaggttttatccaaaggaactgagtctttggtggaccaacccagacagggggccacaatcagaaggttggtgacatcaaactgtgaagaaaagtagccctgcctgcttgtgaacgagcatagatttcagcagctgagggtgtgatggctgtggaggtggtctgggccagtgacctgaggactggaaaatcattgacaatctgatatggaagatggctacacacaacgttatcgttcttcctggctcgtaagtgaagataagaggctatggcagtgagatttccatttgttgaaatgtatgctataaaaattcaatgttttcttgctagaccctatctgtcta

SEQ ID NO: 268614 - DNA, 428 bp, Homo sapiens
aaatcagatgtaaaatcagaaaatattgcctctccaagagctcaaaagactcttaagctgcttaagagaccttttttttttcgtcttgtacctactacctagttcaagtctttgcaaacagttaggcacttaaatgccaccctaaatggaaaaatcaatttagagtttcaatcaaagctgaattcctgagaggaataaagacgtgaaatatgtaaagaggtgatagttcaatctatgacaaatttcattcacaaatggaaagtagagaacaatagagagaaaatacttaatccccattttagagagccagagaaagaaaaagagacagaaatgttagaattcttaaaaagacttactaagtgtctattaactcaaactatgcaacagtctttacaggtaggttctaatactgtttctgttttccaagt

SEQ ID NO: 268615 - DNA, 441 bp, Homo sapiens
tggttgtctttttcagattgacttccattctcaatcttatcactccctttttaggattccttgggctcttatgtctgtaattcagagtctattatttatattgattttcatgtgacttgtaatggttccttattattttttgatgcatggattatctttcttgtccttattgtaaattctctgtgagcaggggttgtatcttctaactcttttgtatgcctagtatagtgctgtgcacaagtaggcgctgaataaatgcttgctaattaaattgaatcaatttaacttacagcaattgtgttatgagacaaaaacttctgttacctgcatgaaaacattttactatgatgtaagaaatggattatctgttgataggctgagtttattgtttaattagattataatgcagatgagtaaataaagctagtgtttatttctact

SEQ ID NO: 268616 - DNA, 902 bp, Homo sapiens
accacacttaccatctgtgggctgagagcgggcaaatgatttattagtcttggtttctaacggtgctgagcagcttgggatcgatcttgctggtgacacactcggcagatgcaccgatgggtgggagggtcaatgtcaggatgaagcttcttgcggagctgacatgcacgtggggaccccaggtgtggtgtttagttggtagactgtgacattgcaaaagtggagtctcaagccatggcggataacaggcggcagaaaaagcagtgagggagcttcttgggatgttttactttaagtagaaagtaaaactgtgcatgaaaagaggggacagagtatgcaacccaaatcatcgccaaggctcttggtttcttctgtgcacactgcctgccttgtatccaagcgtttgactgtgcagaggccagtcatactgggggaccctgagcactacccttggcatttgggtatatcctgatcaatatagccatttccactgcttgacattatgttttgggggctagttttttaaagatcaatgattgaattgctgctcggctgattggatatgtcttctcggagactcacctgtcctccccgaagagatgctgactacacaacagcagtcactgtgctgggcacacgggcagtgttcaggagacgtggcttcctttcttcttctttcatttcttcctgcccagaacagcaaggctgagactgataataaaattcctggaacatggagaaactcatgtggggagaaaagaagaaatgtattgtgacttccatgggcttttggcacttttggacctccctcctcctcttttccataaaaaatgtattttaagacatattggtataaagatgagattattcatagtacatattaaaatgttttcccctaccta

SEQ ID NO: 268617 - DNA, 699 bp, Homo sapiens
ctactgtaaaatgctttcattgcttgcagttttaagtttgatctgcttacacttaggtagacatgcctgcaataacttttctctcagttatttctaacctcataattattctacttttcagtatcttgtgttactcatgggcaaaaaaacttcttagtgaatagaattctgtctgttgtttctgattgttggtatgaacattaaactattgggctggtaagttgtagtaatatgaatttttcatctctcttaacagttgtgtatattgatatgtttggtaaggcataaagtatataaataaaggtcgtcaaaacttttacaaaacaaatataagattatgtaattattttataaatatccaggaaggtttttatagaaagagaattataagcaaggtataaaataataaattagaaatttctaactcagactttgcaatacccaatgaaataattcgttaagttaaaactgtgaaaacaaaaattagctttaattctctataatattttttagaaattatccgtatctttagcaccaaaaagaacaactcacaaactcaataatatggtattatatatttctaaaaggtatgaaccaactggttttgtttttctaaccagaattatattttaatagaaaagtaattcaacatttaacagaattctgttagtacttcttattctggcaatattactaact

SEQ ID NO: 268618 - DNA, 466 bp, Homo sapiens
ataaaaaaagatattccacacaaattgaaaccagaaaagaacagtaggagctagctacacttatatcaataaaaaagacttcaggccaaaactcatacaaagaaacaaggaagattattatataatgataaaacggtcaattcagtaagagaatgtaacaatactaaatatatatgcacccaacactggagcatccaaatatataaagcaaatattaatagatctaaaagtaaagatagactgcaatacaataatggtataggactttagcacttcactttcaaaaataaacagatcatccaggaaaacaatcaattaaaaaagttggaattatactctagaccaaatgtacctaacaaacatttacagaacattttatccaactgctgcagaatacacattcttttcatgaatacatgggatatactctaggatagaccatataataggtcacacaattctcaac

SEQ ID NO: 268619 - DNA, 414 bp, Homo sapiens
atttagactgttatttaagtctttaaagaaaaacatttctttattaacagaatctggtcattatatctcagataagaaaacaggttttgattttagttgaaacacaagcagacctactgctaaaaataattttaaacatttcttttttcactgtgcttagaatttcttactggttttcatgtttgtttcaaaacataaccttaaagagtttatggtcactaatcgttgatatttacattactcatacttatttcagtgtctaaagctaaatattgatcagttttgtaaatagagtgtttgaattttctgtctatagtttttcaaggtcaaacaggtatatctgctgttagatgcatagcaaataatttatgaaaatcattttatttacatagcctcataaagcaattattttcg

SEQ ID NO: 268620 - DNA, 200 bp, Homo sapiens
taaatcaatgtgattcatcatatcaacacaataaagaacaaaaactatataatcatttcaactgatgccgaaaaacaatttcatgaaattcaacatcctttcattgtaaaaactctcaaaaactgggttatagaaggaatatgcatcaacacaataaaacccatattagatagatccacagctagtgtcatactgaatga

SEQ ID NO: 268621 - DNA, 437 bp, Homo sapiens
cttcccaaatacctgagactacaggtgcgtatcaccatgctcagctaattttttaattcttttgtagagacagagtcttactatgttgcctagactggtcttgaactccctgcttccaatgtatcagcctctctgaacttcatgctgccgttatctccagcaccaagtcctaagttactcatcggtttcacactccagctactacttattttgttgttttctcactctggaaatctcttctcacctcctttaattcttcccctttcagactcatgctctcaccccttaaattcttcttcctcctggaaagtcaatgtagacatgctcttttttttttaattatactttaagttttagggtacatgtgcacaacatgcaggtttgttacatatgtatacatgtgccatgttggtgtgttgcacccattaactcgtcat

SEQ ID NO: 268622 - DNA, 510 bp, Homo sapiens
tatcttccaaacaatgaaaacacatactggctaaagtttggtcctaacaaaaatttagatgtttacagtatattagatacaatgttcagttaatacagtttgtcagtattaactggttaatgtcagcattaaccactaaaaacttcagactacttccttccacatgtgaaagctaatggatcatttgttcttaaataaaagatgaaaataaattatgtactcagctgggaccttagctaagtagagtatattgccatcacaactgtcacaaaaaatatgatcacagtgagcctggagatctaggttcctttgtattagttcatacaaatatcctgatagatggccaaaatgacctgcaatcaatctttagaaccactttctgatatcactatactccctcattttcatgtattgcgcctatcctaacaatttatttttgttcttgagtcgtcagaaaacaaaaataaatcaataaaactaaaatcttcactttttacactgtaaaagaaa

SEQ ID NO: 268623 - DNA, 399 bp, Homo sapiens
ggtttaatatttttctactgctgcaaacttaatcctagtggtaaaatatatgttttattattattttatgcaacaagcctgtattaagagttttaaaaacaaatctaagtttgttttaattttagttaaggaatatagaaattagaaaataatgtttaatgaagttctgccaaagtaagtatgaaaggaataattattaaaatattctattaaaagtgcttttaaaaaatgtaagaaattatgaggccaacaaactgcattaacctattagaagagtcaaatatttttgttgtccttgctttgttcaggagaatggcttgaacccgggaggcggagcttgcagtgagccgagattgcaccaccgcactccagcctgggcgacagagtgagactctgtct

SEQ ID NO: 268624 - DNA, 504 bp, Homo sapiens
tgagattcagccatattgttgcatgtatcagtagttcatttctttacgggagctgttttatgggagaccatctgaccatgtagatatgtctattcataatcttaattccaaagagttagcgaaaccctgggatggctttctatctttcatcttagttatctctcccccttttttctaattctaaaaatatatatgatataaaaagttgaaaccactttcactgttttatcatattattaatatagaagtatattttttatagataattataaatatgaatctgattttttcactttaaaaaaagacttctaagtaaggtggttgctatctgttttgacttaaacctcaactaataaatgtgtagtttaggaaattagcatgttgaatgaatagtggtagcccttgaaatctcattttgaatcatgtattctactagataaattagcaaattttagaaaatctgggaccttgtctttctgaatgaaaatattatttgtgaaattc

SEQ ID NO: 268625 - DNA, 314 bp, Homo sapiens
taaaactagaaaccaacagtgtaaaatttacatttggcatctggtcacaaattatcaggtatacaaagcatcagagaacacagtccgtaatgaggacaaaaacagtcaatagaaatagacccaggaatgattcagagaatgcatgttaagtagagacatggaaaatataaaaatgaccaaaatctaacttttaaaaacgaaaactgcagtgtctgagatgagaaatatagtgcccaggatttacagcagatcggcacagcagaagaaaaattagtgaacttgaagacatagcaaatgaaacttaatgcaaaatg

SEQ ID NO: 268626 - DNA, 573 bp, Homo sapiens
acttatctatagattcaataaaatcccaatgaaaatcccagctaaagttattttgtagatattaacaaactgattctaaagtttatatggagaggcaaaagacctagaataggtagctatcacagtattgaaggagaagaacaaagttggggaaggctgatatcaactatatgacattctgggaaagtaaaaaactatgtagacagtaataagatcactagttgcgagaaggctgggggaagaagtggcgaatagacagagcagagaggactttgaaggcagtggaactattctatgtgatactataatggtggatacagctcattacacatttgtccaaacccgtaaaatgtacaatacaaaactgaactctaatgtaaactatagactttgggtaataatgatgtcattgtaggctcattgattgtaacaaatgtactactttggtaggggtattgataatgggggaaagttatgcatgtgtggagaaaaggagtatctgggaaatcttggtacattcctctcaattttgctgtgaatctaaaactgactaaaaaataaagtcttaccaaa

SEQ ID NO: 268627 - DNA, 494 bp, Homo sapiens
cctttcatactttggagctgagaaacccaatgttacagaaagctaagacaatgattctaagttccctttttaaaatgtattgaaatgtgttgtctaaaaattaaaaaataaaaatatctgtggtattttgtgaagacagaggccttggtttggagtagatactgtcacatgacttctcacctcgactcttttattgtaaaagaggaagataataataccttccagggaacattcttcccccttctccattgtggtaggaattaatcactgcccaagactcctggttgaggggctgagtgaagtgcaggcagtctccagccaggagctacaccgtttgttgggctaccctgtttgtagggaggaatgcctttctatgtttctaacttgcccaaagtctgcatccttgtaaagtagtgttctgaatgtgagcgatcatattcatgaagtgcctggcacatagtaagcactcaataaagagggatgtaatttttaaa

SEQ ID NO: 268628 - DNA, 667 bp, Homo sapiens
tgtgagccaccatgcccgctcctattttttctaaaataattataaattctaaaattacctatctaaatggaggagggtcttctgacacctttaaaataaaatccagctcagtactgtaaatgtgtttacagaacttgtttaaagttcttacagttgtttaaatcagactagttaactaccctcactacttagatgcttccatttcttagagctcttttttaagcttatctgaagaaaagcccttccaatttaagggttatttccaattgcacattccaaattgagcctcccaaagtgctgggatgacagttgtgagccactgtgcccagctagcaactgtttttaaacattagttccaatgtagtgtacactgaaaacttttatgaaaggaatttcaaaaattaagataaaccattaaaaacgtaattactaagtactactactactacaatgatatttacataatagactgagttacatttcataaagacaatatatctgtataagaatttttaaacttccctgtctatataatagaagttttagagaaattttttaaacaccaaagaaaactgcaaaataagatcacttacctatttggcattctcaactgtctggaacagcaaggagccattatgattatgcatttggtttgtggggtgtcttg

SEQ ID NO: 268629 - DNA, 527 bp, Homo sapiens
tcgtgcctcagcctcccgagtagctgggattacaggcatgcaccaccacacccagctaattttgtatttttagtagagacagtgtttctccaggttgatcaggctggtctcaaactcccgacctcaggtgatccacctgcctcagcctcccaaagtgctgggatgacagttgtgagccactgtgcccagctagcaactgtttttaaacattagttccaatgtagtgtacactgaaaacttttatgaaaggaatttcaaaaattaagataaaccattaaaaacgtaattactaagtactactactactacaatgatatttacataatagactgagttacatttcataaagacaatatatctgtataagaatttttaaacttccctgtctatataatagaagttttagagaaattttttaaacaccaaagaaaactgcaaaataagatcacttacctatttggcattctcaactgtctggaacagcaaggagccattatgattatgcatttggtttgtggggtgtcttg

SEQ ID NO: 268630 - DNA, 371 bp, Homo sapiens
agacctgccaaggggcaggcgccccgtagggtccacaggtggggaaaagcagaggtcacctcccagattatggcaggactgagcgcctgcagcaggggcagaagaagagcctgctcctggcgcgtcctccgttgcccagccatgccactgcgactgtgagcctctccaggctgcgttcctcgcgaggctgcatctgccctgggtgctcagcacacaggcgaacccagtttgcctcctcacctgcggtcctggtgcccgacacaaggcgaccctgtcctggccacgtctccatcttccctcttaggccttgctggttttgttactcagtaaagaccgggaggatgacgataccaaaaatgtcaaacgtgaag

SEQ ID NO: 268631 - DNA, 448 bp, Homo sapiens
gtgagttcagacaactgggggcatatttaggactagaggtagttcattttaacccgatagaacagtcatggaaaacagaggtattttgggactgtgttgtgtatagatccttgaattaagactaaatatggaaaatgatagatatttaaaaagttcagtaccattttcaagatgttttttaatgtttaattaaattgaaccaaaaatcaggaacctaaatttgtttctcctttatgagaatagatctttatcattgctctaatttagaacattgagaaacttttgcagtacctttcttgaatttgagtcttcttcgttgagcggcatttacttgaaaaataaagttctggctgggtacagtggctcatgcacgtaatcagatagatggattgcttgagcccaggagttgacctgtctgggtaagatggtgagaccttgtctctacaaa

SEQ ID NO: 268632 - DNA, 238 bp, Homo sapiens
gtctcagagaaaatcctataattaggtaattggcattgatacggttgacctaaaagggaattgtggagtagaggtttgcttgcaatttctttaaaatacctgagtctgggtaatttataaagaaaggagatttaattgtcgtagtgttctgcaggttgtacaggaggcatgatgccggcatctgcttggcttctggggaggcctcagggagcttttagtcatggtggaaggcaaaatg

SEQ ID NO: 268633 - DNA, 1025 bp, Homo sapiens
gtctgcggtgacttggctggcgggatcaagtgcagctgcttcaggctgaggtggcagatagtgagcgctggtggcggagttaaagtcaaagcaggagagtaattatgaatagcgcagcgggattctcacacctagaccgtcgcgagcgggttctcaagttaggggagagtttcgagaagcagccgcgctgcgccttccacactgtgcgctatgacttcaaacctgcttctattgacacttcttctgaaggataccttgaggttggtgaaggtgaacaggtgaccataactctgccaaatatagaaggttcaactccaccagtaactgttttcaaaggttcaaaaaaaccttacttaaaagaatgcattttgattattaaccatgatactggagaatgtcggctagaaaaactcagcagcaacatcactgtaaaaaaaacaagagttgaaggaagcagtaaaattcagtatcgtaaagaacaacagcaacaacaaatgtggaattcagccaggactcccaatcttgtaaaacattctccatctgaagataagatgtccccagcatctccaatagatgatatcgaaagagaactgaaggcagaagctagtctaatggaccagatgagtagttgtgatagttcatcagattccaaaagttcatcatcttcaagtagtgaggatagttctagtgactcagaagatgaagattgcaaatcctctacttctgatacagggaattgtgtctcaggacatcctaccatgacacagtacaggattcctgatatagatgccagtcataatagatttcgagacaacagtggccttctgatgaatactttaagaaatgatttgcagctgagtgaatcaggaagtgacagtgatgactgaagaaatatttagctataaataaaaatttatacagcatgtataatttattttgtattaacaataaaaattcctaagactgagggaaatatgtcttaacttttgatgataaaagaaattaaatttgattcagaaatttca

SEQ ID NO: 268634 - DNA, 829 bp, Homo sapiens
gtctgcggtgacttggctggcgggatcaagtgcagctgcttcaggctgaggtggcagatagtgagcgctggtggcggagttaaagtcaaagcaggagagtaattatgaatagcgcagcgggattctcacacctagaccgtcgcgagcgggttctcaagttaggggagagtttcgagaagcagccgcgctgcgccttccacactgtgcgctatgacttcaaacctgcttctattgacacttcttctgaaggataccttgaggttggtgaaggtgaacaggtgaccataactctgccaaatatagaaagttgaaggaagcagtaaaattcagtatcgtaaagaacaacagcaacaacaaatgtggaattcagccaggactcccaatcttgtaaaacattctccatctgaagataagatgtccccagcatctccaatagatgatatcgaaagagaactgaaggcagaagctagtctaatggaccagatgagtagttgtgatagttcatcagattccaaaagttcatcatcttcaagtagtgaggatagttctagtgactcagaagatgaagattgcaaatcctctacttctgatacagggaattgtgtctcaggacatcctaccatgacacagtacaggattcctgatatagatgccagtcataatagatttcgagacaacagtggccttctgatgaatactttaagaaatgatttgcagctgagtgaatcaggaagtgacagtgatgactgaagaaatatttagctataaataaaaatttatacagcatgtataatttattttgtattaacaataaaaattcctaagactg

SEQ ID NO: 268635 - DNA, 1086 bp, Homo sapiens
gtctgcggtgacttggctggcgggatcaagtgcagctgcttcaggctgaggtggcagatagtgagcgctggtggcggagttaaagtcaaagcaggagagtaattatgaatagcgcagcgggattctcacacctagaccgtcgcgagcgggttctcaagttaggggagagtttcgagaagcagccgcgctgcgccttccacactgtgcgctaattgtagagcgggaaggaaacttcaagatcactgaattataacttctcatttttctgtggtaaaactagctccccacgatgagatggtgctgtgctggctctgcagtttctctctcttcagtcccattttccggaagtgtgatatgcgtctttatctggtttttccatgcctttttctcaaatagtatctactctctccttttctcttccttctcaggagcaattctgcctgtctgatataagacttcaggcaaacccggatgtgaatcctggtctccaccacctatatatataatgtgactttgggaacattctctaagctctcaacctcagttttcttatggctaaaagataatagtaatatttacatttcatggtttgtgtaaggattaaataagatagcataaacaacctggaacaatatttgccacagggtagagaataaatagtagtcaccattaatgttgaagagttatattcatatgtgtacgaggggtgctaatgaatgtaatttagtcagactttgaaacagcatttatcagagtttagcaataaaaactatcaaaaagatagtctggcatgtggtaggaagggcatgggatgttctatcaacgataagctgaatgcttagcaacaggtgctttaccgggtagaagagtttcaataacaggacctactagaatcaattttgaattgggagtagtactagttttactatttatatccagataaggcaatgaattgtgaaatcctaagtttgtaaatgacaccacttttttgtgtccttaaatgatgagctaatgagcagtgtgggttttggagttggttgaattcattcaaatcccggaaaataaactgatgataataaatgtgga

SEQ ID NO: 268636 - DNA, 611 bp, Homo sapiens
gtctgcggtgacttggctggcgggatcaagtgcagctgcttcaggctgaggtggcagatagtgagcgctggtggcggagttaaagtcaaagcaggagagtaattatgaatagcgcagcgggattctcacacctagaccgtcgcgagcgggttctcaagttaggggagagtttcgagaagcagccgcgctgcgccttccacactgtgcgctgtgagtgaggaccatccggggatagagggggagcctcccgggatgggggtgaagaggcacaaacccctctgggttttgttcccacagtaccccttacactgttggagactacggggcggggaggggggaggcagcgcgatcctctaacctgctcggagtcttagggggtcggtggaaggaatcggagtagagcaaatgtgggtaaaccctggacagagagcgttgagaccagcagacaggaagggaaagtgtgaaaaaagtctgtagaggtgactgtggagacagacgtgacaggtggatgatgcaggggtggacaggaaaataataaggtgacaaatgggaagggactaaggaccgaatgccggggaacttgaatgccttgaggctggtggggcaatatt

SEQ ID NO: 268637 - DNA, 197 bp, Homo sapiens
ccagcctctacctttagctccagacttgtatatccaactgccagtaccatatatatttgggtatttactaggaaatgatttgcagctgagtgaatcaggaagtgacagtgatgactgaagaaatatttagctataaataaaaatttatacagcatgtataatttattttgtattaacaataaaaattcctaagactg

SEQ ID NO: 268638 - DNA, 1175 bp, Homo sapiens
gtctgcggtgacttggctggcgggatcaagtgcagctgcttcaggctgaggtggcagatagtgagcgctggtggcggagttaaagtcaaagcaggagagtaattatgaatagcgcagcgggattctcacacctagaccgtcgcgagcgggttctcaagttaggggagagtttcgagaagcagccgcgctgcgccttccacactgtgcgctagctccccacgatgagatggtgctgtgctggctctgcagtttctctctcttcagtcccattttccggaagtgtgatatgcgtctttatctggtttttccatgcctttttctcaaatagtatctactctctccttttctcttccttctcagatgacttcaaacctgcttctattgacacttcttctgaaggataccttgaggttggtgaaggtgaacaggtgaccataactctgccaaatatagaaggttcaactccaccagtaactgttttcaaaggttcaaaaaaaccttacttaaaagaatgcattttgattattaaccatgatactggagaatgtcggctagaaaaactcagcagcaacatcactgtaaaaaaaacaagagttgaaggaagcagtaaaattcagtatcgtaaagaacaacagcaacaacaaatgtggaattcagccaggactcccaatcttgtaaaacattctccatctgaagataagatgtccccagcatctccaatagatgatatcgaaagagaactgaaggcagaagctagtctaatggaccagatgagtagttgtgatagttcatcagattccaaaagttcatcatcttcaagtagtgaggatagttctagtgactcagaagatgaagattgcaaatcctctacttctgatacagggaattgtgtctcaggacatcctaccatgacacagtacaggattcctgatatagatgccagtcataatagatttcgagacaacagtggccttctgatgaatactttaagaaatgatttgcagctgagtgaatcaggaagtgacagtgatgactgaagaaatatttagctataaataaaaatttatacagcatgtataatttattttgtattaacaataaaaattcctaagactgagggaaatatgtcttaacttttgatgataaaagaaattaaatttgattcagaaatttca

SEQ ID NO: 268639 - DNA, 888 bp, Homo sapiens
gtctgcggtgacttggctggcgggatcaagtgcagctgcttcaggctgaggtggcagatagtgagcgctggtggcggagttaaagtcaaagcaggagagtaattatgaatagcgcagcgggattctcacacctagaccgtcgcgagcgggttctcaagttaggggagagtttcgagaagcagccgcgctgcgccttccacactgtgcgctatgacttcaaacctgcttctattgacacttcttctgaaggataccttgaggttggtgaaggtgaacaggtgaccataactctgccaaatatagaaagttgaaggaagcagtaaaattcagtatcgtaaagaacaacagcaacaacaaatgtggaattcagccaggactcccaatcttgtaaaacattctccatctgaagataagatgtccccagcatctccaatagatgatatcgaaagagaactgaaggcagaagctagtctaatggaccagatgagtagttgtgatagttcatcagattccaaaagttcatcatcttcaagtagtgaggatagttctagtgactcagaagatgaagattgcaaatcctctacttctgatacagggaattgtgtctcaggacatcctaccatgacacagtacaggattcctgatatagatgccagtcataatagatttcgagacaacagtggccttctgatgaatactttaagaaatgatttgcagctgagtgaatcaggaagtgacagtgatgactgaagaaatatttagctataaataaaaatttatacagcatgtataatttattttgtattaacaataaaaattcctaagactgagggaaatatgtcttaacttttgatgataaaagaaattaaatttgattcagaaatttca

SEQ ID NO: 268640 - DNA, 1243 bp, Homo sapiens
gtctgcggtgacttggctggcgggatcaagtgcagctgcttcaggctgaggtggcagatagtgagcgctggtggcggagttaaagtcaaagcaggagagtaattatgaatagcgcagcgggattctcacacctagaccgtcgcgagcgggttctcaagttaggggagagtttcgagaagcagccgcgctgcgccttccacactgtgcgctaattgtagagcgggaaggaaacttcaagatcactgaattataacttctcatttttctgtggtaaaactagctccccacgatgagatggtgctgtgctggctctgcagtttctctctcttcagtcccattttccggaagtgtgatatgcgtctttatctggtttttccatgcctttttctcaaatagtatctactctctccttttctcttccttctcagatgacttcaaacctgcttctattgacacttcttctgaaggataccttgaggttggtgaaggtgaacaggtgaccataactctgccaaatatagaaggttcaactccaccagtaactgttttcaaaggttcaaaaaaaccttacttaaaagaatgcattttgattattaaccatgatactggagaatgtcggctagaaaaactcagcagcaacatcactgtaaaaaaaacaagagttgaaggaagcagtaaaattcagtatcgtaaagaacaacagcaacaacaaatgtggaattcagccaggactcccaatcttgtaaaacattctccatctgaagataagatgtccccagcatctccaatagatgatatcgaaagagaactgaaggcagaagctagtctaatggaccagatgagtagttgtgatagttcatcagattccaaaagttcatcatcttcaagtagtgaggatagttctagtgactcagaagatgaagattgcaaatcctctacttctgatacagggaattgtgtctcaggacatcctaccatgacacagtacaggattcctgatatagatgccagtcataatagatttcgagacaacagtggccttctgatgaatactttaagaaatgatttgcagctgagtgaatcaggaagtgacagtgatgactgaagaaatatttagctataaataaaaatttatacagcatgtataatttattttgtattaacaataaaaattcctaagactgagggaaatatgtcttaacttttgatgataaaagaaattaaatttgattcagaaatttca

SEQ ID NO: 268641 - DNA, 988 bp, Homo sapiens
  misc_feature (9)..(10): n is a, c, g, or t
  misc_feature (13)..(13): n is a, c, g, or t
  misc_feature (15)..(16): n is a, c, g, or t
  misc_feature (45)..(45): n is a, c, g, or t
  misc_feature (50)..(50): n is a, c, g, or t
  misc_feature (54)..(54): n is a, c, g, or t
  misc_feature (58)..(58): n is a, c, g, or t
cgttcgacnnaananncattttttccctggctttggtgattcagncctgncttntcanaaagtaattatgaatagcgcagcgggattctcacacctagaccgtcgcgagcgggttctcaagttaggggagagtttcgagaagcagccgcgctgcgccttccacactgtgcgctatgacttcaaacctgcttctattgacacttcttctgaaggataccttgaggttggtgaaggtgaacaggtgaccataactctgccaaatatagaaggttcaactccaccagtaactgttttcaaaggttcaaaaaaaccttacttaaaagaatgcattttgattattaaccatgatactggagaatgtcggctagaaaaactcagcagcaacatcactgtaaaaaaaacaagagttgaaggaagcagtaaaattcagtatcgtaaagaacaacagcaacaacaaatgtggaattcagccaggactcccaatcttgtaaaacattctccatctgaagataagatgtccccagcatctccaatagatgatatcgaaagagaactgaaggcagaagctagtctaatggaccagatgagtagttgtgatagttcatcagattccaaaagttcatcatcttcaagtagtgaggatagttctagtgactcagaagatgaagattgcaaatcctctacttctgatacagggaattgtgtctcaggacatcctaccatgacacagtacaggattcctgatatagatgccagtcataatagatttcgagacaacagtggccttctgatgaatactttaagaaatgatttgcagctgagtgaatcaggaagtgacagtgatgactgaagaaatatttagctataaataaaaatttatacagcatgtataatttattttgtattaacaataaaaattcctaagactgagggaaatatgtcttaacttttgatgataaaagaaattaaatttgattcagaaatttca

SEQ ID NO: 268642 - DNA, 889 bp, Homo sapiens
aggagtttatatgtctcgatcgttaggggagagtttcgagaagcagccgcgctgcgccttccacactgtgcgctatgacttcaaacctgcttctattgacacttcttctgaaggataccttgaggttggtgaaggtgaacaggtgaccataactctgccaaatatagaaggttcaactccaccagtaactgttttcaaaggttcaaaaaaaccttacttaaaagaatgcattttgattattaaccatgatactggagaatgtcggctagaaaaactcagcagcaacatcactgtaaaaaaaacaagagttgaaggaagcagtaaaattcagtatcgtaaagaacaacagcaacaacaaatgtggaattcagccaggactcccaatcttgtaaaacattctccatctgaagataagatgtccccagcatctccaatagatgatatcgaaagagaactgaaggcagaagctagtctaatggaccagatgagtagttgtgatagttcatcagattccaaaagttcatcatcttcaagtagtgaggatagttctagtgactcagaagatgaagattgcaaatcctctacttctgatacagggaattgtgtctcaggacatcctaccatgacacagtacaggattcctgatatagatgccagtcataatagatttcgagacaacagtggccttctgatgaatactttaagaaatgatttgcagctgagtgaatcaggaagtgacagtgatgactgaagaaatatttagctataaataaaaatttatacagcatgtataatttattttgtattaacaataaaaattcctaagactgagggaaatatgtcttaacttttgatgataaaagaaattaaatttgattcagaaatttca

SEQ ID NO: 268643 - DNA, 763 bp, Homo sapiens
agtgctctagaggatcttatatgtctcgatccgttaggggagagtttcgagaagcagccgcgctgcgccttccacactgtgcgctatgacttcaaacctgcttctattgacacttcttctgaaggataccttgaggttggtgaaggtgaacaggtgaccataactctgccaaatatagaaagttgaaggaagcagtaaaattcagtatcgtaaagaacaacagcaacaacaaatgtggaattcagccaggactcccaatcttgtaaaacattctccatctgaagataagatgtccccagcatctccaatagatgatatcgaaagagaactgaaggcagaagctagtctaatggaccagatgagtagttgtgatagttcatcagattccaaaagttcatcatcttcaagtagtgaggatagttctagtgactcagaagatgaagattgcaaatcctctacttctgatacagggaattgtgtctcaggacatcctaccatgacacagtacaggattcctgatatagatgccagtcataatagatttcgagacaacagtggccttctgatgaatactttaagaaatgatttgcagctgagtgaatcaggaagtgacagtgatgactgaagaaatatttagctataaataaaaatttatacagcatgtataatttattttgtattaacaataaaaattcctaagactgagggaaatatgtcttaacttttgatgataaaagaaattaaatttgattcagaaatttca

SEQ ID NO: 268644 - DNA, 1533 bp, Homo sapiens
gtctgcggtgacttggctggcgggatcaagtgcagctgcttcaggctgaggtggcagatagtgagcgctggtggcggagttaaagtcaaagcaggagagtaattatgaatagcgcagcgggattctcacacctagaccgtcgcgagcgggttctcaagttaggggagagtttcgagaagcagccgcgctgcgccttccacactgtgcgctatgacttcaaacctgcttctattgacacttcttctgaaggataccttgaggttggtgaaggtgaacaggtgaccataactctgccaaatatagaaggttcaactccaccagtaactgttttcaaaggttcaaaaaaaccttacttaaaagaatgcattttgattattaaccatgatactggagaatgtcggctagaaaaactcagcagcaacatcactgtaaaaaaaacaagagttgaaggaagcagtaaaattcagtatcgtaaagaacaacagcaacaacaaatgtggaattcagccaggactcccaatcttgtaaaacattctccatctgaagataagatgtccccagcatctccaatagatgatatcgaaagagaactgaaggcagaagctagtctaatggaccagatgagtagttgtgatagttcatcagattccaaaagttcatcatcttcaagtagtgaggatagttctagtgactcagaagatgaagattgcaaatcctctacttctgatacagggaattgtgtctcaggacatcctaccatgacacagtacaggattcctgatatagatgccagtcataatagatttcgagacaacagtggccttctgatgaatactttaagaaatgatttgcagctgagtgaatcaggaagtgacagtgatgactgaagaaatatttagctataaataaaaatttatacagcatgtataatttattttgtattaacaataaaaattcctaagactgagggaaatatgtcttaacttttgatgataaaagaaattaaatttgattcagaaatttcaacacaacaacaaaaaacaaaaaaaaaaacaaaacaaaaaaaaaaaaccacacaaaacaacaacaaaagaaccaagaagaaaacaacaaaagacaaggagcacccaaaacacacgcagacagaccagagaaaggggggcgaacacaagacgccccccacccccggcgccccgcctccgcgcccccggcccaccaccgcggccgcccctgatcagaaatcgcaaaccccacatcagacgaaccaggaaccaactactagaagacaaacattaacaacgctgaagaggagcacgcacactcacgctgcccggcgacgccaaacccatcagagaagccggcagaccaatacgaagaccagcatactaaaacaggaaacgaaacaacctaccgccacactcaaaaccagcgcagtagcttaccatcaagcaccaaaggacagacgcaggtataagcacagaccacaaggtccggagagaacgcgctaatacacagctgaacctgaagatacaa

SEQ ID NO: 268645 - DNA, 1079 bp, Homo sapiens
  misc_feature (1079)..(1079): n is a, c, g, or t
gtctgcggtgacttggctggcgggatcaagtgcagctgcttcaggctgaggtggcagatagtgagcgctggtggcggagttaaagtcaaagcaggagagtaattatgaatagcgcagcgggattctcacacctagaccgtcgcgagcgggttctcaagttaggggagagtttcgagaagcagccgcgctgcgccttccacactgtgcgctatgacttcaaacctgcttctattgacacttcttctgaaggataccttgaggttggtgaaggtgaacaggtgaccataactctgccaaatatagaaggttcaactccaccagtaactgttttcaaaggttcaaaaaaaccttacttaaaagaatgcattttgattattaaccatgatactggagaatgtcggctagaaaaactcagcagcaacatcactgtaaaaaaaacaagagttgaaggaagcagtaaaattcagtatcgtaaagaacaacagcaacaacaaatgtggaattcagccaggactcccaatcttgtaaaacattctccatctgaagataagatgtccccagcatctccaatagatgatatcgaaagagaactgaaggcagaagctagtctaatggaccagatgagtagttgtgatagttcatcagattccaaaagttcatcatcttcaagtagtgaggatagttctagtgactcagaagatgaagattgcaaatcctctacttctgatacagggaattgtgtctcaggacatcctaccatgacacagtacaggattcctgatatagatgccagtcataatagatttcgagacaacagtggccttctgatgaatactttaagaaatgatttgcagctgagtgaatcaggaagtgacagtgatgactgaagaaatatttagctataaataaaaatttatacagcatgtataatttattttgtattaacaataaaaattcctaagactgagggaaatatgtcttaacttttgatgataaaagaaattaaatttgattcagaaatttcaaaaaaagaaaaaaaatggcctcgttggactcagcggtggaggtttgcgcaaagn

SEQ ID NO: 268646 - DNA, 980 bp, Homo sapiens
gtctgcggtgacttggctggcgggatcaagtgcagctgcttcaggctgaggtggcagatagtgagcgctggtggcggagttaaagtcaaagcaggagagtaattatgaatagcgcagcgggattctcacacctagaccgtcgcgagcgggttctcaagttaggggagagtttcgagaagcagccgcgctgcgccttccacactgtgcgctatgacttcaaacctgcttctattgacacttcttctgaaggataccttgaggttggtgaaggtgaacaggtgaccataactctgccaaatatagaaggttcaactccaccagtaactgttttcaaaggttcaaaaaaaccttacttaaaagaatgcattttgattattaaccatgatactggagaatgtcggctagaaaaactcagcagcaacatcactgtaaaaaaaacaagagttgaaggaagcagtaaaattcagtatcgtaaagaacaacagcaacaacaaatgtggaattcagccaggactcccaatcttgtaaaacattctccatctgaagataagatgtccccagcatctccaatagatgatatcgaaagagaactgaaggcagaagctagtctaatggaccagatgagtagttgtgatagttcatcagattccaaagatgaagattgcaaatcctctacttctgatacagggaattgtgtctcaggacatcctaccatgacacagtacaggattcctgatatagatgccagtcataatagatttcgagacaacagtggccttctgatgaatactttaagaaatgatttgcagctgagtgaatcaggaagtgacagtgatgactgaagaaatatttagctataaataaaaatttatacagcatgtataatttattttgtattaacaataaaaattcctaagactgagggaaatatgtcttaacttttgatgataaaagaaattaaatttgattcagaaatttca

SEQ ID NO: 268647 - DNA, 505 bp, Homo sapiens
  misc_feature (353)..(353): n is a, c, g, or t
  misc_feature (366)..(366): n is a, c, g, or t
  misc_feature (438)..(438): n is a, c, g, or t
  misc_feature (454)..(454): n is a, c, g, or t
ggaaaagatcaacaaattggcaactgtttagctagactgaccaagaaaaaaaaaagagaagactcagattaatacctcagcatggaagagagagcgagactctgtctcaaaacaacaacaacaaaaagatacaagcaaaacaaatcaagaaacgtatacaaaggattatacaccatgaccaagtgggatttatcccaggaatacaaggttggtttaatatttgaaaatcaatcgatgaaacacacaaaattgagagaataaagatgagaagcttaatgtagggtaaaatgtctgaagctctaagtgaaactgttgataagctggggtttctactcttggaacgctagagaggnagagacacttagntacttagtaacagcaaaaagcccggccaaaaagtagaactcaagtgctttagaaactctgtgggcaggggtnaacgtgactactctantttctctttcgtctgtgggcacttagtttgatcagttgttagcacctttag

SEQ ID NO: 268648 - DNA, 991 bp, Homo sapiens
ttgttgcccaggctggagtgtagtgacacgatctcagctcactgcaacctctgtctcctggattcaggcaattctcctgcctcagcctcctgagtagctgggattacaggcgcctgccaccatgcccagctaatttttgtacttttagtagagacagggttttgccatgttggccaggctggtctcgaactcctggcctcaggtgatccgctcaccttggcctcccaaagtgttgggattataggcgtgagccattgtgcctggttcttttgcccttttaactgccttctagaaaaatactatttttttcagcattttgattatccatagaatgatggtaactaaatccctatttccataatatatattaaaaatattaaatattaaataatatttaaatagtttttcttttttactttatgatgtattctagaaatcttttttatctcagtacagtaattatagtatttccctattttctttcttgtttcttttctctttagcagccagtagacagagtaatgggtcccaatgacttctaggtcttaaaacccagaacttgtaaatatgttaccttgcatggtgaaaggaactttgcagatgtgattgaaattaaggagattatccttaattaattggacagattatccattgggcccaatgttatctcaaaggtgcttataagggaaaaagggaggcaggagggttgaagccacaggaaatgtgttgacggaagcagaggacagactctcctagagccttcagaaggaacacagcaatgccagcaccttgattttagccctttaagacccatttctgacttctgagctgaagaaccgtaggataataaatttgtgttgttttaagtcactaagtttgtggtaatttgttatagcaccagtaggaaacttaatatggtcatataacatttcaatgtttggatagatcatggtttatgtaatcaatcgtctgtagatgataatggattctc

SEQ ID NO: 268649 - DNA, 410 bp, Homo sapiens
ctggtcttgaactcctgacctcaagtgatccacccgccttggcctcccaaagtgctgggattacaggtgtgagccaccgcgcctggcctcttaacagttctaatgtatctttgcagagctatttggagcatatgctgtgtatatgtgcgtgtgtgtgtgacacaaatgatagcacacgctctacactgttcagcacctgctattttcatgtcataatatacctgcctgtagatagtcaacatagttttccatcgtatggtgtgtcacaatttatttaccattcccctcctagtggatatttatgtatgtccgccttttattactacaaacaatgctaattacaggaaatatcttggtacatatatttgcagacatatgtgtgtgtgtgaaataaatttataagtatggca

SEQ ID NO: 268650 - DNA, 340 bp, Homo sapiens
acatgtgtggggacgcactggctgcatggtgcccgcttcctcttccccgagccgtgctctccagcgctgtgtctcagcctcccctccaggagcgctcacttcctctcagctctgggcccctgtggcctctgctttgccagctgcccagccgtgatgactagtttccactccagtgctatctctgtctttattgttctttttgacctctaggtgcacatgctgtcgtgccccagtgttccagcatcgctgactgggagagggaagaagaggtgagggagagggaagaagaggtgaagggctttcttagaacactgacattgaaattgcagctgaatcttta

SEQ ID NO: 268651 - DNA, 519 bp, Homo sapiens
ctggttttctgagtggtccaggactttactgacttcacagaacaggatgttaactgatgagtgcttgctgatgtatgttctgttccataaataactgtccacgtggcaggatttggtctcacttccacatcacacaatcgtcagcttatggaaaagccttaggccccacccacctcacggcttctttggcatctgtttttatcatccccaaaagaactttaggtttggaatgtgactagactgagttagatcaggttgcaatgataatgagaaagccattaagtcactggctcctccatgaagctcctaaacccctgtgtcccatctgaaaaaagctcgggtgctctaaatgcaaacccctcagctgtcactctgcttggtgatgtaagagttttttgtttgttttccaaatacatgactctcctcccaagattgtattagatgagaacgttctacccctcatgtcctgcccataatacatgcctacctcaatttcttgaataaatgaatgaatgtctg

SEQ ID NO: 268652 - DNA, 266 bp, Homo sapiens
cccaggcttgctaattaaaaaaaaaaattttgtagagatgggatctccctatgttgctcaggcttgaactcctgaactcaagtgatctgcttgacttgacctcccaaagtgctgggattataggtgtgagccaccacatccagccccagtgggaaattttgtttgcagttcttaagcatcttttctccatgaactctacttcataaattttgtgtttttaagggtctcaagatttttgtttgaataaacaaaactatgtgtttgta

SEQ ID NO: 268653 - DNA, 597 bp, Homo sapiens
ataaagacatacttgagactgggaagaaaaagaagtttagttggacttacagttccacatggctggggaggcctcagaatcatcatgggaggtgaaaggcacttcttacatggcagcagcaagagacaatgaggaagtagcaaagcggaaaccccagataaacccattagatctcatgagacttattcactatcacaagaatagcatgggaaagactggcccccataattcaatcacctcctcctgggtccttcccacaacatgtgagaattctggaagctacaattcaagttgagatttggtggggacacagccaaaccatatcagatatggatacataaaagtatagatatgtgtgtatacatcgtttagtacagatacatctatttcctaggtctgtctaccaagagggccaagaagcaatgatacactattggtaaagagcagacccaatgcctagattgtactttctaaataccactctccaataaaaggactcagcattctttgggaaaatggctaattctagggctgggcagggaagatacaagacagaccttgagtgtcttctagtgtcaaaaaatgaggaagtgctca

SEQ ID NO: 268654 - DNA, 296 bp, Homo sapiens
aattatcacagagattcagggagatggggaaagcactgtgttgattaccatacagatgtctatgatgaccactactggggcgtgttccagaagttcatttgacaattgattttttggaaacctctaatgagttttcacatagtatctatgttaaaaatcaaggctctgagcctcgcatgggggcacacacctgtaatcccagctactcaggaagctgaggtgggaggatcacttgagtccaggagctcaaggccagcctgggcaacaaagcaagatccagtctcaaaaaaaaaaaa

SEQ ID NO: 268655 - DNA, 344 bp, Homo sapiens
ttcaacagcacagtaggatgactatagtcaacaaaaatatttgtatttcaaaatagctagaagatttgaaatgtttccagtgcaaaaaaatgataaatgttcaaaatgatggatgtaacaaaatatcacatgtaccccataaatatatacaaatattatatgtcaataaaaagacaggaaagaaattattaccaaagtataacatattattacaaatttagaattttttaaccatttggcacccaagtcattctctacggtcaatataattatattggaaatgtcactgtaaaccatcatgaactactgccaataaaacttttatataaagagaagaaaccaca

SEQ ID NO: 268656 - DNA, 386 bp, Homo sapiens
tcatctaatcacttctctagtcctcatttcagttttccaacgaaaagacagaggaatatatttaagaaaataccaggaaccgtaagacaaatttaaaatatttacaatctattgacaactgatttaatcgctttaaaaatgccataaaggggaaagaaatgttgaagtattagagaaaactaggagtgtctttacatacgaaggatacaagggcatctaggacatgatatgcatacacagttagtactttctttgcttttttatattgattcattatatagcaccttaagtatatagtctgactaaagttatttgatcaatggtaagaactcatttaatcattctaacttcagaaatcctaaaattattctggtggtttctttcac

SEQ ID NO: 268657 - DNA, 443 bp, Homo sapiens
atgggtcttccagagagcagacattaatatattagaagccagaggcccagggtattgattgctttgagctgtatcttccaaatgtgcaccagaatcaccaaaggaaagaggtaacaactttttccttaccactgtaactactggaggtgagtcacttggtatttctaaaaccacaggtatactccagatagccttgaaagacacacccttgttggtgaaaatacgttaactaaagggaagcaagtatactaaggtgctcagtagctcaattttagtatagtttgtttatacatttttgagtttttattttccctgaggcttatgctgtagtgatttagggactctatagttcaaataaattctgtaacacagacagctgacacagaggactagaatgttaaagtcctgctcattccttgcctatttccagttaacactcatat

SEQ ID NO: 268658 - DNA, 892 bp, Homo sapiens
tctctctctctctctctctctctctctctctctctctctctgtgtctctctcgtgccgaattcggggcgagccccagcggggcctcaccaccccctttatcactcttctccaaaggatatcttgcgccctcctgtgtgtctatgtgaggtttctctctgcatgcagatttagagcagctttttctatttcagaatactttttaggtattaatcatgcttgaaatctcatggactcagtcgcgatttgggaattttattatattttattttggggggaagggagctaatttcctgtgggaattttatggcactgttataagcaaacactcccataggatggatatgggatatatcctctgtgcgttttcatttcccatcgcaagttaggtggacagcatctcccaagccttcaggatttccgcaggagcctactaggccctcctcttgtcaatgagcctggagtgactccttgcactgcatgtggtgggaaaaatatccccggataagctggggcatgtcataaagtgtgtggaagggatttttataatattggaaaacatataatgcactctgaacagctttaaatgtgtgagaagagaaaaagagatgtgtctgtaagaggggaaatgaagttagctccaaaaacaaagccagaagtataaaaaagcaattaaaaagtctctcacatttttgcattttctgtatcatgagatcacttgtgattgagccatactttttaaataatgggcaacattttctccattgtcttgcttgagcattaactaccatttctgtgttactcttgtgaggttatttttggtgtgatttgatcctagtcagagcaaaaataaaatgtcagttctacaatgatgtactctataatgtagaaagc

SEQ ID NO: 268659 - DNA, 495 bp, Homo sapiens
ctcacgtgcttgctggccattgtgctttaaatcgttttttccagcggacagctgtgactgcagttttcaaatgtgctctggcctccaaggaccaggggggcggtggggggcgggggtgtcctctgtataaaaagtgctgtcctgcgagcttcccgacggacactttggggcatctgagcgattcccggggagggcagctctgccttcctcaggctaccactgcagccaccgacggacattctcaccagcaatcaaccaaaaaacatcagagtctctgtgaacttggctgcgatgataagaaccaaatgttttctaatctaagacttgtatgcagaacacaggaaattgcaattaggaacaccctacaaaattgaacaacagtattttctaaaaatattttttacatcactttaaataatttacagaaagctacagaaatcatatttaccaggacacatctgttaaataaaagcattgtttcatgttggtgtacgt

SEQ ID NO: 268660 - DNA, 426 bp, Homo sapiens
ggtggttggcagggccagaagcaggatattgtggggttagtgtttaatttgtatagagtttcagttggaaaatgaccgtgttctgtggatggattgtggtgatggttgcactacaatatgaatgtaattaatgccactgaactgtacacttaaaattgattaaagtggtaaatgttatgtatatttcaccaccataatagaaaaaaagaatatgttcatcaactaattcataaataagaaacaagaaaagttatttttataacaaagaagtgaaccaggtaatacttggaaagtataggttatagcaagaagacagcaatgacactagacctaaaaaatattcaaaactgtgctactaaaactgtgttgcctgaatcctaatatggggcagagacttagagctctttcattctgccctctccccat

SEQ ID NO: 268661 - DNA, 1143 bp, Homo sapiens
ggtttccgggtgagggttgggctccttggtaccatgtgggaagcgctgtgaagagttgttgccttccaagatatacccaaattcccagttccagcccgtgtcattaaaactccgctggcgtgaaagatgacgtccttagcccagcagctgcaacgactcgccctccctcaaagtgatgccagcctcttatctagagatgaagttgcttctttgttatttgaccctaaggaagcggccacaatcgacagggacaccgccttcgccattggatgtactggcctggaagagttgcttggaattgatccttcctttgagcagtttgaagcaccgttgttcagtcagctagcaaaaaccttggagcgaagtgttcagaccaaagcagtaaacaaacagttggatgaaaacatttcattattccttattcacttgtcgccttacttcctgcttaagccagcacagaagtgtctggagtggttgattcacaggttccatatacatctctataatcaagatagcctcattgcttgtgttctgccatacacgagacaagaatatttgtgcgagtcatacagcttctaaaaattaataattcaaagcacagatggttctggttgttgccagttaagcaatctggagtgccgttagctaaaggaactttgattacccactgctacaaagatcttggattcatggatttcatttgcagtttggtgacaaaatctgtgaaggtttttgctgagtacccgggcagctcagctcagttgagggtgctcttggctttctatgcttctaccatagtgtcggcgctggtagctgcagaggacgtatcagacaatatcatcgccaaactatttccctatatccaaaagggattgaaatcatctttaccagattacagagctgcaacatacatgataatatgtcagatttctgtgaaagtgaccatggaaaatacctttgtgaattcattggcatcacagatcatcaaaacattgaccaagattccctctttgatcaaggatgggttaagttgcttgatagtgctcctgcagagacagaagccagagagccttgggaaaaagtatgtacaattgaattgagaaatggtgctagtcagaggtgaataaaattattttgaataat

SEQ ID NO: 268662 - DNA, 496 bp, Homo sapiens
ggcgtgaaagatgacgtccttagcccagcagctgcaacgactcgccctccctcaaagtgatgccagcctcttatctagagatgaagttgcttctttgttatttgaccctaaggaagcggccacaatcgacagggacaccgccttcgccattggtgagccatcttttaacttagaaaagctcttggaagcgtttgttttctggatgttactgttttttttttttccccttgttttctcttctgtcccgtcctcttccttagcagtttctagcatgttgatgtatatttttaagggaaagagaacataacagtcaggtgcttggtgcttgaaatgtttatgagtagaggtatctggatttcacagatgaagaaacaaaattagagaggtcaactaatatgtcaaagagaagaacagctaaaagggggatggaggcagtgactggggtgacggagaagtcctctcagaggactggcctagttattgtaggggatatcca

SEQ ID NO: 268663 - DNA, 1684 bp, Homo sapiens
ggtttccgggtgagggttgggctccttggtaccatgtgggaagcgctgtgaagagttgttgccttccaagatatacccaaattcccagttccagcccgtgtcattaaaactccgctggcgtgaaagatgacgtccttagcccagcagctgcaacgactcgccctccctcaaagtgatgccagcctcttatctagagatgaagttgcttctttgttatttgaccctaaggaagcggccacaatcgacagggacaccgccttcgccattggatgtactggcctggaagagttgcttggaattgatccttcctttgagcagtttgaagcaccgttgttcagtcagctagcaaaaaccttggagcgaagtgttcagaccaaagcagtaaacaaacagttggatgaaaacatttcattattccttattcacttgtcgccttacttcctgcttaagccagcacagaagtgtctggagtggttgattcacaggttccatatacatctctataatcaagatagcctcattgcttgtgttctgccatacacgagacaagaatatttgtgcgagtcatacagcttctaaaaattaataattcaaagcacagatggttctggttgttgccagttaagcaatctggagtgccgttagctaaaggaactttgattacccactgctacaaagatcttggattcatggatttcatttgcagtttggtgacaaaatctgtgaaggtttttgctgagtacccgggcagctcagctcagttgagggtgctcttggctttctatgcttctaccatagtgtcggcgctggtagctgcagaggacgtatcagacaatatcatcgccaaactatttccctatatccaaaagggattgaaatcatctttaccagattacagagctgcaacatacatgataatatgtcagatttctgtgaaagtgaccatggaaaatacctttgtgaattcattggcatcacagatcatcaaaacattgaccaagattccctctttgatcaaggatgggttaagttgcttgatagtgctcctgcagagacagaagccagagagccttgggaaaaagccattccctcacttatgtaatgttcctgatcttattacaatacttcatgggatttctgaaacttacgatgtcagtcctcttctgcattacatgcttccccatctggtcgtctccatcattcatcatgttacaggagaagaaactgaaggaatggatggtcaaatctacaagagacacttagaagctatacttacaaaaatatcactgaagaacaacttagaccatttgttggctagccttctatttgaagagtatatttcatatagttcacaggaagaaatggattctaataaagtgtctttgcttaatgaacaatttcttccactcattaggcttttagaaagcaaataccccagaacattagatgttgtattagaggaacacttaaaggaaattgcagatctgaaaaaacaagagcttttccatcagtttgtttctctttctacaagtggaggaaagtatcagtttttagcagattctgatacttctttgatgctcagcctgaatcatccacttgctcctgtgagaattctggccatgaatcatttgaaaaagatcatgaaaacatcaaaggtttgtttcagatcgcttttttatatggt

SEQ ID NO: 268664 - DNA, 401 bp, Homo sapiens
agctttgtcacacactgccgctggagtgggacttggcgtggcttttctggagggcgacctacatcaaggggcatgcatgcgccctttgagctacagatttctcagctgggaatgaattatgaatgtcctttagccttggccgagagggtgtacagctctgcagtgttcctgtcggaaactggaaatagcctgagtgttctccattatgaattagtgcaaatgaaacacggctgagccttacggtggcataggatgcagtcattagaatacaacattcgaaaaaggaagagctggtcgtttggtaaaagcttgtaacagataaagttctaaatggcatcaaaagaacagacttagtaaatctcattttggttaaagatgagaaataaaaataatacgcctga

SEQ ID NO: 268665 - DNA, 484 bp, Homo sapiens
gacgatggcagcaccccgtttctttgttgttgtgattttttttgttttgctgcagactacaggctcctccaacacaagacctatcatcccgaattctgttgccacagatcttggggtccctccacacccttaaaattcatcattgaattattgagaggtttctcagcatcaaaatattgacagaaagaaaacagtatctgtttatgacaggtgtgctctgagtgggcaaagctgttatttcacaggttcagttgtgaagaaatgatctgtgatgagaacggtttgggaaagctaaggtgaaagaatgatttttgacatctggagatccctatttcgttgtcatgagtgagtcacactcacagtagaccacagcaaagccaatctccttagatcccatggccccttattaggaatatctgccggcttgaaggagaaagatgtcttttgattttagcatgcaaagacacagtagcaaggacaactt

SEQ ID NO: 268666 - DNA, 193 bp, Homo sapiens
gagtctcatgagatctgatggtttgaaaaacaggagtttccctgcccaagctctccttgcccgctcccatccacgttagatgtgactttctcctctttgccttcccccataattgcaaggcctccccagccatgtgaaattgtaagtccagtaaacctctttcttttgtaaattgcccagtctcaggtatgtc

SEQ ID NO: 268667 - DNA, 1079 bp, Homo sapiens
  misc_feature (1075)..(1075): n is a, c, g, or t
  misc_feature (1079)..(1079): n is a, c, g, or t
ggtaaaaattctcaaacactgcatacacagagaggataggagacatggcatttgcggataggaaatgaggaaattttgcgataggacagctgtagatcctgttgcggacacccagccgggcagttggaggcggggtcagtccagaagccttcagataacaccagggtgtagtcctggcgagaaatcttcagttgcttcaggaccttttctagccccacgcgacggctaggtcctccgtgagagaaaactggttcgagaagcatggccaacattcccaatgatccgtgagtattgagaagttctccatgttctcccaagcaagcctaacatctgagacttcccgcatggcggccgccctattagcatttaggtggctataggatgcccattgtttgaacttaagatggaggccgagagcctccaaatgaaaggacagagttgaaagttaagttctgcgcctgtactcacccctctgatgaatataccttctgttctgattctgatcctgggcgagtccccacaatgaagtggtgttgtctgtctggggaaataactgaggttcgttgtctcgcgctaaggagaacaaagatgtgggcacacagggaatgggtttaagagcagaaagtttaataggtgaaagaaacaagaggaaagctcccctgtgcagagggagggggttccgaagggatctcccgggttgcggtgggaagcggctggttttatagagggcttgaggaggcagtatctgattacatagggcctagggattagttggaccacgtgtgccatttacatagtccacaaagaggctggcatcccaccctaatctttctcttattaggcagatgtggtttccacctggccggtgccatgacacccacacacatggcgacaaggagaagggagaagaaaacctatttgttgtatatacctggcttttggcacagctgccgggattcacctgtgcaagtttccagcttgcttatctatgcttgcagcttgatttttcaggctactttctgttagaaaagaaatgatttgggggctgctttctattaaaagaaaaaccttaccnaggn

SEQ ID NO: 268668 - DNA, 559 bp, Homo sapiens
ggctggagtgcatgtttcagaggcttgcccatacaacgcacatggtcaagtacagcctcagcaatttccctcctaacaattagtataagctagggctcttacttcgactttttaccttgttccatttttggtctcattttcttaaggcttcactgctcaatttgttcattttgtgaggcaagagcttaaagttcatccttaaaaatgcgtaggtgattcagttttttaattagaaaaaagcaaacactgctaatcccaaaccttttcaatggcagccttctaggggcacacattttaattccatcagtgggtcatcttattcattctcttataatcatcgtgggggcccatgctgtatttctgggcagtctctggagtctatgacactggattacagaggtctgtctctgttcattaagtgagtgttcagagaagacccactcatcctgtaagcacttagagacactctggagtttgatcctcatgagagggtgacctggcaaggccattttcctgtctgcttcccagatggtcacctcttctttgtctgcccgccttt

SEQ ID NO: 268669 - DNA, 621 bp, Homo sapiens
aaataggtactttcatctaaatattcccatgttttctgcgctctggtgtgctttacaccacgtattctctaccagttgtattctcttttctagtaatgttttcccaaaaaacttgattccagggtttagaaatgtgagtaaccctggcttcaaatatcttctatgatttgtaaaatcacattgcaggcatttttgtttaattaattgtgtatatatttgagcatatatttaccttttcccaacaaaccattgtaatatgtgcaaatacagggatataggaagtgccatagggaacagggaagaaacaacaaatacagaatgctcgagaattttgagaaccccgggatggatccatcaggatcaggaacatttctctcttttaatcatgcctgagttgccacatcatgagctgctccatcctttgatggggcccctctattagcccatttgttagaccgtgttcttttccttaactctatacctattttgtcacaaactgaccatttttgaaataagccttgtaaagcacatcatcacgatatctctgtggggttcctagtgtttattatttgtgtatttactatgtcatttgccatacatcattaaattttccatttattt

SEQ ID NO: 268670 - DNA, 387 bp, Homo sapiens
caaaattcccaaattcaggaaaagctttatgcacaaaaatgttcttcataacccagatgaccagaaaaacgcatcacaacctgctctcctgtgttatgggtgtgatcaccacgcaaagctgtgtcagggcaatgtgtgtaaaacatgaacatggcgcaatgtgcccagggctcatagtgtagctgtgtgaacatacagaatgaggggcaaggtgcatggttcatggacgatgtgcttggaggcaaggacgccacatgaacctacgtacttgcttggatgatggaacaaaatattgtcccctttgcttttctgaattttccaattgttctttgatgcaaagttttttttataacaaaaaattaaaaccttatgatgtcatcaatcaaa

SEQ ID NO: 268671 - DNA, 386 bp, Homo sapiens
ccagccctctttgttctctgtctagggtcatttcacttataatgattcatcttaatctttcaggttctggaaagcataggatacatcaggcaggaggtaccccatttctaagcctagagcggagaagaaatcctttctggatgaccacaccatggggttgaaaaagcagagcagagtccacagttctgcgtagattatttattcaaaaaatccccaataactaacagagcagaaactggatttaggaatctaaattaaaacttattttgatgacctttgagaaagatacttcaaaacaaagatttattgcaagtgttagcttctttgctccttgaaataacattcattacttcagattaaacactgcttgctatttagtcttcagt

SEQ ID NO: 268672 - DNA, 405 bp, Homo sapiens
accctaactttccacgcctaagtaacaaaaggaccagaggctattccctttgcaaatcccccaccttttctatgcagcagatgaccacaaccaatcagactgattggggcgtagtcttggtttgcaactttgtaacttcaccttagcatctgactggttgcagagaatggaatgaatgaatgaatgaaatggaatcaatgaaattggctgactgcaaccaatagaccgattgcaggccaccacttgatttaccggaggtgagcgtgaagaggccagtgggaaagctctagggggtatttggaccgggtatctgtatccctgccctccagtgctgctcaggtggctcccacactgtggagtgtactttcgttttcaataaatccctgctttcatgcttttgttgct

SEQ ID NO: 268673 - DNA, 733 bp, Homo sapiens
aattattaataatagccttattcctagttaaaagtaaaacaaagtgctggcttgatggtatgggagataactaaaaaagatttaaactgaaaatataaaaacttttcttaaaagctagaaataaacatttgtactccaaaagaatttatatttacaaatagagaaactaacaatgatttaaccacagtgataagggaagcagacttttgggcctaaggaatagacacaatataatttggtagcatagcgggaacaaaggattaaataattaaggcaaatacttacagtgaatggtctcctttacttctggtctcaataacaaaattatgggaaaaatataaaatcaatatatccatgctctaaactaattacagaaaaccagacaatggttgtaaacccaaatgtaatatagagcaatggctcttaagtccagattccgatttaattaatttcagggagccctgtggcgctggtagtatgcagaagattcccaggtgttgaaaatgacctggagccaggaattaaaaccaccaatctggggttaacacccaaagcaaaaatcaggcatcctataggctcagttaaaatcagtttttatacaacgagtttaacaaacacatgacatgactgaccagagttaaagatgaagtggcagatttaacttggagtaagaccagtaagttaaggatataaaaaacaactgtgaaccacaagtcatatatgatgaaagggg

SEQ ID NO: 268674 - DNA, 218 bp, Homo sapiens
tgctgaacaatatcagtgatatgcaagaatctggtatggctgagaagactggaaaggggcaaatataatacttttaataaagtagaagatttatttttgcaaactccacatcagtaagtttggtagaggatgagggcaaagattctaaaatcaattattaaaggggatgtttgtgagcactaaggaaaaacagtgatagctcatatagaccacacttt

SEQ ID NO: 268675 - DNA, 560 bp, Homo sapiens
cttttggcctagatcctctatcctgaaaagacctatcttattgcctcgctgtggcataaagaggggcagaaggagcacatttatttctgggagtatctctaactccttgaatggtggcagtgggaattgtgtaatgaaccacagagactaagaactctctggccctcattcttatcccaaattccctctaggtctgttctttgttgtaataaatgttaaacatgtattctgctggattgagatagatcagatctgttcctctagacgtggagtagagaagggtggtgcaccagtgtgttcttgtggaggggcggggaaagcaaagggtactacagttattctttataggaaccgagagtctggggatgatgggccctcagggtctattttgctagtccaacctcttgtttctcctgagaaaatacaatcaataaataaaaatttaaaagcactgtttttccagctaggagcagtggctcacacctgaaatcccagtacttaaggagtccaaggcaggaatattgcttgaaacccatctctactaaagatacaaaaaaaaa

SEQ ID NO: 268676 - DNA, 470 bp, Homo sapiens
atttagtgtaagaccaagtagggctcaccagactccggagagtcaaaaaaaacaaagcaccaactaagaatgtttataatggcataatgcatgaattgagattccctcaaaatataaatgttttatttgttcatagaatcaaaagtagatttgtgcagatcatgctttaaatgattaactcactttacagttcagaaattcaggtatgtagccttaaaattattatttagattaaaattaattagaagatatggttattcatttgcaaaagaattaggttagaattgtacaggatatacaaattggtcattctttttatttaaccgaaatgccaatttatggggataatcaattttctgtattttcctcttggaatggtgaactcttttacatgccttactttttaaaaagtcatttcaaaaataaaagtcatttcaaaaaaataaatgtgaataaagagtttataaact

SEQ ID NO: 268677 - DNA, 1140 bp, Homo sapiens
gcgatagagtgagactccatcaaaacaaaacaaaacccttaggctactttaaatgattaatgacatctagagtattcaaatttattgttaaatttggatctagggtttgagctttactttctgtgacttttaacagaaattacttgtataaagtagtaaagattttattgcatatgtccaataaactgatacttttctgtatttagtttctcagaattttacagcagtgtgatgaagatggctcctgaaatagtgtgtgtaccaggttatgaatgattttttttcctttgaaagcatctaagtgcagtatgacaaattctgcctcccaagtaggcagcttataagcactggcttttatcatacgtaacaaaattgcaaaataaagtttatcactaaaggtagaaaagtattgtgggtacatgtttatctaaatgctattttatccaggttcaagctcttgtaataggatttatactacttgtaaggagaattctatatttgagaattgtccttttgaaaaggtgaattttatcacatactaaccttttgctgccctgcacattttctgagatacttgaaaacatattttgacatttacatgttttgccagtacccattatgttcctgctttattaaagccattttattcacctgacagattaagattagaatattttaaaagttgaattttgaaagcaaaagtttgttctactgcagtagttcgcaagtgctggtctttgtatgactgcatctgagtcacttaagaaggctttttaaactctagattcctgggctgtaatccttggagattctcatgacttaccatttttggcatccattctttagaaatagttccagcaatcctattctgcccgttttcatttaatacacacactttgtttcttcatctttattttgtggcagatgggtttgactttgccagctgtgactgattagtggttctctgtagcactgtattgagactcttagtgaagccatatttgagctggactggaaggagggaagcattttgccacgagtttctcccaaggcgtgactgaatggattggtccttgtatcatttgcagtgcttatttgccagctttaattagctattctcctgttagacgttttattaac

SEQ ID NO: 268678 - DNA, 913 bp, Homo sapiens
ctcccaggctggagtgcagtggcgtgatcttggctcactgcagccttgaactcccaggctcaagtggatcctccctcttcagccccgcaagtagctgggactacaggagtgcaccaccacccccatctaatatttttttgttgttattctagggacgagttctcactatgttgcccaggctggcctcgaactcctgggctcaagcaatcctcctgcgttggcctcccaaagtcctgggattacaggtgtaagccactacggctggcctattattgctgtattctaacttattcatctcctatggctagcctccaagctggaagctgaattgacagttgaaaaataatgacatgtatacaaggtatgtttgaaggattgcagatgcaggggcaccatatgctaaaggagtgttggaagctcactgcagaagatgacaaaagcagactgatatgtattatttgctgaaatataagctggaggcacaggtgaagattgccaaacctaatgaacagtttggcaaataagacaggctgtcaggccatggcagttcagcagtgggcgtgctgcctgtgaaccaagtcatttgttccagaggactacacttaaataccacaaataaaatcttccttgtcactgatatcacagtgaaatagatgttgtctttcagatttctggttgaattaccagccattaacatctggtgatttgggttgtaaaattatttttagttttgcctgttcatatttcatccagaaagcccaaacaagatatattttcccacataagaatgtaagcagtataatgccccgtccgggagggaggcggggggcagcccccacctggccagccgccccttccaggagggaggtggggggcgcctctgcccggctgccccgtctgggatgtggggggg

SEQ ID NO: 268679 - DNA, 791 bp, Homo sapiens
tattgtcacctgtgcctcactccaaaatatgctctgaaatcaatatttaaatattaaatttgtatggtgaatgtattcttttttaatgttaattaaatgattggtcagcccacttaatatttacaatgcaggacttactttgcgtattctctgtcttgtatttttgctttatttaagctaggctagcctccaagctggaagctgaattgacagttgaaaaataatgacatgtatacaaggtatgtttgaaggattgcagatgcaggggcaccatatgctaaaggagtgttggaagctcactgcagaagatgacaaaagcagactgatatgtattatttgctgaaatataagctggaggcacaggtgaagattgccaaacctaatgaacagtttggcaaataagacaggctgtcaggccatggcagttcagcagtgggcgtgctgcctgtgaaccaagtcatttgttccagaggactacacttaaataccacaaataaaatcttccttgtcactgatatcacagtgaaatagatgttgtctttcagatttctggttgaattaccagccattaacatctggtgatttgggttgtaaaattatttttagttttgcctgttcatatttcatccagaaagcccaaacaagatatattttcccacataagaatgtaagcagtataatgccccgtccgggagggaggcggggggcagcccccacctggccagccgccccttccaggagggaggtggggggcgcctctgcccggctgccccgtctgggatgtggggggg

SEQ ID NO: 268680 - DNA, 657 bp, Homo sapiens
ccaaggaagtatatttaaatcaaagcaagaaatcccatttccaaatggcaataaagcatgtgttacatagaatcagtgcatgaaagtgttttagtagcccagattagattgtaccctggcaaataagcaagagttctttttcattttcatcttgcaattcaactgggtatttgggttctttttctattcactcatgtcagatagagacatacatgttgtaaattattttgtcagaatgaaagcctggcagattaaatgctttcttctcttcttgctttacttgatatcaatctcttgttcatttcttgataatatgtttggttatttttgttttcattgcttttagtgtcagagatggctttggattccccgttctgtgtgctgctgtctggctcctgaacccagctgtagaggtgtgtcaatcccaactggtgaagtactgagaggaagctacacaaaaggcagcaaagtattagtgagtggtgtcattgagcaaacacgaagtcgggctcatccaaggatgagattttgccagagaaaggacgagcagcaagtcagggagcttaaggtaattatgggaaagtgactatctacaattgcttaggtagaaggagacagattggatttttgtgtgtttggtatttgggataagaggga

SEQ ID NO: 268681 - DNA, 614 bp, Homo sapiens
ctcccaggctggagtgcagtggcgtgatcttggctcactgcagccttgaactcccaggctcaagtggatcctccctcttcagccccgcaagtagctgggactacaggagtgcaccaccacccccatctaatatttttttgttgttattctagggacgagttctcactatgttgcccaggctggcctcgaactcctgggctcaagcaatcctcctgcgttggcctcccaaagtcctgggattacaggtgtaagccactacggctggcctattattgctgtattctaacttattcatctcctatgtgtcagagatggctttggattccccgttctgtgtgctgctgtctggctcctgaacccagctgtagaggtgtgtcaatcccaactggtgaagtactgagaggaagctacacaaaaggcagcaaagtattagtgagtggtgtcattgagcaaacacgaagtcgggctcatccaaggatgagattttgccagagaaaggacgagcagcaagtcagggagcttaaggtaattatgggaaagtgactatctacaattgcttaggtagaaggagacagattggatttttgtgtgtttggtatttgggataagaggga

SEQ ID NO: 268682 - DNA, 295 bp, Homo sapiens
gactcctcactctcctccctctgatctgtcccagaatcccatcagttcttcctccaccccacccgacccacaattctctgctacacttgtctccacggccctggtctgaaacacatgatgcttcacctggactcgtaggcgaccgatctttctgcctcttggcttactactcttaagtctcgccttcacgggcagtcgcagggatctttctcaagatctaatttctaatgattgcatttttcttctttaagcagtaggctgaaagccaaagctctccatctttttacaactcaaa

SEQ ID NO: 268683 - DNA, 436 bp, Homo sapiens
ggaagatataataatgaaaagtctaacagaatccatagctttagtgaagataaagtgggggaagaaaatataagtacatcaatcacataaatgtgaaaaagaaaagatatcaaagtactaagagcccagagaaaggtgcaaaggggtgttaggggagaaatcagtgaaagcataacagggtgactcttaagaaagtggccgggcatggtggctcaggcctgtaatcccagcactttgggaggccgaggtgggtggatcacgaggtcaggagatcaagaccatcctggcgaacactgtgaaaccccttctctactaaaaatacaaaaaaattatcccggcatggtggcgggcacctgtagtcccagctactcgggaggctgaggcaggagaatggcgtgaacccgggaggtggagcttgcagtgagccgagattgca

SEQ ID NO: 268684 - DNA, 403 bp, Homo sapiens
acttcttcaacccataaactttggcaaaagtgatatgctgtgacttctggggtttggttgtgagtgaccaggcagctgctgccttgttcagataacacttgtgctgaggtcgctgagccactgtggaagacatccaagctccataaagacaggtcaagtgcacatgctccagtcaacagcccagctgagccctcagcatacagccaacaccaactgcaagctgagggtgaaacaacttggatgtccatttggatgtcaagctggacttcagatgcctgtggttgcagctctgtctgcaactacatggaagacgccatgtgaaccacctagtagagcccttcctagaattgttggccctcagactctacatgcatatcaaaatgaatgttgtttgaagccataa

SEQ ID NO: 268685 - DNA, 305 bp, Homo sapiens
gaaaactattccttgcagagacaagatttacagaggcatggagggtgtgaaacaagacagtaacaataaagggtggaagtaggggcgtgatgagagataagacagggaaacagggagaggccagatcaggaaagaacttacgtatcccgcagaagacctggacttactcccagagacaacagggagccactgaagtctttttaagttgaacatgttagaatctaatttctctttggcagcaacacaaacatgttgctgaaatgattaaaatatttgtttaataaatggatgagcaaacgaatgaa

SEQ ID NO: 268686 - DNA, 276 bp, Homo sapiens
taatgatttcatctctaagatgtattaatatatttgtactgtttgccaaaatcacaaatcatttatgtttttattccttttcaaaatggtgtcagagacatacatgcattttcccaaatgactctacttcactattatttacatggcttatttcattaatttatagagggtttgagaaaaagaatatgtagataatttaatggtttttcacaaattttaagcttgtgattgtgctcaatgagaaggtaaagttattaaaacttatttgaaatcaat

SEQ ID NO: 268687 - DNA, 1045 bp, Homo sapiens
ccacagattgttttttgaatagataatatatttgaatctttctggagaacgacgtgctgttttttgagttctagttaggtaaattcatgttggatgagtgtaagacataccgagttactctacagacttggagcattctttccacttgtactttttggtaggtttacaatatcttgaaaaaatatgaagcccataaagtggtatgtctgtggtatgagctgtttatttggacatttttaatagtcattttaagttggatcaaaatcagatacttcattgttagaaatatttatataaccagcactttggttgcttcacaagtcctcatttaatctgtttttcttcagtctttgattttctttgttgctgtttctgtaaaggaatcatgaaagaaaaaccattgtttaaatacagttaagggtgagaaaccttcactccgccatatttctttgattttgtgttcagtatgttggttgaagatgagaagtacagaccagacactgggaacttcgtggtcccatgtattccaacatcacactggtcccaaagagcacagaggcagtaatgctgctgcagatatctgattaaccagaattctctctgggaaggatcgatagcacagttatgtgatttttatatgcttgactgggttgaacaaataaactctgggtcgtacatttacacaaatgtgttcttcagaatacaacaactatgccactgaaggccgctctcagtatgcgttttaaagaagtgtttccactagttaaaatggatttacattgatccttctatatctggtcctgtgatcaggaagatgataagtacaaaggcaagctgactgcataacaataactgatgtatatggggatctcgcaacctggcttcgttagcagtgccattctctaaccaatcaagccgaagaccaaatgcaacactgagatgcatttttttcatcagtcatgcatggtgaaaggtatattctatgaattgcatggaagtaagaattggagacagtactttttggtaggtttacaatatcttgaaa

SEQ ID NO: 268688 - DNA, 225 bp, Homo sapiens
tcacgtggaccttcttttttcttctaaatctcaaccatattatctatatggctgtgcaaggaagatcaataaggaggagctctaacaatttccattggttttctgcaatccaaaccgagatgatccaggcttaaacaagacgtagggagtctaggggtagagaaaggctgattctttgctgtatcttacaggaggtctacgcttatgaattccagcttttcaggt

SEQ ID NO: 268689 - DNA, 416 bp, Homo sapiens
ctccgtcatccttgatccctgccacccatagccaaccaacctctgaaacagagctccctagctgataggcagctgaacccagctgagaccagcaaaagaactgcccagctgatcccagaccaagttgcaacccagagaatcattaactaaataggtgattgttctaaaccactaaattttggagtggtttgttatgtagcaaaagcaactaatacagacttgttctctctgtgtgtgatgtggtctctttctccccaacaacatgacccaatgattaaaatcttaaattctgccactttttagctgtgtgactgccaatgtgacagccttctgagcctctgatgtctcctgaaaacagagatgtgaataatagtgcctatgacatagagttgtgaaaataaaatgaaaaacagctt

SEQ ID NO: 268690 - DNA, 364 bp, Homo sapiens
gctgacctggaactcctgggctgaagcgatcctccaaccttggcctctcaaagttctgggattatagactttgccaaccccaatgcattgcacctctcattgcatgtgaatgatggctcctgttctattctctcaccttccaacaccatgaagtccatgccagctggtcagttgctaagaaaactacctatggttaccaagaaggacctccaggaaacttcagattgcccaaggatcactataagaaagagtctcactcttttgcccagggtggaccatgattgcaccatttcacattgccctccagtctgggcgacagagtgagaatctgtgtcaaaaaaataaaggaagtgtgatgccacca

SEQ ID NO: 268691 - DNA, 885 bp, Homo sapiens
cccagggtaaatctgcattaccttaagtcccttttatttatttatttttgatctggaatattagtataaagaaggaaaacaaatgttaacatattatgtgctagtcattgtgctaggcattgtcatacaatgatgctacacttaatctttacaatattcctagcattgttattcccagtagtagtaaggggcattgctggcatacggacccatatctgctggtacccatgccatgatgaatatgacttgggaaaaatgtgttttttagacataggaaacagacactctaatttttcactgagtttctactatttgattaagcctctttatttaattcctctccccacctccacccccgtttcttaagataatgcgctacaaaaatggcaatcataaatataaagtttacaaaaaagaatgtatacactagtccagtggaaaaaataattggactgggaattgcaattttgatactcactttatttattggttattatgtgaccctagaaaagacgtctacaagaaaaactttctgtgccttagtttctccatcaaaaggatagataagtcatgtttgttcctccttattttataaactttggggattagttgatgtaatagagaaaatagagttcttttcatgatatatgctgggcaaatcaaagtatttattgttacaaataactacattataaccaaatgattagttaaataatgattttgtttaatatgtaatgcttataataaattgcggtagcttatcgctgaattcagtatttcaagaacaatttttttttgctgtaattcattattgtcctcaggaaatataaaaattatatagctgaagataataaacaagtcctgaaataaaactatttcaaatac

SEQ ID NO: 268692 - DNA, 534 bp, Homo sapiens
tcttgtcctttgactttatgagtctcaatatatataaaagattttatttagtgaaaatgtctgtttttaaagtttctggattttatgtcttgccaataagggcttcccatctccacagttaaatgtataaacattctcctaatttttttgaacacgttattggattttttacatttaaatttcttaactacgtgaagtgtatttttatatacaatgcaaagtgagcatctttctttgcttttttctctgctagaatagccaattatgtcagtgccattcattaaagaaaccacactttttacacctttgttatatactgtattgattccgataggtagctggtttatttctgaactttcccttcccttttacctctatttttgtgccaatattattgtttgtatgtatgtatgtatgtatgtatttgttgagacagagtcttactgtgtcacccaggctggagtgcaattgtgcaatcttggctcactatgactgccgcctcccaggttcaagcaattctgctgcctcagcctc

SEQ ID NO: 268693 - DNA, 347 bp, Homo sapiens
attggtttgaaagatgctgggcagtgcatcgatccctatattacagttagtgtaaaggatctgaatggcatagacttaactcctgtgcaagattggattaattccaaattctaaaatgattcagtccacaatagctctaggggatgaagaatttgccttactttgcccagttcctaagactgtgagttgtcaaatccctagactgtaagctcttcaaggagcaagaggcgcattttctccgtgtcatgtaatttttctaaggtgtttggcagcactctgtaccctgtggagtactcagtaccttttgtttgatgttgctgacaagacctgaaaaaaaatcccttaaa

SEQ ID NO: 268694 - DNA, 353 bp, Homo sapiens
cttttctttctttctttcttctttctctctcttctttctttacttctttgccatttttgttttccactgaaaaggttagatccttatctggtagaagctatgcttctagaagttataaaaagaagagaaaaggagcttgagacttgtgtcagttgggaaggcatgtgaccccatgttgcagaaacctgaccacagtggcctaaccaaataaaggtcagtctgtttcaagtaataaatgtataggcgggtgccaggggatggtgaaagaagacatcaagaacccaggcttcatctaaccgatggagcatcatatctccatggcaggcagggagacggggagaaaggcaaagagg

SEQ ID NO: 268695 - DNA, 640 bp, Homo sapiens
ttgcccccaaaataaaagacagataggtggatacatggaatcacacttactggagcagaaacctctgtgggaaccagtcctgtggtaggaaaacatgaagtgtaattgacaaattgctggagactcagtgtggacaagtctgagagtgatttagttgaatgttgttcccactaaaatctcatgttcaattgtaatccccaacgttggagatggggtatggtggaaggtgattggatcatgaggaatcttatgaaatggtttaatgccatcctcctggtgctgtcctcgcaacagtgagtgagttttcacaagatctggctgtgtaaaagtttgtggcatctttcccccttgttctctctcgctcccactctcaactactccctgttcaccatccaccatgattgtaagcttcttgaggcctccccaaaagctgagcagatgccagcaccatgtttgctgtgaagcctgcagaaccatcagccaattaaatctcttttctttatgaattacctagcttcgggtgttgtttttttatttttattttttgagaaaggatctcactgtgtcacccaggccagagtgtactgtcctgatctcagctcactgtagcctcagcctcctgggctcaagtgatcctcct

SEQ ID NO: 268696 - DNA, 702 bp, Homo sapiens
ttgcccccaaaataaaagacagataggtggatacatggaatcacacttactggagcagaaacctctgtgggaaccagtcctgtggtaggaaaacatgaagtgtaattgacaaattgctggagactcagtgtggacaagtctgagagtgatttagttgaatgttgttcccactaaaatctcatgttcaattgtaatccccaacgttggagatggggtatggtggaaggtgattggatcatgaggaatcttatgaaatggtttaatgccatcctcctggtgctgtcctcgcaacagtgagtgagttttcacaagatctggctgtgtaaaagtttgtggcatctttcccccttgttctctctcgctcccactctcaactactccctgttcaccatccaccatgattgtaagcttcttgaggcctccccaaaagctgagcagatgccagcaccatgtttgctgtgaagcctgcagaaccatcacctcccaaagtgttgggattacaggtgtgaaccaccacacccagcccaggtgtttctttatagcaatgcaagaacagtgtaacacagaaagttataaacttcagtgggacccagtcatggggggtgctcatgctttccgtaagttttacctccaagagttctaccagcccctcacaatgaatattggagagacatccctttgtgcttccagcagagggagggg

SEQ ID NO: 268697 - DNA, 477 bp, Homo sapiens
caatgtttgtgttgctaaaacatggaagactgggttcgaacattttaaaggaatggttcattgtaggaaacgtgaagtatagtatagaattagctttagcactttcagaaagtactgcatcatttgaacaaattttctcagttatggatgctgtctaagatgagaacaagttgtacagccaaagtcatcttcattgttaaaactaagtttagattatcatgcattgaattttacacttattaactgggatatacatttcaaaaaagaaaaatctactctcccaacaaggcagtactccgaagcctacctaaaatgccatcctttggttcatggagtggcactgctctacaaaacccattttgttacctcagtaaataagcttcctggatggagtctaaggccaactaatactacattgaatcccactctacagccaagcatgttagaagaagcagcttacatctgtttgctgttcca

SEQ ID NO: 268698 - DNA, 410 bp, Homo sapiens
tagagacagggtttcaccatgttggccaggctggtctcaaacttctgacttcaagtgatctgcccaccttggccttccaaagtgctgggattacaggtatgagccaccgtgcctggtcctttctgtcagatttatgtgtcaaaaagttgctctgttagaggtatgaaaagggaatgagttgggaagacattggagaggcatcaagagtaatttggattttggagttagacagactggcttcaagtcctggctctgctacttactacctgtgtgaccttaagcaagttcttgaacctctctgtggctccggtttatcatttataaaatgtaataataagatctacttctcaatggcttgtggtgtggtttatgtgatctttgtaaagtcagcatagtgcttagaagatagc

SEQ ID NO: 268699 - DNA, 558 bp, Homo sapiens
caggctctgctgagacctcctgaattggaaccttagggtgggcctcgccatcggagttttaacaaggcctccagaagattctgacactcaccagagtctgagagacacagcagagctagaacccgggctccagttttcacccaggagacaggaggattctggctggaagggcaggagggactggggtcccccccagaaggagcgccccaggacgatgccacacaagagagtcttcagagactggaaatgcttgccagggaggaagaaccactttctgtcctccatcctcaggagcacagaagggtgaagctgagcccacatagagaagcatctcatgctgtctgcagcggctgcagcgctctcctggggcaggagatgctcaaaggtcaacatgactttgaaaaggggctgggagaaaagcccccagtgctggctctggactcactatcccagggctcctaaagggctaaacatgactagattgtagtgagcctttcctaacatgcaaagaagcatccagggataatgtctaaatacagatgtgctatttctctcctc

SEQ ID NO: 268700 - DNA, 576 bp, Homo sapiens
atcaaacattctagagaagcctccttcttagaaaaatatggctgttaaagctactatataatgttttctattctttttttagatggtgggtcaggtatagccacaagaggagacacaggagaggctcaggaaaacaaagtctattatgcttacaggtcctagagacaggagacatattatgccacataggactacatgggaaagacaccagggtgggcaggaggcagaagacagaagaggggaaggtttaggccactgccgttacttgagtttctttgggaaaggcaatgcagggctgagtgaacagtttaggattggctactttgaataaggtataggggtgctccctagttgtctggtacctggccatggggtgattaggacactggaatgttgtctcttggggtgtccatgccagatagagggaatatagctctgaattggttagtttgtatatcaaagaaatcttccagctgaacccttgctatctataagaattatctagcccaaggaggagcagccagaaagatttattttatttttatttttttgagacagagtgagacaccatctcac

SEQ ID NO: 268701 - DNA, 171 bp, Homo sapiens
tctgccagtaaacagatgggcctctctggaccccagtttccaaaggttgaaggtcaagacaatagctctcaattccctacttttgttaggattgtatgaagggtccttccagcactgtcccagtatggtgctcggctaatggaaaaccaatctctgtaacttggactagtt

SEQ ID NO: 268702 - DNA, 633 bp, Homo sapiens
gtaggagtggatggtcccccagcacggggcttagctcttagtaactaggcattctggcaatggcagccatcaataggagagactattgattgttgagtgaatataagtggcataatccaccaagtggagattctgagtgaatgtggccactttggacccaagactgctgcccctctctgtcctctcataggactattatttattgccagtgctgaccagcctttgttggctaccatgatcattacctgcactccgagtgttttaacagaattttctgatgcctctggcctcacctgctgccttttagccaagaggggtgtgtgtgtatgtgtgtgtgtgtgtgttgtgtgtgtgttgggtgtgtgttgggtagcagggttcttggaaggtctggtttagccataatgttgatcataaagagaaaacaagaaaataaatgcaaattaaatagttcggtgagcctttgttatttcgccacatccagtaagttctatcagttgaatgttgtctgaattacttaaaaagttctcagttgtaaacaggtaagagcacccagtggaggccatggagctaggcttagagctttgccaccagccttcagttccatagccatgaacctgggagggcaaggaa

SEQ ID NO: 268703 - DNA, 384 bp, Homo sapiens
ctgctccgcccctctctgtgtgtctgtgtctgtgtatgtaatggtgcgtctctgtggcaagaagagggtgtgtgtgtatgtgtgtgtgtgtgtgttgtgtgtgtgttgggtgtgtgttgggtagcagggttcttggaaggtctggtttagccataatgttgatcataaagagaaaacaagaaaataaatgcaaattaaatagttcggtgagcctttgttatttcgccacatccagtaagttctatcagttgaatgttgtctgaattacttaaaaagttctcagttgtaaacaggtaagagcacccagtggaggccatggagctaggcttagagctttgccaccagccttcagttccatagccatgaacctgggagggcaaggaa

SEQ ID NO: 268704 - DNA, 552 bp, Homo sapiens
agatgaagctgtttctgcactggattaaccctgaaatgaaagatcgaaggcatgaggaatccattctcctttctaaggctgagacagtgacccaagacaggacaaaaaacattgagaagagtccaactgtcaccaaagatcatgtgtggggagctacaacacagaagacaacagaggaccctgaggctcagcctccttctactgaggaggaaggcctgatcttctgtgatgcccccagtgcctaaataatctgctctagcaacactcccttcagtccagccaatcctgggtcctgtgccactcctacaaatgctccaaactctgtcctcaaatgacttgtgccactcaaccaggaaatctatcccaggtctaactcacctcagcagaaggcactgttttatgcaagaatacccatcacaagaaaaaggagttcataggttcctgaacctctgcaatcccctgaaaaaggctttcattgccatttccattaacatgcaggtgaagcagggcattctccaaatatactttgtacctttaagcaaagagccacct

SEQ ID NO: 268705 - DNA, 444 bp, Homo sapiens
cattgatgaaaacagcatttttccaatggaattcagatgtcagcagtttacattttataatttaagaaattgtggaatgtagttgttttgaatgaggtcgactcagaatagttttatttagagctttgttgctacaggtggtagtctattgacacctcctcatttaacatagaaaatgactaacccaataattcagggagttaaaactcaaatgacatttcacagcaaatgccattttgagtctttgcctcctgagtttccatataattaagtggcaatgttctagtgactgcagcataagatgtcatacaatctgaaactgcagagtttgatcaaagtaatctgcaatttactgcctatgtgtacaaagggagacatagcaggttatagtttatatgaatagtctattttgaatgttcattaaacttgttatccctgtgggat

SEQ ID NO: 268706 - DNA, 642 bp, Homo sapiens
cctctattcatgataagtcggtccgtcggaaagcatactcagaggagcgtcctttggggccagagtaacttacggcctggtaagaaagacacagtgaaaccacttataatttgggaaatctcccctcactgccaaatgagcagtggcaagtaggaagtagaagtggaaacaagggataagagttagacctgaattttagtcccaggtctactattaactctgtgtgactttgcataagtcgtttgcattttctgtgacttggtttcctcatttgaaccgaggatctttaaggctccttccaactcaatagtagaataaatgtagctttatcttccctcacttcttcttgattcttttcttgacctggaaaagtcagcttaaacttctcagtcaaattatctcttggtacaaatttacctccctggctgctgagatatgtatttacctcttgatcggaaattccataactgaaacttttattttcaaccatctgtatgtgttccttgctgcttctctcctgccttgcccctggccatgctaaccactgccctcctcgattttttccaatgttcagtaaattggaagagctcacttctgatgaaatggggggtgagagtggaggattgtggaccaaaaaaaaaa

SEQ ID NO: 268707 - DNA, 429 bp, Homo sapiens
aaaatagaaatcactaccaagagatctctcatacctatgacaacatggaaataaaacaacgctcttgaatgagggtaaacgacaatttttaaatctttgaaataatgaaaacaagacacaacgtgccaaatctctgggatgcagccaaaacgtgttaataggaattttatagcacaaaacacctacctccgagttagaagatctcaattaaccatctaacattacagatagaggaacaagaaaaacaacaaatgaaccccaaagctagcagaagagaagaaataactaaaatcagagccaaatggaatgaaattgagacccaaaaatccatacagagaatcaatgaaaaacaaacaatttttttatcttttcaaaaaaaatgttttttgaaagatgaaacaagattggtagactgttagctatattaac

SEQ ID NO: 268708 - DNA, 557 bp, Homo sapiens
gtggtagttttaaaaaaaatttctcataggcacaaaaagcgatataaatgaggtaatacacatttattaagattaatattttaaaaaattcagttcatccccaaagcaagcaaattactttttatttaaaaattttactttaatcataattggatttttaaggtattttaaaataaatattaaacataaaagaatgattttcagtggctgtagttcaaaactgctgtggaatagaaattagtattgtgacaccatttaagtgtccagttttaaattaaatggtgttgagtttccagctctcttagtttttaatgtgaaacaaaccaccccaaaacggtagtagctttaaaataaccatttatttggctcgtgactatttggctttgtcatttggatggggtttagctgggtgagtcttctgccggttaggaggggcttcctcacactgccagattggctgggagcttctgcgcctagaatgtcttcagctgggacagctgatccctgctccatgtggttgcagcctccagcagatgagttcagatttgttcacatgg

SEQ ID NO: 268709 - DNA, 421 bp, Homo sapiens
ctgggattttcttcaaaggttgagggaagaggtaggagtagaagtacaacaagatggccattaactgttaattgttgaagctgggtgataagtacacaagggtttattattctactttctctacctgtataaagtttaaaaaatacataagaaatgcccaagcatatacttagattcaggaaaacaatttaagaaaaatatattcacaattgttaagtatttttctctgttctatatattcaatgttttctctcataatcacaatacactacatcaaaataacatcatctgaagggttttggaaattgtatcttagtcgctattagaatatgactaaatttgtaaatatataattttctctcaaagcactgtggaatgtttcctttgctttgaatatgaataaaataatttgttcacaaaa

SEQ ID NO: 268710 - DNA, 210 bp, Homo sapiens
gccttatgagagaagtagttcagtacaacatgtttaactgtgcttaaacatttcaaaagactgcccaagcaatactattttaaattaaatatcagaaaatatgttaacatagaaagctgggtatgatgatctgcatattgcagttattattaatttgacaatgaacttaggtttggggagtgttttgtagttggggtttttttatttttt

SEQ ID NO: 268711 - DNA, 399 bp, Homo sapiens
aaaaattcccccagcaatagacagtctatcagtccaagtatttacttcctgagttttgatcaatattttttatttgtgtatgttaatcgtcataaaaacagtgattttggtgtgttttttattttggtgctttaatggcttaagatgttgcacattttttttttcttttggtttctgtttatgtttttttgcctatgcagttaaatttttcctagaaatagcatttgtgttgaacagtaacactttatacatatatatatgcatgtttattttgtttggcgtctttggagggatgcttttagacttgtttgcaaaagggcagttttctttttctttgctgcagttgtctattttgcagaataatagtgtgtgcaagtttgtgagcaaatgaaatatgca

SEQ ID NO: 268712 - DNA, 701 bp, Homo sapiens
aataaaaagatgtgaaagaaaaaaaaaaaaaaaatactttaacttatagataaaggataaaagaaatgataatagaggaaattttcctccccccaccaccacttgaacctaatttagtgatggaaaggttttattcccaatatagttgtgttttatgttcctgttctaggcttaaattttcaggggcctggaagcttccatttttgtttcaggaagctagatgctatgctttgaagaagctcagccaagacaactggaagagaagagactacatggagagagaaaggccacgtggaggaccactggggctccacgcattgagtgaagcctttttggacttttgagccagccaactaataagaagtaaaaccaacactgtggagtggcaaacaaaagaaaatgcattttaatctgggtctcaggaattgcaattgggagacacagatccagcaaataggaaaatcatgttccgtcttggtgagattagaagaggcttagaaggactactgtgagtttacacatctggaaggttttagcatagttcataatggatgatggctggttaacaatttagtacgtctttgatgatcaatctagttcagcatagctgtctcttgtcggtaaaccaatgtatacctaaggtcgtttcccggcagtcttttcatgagagcttattgtctggcccccttttgtattgacct

SEQ ID NO: 268713 - DNA, 721 bp, Homo sapiens
tacttcccacagaagctctagctttcccgctccttctgcctattaaattgttgttgtaatatacccttacccctagctgttcagcaagctactgctttctaatgctgtcacatgtatgaatataaagcatgttctttttccctctagttaaactgtctaatgtcaggaaatttgcaggcccacttcctccccccaccaccacttgaacctaatttagtgatggaaaggttttattcccaatatagttgtgttttatgttcctgttctaggcttaaattttcaggggcctggaagcttccatttttgtttcaggaagctagatgctatgctttgaagaagctcagccaagacaactggaagagaagagactacatggagagagaaaggccacgtggaggaccactggggctccacgcattgagtgaagcctttttggacttttgagccagccaactaataagaagtaaaaccaacactgtggagtggcaaacaaaagaaaatgcattttaatctgggtctcaggaattgcaattgggagacacagatccagcaaataggaaaatcatgttccgtcttggtgagattagaagaggcttagaaggactactgtgagtttacacatctggaaggttttagcatagttcataatggatgatggctggttaacaatttagtacgtctttgatgatcaatctagttcagcatagctgtctcttgtcgg

SEQ ID NO: 268714 - DNA, 767 bp, Homo sapiens
gtaggatataaaactagaatgtcaatttaaggagtttggtccttattcagtaggcaatgggaatcgaggtagcaagatctaaccctttaagggagaaaactcaaagggttgagacatcaagattacaaggttatctattgaaagagtcttgcaagagatagcaaaggctgcgatagtgacaactgtgatggtagttgtactatgggaattcaaaaaagaacgaaacccctgtggactggaagcgctataagcagaacctgagctaggttctgtgaagagtgagtaggagtcaacaacagccctgttgtaaacttgaattttaaattagttttataccacagcatatctcagtgacaaaaaagcaaacaaccattatttagcattttatttcaaccaaataaaagttgattaaaagtgaagtcttatttcctgatatttgagtctttcaggtatatctatttaaaaaaactgttctcttcaagtttaagggttagcgtgtcaggaattaattaagccctgtagtcatatgagataggaaaaagtggacctgaaatgaggacaagagaaggacaaattgcagaaatgaggacatgtaagtcttcagaagaatgtgtcacacaatagaattaatgcgtaagggtgaagaaataatgatttgtagtatcatgggagaataacaaaagaatgtaaaagactcacagagaataagaggggtagtgggctaaattcctcaactcaaaattaataaatgaagaggaatgatcaag

SEQ ID NO: 268715 - DNA, 480 bp, Homo sapiens
ttttgagctggagttttgctctcattgcccaggctggagtgcagtggtgagatctcagctcaccacaacttccgtctcccaggttcaagtgattctcctgcctcagccttccgaatagctaaactacacgtgtaagccaccatacttggctaatttttgtatttgtagtagaaacaggatttcaccatgttggccaggctggtctcgaactcctgacctcaagtgatctgcccaccttggcctcccaaagtgctgggattacaggcatgggccaccgtgcccagcctattacatgttttaaggtcataaaactgctacttctggaatatttcttaaacttgcttgatttctgtaaggtctggctgctgggctccctgaaaccttgcacatatcttactgtatgactgtatttcgttttgagtctctggattctggggtttggacagatgaccatagtgaggcctgcagaaatatgcatgt

SEQ ID NO: 268716 - DNA, 323 bp, Homo sapiens
ttcctttcacctggggaaggatttggctttggggaggtaagagcttgaaacatgggatgagagaggagtcactgctacctctgatttgctcaaagccatggcagttgtttagaattctctacctctactgtcacctaacaggcaggcttcatctgcaggccttccaaatagtggaagttcacaggtagaaaatttaggtccctgaatccgtgggttcgctgtctcagcccattcagaacaattctttaggtactggcctcactggagaaagaagtgatccagaagaacagtctagtgaccaggagatctgagggtagggtggg

SEQ ID NO: 268717 - DNA, 496 bp, Homo sapiens
tcgcctcatcttcactgtgggagggcattacagctccctcagaactcctgtagcactttatctgtgtctctttgttatgctttctactgtttattaatacatacccttttctttttctttcattcctggcctcacttcccctaaaaattggggtggtttataggaaaccttgaagataataaaaaataatgataaatggtaaaaaccacggcaaataaaaagtaaaatgaaaaaatggatgatgaaaagtacatgttacaaaagcctttgcatttgctagcagtggacactgaatttggctcaaatattcatttgtctcagggaagcaagaggagcttgaaaatatgaaacaggtcagtgctccatctcacatgaataagctcaatgtgaaaacccagatgctaatttcaatttaaacccaataatgttaaaatagtgtttcataatatttaatatattcattaaagatgatggactaggacacactcttatcatt

SEQ ID NO: 268718 - DNA, 442 bp, Homo sapiens
aattactgcacattgtgagactttcaaattctgcatgtgtatgactatcgagtaactgccaaagttatatttttgaaaaatagctctttgccttaatagtgagggaaaaaacaaggttaccaactccagtagacttagattgaacttatatttttttcagtgaagttaatttcatcttactctttttaatgtaaattgagtctggcaagcataaaggtttgttttatgctactttaaaggcagtgcagctcagtggaaatagcataaagtctgaggaacacctgaattcaagttctaagtgtaacttactagatcctaggctatgttctttcttaatttctcatctttacaatgtggatggtgataccccatggaagttctagaaggattaaagcatctcatttagccactgacaaaattgttggaattattacttaaaaca

SEQ ID NO: 268719 - DNA, 386 bp, Homo sapiens
ctttcttctttccacagaaattctaccttttctgaatttagtctaaattatataacagcaagtttgttaacatggtactataaggataggacatatgaagaggagtggccaggcacagtggctcaagcctgtaatcccagcactttgggaggctgaggcaggtggatcacttaaggtcgggagttcgagaccagtctaacatggagaaaccctgtctctactaaaaatacaaaattagctgggcatgttgatgcatgcctgtaatcccagcaacttgggaggctgaggcaggagaatagcttgaacccgggaagcagaggttgcggtgagcccagatcgtgccattgcactccagcctggggcaacaagagcgaaactccgtctca

SEQ ID NO: 268720 - DNA, 597 bp, Homo sapiens
attaatgttcctttaaattctgagttctgtatttttgaaagtctttttttatgtttgaatatattctaatttactgtaatttgccatcgttttatttgatccaaatcatatatattttagattataagaacatctgtattgtataatatttgcaagtaattaaaaaatattttttaaatcctaggtttaggcttcgtagatctgaatgcggttttttcattaatcttaaataaaatttaagactgaatttacagttgttaaacattcataacatgatcaatttttagtgggttttttggtggggtgtactattttccaccctttttgtatctagttgcaaggagccaagaacaggcaaattattaactcctttattatttcctcctgtctgaaatgttttcaagcagcgtatttgtctgttaaatcatgaaaaactgaaaaaaaaagtctatggctatttcctaatgattttatttaggttgttgctcttaatgaggattagtacctgttttgtacatcagtactggctgacttgtcagttactcggataattgatcgagtgattgctctgcagagaaataaataaatgcttaacta

SEQ ID NO: 268721 - DNA, 412 bp, Homo sapiens
ttctgcccagtgacatgtgggaagaagtggctctttcaggactgttcccccaaaactgtctttgggatgctccaaacttctttattcccccaatcctctgatgaacatgcacctgacattggatgctacatgttaaaaacggagttgtcatcttctacctgggtcgctgaatgactgtgtggatcaggaagctccccactcttccctgccatgactgaactagccactgtcatctggagggtgtctgtaatagcatctagcattgcctaacatcatactaatggaacactacatattttcatctgaagtgatatcagtggaatttccactgaaagcaaaggtttagattttggagcaataatgcttaatatttgtcagtaggagcttattaaatataaataccagtcccagt

SEQ ID NO: 268722 - DNA, 1276 bp, Homo sapiens
ggccgaatggagaatgaagccttttcaaattcacctcccagtgaaccaccctcaaaatagaagtgaatgtgaaaccacagatatttcattaaaacatatctgaagataaaaacatacctcaagcttcacagatataggacttctgagctgagaggacctcccggacatattgtctaccctaagcaccaggctggacacactgggaaacaggctgaccacctgggctcccaggccttctacccaggacgtcagcatgactacctagtcccacctgctggcacagctggcattcctgttcaaaatcagccaggtagacctgaaggggtaccatggatgccagcaccaccaccaccattaaactgtccgccaggattggaatacttaagtcagatagatatgatactaattcatcagcaaattgaacttctggaagtttctattcagttttgaaagtagtaacatgtatgaaatcaagaacagctttgggcagaggatttattttgcagcagaagatactaatttctgtatccgaaattgctgtgggcggtctagaccttttaccttgaggattactgataatgtgggtcgagaagtcataactctggaaagaccactaagatgtaactgttgttgttgcccctgctgccttcaggagatagaaatccaagctcctcctggtgtaccagtaggttatgttactcagacctggcacccatgtctaacaaagtttacaattaaaaatcagaaaagagaggatgtactaaaaattagtggtccatgtatcgtgtgcagctgtattgcgggtgttgattttgagattacatctcttgatgaacaaattgtggttggcaggatttctaagcactggtctgggtttttaagagaggcatttactgatgctgacaactttggaatccaattccctagagaccttgatgttaaaatgaaagccgtgatgattggtgcctgtttcctcattgactacatgttttttgaaagaactaggtaatgactggaatgtcagagtgtgggagtggattaatgattccggatctttggctaggcaaaatgaaactataactgatctaaacggttccttccttcttctactgtgcaaggaagatgtaaggaaaaactcgcacactatctgtggaactcatttaaattcaaatcctagataaacatttcgcattgaatatttacatggagaaaaatcatcaaacatcaacaattatcaagttaattaataaaaatactaggtattgcaaaaaaggct

SEQ ID NO: 268723 - DNA, 804 bp, Homo sapiens
  misc_feature (20)..(20): n is a, c, g, or t
  misc_feature (26)..(26): n is a, c, g, or t
  misc_feature (46)..(46): n is a, c, g, or t
ttttccaagcttaactcatnccgttnttggctatttatgacctacnaccctggttgtctacaccagagacaataaccagctgtccacttggattagagtatttgcatcagataaatcagttaacagtgtgtcaacattttgatcctctgggagtcctcagaaaatttgaaactagtaaaacgtatgaaatcttgaacaatcaaggacagagaatttattttgcagaagagagaaataattgcttccttcgacacctttgtggattttcaagcccttttactatgacaatttatgataatgtaggtagagatgtacttgctctgcataaggctctgaaatgtagcttacaaaagttattgactctggatgaggaaatggttattggaaagatttcaaaacagtactctggatttgtaaggggaatattaaccaatggtgagaaatttgggatccagtttccatttgatcttgatgttaaaattaagcattgatgcttggagcaactttcctcattgaatacatgtattttgaactgtggccataagaattaccctgaaagaatatgtcagagattactggcatttatttttgccagccctcaacaaaactaagcaactttcactgaaaatatctaaataaagttttattttactaaaactattcatatatattctttctgcctaataaactacatcaaaaatgtttaactcaaaaaaacaaaaaaagattgccctcgtcggcctcagcaggaggagcctctgcagccgctttccctttaatgaagggtcaattcatgaccccccg

SEQ ID NO: 268724 - DNA, 706 bp, Homo sapiens
cccgaattgcagaagaaggcccaggtgtaacggacggccgtgacaaggcctttcatcctcagaaaatttgaaactagtaaaacgtatgaaatcttgaacaatcaaggacagagaatttattttgcagaagagagaaataattgcttccttcgacacctttgtggattttcaagcccttttactatgacaatttatgataatgtaggtagagatgtacttgctctgcataaggctctgaaatgtagcttacaaaagttattgactctggatgaggaaatggttattggaaagatttcaaaacagtactctggatttgtaaggggaatattaaccaatggtgagaaatttgggatccagtttccatttgatcttgatgttaaaattaagcattgatgcttggagcaactttcctcattgaatacatgtattttgaactgtggccataagaattaccctgaaagaatatgtcagagattactggcatttatttttgccagccctcaacaaaactaagcaactttcactgaaaatatctaaataaagttttattttactaaaactattcatatatattctttctgcctaataaactacatcaaaaatgtttaactcaaaaaaacaaaaaaagattgccctcgtcggcctcagcaggaggagcctctgcagccgctttccctttaatgaagggtcaattcatgaccccccg

SEQ ID NO: 268725 - DNA, 885 bp, Homo sapiens
ggccgaatggagaatgaagccttttcaaattcacctcccagtgaaccaccctcaaaatagaagtgaatgtgaaaccacagatatttcattaaaacatatctgaagataaaaacatacctcaagcttcacagatataggacttctgagctgagaggacctcccggacatattgtctaccctaagcaccaggctggacacactgggaaacaggctgaccacctgggctcccaggccttctacccaggacgtcagcatgactacctagtcccacctgctggcacagctggcattcctgttcaaaatcagccaggtagacctgaaggggtaccatggatgccagcaccaccaccaccattaaactgtccgccaggattggaatacttaagtcagatagatatgatactaattcatcagcaaattgaacttctggaagtttattgactctggatgaggaaatggttattggaaagatttcaaaacagtactctggatttgtaaggggaatattaaccaatggtgagaaatttgggatccagtttccatttgatcttgatgttaaaattaagcattgatgcttggagcaactttcctcattgaatacatgtattttgaactgtggccataagaattaccctgaaagaatatgtcagagattactggcatttatttttgccagccctcaacaaaactaagcaactttcactgaaaatatctaaataaagttttattttactaaaactattcatatatattctttctgcctaataaactacatcaaaaatgtttaactcaaaaaaacaaaaaaagattgccctcgtcggcctcagcaggaggagcctctgcagccgctttccctttaatgaagggtcaattcatgaccccccg

SEQ ID NO: 268726 - DNA, 471 bp, Homo sapiens
tgcccttccacaaactttctgatcttcagcacacactacccaaccatcaaggctgagacttcccgtggccagcagtgtctcatgctggcttcaagccccacagcactgcttttttcaacttctcttgtggtttagactgtctttagcccagcaagagaattcattgtcttatcccccattaaactgtacctacactctttgaggaaaagggtccatcttacttaaaatattttaaaaattcacatgtgataaaactgatgtgtatgtgtatgagagagagagaaagagagaacagttctatgaggcttaatgtatacatgtggctgtgcagcccactgccccatgtcaccattttcaattctgtcattacccctgggacaatgtcttgtcaatatacacttgaggctgggcggggtggttcctgcctgtaatcccacctgtaatcaggagttcaagaccagcctgggcaac

SEQ ID NO: 268727 - DNA, 478 bp, Homo sapiens
cagcctttttgccgaggtggggatgctcatctgcattcttttagggccatgcagaaaaagcaataaagggaacttccttcccccaaactgccctgtctcccaccatgggcagcccaagaccgcatccttggactgacgttcagctcacaggggagcaggaagtgggaaaagtcaggccactgaagcctctacttcgatgcagcggctacttctactttccagactgttctcttgaatggggggaggccacaggtcggagctgtgcccacatcattagtcaagggcatatagattgttacaggtgatggtttcccatcaaggggatgcagcagagctgaggacccagttcataaatggaaaactggatttgttatccctgttttctctacagtgggtaatgcttctggcaagtgtgaagggaaagggaatgttcaagattatctgggaaagtcaaccgacaaggaaggcagccaggaaa

SEQ ID NO: 268728 - DNA, 621 bp, Homo sapiens
ggttcgtcctaattgagctgaacactagtcactgggttccacggttctcttccatgacccacagcttctaatagagctataacactcactgcatgatccaagattccattccttggaatccgtgaggccaagaatcccgggtcagagaacacaaagcttgccaccatcttggaagcggcccaccaccatcttggaagcggcttgccaccatcttgggaactctgtgagcaagggcctcaggtaacattttggtgaccacgaagtgacctccaaagcgatgcggagtctcactgtgttgcaaattcctgacctcaagtgatcttcctgcctgggcctcaaagagcggggattatacgcaggggccactgctttcagcctttaaattctgttaaaaacagcgttggtgaggtatggaattattatatgccatatgctttacgctactgttagtgggtcttgtaaagatcctatcacatttgtcttataattctcattttacatatgaaggaattaacacaacattgaagtattgccaaaactcacagtttgaaagtcagcatatattttgttatgcatcagaaatagtaaaataaaacttatatgcctctaataaatctatta

SEQ ID NO: 268729 - DNA, 275 bp, Homo sapiens
caagcatgggggcttgtggtgtcaagcatgggcttttgtgggatcaagacagacctagttactctacttaaaatctcaataatttagtgggaaagatggacattaaacaaataattttaaacactatgtaactgcaaatatgccaagtcctacaaggggacacacagaatatgaatgaaatagaagaacaggagctgtcttcttctgcttctgcatggaaaccactaaccacgtgtagctatttaaatttaatttaaatttgaattaattaaaaa

SEQ ID NO: 268730 - DNA, 513 bp, Homo sapiens
catacttaaatgctacctaataatggaatcaagtttttaaatctgcattttaataaaaattaaacataaaatattcagtgtctcagctatgatagacacacttcaagtgctgatcagcaaacggtgtgagtgccaggcagacgggccagtgcaggctacacagctgcagctcaaacagcacagctgcaggtgaaacaggccagtctctctgcgcacgggaacagtctgggcaagcatgagacggggaaaacgggcactgtcctcgtgagaacaaaggacccacaacaggaaccctagactcaccttctgccaaagacaccaacagcccacgacgcagcctcctcacaaaagggagaggcattcaagaacttagaaaatcacctcttcctggaaaatgctcactttaaaactttgcatgtaactttaaattttaattacaaagttgttaacatccattttctcatgtattcttaattaactctgtgaaagtaaacacagcttttattcttaaac

SEQ ID NO: 268731 - DNA, 143 bp, Homo sapiens
tgattttaaaaacacaactcaggccgggtagggttgctcacgcctgtaatcccagcactttgggaagccgaggttggaatattgcttgaggccaggcatgtgagaccaacctgggcaatgcagtgagatcctgtctgtacaaa

SEQ ID NO: 268732 - DNA, 484 bp, Homo sapiens
aagcacatatcctccccttgttcctaattttagagggaaagtactcagtctttcgccattaagtacaatgtcagctgtaagttttcctagagaccctttctcagcttgaagatgttccctggtattcatagtttgctaaaaggtttttgtcattttaaatcataaatgggtgttgaattttgtcaaaggcttttaatgcatctatggagatgatccaagtttttttcctccttatttctgctaaggttgtataattatgctcattggtattttaaatgttaaattaaccttgcgttcctgggataagacccactgatcatgatgcattttcctctttgtaaattgctgtattcattttagtttcttcaggattttgcctatgtttgaaggatattggtttgtaatttttcttgtaacatctttgtctggttttgaaatcaaagtaatactggcctaataaaatgagttggaatgtgaaacccaa

SEQ ID NO: 268733 - DNA, 218 bp, Homo sapiens
acctattttcttaatatctcttataatgataaagtcaatgtatctgtttcattcacaatataatttaagattctttatcatatgatatttattagattagaaaatacttatatagagcttactctgtgctaggcactaagtgccttggaaaatattaacttattcattataagagctgtgattcaccataagaaaagcttagatgttgtgattcttag

SEQ ID NO: 268734 - DNA, 246 bp, Homo sapiens
aataaattagatcaattaaaggtatagtagctgctcacattctagtctacattgagaggtatgtgaaaataggagagcctagaagactaaaaaccattagggggagtctaaattcatgataaaatataagatgacagttgaaaatgaggaaagatgaaaaaattggtgagaaaataaagcattcaagattatgacttcaaggtttaagtagttggcagaatctagagtagtgttgcccaatagaac

SEQ ID NO: 268735 - DNA, 1025 bp, Homo sapiens
cacgccacagcccccctcaatctgattccctgctatgcctgccatcaccactggccagttttaccacatgcttctcaagacccaaggcacaataggcataaagttgtcctgaaaaggacaagaggagtgtcagaagtaggaatggcagttgaaggagcttcgtctgccagcagaaagctgaaatgacaggcaagcacaaaatatattaaggagacaaagctatgcatgagcgaaatatcaaactttcatcttctacccactttttttttttttttttgcttaaaaacaggaagacagaatgtcttgtcaagggtcaccccaggaggaggagtaaattccccaaaaagcggaacatatttttatgatttaattaatacaatttctctcaatgtgtctgtttatcatttgagcatccacatgatcagacctgacatctgcctacattttcttggtcgtctttgacttcagttaagaaccttttgctctttgttttcccccagcagcacagtatattaagtttggaacaagacacacctgaaatcaaatccctgctctgtgctgggtgatcttagaggcagtcttttacctctttctactttattgttctcataggaaaagtggaaatgaggccttttaccccagggttgttgagaagacagaggagaaaaagcacataaaaatgcaccttgtcgggcgtggggctcacacctgtaatcccagcactttgggaggctgaggcaggtgtatcgcttgaggccaggagttcaagaccagcctggccaacaggaaaaatacattaaaaataatgtctctattaaaaatacaaaaattagccaggtatggtggtgcacgcctgtaatcccagctactcaggaggctgaggcagaagaatcgcttgaacccaggaagcgaaagctgcagtgagtcgagatcgcagcactgggcaggcacagtggctcacacctgtaatcccagtactttgggaggctgaggtgggtggatcacaaggtcaggagatggagacc

SEQ ID NO: 268736 - DNA, 795 bp, Homo sapiens
gacctccaaattacagtaaattacagtactaagattttacttgaactttctaaagcattcgccattttaaattatttaacttttatactcctccttcccttttgtgctgtttccttcctggcgctcctaaatatctgtccattctttggacctcttccaaattttcagataattataatagtgtgcgaatgatgcaaaggtaatgtgccgtgggagagaacagaagagagaaacctaattctggcctcatcacattattgtttttttaaatttaataactattttagatgcttcagtagatttacagtgagggcaaaagaaaacagttttctttaggagtatggagggattatataggatgtacaataaataccctaagtacttcaaatcagttcagatctttaaaatcctatttttccttcagttctcaacttcaatatcacctactctgggagtcattccctaccatgcttgtttgtttgtttgtttgtttgtttgtttgttttgagacagagtctcactctgttgcccaagctggagtgcagtgacaccatctctgctcaccgcagcctctacctcccaggttcaaacgattctcttgtctcagcctggccaacatggcgaaaccctgtctctactaaaaataaaaaataaaaaaacagccgggcgtggtggtgcacgcctgtaatcccagctgagtcaagagaatcgcttgaacccgggaagaggaggttgtagtgagctcagatcacaccactgcactccagcctaggtgacagagcgagactccatcta

SEQ ID NO: 268737 - DNA, 366 bp, Homo sapiens
tagtgcaaagatttttgtctgcctgagcttatggctgagctgggagactgggagcagcaaaggcactgttccctgggggaatgggaggtggattgagtcctaggtacttctcagagtgtagactctcactgcacggagagtgcttctcctattgaaagaaatgtatacttggcctccacacagaaactaactactttatctggagctcgtgaagaaaaagagcctgggcatggtggctcacgcatgtaatcccaacactttgggaggccaaggcaggaggatggcttgagtccaagaattcaagaccagcctgggcaacaaagtgagaccccatctctacaaaaaataaaataattagccgaatgt

SEQ ID NO: 268738 - DNA, 452 bp, Homo sapiens
tgtctttcctttcttcctcctttcttccttccttctgtccctccatctcccatccccttctctcctttcctttccatagccctaggtacacattagtaacaagtgtatttacctcattgagtgtcttattcttaagtatgttgaaacaagaactaattaatattgtgaatcggccggacgcagtggctctcgactataatcctagcactttgggaggccgaggcaggcggatcacgagatcaagagactgagaccctcctggccaatatggtgaaaccctgtctctactaaaaatacaaaaattagctgggtgtggtggcgcgcacctgtagtcccacctactcaggaggctgaggcaggagaatagcttgaacccagaaggcagaggttccagtgagctgagattgcgccactgcactccagcctggcaacagagtgagacaccgtttaaa

SEQ ID NO: 268739 - DNA, 495 bp, Homo sapiens
gatggcagggagagaagcagtggtacagagctagaaaggaagacattccaagcagtgtttgtagattgaatggattaattcatgaatacacaaaacattgtgaaagggaaaattcacagaatatttccattcctaaggatgcatctatagtcatttgatgtatatgcatagtatttctttctggtctgagaagggaaattttataaaaactggaattgtaccctagatgatacgtatagtatcttacagccttaatattttgcttcataagacgccatcccaagcaactcgtttgagaatgagaaattgccctgattcctaaagcccacctaatcttcccctttctccctagttagccacttaattatttttcagttattctattccagttttatttcataaacttgatcgaaagctgcttgacagcagagaccataccattcttttttatctaccattctgtacatattggttcatggagattgggagtttggt

SEQ ID NO: 268740 - DNA, 561 bp, Homo sapiens
cagccctgtaggagacacctccagagaaagtaacagctctcaattgattagctgagccagaattagcttctgttacttacaactgtgagtcctgactgaaaacatatttcttcctttgaagaactgttacctgtaacaggctaagaagaatattaagaataaacagatgcttttacagctcgccttggcgggaagatctggcacaaatgaagtatctataaggagcagcagagtcaaggtggtgatcctgtggatgaataactgaaacctgatatacttgacagcagaaaatataaagcaaattgaaaaggagagagtgtggagataaataagaaaatgaaagaactgataaagtcacttggattaaaaaacctgggagtaagggctttgtttatgattgaacttaagagagaattgagggaccacctacctttgatgttaacgagaaagtaaagaggaaacatatttagagataccctttggtgaaaaacagaaatggatgtgtcatttgatgcatcacattatttattcaacaaactcttagtgagaacttactgtgta

SEQ ID NO: 268741 - DNA, 460 bp, Homo sapiens
cagccctgtaggagacacctccagagaaagtaacagctctcaattgattagctgagaataaacagatgcttttacagctcgccttggcgggaagatctggcacaaatgaagtatctataaggagcagcagagtcaaggtggtgatcctgtggatgaataactgaaacctgatatacttgacagcagaaaatataaagcaaattgaaaaggagagagtgtggagataaataagaaaatgaaagaactgataaagtcacttggattaaaaaacctgggagtaagggctttgtttatgattgaacttaagagagaattgagggaccacctacctttgatgttaacgagaaagtaaagaggaaacatatttagagataccctttggtgaaaaacagaaatggatgtgtcatttgatgcatcacattatttattcaacaaactcttagtgagaacttactgtgta

SEQ ID NO: 268742 - DNA, 603 bp, Homo sapiens
cagccctgtaggagacacctccagagaaagtaacagctctcaattgattagctgagaataaacagatgcttttacagctcgccttggcgggaagatctggcacaaatgaagtatctataaggagcagcagagtcaagactggatttagtgacttgcttcatcaatggaatacactcaaataacattttggaatttctgagactgtcataaaaagctgaagggcttctattgggcttcctgaaatgctcccttttggatccctgagcagccatgtgagtttaactactctgcaggagagagtatgtgaaaaggaacctacctaagcccagcctccttgtcatccacaggaagacaccagacaaatgagttacactgttttggactccccaacacaacccagccaccggctgaatgccaccaaattaccttctagttaaaggtttatggagcaaacgaatcacctattcaatatctgcttgaatttctgactcaaaatacatcaggtataaaatgatggtttttttaagccactaagtcttgggggagtttattataaagcaatagataattttgaaaataaatagaacaagctgaagtcccaaa

SEQ ID NO: 268743 - DNA, 612 bp, Homo sapiens
ccaaaatagctgcataaacagttaaatagttaatgaattggttactttttctagccatgtacacacaaatacacacagactttcagaaaaactccacatgattgacatcatgtaaccaacactttaattttccattcagatgttcagtgtataggggacataatctttttattatagatactttaagtaagagttttaattgactgtcagtacctccagatgctattatagtaatatattacttattttggaatccataggctgaatatgttggaagtgaggtgaagctctagtctattcattctaaagtggagatgaagattcatcaggccaagaggaattcctgtttaccagagtttcctagcaggacaacgaaatccagagcccctcagggagttcaaaatttgtgagagaatttcaggacctcgaaataggacagcttcttcacccacccttaagcctcttatagaaaagctagactgctggagaagctttaggatgttaaatgataatgcggtctacattttaaaaccaaagattggtcttgattagtgcccttagattcaagagttttgcattttaaaattatctgagactttgttaaaagcaaaa

SEQ ID NO: 268744 - DNA, 555 bp, Homo sapiens
ttattctgagaattgtgttgacaagaccctcttttcctacagagctctctcttaatgttgcttggaatagccttgtgtcctggagacagttttaggtctggcaggatctgagaacaggagtggggatcttggaatgggatctgcatccctgagcttcatccacaaagggtgggaatgtggcttgggctgtggggtggaggtagatgaacagctggacttgcaggtctatcttctgttgtttctcaataaagtagacaagtccatctgatgggtgtttagtagggtatgacttgtgagtccacaaggccagcagtatatatgctgaatggactgcttagcagtaacacactggaaaaatccaaaaagaatggatttcaagttggcaaaaaatgcattagaagtcagcagtgtgatgtggtcaggagaacaaccagagtgactgtgggatgaggtcttggatagctttgtttctatatacagtcagccctctgtatccatggtttctgcatccatggattcaaccaaccaaggctcgaaaatattaaaaaaaaaaaa

SEQ ID NO: 268745 - DNA, 870 bp, Homo sapiens
ttttttttttgacatggagttttgctctgtcgtccaggctggagtgcagtggcgcttggctcactgcaacctctgcctcctgacttcaagcgattctcctgcctcagcctcccaaagtgctgggattacaggtgtgagccaccatacccggcccagataggttgatcttataacaatccagaaacaaatgtcatagtcaagatttggtagatagatttaaaactaaaatattctgccattggaagtgaaatgtcatagcacatacgtggacgttatgcatttagagatgttataaaaatgtattggcagtatacatagcactactcaagaagccaaagaaacacttgtgcagtgctaagtgtcacatgtctgcttctgccagaggctaggaatagtgatcttgctataatgtgagaacctgaatcatgtttgtaaaataggaggctgggagcagttccaggccacagtgaagtgtgttgcttctgtcactttatattcttatatttcctttccctcagacaatcaactgttgatgcctgtacttgtgaaaagttgtaaggcaatttttagggttgttgtcaaagaaaagcttggattacattaacatttgtactcagccttttaggcaatacaccagagggggctgggaattgtctgtttgttcctatgataagtagatcttactgtaaaatagtaaatgtccattgaaaagcaagtaacacaacctgtgctaactgggagcacttgaacaattttgttccattctgaataacttttcagcaagtaattctaagctttgtcttatatccttgtgtaaaattgctaccttcatttttaccctatttgatttcttaaatggtttgttcaaga

SEQ ID NO: 268746 - DNA, 406 bp, Homo sapiens
ctttaaggtttttggccagagcaattggaaagatggagttgccattaattgggatgaggatgcttgtggggggaactggttcaggatggaaaatcaagagctcagttttggacatgttaagtttgagttgcctattagcagtagtaaacatttacaaattggctttccaggagaaaaaggtgcgtgtgtgtgtgtgtgtgtgtgtgtgtgtgtataataagtttattataaggtttactgatataaatgatgcatagcacacaattcacaaataataaaatatatagtacttcttattgtaaattccatatggccactttattcccacagaacgttttaattgatgttggccagactcttatatctatagccaactaatggttgcaattgctgaacatgtatactt

SEQ ID NO: 268747 - DNA, 587 bp, Homo sapiens
  misc_feature (78)..(78): n is a, c, g, or t
  misc_feature (83)..(83): n is a, c, g, or t
  misc_feature (86)..(86): n is a, c, g, or t
  misc_feature (104)..(105): n is a, c, g, or t
aagcttctcatttcaaacatatgtaaacatttatcagccagctacaaggttctagaacagtgattttcaaacattctntctcnctntctctctctctctctgtnnctatctctctctacctaaacaagctaagaactgaaaagttctgattgacaggttgaaagacctggagcacttaagtcttctattattcaccaatcttttctccttcagcaggtggctccaatgtttaaaacctagaggttgaaccaggggttgtgaaccttaaatagagtgttatgagctactgactcttaaactttgagcttcagaggaagttaacagcaagtctgatgactcatatgcattctcacatgcttgaaggtggctgaagatgaaaatagccgaactagcaggttggtaggtgttatggtagcatctgtcccttcaaccaagaacaatctgcacctgtgacatttgagtaaactttgtgccagactgtgtcttctatttttcttatatgatgtgatacaagatatggcccaaatctgaagaaaacaaattatattatcatgtcaggggagaagaggggtcctctaggtcgccat

SEQ ID NO: 268748 - DNA, 819 bp, Homo sapiens
  misc_feature (58)..(58): n is a, c, g, or t
  misc_feature (63)..(63): n is a, c, g, or t
  misc_feature (66)..(66): n is a, c, g, or t
  misc_feature (84)..(85): n is a, c, g, or t
gaccaagtggatgtctgagtgccgatcacctttatgtttctctctatctctctctctntctcnctntctctctctctctctgtnnctatctctctctacctaaacaagctaagaactgaaaagttctgattgacaggttgaaagacctggagcacttaagtcttctattattcaccaatcttttctccttcagcaggtggctccaatgtttaaaacctagaggttgaaccaggggttgtgaaccttaaatagagtgttatgagctactgactcttaaactttgagcttcagaggaagttaacagcaagtctgatgactcatatgcattctcacatgcttgaaggtggctgaagatgaaaatagccgaactagcagcaattgttttaaaaaccgcaaggattattcgccgttgaaaataaaatcttgtgctccattcaagtacaggcacatcttctaaggaacaccaccacacaaattatcatacccattttatggatgacgaagaacacttggagaagataagaaaatggccacagttacaatgagatcaaaacagctcaatcttaaaatcaagtctctcactccaaatggagatttttatgctacattattaccaaaataattttgtttctcttttcctcaaggaagcacacatttgctgtgagcattatatattacttattaaaatttagtgattttagaatcgtaagaactttagtagaatatagttgaaaaatctgcataccttgtatagatctaaatcaaaggatactagaaaatacaagctatataaagggattacttaattattcctatttt

SEQ ID NO: 268749 - DNA, 583 bp, Homo sapiens
tagaaaaacactttaaaaagtaaaacaaaagtttataaaggaaaaaagttacagtaagctaaggttaatttattattggagaaaattaaaacaataaatttattgtagctaagtatacagtgtttataaagtctatagcagtgaacaggaatgtcctaggccttcacgttcactcaccactcactcactgactcacccagagcaacttccagtcctgcaagctccctttgtggtaagtctcctatataggtgtaccatttgttatcttttaaaccacatttttactgtatgttttctctgtttagatgcacaaataccattgtgttacaactgcctacagtattcagtacagtaacatgctgtacagatttatcgcctaggagcaagaggctataccatatagcctgggtatgcagtaggctatataccatctaggtttgtgtaagtacatacattctatgacatttgcacaatatcatgtaaaacaaatttctcagaacatatcccctgttgttaagcaatgcatgactgtatatattgggtctctgcccctggttcttggcccacagctccttgtaatctc

SEQ ID NO: 268750 - DNA, 395 bp, Homo sapiens
agtttggagaattgaaatgtatatctcctttggcataatgagccttggcttactttccctcctggcagtcacttctatcccttcagtgagcaatgctttaaactggagagaattcagttttattcaggtatgtggggttttgtttggtgaaggattgtgcaggataggatttccttgttaagaacaactgcattttaaatatgttccttattaaaagggtgcctttgaggctgtatttatgcatctagatacattatgctggaagccagcttaggattgctctggttaaataagtgaaagaccagtcagtatatgattgtactggaagactttgacagcactgccttccagtatactatgttaagaacaaaaaagttatcttaaaagagaaaaaa

SEQ ID NO: 268751 - DNA, 509 bp, Homo sapiens
taatggcagttagtgagggaggggatataacaaggtgtctgacctcccatcccatcatggctggaaactcagttttcaaggtttctttggggtccccttggccaagagggggggtccattaagtcagctggatgacttagaattttatttttatttctcaattgtaatggtaaatgaaattttaggagactttggggtttttttggaagaaggattgaagagtaagaaattaaaacagggtgactggttagacagaaatgcagaagtcacaagaagtgataactattgttacaagtagcaacaatgagatgaatgaatgaatgggaaggaaaccttaacttttttggaaaaacaagaaaggcatagaattagaaaagtgtgacgtcaaggaattcaaaagaggaaagaattttgtagaggagtgggacagaatagcagagtttaagcccaggtttggcattgtaggggccaagagaaaacagaccctttgcccatgaaggttcactaaa

SEQ ID NO: 268752 - DNA, 513 bp, Homo sapiens
gcagtgagccaagatcgcaccactgcacttcagcctgggcgacaagaacaaaactccatctcaaaaaaagaaacacgtcactctgtaggcgagtcctgacctcccgttcctgactccgccccagccttgcccacacacccatctgtggggaccatgcctcactgtgcccttttctctctcccttcccttggcagtccaaggagtcgtcctcagtcctgagttgtgacatctccagaaataacaaatacatcgtgacaggctcgggggacaagaaggccaccgtgtatgaggtggtctactgagacatgaccccccttcctgtacccgaagtccagactcccaggggaatcagcagccaggacagacatcctagcagccgcctcccagccctgcctaggaaccgtacatcccatctgctctctggccaacggcttcacaccttcccctgctgcatgtgggggccgatgggcaggggacctcggtggaaataaaatgtatctatcacaaacgcac

SEQ ID NO: 268753 - DNA, 763 bp, Homo sapiens
gcggccgcctggccgtctggtccgtctgctccggaggccgtgacggccagactcgttggtgtcctgtggttcgtctcagtcactacaggaccctggggggctgttgccacctccgccgggggcgaggagtcgcttaagtgcgaggacctcaaagtgggacaatatcctctgtggagaacacccccccatggaggcgaggtagagttggggtcgcagattttctccctgggccactgccctaaccaggactggctggcggtcggaatggagagtagcaacgtggagatcctgcacgtccgcaagccggagaaataccagctgcacctccacgagagctgcgtgctgtccctgaagtttgcctcctgcggacggtggtttgtgagcaccgggaaggacaacctgctcaacgcctggaggacgccgtacggggccagcattttccagtccaaggagtcgtcctcagtcctgagttgtgacatctccagaaataacaaatacatcgtgacaggctcgggggacaagaaggccaccgtgtatgaggtggtctactgagacatgaccccccttcctgtacccgaagtccagactcccaggggaatcagcagccaggacagacatcctagcagccgcctcccagccctgcctaggaaccgtacatcccatctgctctctggccaacggcttcacaccttcccctgctgcatgtgggggccgatgggcaggggacctcggtggaaataaaatgtatctatcacaaacgcac

SEQ ID NO: 268754 - DNA, 412 bp, Homo sapiens
acccgccagcatcagcagcaggtggaagggatcaggtagagggtacattgagcccctgctcatgctagcggtgcccttggggacctgatcccttccacccgccagcatcagcagcaggtgctccaggccgtagaacgcgccaagcaggtcaccgtgggggagctgaacagcctcatcggggtgagtctctctagcccctgccccgccatggggagacgcccactcccaggtccctggcacccacccaggaggtgttaaagctggggtggtgtgtgggccttggctccagtggtcctgggaaccccaggggcacatgctgtgcttaggtcccatcccctgtgtctacctcttgggctggggaccgctgggctcctgccgccccccgccccggcccatcctgcctcctttctag

SEQ ID NO: 268755 - DNA, 2719 bp, Homo sapiens
gcggccgccctcgccgcgctcccgccccggccgctgcccctgcccgccccgctcgccccgcgcaccccaacccggggaggggctcccacgaccccgggcgcgcgcgcttgggggcgcgccagggactccagggtcccttgccccgcgccgcttctccctcctccctctttcttcgggcagcctccccaccaccccacttcagcctcccccactcttgccgcctccatatcatcaagctctggtggcgcctggggggcttttcggatcggcaggatgtacccccagggaaggcacccgaccccgctccagtccggccagcccttcaagttctcgatcttggagatctgcgaccgcatcaaagaagaattccagtttcttcaggctcaataccacagcctcaagctagaatgtgagaagctggccagcgagaagacggaaatgcagcgacattatgtcatgtattatgagatgtcgtacgggctcaacattgaaatgcataagcaggcggagattgtgaagcgtctgagcggtatctgcgctcagattatccccttcctgacccaggagcatcagcagcaggtgctccaggccgtagaacgcgccaagcaggtcaccgtgggggagctgaacagcctcatcgggcagcagcagctccagccgctgtcccaccacgcaccccctgtgcccctcaccccccgcccagccgggctggtgggcggcagtgctacggggctgcttgctctgtctggagccctggctgcccaggctcagctggcggcggctgtcaaggaggaccgtgcgggcgtggaggccgaggggtccagagtggagagagccccgagcaggagtgcatctccctcgccccctgagagtctcgtggaggaggagcgaccgagtggccctggtggtggcgggaagcagagagcagatgagaaggagccatcaggaccttatgaaagcgacgaagacaagagtgattacaatctggtggtggacgaggaccaaccctcagagccccccagcccggctaccaccccctgcggaaaggtacccatctgcattcctgcccgtcgggacctggtggacagtccagcctccttggcctctagccttggctcaccgctgcctagagccaaggagctcatcctgaatgaccttcccgccagcactcctgcctccaaatcctgtgactcctccccgccccaggacgcttccacccccgggcccagctcggccagtcacctctgccagcttgctgccaagccagcaccttccacggacagcgtcgccctgaggagccccctgactctgtccagtcccttcaccacgtccttcagcctgggctcccacagcactctcaacggagacctctccgtgcccagctcctacgtcagcctccacctgtccccccaggtcagcagctctgtggtgtacggacgctcccccgtgatggcatttgagtctcatccccatctccgagggtcatccgtctcttcctccctacccagcatccctgggggaaagccggcctactccttccacgtgtctgcggacgggcagatgcagccggttcccttcccctcggatgcactggtaggcgcgggcatcccgcggcacgcccggcagctgcacacgctggcccatggcgaggtggtctgcgcggtcaccatcagcggctccacacagcatgtgtacacgggcggcaagggctgtgtgaaggtgtgggacgtgggccagcctggggccaagacgcccgtggcccagctcgactgcctgaaccgagacaactacattcgttcctgcaagttgctgccggatggccggagtctgatcgtgggcggtgaggccagcaccttgtccatttgggacctggcggcgcccaccccccgtatcaaggccgagctgacttcctcagccccagcctgctacgccctggccgtcagccccgacgccaaggtttgcttctcctgctgcagcgatggcaacattgtggtctgggacctgcagaatcagactatggtcaggcagttccagggccacacggacggcgccagctgcattgatatttccgattacggcactcggctctggacagggggcctggacaacacggtgcgctgctgggacctgcgggagggccgccagctgcagcagcatgacttcagctcccagattttctccctgggccactgccctaaccaggactggctggcggtcggaatggagagtagcaacgtggagatcctgcacgtccgcaagccggagaaataccagctgcacctccacgagagctgcgtgctgtccctgaagtttgcctcctgcggacggtggtttgtgagcaccgggaaggacaacctgctcaacgcctggaggacgccgtacggggccagcattttccagtccaaggagtcgtcctcagtcctgagttgtgacatctccagaaataacaaatacatcgtgacaggctcgggggacaagaaggccaccgtgtatgaggtggtctactgagacatgaccccccttcctgtacccgaagtccagactcccaggggaatcagcagccaggacagacatcctagcagccgcctcccagccctgcctaggaaccgtacatcccatctgctctctggccaacggcttcacaccttcccctgctgcatgtgggggccgatgggcaggggacctcggtggaaataaaatgtatctatcacaaacgcac

SEQ ID NO: 268756 - DNA, 2606 bp, Homo sapiens
cacatagtctaggtagagctcggggttgaatcggccgcttctccctcctccctctttcttcgggcagcctccccaccaccccacttcagcctcccccactcttgccgcctccatatcatcaagctctggtggcgcctggggggcttttcggatcggcaggatgtacccccagggaaggcacccgaccccgctccagtccggccagcccttcaagttctcgatcttggagatctgcgaccgcatcaaagaagaattccagtttcttcaggctcaataccacagcctcaagctagaatgtgagaagctggccagcgagaagacggaaatgcagcgacattatgtcatgtattatgagatgtcgtacgggctcaacattgaaatgcataagcaggcggagattgtgaagcgtctgagcggtatctgcgctcagattatccccttcctgacccaggagcatcagcagcaggtgctccaggccgtagaacgcgccaagcaggtcaccgtgggggagctgaacagcctcatcgggcagcagcagctccagccgctgtcccaccacgcaccccctgtgcccctcaccccccgcccagccgggctggtgggcggcagtgctacggggctgcttgctctgtctggagccctggctgcccaggctcagctggcggcggctgtcaaggaggaccgtgcgggcgtggaggccgaggggtccagagtggagagagccccgagcaggagtgcatctccctcgccccctgagagtctcgtggaggaggagcgaccgagtggccctggtggtggcgggaagcagagagcagatgagaaggagccatcaggaccttatgaaagcgacgaagacaagagtgattacaatctggtggtggacgaggaccaaccctcagagccccccagcccggctaccaccccctgcggaaaggtacccatctgcattcctgcccgtcgggacctggtggacagtccagcctccttggcctctagccttggctcaccgctgcctagagccaaggagctcatcctgaatgaccttcccgccagcactcctgcctccaaatcctgtgactcctccccgccccaggacgcttccacccccgggcccagctcggccagtcacctctgccagcttgctgccaagccagcaccttccacggacagcgtcgccctgaggagccccctgactctgtccagtcccttcaccacgtccttcagcctgggctcccacagcactctcaacggagacctctccgtgcccagctcctacgtcagcctccacctgtccccccaggtcagcagctctgtggtgtacggacgctcccccgtgatggcatttgagtctcatccccatctccgagggtcatccgtctcttcctccctacccagcatccctgggggaaagccggcctactccttccacgtgtctgcggacgggcagatgcagccggttcccttcccctcggatgcactggtaggcgcgggcatcccgcggcacgcccggcagctgcacacgctggcccatggcgaggtggtctgcgcggtcaccatcagcggctccacacagcatgtgtacacgggcggcaagggctgtgtgaaggtgtgggacgtgggccagcctggggccaagacgcccgtggcccagctcgactgcctgaaccgagacaactacattcgttcctgcaagttgctgccggatggccggagtctgatcgtgggcggtgaggccagcaccttgtccatttgggacctggcggcgcccaccccccgtatcaaggccgagctgacttcctcagccccagcctgctacgccctggccgtcagccccgacgccaaggtttgcttctcctgctgcagcgatggcaacattgtggtctgggacctgcagaatcagactatggtcaggcagttccagggccacacggacggcgccagctgcattgatatttccgattacggcactcggctctggacagggggcctggacaacacggtgcgctgctgggacctgcgggagggccgccagctgcagcagcatgacttcagctcccagattttctccctgggccactgccctaaccaggactggctggcggtcggaatggagagtagcaacgtggagatcctgcacgtccgcaagccggagaaataccagctgcacctccacgagagctgcgtgctgtccctgaagtttgcctcctgcggacggtggtttgtgagcaccgggaaggacaacctgctcaacgcctggaggacgccgtacggggccagcattttccagtccaaggagtcgtcctcagtcctgagttgtgacatctccagaaataacaaatacatcgtgacaggctcgggggacaagaaggccaccgtgtatgaggtggtctactgagacatgaccccccttcctgtacccgaagtccagactcccaggggaatcagcagccaggacagacatcctagcagccgcctcccagccctgcctaggaaccgtacatcccatctgctctctggccaacggcttcacaccttcccctgctgcatgtgggggccgatgggcaggggacctcggtggaaataaaatgtatctatcacaaacgcac

SEQ ID NO: 268757 - DNA, 2683 bp, Homo sapiens
gcggccgccctcgccgcgctcccgccccggccgctgcccctgcccgccccgctcgccccgcgcaccccaacccggggaggggctcccacgaccccgggcgcgcgcgcttgggggcgcgccagggactccagggtcccttgccccgcgccgcttctccctcctccctctttcttcgggcagcctccccaccaccccacttcagcctcccccactcttgccgcctccatatcatcaagctctggtggcgcctggggggcttttcggatcggcaggatgtacccccagggaaggcacccgaccccgctccagtccggccagcccttcaagttctcgatcttggagatctgcgaccgcatcaaagaagaattccagtttcttcaggctcaataccacagcctcaagctagaatgtgagaagctggccagcgagaagacggaaatgcagcgacattatgtcatgtattatgagatgtcgtacgggctcaacattgaaatgcataagcaggcggagattgtgaagcgtctgagcggtatctgcgctcagattatccccttcctgacccaggagcatcagcagcaggtgctccaggccgtagaacgcgccaagcaggtcaccgtgggggagctgaacagcctcatcgggcagcagcagctccagccgctgtcccaccacgcaccccctgtgcccctcaccccccgcccagccgggctggtgggcggcagtgctacggggctgcttgctctgtctggagccctggctgcccaggctcagctggcggcggctgtcaaggaggaccgtgcgggcgtggaggccgaggggtccagagtggagagagccccgagcaggagtgcatctccctcgccccctgagagtctcgtggaggaggagcgaccgagtggccctggtggtggcgggaagcagagagcagatgagaaggagccatcaggaccttatgaaagcgacgaagacaagagtgattacaatctggtggtggacgaggaccaaccctcagagccccccagcccggctaccaccccctgcggaaaggtacccatctgcattcctgcccgtcgggacctggtggacagtccagcctccttggcctctagccttggctcaccgctgcctagagccaaggagctcatcctgaatgaccttcccgccagcactcctgcctccaaatcctgtgactcctccccgccccaggacgcttccacccccgggcccagctcggccagtcacctctgccagcttgctgccaagccagcaccttccacggacagcgtcgccctgaggagccccctgactctgtccagtcccttcaccacgtccttcagcctgggctcccacagcactctcaacggagacctctccgtgcccagctcctacgtcagcctccacctgtccccccagatggcatttgagtctcatccccatctccgagggtcatccgtctcttcctccctacccagcatccctgggggaaagccggcctactccttccacgtgtctgcggacgggcagatgcagccggttcccttcccctcggatgcactggtaggcgcgggcatcccgcggcacgcccggcagctgcacacgctggcccatggcgaggtggtctgcgcggtcaccatcagcggctccacacagcatgtgtacacgggcggcaagggctgtgtgaaggtgtgggacgtgggccagcctggggccaagacgcccgtggcccagctcgactgcctgaaccgagacaactacattcgttcctgcaagttgctgccggatggccggagtctgatcgtgggcggtgaggccagcaccttgtccatttgggacctggcggcgcccaccccccgtatcaaggccgagctgacttcctcagccccagcctgctacgccctggccgtcagccccgacgccaaggtttgcttctcctgctgcagcgatggcaacattgtggtctgggacctgcagaatcagactatggtcaggcagttccagggccacacggacggcgccagctgcattgatatttccgattacggcactcggctctggacagggggcctggacaacacggtgcgctgctgggacctgcgggagggccgccagctgcagcagcatgacttcagctcccagattttctccctgggccactgccctaaccaggactggctggcggtcggaatggagagtagcaacgtggagatcctgcacgtccgcaagccggagaaataccagctgcacctccacgagagctgcgtgctgtccctgaagtttgcctcctgcggacggtggtttgtgagcaccgggaaggacaacctgctcaacgcctggaggacgccgtacggggccagcattttccagtccaaggagtcgtcctcagtcctgagttgtgacatctccagaaataacaaatacatcgtgacaggctcgggggacaagaaggccaccgtgtatgaggtggtctactgagacatgaccccccttcctgtacccgaagtccagactcccaggggaatcagcagccaggacagacatcctagcagccgcctcccagccctgcctaggaaccgtacatcccatctgctctctggccaacggcttcacaccttcccctgctgcatgtgggggccgatgggcaggggacctcggtggaaataaaatgtatctatcacaaacgcac

SEQ ID NO: 268758 - DNA, 2626 bp, Homo sapiens
gcggccgccctcgccgcgctcccgccccggccgctgcccctgcccgccccgctcgccccgcgcaccccaacccggggaggggctcccacgaccccgggcgcgcgcgcttgggggcgcgccagggactccagggtcccttgccccgcgccgcttctccctcctccctctttcttcgggcagcctccccaccaccccacttcagcctcccccactcttgccgcctccatatcatcaagctctggtggcgcctggggggcttttcggatcggcaggatgtacccccagggaaggcacccgaccccgctccagtccggccagcccttcaagttctcgatcttggagatctgcgaccgcatcaaagaagaattccagtttcttcaggctcaataccacagcctcaagctagaatgtgagaagctggccagcgagaagacggaaatgcagcgacattatgtcatgtattatgagatgtcgtacgggctcaacattgaaatgcataagcaggcggagattgtgaagcgtctgagcggtatctgcgctcagattatccccttcctgacccaggagcatcagcagcaggtgctccaggccgtagaacgcgccaagcaggtcaccgtgggggagctgaacagcctcatcgggcagcagcagctccagccgctgtcccaccacgcaccccctgtgcccctcaccccccgcccagccgggctggtgggcggcagtgctacggggctgcttgctctgtctggagccctggctgcccaggctcagctggcggcggctgtcaaggaggaccgtgcgggcgtggaggccgaggggtccagagtggagagagccccgagcaggagtgcatctccctcgccccctgagagtctcgtggaggaggagcgaccgagtggccctggtggtggcgggaagcagagagcagatgagaaggagccatcaggaccttatgaaagcgacgaagacaagagtgattacaatctggtggtggacgaggaccaaccctcagagccccccagcccggctaccaccccctgcggaaaggtacccatctgcattcctgcccgtcgggacctggtggacagtccagcctccttggcctctagccttggctcaccgctgcctagagccaaggagctcatcctgaatgaccttcccgccagcactcctgcctccaaatcctgtgactcctccccgccccaggacgcttccacccccgggcccagctcggccagtcacctctgccagcttgctgccaagccagcaccttccacggacagcgtcgccctgaggagccccctgactctgtccagtcccttcaccacgtccttcagcctgggctcccacagcactctcaacggagacctctccgtgcccagctcctacgtcagcctccacctgtccccccagatggcatttgagtctcatccccatctccgagggtcatccgtctcttcctccctacccagcatccctgggggaaagccggcctactccttccacgtgtctgcggacgggcagatgcagccggttcccttcccctcggatgcactggtaggcgcgggcatcccgcggcacgcccggcagctgcacacgctggcccatggcgaggtggtctgcgcggtcaccatcagcggctccacacagcatgtgtacacgggcggcaagggctgtgtgaagaaccgagacaactacattcgttcctgcaagttgctgccggatggccggagtctgatcgtgggcggtgaggccagcaccttgtccatttgggacctggcggcgcccaccccccgtatcaaggccgagctgacttcctcagccccagcctgctacgccctggccgtcagccccgacgccaaggtttgcttctcctgctgcagcgatggcaacattgtggtctgggacctgcagaatcagactatggtcaggcagttccagggccacacggacggcgccagctgcattgatatttccgattacggcactcggctctggacagggggcctggacaacacggtgcgctgctgggacctgcgggagggccgccagctgcagcagcatgacttcagctcccagattttctccctgggccactgccctaaccaggactggctggcggtcggaatggagagtagcaacgtggagatcctgcacgtccgcaagccggagaaataccagctgcacctccacgagagctgcgtgctgtccctgaagtttgcctcctgcggacggtggtttgtgagcaccgggaaggacaacctgctcaacgcctggaggacgccgtacggggccagcattttccagtccaaggagtcgtcctcagtcctgagttgtgacatctccagaaataacaaatacatcgtgacaggctcgggggacaagaaggccaccgtgtatgaggtggtctactgagacatgaccccccttcctgtacccgaagtccagactcccaggggaatcagcagccaggacagacatcctagcagccgcctcccagccctgcctaggaaccgtacatcccatctgctctctggccaacggcttcacaccttcccctgctgcatgtgggggccgatgggcaggggacctcggtggaaataaaatgtatctatcacaaacgcac

SEQ ID NO: 268759 - DNA, 2173 bp, Homo sapiens
gtagggggcccctggagtctgcatcagcagcaggtgctccaggccgtagaacgcgccaagcaggtcaccgtgggggagctgaacagcctcatcgggcagcagcagctccagccgctgtcccaccacgcaccccctgtgcccctcaccccccgcccagccgggctggtgggcggcagtgctacggggctgcttgctctgtctggagccctggctgcccaggctcagctggcggcggctgtcaaggaggaccgtgcgggcgtggaggccgaggggtccagagtggagagagccccgagcaggagtgcatctccctcgccccctgagagtctcgtggaggaggagcgaccgagtggccctggtggtggcgggaagcagagagcagatgagaaggagccatcaggaccttatgaaagcgacgaagacaagagtgattacaatctggtggtggacgaggaccaaccctcagagccccccagcccggctaccaccccctgcggaaaggtacccatctgcattcctgcccgtcgggacctggtggacagtccagcctccttggcctctagccttggctcaccgctgcctagagccaaggagctcatcctgaatgaccttcccgccagcactcctgcctccaaatcctgtgactcctccccgccccaggacgcttccacccccgggcccagctcggccagtcacctctgccagcttgctgccaagccagcaccttccacggacagcgtcgccctgaggagccccctgactctgtccagtcccttcaccacgtccttcagcctgggctcccacagcactctcaacggagacctctccgtgcccagctcctacgtcagcctccacctgtccccccaggtcagcagctctgtggtgtacggacgctcccccgtgatggcatttgagtctcatccccatctccgagggtcatccgtctcttcctccctacccagcatccctgggggaaagccggcctactccttccacgtgtctgcggacgggcagatgcagccggttcccttcccctcggatgcactggtaggcgcgggcatcccgcggcacgcccggcagctgcacacgctggcccatggcgaggtggtctgcgcggtcaccatcagcggctccacacagcatgtgtacacgggcggcaagggctgtgtgaaggtgtgggacgtgggccagcctggggccaagacgcccgtggcccagctcgactgcctgaaccgagacaactacattcgttcctgcaagttgctgccggatggccggagtctgatcgtgggcggtgaggccagcaccttgtccatttgggacctggcggcgcccaccccccgtatcaaggccgagctgacttcctcagccccagcctgctacgccctggccgtcagccccgacgccaaggtttgcttctcctgctgcagcgatggcaacattgtggtctgggacctgcagaatcagactatggtcaggcagttccagggccacacggacggcgccagctgcattgatatttccgattacggcactcggctctggacagggggcctggacaacacggtgcgctgctgggacctgcgggagggccgccagctgcagcagcatgacttcagctcccagattttctccctgggccactgccctaaccaggactggctggcggtcggaatggagagtagcaacgtggagatcctgcacgtccgcaagccggagaaataccagctgcacctccacgagagctgcgtgctgtccctgaagtttgcctcctgcggacggtggtttgtgagcaccgggaaggacaacctgctcaacgcctggaggacgccgtacggggccagcattttccagtccaaggagtcgtcctcagtcctgagttgtgacatctccagaaataacaaatacatcgtgacaggctcgggggacaagaaggccaccgtgtatgaggtggtctactgagacatgaccccccttcctgtacccgaagtccagactcccaggggaatcagcagccaggacagacatcctagcagccgcctcccagccctgcctaggaaccgtacatcccatctgctctctggccaacggcttcacaccttcccctgctgcatgtgggggccgatgggcaggggacctcggtggaaataaaatgtatctatcacaaacgcac

SEQ ID NO: 268760 - DNA, 2700 bp, Homo sapiens
gcggccgccctcgccgcgctcccgccccggccgctgcccctgcccgccccgctcgccccgcgcaccccaacccggggaggggctcccacgaccccgggcgcgcgcgcttgggggcgcgccagggactccagggtcccttgccccgcgccgcttctccctcctccctctttcttcgggcagcctccccaccaccccacttcagcctcccccactcttgccgcctccatatcatcaagctctggtggcgcctggggggcttttcggatcggcaggatgtacccccagggaaggcacccgaccccgctccagtccggccagcccttcaagttctcgatcttggagatctgcgaccgcatcaaagaagaattccagtttcttcaggctcaataccacagcctcaagctagaatgtgagaagctggccagcgagaagacggaaatgcagcgacattatgtcatgtattatgagatgtcgtacgggctcaacattgaaatgcataagcaggcggagattgtgaagcgtctgagcggtatctgcgctcagattatccccttcctgacccaggagcatcagcagcaggtgctccaggccgtagaacgcgccaagcaggtcaccgtgggggagctgaacagcctcatcgggcagcagcagctccagccgctgtcccaccacgcaccccctgtgcccctcaccccccgcccagccgggctggtgggcggcagtgctacggggctgcttgctctgtctggagccctggctgcccaggctcagctggcggcggctgtcaaggaggaccgtgcgggcgtggaggccgaggggtccagagtggagagagccccgagcaggagtgcatctccctcgccccctgagagtctcgtggaggaggagcgaccgagtggccctggtggtggcgggaagcagagagcagatgagaaggagccatcaggaccttatgaaagcgacgaagacaagagtgattacaatctggtggtggacgaggaccaaccctcagagccccccagcccggctaccaccccctgcggaaaggtacccatctgcattcctgcccgtcgggacctggtggacagtccagcctccttggcctctagccttggctcaccgctgcctagagccaaggagctcatcctgaatgaccttcccgccagcactcctgcctccaaatcctgtgactcctccccgccccaggacgcttccacccccgggcccagcagcttgctgccaagccagcaccttccacggacagcgtcgccctgaggagccccctgactctgtccagtcccttcaccacgtccttcagcctgggctcccacagcactctcaacggagacctctccgtgcccagctcctacgtcagcctccacctgtccccccaggtcagcagctctgtggtgtacggacgctcccccgtgatggcatttgagtctcatccccatctccgagggtcatccgtctcttcctccctacccagcatccctgggggaaagccggcctactccttccacgtgtctgcggacgggcagatgcagccggttcccttcccctcggatgcactggtaggcgcgggcatcccgcggcacgcccggcagctgcacacgctggcccatggcgaggtggtctgcgcggtcaccatcagcggctccacacagcatgtgtacacgggcggcaagggctgtgtgaaggtgtgggacgtgggccagcctggggccaagacgcccgtggcccagctcgactgcctgaaccgagacaactacattcgttcctgcaagttgctgccggatggccggagtctgatcgtgggcggtgaggccagcaccttgtccatttgggacctggcggcgcccaccccccgtatcaaggccgagctgacttcctcagccccagcctgctacgccctggccgtcagccccgacgccaaggtttgcttctcctgctgcagcgatggcaacattgtggtctgggacctgcagaatcagactatggtcaggcagttccagggccacacggacggcgccagctgcattgatatttccgattacggcactcggctctggacagggggcctggacaacacggtgcgctgctgggacctgcgggagggccgccagctgcagcagcatgacttcagctcccagattttctccctgggccactgccctaaccaggactggctggcggtcggaatggagagtagcaacgtggagatcctgcacgtccgcaagccggagaaataccagctgcacctccacgagagctgcgtgctgtccctgaagtttgcctcctgcggacggtggtttgtgagcaccgggaaggacaacctgctcaacgcctggaggacgccgtacggggccagcattttccagtccaaggagtcgtcctcagtcctgagttgtgacatctccagaaataacaaatacatcgtgacaggctcgggggacaagaaggccaccgtgtatgaggtggtctactgagacatgaccccccttcctgtacccgaagtccagactcccaggggaatcagcagccaggacagacatcctagcagccgcctcccagccctgcctaggaaccgtacatcccatctgctctctggccaacggcttcacaccttcccctgctgcatgtgggggccgatgggcaggggacctcggtggaaataaaatgtatctatcacaaacgcac

SEQ ID NO: 268761 - DNA, 2264 bp, Homo sapiens
cacatagtctaggtagagctcggggttgaatcggccgcttctccctcctccctctttcttcgggcagcctccccaccaccccacttcagcctcccccactcttgccgcctccatatcatcaagctctggtggcgcctggggggcttttcggatcggcaggatgtacccccagggaaggcacccgaccccgctccagtccggccagcccttcaagttctcgatcttggagatctgcgaccgcatcaaagaagaattccagtttcttcaggctcaataccacagcctcaagctagaatgtgagaagctggccagcgagaagacggaaatgcagcgacattatgtcatgtattatgagatgtcgtacgggctcaacattgaaatgcataagcagagtgcatctccctcgccccctgagagtctcgtggaggaggagcgaccgagtggccctggtggtggcgggaagcagagagcagatgagaaggagccatcaggaccttatgaaagcgacgaagacaagagtgattacaatctggtggtggacgaggaccaaccctcagagccccccagcccggctaccaccccctgcggaaaggtacccatctgcattcctgcccgtcgggacctggtggacagtccagcctccttggcctctagccttggctcaccgctgcctagagccaaggagctcatcctgaatgaccttcccgccagcactcctgcctccaaatcctgtgactcctccccgccccaggacgcttccacccccgggcccagctcggccagtcacctctgccagcttgctgccaagccagcaccttccacggacagcgtcgccctgaggagccccctgactctgtccagtcccttcaccacgtccttcagcctgggctcccacagcactctcaacggagacctctccgtgcccagctcctacgtcagcctccacctgtccccccaggtcagcagctctgtggtgtacggacgctcccccgtgatggcatttgagtctcatccccatctccgagggtcatccgtctcttcctccctacccagcatccctgggggaaagccggcctactccttccacgtgtctgcggacgggcagatgcagccggttcccttcccctcggatgcactggtaggcgcgggcatcccgcggcacgcccggcagctgcacacgctggcccatggcgaggtggtctgcgcggtcaccatcagcggctccacacagcatgtgtacacgggcggcaagggctgtgtgaaggtgtgggacgtgggccagcctggggccaagacgcccgtggcccagctcgactgcctgaaccgagacaactacattcgttcctgcaagttgctgccggatggccggagtctgatcgtgggcggtgaggccagcaccttgtccatttgggacctggcggcgcccaccccccgtatcaaggccgagctgacttcctcagccccagcctgctacgccctggccgtcagccccgacgccaaggtttgcttctcctgctgcagcgatggcaacattgtggtctgggacctgcagaatcagactatggtcaggcagttccagggccacacggacggcgccagctgcattgatatttccgattacggcactcggctctggacagggggcctggacaacacggtgcgctgctgggacctgcgggagggccgccagctgcagcagcatgacttcagctcccagattttctccctgggccactgccctaaccaggactggctggcggtcggaatggagagtagcaacgtggagatcctgcacgtccgcaagccggagaaataccagctgcacctccacgagagctgcgtgctgtccctgaagtttgcctcctgcggacggtggtttgtgagcaccgggaaggacaacctgctcaacgcctggaggacgccgtacggggccagcattttccagtccaaggagtcgtcctcagtcctgagttgtgacatctccagaaataacaaatacatcgtgacaggctcgggggacaagaaggccaccgtgtatgaggtggtctactgagacatgaccccccttcctgtacccgaagtccagactcccaggggaatcagcagccaggacagacatcctagcagccgcctcccagccctgcctaggaaccgtacatcccatctgctctctggccaacggcttcacaccttcccctgctgcatgtgggggccgatgggcaggggacctcggtggaaataaaatgtatctatcacaaacgcac

SEQ ID NO: 268762 - DNA, 1948 bp, Homo sapiens
gcggccgccctcgccgcgctcccgccccggccgctgcccctgcccgccccgctcgccccgcgcaccccaacccggggaggggctcccacgaccccgggcgcgcgcgcttgggggcgcgccagggactccagggtcccttgccccgcgccgcttctccctcctccctctttcttcgggcagcctccccaccaccccacttcagcctcccccactcttgccgcctccatatcatcaagctctggtggcgcctggggggcttttcggatcggcaggatgtacccccagggaaggcacccgaccccgctccagtccggccagcccttcaagttctcgatcttggagatctgcgaccgcatcaaagaagaattccagtttcttcaggctcaataccacagcctcaagctagaatgtgagaagctggccagcgagaagacggaaatgcagcgacattatgtcatgtattatgagatgtcgtacgggctcaacattgaaatgcataagcaggcggagattgtgaagcgtctgagcggtatctgcgctcagattatccccttcctgacccaggagcatcagcagcaggtgctccaggccgtagaacgcgccaagcaggtcaccgtgggggagctgaacagcctcatcggggtcagcagctctgtggtgtacggacgctcccccgtgatggcatttgagtctcatccccatctccgagggtcatccgtctcttcctccctacccagcatccctgggggaaagccggcctactccttccacgtgtctgcggacgggcagatgcagccggttcccttcccctcggatgcactggtaggcgcgggcatcccgcggcacgcccggcagctgcacacgctggcccatggcgaggtggtctgcgcggtcaccatcagcggctccacacagcatgtgtacacgggcggcaagggctgtgtgaaggtgtgggacgtgggccagcctggggccaagacgcccgtggcccagctcgactgcctgaaccgagacaactacattcgttcctgcaagttgctgccggatggccggagtctgatcgtgggcggtgaggccagcaccttgtccatttgggacctggcggcgcccaccccccgtatcaaggccgagctgacttcctcagccccagcctgctacgccctggccgtcagccccgacgccaaggtttgcttctcctgctgcagcgatggcaacattgtggtctgggacctgcagaatcagactatggtcaggcagttccagggccacacggacggcgccagctgcattgatatttccgattacggcactcggctctggacagggggcctggacaacacggtgcgctgctgggacctgcgggagggccgccagctgcagcagcatgacttcagctcccagattttctccctgggccactgccctaaccaggactggctggcggtcggaatggagagtagcaacgtggagatcctgcacgtccgcaagccggagaaataccagctgcacctccacgagagctgcgtgctgtccctgaagtttgcctcctgcggacggtggtttgtgagcaccgggaaggacaacctgctcaacgcctggaggacgccgtacggggccagcattttccagtccaaggagtcgtcctcagtcctgagttgtgacatctccagaaataacaaatacatcgtgacaggctcgggggacaagaaggccaccgtgtatgaggtggtctactgagacatgaccccccttcctgtacccgaagtccagactcccaggggaatcagcagccaggacagacatcctagcagccgcctcccagccctgcctaggaaccgtacatcccatctgctctctggccaacggcttcacaccttcccctgctgcatgtgggggccgatgggcaggggacctcggtggaaataaaatgtatctatcacaaacgcac

SEQ ID NO: 268763 - DNA, 1846 bp, Homo sapiens
tgagacatgaccccccttcctgtacccgaagtccagactcccaggggaatcagcagccgggacagacatcctagcagccgcctcccagccctgcctaggaaccgtacatcccatctgctctcgtggccaacggcttcacaccttcccctcccggctaccaccccctgcggaaaggtacccatctgcattcctgcccgtcgggacctggtggacagtccagcctccttggcctctagccttggctcaccgctgcctagagccaaggagctcatcctgaatgaccttcccgccagcactcctgcctccaaatcctgtgactcctccccgccccaggacgcttccacccccgggcccagctcggccagtcacctctgccagcttgctgccaagccagcaccttccacggacagcgtcgccctgaggagccccctgactctgtccagtcccttcaccacgtccttcagcctgggctcccacagcactctcaacggagacctctccgtgcccagctcctacgtcagcctccacctgtccccccaggtcagcagctctgtggtgtacggacgctcccccgtgatggcatttgagtctcatccccatctccgagggtcatccgtctcttcctccctacccagcatccctgggggaaagccggcctactccttccacgtgtctgcggacgggcagatgcagccggttcccttcccctcggatgcactggtaggcgcgggcatcccgcggcacgcccggcagctgcacacgctggcccatggcgaggtggtctgcgcggtcaccatcagcggctccacacagcatgtgtacacgggcggcaagggctgtgtgaaggtgtgggacgtgggccagcctggggccaagacgcccgtggcccagctcgactgcctgaaccgagacaactacattcgttcctgcaagttgctgccggatggccggagtctgatcgtgggcggtgaggccagcaccttgtccatttgggacctggcggcgcccaccccccgtatcaaggccgagctgacttcctcagccccagcctgctacgccctggccgtcagccccgacgccaaggtttgcttctcctgctgcagcgatggcaacattgtggtctgggacctgcagaatcagactatggtcaggcagttccagggccacacggacggcgccagctgcattgatatttccgattacggcactcggctctggacagggggcctggacaacacggtgcgctgctgggacctgcgggagggccgccagctgcagcagcatgacttcagctcccagattttctccctgggccactgccctaaccaggactggctggcggtcggaatggagagtagcaacgtggagatcctgcacgtccgcaagccggagaaataccagctgcacctccacgagagctgcgtgctgtccctgaagtttgcctcctgcggacggtggtttgtgagcaccgggaaggacaacctgctcaacgcctggaggacgccgtacggggccagcattttccagtccaaggagtcgtcctcagtcctgagttgtgacatctccagaaataacaaatacatcgtgacaggctcgggggacaagaaggccaccgtgtatgaggtggtctactgagacatgaccccccttcctgtacccgaagtccagactcccaggggaatcagcagccaggacagacatcctagcagccgcctcccagccctgcctaggaaccgtacatcccatctgctctctggccaacggcttcacaccttcccctgctgcatgtgggggccgatgggcaggggacctcggtggaaataaaatgtatctatcacaaacgcac

SEQ ID NO: 268764 - DNA, 2642 bp, Homo sapiens
gcggccgccctcgccgcgctcccgccccggccgctgcccctgcccgccccgctcgccccgcgcaccccaacccggggaggggctcccacgaccccgggcgcgcgcgcttgggggcgcgccagggactccagggtcccttgccccgcgccgcttctccctcctccctctttcttcgggcagcctccccaccaccccacttcagcctcccccactcttgccgcctccatatcatcaagctctggtggcgcctggggggcttttcggatcggcaggatgtacccccagggaaggcacccgaccccgctccagtccggccagcccttcaagttctcgatcttggagatctgcgaccgcatcaaagaagaattccagtttcttcaggctcaataccacagcctcaagctagaatgtgagaagctggccagcgagaagacggaaatgcagcgacattatgtcatgtattatgagatgtcgtacgggctcaacattgaaatgcataagcaggcggagattgtgaagcgtctgagcggtatctgcgctcagattatccccttcctgacccaggagcatcagcagcaggtgctccaggccgtagaacgcgccaagcaggtcaccgtgggggagctgaacagcctcatcgggcagcagcagctccagccgctgtcccaccacgcaccccctgtgcccctcaccccccgcccagccgggctggtgggcggcagtgctacggggctgcttgctctgtctggagccctggctgcccaggctcagctggcggcggctgtcaaggaggaccgtgcgggcgtggaggccgaggggtccagagtggagagagccccgagcaggagtgcatctccctcgccccctgagagtctcgtggaggaggagcgaccgagtggccctggtggtggcgggaagcagagagcagatgagaaggagccatcaggaccttatgaaagcgacgaagacaagagtgattacaatctggtggtggacgaggaccaaccctcagagccccccagcccggctaccaccccctgcggaaaggtacccatctgcattcctgcccgtcgggacctggtggacagtccagcctccttggcctctagccttggctcaccgctgcctagagccaaggagctcatcctgaatgaccttcccgccagcactcctgcctccaaatcctgtgactcctccccgccccaggacgcttccacccccgggcccagctcggccagtcacctctgccagcttgctgccaagccagcaccttccacggacagcgtcgccctgaggagccccctgactctgtccagtcccttcaccacgtccttcagcctgggctcccacagcactctcaacggagacctctccgtgcccagctcctacgtcagcctccacctgtccccccaggtcagcagctctgtggtgtacggacgctcccccgtgatggcatttgagtctcatccccatctccgagggtcatccgtctcttcctccctacccagcatccctgggggaaagccggcctactccttccacgtgtctgcggacgggcagatgcagccggttcccttcccctcggatgcactggtaggcgcgggcatcccgcggcacgcccggcagctgcacacgctggcccatggcgaggtggtctgcgcggtcaccatcagcggctccacacagcatgtgtacacgggcggcaagggctgtgtgaaggtgtgggacgtgggccagcctggggccaagacgcccgtggcccagctcgactgcctgaaccgagacaactacattcgttcctgcaagttgctgccggatggccggagtctgatcgtgggcggtgaggccagcaccttgtccatttgggacctggcggcgcccaccccccgtatcaaggccgagctgacttcctcagccccagcctgctacgccctggccgtcagccccgacgccaaggtttgcttctcctgctgcagcgatggcaacattgtggtctgggacctgcagaatcagactatggtcaggcagttccagggccacacggacggcgccagctgcattgatatttccgattacggcactcggctctggacagggggcctggacaacacggtgcgctgctgggacctgcgggagggccgccagctgcagcagcatgacttcagctcccagattttctccctgggccactgccctaaccaggactggctggcggtcggaatggagagtagcaacgtggagatcctgcacgtccgcaagccggagaaataccagctgcacctccacgagagctgcgtgctgtccctgaagtttgcctcctgcgtccaaggagtcgtcctcagtcctgagttgtgacatctccagaaataacaaatacatcgtgacaggctcgggggacaagaaggccaccgtgtatgaggtggtctactgagacatgaccccccttcctgtacccgaagtccagactcccaggggaatcagcagccaggacagacatcctagcagccgcctcccagccctgcctaggaaccgtacatcccatctgctctctggccaacggcttcacaccttcccctgctgcatgtgggggccgatgggcaggggacctcggtggaaataaaatgtatctatcacaaacgcac

SEQ ID NO: 268765 - DNA, 1091 bp, Homo sapiens
  misc_feature (7)..(7): n is a, c, g, or t
  misc_feature (11)..(11): n is a, c, g, or t
ctgaagntcgncttaaaaggattcccggtaagatttccaagaaacgggttccaccaagcatgtgtacacgggcggcaagggctgtgtgaaggtgtgggacgtgggccagcctggggccaagacgcccgtggcccagctcgactgcctgaaccgagacaactacattcgttcctgcaagttgctgccggatggccggagtctgatcgtgggcggtgaggccagcaccttgtccatttgggacctggcggcgcccaccccccgtatcaaggccgagctgacttcctcagccccagcctgctacgccctggccgtcagccccgacgccaaggtttgcttctcctgctgcagcgatggcaacattgtggtctgggacctgcagaatcagactatggtcaggcagttccagggccacacggacggcgccagctgcattgatatttccgattacggcactcggctctggacagggggcctggacaacacggtgcgctgctgggacctgcgggagggccgccagctgcagcagcatgacttcagctcccagattttctccctgggccactgccctaaccaggactggctggcggtcggaatggagagtagcaacgtggagatcctgcacgtccgcaagccggagaaataccagctgcacctccacgagagctgcgtgctgtccctgaagtttgcctcctgcggacggtggtttgtgagcaccgggaaggacaacctgctcaacgcctggaggacgccgtacggggccagcattttccagtccaaggagtcgtcctcagtcctgagttgtgacatctccagaaataacaaatacatcgtgacaggctcgggggacaagaaggccaccgtgtatgaggtggtctactgagacatgaccccccttcctgtacccgaagtccagactcccaggggaatcagcagccaggacagacatcctagcagccgcctcccagccctgcctaggaaccgtacatcccatctgctctctggccaacggcttcacaccttcccctgctgcatgtgggggccgatgggcaggggacctcggtggaaataaaatgtatctatcacaaacgcac

SEQ ID NO: 268766 - DNA, 2264 bp, Homo sapiens
gcggccgccctcgccgcgctcccgccccggccgctgcccctgcccgccccgctcgccccgcgcaccccaacccggggaggggctcccacgaccccgggcgcgcgcgcttgggggcgcgccagggactccagggtcccttgccccgcgccgcttctccctcctccctctttcttcgggcagcctccccaccaccccacttcagcctcccccactcttgccgcctccatatcatcaagctctggtggcgcctggggggcttttcggatcggcaggatgtacccccagggaaggcacccgaccccgctccagtccggccagcccttcaagttctcgatcttggagatctgcgaccgcatcaaagaagaattccagtttcttcaggctcaataccacagcctcaagctagaatgtgagaagctggccagcgagaagacggaaatgcagcgacattatgtcatgtattatgagatgtcgtacgggctcaacattgaaatgcataagcaggcggagattgtgaagcgtctgagcggtatctgcgctcagattatccccttcctgacccaggagcatcagcagcaggtgctccaggccgtagaacgcgccaagcaggtcaccgtgggggagctgaacagcctcatcgggcagcagcagctccagccgctgtcccaccacgcaccccctgtgcccctcaccccccgcccagccgggctggtgggcggcagtgctacggggctgcttgctctgtctggagccctggctgcccaggctcagctggcggcggctgtcaaggaggaccgtgcgggcgtggaggccgaggggtccagagtggagagagccccgagcaggagtgcatctccctcgccccctgagagtctcgtggaggaggagcgaccgagtggccctggtggtggcgggaagcagagagcagatgagaaggagccatcaggaccttatgaaagcgacgaagacaagagtgattacaatctggtggtggacgaggaccaaccctcagagccccccagcccggctaccaccccctgcggaaaggtacccatctgcattcctgcccgtcgggacctggtggacagtccagcctccttggcctctagccttggctcaccgctgcctagagccaaggagctcatcctgaatgaccttcccgccagcactcctgcctccaaatcctgtgactcctccccgccccaggacgcttccacccccgggcccagctcggccagtcacctctgccagcttgctgccaagccagcaccttccacggacagcgtcgccctgaggagccccctgactctgtccagtcccttcaccacgtccttcagcctgggctcccacagcactctcaacggagacctctccgtgcccagctcctacgtcagcctccacctgtccccccaggtcagcagctctgtggtgtacggacgctcccccgtgatggcatttgagtctcatccccatctccgagggtcatccgtctcttcctccctacccagcatccctgggggaaagccggcctactccttccacgtgtctgcggacgggcagatgcagccggttcccttcccctcggatgcactggtaggcgcgggcatcccgcggcacgcccggcagctgcacacgctggcccatggcgaggtggtctgcgcggtcaccatcagcggctccacacagcatgtgtacacgggcggcaagggctgtgtgaaggtgtgggacgtgggccagcctggggccaagacgcccgtggcccagctcgactgcctgaaccgagacaactacattcgttcctgcaagttgctgccggatggccggagtctgatcgtgggcggtgaggccagcaccttgtccatttgggacctggcggcgcccaccccccgtatcaaggccgagctgacttcctcagccccagcctgctacgccctggccgtcagccccgacgccaaggtttgcttctcctgctgcagcgatggcaacattgtggtctgggacctgcagaatcagactatggtcaggcagttccagggccacacggacggcgccagctgcattgatatttccgattacggcactcggctctggacagggggcctggacacgctggcccatggcgaggtggtctgcgcggtcaccatcagcggctccacacagcatgtgtacacgggcggcaagggctgtgtgaaggtgtgggacgtgggccagcctggggccaagacgcccgtggcccagctcgactgcctgaaccgagacaacta

SEQ ID NO: 268767 - DNA, 823 bp, Homo sapiens
gcggccgccctcgccgcgctcccgccccggccgctgcccctgcccgccccgctcgccccgcgcaccccaacccggggaggggctcccacgaccccgggcgcgcgcgcttgggggcgcgccagggactccagggtcccttgccccgcgccgcttctccctcctccctctttcttcgggcagcctccccaccaccccacttcagcctcccccactcttgccgcctccatatcatcaagctctggtggcgcctggggggcttttcggatcggcaggatgtacccccagggaaggcacccgaccccgctccagtccggccagcccttcaagttctcgatcttggagatctgcgaccgcatcaaagaagaattccagtttcttcaggctcaataccacagcctcaagctagaatgtgagaagctggccagcgagaagacggaaatgcagcgacattatgtcatgtattatgagatgtcgtacgggctcaacattgaaatgcataagcaggcggagattgtgaagcgtctgagcggtatctgcgctcagattatccccttcctgacccaggagcatcagcagcaggtgctccaggccgtagaacgcgccaagcaggtcaccgtgggggagctgaacagcctcatcgggcagcagcagctccagccgctgtcccaccacgcaccccctgtgcccctcaccccccccctgcctaggaaccgtacatcccatctgctctctggccaacggcttcacaccttcccctgctgcatgtgggggccgatgggcaggggacctcggtggaaataaaatgtatctatcacaaacgcac

SEQ ID NO: 268768 - DNA, 463 bp, Homo sapiens
cacatagtctaggtagagctcggggttgaatcggccgcttctccctcctccctctttcttcgggcagcctccccaccaccccacttcagcctcccccactcttgccgcctccatatcatcaagctctggtggcgcctggggggcttttcggatcggcaggatgtacccccagggaaggcacccgaccccgctccagtccggccagcccttcaagttctcgatcttggagatctgcgaccgcatcaaagaagaattccagtttcttcaggctcaataccacagcctcaagctagaatgtgagaagctggccagcgagaagacggaaatgcagcgacattatgtcatgcagatgagaaggagccatcaggaccttatcaacggcttcacaccttcccctgctgcatgtgggggccgatgggcaggggacctcggtggaaataaaatgtatctatcacaaacgcac

SEQ ID NO: 268769 - DNA, 425 bp, Homo sapiens
ctatcctagaaggctgtcagaaaacactgagtgaatggctaaacgtgaggcctttaaaacagagcctggcacagagaagctagaataagcagttggttccgatgactaccacctttctacagaactgcagagagaatgctctacaacatgagagaggcatctagtcctgcttaggggcatgacagcagacctgagtctccatgaaccaggtgaaaggtgtcattcggggctggagctgaggcaggagcagcaaaaacttcaggtgctgaagctagagagaaagcagaccaaatatgctccaaaagaaaggagctcagcctgggtgcagtggctcatgcctgtaatcccagcactttgagaggccaaggcaggcagatcacaaggtcaggagtttgagaccagcctggccaacatgacgaaacccc

SEQ ID NO: 268770 - DNA, 436 bp, Homo sapiens
tcagattatccaggaatcatcgaaccagagttgttttactttctacttataaagaacataagaaagcactcttgatctaaggcatgacactgagctggctcacacctgctctgatctttattactttctgtatgtaaaattctcacagtacagtaactgtgaggaaaataataattttgtgcacaatactttaggtaggaaggaaactatattaataataattcaatttaagtagaaatataagtaaacttaattacaggcttttgaaaatccaagcctatttattttatccagttttaaaattcaattcctatttattatctatttaaacctactctgtggagcatacttatacccctcgaaattatcagaattaagaaaaattcagtaattcctgtgtcaaaaatattctgtaaaagtaaactgttcaacagag

SEQ ID NO: 268771 - DNA, 306 bp, Homo sapiens
catgaatgtggctatgattaaattgtgatgaggactgtgacccacaagactggaaaaccagtttggcaccttgatgcagatgttttcaaggactgggttagagaatacataccatcattctacttttagctgttttgtttcattaaaacctttttggttttaatgaaacaaaccataacatgtatgacaaccataacatgtatgacaacatagcatgacaaccataacaagtacaatattttggccaatttcatttaatttggcacatagaatggaagaaatattaagatattattttctacatga

SEQ ID NO: 268772 - DNA, 1589 bp, Homo sapiens
agcggactgtagcctctgcctcctgggttcaggcagttgtcctgtctcggcctcccaagtagctgggattgcagatgcgtaccatggagcccagctggtttttgtatttttggtggagacagggtttcgccgtgttggccagctggtcttgagctcctgacctcaggtgatctgcccaccttggccacctcctgaagtgctgcaattgcaggcgggagccactgcgccctgcccaaacgcctcatttcttaataccatcaccttggagttaggttttcaacgtagaatttggagggacacaaatcccagcaccatccaatcttatcctatcctatccttccctaccctatcctatcccatcccatcttatgtcattgtttcaaattactggttgcaacccaccaaatgatgttatgacccatgagtgcgtctaaatcctaagttctgaaagctgttcttagtggtacattcccagaaagccatagttgttggtaatcagtgcttagtgtgtatttgctgcaattggcagggctcagcatggtgtcatatcttgggatccagagtgcccccaggccttgtggggacaggtaaggagaaagaaattaggagcttccaagaatctggttacccagaaccctgaccccactaggaggaatacaggatcacattttatggcctcttgtctttgtgatggcccatgttcgtgggggaccttgaggctaggtggtcctagagacccagtgggcagcgtggccctgaacttaagccagcattaggtcaggagggtttagaaggcaagagaaagagataggccgggtgcggtggctcacacctgtaatcccagcactttgggaggccaaggtgggtggatcacttgaggccaggagtttgagaccagcctggccaacatggtgaaacaccatctctactaaaaatacaaaaattagccaggcatggtggtgggcacctgtaatcccagctacttgggaggctgaggcaggagaatctcttgaacccgggaggcagaggtttcagtgagccgagatcacaccattgtactccagcctgggtgatagagtgagactgtctcaaaaaaagaaagaaagaaagaaagagattaaatacactggagaaaggaaggagggcacccagtgttggaagggctactctgcctccatcagcattttcaaatttcaggctctggcctttcaccgaatgcacttcccaccagtcctgtttacactgccaggttccgctaggagctttcccacctctgcaggtgcaggcctcgctgcttcttaaggcctttctctggggtgggaggaaacggaaactgtatgattgtctttcatattcacttttatagacctataatgtctacaatgtctgagagtggcgtttgcggcatgacttttaaaaaaatgtcctgctggtattggaccctttctgtgtttgtgaaattgctattttgtattaacacagtatttgataaacatttatattaagaagaataatccctctgctgaatattattgtttccaatggagtagaaagaacttaaaaaaaaaaatcaagatgtctcactctgg

SEQ ID NO: 268773 - DNA, 326 bp, Homo sapiens
ctgctcatcctagcactgggcgctctgggaaggctgtggagggtgtaggtacagtgtggtgagcccagattccaaaggccaggtccagggtcgggcacagtgactcatgcctgtaattccagcactttggaaggacaaggacaaaggattgcttgagcccagcaattctgttcaagacaggcctggacaacatagcaagaccccatctctaaaaaaatttttttttaaattagccagatgtggtgatgtgcacctgtagtcccagctacctgggaggctgagaagggaggattgcttgagcccaggagtttaaggttacagtgagc

SEQ ID NO: 268774 - DNA, 351 bp, Homo sapiens
gaaaaagaagagcaactaaacctaaagtgagcagaaggaaagaactaataaaatgttaagtgaaaaataaaggagagaatacaaaaacaataggtagaataaacaaatctaaaagttggtaccttgaaaacatcaacaaaattaacaaacttttcacaaggatgagcaagagaaaaagagagaaggctcaaattattaaaatcaggagtgaaagggggaacattactacagaccttatggaaataaaaagaatactgagggaatactacaaaaaactgtatgccaataagttagacaacatagacaacattgacaaattcctagaaagacataaactactaaagattactc

SEQ ID NO: 268775 - DNA, 169 bp, Homo sapiens
ttaccctgggcactttgtcctagtgatcctccatctcctgcccccaccctgcttcttggctttcctttagttgcacactcctgttttcaacagtcatgcccagaattttagccaagaaaaattagaattcggaccaaactgtagaaaataataaaaatttaaaaacatt

SEQ ID NO: 268776 - DNA, 492 bp, Homo sapiens
taagtgttttaaagcaatatttagtctaagtagtaaatattcctaagacagacagtaactttacaattcatttgttttgttgtcttaaatggcagaacaatgttgtttttctgtcactaacgtttttatatgttttctaagatgatgaatcatacagaatcaccaaactcatatttctgttcaggtctgaccatttttacaattttcatttgcctatgtaaatattacccacatattatagttcataatttgtgatatgtcagcagatttcattgaacttgagtcttaggtcacaatagaactaacaacatattggcttcattctagtccaatttgttttcttttatgcctacacaccaagggtgttcgcttgaaaacaagtcttccttcacctcctgctttttctcctcacctgctctttaaaaaataattgtacctgactcaaattgatagtcttctaggattttcattcgctaactcaaattgctagtc

SEQ ID NO: 268777 - DNA, 321 bp, Homo sapiens
tagggtccagacattatgtaaattggcattaagtttgaataatgtatggacccagtttaaaaggaaaaaatgctttgggaggctgaggcaggtgcattgcctgaggtcaggagttccagaacagcctggccaacacagtgaaaccccatctctactaaaaatacaaaaagttagctgggcacggtggcgggcacctgtaatcccagctactcaggaggctaatgcaggagaatcacttgaacctgggaggcagaggttgcagtgagccaagatcgtgccattgcactccagcctgggtgatgagagcaaaactccatctca

SEQ ID NO: 268778 - DNA, 562 bp, Homo sapiens
  misc_feature (17)..(17): n is a, c, g, or t
cagtgatccccccgggntgcaggaaattcgcggccgcgtcgacacggcttgcgaagaagacgacagaaggggagagatgaagctccctgcccagaggagctgacctcccagcagtcttacaggatatggttacagaggtgaatctgggggagagtccatcgttggtgttgctccactgacctccaggatggcctccagggaccccgcctcctggtggccactgtccccatcgtattagagttggccttttgaaagctgtgagtccaagttgcctggcaaatagataaggaatacaaggtgatcattcttaagacctcggggatctgcaaaccagccttctggaacctttgagcttccaggatgattcggaatttggatgcagccacagaaagcctaagcgccacaagtcccgccatgacgccctgaggcgtgggttcacacttgggtgtggctggtcacgtctataaaaatgagccttcactttgggaggcccaggcgagtggatcacaaggtcaggagatcaagaccatcctggccaacatggtgaaaccctgtctctact

SEQ ID NO: 268779 - DNA, 436 bp, Homo sapiens
attaaagtttttgttttgttgtttgttcttaatgttgtgtaatgaaatgtttcaacatttggaagataagcgtaactcagtgaatgaatgttcctcaagtgaccagtgtacagtgggtaagagagccattcacagtgcaaggtagacaagtgggttttaatgtgagaaagtacaaagagttaattgttatgatttttagattccacattgcaactcatctttaagaaactgccacttgtcaagttttggtggagtgtctgagaagaatgttcacaataatatgaaaaggctgtaaagtatttcttccttgtccgacatatctataaggccattgtttatgtacttcaaccaaaaaaaaattgcaaaatattgaatgtagaagcagatgtgagaatccaggcaataaagagatttgtaaaaatgtaaaactgtgccg

SEQ ID NO: 268780 - DNA, 127 bp, Homo sapiens
agatcagagcagaacagatcttacctttggaaaactgttaatttttaccacgttgaaacacaaagattcatagttgatgcgatccagcacctgccagaatcatagcaatcagacttccaaatatgag

SEQ ID NO: 268781 - DNA, 862 bp, Homo sapiens
gtcatgtggtactttgctttcattttttaattaccaatgcatattagctatttgtatttcttcttttaggatccagtgtattttgaatttctagaacttaaattataactccttatactcaaatttatacacaaaaacactccaaagacagatgttagtaatttggctatgggcatgattgaaaattgatttctgaagtatacttggaaatgtggtaataaggttgttttgagtggaatattgttagaacatatttatatattataaaatattttttgatttcagaagaaaactttcaccttattttttaatgttctaagtctttactttttaactactacctttaaattgagccttatttataattgtcctatgaagttatattgtatcattctgtgtttgttgcagtatcatttaattgttttgtaaaaagctacattgcaacacaataaaatacttcaatgcttacaataggaagtcttgaaatagtatcctgacatggtattagaaagtcttatctgcagaataacacaaatgcacaccaggaatggggagggatgagggcggaccagagaccagaagagctttgtttttatgaggagaaagaagggaatcacgctactcttgttgactctttactccaagttcattcttcattgctaatgtctccaaatagtgctaccttaggattgatttccagaatgtttcttgtttgtattattagaaagttaaataagtaccattgtaattttgaatatactttcaacagcatggtagaatatatgccatgtggtaatagtagtctttgtttccatttaagctttggcaaatctcttttagtactaattagtttaaaaaaaaa

SEQ ID NO: 268782 - DNA, 401 bp, Homo sapiens
gtttcaaattcagcctatgggtggagagtggtagcaaagatcaatttccttgatatctaaaagcttaaacataacagcagttgcaattatttaaacaatattctgttaaaaaaatgcttttcttcttattaaaataactttaatacaactaattccatcacaataataattctaatattaaatttggcattgtattaataacagatagatggaaaatatagaaaaagccaaagtagaaaattagaatgacctattttgtaattctaagagattttataattttgattgcatttttcctattattttatgttcatgtatatttaaaacactgagatcacagtgtgcatattgttttatactagcacacaatcccttaaattttttatatttctccctagtct

SEQ ID NO: 268783 - DNA, 289 bp, Homo sapiens
tttcactctagttgcgcaggctagaatgcaatggcgtgatatgggctcactgcaaccttggcctccaaggttcaagtgattctcctgcctgcctcagcctcccgagtagctgggattacagacatgcaccaccacacctggctacccaaacccttatcttaatccagacattcctttctcttcattccaggtctttagataaaaactctttcaaccaatttccagtcagaaaatcttggattggaaactgacctggaagcccaccacccaccttcgtcagttgtcctgc

SEQ ID NO: 268784 - DNA, 892 bp, Homo sapiens
gcccagaaccttggctcaggccaagtaggccagaccaccccacaacagacatcttccctgaatgcagggtttgagaagtgccctaatgccctctaactgatgctgagtttgaagaatccatcagttaaggggaggtgtttctgagtttgaagaatcaaacaccttcctaattggtaggaatcctgaaaacactccacaccggagtaaaagactttggttttttatctttatgcctgactaaaagttaactctcattctttcattcagcaaatattttgtgctagtgcatgacactgcagattaatatcgtagatgaactgagtctgggctaggtagagtcaaaaaaaaatttcctaaaggagcctgtacctaaactgagtcttcagagagaagttggaactggcaaagtgaggaaggacggggtctggagggaagagtgagtgcaaaggcacagcacatacagaatgcctgcatgctctagaatccaaaactgtgtcagccaaatttgagttgatggagggacagccaaactgagatacccaggcggtggttggatttatggatctggatttcaggggagtgggcagggctaggggaatagaactgagggtcatgatgtcagtggtaggagttgaagtcttggaagaaagagtagatagaaactttgttttctgatgaacattctatgaggaagttcagcagaggttggaaacatctttaccatttataaataaattttatgtaaaatcctatcctgctgtcatgtttaagcaacttattatgcacagcaccaggacatcaatgtaaattgcatgccagtctttgctctcagtttcaaaggcattcttccctgcctgctgtctaatctttacaaagaaaggttaactccaga

SEQ ID NO: 268785 - DNA, 407 bp, Homo sapiens
actgactcagattcatttattatagcacctcatttaaatgcaaactcaattggtatttctcccacaggtttttttcagtaccatatctgtgtgagcctttttacacacaatccccttagaaaaggaatgttgtctaaaaataggtgaattgagtttctgaaaaaacagaaatccaaagagtaaatttcaaatgtctgtctataaaaaatgataggcaggcaaggtaatggatatgttaaattacctttatttaatcattgtgcattgtgtacatatatcagaacatcacattgtaccccataaatgtttgcaattatgatttatctattgaaaataattttaaaaaaccttgtgaatcgtgagaaaaattaactcttgaaaataaaaaataaaatgtcataaattta

SEQ ID NO: 268786 - DNA, 557 bp, Homo sapiens
actgactcagattcatttattatagcacctcatttaaatgcaaactcaattggtatttctcccacaggtttttttcagtaccatatctgtgtgagcctttttacacacaatccccttagaaaaggaatgttgtctaaaaataggtgaattgagtttctgaaaaaacagaaatccaaagagtaaatttcaaatgtctgtctataaaaaatgataggcaggcaaggtaatggatatgttaaattacctttatttaatcattgtgcattgtgtacatatatcagaacatcacattgtaccccataaatgtttgcaattatgatttatctattgaaaataattttaaaaaaccttgtgaatcgtgagaaaaattaactcttgaaaataaaaaataaaatgtcataaatttaaaaaaaagaaaaacaaacccagagagtgcagtggcacaatctcagctcactgcaacctccacctcccgggtttaagcagttctcttgcctcagcttcccaagtagctgggattacaggcgcccttcaccacgcccaactgattttttgta

SEQ ID NO: 268787 - DNA, 407 bp, Homo sapiens
tatctacgtacatgcatttagaaatatgaaagtaaatatttctacaattttttaacaaaaattggctaacatagctaacaggattgctcccaaagagtgaggcaagagtgtgggacagggtgagaagtatgattgttgcaagtgctactgcaaatatttcacactattttttttaagagattggggtcttactatgttgtccaagctggccttgaactcctgggctcaagcaatccttctgcttcacctcccaagtagctggtactataagcatatgccatcatacccagctctttcacgcttttaacctacatacatgttttactgtagtaaaaagaaacattaaattacaaaaactcaaagttagtataactgaaaataaaaaactatgacttagtaagttagca

SEQ ID NO: 268788 - DNA, 532 bp, Homo sapiens
actactgcactccagcctgggcaacagagggagaccctgtctctaaataaaaaaagaaaagaaaaaaaaagcttacaacttgagattcagcatcttgctcagtatttccaagactaatagattatggtttaaaagatgcttttatactcattttctaatgcaactcctagaaactctatgatatagttgaggtaagtattgttaccacacatgggctaagatccccagaggcagactgcctgagttcaattcttggctccaccattcccaagttccctaacctctctatgcctcagtttcctcttctgtaaagtagggacactcatacttctcatttcagaacatttttgtgaagaataaattatgttatccatttgaggcccttagaatggtacccggtgtatattaagtgctagtacatgttagctatcatcattatcactttatatgagatggactggggttcatagaaacccaatgacttgattgtggctactactcaataaataatagaatttggatttaaaaccag

SEQ ID NO: 268789 - DNA, 273 bp, Homo sapiens
gatcacttgaggatggcatgagccttggaggtggaggttgcagtgaaccaagatcaccgcaccccagcctgggtgacagagtaaggccctggcttaaaaaaaaaaaaaaaaaagttaaaatcagtcctcttctttgtaacaatatagtgttatctgcttgtctaaactgaatgctagtcttgttgttcttatcagtagttggtgaacaaatgcgcctgttttactggaatagtcacagttttgatcactgaatctcacctgctcatagctgtg

SEQ ID NO: 268790 - DNA, 605 bp, Homo sapiens
gagtgaaaaatgaaatttaatatttatgtaaaattagaaaaaaaagttcaaattaatgaagcagaaataaatagaattaaaaataaatgaattctttgaaaaagagtaaattcataagtaagtttaacttgcacatctgaccaagtgaaaaaagagagagcagaagtaggcaaaatcaggaataaggagacaaccatggatctaggggggaggaactaagtttgctgctctgtagcaccaaatttgaaaacaacaagaaatggtggatttccatttaaaatacaaactactgaaattgaatcaagaaaagtctgaatggttacaagttctattgttaaaactgttataggccataaataaaagcttccaaatttattttacaaagtaatatcaaaacctaacaaatagtgtttaaaaagaaaactgtaggccaatttcacatgtgacagaatatatatgcaaaagtttaaataaaatattaggaaatagaatccagcaatatatgcgaaaaatccttataacaaaacagatggtattgcaggaattcagtgctggttctgtacctgaaaatgtctatatactatattaaattgaaaagctcattt

SEQ ID NO: 268791 - DNA, 364 bp, Homo sapiens
atttcttagctaagatatctggtgccacggcttcagtggtttctataccactacacgcatcttcaccatcacccatcttacgacaggaaggagtgcttggttcaactattttcattaaaccatagtctttgtccgctggatgatatgtcgccaggatgttcatttcttcccacttctgggattttttgctcagctcctcctcgacactcccgctgggctgttcagccgaggccaccatagaggaagctgtagaggtcttgttcttcaggatccccttgactggccagtgcgaggcagtccaggccgccatttctgggcgctctggctgttggctcagggtcgctgcttggcgtggagtccggaa

SEQ ID NO: 268792 - DNA, 612 bp, Homo sapiens
tttttaaaaagtattattaacactttctttattttgtattactgaataaactccttttttctgaattttttgaacttctgatatttgtaacactaattcatgaatctccaccaaaataaatacttatagagagtattgcatgatttaagagagtaaatgtgttttccaaagatgaatagagtcctgccaccatcaccacccgccacccctacaaattgaggatatcctaaataacctttaatatagcatatggacattgtacatttaaggtcagggaaggcacttttcttcctaattttatattacagtgcaaatcttgggttgactcactttaaggtttctgactgcccaaaatattttttcccctttacgttacagaacattataataaggcaaacaagttagggatttgaataacactcaaagcaacaaactgtttccagaaagtaccatatttgaagctgtttggtgtgtaaatgttcatttagctcatgtatttacaaaactcttactaaaacttaatttttgtgccataacagtgtctttcctggattacattgtaactggaagtaagcattttctaaaataataaaagtgcccttaagtttaaaa

SEQ ID NO: 268793 - DNA, 202 bp, Homo sapiens
ctctcctgaataattaacaattgctgactagtggtaacaagaagctctgggcattcttgttgttgtgctattaatatgctttataacatttcaaacttcattatgaggcaaaactcaagagataaggcacaaattgatagtcttgtttagcaattaaaatttcagcctcatgataatgatgaaaaagttatttcatttcatt

SEQ ID NO: 268794 - DNA, 389 bp, Homo sapiens
ccacacccacctccctaaacatatacaccccattcctaacctctgccaactactaatctcttctccatgctattgttttaaaatgtttatataaatggaaccatacaatacataacctttgagattgcccaccctccctgacccaaggataattcccttgacatcatccaaattgttgcctgtattgatactgtgttcctttttttggtggggttcatattccatgatacagaggtacagcagtttgtttaactgtttacttgtgagtgacgtctgggttgtttccagttgggggctattttatgaataaagctgcaagggacattggtgtataggcttgtgtgaacataagttttcatttttcttgaataaatgcctaagagtacaat

SEQ ID NO: 268795 - DNA, 369 bp, Homo sapiens
tcagcaggtgggcgtcactggtttagcaaggacagaagagtaggtttctcatttttgcaaagaaatggtccataagctggagattgaagcatttttcctccagttccctcactaaccagctgggtggcaatgataaatcacttccttttcctataaaatgaggggtctgaatagatgctaatgccatttgctacacaccaggcactgctccaactactgcaggcacatttattgccgaatccccacaaaggaggtgctatcactaactccttttaaagaaaggaggcggccaggtgcggcggctcacgcctgtaatcccagcactttgggagcacgaggcgggagaatcgcttgagtccaggagtttga

SEQ ID NO: 268796 - DNA, 451 bp, Homo sapiens
gggggcatgttaactaagtaatgtttcatagaaatatgtaattaacctacctgtggagcctctttccgtgcattctggaaagatcacaaaatattgccctggatttattgggcaagattcctgatacctgtcataaattcttgggaaagctgagtcctagaactacttttcaaattttaggtttacacatttctttcaggagcagtgtatctaatatggatgatcttacacaagcattttctcttctgatctttgttcttattagctaattgtaaaattcaatcaggaactgacaaaggggttgaaactcaagtttacttgctacttgttagaatctttgaattatttgaggttttaatcatcagtgttgtattagtccgttctcacactgctataaagaactacttgagactgggtaatttatgaataaaagagatttaactgaaacaca

SEQ ID NO: 268797 - DNA, 409 bp, Homo sapiens
aaattgaaaagacaggcaacttttatttccctctggctggatccacactcaggtggtgaggcttagtaataggaagcctctcacctccaacaaaggctaagtggactctcagcaagactatattaaaagtatccagcatgtctcatgcactagacagattctatatttaacccctccatttgctgagtagcacaataggtaaaggagaagcccagcattgtgttcaggatgtcttgagaacaaatcatgcaggctggcaatgggatcccataaccattgctaggaaaaaggactggtggggcccttgatatgtgtgagccctggcttcgttattacagccacttggaagaaaaggcgggatagcagatttgggctacgggtttccacttatctgaattagtaataaaga

SEQ ID NO: 268798 - DNA, 496 bp, Homo sapiens
agagctgccaggtttgcaggcgcctcccctacaggtggaagctatacttctggattgctccacctggcaggaaccccagagaggtggaattccatgcgttgtgctcggacctccacaaactgcaggctgatacagaatgtgtttactgggttagtgcaacctagcatgcaaacgtggacacaggatagtcacaactcccacagcagcctaaaggaactatgcaggtcaggttgtgaaatggcacccagagttatttagaagggcgtttggaattcataacgaggttggttttgttttaaaccctactgttgtcctggtaggaaacaatgagtgttgattacattttattctacttaacatcagtgcttctcaagggagatattggtgacatggaattaggtcttatattcaggcatatagcaaaaataaataaagaacctggggagaagatattaaaattttaagtaaaagtggaaatgagactacgaacaaaggc

SEQ ID NO: 268799 - DNA, 277 bp, Homo sapiens
cctaatgaactgaagagttgcagtgttcaaagtaatctcagaacaagctatgtattgcacaaatgcatttaggactcttgtcaaagtgggcttttgagaggcaaggtttgttgagagagaaaagatttgtacattttcaagctcctaaaagattgaaggtctgaacttcagttactctagagatcacaggaagaagaagaatacaggctgtaacgtaggaaggctactgtttattagggaagaaggacagatcatgggggaataaaaaggaaagaaa

SEQ ID NO: 268800 - DNA, 521 bp, Homo sapiens
gatggatttaactgcactttatcttaatatatctcttttatcaacaccttcctttccacgctcccagccgcattgtttatcaagaacctgttacatttcacttgactatttaccttctcaacttttccaactcctcttcctcaggcacctttgctggctcttctctttctctctttacccgctatctctcagcaggcctcagacttctctcctgtctctcccaagagtgctaccctagaccagcctgcctcagattctgtttcggcctagaagggccaaacatctggtttgtcatcttccttgggttttagcacattatcacacacacattaggtcttagcacattattagaactcgcaaatcccttatttgatagaagaactgatttcctttttaaccctaattcctctcccctacccccatttgaatgtgtatcttttcatttggatgtgttcttgtggaatgtccattttatttgtatgcacttattttaaattctgtaaatgatattatagtatccc

SEQ ID NO: 268801 - DNA, 379 bp, Homo sapiens
gataaattctccagaaagtgggcagattgacatttctggcagaaccctaggagcagaaaaaaaatctgaaaaacaaataagcacctgtgatgccctgtgactacagagttccagtagaactataatctgtggaagttcaagaagacttaaagcaggtacaaaagcagccagagtcactcctatctccattgcttacatgagtgagagatgtgagtattgcccagtggaacagatgagaagtaatcacagatattattgcaaaaatcagaaagtcaaagaacaacagaactcatttgactgtatggggcctaagaacttaccagtgagagagaaatgcacagcacagtatcatatttaaatacaatgagctagcaaaaaa

SEQ ID NO: 268802 - DNA, 469 bp, Homo sapiens
gataaattctccagaaagtgggcagattgacatttctggcagaaccctaggagcagaaaaaaaatctgaaaaacaaataagcacctgtgatgccctgtgactacagagttccagtagaactataatctgtggaagttcaagaagacttaaagcaggtacaaagttatttaaaattgaatcacatggtcttcacaatgtataagaaaacaaaattaatatagttataacagtctgaatattttcttcttagagagcagccagagtcactcctatctccattgcttacatgagtgagagatgtgagtattgcccagtggaacagatgagaagtaatcacagatattattgcaaaaatcagaaagtcaaagaacaacagaactcatttgactgtatggggcctaagaacttaccagtgagagagaaatgcacagcacagtatcatatttaaatacaatgagctagcaaaaaa

SEQ ID NO: 268803 - DNA, 202 bp, Homo sapiens
ctcccctattccagatttatcaggcattgcctcttcaaagttgttcttcaccctcagggatatggtgtgataataatgagcaaaagagataaaaaaggaaagccctactgattataggcaggtggcttaattctacaattcattccttatagttgagccctatcttagcgtcttctcttccatcctctctccaaccactgca

SEQ ID NO: 268804 - DNA, 452 bp, Homo sapiens
caccaatatatagcaccatttcagaatgcatgaagttttagcagtagtctaaatatctagcaaaatggctagataaccagttgaaattaaaggattaagggccaagagatacttatttcacttatataaacatttcttccttccataaatggttgttttagttaactcaactgtttttattttgtcttgttgagtacagttgggccaggtttttatatgtaggtaaattttgtacttggcagaaatgcacagaaattgtcagtttgattataactaacaataaaatgagttgatgcttttgagtaaatggtatccaagaattttagaaagttgtctgggcatggtggctcacacctgtaatcaaatcactttgagaggccgtggcaggaggattacttgaacccaggagttcaagaccagcctggggaacatagcaagatgccatctctaaa

SEQ ID NO: 268805 - DNA, 1192 bp, Homo sapiens
tcccggctgcagtcctacctcttggaactacccgtgtttccgggcccagccctcgcagccccccacctcctcgccccggcccggggatccgttggggccgcgtcccccacgcgcccccggagacgccctttccgtgtgcgcccgggacttggtgaaactttgcaggcgccggctgcgaaatggatttaatccgaggcgtcttgctccggctcctgctcctggcttccagcctcggacccggcgcggtgtcgctccgagcggccatccgaaaaccaggaaggtgttggaggatgactgtcacgaaaacttggacagaaccatgacgcaggaccaaagctgcaggaaacagaagatccaatccaggagagggatataagaagtccccagaataatagtgggaaggagatgctagaatgacaaatatttactagatagaaaaggcaaccagtccaactggaacaggcaaggtagggcctcctcttgacatcaagctgggcgcattgaactgtacggctttcagcatccagtggaaaatgccaaggcatcctggaagtcccatccttgggtacactgtcttttactctgaggttggcgcagataaatccctgcaggagcagttgcacagcgtgcctctcagccgggacatcccgaccacggaggaagtgattggagatttgaaaccaggcactgaatatcgtgtgagcatagcagcttacagccaggctggcaaagggcggctgagctctcctcggcatgtcaccactttgtcccaagattcctgcctgcctcctgcagctccccagcagccacatgtcattgtggtttcggattctgaggtggccctgtcttggaaacctggagcgagtgaaggaagcgcccctattcagtactattctgtggaattcatcaggtaagtctgtatgtcacattcaaaagccaaatgtgtgctgggtgcggtggctcacacctgtaatcccagcactttggcaggctgaggcgggcagatcacaaggtcaggagttcgagaccagcctgaccaacatggtgaaaccccgtctctactaaaaatacaaaaattagctgggcgtgatggcacgtgcctgtagtctcagctactcaggaggctgaggcaggagaaatgcttgaacccaggaggtggaggttgcagtgagccgagatcatgccattgcac

SEQ ID NO: 268806 - DNA, 782 bp, Homo sapiens
tcccggctgcagtcctacctcttggaactacccgtgtttccgggcccagccctcgcagccccccacctcctcgccccggcccggggatccgttggggccgcgtcccccacgcgcccccggagacgccctttccgtgtgcgcccgggacttggtgaaactttgcaggcgccggctgcgaaatggatttaatccgaggcgtcttgctccggctcctgctcctggcttccagcctcggacccggcgcggtgtcgctccgagcggccatccgaaaaccaggcaaggtagggcctcctcttgacatcaagctgggcgcattgaactgtacggctttcagcatccagtggaaaatgccaaggcatcctggaagtcccatccttgggtacactgtcttttactctgaggttggcgcagataaatccctgcaggagcagttgcacagcgtgcctctcagccgggacatcccgaccacggaggaagtgattggagatttgaaaccaggcactgaatatcgtgtgagcatagcagcttacagccaggctggcaaagggcggctgagctctcctcggcatgtcaccactttgtcccaagattcctgcctgcctcctgcagctccccagcagccacatgtcattgtggtttcggattctgaggtggccctgtcttggaaacctggagcgagtgaaggaagcgcccctattcagtactattctgtggaattcatcaggccagatttcgacaagaagtggacctcaatccatgagcggatccagatggactccatg

SEQ ID NO: 268807 - DNA, 299 bp, Homo sapiens
catttaccaaaaaaaaaaaaatgggatgtaaaggagagagatccagattgtaacagtatcaggaaacagcaccagaggagatagagattctccaaggattggcacaacggagagagtaacacaaagaaacatactctttaagggagtctttgctgggtgaagtgattttgattgagtcatttacgtcatgaggcattgtctcatgtttaaatgaatgacttggactagtagatttccaaccccttttaatctaaagtgcaatgatgattaattatgtaatgtcatgctatagaaaaaaa

SEQ ID NO: 268808 - DNA, 392 bp, Homo sapiens
ttagtccacagtccagtttgtgaggctactgggagttgaaataagacatatacaaatgtctttcttttttccttttctagtatacaggttacagtcgagcccagagcaggaacagagggatctaaatttgaaagcaataatggcaggcttacatatgtcaattctctacaagaatactaagtcactgtttcattaaaaagagaccaacaggtgggcgtagtggctcaaacctgtaatcctaccattttgcaaggccaaggcaggcacctgtaattctagctacctgggaggctgaggcaggagaattgcttgaacctgggaagtggaggttgcagcgagctgagattgcaccattgcactccagcctaggcaacaagagcaaaactccatct

SEQ ID NO: 268809 - DNA, 459 bp, Homo sapiens
ttatggagcaggcagcaggaatggcttattctctgtcagacacaggagacagagtgcccagggcccatgatactttaaggagcccatgagaatattttcttttatagtcagaagaaaaaattattatactttcaagtggatttgtctttataccaacaaagttataaaataaatttttaaaaaatgttttaatgacagaaggggcttatgaaggcactcctcaaggggcttatgaaagtcactaaaggaaaggtcataatttggaaaggcaaagaagagggtaagaagctagctgagtgaactgggatgaatactatgaaggaagccatggggacaggaaggtaatcacagaagcaaaacaatgagatagctgtggtttcccaaacaaaaacctggaaacatcttctgacacataatctgatcatagaacagaagatccaaaatcaagaccattctgca

SEQ ID NO: 268810 - DNA, 679 bp, Homo sapiens
gggtttcagcctgttggccaggctggtcttgaacccctgacctaaagtgatctgtccatcaaagtgctaggattacagcgcttacagctcacaggcgtgagccactgtgtctggcccaggttgtttattcttttctatttgatttgtaagtattcattttatattttgaatgttagtcctttttagattacagattttgcagatactttgtgaatctgaggagccctttaaaaatatgtatgattgagacttacccacagaagttctcattcgtaagtgtggtggttgtggggattggcatctgtattttaaaatttgatatacaatcaaatttaagaactatgataagattatggagaatggaggaatttaggacagtagctaagacctcaaaaagatgtgtgttcaactctcaactgtgtcatttaacagctgtggggccttgggcaggttattaaatgtccataagctttgttttcttcatctgaaaaatggaaacagtaggatttatgagatagttaaataagattgattcttgtgaaatgtttaacacagtacctagttcataggaaaagttaaaaaataaaaaatagagacttatttttctattcaagcaatcaaaatattaagactataaaatacatgttatgttatttgtgaaaaatgtccattaaggttc

SEQ ID NO: 268811 - DNA, 2856 bp, Homo sapiens
cttggctcgccccgcccttccttgtaagatggcggcgcccaggtggagcgcgtcgggcccctggatccggggaaacggccaaggttgcgggagtctcttcactctcgtctcaaagccattttgtgccgctgccgctgcctctacggccataaatgcccagagattagcggagaagctccgagcccagaaacgggaacaagacacaaagaaggagccggtgtccacaaacgctgttcagcggagagtgcaagaaatagtgcggttcacacggcagctgcagcgagtccaccccaacgtgcttgctaaggcactgacccgaggaattctccaccaggacaagaaccttgtggtcatcaataagccctacggtctccctgtgcatggtggccctggggtccagctctgcatcactgatgtactacctatcctggcaaagatgcttcatggccacaaggcagagcccttgcatctgtgccaccggctggacaaggaaaccacaggtgtaatggtgttggcttgggacaaggacatggcacatcaagtccaagagttgtttagaacccgtcaggtggtgaagaagtactgggccatcactgtgcatgtccccatgccctcagcaggagtcgtggacatccccattgtggagaaggaggcgcaaggccagcagcaacaccacaagatgacattgtccccgagctaccgcatggacgatgggaaaatggtgaaagtgcggcgcagccggaatgcgcaagttgctgtaactcagtaccaggtgctcagcagcactctctcctccgccctcgtggagctccagcccatcactggaataaaacatcagcttcgagttcacttgtcttttggattggattgtccaatccttggtgatcacaagtactcagactggaataggttggccccccagaagctgtctgtgggcaccctgaagaagctggggctagaacagtcgaaggcccgctacatcccccttcacctgcacgcccggcagctgatcctgcctgccctggggtccgggaaggaggaactcaacttggtctgcaaacttcctcgcttctttgtgcattccctgcaccgcctgcgtttagagatgccaaatgaggatcaaaatgagaacaatgaagccaagtgtctgggagcacagtgaagaccatgggagcaccctggcacctgggagcacagtgaagaccctgagagcatcctggcacctgggagcgcaggttggcccctgaactgttctttgtttacaggactctgctaacttctcacttggaacagactgcgtaagagccaggtgggataaggtaaagcaactcagctgctacagggcttttaatggagaacaaagtctatttactgatagtttggctgcactgtggaaaagcctgctggaagtctccctgccgtgggctctcattgccaatatggaacagagcccagggccaggcagactggggcagtgactggaaaaggaaaactaaaggtcagaatccgggatcaggaactgtttttatccagcagtgaagctcttgagctcttaggaaggttcccgtggttggaaagaacataatggttaacaaatatcacagcatccagggattgcccagctatagtgtgggtgccctactgaactctgattagggaacctgtataagggtattgagtgtgaggttgaggtgggacatttgctgagcaaggagaaccgatgtgaatggcaggcagataacatgcacacatgaagctggctgggtgtaaggcagtagcggggagcagcatgctgtctaacagctgttagctccagctggttgttgccatgtgggaatggattttctcatttcttcagagaagctggaaacctagatatttatgtgaaacctcccagtgtattgccaactaaatcaaatttttaaagatgcttaggcacctaagcaaataatacttagaggttgaatttggtctacaggctagcagtttgcagtctatgtttaatgaatggtatagaagtttggggaaaggtgccatcttgaaaattctggatcagtggttggcattttcgctgcgtgtagtatgtatcctttctaggcttggagatggctttggttggtccgtgaatgtagttatgagagtgctgccattaaaaaatcaaaatctctgttgtggaagcgtatcttctgttcttaggtctcaggaaggagagggctatactgaacaccattagggatagatggaaatgaccttggcctccctgctcagctggtccatctagtttccaccttgtttcttgcaaacaaatacacctcacactactttttctttctgacagagttggagtgacagcacagttaggggggtacaccccgggacagtctttatatgttccctctgtatagatgatgccactttctagccctttccctgtctccatggtacccattactgtgcataataaatttaactttgaaagcacaaaaaaaaaaaaaaaaaaaaaaaaaaaaaaaaaaaaaaaaaaaaaaaaaaaaaaaaaaaaaaaaaaaaaacaaaaaaaaaaaaaaaaaaaaaaagagggggcgcgcgccgccgaaaaatcatccctagggggggcccgactgcgcgcccaccatttgtgcgacacacgggcgcctcccagaggggggcggcgtaataatgcaagagaacgagcgcgcgcgtgcgccggccttaaaaacacagcgggcagacagcgaaaaacaacgcgcgacggggcagcactacttggggagagagaccccacacgtagcgagcggagacacaaacgtgggcacataccgcgaccgaaagtaaaacccgcggggcgaactaagt

SEQ ID NO: 268812 - DNA, 2617 bp, Homo sapiens
cttggctcgccccgcccttccttgtaagatggcggcgcccaggtggagcgcgtcgggcccctggatccggggaaacggccaaggttgcgggagtctcttcactctcgtctcaaagccattttgtgccgctgccgctgcctctacggccataaatgcccagagattagcggagaagctccgagcccagaaacgggaacaagacacaaagaaggagccggtgtccacaaacgctgttcagcggagagtgcaagaaatagtgcggttcacacggcagctgcagcgagtccaccccaacgtgcttgctaaggcactgacccgaggaattctccaccaggacaagaaccttgtggtcatcaataagccctacggtctccctgtgcatggtggccctggggtccagctctgcatcactgatgtactacctatcctggcaaagatgcttcatggccacaaggcagagcccttgcatctgtgccaccggctggacaaggaaaccacaggtgtaatggtgttggcttgggacaaggacatggcacatcaagtccaagagttgtttagaacccgtcaggtggtgaagaagtactggaataaaacatcagcttcgagttcacttgtcttttggattggattgtccaatccttggtgatcacaagtactcagactggaataggttggccccccagaagctgtctgtgggcaccctgaagaagctggggctagaacagtcgaaggcccgctacatcccccttcacctgcacgcccggcagctgatcctgcctgccctggggtccgggaaggaggaactcaacttggtctgcaaacttcctcgcttctttgtgcattccctgcaccgcctgcgtttagagatgccaaatgaggatcaaaatgagaacaatgaagccaagtgtctgggagcacagtgaagaccatgggagcaccctggcacctgggagcacagtgaagaccctgagagcatcctggcacctgggagcgcaggttggcccctgaactgttctttgtttacaggactctgctaacttctcacttggaacagactgcgtaagagccaggtgggataaggtaaagcaactcagctgctacagggcttttaatggagaacaaagtctatttactgatagtttggctgcactgtggaaaagcctgctggaagtctccctgccgtgggctctcattgccaatatggaacagagcccagggccaggcagactggggcagtgactggaaaaggaaaactaaaggtcagaatccgggatcaggaactgtttttatccagcagtgaagctcttgagctcttaggaaggttcccgtggttggaaagaacataatggttaacaaatatcacagcatccagggattgcccagctatagtgtgggtgccctactgaactctgattagggaacctgtataagggtattgagtgtgaggttgaggtgggacatttgctgagcaaggagaaccgatgtgaatggcaggcagataacatgcacacatgaagctggctgggtgtaaggcagtagcggggagcagcatgctgtctaacagctgttagctccagctggttgttgccatgtgggaatggattttctcatttcttcagagaagctggaaacctagatatttatgtgaaacctcccagtgtattgccaactaaatcaaatttttaaagatgcttaggcacctaagcaaataatacttagaggttgaatttggtctacaggctagcagtttgcagtctatgtttaatgaatggtatagaagtttggggaaaggtgccatcttgaaaattctggatcagtggttggcattttcgctgcgtgtagtatgtatcctttctaggcttggagatggctttggttggtccgtgaatgtagttatgagagtgctgccattaaaaaatcaaaatctctgttgtggaagcgtatcttctgttcttaggtctcaggaaggagagggctatactgaacaccattagggatagatggaaatgaccttggcctccctgctcagctggtccatctagtttccaccttgtttcttgcaaacaaatacacctcacactactttttctttctgacagagttggagtgacagcacagttaggggggtacaccccgggacagtctttatatgttccctctgtatagatgatgccactttctagccctttccctgtctccatggtacccattactgtgcataataaatttaactttgaaagcacaaaaaaaaaaaaaaaaaaaaaaaaaaaaaaaaaaaaaaaaaaaaaaaaaaaaaaaaaaaaaaaaaaaaaacaaaaaaaaaaaaaaaaaaaaaaagagggggcgcgcgccgccgaaaaatcatccctagggggggcccgactgcgcgcccaccatttgtgcgacacacgggcgcctcccagaggggggcggcgtaataatgcaagagaacgagcgcgcgcgtgcgccggccttaaaaacacagcgggcagacagcgaaaaacaacgcgcgacggggcagcactacttggggagagagaccccacacgtagcgagcggagacacaaacgtgggcacataccgcgaccgaaagtaaaacccgcggggcgaactaagt

SEQ ID NO: 268813 - DNA, 2958 bp, Homo sapiens
tcatgcctcagcctcccaagtagctggaattacaggcacgcgccaccacgcctggctgattttttttttgtatttttagtagagatggggtttcaccatgttggccaggctggtcttgaactcctgacctgaagtgatccacccgccttggcctcccaaagtattgggattacatgtgtgagccaccacgcctgtcccctgtgacttcttcgggtacagttccctcctgttttacctatgtggcaaatgagccaggaacggttctctgaatgttttattaggttcattcatccaattattcatttgttcatttaccatgcagtcagaatctacaatcttttattatttgaaaaaaaatacaaaactatattaccataattttattttaactgtacatatccatttttaaagactggaaagaccatgttattaatgtaatttttttctttttttaccccaaatattctacaattagcatgtatgactttagtagtaaaaaagataagcttgtgaaatctatcagctctcaggctaagcattacaccaagagaatcttgcacgatccttcaatcataagaaatcacatgttagtgcagaaggtccagcgtgaaatcctctaagtggccaaatctaggagttcttctctggcttggttggctaaagcagtgatctgtgtcacccccagggggccatcactgtgcatgtccccatgccctcagcaggagtcgtggacatccccattgtggagaaggaggcgcaaggccagcagcaacaccacaagatgacattgtccccgagctaccgcatggacgatgggaaaatggtgaaagtgcggcgcagccggaatgcgcaagttgctgtaactcagtaccaggtgctcagcagcactctctcctccgccctcgtggagctccagcccatcactggaataaaacatcagcttcgagttcacttgtcttttggattggattgtccaatccttggtgatcacaagtactcagactggaataggttggccccccagaagctgtctgtgggcaccctgaagaagctggggctagaacagtcgaaggcccgctacatcccccttcacctgcacgcccggcagctgatcctgcctgccctggggtccgggaaggaggaactcaacttggtctgcaaacttcctcgcttctttgtgcattccctgcaccgcctgcgtttagagatgccaaatgaggatcaaaatgagaacaatgaagccaagtgtctgggagcacagtgaagaccatgggagcaccctggcacctgggagcacagtgaagaccctgagagcatcctggcacctgggagcgcaggttggcccctgaactgttctttgtttacaggactctgctaacttctcacttggaacagactgcgtaagagccaggtgggataaggtaaagcaactcagctgctacagggcttttaatggagaacaaagtctatttactgatagtttggctgcactgtggaaaagcctgctggaagtctccctgccgtgggctctcattgccaatatggaacagagcccagggccaggcagactggggcagtgactggaaaaggaaaactaaaggtcagaatccgggatcaggaactgtttttatccagcagtgaagctcttgagctcttaggaaggttcccgtggttggaaagaacataatggttaacaaatatcacagcatccagggattgcccagctatagtgtgggtgccctactgaactctgattagggaacctgtataagggtattgagtgtgaggttgaggtgggacatttgctgagcaaggagaaccgatgtgaatggcaggcagataacatgcacacatgaagctggctgggtgtaaggcagtagcggggagcagcatgctgtctaacagctgttagctccagctggttgttgccatgtgggaatggattttctcatttcttcagagaagctggaaacctagatatttatgtgaaacctcccagtgtattgccaactaaatcaaatttttaaagatgcttaggcacctaagcaaataatacttagaggttgaatttggtctacaggctagcagtttgcagtctatgtttaatgaatggtatagaagtttggggaaaggtgccatcttgaaaattctggatcagtggttggcattttcgctgcgtgtagtatgtatcctttctaggcttggagatggctttggttggtccgtgaatgtagttatgagagtgctgccattaaaaaatcaaaatctctgttgtggaagcgtatcttctgttcttaggtctcaggaaggagagggctatactgaacaccattagggatagatggaaatgaccttggcctccctgctcagctggtccatctagtttccaccttgtttcttgcaaacaaatacacctcacactactttttctttctgacagagttggagtgacagcacagttaggggggtacaccccgggacagtctttatatgttccctctgtatagatgatgccactttctagccctttccctgtctccatggtacccattactgtgcataataaatttaactttgaaagcacaaaaaaaaaaaaaaaaaaaaaaaaaaaaaaaaaaaaaaaaaaaaaaaaaaaaaaaaaaaaaaaaaaaaaacaaaaaaaaaaaaaaaaaaaaaaagagggggcgcgcgccgccgaaaaatcatccctagggggggcccgactgcgcgcccaccatttgtgcgacacacgggcgcctcccagaggggggcggcgtaataatgcaagagaacgagcgcgcgcgtgcgccggccttaaaaacacagcgggcagacagcgaaaaacaacgcgcgacggggcagcactacttggggagagagaccccacacgtagcgagcggagacacaaacgtgggcacataccgcgaccgaaagtaaaacccgcggggcgaactaagt

SEQ ID NO: 268814 - DNA, 1629 bp, Homo sapiens
aactgctgcgtgctcacttggcacagagtgcctagaaagcaggtagtcgatagggtaatagcgagcattcccgttatagaggctcttcctccggaggagatggtgaatctatatagtgatagtcaggcatgccatgtacacttgcctttttgtgtgtctccctgacgagtgactctactagcccgttatgatctggactgtggttcctgcataatgacgcatgtgtgtgggtgccgggacgtacaggtccaattccgggtgtcacgagatctgttccgatcactacgacgagatgactgctctagattcgtcttagcaatggtaccgcgtcgtctactcttagcatccatggttggccatatatctacagtgagtctctaaggtattgttacaggctatagtgtgggtgccctactgaactctgattagggaacctgtataagggtattgagtgtgaggttgaggtgggacatttgctgagcaaggagaaccgatgtgaatggcaggcagataacatgcacacatgaagctggctgggtgtaaggcagtagcggggagcagcatgctgtctaacagctgttagctccagctggttgttgccatgtgggaatggattttctcatttcttcagagaagctggaaacctagatatttatgtgaaacctcccagtgtattgccaactaaatcaaatttttaaagatgcttaggcacctaagcaaataatacttagaggttgaatttggtctacaggctagcagtttgcagtctatgtttaatgaatggtatagaagtttggggaaaggtgccatcttgaaaattctggatcagtggttggcattttcgctgcgtgtagtatgtatcctttctaggcttggagatggctttggttggtccgtgaatgtagttatgagagtgctgccattaaaaaatcaaaatctctgttgtggaagcgtatcttctgttcttaggtctcaggaaggagagggctatactgaacaccattagggatagatggaaatgaccttggcctccctgctcagctggtccatctagtttccaccttgtttcttgcaaacaaatacacctcacactactttttctttctgacagagttggagtgacagcacagttaggggggtacaccccgggacagtctttatatgttccctctgtatagatgatgccactttctagccctttccctgtctccatggtacccattactgtgcataataaatttaactttgaaagcacaaaaaaaaaaaaaaaaaaaaaaaaaaaaaaaaaaaaaaaaaaaaaaaaaaaaaaaaaaaaaaaaaaaaaacaaaaaaaaaaaaaaaaaaaaaaagagggggcgcgcgccgccgaaaaatcatccctagggggggcccgactgcgcgcccaccatttgtgcgacacacgggcgcctcccagaggggggcggcgtaataatgcaagagaacgagcgcgcgcgtgcgccggccttaaaaacacagcgggcagacagcgaaaaacaacgcgcgacggggcagcactacttggggagagagaccccacacgtagcgagcggagacacaaacgtgggcacataccgcgaccgaaagtaaaacccgcggggcgaactaagt

SEQ ID NO: 268815 - DNA, 1685 bp, Homo sapiens
gggtttcagcctgttggccaggctggtcttgaacccctgacctaaagtgatctgtccatcaaagtgctaggattacagcgcttacagctcacaggcgtgagccactgtgtctggcccaggttgtttattcttttctatttgatttggccatcactgtgcatgtccccatgccctcagcaggagtcgtggacatccccattgtggagaaggaggcgcaaggccagcagcaacaccacaagatgacattgtccccgagctaccgcatggacgatgggaaaatggtgaaagtgcggcgcagccggaatgcgcaagttgctgtaactcagtaccaggtgctcagcagcactctctcctccgccctcgtggagctccagcccatcactggaataaaacatcagcttcgagttcacttgtcttttggattggattgtccaatccttggtgatcacaagtactcagactggaataggttggccccccagaagctgtctgtgggcaccctgaagaagctggggctagaacagtcgaaggcccgctacatcccccttcacctgcacgcccggcagataacatgcacacatgaagctggctgggtgtaaggcagtagcggggagcagcatgctgtctaacagctgttagctccagctggttgttgccatgtgggaatggattttctcatttcttcagagaagctggaaacctagatatttatgtgaaacctcccagtgtattgccaactaaatcaaatttttaaagatgcttaggcacctaagcaaataatacttagaggttgaatttggtctacaggctagcagtttgcagtctatgtttaatgaatggtatagaagtttggggaaaggtgccatcttgaaaattctggatcagtggttggcattttcgctgcgtgtagtatgtatcctttctaggcttggagatggctttggttggtccgtgaatgtagttatgagagtgctgccattaaaaaatcaaaatctctgttgtggaagcgtatcttctgttcttaggtctcaggaaggagagggctatactgaacaccattagggatagatggaaatgaccttggcctccctgctcagctggtccatctagtttccaccttgtttcttgcaaacaaatacacctcacactactttttctttctgacagagttggagtgacagcacagttaggggggtacaccccgggacagtctttatatgttccctctgtatagatgatgccactttctagccctttccctgtctccatggtacccattactgtgcataataaatttaactttgaaagcacaaaaaaaaaaaaaaaaaaaaaaaaaaaaaaaaaaaaaaaaaaaaaaaaaaaaaaaaaaaaaaaaaaaaaacaaaaaaaaaaaaaaaaaaaaaaagagggggcgcgcgccgccgaaaaatcatccctagggggggcccgactgcgcgcccaccatttgtgcgacacacgggcgcctcccagaggggggcggcgtaataatgcaagagaacgagcgcgcgcgtgcgccggccttaaaaacacagcgggcagacagcgaaaaacaacgcgcgacggggcagcactacttggggagagagaccccacacgtagcgagcggagacacaaacgtgggcacataccgcgaccgaaagtaaaacccgcggggcgaactaagt

SEQ ID NO: 268816 - DNA, 1011 bp, Homo sapiens
cttggctcgccccgcccttccttgtaagatggcggcgcccaggtggagcgcgtcgggcccctggatccggggaaacggccaaggttgcgggagtctcttcactctcgtctcaaagccattttgtgccgctgccgctgcctctacggccataaatgcccagagattagcggagaagctccgagcccagaaacgggaacaagacacaaagaaggagccggtgtccacaaacgctgttcagcggagagtgcaagaaatagtgcggttcacacggcagctgcagcgagtccaccccaacgtgcttgctaaggcactgacccgaggaattctccaccaggacaagaaccttgtggtcatcaataagccctacggtctccctgtgcatggtggccctggggtccagctctgcatcactgatgtactacctatcctggcaaagatgcttcatggccacaaggcagagcccttgcatctgtgccaccggctggacaaggaaaccacaggtgtaatggtgttggcttgggacaaggacatggcacatcaagtccaagagttgtttagaacccgtcaggtggtgaagaagtactggtatgaggcctgctgatggcagtagaggtggtataagtggaggcatttctttcacctatttattcattaaaaacagaaactcccattaatagaaggcactgcactatgacctgcgagattgtaaaaaatatgtgaaacagctttggtgcttagaatattaagtctgatagaacagtggttcttaattctggtatacatcaaaattatcaaaaattaattatacaagcatgggggggacatggtggctcacgcctgtaatcacagcactttgagaggcagaggtgggaggatcactttaggccaagagtcggagaacagcctgggcaacatagtgacaccttttctctataaaaagtaagaagttagtccggtatagtggcacatacctgtagtcccagctacttgggaggccagggtgggaggatc

SEQ ID NO: 268817 - DNA, 2883 bp, Homo sapiens
cttggctcgccccgcccttccttgtaagatggcggcgcccaggtggagcgcgtcgggcccctggatccggggaaacggccaaggttgcgggagtctcttcactctcgtctcaaagccattttgtgccgctgccgctgcctctacggccataaatgcccagagattagcggagaagctccgagcccagaaacgggaacaagacacaaagaaggagccggtgtccacaaacgctgttcagcggagagtgcaagaaatagtgcggttcacacggcagctgcagcgagtccaccccaacgtgcttgctaaggcactgacccgaggaattctccaccaggacaagaaccttgtggtcatcaataagccctacggtctccctgtgcatggtggccctggggtccagctctgcatcactgatgtactacctatcctggcaaagatgcttcatggccacaaggcagagcccttgcatctgtgccaccggctggacaaggaaaccacaggtgtaatggtgttggcttgggacaaggacatggcacatcaagtccaagagttgtttagaacccgtcaggtggtgaagaagtactggtatgaggcctgctgatggcagtagagggccatcactgtgcatgtccccatgccctcagcaggagtcgtggacatccccattgtggagaaggaggcgcaaggccagcagcaacaccacaagatgacattgtccccgagctaccgcatggacgatgggaaaatggtgaaagtgcggcgcagccggaatgcgcaagttgctgtaactcagtaccaggtgctcagcagcactctctcctccgccctcgtggagctccagcccatcactggaataaaacatcagcttcgagttcacttgtcttttggattggattgtccaatccttggtgatcacaagtactcagactggaataggttggccccccagaagctgtctgtgggcaccctgaagaagctggggctagaacagtcgaaggcccgctacatcccccttcacctgcacgcccggcagctgatcctgcctgccctggggtccgggaaggaggaactcaacttggtctgcaaacttcctcgcttctttgtgcattccctgcaccgcctgcgtttagagatgccaaatgaggatcaaaatgagaacaatgaagccaagtgtctgggagcacagtgaagaccatgggagcaccctggcacctgggagcacagtgaagaccctgagagcatcctggcacctgggagcgcaggttggcccctgaactgttctttgtttacaggactctgctaacttctcacttggaacagactgcgtaagagccaggtgggataaggtaaagcaactcagctgctacagggcttttaatggagaacaaagtctatttactgatagtttggctgcactgtggaaaagcctgctggaagtctccctgccgtgggctctcattgccaatatggaacagagcccagggccaggcagactggggcagtgactggaaaaggaaaactaaaggtcagaatccgggatcaggaactgtttttatccagcagtgaagctcttgagctcttaggaaggttcccgtggttggaaagaacataatggttaacaaatatcacagcatccagggattgcccagctatagtgtgggtgccctactgaactctgattagggaacctgtataagggtattgagtgtgaggttgaggtgggacatttgctgagcaaggagaaccgatgtgaatggcaggcagataacatgcacacatgaagctggctgggtgtaaggcagtagcggggagcagcatgctgtctaacagctgttagctccagctggttgttgccatgtgggaatggattttctcatttcttcagagaagctggaaacctagatatttatgtgaaacctcccagtgtattgccaactaaatcaaatttttaaagatgcttaggcacctaagcaaataatacttagaggttgaatttggtctacaggctagcagtttgcagtctatgtttaatgaatggtatagaagtttggggaaaggtgccatcttgaaaattctggatcagtggttggcattttcgctgcgtgtagtatgtatcctttctaggcttggagatggctttggttggtccgtgaatgtagttatgagagtgctgccattaaaaaatcaaaatctctgttgtggaagcgtatcttctgttcttaggtctcaggaaggagagggctatactgaacaccattagggatagatggaaatgaccttggcctccctgctcagctggtccatctagtttccaccttgtttcttgcaaacaaatacacctcacactactttttctttctgacagagttggagtgacagcacagttaggggggtacaccccgggacagtctttatatgttccctctgtatagatgatgccactttctagccctttccctgtctccatggtacccattactgtgcataataaatttaactttgaaagcacaaaaaaaaaaaaaaaaaaaaaaaaaaaaaaaaaaaaaaaaaaaaaaaaaaaaaaaaaaaaaaaaaaaaaacaaaaaaaaaaaaaaaaaaaaaaagagggggcgcgcgccgccgaaaaatcatccctagggggggcccgactgcgcgcccaccatttgtgcgacacacgggcgcctcccagaggggggcggcgtaataatgcaagagaacgagcgcgcgcgtgcgccggccttaaaaacacagcgggcagacagcgaaaaacaacgcgcgacggggcagcactacttggggagagagaccccacacgtagcgagcggagacacaaacgtgggcacataccgcgaccgaaagtaaaacccgcggggcgaactaagt

SEQ ID NO: 268818 - DNA, 2656 bp, Homo sapiens
cttggctcgccccgcccttccttgtaagatggcggcgcccaggtggagcgcgtcgggcccctggatccggggaaacggccaaggttgcgggagtctcttcactctcgtctcaaagccattttgtgccgctgccgctgcctctacggccataaatgcccagagattagcggagaagctccgagcccagaaacgggaacaagacacaaagaaggagccggtgtccacaaacgctgttcagcggagagtgcaagaaatagtgcggttcacacggcagctgcagcgagtccaccccaacgtgcttgctaaggcactgacccgaggaattctccaccaggacaagaaccttgtggtcatcaataagccctacggtctccctgtgcatggtggccatcactgtgcatgtccccatgccctcagcaggagtcgtggacatccccattgtggagaaggaggcgcaaggccagcagcaacaccacaagatgacattgtccccgagctaccgcatggacgatgggaaaatggtgaaagtgcggcgcagccggaatgcgcaagttgctgtaactcagtaccaggtgctcagcagcactctctcctccgccctcgtggagctccagcccatcactggaataaaacatcagcttcgagttcacttgtcttttggattggattgtccaatccttggtgatcacaagtactcagactggaataggttggccccccagaagctgtctgtgggcaccctgaagaagctggggctagaacagtcgaaggcccgctacatcccccttcacctgcacgcccggcagctgatcctgcctgccctggggtccgggaaggaggaactcaacttggtctgcaaacttcctcgcttctttgtgcattccctgcaccgcctgcgtttagagatgccaaatgaggatcaaaatgagaacaatgaagccaagtgtctgggagcacagtgaagaccatgggagcaccctggcacctgggagcacagtgaagaccctgagagcatcctggcacctgggagcgcaggttggcccctgaactgttctttgtttacaggactctgctaacttctcacttggaacagactgcgtaagagccaggtgggataaggtaaagcaactcagctgctacagggcttttaatggagaacaaagtctatttactgatagtttggctgcactgtggaaaagcctgctggaagtctccctgccgtgggctctcattgccaatatggaacagagcccagggccaggcagactggggcagtgactggaaaaggaaaactaaaggtcagaatccgggatcaggaactgtttttatccagcagtgaagctcttgagctcttaggaaggttcccgtggttggaaagaacataatggttaacaaatatcacagcatccagggattgcccagctatagtgtgggtgccctactgaactctgattagggaacctgtataagggtattgagtgtgaggttgaggtgggacatttgctgagcaaggagaaccgatgtgaatggcaggcagataacatgcacacatgaagctggctgggtgtaaggcagtagcggggagcagcatgctgtctaacagctgttagctccagctggttgttgccatgtgggaatggattttctcatttcttcagagaagctggaaacctagatatttatgtgaaacctcccagtgtattgccaactaaatcaaatttttaaagatgcttaggcacctaagcaaataatacttagaggttgaatttggtctacaggctagcagtttgcagtctatgtttaatgaatggtatagaagtttggggaaaggtgccatcttgaaaattctggatcagtggttggcattttcgctgcgtgtagtatgtatcctttctaggcttggagatggctttggttggtccgtgaatgtagttatgagagtgctgccattaaaaaatcaaaatctctgttgtggaagcgtatcttctgttcttaggtctcaggaaggagagggctatactgaacaccattagggatagatggaaatgaccttggcctccctgctcagctggtccatctagtttccaccttgtttcttgcaaacaaatacacctcacactactttttctttctgacagagttggagtgacagcacagttaggggggtacaccccgggacagtctttatatgttccctctgtatagatgatgccactttctagccctttccctgtctccatggtacccattactgtgcataataaatttaactttgaaagcacaaaaaaaaaaaaaaaaaaaaaaaaaaaaaaaaaaaaaaaaaaaaaaaaaaaaaaaaaaaaaaaaaaaaaacaaaaaaaaaaaaaaaaaaaaaaagagggggcgcgcgccgccgaaaaatcatccctagggggggcccgactgcgcgcccaccatttgtgcgacacacgggcgcctcccagaggggggcggcgtaataatgcaagagaacgagcgcgcgcgtgcgccggccttaaaaacacagcgggcagacagcgaaaaacaacgcgcgacggggcagcactacttggggagagagaccccacacgtagcgagcggagacacaaacgtgggcacataccgcgaccgaaagtaaaacccgcggggcgaactaagt

SEQ ID NO: 268819 - DNA, 2140 bp, Homo sapiens
cttggctcgccccgcccttccttgtaagatggcggcgcccaggtggagcgcgtcgggcccctggatccggggaaacggccaaggttgcgggagtctcttcactctcgtctcaaagccattttgtgccgctgccgctgcctctacggccataaatgcccagagattagcggagaagctccgagcccagaaacgggaacaagacacaaagaaggagccggtgtccacaaacgctgttcagcggagagtgcaagaaatagtgcggttcacacggcagctgcagcgagtccaccccaacgtgcttgctaaggcactgacccgaggaattctccaccaggacaagaaccttgtggtcatcaataagccctacggtctccctgtgcatggtggccctggggtccagctctgcatcactgatgtactacctatcctggcaaagatgcttcatggccacaaggcagagcccttgcatctgtgccaccggctggacaaggaaaccacaggtgtaatggtgttggcttgggacaaggacatggcacatcaagtccaagagttgtttagaacccgtcaggtggtgaagaagtactgggccatcactgtgcatgtccccatgccctcagcaggagtcgtggacatccccattgtggagaaggaggcgcaaggccagcagcaacaccacaagatgacattgtccccgagctaccgcatggacgatgggaaaatggtgaaagtgcggcgcagccggaatgcgcaagttgctgtaactcagtaccaggtgctcagcagcactctctcctccgccctcgtggagctccagcccatcactggaataaaacatcagcttcgagttcacttgtcttttggattggattgtccaatccttggtgatcacaagtactcagactggaataggttggccccccagaagctgtctgtgggcaccctgaagaagctggggctagaacagtcgaaggcccgctacatcccccttcacctgcacgcccggcagctgatcctgcctgccctggggtccgggaaggaggaactcaacttggtctgcaaacttcctcgcttctttgtgcattccctgcaccgcctgcgtttagagatgccaaatgaggatcaaaatgagaacaatgaagccaagtgtctgggagcacagtgaagaccatgggagcaccctggcacctgggagcacagtgaagaccctgagagcatcctggcacctgggagcgcaggttggcccctgaactgttctttgtttacaggactctgctaacttctcacttggaacagactgcgtaagagccaggtgggataaggtaaagcaactcagctgctacagggcttttaatggagaacaaagtctatttactgatagtttggctgcactgtggaaaagcctgctggaagtctccctgccgtgggctctcattgccaatatggaacagagcccagggccaggcagactggggcagtgactggaaaaggaaaactaaaggtcagaatccgggatcaggaactgtttttatccagcagtgaagctcttgagctcttaggaaggttcccgtggttggaaagaacataatggttaacaaatatcacagcatccagggattgcccagctatagtgtgggtgccctactgaactctgattagggaacctgtataagggtattgagtgtgaggttgaggtgggacatttgctgagcaaggagaaccgatgtgaatggcaggcagataacatgcacacatgaagctggctgggtgtaaggcagtagcggggagcagcatgctgtctaacagctgttagctccagctggttgttgccatgtgggaatggattttctcatttcttcagagaagctggaaacctagatatttatgtgaaacctcccagtgtattgccaactaaatcaaatttttaaagatgcttaggcacctaagcaaataatacttagaggttgaatttggtctacaggctagcagtttgcagtctatgtttaatgaatggtatagaagtttggggaaaggtgccatctccaagcctagaaaggatacatactacacgcagcgaaaatgccaaccactgatccagaattttcaagatggcacctttccccaaacttctataccattcatt

SEQ ID NO: 268820 - DNA, 1738 bp, Homo sapiens
cttggctcgccccgcccttccttgtaagatggcggcgcccaggtggagcgcgtcgggcccctggatccggggaaacggccaaggttgcgggagtctcttcactctcgtctcaaagccattttgtgccgctgccgctgcctctacggccataaatgcccagagattagcggagaagctccgagcccagaaacgggaacaagacacaaagaaggagccggtgtccacaaacgctgttcagcggagagtgcaagaaatagtgcggttcacacggcagctgcagcgagtccaccccaacgtgcttgctaaggcactgacccgaggaattctccaccaggacaagaaccttgtggtcatcaataagccctacggtctccctgtgcatggtggccctggggtccagctctgcatcactgatgtactacctatcctggcaaagatgcttcatggccacaaggcagagcccttgcatctgtgccaccggctggacaaggaaaccacaggtgtaatggtgttggcttgggacaaggacatggcacatcaagtccaagagttgtttagaacccgtcaggtggtgaagaagtactgggccatcactgtgcatgtccccatgccctcagcaggagtcgtggacatccccattgtggagaaggaggcgcaaggccagcagcaacaccacaagatgacattgtccccgagctaccgcatggacgatgggaaaatggtgaaagtgcggcgcagccggaatgcgcaagttgctgtaactcagtaccaggtgctcagcagcactctctcctccgccctcgtggagctccagcccatcactggaataaaacatcagcttcgagttcacttgtcttttggattggattgtccaatccttggtgatcacaagtactcagactggaataggttggccccccagaagctgtctgtgggcaccctgaagaagctggggctagaacagtcgaaggcccgctacatcccccttcacctgcacgcccggcagctgatcctgcctgccctggggtccgggaaggaggaactcaacttggtctgcaaacttcctcgcttctttgtgcattccctgcaccgcctgcgtttagagatgccaaatgaggatcaaaatgagaacaatgaagccaagtgtctgggagcacagtgaagaccatgggagcaccctggcacctgggagcacagtgaagaccctgagagcatcctggcacctgggagcgcaggttggcccctgaactgttctttgtttacaggactctgctaacttctcacttggaacagactgcgtaagagccaggtgggataaggtaaagcaactcagctgctacagggcttttaatggagaacaaagtctatttactgatagtttggctgcactgtggaaaagcctgctggaagtctccctgccgtgggctctcattgccaatatggaacagagcccagggccaggcagactggggcagtgactggaaaaggaaaactaaaggtcagaatccgggatcaggaactgtttttatccagcagtgaagctcttgagctcttaggaaggttcccgtggttggaaagaacataatggttaacaaatatcacagcatccagggattgcccagctatagtgtgggtgccctactgaactctgattagggaacctgtataagggtattgagtgtgaggttgaggtggactaatacatattcagacgaactcttctctgctgatacctagg

SEQ ID NO: 268821 - DNA, 461 bp, Homo sapiens
accccttcatcactatggcacatctcctgccaaacctttctctaaacatttgtctccatgtgtgtattgttaagttatttaaaaatttatgtttatataaacggtgtattgttgtcaattgctgccatgaacagtgacttgaaataacaaatatttactatctctcacactttctgagagtgagcaatccaagggcactaagctctggggggttctagttcatgatctctcctgaagttgtagtcagggtctaagccaggactacagtcatttggaagcttgactgggactggaggaagtgcttccatcatggctcaccaacacagctgttgcctggagtcttctgtccatcactggctattgacaggaggctgccacatgggcttctccacagggttcctggagtgtccttaaaacacagtagttggcatcctctagagtgagtgatgggagagtaaaag

SEQ ID NO: 268822 - DNA, 181 bp, Homo sapiens
cccttacctgcaatactctttccatatgatgtgatctctgcttccttcagactttactcaaacatctcactctgcgtgaggcctaccctggctgatgtaaaactgctaccctcggctgggagtggtggctcacgcctgtaatcccagcactttgggaggccaaggagggtggatcacttaa

SEQ ID NO: 268823 - DNA, 522 bp, Homo sapiens
aattttagcacatttaaaagaatcctaaatcatgggtttaaaactaatggggttgaacagacatttatttatcctgcaaagcaggccaataaacaattttatgtttccaaatgctaatttggaagtttgaaagtcaaagaatgtattgctaatgttaagtaaaaaggattacatgaagtagatagaaaaacaaatatacgcatgctgaaaaaacattcctccatgatccatgtgatgcccacttttaaaactgaagagaaataacagaaaatattgagcttcagttcttcaattggcacttaaattgcagggtcttgagaggtgagaaaaaggcatgaaacagtctgtgttgcctcagatccttaggtcagaaacaaaattcttatctgaaaacataagttggaatttgtggtccaagagactgtcatgattcacctggcacattggattcatctttttgcttacacttaaatcttttctagtattcgtttaagtcagtaacatattaaggttaaaaaaaaa

SEQ ID NO: 268824 - DNA, 373 bp, Homo sapiens
cccattcccttactgtagttctcccagataattttcattctagcacttttattgtgttttcattatggctcatgatcacacttttaatacaagatgaaaagacttaaatagtcatgcaccacaaaatgacatttttggtcaaggacggacagaacatgtaacagtggtctcataagattatgaaagaactgaaaagtccccgttgcctagtgacgatgatgatcttgatgatcttgaccctatgtagtcctaggctataggctaatgtgcgtttgtatcttaattgcatacgaaaacagcttaaaaaataattttaaaagttaacagaagagtactgataggataaagatataaagaaaatattttcgtacag

SEQ ID NO: 268825 - DNA, 695 bp, Homo sapiens
tttatggttttcatagaatttggaaattggggggcattttttcttctgttatggttttctctctgctcctctcatgcttctcctggggctctgatgacttggatgtacgttaggcccctcagaattttctcccagtgtgctgattctgtgcagctttttaaaaagcctttttctctctgtgtttcatgttgggtactttccagtgctgtgtcctcattgtttattaatctttctgtctaaagtatctaatttccttttaatcgtatccaggtatttttcacctccgacatatttttagtctttagaatttctgtctgggtctttatctcccatgtgtctccttcacatgctcatgccttcctctatttttttttttttcaacatctggagtgtattgataatagctctttcagtgtgcttgcccattctgtcatctgcatcatttctggtctgtttctattgattgattcccaccctaccccaacccccaccctgcccatattggattgtaacttccttcattacatgcctggtaatttctgtttttaatattgggtgctggagttcttttaagtatcttgaactctgtttggggacataaagttacttggaaacaatccgatcattttatagcttgcttttaagcttaataagacaggactgggacagcctttagtttagggctaatttgaccc

SEQ ID NO: 268826 - DNA, 518 bp, Homo sapiens
aaaccatctccatttcccgtttccttcatccttactcgttatgtcaagcctctgcaaactgtggctttcagaacatcccctccagattccactgtttgaggtcttcgccttgccctcttcatttgcatcctgcccactggtgacctatcccctcatgagccatggcaagatccctgtgggtgcccatgtttcactttaggatatggaatgatgcccagcaactattatgggttttgtatcctaacctcaagtctttatcaataaactttattttagtaactgctttaaaatatgcctcacactggttggttctagtcaagtcagaattcttcgtacttcttgtgttttagcatttaaaaatgacctatgctcttccctagaagtcttaaatatcctaatatctaagatagtttaagtacacttttacctggggttggagcttgaacagatacttctcaggcccctcttggagctgactccacacttgcttagtctaagaaccagacctgatgctaatg

SEQ ID NO: 268827 - DNA, 539 bp, Homo sapiens
acatggagactatagttaataacaatgcagtgcctgtagtcccagctattaggaaggctgaggcaggaggatcacttgagcccaggagttccaggctgcagtgacccctggtcacaccactgcactccagcctggctacagagtgagaccctgactccaaaaacaaacaacaatgtgtacttgaaaattgcgaagagagattttaagtgttttcacaagtatgtgaggtcatgcatatgttaatcaacttgatttagccatttcactatacatattttgaacagtatgttgtacgccataaatatatacaatttttgtcaattttaaaaatagatttttaaaaactactggagcatgcatttcccttgccctgcctctccttctgttgaggtaggagtgagaattctgcagccatttcagacactgagagacaagttgtctgtcaagtttgacaaagcagctgtatcggctgtggaccactcacctctgtaatttgagaaataaacttttattgtgttaagccactgtgttttgggtct

SEQ ID NO: 268828 - DNA, 1141 bp, Homo sapiens
gatcattatttaacaatgattaggaaggaaagttgtgacctctgttgctgttacctagggtccagtcttaactgacttgaaaatcaaatctgtggagggtttagtgaacttaaatcatacatcctacctagcctcagagcctctgataggaggtctctgtcgttacatgaggctgtgcatgggaagaggcagctcagcatagtggactgccgagttcaagtttggactccaccagttactaggtgtgtgacttcaactaaataactgtacctctttttttaatttttgtttgtggcggggtctcactctgttgctcaagctggagtgcagtgacatgatcttggctcactgcaacctcctgtctcctgggctcaagggatctgccacctcagcctcctaagtagctgggactacaggcacacaccaccacactgggctggttttttgtagagacagggtttctccatgttgcccaggctggtctccaactcctgggttcaagcaatcctctggccgtggcctcccaaagtgctgagataattggtgtgagcccctgcgccctgcctactgtacctcttagtgctgtcgtttcctcatctgaaaagtaggggtgaagataattgtgtctgtcttatatggttgttatgaggattaagttagttaatatttgtaaagtgcctagtacagtgctctgtaagtttttgttaaatgaaatatttttttaaattcctagggtattgtgcttgcttaagttagcatggggccgattcgggtcattggccaattgccttatagggcgatttcattaatgtgcgcgtttcacaagcgactggaaacctgggtcccaattataccttcgaaaaaccctttcccattggtaatccaaaggccaccgtgcctttcaaattggccctttagccatagaattagcgtattttgtaaaaccgtaaatttgtaaacccttttttcacaggcctatgcaaactctttataaaataccctcctctctttgtccctctagcgccttcagcccccaccatgcgtaactctttctcgggacgcctctgacaccccttatcatcttggcgcgcctcttccatgcctctggtctctctatacatgtacacactatcctctgccg

SEQ ID NO: 268829 - DNA, 227 bp, Homo sapiens
agatagtttggctaagattcatgagtcactactatgttctatttcctttaagtgttgtaatgaggtgcttatttgcatttttaaaatttcttttattattgcctgttagaaatagtctttttttggatgcaggaaaaaaatacatagagctgttttggcctttgagaacaactagccagttaaacttctagttcaccttaaacttcattttggttctgtgtttacag

SEQ ID NO: 268830 - DNA, 612 bp, Homo sapiens
atcacagaccaaatctattagattctcttaaatgcttacaaaagagaacatgtagttctagtaatgacagcaaaactcctgatactcacacttaatataagcatcagtactgtgggtttaattcatttctttgtgaatttctgaatctgttttatatttttccagtgatctagtaatcttaatagatattaaagcacaaacttggtggcttaagacaatagaaatttattctctcacagttctggaggccagaggtccaaagtcaaggtgttggtactgttggttccttctggacactctgagggagaatctgttccctgcccctcttgcagtttctggtggctgccggccatcctcgacattgctaggtttgtggccgcatctctccaggttctgctctgtcttcacgttgccctctcctctgtgggcgttttctcctcttctcctctgaggacacttgtcattggatttagggcccacctcaatccaggatgatgtcatctcaagacttttaactgaattacaccagcagggccgggcacggtggctcatgcctgtaatcccagcactttgggaggccgaggcaagcagatcacttcaggtcaggagttc

SEQ ID NO: 268831 - DNA, 416 bp, Homo sapiens
gttgaaaagcagttcatacaggtattggagccttggagaggttgcttgaagacaggctatatgcagtggatgaagtcacatacacagaaagaatgaacatttcagatggaactagaggacacggggagagaagtgtctaatgagcaaaacaaaagtaacaataatgagatgtgggagaaggggggttgaaagaggaagtgagtagctacagagatccattttagattataacgtgtagatttgcctaccaaaatgaaatagaagacgaccatgttgctgttaaggcattcattaagttagaacttacggctaaatttcttgatcatgtggtcacatattccaacatttctctttgagatacttactgcacaacagagaaatcataagaaagtaccatcagaagtaaatgactgatt

SEQ ID NO: 268832 - DNA, 442 bp, Homo sapiens
acagctctatttggggattgccacaaaccatttcccacaagctgtctgctagaaaactacatcccctggccagaggtgaccaactgggactgggggtggacatttgacatcatcctgaacttcaaagacagaaatttggatacggtgggggactgccttctggcatgcccatagaggaatgtaggaagcttctctgcagagaaatacagtaataaatgcggattgagcaactactgtgtgccaggcactgtgctaggcatgggcaagcctgaaggaaacaaatcaaacaaaatcctcgcattcatgaaactcacatctagtaaaacccaggaaataaaaatgagagggagggagaaaacagaagagcatggcccctgaatgctgtctttgggttctgtgagaaactctaatgattctccaataaacttcctgctttgctcac

SEQ ID NO: 268833 - DNA, 416 bp, Homo sapiens
gaagtctcttctttctggctctctttttctgagtgaggggttattccctgattccctgggctacaaattgttcttcctggctctctataaaaccactctgctctttctcttctctctattggatcctgcttctcccatgggagctctgtcacctgaaacccctcttctcaagtctctgctgactatttccatagctggtagtcacgacgaggagacaactgtgtagggtcaatatttgggccaaccaccctgaggaactgtgagggttagaactggaaattgtcaagagaatccgaacccagctaccatataagagagttcaacttatgttcaatgtgaatgccatggcaatattaaaaggtaagaattcaatccatacgtgcttgaggtaaataggagaaacctagaatttatgt

SEQ ID NO: 268834 - DNA, 232 bp, Homo sapiens
cccctggtgtgaacgatactgccagtgccaggagggcctgactcttcctagagtcctctttgttatcagcatcaccactgaaagatgggctccatgtggccctgccttcccatgagaccagcgggtctgattcctcatgttttgtttaagtgtcagatttgatggactgggggagatggaagcagaactgtgccacactgaaaggtgcctgtagctgatatctgcaaatgta

SEQ ID NO: 268835 - DNA, 443 bp, Homo sapiens
agaggcgagtcagaggtttggtggcattaggccagtttgagcattctgcattcaggtgagcctagcttcaaccccaaccttgtctatcccaccctgactttgatccttaatcccagtgctacttggcccattagacagtgttgttttgcctttaggatgctgaaaaaggatgaaaacagaggctcaaacatgtaaactgtacacaagtcacaaaaggaacaaaagccgttgacccttggattggagacttaacagtgctttctcctgttcttactttcagtctagaaataatttgatcctcctgcatctgactgtgacttaaagtgtagttcttcatgggagtttttaaacgatgtttacacacatgttagcactcattgcactggacttcacttctcccttcttgctaaatgggtgtgaaataaaaatatttttttaaatac

SEQ ID NO: 268836 - DNA, 683 bp, Homo sapiens
atttattctctcatagttctaaaggttagaaggctgaagccaaggtgccagtagagccacgcttcctctaacggctctaggaaagaatctctcctggcctcttccaacttctggtggcccttaacattctttggctatggctgagtaactccagtctctgtctccgtatttacatggccttattctctatactctcatgtgtcaattctaccactactttcttttataaggatgtcagtcactggctttaggacccacctaaatccaggatgatctcatctctaaatctttaattacatctgcaaagtacccattccaaataaggtcacattcacaggtaacttcaaatagatgttatttaacccactacagaccttactttatatacggtatttttaaaataactcaaaaatacatcaaagacctaaacataagagccataaaaaacttagaaggaaacataagggtaaatcttcatgaccttaaacttggcaatagattcttagatatgacaccaaaagcatgagaaacaaaagaaaaatagataaatatgacttcatcaaaagtaaaaacttctgttcctcaaaggacaccatcaaaaaagtaaaaagacaactcacagaatgggaaaaatatttgcccatatctgataagggactgttactagaatatataaaaaaaaa

SEQ ID NO: 268837 - DNA, 586 bp, Homo sapiens
tgctgtgagcatgtgagcctaagtgggtgagcccactcattcattgatttattatttggagccaatatgtgtggatattgaatgtatttgttggctgccacttgagcatttattccttccatttaagccaggcaacataaccattccctctagcagcagagatggtcacaagcccagtcagaaacaatgaacccacaaagactggggctgaggcttccagtaaactgtagcttccttgctcctctagcatggtgtaagtatatgatgcctggaaatgtggcaaccgttttcctcctataaggggaaaccctagagggatgggagtttagagggacagcaacaagtagagcctggggttgaagtcagtactgtcaaatgaatgcgggaaagatggagaagaaccttgtgtttggtggcatgatttgagctgcagtatcaaacctcacctgtttgattctatggactatcctatagactattcgggattgtgagcaaggccatcttacagactatccagaattgtgaaccacaaatttcctgtattgtttaagccagttcatattaaaattctaaaagtcctaactaa

SEQ ID NO: 268838 - DNA, 360 bp, Homo sapiens
tttgaagattacttcaaaattagcttccccccacttccagtaatgtgcttggttacttacgtattgaaagtaaccttgcagacaagttttgaaacacaattttcaaaatgatctaaggaatagttttccccatatatataaattaaatgatttgttaaataatagccatatttgaacagctaagtaaaatgtttgagttttaaaatcttggattaaattgttcaaactggctaggggaagtgggtcacgcctgtaatcccagcactttgagaggctgaggcaggtggatcacctgaggtcaggagctccagaccagtctggctaacatgttaaaaacccgtctctactaaaagtaccaaa

SEQ ID NO: 268839 - DNA, 508 bp, Homo sapiens
gaagctgaagcaactccatcttggaagctaacctgccacattgacttaactgagtgaccccagttccaaggcagggcctctacaatttccagtttatctattgtttcctgtgtaagagcagatacttactgtaagtccgtaagtgctactcgtaggtcaaacaaccttgatgatatcacacttcaattgtcttataaatcccatctgaaccactcctaccctatggtatatgagccctgggtttgggtgctaatgcggggatccaccatctcatctcattgccgcctgagacacctacatggcttctgttggaaagtcccctagctttctcagcctctttcttcaacttctcaacttcctcagactttggggtaggtttgcataggcctgtctactgcagaacaactcctgttctcagggagcttccagtctactgacagagaaagaaaataaaaacggatacgtccagcttctccgggagagtgagacgaatcagtggcgataataa

SEQ ID NO: 268840 - DNA, 405 bp, Homo sapiens
gtgcatttacaatcctttagctagacagaaaagttctccaagtccccaccccacccagaaacccaggcgacttcacctgtcaagctgagctgagctcttgatttttctcccactggaaggtcaacattgttcgggattcctcatcttgccgtggctctgagttggctaaatacgctgtaattgattttctgagcgaacctctgcatgttcctacgacattttgtgatcttccaagtgaacaacctgacagtgccaacatttatactgaagtaaaagaactcctgaaaattctcatataaatgtcagcaatattgtggaagtttgaccactttcatgagtccatacattggaaatcaaagtaataaggaaatatcttaactctattaaaatcattttttctccttt

SEQ ID NO: 268841 - DNA, 570 bp, Homo sapiens
tattagtgcagtctagaacgaccatgacagctatatcctcttcaagtcattgtacatcttcaatagacggtaagcatgtggatgtagtcagtgatcaggcagcccttcaactttcaccaaaagggaagttgtcggaatccccaaaagaagagtccttggaggagccctccatgcgccagagcagccccgcagagactgttgattaacccagcagaagcctgggctgcgcagacggggcctcagaaagagtggcctcgccgtcctggtgtaaggtgcctccctcggaaaggatactatctccaaggattttctaaactaattgtttaatctctccagattatgtatattaaccagcactgcgctcgaatagacctcaatgcgcgccttgtgcgcgctcctttccacgcctttaaggaaagccctggctggtgctgggtgagcggggcgcactgaacctccggggcaaccacatccattcaggagctccggggactcagaagagcccaggcgtctaagagtgggaagggacggactttaattaaaaagtttgactccctctctaatccagtc

SEQ ID NO: 268842 - DNA, 501 bp, Homo sapiens
agtttacctatgctctgggtagcactgactggtactaatttctgtattacttagagttttgtttacaaataccaaaaactaagtgtacttaaatattataacatttttagaaagacttattgcagaacaccagaacatcacacaaagccccttgctcagtggcttggggtttaatactctgtagccaccagcttgaaattcttcattttatctattaatttgtgttgcaagagaagtcccatgtgtcaagggatcaggtgccacggacttggagctgtggctcacaggtattgaatgaatgagcaatgtgcgaatgctgagtgttcaatcttttgggtagcccctgcattcatccaatctggagaaatattattttgtggtctaaggaggctaaagtagatccacctgtgcctggaggcacacacgcttctcaacagaaagcaatcgtgttctgccacctccatcattccttccctttgcagggtcgtgcctgaagttttg

SEQ ID NO: 268843 - DNA, 501 bp, Homo sapiens
atcaagcagaggagacatgtttctcggcttcccctctctgggacttaatagcctctgaaggctagcctttactgactcatgaagctgtgtctgcctggggtcagtggtggagacattgcgttaaccccagcaagcgagccatcaccagagctttgcacagggagacaccacatagaaaggcagatgaggcaacacacacaccatccccagacagccatgggtccccagagacaggaaaaatatgtgttttcttaaagaattagaaaagaaaaccttgctttttcctgtgtggctcattggtaggagatctcaaattctaacccttgttttctcttttacctctctgtctgctaaaaagcactccttagatccagtatctagcatggtgagcctcctggattcagtgctgcagtggccactgctgggtcaaaaacaaacactgggaaaggaggaaaatgatgtttttctctctttcaataaagcatttgaaatctctaattc

SEQ ID NO: 268844 - DNA, 406 bp, Homo sapiens
tctgcctcccaggttcaagcaatgtatgttcactgcagcactattcacaatagcaaagacattatacactccacctctcaggttcaagcaattcgtgtgcctcagcctcctgagtagctgggattacaggccccgccatcacacctggctaatttttgcatttttagtagaggctaaaataaaaatgtatcattaacaatccaacatataaaactagtgccaagtctaagtgagaacaattccacctaatagcgcttgtaaatctccatgcaggcaaagcacaagggaagggactaacaagtccttgaaacggaaacagaaaaaaagctattctcaattggaaaaataatttatatgcattaagtggcaaaacaacaaaccttaattttttatataatggaaaaac

SEQ ID NO: 268845 - DNA, 345 bp, Homo sapiens
gactctgagggtgacagggtcctaggagagtggatgggtggggagcaccctgtggtctcagctgctggggctgctgaggggctaggccttctccttggttatagaaaacatcacttctggggcattgtgagttggactctggtgaccctgacagctgacccctggaacctacatcagagaggttttccttgggggaaaatctcagtctccggcagactgatggtattgctgcctcagcaccatcagtagcaagctgaactgagtttcagctcctcctgagttttctagatcattcccatgttctgctccctgtacctctatcaccatcacttgtgggtaagaaag

SEQ ID NO: 268846 - DNA, 500 bp, Homo sapiens
cagatgaagagagaaatgatggaccagatcttactgaactgaattaaaacctgaaatttaagattgaaaggacacatagagtctcagactagattgatgaaaaaagacacacacatatcctgataaaatctcttactgataaaagaaaaaagcataggaggttgacggggaggatcacttgggtccaggagttcaggaccagcctgggcaacatagcgagatcctgtctctaaaaattaaaattaaaaaaatcagtcagatgggcatagtggtgcatggctatagtcccagctactcaggaggctgaggaggaaggattttttaagctcagcagttcgagtccgtggtgtgctatggttgcaccattgcactccagactgggcaacaccaatctgtctcttaaaaaaaaaatgctttgggaggccaaggcaagaggatggcttgaggccaggaattcgagaccagcctgggaagcataacaagaccctacccctacaaaa

SEQ ID NO: 268847 - DNA, 131 bp, Homo sapiens
tgctgggattacagtcatgagccactgcgcccggcctgtgatgtcatttctaattctaatacatttctccttctggcttcatgattctagacttagtttcaattaactgtatgttcacatcttctcaccta

SEQ ID NO: 268848 - DNA, 312 bp, Homo sapiens
agagccagagtaaacatccactggaggttccgtttaaggccaactcattagaattttaaccaatttgcaagaataatctcaattagcagagctcattagactttaattggactttaagctcttcctttaacctggtagccttggtggggctcctgaggattcgttgctgggggtggatgtctacatggatgtatacgtgtgggcatgccaaagagttaattttcccacagcagggtggagtaatccaaagaaaacaaacaaggaatcagactgtcttgacaaaggcactacatgattgtaaaaggcaacagg

SEQ ID NO: 268849 - DNA, 1214 bp, Homo sapiens
ccacgtaagaagtgcctttcgcctcccgccatgattctgaggcctccctagccatgtggacctgtcttctttctgaaaccagcccaacttttctcccagagagtatcatggaactgaactttcaagatcatggcatctggacatcgagaaaacggaaccctcatctggccacctgctgctttttgaccaattcccatataaaccgctaacttcagtcagttggagggatggatttgagatttgccttctgtctctcaggtgatgtcaccagcaataaagccttcttccctggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaaaaaaaaaaaagaagagagcgggcgcggcgagcgacgccaagactctcccccgaggaggcggaacccaatccaccacacaccccccaatatttagaaaacaaaggaggcgccccacaagagagagagcaacaaaaaaagaagagcgaacagcgctactaaaacaaaacacgccccgggcgaacacacacaccaccacagtagagacacaacatagagagaagacacaccctaacagtgtggtgatgaaaaaaactaggacagcaaacacacaccaacaaagaacacacaccaccacaagaagaaataacaaacataactaagccgctgagagatacaagatagaagaagcaccccacacacagcacaagcacttccggcgcaaaagaatacacgcacgcgcacggtacgagtcagaaaaaacaattactagcgggggaagaaacataacaaacaacagcaagcacagtgagggcaaggcgagacaggcacggacgcgacggggagtaggaggaaaagaagaggcagcgcgaagcaaacaaaggaggagatagagagagaagacgacaaccacaccgagagaaaaaaaacaacgcagaaagtcgagatacacaagggcggggaaagccagaccgaccaaccgacccggaggacaaggacaaaccagccagaaaaagacgagcagaagcgcaccaaagccataacacaaagagatagaatgaatgcagtagagctcagaagaagagagacgaaagacagaaaacgagcagaccgtgagagaatgaggtaccgcctcacactacag

SEQ ID NO: 268850 - DNA, 465 bp, Homo sapiens
ccacgtaagaagtgcctttcgcctcccgccatgattctgaggcctccctagccatgtggacctgtcgtcgctgccctcagcctccagatgcagcccccctgccaccttcaggacccctggctctcccctggactcagtagcgaaagggtttatgtgctcggagggagaccttcaggaatctgtgcatagaatgccatagtgcagaggaaagtcttctttctgaaaccagcccaacttttctcccagagagtatcatggaactgaactttcaagatcatggcatctggacatcgagaaaacggaaccctcatctggccacctgctgctttttgaccaattcccatataaaccgctaacttcagtcagttggagggatggatttgagatttgccttctgtctctcaggtgatgtcaccagcaataaagccttcttccctggcaagacaaaaaagaaacacaaaaaaa

SEQ ID NO: 268851 - DNA, 442 bp, Homo sapiens
ccacgtaagaagtgcctttcgcctcccgccatgattctgaggcctccctagccatgtggacctgtcgtcgctgccctcagcctccagatgcagcccccctgccaccttcaggacccctggctctcccctggactcagtagcgaaagggtttatgtgctcggagggagaccttcaggaatctgtgcatagaatgccatagtgcagaggaaagtcttctttctgaaaccagcccaacttttctcccagagagtatcatggaactgaactttcaagatcatggcatctggacatcgagaaaacggaaccctcatctggccacctgctgctttttgaccaattcccatataaaccgctaacttcagtcagttggagggatggatttgagatttgccttctgtctctcaggtgatgtcaccagcaataaagccttcttccctggcaa

SEQ ID NO: 268852 - DNA, 692 bp, Homo sapiens
ccacgtaagaagtgcctttcgcctcccgccatgattctgaggcctccctagccatgtggacctgtcgtcgctgccctcagcctccagatgcagcccccctgccaccttcaggacccctggctctcccctggactcagtagcgaaagggtttatgtgctcggagggagaccttcaggaatctgtgcatagaatgccatagtgcagaggaaacagccccagaaaatggaacagctgctaagtgagactcctcagccaggccagagaatgtgcattctgacggactgcttctcatttgcactgatcactgtgagtgtctgatgggtgggcatccggcgcccagagaaggagttgctctattatcctggcactccataaagaacaggtagaaataagcgcttcttaccaagatgaaatccacccatcatttctgaatggctcagttttgatttcatctcccaaggtcttctttctgaaaccagcccaacttttctcccagagagtatcatggaactgaactttcaagatcatggcatctggacatcgagaaaacggaaccctcatctggccacctgctgctttttgaccaattcccatataaaccgctaacttcagtcagttggagggatggatttgagatttgccttctgtctctcaggtgatgtcaccagcaataaagccttcttccctggcaa

SEQ ID NO: 268853 - DNA, 1611 bp, Homo sapiens
ccacgtaagaagtgcctttcgcctcccgccatgattctgaggcctccctagccatgtggacctgtcgtcgctgccctcagcctccagatgcagcccccctgccaccttcaggacccctggctctcccctggactcagtagcgaaagggtttatgtgctcggagggagaccttcaggaatctgtgcatagaatgccatagtgcagaggaaacagccccagaaaatggaacagctgctaagtgagactcctcagccaggccagagaatgtgcattctgacggactgcttctcatttgcactgatcactgtgagtgtctgatgggtgggcatccggcgcccagagaaggagttgctctattatcctggcactccataaagaacaggtagaaataagcgcttcttaccaagatgaaatccacccatcatttctgaatggctcagttttgatttcatctcccaaggtcttctttctgaaaccagcccaacttttctcccagagagtatcatggaactgaactttcaagatcatggcatctggacatcgagaaaacggaaccctcatctggccacctgctgctttttgaccaattcccatataaaccgctaacttcagtcagttggagggatggatttgagatttgccttctgtctctcaggtgatgtcaccagcaataaagccttcttccctggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaaaaaaaaaaaagaagagagcgggcgcggcgagcgacgccaagactctcccccgaggaggcggaacccaatccaccacacaccccccaatatttagaaaacaaaggaggcgccccacaagagagagagcaacaaaaaaagaagagcgaacagcgctactaaaacaaaacacgccccgggcgaacacacacaccaccacagtagagacacaacatagagagaagacacaccctaacagtgtggtgatgaaaaaaactaggacagcaaacacacaccaacaaagaacacacaccaccacaagaagaaataacaaacataactaagccgctgagagatacaagatagaagaagcaccccacacacagcacaagcacttccggcgcaaaagaatacacgcacgcgcacggtacgagtcagaaaaaacaattactagcgggggaagaaacataacaaacaacagcaagcacagtgagggcaaggcgagacaggcacggacgcgacggggagtaggaggaaaagaagaggcagcgcgaagcaaacaaaggaggagatagagagagaagacgacaaccacaccgagagaaaaaaaacaacgcagaaagtcgagatacacaagggcggggaaagccagaccgaccaaccgacccggaggacaaggacaaaccagccagaaaaagacgagcagaagcgcaccaaagccataacacaaagagatagaatgaatgcagtagagctcagaagaagagagacgaaagacagaaaacgagcagaccgtgagagaatgaggtaccgcctcacactacag

SEQ ID NO: 268854 - DNA, 656 bp, Homo sapiens
ccacgtaagaagtgcctttcgcctcccgccatgattctgaggcctccctagccatgtggacctgtcgtcgctgccctcagcctccagatgcagcccccctgccaccttcaggacccctggctctcccctggactcagtagcgaaagggtttatgtgctcggagggagaccttcaggaatctgtgcatagaatgccatagtgcagaggaaacagccccagaaaatggaacagctgctaagtgagactcctcagccaggccagagaatgtgcattctgacggactgcttctcatttgcactgatcactgtgagtgtctgatgggtgggcatccggcgcccagagaaggagttgctctattatcctggcactccataaagaacaggtagaaataagcgcttcttaccaagatgaaatccacccatcatttctgaatggctcagttttgatttcatctcccaagagagtatcatggaactgaactttcaagatcatggcatctggacatcgagaaaacggaaccctcatctggccacctgctgctttttgaccaattcccatataaaccgctaacttcagtcagttggagggatggatttgagatttgccttctgtctctcaggtgatgtcaccagcaataaagccttcttccctggcaa

SEQ ID NO: 268855 - DNA, 384 bp, Homo sapiens
ccactttgattctactgtgtgaagtgtcccatagtcccaaggtcttgcaatctttgtgctattgctattgagggcagatgctgtaatgatgtattaattgacatagttttcttttttcttctgagccaaatgtttttacttctactctaaaggtcttctttctgaaaccagcccaacttttctcccagagagtatcatggaactgaactttcaagatcatggcatctggacatcgagaaaacggaaccctcatctggccacctgctgctttttgaccaattcccatataaaccgctaacttcagtcagttggagggatggatttgagatttgccttctgtctctcaggtgatgtcaccagcaataaagccttcttccctggcaa

SEQ ID NO: 268856 - DNA, 148 bp, Homo sapiens
aaatgagcatttatataggtttataagtaccatctttattttagaaaataatcattttctaccttgaattctagtttattgtgaccaaagattgtaaaatttcaggatatggctgaattaaaatcttggtcctgcacttaagtagctc

SEQ ID NO: 268857 - DNA, 319 bp, Homo sapiens
tgaaaggtgtggcggggaatgggggctgtaattcagacttaactgtttgattgatcttctcggactcctcaaggttatcagagtaaaaaaaggaatatgtacaggacattgctttcatgaagtgtctgtcacagtccacaaaacctcggcttggattgtgaaagcagattgttttctgtctcctaggggactgtctattgtgttaatttccagatatggatatgactgtgccatctagcacctaacggaacttcttttttatctgttaatgatggaacacttcaaaattgcaagaaaataaaccctttgagtaaacact

SEQ ID NO: 268858 - DNA, 969 bp, Homo sapiens
atccataatagcaagtttcagtggatttcagaagcccctaaggcagaaaagcaaaagcaccttattttttgtccacttgacctgtgtcttatgttggactgaaatgtaggtctcctaattttagtgtagttttgtatatttctccctatatatctttaactttctgatatataaaggtagctgaaatacaacatcataatttttactggaaaatagccacaatgaaggaacaccacaatttcaccatgaaaaccagcacaaccttacacagatgacaaacatttcccctcaaaacttgttaaactgtatttgggctgaccaaattaaccagagttattctatttatgggggagcaggaagtaacttgataaaatgctttgagtttatatatcatgtcaaataaatagcataattttaaaggaaaaaaacttgttaggcaatgctctcttattttctgacatcacatattgtgacagaatgtaaggccaacctggtttttacaaattccgtggtctaatttttttgttgttgttagtgtataataatagcattgacttaaaattttttaaatttcttttatttagttaattaatttattttgagacagagtctcgctctgtcacccaggctggagtacagtggcacaatctcgacggactgcaatctccgcttcctggattcaagcgattctccttcctcagcctcccgagtagctgggactataggcgtgtgctaccacgcctggctaatttttgtatttttagtagagaggggatttcaccattttggtcaggctggtctcaaactcctgaccacaggtgatctggctgcctcatcctcccaaagtgctgggattacaggcctgagccaccgcactcagctgagtttttttttaatgaatgtactcctggttgtttttttgttgttgttgagacagagtctcgctttgtcgcccaggctggagtgcag

SEQ ID NO: 268859 - DNA, 1062 bp, Homo sapiens
atccataatagcaagtttcagtggatttcagaagcccctaaggcagaaaagcaaaagcaccttattttttgtccacttgacctgtgtcttatgttggactgaaatgtaggtctcctaattttagtgtagttttgtatatttctccctatatatctttaactttctgatatataaagatgtgaatcatgttttttgtttcttgatctctgcggttttttcaagtacgcgtattcattttgtgaaaattcaatgagctctacactttatatgtagctgaaatacaacatcataatttttactggaaaatagccacaatgaaggaacaccacaatttcaccatgaaaaccagcacaaccttacacagatgacaaacatttcccctcaaaacttgttaaactgtatttgggctgaccaaattaaccagagttattctatttatgggggagcaggaagtaacttgataaaatgctttgagtttatatatcatgtcaaataaatagcataattttaaaggaaaaaaacttgttaggcaatgctctcttattttctgacatcacatattgtgacagaatgtaaggccaacctggtttttacaaattccgtggtctaatttttttgttgttgttagtgtataataatagcattgacttaaaattttttaaatttcttttatttagttaattaatttattttgagacagagtctcgctctgtcacccaggctggagtacagtggcacaatctcgacggactgcaatctccgcttcctggattcaagcgattctccttcctcagcctcccgagtagctgggactataggcgtgtgctaccacgcctggctaatttttgtatttttagtagagaggggatttcaccattttggtcaggctggtctcaaactcctgaccacaggtgatctggctgcctcatcctcccaaagtgctgggattacaggcctgagccaccgcactcagctgagtttttttttaatgaatgtactcctggttgtttttttgttgttgttgagacagagtctcgctttgtcgcccaggctggagtgcag

SEQ ID NO: 268860 - DNA, 296 bp, Homo sapiens
ggcgagcgtttgtagtcccagctactcgggaggctgaggcaggagaatggcatgaacccgggaggcggagcttgcagggagccgagatcgcgccactgcactccagcctgggggacagagcaagactccgtctcaaaaaaaaaaaaaaaaaaaaaaattaattaaaaaaaaataaagtgttcagcgggtgctcacttcagtggtacatatactaaaattggaccaatacagagaagattagcatggcccctgcacaagggtgacatgcagattcgttaagtgttttatatttttaa

SEQ ID NO: 268861 - DNA, 406 bp, Homo sapiens
cacaaattctttaacccttctcccatctaaagatggaagctatttctctttctcttaaatatgggtaggacttagtgttatgtattataacaaacataatggggcagaaatgatactctgtgactcccaaggttataaaaagcatgaagtttctgcctggccctctttcaggagcctggcccttggacagccaccatactctgcagaagcccaggctgcgtggagaggctgacgctggtgtctggccaactgtccctgctgggccttcagcctgtagtcagcatcaacagtcaggcgtgtgagtgaatgagtcttcagataatgccagccccagcctttgcttcttccagccatgaccccagacatagtggagcaaggacaagccatcctcactgtgatgtgccct

SEQ ID NO: 268862 - DNA, 1116 bp, Homo sapiens
tctactccatatctctgaacagctggtgtctttcagtgcctaaactcaatcagaatcctgggagcaaaagtagctctccagtgcagtccatgcaggttaattcttgcaacatagaggtgactgaagcatggtaagcagatctagaaaggcaaacatctctagcagatctagagaggctagccaatgttagctagcagtgtctttatgttgataaacctattcagaatgttaactttgtttgttggtttgtttgtccatttttgtctcccaggctggagtgcagtggtgcgatctcggctcactgcaacctccagtaattctcccgcctcagtctttccagcagctgggattacaggctccccatcgccacacccagaattttttgtagagacggggtttcgccatgttgcccgggctgctctcaaactcccgatttcttagtctgaccaagtcagggtttagctatttcttagcgtagcaagttgagatttattccagtttcgatttctagttgtaacaatgctggctttaaccgtgcctacgtagtcgttgcaagttcctgttttgtaataggaacccccattatagccgttcgtacggtttttaagtcttgtagaaatctgggtactggagaatgtaattaaaaaaaaaatttagcagtgcctgaaatcttttagtcataccaagtgtgatttcacaatagagattctcgccctggctgtgcttgtgatttttcactcatgcagaagttgaggtgtctaggctacaggaactttttggtgtcgcaaataccggtttagccatggctgtttcttcttaatccgaggaattttcgaataggcgcaagaggcacaggtttagtgctaatacaaatatagccgtaggatcgcatcgttcaacactgcaatttctttgtagggttatttgtatgttttgtatactcaaaaaaattttttttgatgtgtctttttctgggagcgaggttactggtgtattttattttcatttctgtttgctttaaaaatttattttattttttatgtaaatgttatgtattttattttttcttacccactgccttccccaggagagtaaatgtggcataatttcttctac

SEQ ID NO: 268863 - DNA, 814 bp, Homo sapiens
cagaattgatctcggtggcagcacctctggtgggtcaagcctgcagcttctcctgagcagtttcgttagtttttgggtcctagaaccgctagtggtaccatagcggctcttcatgggttgcaggacgtttgccaactccaccccacgctgcctgcctaggttcggctacggggcaaaaagaacagactcctgcaaaggaagaaccccgagggttggatatttaggaaagacgtcctttgcagtgccacgtccgcggatgctgcacttggctttctcctccctcctggggaagaattgatgtttacttctccccactctccgggccgcattatccagggatttcggggactagattacctgagattttagcgcttctactggatcatccttttggaaataattatcacttacaataatgtctatccgggccgggtgcggtggctcacacctgtaatcccagcactttggaaggccgaggagggtggatcacgaggtcaggagatcgagaccaccctggccaacatggtgaaacctcgtctctactaacagtacaaaaattagccgggcgtggtggcgcgcgcctgtagtccgagctacttgggaggttaaggcaggagaatagcttgaaccgggaggactgcagtgagccgagatcctgccactgcactccagcctggcaacagagcaagactccgtctcaataataataataataataatgtctatccatgttctttaaaaaagtttgccttcactattctttatcaacgtttggttgtctttctcaataaaataatagagaaacatcaaatgc

SEQ ID NO: 268864 - DNA, 399 bp, Homo sapiens
tctactccatatctctgaacagctggtgtctttcagtgcctaaactcaatcagaatcctgggagcaaaagtagctctccagtgcagtccatgcaggttaattcttgcaacatagaggtgactgaagcatggtaagcagatctagaaaggcaaacatctctagcagatctagagaggctagccaatgttagctagcagtgtctttatgttgataaacctattcagaatgttaactttgtttgttggtttgttttccagcctggcaacagagcaagactccgtctcaataataataataataataatgtctatccatgttctttaaaaaagtttgccttcactattctttatcaacgtttggttgtctttctcaataaaataatagagaaacatcaaatgc

SEQ ID NO: 268865 - DNA, 1107 bp, Homo sapiens
  misc_feature (1077)..(1077): n is a, c, g, or t
caatttcgactgtgaagattcaggacacctgactgatagtgaatgtaatcagaaacacacatccaagaaagggtcactgatagagcgcaagaggagctctggtcgggttaggaggaaaggcgatgagccccaggcctcgggataccacagtgaaggagaaacactgaaagagaagcaggctcctagaaatgcctccaaaccatccagcagcaccaacaggctgagagattttaaagagacagtcagcaatatgatccataacagaccatccctggcttctcagaccaatgtaggctctcactgcaggggcagaggaggagaccagcctgacaaaaaaacctcctaggaccctgcctttacactctcgtgactgggaaatagagagtaccagcagtgagtcaaaatccagttcttccagcaagtatcgtcccacatggagacccaaacgagaatctctgaatattgacagtatctttagtaaggacaaaaggaagcactgtggctatacccagcttagccccttttctgaggattcagctaaagaatttataccagatgaaccaagcaagccaccttcttacgacattaaatttggtggaccaagcccccagtacaagcgctggggcccagcacggccaggctctcaccttttagagcagcacccccgactaatccagcgaatggaatctggctatgaaagcagtgagaggaacagcagcagccctgtcagcctggatgcagccctgcctgagagctcaaatgtctacagggatccaagtgctaagagatcagctgggttggttccttcctggcgtcatatcccaaagtcgcacagcagtagcatcctggaggtagactccacagcatccatgggtggctggacaaagagtcagcctttctctggtgaggagatatcttctaaaagtgaactggatgaattgcaggaagaggtggccaggagggcgcaggaacaggaacttcgaagaaaacgggagaaggagttagaggcagcgaaagggtttaaccctcatcctagccgcttcatggacttggatgaactgcagaatcaggggaggngtgacggctttgagaggtccctgcaagagg

SEQ ID NO: 268866 - DNA, 375 bp, Homo sapiens
tccaaaccgtacgtgaaagctttaccctttgtccttttggtggtggttgtttgtttctgtgttttattaccgcttcctaaattctaaggaaaaaattcacatcttagtgatagatggaaattgcttaaatatcagaaaggatccagatcaagcacttttctagtcatgctgtaatacaaaagttatataaagatgatttatgtctttagtaaaggaaaaagtaggacactggctaaggctgcctccctcttgtacattccaacatcggaaatggtcctaccacaaagcaaactaagcctaatgtaattagactgcatccccaaaatgtcacagtgaattgactaaggcaaaatatttgagacaagttatacaagc

SEQ ID NO: 268867 - DNA, 849 bp, Homo sapiens
ataaatactatcatataaacgaaatatactaataaaaacttagctggggaacctttaacaccatttttatgtaaatatttctcaactttcagtagagtaaaaattaaaacacatttttaattgaaattaaatttgaggctgggcctggtggctcacttctgtaattccagcactgtgggaggctaaggcaggcagatcacttgaggtcaggagtttaagaacagcctggccaacatggtgaaaacctgtctctactaaaaatacaaaaattagccaggcatggtggtgggtgcctgtaagtaattccagctacttgggaggatgaggcaggaaaatcacttgaacctgggaggtggaggctgcagtgagctgagatcatgccactgcactccaggctgggcgacagtgagactctgtcttaaaaaaaaaaaagtgttgaatcagttttgtcctttaagtgttacaaagctgaaagccaaatgtcagcccagctcttcaaggcaatgcattttgtgtacttattcctgtctttagctcactttccttaattttcttattttaaatatatataggtataagtatatatttgacatggttgcaagacccccatttctcattctcagttctcctttatttttctccttaacatttcactctacctaacatactatagattttactcatctgttttgtatctttcttttctcactagaatgtaaactccataggaacaagaatgttcttctgttttgttcactgctgtttccctgcagtctagaataggactaggtatatagtattcaatacattgttgttaaattaatgaatcctaaataaatatatttgtct

SEQ ID NO: 268868 - DNA, 391 bp, Homo sapiens
accaagtggaaattatagaactgaagaatttaataatttttttaatgctggcagatgtgcttaaaagtagactggagatgacagagggtaacatcagtgtatttgaaaaaagatcaaaagattcactcaatctgaacaaaagaaagaaagactggggaaaaaaagtgtagagcctttgggcttgtgggataataacaaaaattccagcatttgtatcattggaattgcagaagaaaagaatgagagtggaactgaaagaatatttaaagaaataatagctgaaaactccccaaattggtaaaagacataaacctagaaactcaagaagcttagagaatcccaaataggataaatccaatgaaatcaacataaaaacacatcataatttaga

SEQ ID NO: 268869 - DNA, 432 bp, Homo sapiens
gaaaataaaacaacttttatggattttaagaaagagagtaaaatgatcagatgtctattttagaccaatcactattgcagctgggagagaatgaattagagaaggattcctgcaaaggtagcaaagagaggtttgctgtaagatgcgtgtttgggctggccatgctggctcatgcctgtaatcccagcactttgggaggccaaggtgggtggatcaattgaggtcaggagttcgagaccagcctgaccaacatggtgaaaccccaactctactaaaaatacaaaaattagctgggtgtggtgatgtgtgcccataattccagctactcaggaggctgaggcaggagaattgcttgaaccgggaagcagaggttgcagtgagctgagatcatgccactgcactccagcctgggccacagagtgagactccatc

SEQ ID NO: 268870 - DNA, 462 bp, Homo sapiens
ggcaaggattaaaagtggaatctgaacaggaatcactatttcaaaaagaacaaattagaaaatatgaataaacaggtgaactacatgagcccttccattcagaatagcatggcgggtaagcatgggctctggagtcagacttctctgagttccaatcttggctcttttgctaacttcctttgtaattaaacaaggtcgtaacactttccacctctcagctttttcatgtgtgagatgagatcatgatagcagctgtgtccttgggtggtggtgagaattaaatgggaaatcgcctttaaagcactgaactgagcacacagtaaacatttaataaacgttagttcctattattcctaaaataatactattcatttagaatcacttattagtaatcaatgctaacttgaccttaacgattaaaataaagataaaaattcatgggctatcgaaacctataatgtg

SEQ ID NO: 268871 - DNA, 780 bp, Homo sapiens
actccgggttttcgcagtggctcggtggcctaccccgatcgaaaccgtgaggcttttgctgagggagggcaatgggagaggggaggatggacgcagagtttagaagtagtttgccgaggtgcagtcgcacgaatggatttcatcctcactggtgtatttaatagtttgtaatctaccaaacagcaactgccagaagccagtcccagctaacctactggcgtgcacgaaagaacccagcgatgctgatctcgtttcgttatttttctgacttaaacggttaaatctaaacgcgattactaagaaaaaaaattttatacctatcattgtacacagaaaaaaaatagaaaaatgtttatataagcgtaaagctggtaggacaggaaaggaagccgaaacaaaaagtaaagaaaaatccacaaggacaacttttggagctagtgcctgagattttggatttctgagtcccaggaggtgctgatatcatttatctgcggactcgtattatgaagcgcaaggtcctagagcgtgtgattttacaggcataaggaatataagatgaaggctgagacaaaataggatgggtggcctaattttcttcccccaccctctcgtccctcccatacacatacaacctgacaactaaaagggccgcactccatggaagaactcctgcagagttggactccccaccggcaaacaggaggaggctatgaagaaacttgcctgtctccgattttcttgggaattgaaaaaataaaatttttaagcctttcatgaaaa

SEQ ID NO: 268872 - DNA, 406 bp, Homo sapiens
tgagacggagtttcgttcttgttgcccaggcaataagagtacagtggtgcgatctcagctcactgcaacctccacctcccaggttcaagcaattcgcctgcctcagcctcccaagtagctaggattacaggcatgccccaccacacccggctaattttgtatttttagcagagaagggggttccaccatgttggccaggctggtcttgaactcctgacctcacatgatccacccacctcagcctcctaaagtgctgggattacaggcgtgagccatcacacccggcctcttttttacttatattctagacagtacagctgctgatcaaatgggttcagagcgggagacggcggagtaccatagggcctagacaaccacacaacagtctttgagattagctactact

SEQ ID NO: 268873 - DNA, 293 bp, Homo sapiens
gaaacagaatgagggacagggtgaaatctcacctcctcttccacctaagactggcacctctgctatcttggcctccttcaggaaggctttctggagactgaagcggacggggcaggtttgggaccttaccctcgattcttgcagcctggcaagaaccctgccttcatggcaggtccagtccatttgcagctttgccctccccatctcagtggctttcttttccgccagggtccctctcatatctgcagggcctcagaaaattaagaaataaaagccctttctcatcagatccg

SEQ ID NO: 268874 - DNA, 403 bp, Homo sapiens
agaagagagaaacatacaaagaggcaggcgttggctcaatgaatggaaggaaggactttcttgaccgttttatcagaatcgcaaattatcaggattaggaatgacctgggagttcaacccacctctgaggcttgaaccccgcttctaagaactctgtttagaaacctccagcagtggagcactctccatgtatggagcaacctcttccatttcctaaaagttctgatggcctaattcacacggaattgcacggcagcctttacttatgctccggggggtgatgttttaggggttagatccctgcaagtgcagcttaggtgatagcgtcaagagtgatctctagaccttactgttctgaaaagtattttagtctgctgctcattctcactggctgtgtttcttt

SEQ ID NO: 268875 - DNA, 156 bp, Homo sapiens
gcccgtgtagctaactgcattgatgttgcctcccgctggcgcctccctaagtccaccttcccttgaaatgttaagcttgttgggtcttaccaagtatggatgggtttgtgtagacctgaaactctcctgtactgctgttgggaacataaaatggtg

SEQ ID NO: 268876 - DNA, 353 bp, Homo sapiens
caaagccagccacagctaccccaggatccgattctagaggtaagaaaactttttcctgcaacagctgaaagagtccacttattgtacaaaatgatgcagagttggctgcatcaaaactgacacctgtttgggaggccgaggcgggaagatcacttgagcccgggagttcaagaccagcctggacaacatggtgaaaccccctctctacaaaaaagttaaaaaaaaaaattagccaggtgtggtggtgcatgcctgtggtcccagctactcaggaggctgaggtaggaggatcgtttgagcccaggagttttgaggctgcagtgagtctgggccacagagagacactgtcttta

SEQ ID NO: 268877 - DNA, 523 bp, Homo sapiens
gctttcttcccaggacccacaggctgccatgggattgaaagcatgtggaggtgggaaaggtgacagagtagcatgcctccaaggcccccttcatcccagtcctgctgtggggaaagtgggctttgaacgggatccaagtctaagatgtttccggtgagctgccagggacaaagggctctcagacatcttgggtccccagtggctggggtgggcaggggctgattcagccaaaggaggctctagcccagaacagaggaagccagagcccctgccccattcttgagcctcacagagcttgtccccgagttgattcactgtgcaacacaggcttcagattcatgtatttgaaaggtattcatgatgttgttctcttatcacctctgcccctcacctctgtgaattatcatgaagagtcctttaagagtataaatagaagacaaagaaagatgctattaatgttattttgccaaaaatatttttgtagcataatatattaataaaagatattatgaattcaaaaaat

SEQ ID NO: 268878 - DNA, 493 bp, Homo sapiens
cgctttcctttgcatgcctatctcttagaatattaatcccataaattataatttccccaaagagacactgatcttcaagggtatgactgtgtttttcttattacttaatacctagaactgtattttgcacatattagaaacttgacaaaattaagaaacccaaaggacattcaaattctttctcccaatttaaaaattatgggtacagggacaagagtggagttggaaaacgtcagtcaccctaataaacaaggcacatttaataaacaggatacgcatctctattttcttccccatccccagataattgtttttgagtgatgaaccaaaaaaaaaaaaacctaataaatgcacaagtttataatttgagaaactagcgtgacaaaaatgaggtcatcccatggatgtcataaaataagcatgactttcttctctcaattcttttacttattgcccatataattaaatacagttgtaatttaattctgttggc

SEQ ID NO: 268879 - DNA, 467 bp, Homo sapiens
atttggctttacccttaactttcgctttttgacaacaaaaatatctcctgatgttgattcagcatttatttttactactttgaaagcagttggggctgaattttgtattaaaaaagtgatgatttagtagcactggctggagctatatactgtgcaggaagattctgtgcaaacctctgcatagttctgccaatgcaccgccatgctggcctgtagcatcccttattattccatagctgtgtctttttgagcacagaaaaacagaaaacaccaccaccaacagacaaaccaaacctcgtgtgatttgatatgattggcaatatctctaaaatcaatgtgagattagaatgaaatcccaatactcatttgtccagtgatccaaaccaaaaagtgcattcatagatggtgaaagggaaaaccagtgctactacgtaaaaataaaagaaaaagaaaaaatctttaataca

SEQ ID NO: 268880 - DNA, 255 bp, Homo sapiens
cagagcagagtgagctgcggtcatgattgaaggcagggatgctagcagcaaggaccccaaagaattatcagcattggggcccaaacttccccccaggctgggggaaactgccgggcgcggtggcgggcgcctgtagtcccagctactcgggaggctgaggcaggagaatggcgtgaacccaggaggcaaagcttgcagagagcggagattgcgccactgcactccaacctgggcgacagagcaagattccgtctc

SEQ ID NO: 268881 - DNA, 342 bp, Homo sapiens
gttaccatcaagattcacaggaagatatgagtaccaaagaaaagaaattagtagcaacggtatggtctgcggagagccagagttcaggttcagatctgggctttgcacttactagttgtgtcaccgcgggcagttactaacctctcagtgcctgttccctcgtttgcaaaatgaggatgatactagtacctatcttgtagaattgtgagcatgtgaatgagttaacatacataaagcacttagaataatgtctattatatataaaatgctctgttactgattagtcttatcatccatatcattatattaacctgtgttgtgatactggaattttccaatgag

SEQ ID NO: 268882 - DNA, 364 bp, Homo sapiens
cgcgggtcccgtgagcccgtacgtgccttctgtgcttcacgtggagcacctgcgtttcccagccacccaccaggggcttcaggagattcaaacacagccctcacctccccagagcaggaagccgcagctgtcggccggcgggggctcgatgcagctgctccagccgtgccccttgctgctcccccagggctgccttggtgtgggacactcggtccctgagcgagccgtgatctggaggccagggatgctgaccagtgtgcaggggctcagcgagggcccctctgcaccacgtagatgctgtgggtacagaaagcagacagaaggacttctgctcttgagtgtgggaggcaggggtatggacgtg

SEQ ID NO: 268883 - DNA, 431 bp, Homo sapiens
ctggagaatgctggatttttagtttgcacccttagcagaactgtaactcatttctggaccaggagccagagttatttattagatgtataagttatattaagatgtttaagttacatatttgtccttgagcctgtaaaactcagattggactgggcatggtggcttacgcctgtaatcccagcactttgggaggctgaggcaggcagatcacctgaggtcaggagttcaagaccagcctggccaacatggtgaaaccccgtctgtactaaaaatacaaaaaatcagccaggcgtggtggcgtgtgcctgtaatcccagctactcgggaggctgaggcataagaatcgcttgaacctgggaggcagaggttgcagtgagccaagactgagccactgtacggctgcctgggcggcagagtgagactccgtctca

SEQ ID NO: 268884 - DNA, 499 bp, Homo sapiens
gtcatctcatgagtcccctggccagagctgagtggagcaggattagactaatctgactgtagaagaaacaatttatgatgggttgagcctatccagttctctgtgaataatgcaaactggtagaggatattcctattatgggatgtaaaggtctttatcattttagtttcaatagcattgaatataaggagctataactggaatgagatacaagaaaagtttaaaaattataccataatgtattctactaccactaccaccagaaacataaaagaccattacagaagatgacgttattcgtcctttacttggtagaaacgccatcacctcacaaagttaaagaaatacatcaaagttcctcctcaaagaatctgatgagtagtcctccaaggaagtctgaccaagaatcatatacactcatgatatgagtgtatttctagtaagcaagactacaacaaactttgctttgagtaatttaaatttaaaaccaagaaacaaa

SEQ ID NO: 268885 - DNA, 285 bp, Homo sapiens
gtgactgtggtgtaggtattgcctataatcaagaatcttttagggtctgctatgtgcaatccctgaagggtcatggatcgcagtttcataaagactgctgtattttaaagccttcaaatgccaacgtagtatcttcacaatgattttttttttcagttttattattttttgaaagcgccttcgacaaagttttcagtggattttgttgagggatattaagtatgccatctacataatagccatagtgataactccagcctgggcgacagagcgagtctccgtctc

SEQ ID NO: 268886 - DNA, 486 bp, Homo sapiens
ccatgaatgataatattaaaaactactgaatttacatttatgccctgacttccatgctcctttttaaaaataatgaattttaagccctagccatataattcagtaattttgatgagaaagacatcatctctttttatttttaaaaataagtttcttgaaatctcgtcactggcctgtgttaatgttctcattttccttgtggtgaatttataatcttttctaaactctccataaaaagaaaaactcatagtctttccttaatgtttcgatctcattttcagtgccttaattttactttcactgtaaaatgaaatagaattgctatggtaagcaatggtgaatctttgatgcattgctttttttttcattgacacttttaattctgtcttaatagaatctgatttcaagctctgttctgtggcctacagatattctaagatggtttaaacagtttggttaagcaataaatttcaatatattgataaa

SEQ ID NO: 268887 - DNA, 267 bp, Homo sapiens
acagatgaagaacatgagtcttagagaagtcaaagaagttgcctaaggtcacatgagcagtgagcagaggagttgcttacctttgttagactccaaatcctgtgtgactatgaaactcattaactgaaacaacccggcacctttggacctgtgcaggcaaaggcaagggagttgaccaggagcacacagcacagacgagaacagtcccaaagccttttgctgtatcccatctgtgcaaaccactcccaataaacaaacaaacacaca

SEQ ID NO: 268888 - DNA, 468 bp, Homo sapiens
gtttacctttccaagtcagctggtattagagacatccatgagtatctcaattttattaaccatttcttttatctcttttggaaaactagaatgcaacattatgtgtttaccactgaatgagattaatttatgggttttaatgttgttagtaacttgttataagtgtatctatgatatccacttataaccataaataaagaatacactatttggtaaatgaaataacaggaataattttcagtataaaaggtaaaaatgcaaaattcaaaatatgacagatggaagaatttcatagaagatttctctctggaatcacctatgacttggatggagtttggatgttcatcctgtgggaataggacagtgttggcaagcatattgagaacatcaggaaaaagggggtaccttcaaatttgaagtattaaaatattcatgagaagatttatttcaattactttgtacctattt

SEQ ID NO: 268889 - DNA, 805 bp, Homo sapiens
agccatcacccaactttaacaatgatcaactcatggccaatctcgtttcatccccttttattcttaaagtaaatctcagaaattagggtccaattttaaaattaagaattctcatgtttaatacttactaatgcacaatagtcttcagtgtgtctttgaatacaccaatgtggatcttttcaaccaaatattctactatattactaacttttccatgttaaatactatacctctcactatcctccccataagttgttctcatttaacattcaatggatacgttcacttgttgtcaagtatacattcctaattcctaggcaaacattcctacacacaacaattttttttcttgcagtcttgagaagtgacctccccatattgtaatactattcgtcagtattttcagatagctctgactgaatgcacagaatatttgactaaagttgacaatacaattatttattagtagcagaaactccagatgtagtcattatattgttacatcattctattttcctgcctttagttagctaccttttaggaaaaacagtatcttaaaaattctattaaattccatagtctgtatgagatcccactgatggcaaacaaacaaaaaaccaccaacttcaatatggcatgcagaagaagttcagtaccaagcctcaaattccctttttaacaataaagtctgttttcaaaaagtccatcaaagatatttggactagatctttgccacaataaaaaaattaaatcactttaatttctggtttcacttttaattctaacaggaagaagtaattctaag

SEQ ID NO: 268890 - DNA, 450 bp, Homo sapiens
gaagtattgacatcttaaaaatactaaatctttcaaaacaagcttttttaattttttgagatggagtcttactctgttgtccaggctggagtgcagtggtgtgatatcggttcactgcaacctccacctccagggttcaagcgattcttgtgcctcagcctctgagtagctgagattacaggcaaaacataaacttttataactattcacttatttaagccttctttaatttctccttgataagtttcaatgtagaagtcttacacatcttatataaaagttttttctttctattattacattttgatgataactatagcacgtttttatttcacttgtcagttttctttacagcatatagagtaaaatacttttctgtataataaacttgtatcccagcctgggcaatatagtcagacctcgtctctacaaaaaaaaaaatttttaaat

SEQ ID NO: 268891 - DNA, 488 bp, Homo sapiens
tcttgttttaaatttactaaacagataagaaaaaaaatgtagtgtgttgagaattagagtattactaatttctccacttgctaaaacctgattgcttggtctatgtaatataccatatttctcctgaagtagcaatgacaaggggcaagataaagcatctgaagatgtctagcaggcatcttagaattcaaaattttaaacataaaattcttcagttgtaatggtgtccatatgttggggaaaaaagaaaagcaaagatgttttatggaaccagttgcaggtaagactgctaatctctaaggcaaacacactcagctggtagatcacattctactaaaagatcttgaaaaggtgtgagcaagaaaagaaggcaagtctataccggggaagaaaattttgcctgcgttagtgtgctatttgtgttctgctaagggattttattctttgcctacccgcttctctcactactcagttatctgaagactaaa

SEQ ID NO: 268892 - DNA, 505 bp, Homo sapiens
aataaatctgatcacagcatttctttctttttcttttttgagactgagtcttgctctgtcgctcaggctggagtgcagtggcacaatctcggctcactgcagcctctgcctccagggttcaagcgtttctcctgcctcagcctcccgagtagctgagattacaggcgcacaccaccacgcccagctaatttttgtatttttactagagacaggatttcatcatgttggccaggctggtcttgaactcctgacctagtgacctgcctgcctcagcctcccaaagtgccgggattacaggccaccgtgcctggcctgatcacaacatttctaaaacattaaatttaaaatcaactcttgtacttttttctgatttaaaagtttaaatttgcctgtattccacaatcacttaaaactagaataattattcacatttagtacaattgtttccttttaacggacatatggatatccaatacctctgcccccaacccaaaaagtgtttttt

SEQ ID NO: 268893 - DNA, 329 bp, Homo sapiens
gtttgggccaacctgggctggacctggcgtcgtgtctttggacggactcagggaacatattgattagggaatggaggaccgggaggagggagacactaagccaggtgctattagctgcagtaaattaacgtcctcctgctggatccattattgatggccacgccatgcatttttaaacaaaataaataatgtacttcgaacagtgtcgatttgtgcctatttaccggttggataggtgaattgttgtactaaaacaatttgaaaatactttttttgaattaacgcaatgtttcggtaaagagacaacaaattcttacttttaaacactt

SEQ ID NO: 268894 - DNA, 353 bp, Homo sapiens
cacgaggcctgcctcggcctcccaaagtgctaggattacaggtgtgagccattgcttgcctggccaagaagctcagttttgttgctttctgcattttctacttctgtatcccttaagagtggtcttttattcctcttagtggttaacaacctttgactagttaacattttttttttttttttttttttttgagacggagtctcgctttgtcaccctggctggagtgcagtggcatgatctcagctcactgcaacctctgcctcccgggttcaagtgattctcccgcctcagcctcccaagtagctggtagctgggattacaggtgtgcgccactgtgtcagctagttttttgt

SEQ ID NO: 268895 - DNA, 712 bp, Homo sapiens
cagaatacttcttttccttagagaatcgtttttgtggtacatgtgggttagataagcattatcaccttggcttctctaatatggggctaatagtacataccacacagagttggtagtattaaatgtaacaatctaaggcactagaacaatgctgaacacataatagtgagtccaaagtctcaggactcttcactgatgctgcttctactattggaccctggaactcaacaatggcaaaagaaataattcagagacccctctccccaacacacatacctgctgcttggcccctgatcttttacttcctgaaacaggctgttctgataaatgtctattaatttggtgcagggaaggtgtaaggggaaagagttaagtgggtcactttgaagctaatatagtctaattacccacattctggtcattccattgtggctagaaggctctcagtctcccctctgggcctctgtccctctgccaacaatgtcctctctcctttccttcctctactcagagcttaagtcactttttaaccccaaacccaactcatttcttgcctcctctccagccacctgaacctcacttttgtcttggccaatgcaatacgttttgctttttcaagtctctagaagcagactcagcaaactatgacccatgagcaaaatcctgtctttcccacctgttgttgtaaataaagttttgaaatgcccattca

SEQ ID NO: 268896 - DNA, 444 bp, Homo sapiens
taaaccataaaaataaggactgttttaaaccaatacaggtattgttcattcaccaaacacataaatcacagagcttttgattccacgtagctctgtaagtttccagtttaacctataacatgccaccctcctccatggatctctgctcaactgaagaacttacatcaaaccatccatcgcgtgctgtaaccaaatggccccatccagcagcagcagtaatttcctgcttgaagaatgatgcctctaggactctggaggatggaaggactttaattaacgttgtttcctagtgtgatagctctttggtgcaaccataggaacagttacatacagggactgttaacatgcaatgtctcatttacacaattaccattaaatcttacggtattgacatttgtctcaataaggtttcattaaaacagactgtttactaaaactgttaaa

SEQ ID NO: 268897 - DNA, 564 bp, Homo sapiens
tgtagattaaagacatattcaaaatgcaaaaccgggcagagcagtggtaggaaatccatcagggttctgtgccactgctcctaagacatgaactgcagggacaacttggaatcatggctgggaaattgcctgctgtgtccccatcgccaattcaggtctatggagatgttactgttcttggaaggagttagcttgtccagggctagaaactctagagttatcagggcttgttttatcttaattggaaataccaatcaatttggcctcacttctgtcacctttcttttcctccaccccgagttccccaagttcatctagctgctgtccttctttcctggacttttgcaatggcctcttaactggccaaccccatttctgctctggtcccttctagagaaaatctcatcatgccaaccccctgcttcaacctgaaaggacttcctggtgtccctagtagaatgtcggggatccctaatgttgcctgtgaggccctgcacacttggtttcatagtctctgtcctcttgtctgtcaccttcttcactcctcctaggttccgcatctct

SEQ ID NO: 268898 - DNA, 318 bp, Homo sapiens
tagatgtagtttatcatggattgctctgtcagttggaataatatactcctgcacagtgagagcttgtcagagccttttagcaactgtcaagctatttctgttgtcttaggcttaaaaatagtaaaaatgagagagaaattcagtgtaggtagcctctgccagttattgcctcatagctggaatgagtccattgctagtagtcaattttgaaagtttttcaagccttgtgcatatgtacctgatgcaaataatccttatataactaaacttaatgaaaaaattttatagttgtaataaaagtaatgcagtctaaaaata

SEQ ID NO: 268899 - DNA, 303 bp, Homo sapiens
aaatgatgatatatttacataggagaaaagtctgaaaagtttctaaaatgtcagcatgaccaggtgagtgatgagactggggtgatttattctcctacctatatttctaagtttctttaatgtacattattaattttataatatttcaaaatatttggaaaactgaagaaaagcacaatataaatataactggtgaatgcaccaatatcattaaatatgttgatgctcttaatgaatagacatatttataattgcctttacaatttctgttaaatgagagaacatctgggagttacctgaaaa

SEQ ID NO: 268900 - DNA, 321 bp, Homo sapiens
caaaccctacacgaaggcagacccagcgtttgcaaaacaccagccccctgtgaacaagtcgacctgccgtgcagcccacctctgactccgtttcccccagcatacccggccgcattgggaggctccacctcggtccaacactccggcattagcaggacctgctgaatgagtggcaccgggcccatccatctctgccatctctgctcagccctctgccatgttcaaatatcacacagtccccaggtacctcgtaaatcactgtaattaggggctgctcacttaaaattagagcgcaattttttaaaaagcaaattgtcagta

SEQ ID NO: 268901 - DNA, 475 bp, Homo sapiens
gatgggaggtgccgtccctacatccaggccaatgccgggcacgtagcaggtagtcagtgaatgtttattgaattaaactgaagagactactgtgacccaggatgggatacagagcagtggcagagttcatataatccagtcccagaatgggagcttcagagatcattaatttcaaattgtggttcttggccatattcaaagtaaaaggcatcaatcagatcaatggggtggagatccactcttgcctggggatatcaatcccctcaagatctagcgttggtctcagatgtttccagtctttttcaaactcaacagaaacgtaacggtagtaacaaactatgggccttcaacctcatgaatttgaaatacaagggaccaaaaaaaggggaggcttttaatttattaggtatataaaagtggatattttcattaaataccaatagagttctgagcagacagggaaattacttgaaat

SEQ ID NO: 268902 - DNA, 439 bp, Homo sapiens
ctgctgctgaaagaaactgacgcttacttggatcacatctctgcaggaacaacacatttccagagcatttgtcatcattttctattgctcagttccacggtgacagctttaagaaaaactgtttctgatgttgcaggattctcttaaatctctgcaaagaatcttctttagaaagggttttctgtgactctgttttcatataacacatagtctagtaagaattagaaattagaaataactgagctttaatcacggaataatcttttccagccttgaaagagtttgtttctttgtaaatatttgtcatttcatcttgctcccgctgtcatctacctgaatgaactctaaagacttctctctcattgagcacatttcccctctatttcccctgcaagttctgtgttaataataaaacttcattttcccagtttcagagatg

SEQ ID NO: 268903 - DNA, 805 bp, Homo sapiens
caaaaacaaaacgaaaaactaaaccacaaaaaagacccgaaggcagaaagcctggaagaatgatcagattcccagcaagaagtcaaacaccaccgtccaaaacagaggccccaaggtctcgctgatgtgagctgggtgaggctgcccctgcctggtgtacggcttgacagcacccagggatgaagggcgccatgttggcaactattatcttatgtcacaagatgcgaagcaagtgctggcagaatgtggctgtcttcccagatgacggggaacacagccagcacacactgaagggataaggggagggtcctgtgctttgctcagggtcacggccagctctgcctccaagcagcagtggaccaaggccactcagggctctgggaaaccgagctacagtgatctgccctggggcagggtgttcaagggagacacccagcagcctccaccatatctagcacgccagcgtcaaagaaccaggaactgtgagcatgggttggtccctgatggttgagggtcttgggtggggttggaggctgccccacagaaagctggacaaagcaaggtcaacatggcattgtgcttggtcatcacaggcacttagaaagagccttagttagcctgggcaacatggtgagagccggtctctacaaaaaataaagaattagctgggcatggaggtttgcgcctggagtcccagctacttgggaggctgaggcttcagtgagccatgatgtaccactgcattctagcctggctacagagcaaggccctgtctcaaaaaataaataaataaaaggttaaaaag

SEQ ID NO: 268904 - DNA, 407 bp, Homo sapiens
cacctcactttgaccttcttcctcaaagacattctctgtgacctgcctggcccttattacctctctagctttgccacttccctatgtctccatctcccctctcacacgtagtagaaagagactctacctcatggagtaaggagaggcttcacagaggcaggattgctattagtcttcaaagatgaggtatttgctaaatgaatgagacaaagggattggggccacattacaggaaattgaggtatgtaatagcctggtgcaggttaagagtgtggactctgaaaccagactcagcctggaattgaatcctggctgtgtgatgttgggccagtgacttaacctctctgtgcttttattcactcttctataaaatggggattataataaacctaccttataaggttaaa

SEQ ID NO: 268905 - DNA, 319 bp, Homo sapiens
aaatgaggttatcggtggagactagaggataaggttattcagcaagcctaaggaagaaaggcaaattgtgactccggatctctgcataagcatatggcagatggcacagtggagaacaaggtgataagaacaggcagagaaaagtcacactgtcataagccccaaactgggatctctcgttgctgctggcttggaccaagctcaagaccttgcccttgcccataataaaaagctgcagacagtaaaggctgcacatatcttacttcttacaatacaatgatggctgcatccttaaataaaattgtaatataactgcaaa

SEQ ID NO: 268906 - DNA, 338 bp, Homo sapiens
tgcacctcgtagtcactacttttcctccagacattttctcaagccagaagaatgagcacagcccacatctgaagcagcctgagaggctgggcctgcaggggagataccggccctatggaaggcagttggtgggcaaaagtccggtttctacgctttgaggggacacctgtggggcaccctgaggcccagccctgctggcctgctggcctttggactggagctacaccatcagctctcggaggtctccactcgccaactcaccctgcagatcacggaacttgtcagcctccataactgcaggagccaatgccttataataaaatctctttctcttgtct

SEQ ID NO: 268907 - DNA, 345 bp, Homo sapiens
ctctcactgcagccgtttcttcacagggtgatcctcacagaaacactcaaagccttctgttacgtacaaaggaccgcgtgtcagtaatctacagccatttaccagttaccaagaaaacacggacgtttccactaaaaatcgcaaacgtttctttcaagcaaggagcgccctgcgccagaggctgtgggaggagtgaggagtctgggttcgttccagccgcagtgagtaaggcgtgggtgactccgagcattgcagaggcatgaggaaacgaaaacaaaacctgccgaagtggggccttactgacttatcttccactgtgaaataaataaaataatgtttttcttt

SEQ ID NO: 268908 - DNA, 345 bp, Homo sapiens
cattatgtggctctggcggctcaagtgatgcacctggaacatacgccgttcatgacactttgcctttatgggcccctttaactcgaggatctcaaagggcctcagcagtatgaccttgcgtgtcctggccgggcgcccaagggagggaggccagaaggtccacgctgctttccgtgtgagaagtcaggtcacggtgccggatcagaactaacacctggcctgcaccctcattggtgtggtactttggaaggcagaggtataagaggagaactagcaatgttggcaaatgctgatagttggggtcaggatcccaaaacatttaaattctgataggggtcaggccct

SEQ ID NO: 268909 - DNA, 405 bp, Homo sapiens
ggtttatacataggttaagtttcagaaacgttacagagtccttagatccttacgtgatgattatgtgttcagttgttttacctattagactgtaaactccttataatctagtaaaggcatagattatattttattcatccttgcagtttcattagagtctgtctcagtactttttcctagtagtgacccagtaaatatctatgcaacaaacttggctttgctggtgtgcaaagtgtaatataaggaaaattagtgacattttttgccttttagtgtgtaactggaatgtatagtatagaaaacagagagatagtatatattttaacaacttgaaattcataggtgttaatagattcctctttttgaaattaaatatctcctaggattttgatcacttacagtgtt

SEQ ID NO: 268910 - DNA, 435 bp, Homo sapiens
gtacggctctccaggtgacattgacctctggcccgcccttatggttgaagacctgattcctggtacaagagtgggaccaacacttatgtgcctgtttgttacccagtttcagcggctaagagatggagataggttctggtatgaaaaccctggagtatttaccccggcacaactcactcagctgaagcaggcgtccctgagccgggtgctttgtgacaatggtgacagcattcagcaagtgcaggctgatgtctttgtaaaggcagaatacccacaggattacctgaactgcagcgagatcccgaaggtggacctgcgagtgtggcaagactgctgtgcagagactgtaggagtagaggacagttcagagcagtgacgcaagagtctcaaaagaaacgctcagctcaatacagctatcctgttgataaggatatg

SEQ ID NO: 268911 - DNA, 707 bp, Homo sapiens
tcatgcctgtaaccccagcactttgggaggccaaagcaggtggatcacctgagctcaggagttcgagaccaacctaggcaacatggcaaaaccccacccccaccaaaaatacaaaaaattagccaggtgtggtggcatgcgcctgtggtcccagctacttgggaggttaagatgggagtatcgcttcagcctgggaagtggaggttgcagtgagctgagatcttcccactgcacttcagtgtgggtgacaaagtgacactccgtctcaaaataaacaaaaaattaatagaaatactcgatttgaataggagaaagggacagagttcatattgtttctgaaattaatgagcctgactggtgttctcagctgggcagaagggcataaagatttttataaaggtgggcctaaagaataactataggcgggcgcggtggctcacgcctgtaatcccagcactttggggggcccaggcaggcggatcacaaggtcaggagatcgagaccatcctggctaacacagtgaaaccctgtctctactaaaactacaaaaattagccgggcatggtggcaggtgcctgtagtcccagctactcaggaggctgaggcaggagaatggcgtgaacccgggaggtggagcgtgcagtgagccaagaccacaccactgcactccagcctgggtgacagagtgagactcaatctcgaaaaaa

SEQ ID NO: 268912 - DNA, 440 bp, Homo sapiens
aatagtagtgtatgtgttaaatgtttgtgtatcacttagttttaaaatttgttttatttggacaatgtctttgattcagttggggaaaaagaaatgactggttgatcagaaaaaaatttctgttcaaagtattttattattgcctatttttaaataattatactgaactaaatctgttacatcctttataaattgcaatgtccagagaggctgggcgcgacacctcacgcctgtagtcccagcactttgggtggccaaggcaggtggatcacctaagttcaggagtttgagaccagccttgccaacatgatgaaaccccatctctactaaaaatacaaaaaaattagccgggtgtggtgttgggtgcctgtaatcccagctacttgggaggctgagtcaggagaatcacttgaacccaggaggcagaggttgcagtgagc

SEQ ID NO: 268913 - DNA, 445 bp, Homo sapiens
gaactacattttatatattctgttacttgtaatcaaataattatatgacattcttaatgtctgtacctacaaacattgaattcatgcatatttataaggtagcttattgactataattcattgttgacctttctgatgattctgtagttagatttttaaaatatgattgaatgtggaatatctaggcatagactaacatgggtttgaatcttagctgtgacatttatgagctgtgggctcaacactttaaaagtaattaactgcatttttcatcttttaaatcattctctgagaaaaagtcaactccttaattagtccttgtttgaattatgatcaaatagtattggtttgtacagaatgatgctaacttaggatccaggctatagatggctgcaaccggaatagagccatttagtcatcatatgtacaatagagtaagaaatgc

SEQ ID NO: 268914 - DNA, 382 bp, Homo sapiens
ctgctaatgatggtggtttctttatctagagaaactttaagattatagaaggataagagattacttggagcagcatgcctgagttaactcttagttaatgagatttttaaatataataattccttccctccaggcttatattaaaagaaaaatcactgtataaaaagttattttgtgtatttgtgtggttatcttacattacatttataaaatacttagtatttgaaacattgtttaattttatgtccatttcctctcacttttcaaacatgacgtatgtagagattcttagtaaatgctttttgaaaatgatgacttattattattattatcattatttttgagacagagtctcactctgtccctcaggctggagtacagt

SEQ ID NO: 268915 - DNA, 378 bp, Homo sapiens
atgctataaataaaggtagaaacaggtataatgtcaatacatagggcaaattctgacttattcttctggagtaaaatgttgcctccagaagaagatttttgacattcaccttcaaagtgaagcaggatatggcagaggaaaaggtacctagcatgaagattttagaagtcatggtttattaaaaggctactggtagtacagaaaaatattggactttcagacaattttatgatgaagatgagaaaaaatggacagtaagagtcatactactttagctttatttgtcctcttaaagaaagtttactctttatcctacgatgtgatagctagctactgaaggctttcctgcaaggagctaatgatgtcaagtttactctt

SEQ ID NO: 268916 - DNA, 718 bp, Homo sapiens
acagcagaagcctcccctgcacctgcaaatagaccagtgcaggcattgaacatctggggcaagactagcgtctcccagcagccccaggctttaaatctgattctcctccttcaattactgcttatcttcagaaaagccatgcacctcacgaacgtcacctgtcagtggccaccctaccttcatcttgctggtgggtgaggatgagagagttcagaacgtatgacctgaaactggtcccgaggaaacatcagatggaccacgttgagcatcacactgcagaatgtagggctgcattcttccaaactgttgggacgatgaaagtcagggaaagactgaggaaatgctccaaactggggcagactgcaaagatgtgacaattaaatgcaatgtgtaactcggggtttctgcactttagctctttcaagatttttgactggataattcttggggtctgtcttgcacactgcacggtgtctggcatcatctctggtgtctaagccctagatgtcaataccaattcccacttgtgtgatcaaatgtctccagacattaccaaatgtaccatgggtggggtcagaggggagtgcaaagtcagctccagatgagaaccattggtgtaactggatggaatcctgggccagatatgaaaaagagacatcactaggacagctggacagatctgaggttaatgaagatttctcactgttgcagaaggtat

SEQ ID NO: 268917 - DNA, 646 bp, Homo sapiens
tgctgggattacaggcatgagccaccacacctggccccataccatggtttgtagccactatgccatcttacattcccaccttagaatatttgcataatgatataccaaacgaagcatagtattttaaaataattgcttgtattagtctgcttgggctgccattaaaaaatgccacaggctttgtggcctgacagaaattattttctcatagttctgaatgctagaagtctaagatcaaggtccctgctagtttggtttctggtaagggctctttgtagtttacggacagccactttgccctgccatggcctttctggtatctcttcatatggcactgagcctgtcagaacaaggccccactccaatgacctcacttaggttaattacccctttacttcaaaaacagccacattgggggttagggcttcaacatatgaatttggggaagacacagacattcagtctataataatgttcacttttttccctctagactgtaaccctcttgagcacaggattatgtttttattcatctttgtttccttagcacaatatatggaatatagatgctacctacatcagtgtctgttgaaccaaactaataacttagaaaagttaatgaaatacattacttttcttggaaaaa

SEQ ID NO: 268918 - DNA, 464 bp, Homo sapiens
ttttagaaaagtgtattctacatatatgttggacatgaagacagtgtctaacaaacatatacattcaaatgttaaccggtatttttggtatgggattatgggtaccttttcaatattgagctttttttttttcccattgaaaaactgatttgcattattttaataaattagaatacaaatacaaacaaatgataaaaagtactttaagcattctgagaaatgcttcccaaagtacattctacatctgtactattcagtatggtagccactagccatgtgtgggtattgagcacttgaaatatggccagtccagattgagatgttctgttaagtataaaatgcacactagactttgcagacttggaatgaaaaaatgtaaaatatctcagtatttttaatactgatcacatgttgaagtaatattctacaaatgctctattaaataaaatatattattactctta

SEQ ID NO: 268919 - DNA, 463 bp, Homo sapiens
gaggaggcctgcaaagtccttgggcatgtgcagttatctcttcatgggtcccatgtgcaaattcaggaagagttagtataaaccatgtggtggaaatttaggctgtgacattagcaagcttgttctgtacaaactttagttggacatcctggttccaactgatttcaaccagttctttcgtcgcctaagcaaggaagtttctgtgtttcagcaagtggtttctttttctatctgccattctacaaactcaaaaatttctgttagtcattggtctgtttaactcttcggggtattgtttcaattgacaaataaagcatgaggcaaacatcaagcaagcaaagtttaaagaagaaaaaggctggagtaaaggaagatcccaaagaaataactggggcaaagctgaagaaaaagagtttaaaggaatttctgatgaggaggctaaagaaaatatcaatactaaagg

SEQ ID NO: 268920 - DNA, 368 bp, Homo sapiens
aaggcactcaaacctggaaagggttttctgatgcaaaatatctgcaactgactgtcccctctgtaaggctggaggttcagtgggggggtctcctgggaagaatattcaaaacggaggcaaatatgtaaacactcagagaagaagacgcttaccattttgtcagaaaggaataaattgttactattactgaaggggaagggagtgggcaaagccaagaggaactagggccagggaatagctaaccaaacttggaaatgcacatggattcacattcccagtgcccaggcaaaactgtgcaggctttgctctagagcttcatttccccaaaactgtctgtggaaacttcttttttacttaaaaaaaaaaaa

SEQ ID NO: 268921 - DNA, 432 bp, Homo sapiens
ggcaaggacacaggtcacggggcaacctctgccctcatgtgtgcctctcatctctcgctcatgccttcagcacagaactgagcatttgctgtccatcaggccctggggtggctctctggctacagagagaaaggaagattcctgccccggaggggctcccactctatgggctgatgctggagggagagagatgacagtagctggtgagtgggagaagtctttagactctcaggccccacgtgccatcactgacaggctgctcatgacagccaacatcagaaagccaaatgtcctgggagtaggaatctctgtcttcccggggaaggctccatccatgcagtatctgtcacgtgcaaagagacagcttccaagacacagcgtgtgcacgtggtattgaacattaaagagaacgtaggctgccgagtgtgctgt

SEQ ID NO: 268922 - DNA, 591 bp, Homo sapiens
gtgaggccaagaaccccaggtcagagaacacgaggcttgccaccatcttggaagtggcctgccaccatcttgggagctcgggagcaaggaccccctcgtaacagtgaaattctgaagataaatgacatacaagtgccaaatttacagttccaaaatgaagagttctgcattcaaaaaaaggatgagaaaggatgttatttgagctagaccttcaagcacaagaggaattccgataagtacgaggcactggaaaattattatagtcaaggataatggcaaaagcagagaataaaggcaggaaggggcatgtagtgatcagaagccaaaacaaaaatcagtgggcagatacattctttagaacaactcattattatcgtcattatatacacaagaaaacagagttcatcagataggttcagcagattgttcaaggtcacatagcaaaagatggagactcttggattttatcccagccagaccaactctaaccaccatcctgtgcagcctgagaccaattgttaaagttacatgtattggtatgaccatttccacctgacagcaaatgcaagggaaccataaataccacacaaa

SEQ ID NO: 268923 - DNA, 405 bp, Homo sapiens
ggctcacccagatagtgtaactggtccgaggtcttctaatgattgggtgtcaattgcattaaatcctaattttccaatactcagctagagttactcctgctgcttctcaagtaccagggcctttatgggttttaagagctacaatttgtgctgaaaaaactgtcaggcaagatactcttatcccttttattagttagttgattatgttaggtgacagtggcaagtgggaccttacaattgagatatattttgttctttcacttttattgtttcctgattttatgtgtttggaaatatgtttacagatttgttacaatgattggaaaatgtatatttttgccacagtgactttataaatcttaacttatacaataaactaaagttatcaagcatttaaatagtgtt

SEQ ID NO: 268924 - DNA, 237 bp, Homo sapiens
agccaggctgggtctgaggccatgaatggccaccttggagctatgaagtttgtccacacagcctcctctctcaggagtcagggcacaggttcctgcagtgtgggtttagaagttggcaggccaggcacagtggctcacacctgtaatcccagcactttgggaggctggggcgggagggtcgcttgaactcaggagttctaaatcaacctgggcaacatggcaagaccccatctatac

SEQ ID NO: 268925 - DNA, 309 bp, Homo sapiens
gcaaagctcttctagaagaaacagagctctcacgccaccacttccagttggtttctgccacgtaaccaaagctgaaacacaagccactggattttaacctcttccgttcccaggcctgagccctggcgagaaaacagcgcagacggcggtttggccatcctgaacggttccttattgttcacgttctatggatttcctgtttatttcatcttttatttgatatctgctttggccacgcgagttacaagggaaacttctgctgagtctttttactgtatcacagttattatatttttatatttttttatt

SEQ ID NO: 268926 - DNA, 511 bp, Homo sapiens
gaggaagctgctgctgatcaccagcttcaggtgttttctatctatggggagactgccttttcttggcaccagctgtgaccagttattatcttagagagacagtgtagcaactgcctgacaatcacctgatggtcactggacattgctggtcggagggacccctctccagccctgcttgtatctgcctgactacttgctctaacgtccctacactggctgcccaggatgtcagacgttctggctctccacctgggagcccaactcatgtttttgttttcttccatccgtgaagcaagtttgacaagcactacagcccatcagctcctgctggtgactcctgacggccatgagcaccaggaccctgagaagccgtgtttgaaaggtacctggttttctttgcttagccgtacttgacttttctttgagaagcacctgtttaacattcctggcgattaggctccacatcaagttcttccttatattgaaataaaagctgttgtctcgtaaaaaa

SEQ ID NO: 268927 - DNA, 325 bp, Homo sapiens
aaacttaaaaacgagagtgtaaatcaatgacatttaaaacaggaaaataatagagaaaatcaatgagaccaaaagcttgttctctgagcagatcaataaaattgatatacttctagccaggataaccaaaagagagaagacacaaattactaataatagaaatgaaagaaactctaagctcacaaatttgataactgaaatgaactagatcaattccttgaaagacaaactaccaaaactcacacaagcagaaatagaaaacctgaaaagccctttatctgttagagatattgaaccaataattaacaactttccaaaaaaagaa

SEQ ID NO: 268928 - DNA, 453 bp, Homo sapiens
gaagagtccaggagcttgttaaaagtgcagatagactgattccaccccagaatggacaccgagaaatcttggatcccaagagtttggttggctttatcatgccccttagtcatttctgagtggttcctcatactctgcatccatgtgatgagaggcaaatttcctcatgatctgctttgcttcctcatcaagctactatgccccaccattgctggctctgcttatggttgctgcaatgtaggcagcgctgtttcttgttcttaccacttttaactatcttaaaatagaacctgactctgattctccattaagaagtggaaactggctgggtgtcgtggctcatgtctgtaatcccggcactttggcctcctatctgaggctaaagcagggggatcactagaggccaggagtttgagactagcctgggcaacatagtgagaccctgtctctatc

SEQ ID NO: 268929 - DNA, 344 bp, Homo sapiens
atcgctgatggagcccaggttcccccagcagtgcctggccctggtggggcaggataaatgtttgtgaaactaaatgggaacccaggtctcagcactgtgtcaggttctagaatcttctttgatgtctccatcctgcttgtttctcactcagcccttcgtctggcctgacatccacaagaatcccctacctcaatccctcctatttccagtgcccccatcccaccaggcctcgttgccctgggtcttgctctctgcagaccacaactgggcaggccctctttcacaccagctcctcaccaccctccaggtgaagccttcgttaaaaccgcattttctgtagaggc

SEQ ID NO: 268930 - DNA, 412 bp, Homo sapiens
ccaatgagagaatttagtaaaatagcaggttataatatcaacattcaaaaattaatagcctttatctacacacaaaaaagatagaagatatgagaaggcttattttaaaaggcaagaaataatacatgataaagttataagactacaagaacatacgacataaactataagaactgttcaaaaacctatataaggaaaattatgaaacactcctgaaaacacaaaagtagaggctggaacacatggaaagacagtgtttttggatacgagacttcaacatcataaagatattaatcctccctaagttaatgttaaccccaatgaaaacaccgtcagtctttttctgcatctagataaactgattatcaagttcatttggaagaacaagcaagaataaccaggaaatctctgg

SEQ ID NO: 268931 - DNA, 433 bp, Homo sapiens
tgtgagatgcggcattcctctgagcccagtgacctctgagcacctctctgttataacaatgatcacaaggctctgtccctgcctgagctgcttaggtaaggctcatctcagactagtacagaagccgtttagaagctaaacagatttacgagctgtaccaccagactcctctcctactgctaattagctgtgtgacccctgggcaaatgacttaccctctctcggtctcagcttccttatctataagatgggaatcataacaatatctatctcatagtaatgttgtgagggttaaatgaggaaatacacatggaatgtttagaatggtgcctggcacacagcacattgtaagtataggtaattattattatttgcttttgcctcacagtaatctagcatggtggatacaaaatattaataaaatgaattatac

SEQ ID NO: 268932 - DNA, 534 bp, Homo sapiens
tctctgcgttctgttctctatctctctctcttccccccaccgtgtgtgtgtgtgtctgtgtgtgtccgtgtgtgtgttgctgagtctccctttaagtcaggtagaagaggaaaactaccatattaccattaataagtccattataaattatgagctaatattatttaaaacatagatgaaaataaaaaattcaaaacttttgaaatgggaaacaatcatgaaatttctgtccaggctattttctatgacattataaaactaaatagcccctcctgaatttaacattactattttgtcttaggctttttaaaaaatacagatatgtaggcaaataattcttctactcaaacatatccctactttataaggtggctttcgtgccacttactgagtaattttatattcgtgaagtgctttgagctacgcaggaaatctgtgaaaaatgaataaagaaccagctatgtcttcaatttactccaagatggaatgaaacttttcatcctgattagggaataaatattaaatatagataat

SEQ ID NO: 268933 - DNA, 442 bp, Homo sapiens
tgagacaggatcttattctgttccctaggatggagtgcagtggtgcgatctcggcttactgaaacctccacctcctgggctcaggtggtcctcctatcccagcctccgaaggagctgggactacaggcacgtgccaccacacccggctaatttttgtattttgtgtagagatgagtgtcgccatgttgtccatgctggtctccaactcttgggctcaagcattctgcttgccttagcctcccaaagtgcgggattataggcgcgagccactgcgccctgccgtaatattcttacagttttcactttgcaaacatttattccttgattggttaaatccagtggtggttataccaccactatgaccactgtcactttctgactcacccaaaattaggtacgtaattgtctttcttgttaatcttttaaaaatgtgtgtggctca

SEQ ID NO: 268934 - DNA, 563 bp, Homo sapiens
tctagggtccctcttcggtttaatctccctttttcatggactcctcttccttcgtttactttcatcaacatgtttttttcctgccttttggatttggtaaggccgaagcttaaaacttggcagtctagaacagtgttgtctgatagaactgtctgtaattctgtgtgcttttcagtatggtagccactggccacactgagtggctaaaatgtggctactgtgactaaggcagttaatttaaattttattttattaattaaaatttaaatcatcacatgtggctagtgtggctagtggtactatattgatcatgtccacaatcacagatctgcgtatgtgcccatatgcgcttgtgtgcatgtgtgtagttttcccctcccaagggattaatagtttaaaggtgatatatttgactttggtgagatttttatctgatgataaacaccataaaatagatttaaaatgttaaagatagctgggcgtggtgggtcacacctgtaatcccagcactttgggaggctgaggcaggaggatcacttgagaccaggtgtttgaaaccagcc

SEQ ID NO: 268935 - DNA, 328 bp, Homo sapiens
tatctccttcaattcatcttccactcctcactggaatctcttaaatgaactatttgatcatcagtaaattgcacttttcttatgaaaaagctgtggccttcacagtggaatatgcagcttctgtccttgacaccggagcagaatctgtcattcttggcaccttcttccagcctctcgccttgacctcaaagttggatgatgtttctgtgagcacattgccttccaaaataggcttgacttagaccctcctacctgtgtgagggtatgaccttcagctcctctcccgacattgtggcatggcaataaaaagaaagaatccagcctggtg

SEQ ID NO: 268936 - DNA, 427 bp, Homo sapiens
gtttcatcctcaaattacagagatcttgtttttcatttttttaaactcttattattctcaatcacaatcataatacatgatgcaatgtaaaccttaaattatttatttaatcttactacactaatcagctaacaagatctctgtcttcttagatcttggagcctggaaaaacccagttattaatccccactatcccttcccaaaattctctggttagctgacatgttaataagattccaagaatgttctaaagaaagcaaaatcaccacaaaaaaggactgtgttctgaaagtaaaaactgtgcttttttttccttctctcataatttatttttaattaaaataaattctgtccttgaatgtgtatacataattatttggtcaggctgtgttcccttataatcaaatataaatactgaaagccgtac

SEQ ID NO: 268937 - DNA, 367 bp, Homo sapiens
tggaattattagagaggaaagtttaaacaactatgattactatattaagggctgtaatggataaagtagacagcctgaaaggataggcaatgtaaacagagagatagaaatcctaagtaagaactaaaatactagagagagagagagagagagatactgtaatagaaataaagaatatctttgatgagtctattaatagactgagcacagctgataaaagaatctctgagaatgattatatactcatagaaaccccccaaactgaaaagcaaagagagtaaagacttaaaaaacaagcaaacaacaacatatccatgaacaatggaacaactatcaaaaggtataacttacatatactgggaatatc

SEQ ID NO: 268938 - DNA, 490 bp, Homo sapiens
ttgtttttttttttgagatgtcttgctctagcctgggcaataaagcgagactgtctcaaaaaaaaaaatcataaaatagtaaaaggcatcaaatttttgaggggaaatacctattggtgaactgaaaactcgacaacagttctggtgtgtgggataacatgttaatagccttgatcattttgaatttcataatcataaatgggattttgtttttgagatggggtttcgctcttgttgcagtgagcagagattgcgccattactccagcctgggcggcgagagcaaaactccgtcaaaaaaacaaaaacaaaaaaaacaaaccatgctttcaaatctgcctaacaattatagcttcagagtccttgtattcaggattatctatttgtaacttactactttttacaaatatttttcttacactaaattagaaagaatgtttggtctcgcaggtgtctgagaatctttagtaaaatacccctacagattctat

SEQ ID NO: 268939 - DNA, 254 bp, Homo sapiens
tctctttttgcacagatgaaactatggctcaaaagggaataagagatcaaggcaagcatggacatcttgtacgtggaagtgcagaccagaacttgtatcacagccagtcatatctggtgctttccatgctacttttacatacatgtatccttaaatttgatcctcttctagtttagtctaaactctttactttgtaacttccaaacctaaaaggtgcagcagacattgacaatcttaattcatttgtcaggtca

SEQ ID NO: 268940 - DNA, 470 bp, Homo sapiens
ggtttctttttactagtcaggttccacaggaaaatgtgagaacttatacttagggaagaaagacattactcaggtccctgcaaggctggaaaatgggaatgattctccactttcccctccagatttaagcactacaaagactgtcaacatctcttggcattttgtacagtacagagagatagacaccctacattgtgtaatgtttatatttaatatcagtgctgctttccgtctccattgagttcccacattcagctcactcacagcgctccaaaggcctaggataagtgacctgtgtgaagacatggggaggcggttctggagcaccttcaggtactcctcaggaactgatgttttttcacttgttgtttgcctaaggccaagttctctttacccgaaggcatcattcagccccccttgctaggtaataaagcacaatattttgtagcgctggtcacagttggttcaca

SEQ ID NO: 268941 - DNA, 578 bp, Homo sapiens
aaaaagaatcttgggttggaaaggcagctgaccaagtgattctggtgtcttctgagtttccccttgccccttggggtatctcgttctgccacccctttagttggctcccatgtgtgcaccaccggctcagcagaggcagtaacttctttacttggtttccctcagtatgagtaaaaaagttggtgagttaaaaatacttttagggttttaaaaaatttttacagcctggcccatagggtgaaaccctgtctctacttaaaatacaaaaattagccaggcatggtggtgggcgcctgtaatcccagccactcgggaggctgaggcaggagaattgcttgggcctgggaagcggaggttgcagtgagccaagatcatgccaccacactccagcctgggcaatagagcgagaccctgtctcaagaggacatccaatggccgaatcacggctcactcgacattcaccctctgggtcatagccaatcctctcggctaaggcctctctattaccaggcactatatccccaatgcagtcagcctagcccctttgcgccattgctcttcgatcccaggcctccccc

SEQ ID NO: 268942 - DNA, 521 bp, Homo sapiens
aaaaagaatcttgggttggaaaggcagctgaccaagtgattctggtgtcttctgagtttccccttgccccttggggtatctcgttctgccacccctttagttggctcccatgtgtgcaccaccggctcagcagaggcagtaacttctttacttggtttccctcagtatgagtaaaaaagttggtgagttaaaaatacttttagggttttaaaaaatttttacagcctggcccatagggtgaaaccctgtctctacttaagctgaggcaggagaattgcttgggcctgggaagcggaggttgcagtgagccaagatcatgccaccacactccagcctgggcaatagagcgagaccctgtctcaagaggacatccaatggccgaatcacggctcactcgacattcaccctctgggtcatagccaatcctctcggctaaggcctctctattaccaggcactatatccccaatgcagtcagcctagcccctttgcgccattgctcttcgatcccaggcctccccc

SEQ ID NO: 268943 - DNA, 303 bp, Homo sapiens
tgagatggagtcttgctctgtcaccaggctggagtacagtggcacaatctcggctcactgcaacctccacctcccaggttcaagagattctcctgcctcagcctcctgagtagctgggagtacaggtgcgtgccaccacacccagctaatttttgtaattttaggagacggggtttcaccgtgttggccaggatggtcttgatctcttgacctcgtgatctgcccacctcggcctcccaaagtgctaccgcatccggcctctctctgctatataattctacggcaggcaaccagaagggcctt

SEQ ID NO: 268944 - DNA, 1117 bp, Homo sapiens
aacatagtcctgaaagtcgtagccacagcaatttaacaagataaagcaataaaatgtattcaaatagaaaaagaggaagtcaaattatcttcactggtgatataattctctacctgggaaacttcaccgaaaaagatttcaccaaaagatttctaagcctaaataatgacttcagcaaagtctcaccatacaaaatcaacatacacaaatgagtagcatttctgtgcaccaataatattcaagctgagaaaaaaagaacatggttctatttacaatagctacaaacaaaaaaatatgtacctagtaatacattaaatcaaggaggtaaaatatctctacaacaagaactacaaaactgctgaaaaaaaatagagacaacgcaaataagtaaaaaggcactccatgctcatgaatttaaagaatcgatataattaaaatgtccgtgctgcctaaagcaacttacagattaagtgctatttctctcaaactataaatgcaactttttatggaattagaaaaagaaaaccattctaaaagtcatatggaagaataaaacagcccatttagccaaagcaacattaacaacaaagcaatcctggaggcctcacattacctggcttgtactacaaagctacagtaatccatattacatggcttgctacaaaaatacacatgtagaccaatagaaagaagagaaagccctgaaataagtttacatttctacacccaacttttttctgacaaagtcaacagaagtaaacaaggaaaaattgtctatccaacaaatggtactgggaaaactggttaatcatatgtagaaggagaaaattgaaactgtacctctcaccatataaaaaatgtaattcaaaatagattaaaaacttaactgtgaaacttaaagctataaaaatcgtagaacatcaaaaaagtactcttctagtcactggcctctggaaaggatttatgactaacaccataaaagtgaatgcaacaaaaataaaagtgaaaaattaacacctaattaaactaaaaaacttctgcacaccaaaagaaaccattgacaaatatgcagacaacctagagtatggaataaactattttcaaacttcatacaaga

SEQ ID NO: 268945 - DNA, 453 bp, Homo sapiens
agttttccgtttcattttcagttttattgttattttattgactgatacttttgtaacacacaataaagatgaatcatatagcttcatccactggaggtatcctttataaaaagtggttcttctatgcctcttaaacccaggtgttctcgttatcctgtagcatcatcaacaaggtaggaaagaagggtcatgcacgtggatcttgcagccacatagatatcttatcgtggaccaataacagtttgtggaccactgtagtccaaggactgcactgcagcactgtcaagctttcttgactatgagtcaataacttctttttattgtttaaagtaattttcagttacaagaggcagattccaattgaagcactctatcacagccatatccatctaggctgcagtcatcggatgacatgttgctctctctttctatctctctctttcccacaggaga

SEQ ID NO: 268946 - DNA, 557 bp, Homo sapiens
tttttttgcttttgaactacacttactctccatggcagcttaaaaagagaagccccatgaaagttttaaactctatccaaacccaggacaatccagcctctgtttagatgtgcctccacccatctcagattttgatataatttgtcactctgccatgtccttgttcaaatactacagtatgtactctctcagcttttatgccagaaaccacgagtctcctaactttaggaatatgttgggtaaatattcttacccaatgaactgcttttgaacacttaatggtttgcatctaatattatatatcactaatttttatcctcttcacttcaaaaaacataaaattcaccctttgaacacatcacatgtccctgaatatgtaagccctgtaaccaaatcttcagctgccattctcatgggagttttttatctaatgagattatactgaactcaaatctaaaatagatttgcatttagaattaaagtgataattctttctcctttataaaatttgcgccaaaataggttcatagttagaatacctccacaaggctcttgat

SEQ ID NO: 268947 - DNA, 670 bp, Homo sapiens
aaggagggcagtttaactgaaaattcagaggtattatagctctgaagaaaaatactgatgagcagttatacaaaatgagaaattgagttctaagaaatgcatccctaacttcaacataaagatagctatgagaaaacattctttgtacccaaccataaatgaataaaaatcacctcatttctcatcagatgtttactgggttgctagttatatatagaatcctgcaagaggctcaacagggaagtccaaagagtcaatcaagaaggtatgataatggctaaagatggggactgtaggtcaatgctccacgaggttcttcttttgttgcaccaatatagctgcactgttatacccatatggttacaatccaggcctcagaaaatgttgcagatgccctcaccagaaggctgagaaccagttcctcagtttgcatgcctccagacagcactagaagtcaaactcaaattgcttacatggtaacttggtttatcccaacaccaactaggatattccctcaatcacatgattgtactgaaaatataaccaagttttatttatgtttttcatttggtattagccatctggtatttaacctctgaaaaccacacaatcttctatacgcttttttcactggaataaatgaaactgcttacttttgacttaagtctat

SEQ ID NO: 268948 - DNA, 640 bp, Homo sapiens
tataggctcctgcctttaaggtactgtttcccttctgggacaaaaaacaagggcttttacagggggacttggcataaatggcatgcagaagagggtgcaagcaggtgcacggtctatgtgacttcttgggtgccttatctacccgatggtcaagctgacgccattgtgggcagagctagattgtaaaatggccattgtttcaagacacttggacagagttccctcatgggcctaactgaggttgtaaattgactgttgtctcttaaggccttctcctggtgggagagagtcccagctctcaagcattgaagtgagcacatacataagcttgccatgcagggagtgtctggtaaaagggaaggtaaaagttatgattccatttctaaagagctaagcaggaagtagagaacagggaaaaaggctgaaagagaaaagaaaaaaattgttttttaagtaactcattctctttctcttagaaaaatggagtactcagttatagtaggaaaagactcaaattataatccaaattaaggtatttttaaaaaatgttctttcttccatttttactagtgaacagataagcactcttgcaaaaaaaaaaggaaatgtcagaaagaaaatatggagttggtttagtcac

SEQ ID NO: 268949 - DNA, 242 bp, Homo sapiens
ctaggatttgagtaattttctgtaatattatatctcatcgagtaattgttgatcagttaaaacttgaaaagtagctttccttttggcctatgtgtcttcttttattcactgaaaaaacccttgcattcctatgtatattcaagtcattaaattattaaagaatcagcttctgcaatgaaaaataattattattgttttatttatatgttgaaataaagtaaaaaaaaattatatggataata

SEQ ID NO: 268950 - DNA, 254 bp, Homo sapiens
tctcagcctcagtcacctgcattggcgacatccagtcatgaatatacagcaggaccccaacatcttagtagttttaagcctgaataacttcagaagtacaagtcctataaacttacaaaaacaccattttaaagtttaattatttaatgttgtgtgcatggttttgtgattttcgaataataaatgtttcactttaagttttggtctccatcctcccaaagatggaaaatgctgactcaaaccaaaaatgaaaa

SEQ ID NO: 268951 - DNA, 509 bp, Homo sapiens
gatttgcgtctatttctgtcctccctccagactctagcctcatggttctcagacatgggtatgcatcagtctgggcttcctgggtctgaagacttcccaggtgattctagtgtgtagccaaggctgagagctactaatcttgttaagtctttcaatgaaacatgagaacactgagagtgtgaaaggtgacacactctgcccaagtccctgagctcgttaggttctgagtctgcactcattcccagggctgattttcaagacagtcccacgggttctccatactcagccttgcaggtgcagggggtagaatcttatatagaacctgcatcttttctactcttaatttgaactgtaatccttgaattagagtgtagtcagtgctgctataatgcttgttttggaatgtaaatttgtttctaacgtgattgatgtattagggaacaatattaatgtgttagggaagactattgatatgctggagaataatattaacatattcaagaatgtga

SEQ ID NO: 268952 - DNA, 403 bp, Homo sapiens
tcaaccccttctacaatagctgcacaaaaaataaaatacttaggaatatacctaaccaaggaagtgaaagacctctacaagaaaaactacaaaatgctgctgaaagcaatagatgacacaaataaaaacacatcccatgctcatagatgggtagaatcaatactctaaaaatgaccatactgccaaaagcaatctacaaattcaatacaattcccatcagagtactgacattattcttcaaataactatgaaaaaacaatcctaaaattcatatggaaccaaaaaaaaagcttgcatagccaaagcaagactaagcaaaagaaacaaatcaaaaggcttcgtattacccaacttcaaacaacacaataaggccacactcaccaaaacagcatggtaccggtat

SEQ ID NO: 268953 - DNA, 306 bp, Homo sapiens
gatcaatatcacattaggagttagttaggcccagtagtaaattgctaattaaaagaagaattctttttaattaggcaataggagaataaaagacacagggtaatagaattatgctttcttggttactctgtgctgaggtgatatgatggtttatatggctagctgagaaaacttattgttgaatgagcacctactttgtgataggcagtttcctcatccagaaagtagcaatagtacaatttaatttgaataatttgaagtctgtagtgttttttaaattttctacgtttctttttactttttttt

SEQ ID NO: 268954 - DNA, 432 bp, Homo sapiens
gtatttattttactattcttttagcttttctgaaggtttgaaaaaaattaaaataaaaaataggtgaacaaaaagagtgagggctgtggaattcagactgcctggtgttggaattctgacactgctaatcataggctctatgatctggggcaagatccttagctgttattagtttccattccttcatctgtaaaatgagtataataacagttcctctcttgtagggcagccatgaagattaaatagtattatatgaattaactattattaattacaagcttggaactttaattcttaatacaaattacttaggtgacacatcacaacggactgatcctggtgggttatgtcattgttgggtacaatgccttctccatagagctcagggaacagaaccagcatgctccttcggaattgccaggctgatttaaa

SEQ ID NO: 268955 - DNA, 505 bp, Homo sapiens
aacattcgagaacaaagttttgtcatgttactcttattccagtttcctgccatctgattcacatgcagatgttctattccagagtagtccaaatactatgctctgctgactcaagtcatgtctcaaacctatttcctctattaagtaagtcagtcaatccatagtgaaatggactcttcctaccgcctgtagcatttactgttgatactgagtattttccattttaatagttcccagcctttataacactaagttttaagaaatgttgattaggcatctgctaaggttacatgctaagcagctacttatattgtatttggtatttaattttgtttattctccagttgaacagtagggaacaattcaagctacttgaattgtttttcaccctcaccatccaagaccgtgttaagtacatagaagatgcatggtgaaattcgtttctgctgaggtttctattttaaatggcaaattctcataataaaatggagcattgatgcctaac

SEQ ID NO: 268956 - DNA, 503 bp, Homo sapiens
cctcttttttttctggccatatataccaggaagtgcagtttttgccagatgcagttatagtgttgtaaaaatgctgaaaaatattgccaaaaatttgttaggttgttatattggccaagtatagtaaactaaaagaaagtaggtgaagtgatcattaaagctaagactttattaatggaaaagatattaaaattagatgaaaataattgaaaagagaagactgtattttggtcctacatattgatgagcaaaaatgtgaagagctagagagagcattctttttttcaaatttttagaaaggaaataatatctgaataattttaaacaaatacagtctctttacatgagtgtattaagaaattaaggttgtttagataaggagtagcttaattagtttataaaaatatatgaagtgtattctacaaagaatatggactaattcctctccattttagagtactgaggaaaaagacttagttttaaataagtatacaggaattaat

SEQ ID NO: 268957 - DNA, 209 bp, Homo sapiens
accattgtgaatgtgcctatgtatccttcagcacattttctgtgtatattttgcacccctgttgcttacataaaatgtacatgggaagaattattattcagaaaatattaaaaagtcctttaaatcacctaaggaaacaaaatgacagaacatcagaaaaatgggccaaaggtatggaccagggatttggagaagagttaaactgaatc

SEQ ID NO: 268958 - DNA, 268 bp, Homo sapiens
gtcagttattccttagaggcctaagtgtctccagtgaaaggggccattgtctcagcctatggtagtgtgactgtttgaagtttgatagcctgaaggtgaggagaatcaaactgtgttactaaaaagcacgtattaaaatgaaccaagggaaatgtggaagagacagctcaaaaaaaatccagggttttcaccagtttgcataggtagagggaggccaaaagcccaacaggaaaaaataaaagaaagaaagaaaaagaaaagaaagaaa

SEQ ID NO: 268959 - DNA, 488 bp, Homo sapiens
gtcggcacctagagccgcacggaggttcggaccccgcccgccgagggcgcccacacctggagctgggtttcggcctctgcgaaagtgaaatgcccaagcctccggccaaagcccagaccagtacagtatgaattgtcctatgagactgaggggttcggcttcattcctacctgcccgcaaagctcgcccccagcctcgaaaacaaagcgactggtctgacgtggggtccctgcgcccctcctctagcgcgacaggacccccccagggaagagccagtacccgtgggatgtcaccccgtccccatctaccggggtggggggcctgaaaggagaacgatttaaaataatcttcagaaagaaaagggaggagggagcgggtgacacatcgttcacataaacccaatttctggtttcgagtgaagtcaagatctccgcccctgcgcctgcacacacacctcctgcctaacattctcagctgcaaatgccaaa

SEQ ID NO: 268960 - DNA, 434 bp, Homo sapiens
gtgcctagtaacatcctggcacacagtaccatatgcatgggtcttaggtatcttggtgcctagtaacatcctggcacacagtaccatatgcatgggtcttaggtatctttagtgcctagtaacatcctggcacaccgtaccatatgccaggtgaacatgtgttggttgaatgttctaaatgcatttttaacatttggaagaacatcttctttatatgtccccatcttacactttggtttatttcaagagtctatttgtacttcaagtcagagtttttcttagaaatgatgttatacctaatgaagagcgtaatagaatacactataaaagacttccctcggccgtgcgcggtgactctcatgcctgtaatcccagcactttgggaagcctaggctggcagataacctgaggtcaggagttcgagaccagcctgg

SEQ ID NO: 268961 - DNA, 205 bp, Homo sapiens
gctgtaggccttgggaatggacgagaatagaatagaggaatagcgtgtttgtgttttgcccgcaccatggtgatgtgtgttgtttaactaaacaaccaaaccaaagaaaggtgttgccctacaaacaacctctctcccaggctccctgtgtgaccttctggcccttggaggaggcacagatgcgtggaacagagccagcagacac

SEQ ID NO: 268962 - DNA, 424 bp, Homo sapiens
cagaagtctgcaaagataatttataggacaactccccaaatcaccccacgtagtctttcctaaaatttccaacaatgcaatttcttagtacttttttaagaggtaggtatttaataaagttaaggcatttctagactaaacaaaggtaaagcattagctaacacatacgcagggtctagtttatatgattaattcccattaccaatcataaattcttaggcagcatagactcagttcttcaaataagtattaaaaagaacaatattgagagcatgacactatgatgtctcttgagtgaaagaaaataagagaattgaacttcaatctctcatacattataaacatgtttcttacacaaaacacataccagtcaatgaaaaggtcgtggtttttcacaagttctttaggactcgggcccagaatt

SEQ ID NO: 268963 - DNA, 497 bp, Homo sapiens
ttgagctccttttattaggattatttttcatagttgtatatgcaaaacagttcagaaactcttgtaggattgaggaaatgagtaaatgtctcaatgttcttgggagccaagattctcactatagaagaagatatacgcaggtacggaacagggcaaagtgagaaagaatcctgtggcaatgggtttgaattggaggcattggtgtgaattcaagctttgtaaagtatgtgtgtgaatgtgtgtgtgcgtgtatgtatatacgtgtgtctgtacttgcatatatttctcagctttgtccactgaatggcctgaaagcaaagaaaccccaataatgacatgccttgtatccagataatggtctctaataccattccccactaaagggaagcagagctcctttgagaaatggttgattccagggcttgggcagggaaaatataaggggaatcttgaatattatgttcctttgccagaaggaaaagatacttaaaaaaaaa

SEQ ID NO: 268964 - DNA, 825 bp, Homo sapiens
ggtcaaagaacgaccagcctacagtactgtttattggcctgagcatacggaaggatgaagttgcaccagcgaaatgggattaagctgcaggtgcgggctgggcgcggtagctcacacctgtaatcccagcactctgggaggctgaggtgggtggatgacttgagatcaggagtttgagaccagcctgaccaacatggtgaaacctcgtctctaataaaaatacaaaaattagccgggcgtcatggcgggcacctgtagtcccagctactagggagaccgaggcaggagaattgcttgaacccgggagatggaggttttaatgagccgaaattgcgccactgccctccagcccgggcaacagaccgagacaccttctcaagcaaaaataaaaacaaaaagctgcaggtggaaaaaaaagtctggattttggttcagagcccctggggccttcctcagtagttttctctttccttgaaaaaggaagcctgtctcagtctctgcatctctctgagtccttttggagattgaggatggtgaggtctcagtgcttggcccccttctaactctgggtacctcccctcccgtgggtcaacctggtccagtgcacaggccccagctccgacgaccatctcccccctaccctttgctcccagcaaaggccatttctaggtcagtcgtgaggtacagccaggacagggcagctcgctccgagatttttggctctcgaaggccttgagcgctgtggttctgcagaacgctgtctgcctcttgtggaggaactgacacccgctggagaaagtgtggagggaagcgagggctgcacct

SEQ ID NO: 268965 - DNA, 486 bp, Homo sapiens
agggtatattctggttaacatgatggagccccataaggcatcaccatgggaatgaggacttggcatggacacctcttggctcgtggagactgcccagaatgtggagcctgcggctggggctcatcttgctgatttgggcttcccgtcactggcagctcccacagcaggtggcgttcccataactagcaacttcactgagccactatttcttagctgttctttgaaagacgttgaagacccctctcttccactggccaaagcacttctaagggattttggagagaaaaacttgggagctttccatgaagaaaacagaagaatctggcagccgtttccatagggctgaacaggcaccttagagaattccagtgaagagggcagctgctgtgaagtttcccattcactgcaagcaaagtccaggtgaaagcaaagattcttcacccgcagaaaccctctgggcaggtaactcatgatgtattcccagcc

SEQ ID NO: 268966 - DNA, 793 bp, Homo sapiens
ggatgggatccaggagaaaacgtgctgaacgtgcagcttgctcctaccgattacagcccagcagatgacatagttccactgtgctctagtccattaaacagaaagaaattgaagacagagatgaacacagatcaagagcccaggtttcttgatatctaatactaatatactgatggagttaaacattccaaggaatatagcatgtcttggtctctgagagccaatatatctgggttacactgaaagaggaataacgagataatatttacactgtacattgaagatgacctgaaaagctggaagagctcagacagacatcagctggatgaagccccaggttcaaacaaacttgccttggatatcaaagtactagtaacaaaggaactcccaattcctcacctgctgtgaagtttcccattcactgcaagcaaagtccaggtgaaagcaaagattcttcacccgcagaaaccctctgggcaggccaggcacggtggctcacgcccagaatcccaatactttgggaggccaaagtgggaggattgcttgagcccaggagttcgagaccagcctggacaatatagtgagaccccatctctacaaataataaaaaaaagtagccgggcttggtggcccatgcctgtggtcccagctacttgggaggctgaggcaagatgatcgcctgagcccaggaggtcgaggctgcagtgagcgaccgcatcctagcctgggtgacagagtgagaccctgtctcaaaaaaataaataaacaaaaataaaaatatacgtttattcta

SEQ ID NO: 268967 - DNA, 571 bp, Homo sapiens
acagctctctaacaaaggacacaatggaatgtgcctgttttcaaattcctgtaaaaaagggccctggaagacctccaagcctgctcagacagacatcagctggatgaagccccaggttcaaacaaacttgccttggatatcaaagtactagtaacaaaggaactcccaattcctcacctgctgtgaagtttcccattcactgcaagcaaagtccaggtgaaagcaaagattcttcacccgcagaaaccctctgggcaggccaggcacggtggctcacgcccagaatcccaatactttgggaggccaaagtgggaggattgcttgagcccaggagttcgagaccagcctggacaatatagtgagaccccatctctacaaataataaaaaaaagtagccgggcttggtggcccatgcctgtggtcccagctacttgggaggctgaggcaagatgatcgcctgagcccaggaggtcgaggctgcagtgagcgaccgcatcctagcctgggtgacagagtgagaccctgtctcaaaaaaataaataaacaaaaataaaaatatacgtttattcta

SEQ ID NO: 268968 - DNA, 324 bp, Homo sapiens
gaaaatgccacccgagctgcccacccacatgagttttaaccttctaaagatatctgtgtaagcaagctacaaaaactgtgtgttcctcctttaccagaatgtgtgtccttcagaaaaggtaccaggtcttacaccccttcccacaatcgctcaagacctggacatggtatgcagagtcatcagaaatgtgttctaccatcgtctgatacccctgcaggctcagaaggccccttctccagagatactgaaaccgcatttccagccttaaccatcacaggttccacaccaatgatgaataaatgccctcacacccccccatctcca

SEQ ID NO: 268969 - DNA, 312 bp, Homo sapiens
tagaaagctaagaatggcttcacatatttagtagttgaaaagcagtcaacaggcgaccaatactttgtgacatgtgaaaattacgtgaagtctcagtgttcatcagtgaagcgttctgggcacggccatgcccggctttcacatgttgtctgtgctgttctcactccagtgggagagcggagtagtcgccacagagagcacctggcccgcacagcctgttctgcattttacagaagtttcccaactcttgctttgttacatgcaaagtctagaaaggataaatgcaaaatattagcaggtgatgttgtgaag

SEQ ID NO: 268970 - DNA, 405 bp, Homo sapiens
gaaaccccatctctactaaaaatacaaaacttagccaggcgtggtggtgggtgtctgtaatcccagcattttgggaggctgatgcatgaaaatcacttgaacccaggaggcagaagttgcagcgatccatgatcatgccactgcactccagcctgggcaagagagtaagactctgtctcaaaaaaaaaaaaattgcctaataatagcttggaagtgcacatcttcaaaacacaaataagtaactgtgtttaaatgaggccttctgtgtaatatctagggaaaatcaatgtggctattcaaatttgtttccccttccaagcacagagaagttgctcatgactctgtgatccgttttgtccaatgaaccatgagcagcagcagcaacttgagtcacctccaggtgga

SEQ ID NO: 268971 - DNA, 506 bp, Homo sapiens
ggtaagtgggtaagttcagttgaccatcacctgacagtaagatacagaattgagatgtattggtggtggtggatttaccagaataacacagatatgccttttatgtctttctttctttttcccttgtggaacagtataataattgtttttatggacaatctcatttgaactttttttgtctgccccaatatgagaaatattccaaattcttgatgtgtttccagccctagtaggctagtcatttccgggatgctgttgagcctgacaggtctggcctcaattaggcaatggcttacatggcatgaaagaggacattagtcaaactgatttacagcttcaaggttcagaagtgtttcttaagtttgagggtgtgaatactagtgatgtacctggcattgagaaattccaaaattaaacttgtattcagctctagcctgcttaatctcctatcaaactaagatggtacgtttgtaaatacaaatgaagttaattgcattttaaactga

SEQ ID NO: 268972 - DNA, 481 bp, Homo sapiens
ggagcattatctccataagaatgagaaaaatgacactgcaggatagaacagtagtgttaatgggtcagtgagtgacagctgagccttctctcagaggtatcagccaggccagtgctgccaggaacacaagagctgtacagtaaagtgtgccaatttaatcttgtcacacgtagcctggactgcaaagatagagctccccttaaaagcccagtgtgtcaagcctaaacccgactcatgccagaagagaacatacaaagatgctaattggaaaatatctgtactacgggttcccacagaagatgtcctttaaaaaaaaaaatttctcaacaggatctagttaagataataaataataaaatgtgaaactcccatagacctcttggtcatcagttaccctatatatcctaaattcaacttaaaaatagacatctgaaatcaaacaatgttgaagcatttcaattaaactgattaatcttgataa

SEQ ID NO: 268973 - DNA, 516 bp, Homo sapiens
ttgaattaatatgttttgtgattccactttatttccactattggtttattatttgtacctcttaagttttacttgttaccttaggtttacaatctgcatctttaattaacatgtctgcattcaaataatattatattacttcacatgtagtttaagagccttagaacagtgtactcccaattcttgccttccattctttgtgctgttatcatataattttatgttattttctctttaagccccactaatgtttatactttaaatgattctgtaaccaccctcactgttaagatttttctaggtttgtgacagtaagttacaagattcataaatttgcactgttttacaggtggagaattaggaatatagagacaataagaaaaaagcgttagcctgacaaagtcagagtgctagaagagagctttcaatagctacagataacatttcctctcattcttaccactcagtgtttttctttagtcattaccttaattataactcttactttataagaaa

SEQ ID NO: 268974 - DNA, 206 bp, Homo sapiens
gattcaacactgccccaatatttaaaaaaggaaaatatattaattcaacttataaactgctgagacttcctatccacaagccaacaaattcagttgaacactgtaatcaataacaaagaaataaccaaaatctatgagaataagaacgtggaaaatcaaccaaaggtatcaccaaatgaaccaaagatttcattactgttttagtc

SEQ ID NO: 268975 - DNA, 429 bp, Homo sapiens
gtgaacaatcagcgatgtctgctgaaatgaaatgatttgaagagtataatgtaaagaggaaactcatttaaggagccctgtcatggtacggtttcccagatggactcaaagcgaaagagcgaggagcagaacagtgagtttcgtgggctgcactgtgttgggggaggaggcgacgtctgcaatcgggctacacatgttcatcaagacaggggagcagcttcgcccactgggagcagaatcagggacttggtcagagggagacgttttgctctactcccttttgtgctgtttgaatttatcttctgcatattttcctttcaaaatgaaaataattataacactggatagatgagaagctgcaggcacttctgctatcggctgccccagctggcctttggtaccacaggtcacaagcccccttaccctcag

SEQ ID NO: 268976 - DNA, 554 bp, Homo sapiens
ggggcattttaaagcccactgtcttattcgattctcctgacaaccctggtttattcacttttcagaggaggaaactggcaaagtcaattgctagttataggcagagctgaattcaaacccaggactgagccctcgtaatgtcccctttcctccttgggtttatttgttctccattctctgggacattcgggtcacaagacctgtttccagttttggccctgccatttactggcagaggaacttaggcaactgacttggctttcctgtgcctcagtttccccatctgcaaaatgggacagatatgccctattcagagggttgatgtgaggcttagctgctcctgataacaatggctaatgtgtcctgaaagcttctgtgtatgaacactttgtgggtattatgctcatggcatgtctgggcaagtacgtagaactatgtgtcccattttgcaaaagtcttgattaaggcttagagaagcgaacaccttgcccaaggccacgcagagagtaaagatttgaacgaatgatgtcttgactccagggcccaggctctta

SEQ ID NO: 268977 - DNA, 452 bp, Homo sapiens
caaagtgctgggattacaggcatgggccaccgcgcccagcctatttattatttctttagtacaaattcccagaaatggaattactgggccaaagagcataaatatttaaagcttttaatatctgttaccaaatttgccatccaaaagcatattgccagtttatatttccagctttacgcatatgacagcctcttgtttctccatagccttgatagcattagatatattaaattttacaatttccctagttttaatagcaaaaatttgtgacatctaaattttattttttatttttaatagtgaagttgaacattttgagtaagaattaactcttagtgatagaaaaagataatcttcccaccactttgtggcttataaaaccctctgtaatcttatagagggaagtagcaaaagccagaagagagaccaaaatatgacaaagtgggatctca

SEQ ID NO: 268978 - DNA, 327 bp, Homo sapiens
gacagtttttataacctctttgagctctaaaccatgtttcctgtgcacttaggagatcttaatagaaaccaagtacttcttttaggcatctatactcttaatgccgtaagtcaagtcaagtacccaggtggttaagataactgtaccaacagaaacatttttaaaaaatatcctaacacaacatgaagtgaccatcgcgaattcaaagaagcaggcatatttcttaaaggttgaaaagaggtgagtctttcacaagattctagctcaaggccatatttgcacaagtatagtcattcctctagcaaggttttgtttatctggccatta

SEQ ID NO: 268979 - DNA, 478 bp, Homo sapiens
atgtacaagttacaggtggagataagtgctctgcagaaaggagcatgactcttgtgagagaaacagaagaccatgttctgaactgggaatcaaggaagacttccctgaggacgtgacccttgtttggactctattctgtttatgctaaggattttaataaggagcaggtgatggacatgatccagcgtacatttttagaggaatatcatgagtcctatcacttcatctcctaaatatttctgacatctgttctctttcctccatcctcacgaccttcactggcatgggcctccaacagctcactgtgggggaagtttccctcaaagggcactgataacacatcttattaaaactataccacatcattatacctccccaacataatatgtacatgtatgtatttgacaataatatatatgtattactgtcctatttattatatacattaaaaacattcacaaaaaattaaaaatccaaa

SEQ ID NO: 268980 - DNA, 386 bp, Homo sapiens
taaagactacccagcagggctttccagcagccacatgaatgtcctataaagcctctcttcacacctgggtcacacaaaggtgggaaagactcagtgctgtcctgaagactgtccagttcctgaaatccatatgttcactggatctttatgtgtacaacactcctctttagccctcactggcgagcatcctctcatgccagtgtctccactcttaactactctcccctcctccctcctggaatcttggaggatttctgagagtctaccatcattgcaacacatttctcctccattataacatcaaccatgccacactttccatcccaactgctagcaatagacacttgcatgtaataaaaaatattaattgaattaattaagagaaa

SEQ ID NO: 268981 - DNA, 1107 bp, Homo sapiens
cgcatttgtcatttcagtcaaacatacgttggcactttgggaaaaatgttatctgttattgctctcacagtaagcttttaaggaaaggtaaatagactgtttctttgatgaaatatttaattcatatctcaataatggatcaagatctgtacctatatggtaggtatacaaaatacatgaaagatcaagatggggaggcagtgaaacagcttttaaaataattgtgtcaatgcagataaaacattaaattcctttcttgcctcttctttaaaccaattctgtatctactgagtacctaaataagaactctgtagatgtgaactgagtaattcttttcaggaactgagaatataaatagggaaagagaacacagaagaaaatattgatataagacacaagagcaagttcattatacttagggtaaaaattgtataaaagaccagagataagatttaaaaatccactccaataaataaaggcttcatctagaaatgcttcaaggaaacttactgggaactgaaatataccaagtgaacctggacattaaaaaaaaatagaaagctgttggggccgggtgtggtggctcatgcctgtaatccaactttgggaggctgaggctggaggatcacttgagtcctagagtttgagaccagcctaaacaacatagtgacaaagtgagacccctgtctttacccaaaaaaaaaaaaaaaaattaaaacttaggcacggtactgtgcatctgtacttctagctacttgacagagtgacctggaaggactgcttgaacccaggaattcaggcaacagaatgtcaccctgtcttaaaacaaagggggtgttggacaggtaagatgttattgttagatatgaagaataagctcaggtgttctcttgcatggtaaggtgattatagctaataataatgtatctttcaaaatagaagagagaagttttgaatgctcttatcacatagaaatgatacacatttgaaatgatacacatttgagataatggatttgctaattaattttatatgatcattatacaatgtatacatgtattgaaacatcacattgtacttcataaacgtacagtcattgtgtcaatt

SEQ ID NO: 268982 - DNA, 364 bp, Homo sapiens
aaactttaatatatctatttctccatttccatctttgtatttatgcaccgtaattaaaactttcatgtttgtgtgaatagaattactcatgcagatgttaaaatgtattaagttcatattaggccaggcacagtggctcacacctgtaatcccagtgctttgggaggctgaggtgggaagactgcttgaggccaggtgtttgagaccaggctgagcaacatggcaagaccctgtctctgccaaaaaaaaaatgttttttttaaactttgctgggtgtagtggtgtgtgcctatagtcccagttacttcaggaggctgaggcagaagaatcacttgagcccaggaggctgagactgcagtgggcc

SEQ ID NO: 268983 - DNA, 425 bp, Homo sapiens
aagacttgatatactctggttgcttcatctaaaaacataaacccagcagttacaaaggaatttgtatacttttattgttgggggtgcaaatgaaaaaataatcgatcctctgttagtcatccctagtgtgttagtgggggcacttggacttacacactattgaggttctggattaattcaagcattcatgctttttctttcatatacagtttattgcacaataaataaagtcaccttaaaccaagttttaatgcctggaagcttaaagtgggggaaaggttgaaatcttttactttgagagtagcttgattttttctgacttccctcaaaaattacaaatccttcagaagttgagtacattatgattcttgatgtatgtagcttaatgttattgacgtttcggttcatttctctgcaaaaaaaaa

SEQ ID NO: 268984 - DNA, 528 bp, Homo sapiens
aaggaatggaaaaagatactccatgcaaataggaaccaaaaagagcaggagtagctagacttatatcaaacaaaatagatttcaagacaaaagctagagacaaagaaagtcattatataatgataaaggggtcaattcagcaagaggatatagcagttgtaaatatgcatccaacattggagcacccagataatataaagcaagtattattagaactaaagataaaccccaatacaataatagctagagatgtcaacacaccactttcagcactggacagatctttgatacagaaaagcaacaaagacacttgactttatctgtactttagaacaaatcaatctaaagatacttacagaacatttcctctagtggcttcagaatgcacattcttttcttagcacatggatcattcttaaggatcatctatattaagcacaaaacaagtcttaaaatttttttaaaaatgagattcatctcttaaaaaaatataattttatcaagattcttctgaccacaatggaataa

SEQ ID NO: 268985 - DNA, 461 bp, Homo sapiens
caaaaaggtggcctgtaatcccagcactctgggaggccgagataggcggatcacttgaggtcgggagttcgagaccagcttagccaacatggtgaaacctcgtctctactaaaaatacaaaaattagccaggcgtggtagcaggcacctgtaattccagctactaggaggctaaggcaggagaatcacttgaacccaggaggcagaggttgtggtgagctgagattgtgccactgtcctccagcctgggcaacagagtgagactccaccccaaaaaaaaaaaaaaaaaagtttgtcagccatggagaattatgtttaaattctagctaaaaatgttatgttgctttgataagaagtgttgaattagagatgctaatgagataataatgtatttaatgtaaaaaatacattattaataatgtataaaagtctataaacttgactgcatttttaataaagctc

SEQ ID NO: 268986 - DNA, 725 bp, Homo sapiens
atgaatcctacagattgcagcatgctgagtgtgttttgcaagatgcacatataaggtgatgattaatgtttaatccctttcaaaatcactagtgagatctgctaggtacagttactggatctgtttattttaccggaaatgtacgtgggtactctgaatgactcactgtctacctttaggtttctagaacaatctctgcttcctgacctcttttttcctgctcctgtgcccttgcaacagacagaacaaacacaatctctctctttctctttatacctggattatatgttaattaaaattaatattaggaacataaactttccctactgttagttgtaataatctcattgtcacactagactagttgttacagaactctcattttggtttcagatatttcattttttcctgttaaaattaatatttttcctttgtctatgatttacatactgataatatttttgcctctatgaaactaacctgctaataatatgttaaagaaattattttatgttgccatttatacttaaaaccattgccacattcaacgttaacaaaatttatatatacttatccaaagatactgtatctgactgtcccatttttaaatgttttttgttctttctctttcctgcctgttccttgtcctgcctttaataatggaataatattctactttccttctttctgccacatacccccttgcacaatgtttcccttatcta

SEQ ID NO: 268987 - DNA, 481 bp, Homo sapiens
ataattatatgctgagtcctacgaatcttcctaggaaatcacatatatatgaatgaaacattttatatcgatttttaaatgctcactacatgcctctgaagcagtcaagcagtttattgtggtttaatgatgagatgcatgtgctgaggaggtaatcagaagaagtgagaaaaggagacggtgtgaaattttgaagattttatatgccatgatgcagaaataaaagttcagcagggtcaagtaagttgtccaatgttcagtatgatggagtgggattcacatgcaagactaactaccactgaaccatttacttctgactttgctattctgcttccactcactgaacatctctctgagcaaggctcagcacctggtatgaaggctgaaacaagagcggttgcacagcaaatgttttgctataatgagagaatacatgaattaaatgcgaattaaactgcttctatctccttatggtggcaaa

SEQ ID NO: 268988 - DNA, 273 bp, Homo sapiens
ataattatatgctgagtcctacgaatcttcctaggaaatcacatatatatgaatgaaacattttatatcgatttttaaatgctcactacatgcctctgaagcaggtattgctacttccattttaccaagaaattaagtaacctaagatcactcagtgaagagttgatccatttgactccacaacctgtgtgttttcttgattcagtctacaatgcctatgaaatgtgactgaggagaggtaatattaaataaatcatccttacagtgttgatc

SEQ ID NO: 268989 - DNA, 748 bp, Homo sapiens
cctaaatcctcagaaagccttgcctttagagaacgtcactgaacgaatgattagaggagtgctactttttcactcaaaaaatagcatccatgggactttttatcatctaagtaacctaagaattcaaaagctggatagaattttagaagcaactacgtacatcattattaatataaaaataacaggcagactcaagaatgtgctgagatttctctggaaaacaagctctgcctctccgggttttagtcaacctaacaccaaaccaaaatagaatgttagctgttcaagaatctgggaccagccaacctgtatgtatgcatttttgaagcaagagaaaattccattttatagttagacccaaattcactaaatagtgtgtatgttcactttgtttaagttgtatagacatagcccagaatgttttgtgaagatttgcaatatggtgttttggaatgtgtagaatacaaatcacagtttttactaccttcttggcatatgcttacaaagaacattatattttgttcatgttttacatgaactaatggataaaaaacaaagtatacatatatgtctatatatatatatagacacacacacacagacatatatttccttctttaaggtaatcatacaaaaggtctatacatacaggaaggtatatattgtctcaatgcaatcaaatcatcttttactggggattcaaataaaatgtagcaaataagagaaaaataaaatgaaagaaaatagc

SEQ ID NO: 268990 - DNA, 349 bp, Homo sapiens
atcacccacctcaggctcccaaagtgctgggattacaggtgtgagccactgcgcccagccaacaacaatttttattttaattgaaaaagaggtcggttgctctgcgagtgcacctcttcactccagaagggtcacaatagtgggggcgggagcccaggcgtttattcctgttcagtggccattcccagacacacttcaggtgctgttctcactgttcctccaggcccttgtgcctcttaaaaaaaaatttttttttccactttggaaagctgagacaggagaatagcttgaggccaggagtttgagaccagcctgggcaacataccaaggccctgtctcctcaaaaaat

SEQ ID NO: 268991 - DNA, 330 bp, Homo sapiens
caggggcagtcatgcaaaggccctgggacatgagcatttgggggaaaccaagaaggccggtgtaggccgcgcgcagtggctcacacctgtgatcccagcactttgggaggctgaagcaggaagatcacttggagccaggagtttgagaccagcctgggcaacatagaccccgtctctactaacgatttttttaaaaataagccaggtgcagtggtgcacacctgtagtctgagctacttgaaggctgaggcgggaggatcacttgagcccaggaggtcgaggccacagtgagctgagatcataccactgcgctacagcctgagcgacagt

SEQ ID NO: 268992 - DNA, 380 bp, Homo sapiens
tgagaagttccaggacaagatgtttcaggatgctacaattttgccatgatgtttatggatgcttttaaatgagaaatgaaaattaactccagaaaattgtcaataatccttaaatcaagtctgcagtattttctgagaagtcctttagttagaatggttgagatcaccacaaatttgcgaagattgcaatgaagattgtgctatgactgtgcaatcaacctcctttaaggaggagtcaacagttacagatccaagatccagggggaggatgaaggaactctcaggaatcactgtccagtattgatgcctaacaaagaatataaatgcaggccattataggggtttacaaaagccacattagcaactatttgttcattctt

SEQ ID NO: 268993 - DNA, 459 bp, Homo sapiens
caaacacatccttctttacatggtggcaggaaggagaagtgcagagcaaagtgagaaaagcctcctataaaaccatcagatctcatgagaactcacccattatcacaagaacagcagcatgggggtaactgcccccatgatttaattacctcctactgggtccctctcacaacatgtggggattatggaaactacaattcaagatgagatttggttggggacacagacaaaccatatcaccctcttagttattcttgttcactttatcttcatagtacttctcacactgtgaaattaccttgtatatatttttacttactgttatctcccccactagaatgtgagctccatgaagatggtaaccatgtctgtcttgttcattgctttaccttcagtgcctagcacagtgcctggctttcagcaaatatttactgaataaacgaatgagttgggtatgga

SEQ ID NO: 268994 - DNA, 536 bp, Homo sapiens
ttgttgatgatatgtgaggacagataacgccacttagcatgtgttcagcaaatgaacttcccctccactctcttccttttctccaagaaatatttttttgaatgtcttcacttgttgaatgtttgctcttctgttccctaattcctacccttccatccagtccagggatttataagggagacctgggggtaaaattcatccattcttgtccagaacacctgcatcattcatccatccagtcctcgttcagcaaatactctcatactgcattccaacccccacatctgtgcacagcatctttctgtgctctggagacctgggaaggacccaaccagggatctattttccaggtgctcccagcctggtgggggaactgtccctgggcaggacagtcccagcccacgtgggcagggatggggtttacagtaagggaagcaggactaggggggtatagaaagtgtctcagttgaaagcctgaataatgatcagtagataattgggtacagttggggagcagtgctgtaggtcaagaagac

SEQ ID NO: 268995 - DNA, 256 bp, Homo sapiens
gggctccagaggaccctacaactattgtggggggaactggatgtggtgggaaaaattgtatacctcttctcagacttcataccccaccaatgggctctcaccacggtttgcagactgttcacaccgagtttgtgtagaaaggatgaaatcttaagattagaatgagagtgaacgcaggttggtcatgcctgcagctctctttgaagacactcgctatcatggtgggctagaaatagtcaccatagatagtattctt

SEQ ID NO: 268996 - DNA, 710 bp, Homo sapiens
taggcaatccgtccacctcagcctcccaaagtgctgggattacaggcatgagccactgcgctcagccatctgactgctttttattctggtcaagctggcagctgattacgttgtgcccacctagatgaaaggtgggcagcctttctcagcccactgactcagatgtgaaatttcctttagcaacaccctcacagacatacccaggatcagtactttgcatcctcaatccaatcgagttgacactcagtattaaccatcgcagtagcttttgttgcagagttgtggtggccgaaaacctgatcaccaacttagtggggcatttgctctttgtgtggctggtagaagcatacagtgtaaattcaggcaaggtcatatagtttaagattaatggaaactatacagagcattcgtttcttttttaagagacagagtctcactttgtagcctgggctggagagcagtggcactatcatagctcactgcagcctcaacctcctgggctcaagggatccttcagcctcaggctccccagtagctgggactataggtatagtctacccctattttcttttcatagggaattctaaaaataatgttgattcttctatagaaatagtcaccttaggtagtcacttttgatatgtctgatttatcatttccaaacctcacatgtgttccaccttgtaaagatagcaaatacagtgagctat

SEQ ID NO: 268997 - DNA, 496 bp, Homo sapiens
tcccaacggttgttgttgttgaattatccccaggcactcatggagttgtcctgaaacccatcttccgtgtgccttgatttatccatgctgttcttacccatgtcatcttcagagagaaaagtctttttcccatgcacagccaagagactgactttacttgttttgtacgtagttaagaattccaccaaaaagaattccactgccataccagcatctccaaggatgtcccataaacttggttgcagagttttgtgaaatgttgcactccagtagaaggcagcagactaggcctggtgcggtggctcatgcctgtaatcccagcactttgggagaccaaggcggcagatcacctgaggtcaggagtttgagaccagcctgacccatatgatgaaacctcatctctactaaaatacaaaaattagccgagtgtggtggtgggcacctgtaatcccagctacttgggaggctgcgacaggagaatcgcttgaacccggga

SEQ ID NO: 268998 - DNA, 470 bp, Homo sapiens
  misc_feature (344)..(344): n is a, c, g, or t
  misc_feature (363)..(363): n is a, c, g, or t
  misc_feature (407)..(407): n is a, c, g, or t
  misc_feature (423)..(423): n is a, c, g, or t
aaacaatcccggcgcctatcactcgcgcgcaggctcctaatggctcctaaattataaccggtcttcctacatcttcagttatctcttccactagagcagtcccaccagcatgtaaacatgcgggaatgtctctcatcttaaacaaacaaaaggaaaaatccctccagaaaaaccagcaaagcttcctttggccctgtattcctgtccatctactgccctcctccattttatagtaaaactccttggaagagttgtatgttttcacatccttttctgtcattctgtagcaagccactctgatcatgtttttctgctctgttctacctgaccaaatccaggggctnggctgaatgatattccatngtgtgtgtgtgtgtatggcattttctttaattcattcatccttngatgaacacttaggtngattccatatctgggctactgtgaacagtactgcaataagcataggg

SEQ ID NO: 268999 - DNA, 733 bp, Homo sapiens
aaacaatcccggcgcctatcactcgcgcgcaggctcctaatggctcctaaattataaccggtcttcctacatcttcagttatctcttccactagagcagtcccaccagcatgtaaacatgcgggaatgtctctcatcttaaacaaacaaaaggaaaaatccctccagaaaaaccagcaaagcttcctttggccctgtattcctgtccatctactgccctcctccattttatagtaaaactccttggaagagttgtatgttttcacatccttttctgtcattctgtagcaagccactctgatcatgtttttctgctctgttctacctgaccaaatccaggggtcaattttcagttctcatgctacccattagacctatcagcatgttacattctactgcatttgaaatccattgccttagtatggcctgtaatacctatagtattccaccctaccataatctcacccctttctctctccatagctctttactctccagccaagtggactttttttctacttctgtctttctgtaattgacgtatactatcttggctcattttcggaattgtgtatttaattctgtttgtacccatctacaatttgtaaatgcaatttcatttctaagatttgaaataaaaccagaacaacttccaacatgactttaaaaagaaatcaccccttcagaagggcttttggttcagaagagctatcaaatttggaaccctaagatag

SEQ ID NO: 269000 - DNA, 353 bp, Homo sapiens
ttaaaccagggttatttagctataagtccaaatgggttttatattcttgaaagtttatattaacaccaaacagtaaaatcttattgactatattttgggaaaattctgccttgtgagattgatttattcatttatcaagcatttactaagcatctgttatgccacattttctgttaggtgctgggaataccaacccctttgctttcaggagactttaggtttactagtgggtaatacgttataagcatttcattctggagtaaagttttttcagttaattgatttgcatattagacatttctattatgttttagtacaagaacttggaggattttacctttgtaaatgtttta

SEQ ID NO: 269001 - DNA, 410 bp, Homo sapiens
attagagaccagaaacagttggggcagaataaatagctggcccagaccaggacttgaattaggacacgaagtgttccagaggaatcccactaacatgcttgaactacatttaaaagtggaagaagcatataggagagggaattcaagactataagctgaaaagatccagtgaggctagcacagagcatggctaagggcatggactccctggacttgaatccagacttgccagctggatgcacttgagctggttacttgatctatctgtgcctcagttctgccatctgtaaaatgggaacaatgatagtactttactcagagttgcttcatgaaaactaaatcattaatttatgcaaaaggcttagaagtgttaggcacacagtaagcggcatgtaactgtttcttaaatt

SEQ ID NO: 269002 - DNA, 529 bp, Homo sapiens
gtttactggatgagttcatcttctagaccttgaatttaaagttcacattatccagcctccttcacttattgtgaagattctctgatccaaacatgctagatgatttgcgttgtcacccagctggttagtggtaagagtaagggttagaacctatcttctggccttgaactagtatgtaatatttattttttattaatttattattaaacagagatcaaccatattggcatgtggggtgttggcaagaggcagccctcaattttcttcccatttaatgtatatgctactcttactaagttatggaattattatttgttagactatcttgttaactaaatagtctggtttgtagtgagttatcatgtgttccatccgtgaataatctttttcaagggttgcaaacactaccttcaggggctgactgtaaaataatggaaggtcacgggatctgtggaagtcgagagtaaccacctgaatgcatccagatccgattttcctgtattaaaacacccttcaatccaaataatac

SEQ ID NO: 269003 - DNA, 848 bp, Homo sapiens
aaagaggtggaaagttaaccaaagaactaacacccctccccccaaaaaagaaaaaagtttatgtgccaggctttagaaaacctagatgtgtcaagctgttttaacctttgctagcctcctcccatgcaaaggtgacaaggtccagatcataatatgtccttcagtatcttcccagtgacccccaaattgaatcctgctagtcacttagcaggaagttagtagtttattttagtttcaccttatcagcttggcgtcttttcctaaccttattcccctgtcaccctcagatgccagacccccaaaggggaagattgacaggtagttcccatagctcagttttaccctcaaacaacagggatttagtttcttgtgcctttgccaatgtttatgtagtcaaagtttagatctcgccttaaggagtctcttttttacgcgtcactgcaataggaaagccacaaagaagtttttgaacaaacccttgcaactggaaccccatctagtgttcagtttgattcatccatgggaaagacattttcccctttcatttattgtgtacattaggtgggcttggatcactattttaaaagcaacgcctcgtccatgttgttattttttcagagatttcacttgtattcttccacaagagaatactctaatccccgtcagaacagtgagtgaacttgaagggtaccaggaaatttgtcatttggtggcatatcacatagaggaaactttagacatcacagaaaatatgcccagcatatgtcgtagtgtttaaaatttctttggaatcctaagttggattcagacttttccatttggattcagacttttcccaggtcgatgca

SEQ ID NO: 269004 - DNA, 356 bp, Homo sapiens
tgctagcttgagatggagaacaggcaaatttcggaaaaagatattctagagcttataaacagaaggaaaaaacatttcaatgagactgggaccaactgtcccaaagatccaagaggatctcctttctaaagtcctgaatctctaaaagcaaaattgattttgcttaaagctttcttcccccgcattacattaccttcgacggttggaaattagataaaataataaatagttggccgggcgtggtggctcatgcctgtaatcccagcacattgggaggccgaggtgggtggatcacaaggtcaggagttcaagatcagcctggccaatatggtgaaatcccgtctctactaaaaata

SEQ ID NO: 269005 - DNA, 850 bp, Homo sapiens
ctaacacaacagtaagaatgcaaacaattagaccaagggcaaagatataaataaacattttaccaaagttatacagatagcaaataagcacataaaaagatgtccaacacctagggaaataacaattaaaatcacaatgatatatcactacatacctacctatcagaacagtaaaataaaaatagttcagcctgggcaatgtagcgagactcttgtctgtacaaaaaaataaacaaataaataaaattagctaggtgtggtggcatgtgtctggagtcccagttacttgggaggctgaggtgggaggatcgcttgagcccaggaatttgagaccacagtgagctatgactgcaccactgaacaccagcctgagcaacagagtgagaccctgtctcaaaaaaaaaattcaaaagtgacaacaccaaatgttggtgagaatgtagaggaactggagcactcgtatattgtttggttgatagtttgaagttctgctgaatttcgaagccttcaaagtattttggtgtgtatttcctcatataatttggcaataattatttgaggtggtaataggaaaggaattcttactacttctcttcctaaataagtaaacaaatttgtggagtggctaatttactacctaaggtcacacaataatgtcagagaaccattgaccatagaagtcaattaatattagtcttaggactttttcttagtgttccaagactatcatgaggtggttttatttgtttctgtcgtggtttataatctcaagcattttttgtagtaaaacgtctgaggatcattaataaacctatgatcataagattttgtaaataaaatgtccatggat

SEQ ID NO: 269006 - DNA, 453 bp, Homo sapiens
aataccatgcagccattacatgattattaaatgggaagcgcaataaaataagtgaaaaaaggcatatgtccacttcatgctttatttttatatgcacacacataaacataggtatggaagagagatgggactagaaagaaatgcaccagctctttttccattttctgtaacattgtaaagtacaggcctaatctggatcacctaattcagtacttttgattgagaaagaaagaatattttatgtggtttttaaatgtatttgcagtagtcctgaacttcagcacctcagactgataagaagagccaaaggcaaattacaaattggggaaatatttacaatttgtatcacaaaaggttaatgtcacaaatatataaggtactcttggaaatctctttttaaaatacctacaatcagatagacaaatgagcagaggatttgacagacagttcacc

SEQ ID NO: 269007 - DNA, 421 bp, Homo sapiens
atccattagcaaatcatttaacttaaaaatattttatccatatgttaaattgggctactaaaacatataatgaaagggcatatagagctatgggcttctttaaggaaatacaataacagctaatattcctaggagctttatgcatatcaggcactgtgctaaacactgaataagcaatttcttaaccttcacatgaaccccatgagatagacatggttttcccccattttacagttgacgaaatagaagagatttcagccacttgttcgaggtcatttgttcaaggtcagacaggttccacggtggaacctggaaagtaatctcagatagtttctcaaattgaagctctcaaccaggaactctttttacctccagcatatattcagacatggcataagcagaggacagaggctgttctatg

SEQ ID NO: 269008 - DNA, 308 bp, Homo sapiens
gagaattgagaaatttattatcagattcaaaacttatacacttgggtgggaatctgtgtggaattaaatagctttctctcctgctaaataaagtaacacatgctccctgtagaagatttggaaaaatatgtacaagtaaatgaaattccactcatagcccgtagataataacttactgttttggtgactatatatctggttttaaaacagaccgtatataggaatataagaataatatttggatgattgagatcatattatgtaccatttcatatcttttaaaaaacttatgatgtggtgagttttcc

SEQ ID NO: 269009 - DNA, 567 bp, Homo sapiens
cactcacaagccatcaggtgctgccgagagccttcagtgaaggtcacagtgatgctactttccagaggaacctgaaaggcattgaacgtaacacagggcatggcatgtcctagcacaaactgatgagccgggtagatgctgcctcagcaggccgactcctgttgggcaaaggcaggctcagttcaggtctgactgaaatgccactcagcagccacagactcttcaccacaggaggggcgggccccatcatacacagctcaggaaatggagcctgaagtacaagggcaaactctgtgagactcgccccggcctgcttcaagacagctatgaagaaaaagtgcctctcttcatgccttcaaagcaactgctttcaccttggagcaatgtggacctgaacacacaaaaccagcgaatatgtgctctcagcggcttcaatgaaccccttcatcattcacccctactcaatatcccaccctctccaaacacagctccaaacaagatactttggacctgggcactgactagaactttgattaatgcagaaataaatataaaattgtcctttaa

SEQ ID NO: 269010 - DNA, 489 bp, Homo sapiens
cctgtagtgtagattccagtccagattcgaaggcctgaggaccaggaatgccaagggcaggagaagatcgatgtcccagaacaagcaatcaggcagagatgaaattcaaccttcctgtgcctttctgttctattcaggccttcagtgggttgaatgaggcccaacccacattgaagaggaccatctgctttactcagtctcctggttgaagtgatgatctcatctggacatactcagaaatgctgtttaaccagctctctggaaatcctgtggcccagtcaagttgacacacaaaattaaccatcacactgcagagacacagtctatcccaatacctgtatttactgggtaacgtgcatctcagctcaccaggctggtttgattgacttggcccaaagctgccctttgagtgttgagccctagctgacccctttgatccttcacagccccatcattaaaacaaggaccctgaatcaagtgactgtaaga

SEQ ID NO: 269011 - DNA, 427 bp, Homo sapiens
atcttcatgacgtaaacacctcccattaggacccccctaaagtgggatcacatttcaacattaggtttgtaggtgacaggtatccaaaccatagcatacatacagtagaatattatccagccttaaaaaggaatgaaattctgggccgggtgcggtggctcacgcctgtaatcccagcacttcggaaggccaaggcaggtgaatcacgaggtcaggagatcgagaccatcctggctaacacagtgaaaccccgtctctactaaaaaatacaaaaaattagtctggcatggtggtgggcaccagtagtcccagctacttgggaggctgaggcaggagaatggcatgaacccggaggcagggcttgcagtgagccaagatcgcaccactgcactccagcctgggtgacagagcgagactccgtctcaaa

SEQ ID NO: 269012 - DNA, 419 bp, Homo sapiens
gctagaccagggcttccatattcatttgaaagggcaggtcctaggaggcaggctcctctccttactttgagactgctgggtggcatttccatagatctttatgcaagttaggaaaaggtgctcttcacacctttaacttccatctgtcagaaaattgttttgccgggtgtggggtctcacacctgtaatcccatctctttgggaggctgaggcgggtggatcacctgaggtcaggagtttgagaccagcctggccaacttggtgaaaccccgtctctactaaaatacaaaaattagcctggtgtggtggcatgcgcctgtaatcccagctacttgggaggctgaggcaggagaattgcttgaacctcctgccactgcactccagcctgggtgacagaatgagactccgtctccaaaaaa

SEQ ID NO: 269013 - DNA, 435 bp, Homo sapiens
gtcaatgaagtgtgtgagataaaggcagatggtgccacaggaggcacggcatagcatggaagaaagcagataaaacaaaggaaccagaaccacatccactgatcggatttgcctggggaggaggggtgctctctcctttgatcttctcttctggaagagatggaccaaaagcctctccagcaataatccgtccacttacatgcagattttcttctgcctctgccacccctgagacagcaagaccaactctcctcttcctcctcctcctcctcagcctactcactgcaagacgacgagtatgaagatctttatgatgatccacttccatgtaataaatagtaaatgttttctcttccttgttatttgcttaataacattttctttcctctaactcattttattgtaacagtactgtatataatatatataacatac

SEQ ID NO: 269014 - DNA, 2403 bp, Homo sapiens
cggtccacgcttcccgccggcccggcaaggggttccggagaacggcttgggggggcgagaaccatgggcgggggaaatggaagacagagggaactgaagcacgggggtcttcgatgagcagtgcggatgttcgactccaaacatcaaagccaacgagaggttcaggttactcctccttgaccccaaacatccagtgagtggagactggcctgttcacagagtaaaatatgtcgtctctaattcggcaaagacggtgatgactgtatatatgcaggccaattccataaaacaaaggaaccagaaccacatccactgatcggatttgcctggggaggaggggtgctctctcctttgatcttctcttctggaagagatggaccaaaagcctctccagcaataatccgtccacttacatgcagattttcttctgcctctgccacccctgagacagcaagaccaactctcctcttcctcctcctcctcctcagcctactcactgcaagacgacgagtatgaagatctttatgatgatccacttccatgaaatgattcttgaagactatctttccagcttgtcacatatgcaaggtgtatttacaggagacagcaatggaaacctggtcagttgagcaggtctgcagttggttggtggagaaaaatttaggagagctagttcatagatttcaagaggaagaagtaagtggggccgctcttcttgcacttaatgatcggatggttcagcaactggtaaagaaaattgggcaccaggctgttctgatggatttaattaaaaaatacaagcagaacactcaaggactgaagtccccagaaaaccccaaaaaggcagccctggtcatgcaaacagaagcagctcgagattacagggatgaagagtcctccagtccagccaggcatggggagcagatgccatctttctatccagctgaaaaccttgataatggactaattgaccaaagagtattgaaacagagaagaaatgtgaaacaaattctagcaagaagcaaagcattacagtggacgaagtcctatgttttaccagagtttccctatgatgtcaaatgcatgttagcagagcagaagtgcccggatcacagcatgaggataaggatcattgagtttctccaggccgacatgactaagtatctggaaggctcactgtaccccagcacccagcagtacaatgacgtggttaatgccctgctgcaggcccaccctttcctggatgaggatggctgtggcttctttttatggaaacgagccctcaaagatcgctttaaatatgttcgaagacccatagaagatgatgagcaagtgattagaaataagtgtaaatttggacaccgaagaggccagacaaggaaatctcttgctgatataagatttgatgaaattaaacttgtccagataaaagaagaagctgtttgttttgattctgagctagatgaacatattaagtggttccagcaagaatacgtgaaaacagaaaaggactggagagaaattgacaagagaatgagccaaactttggaaataagaagaaagatgattggcagccgaacacctctgaaggacattcttaaactgtttcctttcttgaagtgcccttatcagatgttcagagaattccaacttcttacaagaacagatatttataagaaaacaaggcacattttggaatcctattcagaaaatatactgacttctttttcagtggtggacaatccaatcaatattgtattgcaagaaaaaatgaaacattacacagatgaagacatgttgaaatacatgaagatgacagccacatgtttactcctcccagatgtttttggggatgatcccagcctttttgtcatcatgaatgaacaggtgcaagtgtccacacctgtgttggaagttaaaaaccctttcaacatggaggtctgcgaattttctttatatttagaaagggagaggctcacaaaggtggacgactgtgttacagccttggctgcgctagtagctgcctttcatgtatttaggattgagtgtccaagaagactgtcccaaactttcaacttcctagaaacgctgattttcgatatgcacagtccttattttccttctttgaaagaaaaggaaaacgaagtaggatttcagcacccactcacttaatagcatgccaaatattgtactggaatttacctctgggaaaactgaagcttcataagaaattgttttgatttagggttgtggtagaggtaggtatgagaaaatcatcttgtatttatagatgctaatgaatttcaatgctttctatctttacacttagatattaagttctttgtgaaattctgtaataaaattctacttcattaaagagctgtcgatttattttgagttttt

SEQ ID NO: 269015 - DNA, 2383 bp, Homo sapiens
tgctaacggaaaacaatgagaagcagcaagttacaatctccttctcctagccaggagaagcaaggggttaaccagtctactaaggggttaaccagtttactaagtatctctgtcaggcttttatctgatccttcctcccttcctctcctgcccaccccttctgtaaatgtcaaccacttcctgaggagcctggtagtggtgaatttcacacctttcttttctttgtgaagaaacctgggtgttaatggtacaggattgggtaccattgtatgtccctggctgtctgttagtaaagcttagagatgcctgtggaaaaaaagtaggagaaggtgaagaaatttgagaaatgggatgctaggaaataggtttaaatcaggtcttatttttaaagtgagtgtgtgttttgttagcaatttttaaatgtacattgtaaaaatagtaattttaaaaaagcttaacattgagaagataaaggagtctagcaaaggaagcggctgactgttaaaaaaaaaattaaggcacaatcagaaagaaaagctggagaattctctgaccttttgctctacaggtgtatttacaggagacagcaatggaaacctggtcagttgagcaggtctgcagttggttggtggagaaaaatttaggagagctagttcatagatttcaagaggaagaagtaagtggggccgctcttcttgcacttaatgatcggatggttcagcaactggtaaagaaaattgggcaccaggctgttctgatggatttaattaaaaaatacaagcagaacactcaaggactgaagtccccagaaaaccccaaaaaggcagccctggtcatgcaaacagaagcagctcgagattacagggatgaagagtcctccagtccagccaggcatggggagcagatgccatctttctatccagctgaaaaccttgataatggactaattgaccaaagagtattgaaacagagaagaaatgtgaaacaaattctagcaagaagcaaagcattacagtggacgaagtcctatgttttaccagagtttccctatgatgtcaaatgcatgttagcagagcagaagtgcccggatcacagcatgaggataaggatcattgagtttctccaggccgacatgactaagtatctggaaggctcactgtaccccagcacccagcagtacaatgacgtggttaatgccctgctgcaggcccaccctttcctggatgaggatggctgtggcttctttttatggaaacgagccctcaaagatcgctttaaatatgttcgaagacccatagaagatgatgagcaagtgattagaaataagtgtaaatttggacaccgaagaggccagacaaggaaatctcttgctgatataagatttgatgaaattaaacttgtccagataaaagaagaagctgtttgttttgattctgagctagatgaacatattaagtggttccagcaagaatacgtgaaaacagaaaaggactggagagaaattgacaagagaatgagccaaactttggaaataagaagaaagatgattggcagccgaacacctctgaaggacattcttaaactgtttcctttcttgaagtgcccttatcagatgttcagagaattccaacttcttacaagaacagatatttataagaaaacaaggcacattttggaatcctattcagaaaatatactgacttctttttcagtggtggacaatccaatcaatattgtattgcaagaaaaaatgaaacattacacagatgaagacatgttgaaatacatgaagatgacagccacatgtttactcctcccagatgtttttggggatgatcccagcctttttgtcatcatgaatgaacaggtgcaagtgtccacacctgtgttggaagttaaaaaccctttcaacatggaggtctgcgaattttctttatatttagaaagggagaggctcacaaaggtggacgactgtgttacagccttggctgcgctagtagctgcctttcatgtatttaggattgagtgtccaagaagactgtcccaaactttcaacttcctagaaacgctgattttcgatatgcacagtccttattttccttctttgaaagaaaaggaaaacgaagtaggatttcagcacccactcacttaatagcatgccaaatattgtactggaatttacctctgggaaaactgaagcttcataagaaattgttttgatttagggttgtggtagaggtaggtatgagaaaatcatcttgtatttatagatgctaatgaatttcaatgctttctatctttacacttagatattaagttctttgtgaaattctgtaataaaattctacttcattaaagagctgtcgatttattttgagttttt

SEQ ID NO: 269016 - DNA, 1514 bp, Homo sapiens
cggtccacgcttcccgccggcccggcaaggggttccggagaacggcttgggggggcgagaaccatgggcgggggaaatggaagacagagggaactgaagcacgggggtcttcgatgagcagtgcggatgttcgactccaaacatcaaagccaacgagaggttcaggttactcctccttgaccccaaacatccagtgagtggagactggcctgttcacagagtaaaatatgtcgtctctaattcggcaaagacggtgatgactgtatatatgcaggccaattccataaaacaaaggaaccagaaccacatccactgatcggatttgcctggggaggaggggtgctctctcctttgatcttctcttctggaagagatggaccaaaagcctctccagcaataatccgtccacttacatgcagattttcttctgcctctgccacccctgagacagcaagaccaactctcctcttcctcctcctcctcctcagcctactcactgcaagacgacgagtatgaagatctttatgatgatccacttccatgaaatgattcttgaagactatctttccagcttgtcacatatgcaaggtgtatttacaggagacagcaatggaaacctggtcagttgagcaggtctgcagttggttggtggagaaaaatttaggagagctagttcatagatttcaagaggaagaagtaagtggggccgctcttcttgcacttaatgatcggatggttcagcaactggtaaagaaaattgggcaccaggctgttctgatggatttaattaaaaaatacaagcagaacactcaaggactgaagtccccagaaaaccccaaaaaggcagccctggtcatgcaaacagaagcagctcgagattacagggatgaagagtcctccagtccagccaggcatggggagcagatgccatctttctatccagctgaaaaccttgataatggactaattgaccaaagagtattgaaacagagaagaaatgtgaaacaaattctagcaagaagcaaagcattacagtggacgaagtcctatgttttaccagagtttccctatgatgtcaaatgcatgttagcagagcagaagtgcccggatcacagcatgaggataaggatcattgagtttctccaggccgacatgactaagtatctggaaggctcactgtaccccagcacccagcagtacaatgacgtggttaatgccctgctgcaggcccaccctttcctggatgaggatggctgtggcttctttttatggaaacgagccctcaaagatcgctttaaatatgttcgaagacccatagaagatgatgagcaagtgattagaaataagtgtaaatttggacaccgaagaggccagacaaggaaatctcttgctgatataagatttgatgaaattaaacttgtccagataaaagtaagattgaattcctaaatgttctgatgacttgatagattgatatattgattaagggataataaataatagcatttaaaata

SEQ ID NO: 269017 - DNA, 331 bp, Homo sapiens
caggtaaggtcatggcaccaatgaacttgacctcggttttcccagccccttagaaatcctcgctccctttgctggtcttctcctgatactattgtgtttagtggcctggtagaaagaagatgagtggcatgtgagtgtgagtgtagggcatgtgtgtgcccatgagtgttggggggcagagtaaggtattaatgaggttaaggttgcagtgggtcataccttgctcctgaataggaagattcaacattgtgaagatgtcaaacctcctctacacagtcaataaatttaagcacataattagatactagaaaattaaaaattagttttttag

SEQ ID NO: 269018 - DNA, 646 bp, Homo sapiens
ttagcatctgtcttccatactacaacccaaacttcctgtaggcaggggtgtcatctcttgatggctgctgtcaaccctgtgcattgaacagcgcctggtgggtactgagcactccatgcatgttggctataaaaaagattttcagtaactacatgggatactgctttttttaatttgggaatttctctattatgaatagtttcaaaggcatagccaataatcatctccaactaaatatttatagttctaatagcccaagttgggtctccacatatatttgtttctttgatgattgattgagagagacagggtcttgctctgtcacccaggctggagtggagtggcacaaacacagttcactgcagcctccatctccagggctcaagtgatcctcccaactcagcctcccgagtagctgggattataggtatgcacaccagcatgcctagcttttttttttttttttaatttttcatagagactggatctcactttgttgcccaggttggttttgaattcttggcttcaaacgatcctccctcttcagcctcccaaagtgctgggattacaggcacaagccactgtgcctagcctctatcattgttttaaatttaccaatatttgtctttttgaagaaatacaacag

SEQ ID NO: 269019 - DNA, 426 bp, Homo sapiens
ctttctgaaggttggtacatttgcccagggctctgcttgggtttggagcctttactaacgtgtgtcaataatgcgggtccaccttccataccatcttgcaaccaattatcagaaagagaaggcctgagcagggggatgtgcattttgctttctttcggcgtagcatctcatgctagatttttatctgggggcctttgaagagccagccggcacagaagcatggtggcaacgctgtgcctggaaaactcatcagtgtcactctggtttattttcctctcctctttgagctctttcccatggtgtggggctctcagtgacaactggcaagcggcggggcggttgctcgttgtcattctggtaggcgctggtttccggagggctccgagtgctttgtgagtattcgcatttgtttctgagatgctggga

SEQ ID NO: 269020 - DNA, 680 bp, Homo sapiens
aatataaaaacttagctaggtatgttggcgggcacctgtaatcccagctactcaggaggctgaggcgggagaatcgcttgaacctgggaggtagagaggttccagtgagccaagattatgccactgcactccagcctgggcaacaagagtgaaactccgtctcaaaaaaaaaaaaagaaacagggccatctgtctttgaggcagagggatttacacccttgctaagacactaaagttttttgctaaggcactaaactttttaggcccttcccccagtattacacatgagagatgataatcaagcctttgttgcctatgagtgaaaaggaatctaaaaatcactgaaataaataataatagtttttcaaggaatttcaaagaagttttttcacatgggaaaggactgctaggctggatgtggtggctcacacctgtaatcccggcaatttgggaggctgcagcaggaggaatgcttgaacccaggagttggagaccagtgtgggcaacatagtgagaccctgtctctaccaaaaaaaaaaaaaaattagccaggtgtggtggtgtgcacctgtggtcccaagctacttaagaggcttaagtaggaagattttttgatcccaggaggtcgaggttgcagtgagccatgactgcgccaccgcactccacccttggtgacagag

SEQ ID NO: 269021 - DNA, 325 bp, Homo sapiens
cactcataaatgccttctctttctataagcaaatttacatagaaagtccacttttaagtagatggcttggtgagcataaaatcagagcatcacattaagctgaatgactttaatggctggtgaagataattgatgcaagagaagctggatctataaactttatagagatgcaacctctgttcaggtcacagaccagtatccgttggtattcattgtaccagtgcattagaatttatgaaccactgtggcaggataatttattgaggaattcatttgtattttgcggctgctgataattaataaattgctttgttttgttcttact

SEQ ID NO: 269022 - DNA, 418 bp, Homo sapiens
gcccaggcaactactgatttgctctctgacacacacacacacagacacatacacacacaccttcctctttcatatacttttatataaatggggtcatacaaactgtgtgatcatactttcacttccctcgggtaaatacctagaagtggaggctggctgcggtgggtcacgcctgtaatcctagcactttgggaggccgaggtgggtggattgcctgagctcaggtgttcgagaccagcctgagcaacacggtgaaaccctatctctactaaaatacaaaaaatgagctgggtatggctatagtcccagctacttaggaggctgaagcaggagaattgcttgaacccaggaggcagaggttgcagtgagccaagattgttccactgcaccccaacctgggcaacagagcaagactgct

SEQ ID NO: 269023 - DNA, 307 bp, Homo sapiens
gaggaacacacccactggggcttcaggagctgtaaacattcacccccagacactgctctgggatcagagcctcacagcctgaccatctgtatgctcccctggaggtctgagcagcgggcactggagaagagagccacatcgcactccctgcaaggggaacaagggaattttttctgtttcaaaaacatgtagctaagttgactcttggacttcagcattcttcagcataccccaggtaccaatctactgaattgtccaaactctggaatatgtatgtacattaaactctccaagaggtcttttcata

SEQ ID NO: 269024 - DNA, 143 bp, Homo sapiens
gaacacaaataactttggctttaaaactactaaatcccatgtaggttcaatgcattgcacaacgtatccatttattttatcacatttgtaagtgaacatcatatgatgctatctccaaatagaaatgtttataaagctcatga

SEQ ID NO: 269025 - DNA, 1151 bp, Homo sapiens
aagtactggttctagtactagctttcataagaaagtactggttctagtactagctttcagtactctcttgtgaaattttcaatattcagtcatttcaacctcaaaaatggcaacataattatgtttcaacataattgttgttttaaacaaacaattttgtttcaacataattctcctgaactgggtggaaggctatcaagaaaaagcttagcttcttcttcaggtaactgcaagagacagggttctctagagaaacagaacaaatatacaaagagattcattataaggaattggaagtccaaaatctccagagcctctgtacttgtacaagtctgaaggccgacaggcaggagaattctctctttttggggcaaaggtcagtgttttgttctatccaggctttcagatgattggttgaggctcactcacattagaagggcaatctgtcttactgccattagaatgcaacctgttttacttagcttactgatttcaatgttaatctatttcaagagcaccctcacagaaacacccagaataatgtttgatgaaatatctgggcaccctgtgacccagtcaagttgacacatgacactaaccatcacagtacgcttagggtcttgtcactcggagtgtggcctgtgaaccagcagcatttttatcttctgggagcttgggcacgatctcaggccccacctcctgcttattgattcagaatctgcattttaacaagatccccaggtgatctggatgcaccgtaacatctgagaagcactcaaactatgtgccgcaaacaaacgccaaattcttaggcatttgtgtggcttggagcacatagttggttctttctactgtctaattcattacattttttcagcacattcctgtctataaaatgtttttttgtatgcaccccaatatatgcacatttataagcatatgcatgaacccacgaacaatgattaggtacattatgaagcatacgtaaggacagaaatttcaaaccaagcttgagggtgaaataaatattatttgaaaacctgttgctaattgtgatgacttcatactatcattagttactatctcaatgcataatgtacagtgacgggtgaagtttatcattaataaaaaaaatctggattttaaccatt

SEQ ID NO: 269026 - DNA, 527 bp, Homo sapiens
aagtactggttctagtactagctttcataagaaagtactggttctagtactagctttcagtactctcttgtgaaattttcaatattcagtcatttcaacctcaaaaatggcaacataattatgtttcaacataattgttgttttaaacaaacaattttgtttcaacataattctcctgaactgggtggaaggctatcaagaaaaagcttagcttcttcttcaggtaactgcaagagacagggttctctagagaaacagaacaaatatacaaagagattcattataaggaattggaagtccaaaatctccagagcctctgtacttgtacaagtctgaaggccgacaggcaggagaattctctctttttggggcaaaggtcagtgttttgttctatccaggctttcagatgattggttgaggctcactcacattagaagggcaatctgtcttactgccattagaatgcaacctgttttacttagcttactgatttcaatgttaatctaagtaaaaaaagttggcggccg

SEQ ID NO: 269027 - DNA, 1063 bp, Homo sapiens
gctgggcagcctggttcggggcaggttgtgaggccacagcaatgctgtcccaagtgtgtggaacctcacactccctctggactccgggccccaccaaagtcctgccagcacaacgggaccatgtaccaacacggagagatcttcagtgcccatgagctgttcccctcccgcctgcccaaccagtgtgtcctctgcagctgcacagagggccagatctactgcggcctcacaacctgccccgaaccaggctgcccagcacccctcccgctgccagactcctgctgccaggcctgcaaagctggctccagctggggcctgctatgctcagtcagtgactttcatccttcctgccatttgcagagacatcctcaggatccatgttccagtgatgctgggagaaagagaggcccgggcaccccagcccccactggcctcagcgcccctctgagcttcatccctcgccacttcagacccaagggagcaggcagcacaactgtcaagatcgtcctgaaggagaaacataagaaagcctgtgtgcatggcgggaagacgtactcccacggggaggtgtggcacccggccttccgtgccttcggccccttgccctgcatcctatgcacctgtgaggatggccgccaggactgccagcgtgtgacctgtcccaccgagtacccctgccgtcaccccgagaaagtggctgggaagtgctgcaagatttgcccagaggacaaagcagaccctggccacagtgagatcagttctaccaggtgtcccaaggcaccgggccgggtcctcgtccacacatcggtatccccaagcccagacaacctgcgtcgctttgccctggaacacgaggcctcggacttggtggagatctacctctggaagctggtaaaaggtcactggaacgtcttcctagcccagaccctggagctgaaggtcacggccagtccagacaaagtgaccaagacataacaaagacctaacagttgcagatatgagctgtataattgttgttattatatattaataaataagaagttgcattaccctcaaaaaaaaa

SEQ ID NO: 269028 - DNA, 352 bp, Homo sapiens
caggtgacaggagcaggatcagcaaagagaacagacagaagaaaacaggcttcactgtggaggcgacaggacgtcagggaaggggaatgacagggaatcttccacttgactcagatcaagaaagtcaggaagcaagacttccagaaagaggcacagcacttccgactgctcgctggcccccacgaaggtcactggaacgtcttcctagcccagaccctggagctgaaggtcacggccagtccagacaaagtgaccaagacataacaaagacctaacagttgcagatatgagctgtataattgttgttattatatattaataaataagaagttgcattaccctcaaaaaaaaa

SEQ ID NO: 269029 - DNA, 1211 bp, Homo sapiens
gctgggcagcctggttcggggcaggttgtgaggccacagcaatgctgtcccaagtgtgtggaacctcacactccctctggactccgggccccaccaaagtcctgccagcacaacgggaccatgtaccaacacggagagatcttcagtgcccatgagctgttcccctcccgcctgcccaaccagtgtgtcctctgcagctgcacagagggccagatctactgcggcctcacaacctgccccgaaccaggctgcccagcacccctcccgctgccagactcctgctgccaggcctgcaaagctggctccagctggggcctgctatgctcagtcagtgactttcatccttcctgccatttgcagagacatcctcaggatccatgttccagtgatgctgggagaaagagaggcccgggcaccccagcccccactggcctcagcgcccctctgagcttcatccctcgccacttcagacccaagggagcaggcagcacaactgtcaagatcgtcctgaaggagaaacataagaaagcctgtgtgcatggcgggaagacgtactcccacggggaggtgtggcacccggccttccgtgccttcggccccttgccctgcatcctatgcacctgtgaggatggccgccaggactgccagcgtgtgacctgtcccaccgagtacccctgccgtcaccccgagaaagtggctgggaagtgctgcaagatttgcccagaggacaaagcagaccctggccacagtgagatcagttctaccaggtgtcccaaggcaccgggccgggtcctcgtccacacatcggtatccccaagcccagacaacctgcgtcgctttgccctggaacacgaggcctcggacttggtggagatctacctctggaagctggtaaaagatgaggaaactgaggctcagagaggtgaagtacctggcccaaggccacacagccagaatcttccacttgactcagatcaagaaagtcaggaagcaagacttccagaaagaggcacagcacttccgactgctcgctggcccccacgaaggtcactggaacgtcttcctagcccagaccctggagctgaaggtcacggccagtccagacaaagtgaccaagacataacaaagacctaacagttgcagatatgagctgtataattgttgttattatatattaataaataagaagttgcattaccctcaaaaaaaaa

SEQ ID NO: 269030 - DNA, 1156 bp, Homo sapiens
gctgggcagcctggttcggggcaggttgtgaggccacagcaatgctgtcccaagtgtgtggaacctcacactccctctggactccgggccccaccaaagtcctgccagcacaacgggaccatgtaccaacacggagagatcttcagtgcccatgagctgttcccctcccgcctgcccaaccagtgtgtcctctgcagctgcacagagggccagatctactgcggcctcacaacctgccccgaaccaggctgcccagcacccctcccgctgccagactcctgctgccaggcctgcaaagctggctccagctggggcctgctatgctcagtcagtgactttcatccttcctgccatttgcagagacatcctcaggatccatgttccagtgatgctgggagaaagagaggcccgggcaccccagcccccactggcctcagcgcccctctgagcttcatccctcgccacttcagacccaagggagcaggcagcacaactgtcaagatcgtcctgaaggagaaacataagaaagcctgtgtgcatggcgggaagacgtactcccacggggaggtgtggcacccggccttccgtgccttcggccccttgccctgcatcctatgcacctgtgaggatggccgccaggactgccagcgtgtgacctgtcccaccgagtacccctgccgtcaccccgagaaagtggctgggaagtgctgcaagatttgcccagaggacaaagcagaccctggccacagtgagatcagttctaccaggtgtcccaaggcaccgggccgggtcctcgtccacacatcggtatccccaagcccagacaacctgcgtcgctttgccctggaacacgaggcctcggacttggtggagatctacctctggaagctggtaaaaggaatcttccacttgactcagatcaagaaagtcaggaagcaagacttccagaaagaggcacagcacttccgactgctcgctggcccccacgaaggtcactggaacgtcttcctagcccagaccctggagctgaaggtcacggccagtccagacaaagtgaccaagacataacaaagacctaacagttgcagatatgagctgtataattgttgttattatatattaataaataagaagttgcattaccctcaaaaaaaaa

SEQ ID NO: 269031 - DNA, 472 bp, Homo sapiens
tgaagaggtacagccaacgtttattgaacacttcatgagcttcttgtctctccagaggacaaagcagaccctggccacagtgagatcagttctaccaggtgtcccaaggcaccgggccgggtcctcgtccacacatcggtatccccaagcccagacaacctgcgtcgctttgccctggaacacgaggcctcggacttggtggagatctacctctggaagctggtaaaaggtgagtgctggcccactcccagtggggtgtacctctggccagtcccccttcccgtgccccagaccccacaggggccttagggacgttttgctgatcaggtgcctctggctgccccgccaggtttaagagcccctgattccaagatgcaggaagatagtgagcctgactggttctctacaattctgataagctcctcctgctaatgccaaggctcgatagtgctccctctcctggggggaaggc

SEQ ID NO: 269032 - DNA, 362 bp, Homo sapiens
ctctaatatgttctaagagccctgcttaacacagaaaaacaaaaggaaccagcataccataaatagactacagtgtttatttttgatttggggtgtctcctcctactagaaatctaaattctgagaggaaagatttttgcctgttttgttccccaggactgagaacagtgcctggcccaggaagggtggatatttgatcagttgaaaccagtttaactagctacattaaagaaaaataaatgcagtgaggcacagaggctcatgcctgttatctcagcaatttgagaggctgaggtgggagtatcgcttgagccaaggagttcaagacctgcctgggcaacaaagcaagaccctgtctctgc

SEQ ID NO: 269033 - DNA, 530 bp, Homo sapiens
tgaaagatgaagtcaagtgcgaagacactggtggcacggagagtgttgctggcactcaggctggagagatgatgaatgtttggacaaaagtggggtcagagaggagagagcagcacagccagattcaagagttgctgctgggatagagtctacaggactctatctttggtgacatatttaagatgatgagagagggaaagcaaagaattgagaatgaagtggatgtttctgattttggaggccagaccccttgtgccattcatcaagataaagtaaatagagaggagctgcttttggtgagagaagataatgaatttagtcatagaaatgttcagtttgagatgtctgaaggaaatctctgaaggtaagttcaatggggagaattctggtcaagatggctctctgtaaggttcatcttttgagtaccccctcccatacacacacaaacataaaaaagcaacaattcgatataaaaagaaaatgtaagagctacatttttgtttataaatgatataaatacccaagaggac

SEQ ID NO: 269034 - DNA, 927 bp, Homo sapiens
agccttactccttagctgtcttgcttttgaaaaaatatagaaactaaaagggtttttgagctttggaaagaggtcagtcactagccagtcaggtttctgcaatgtattctgtgctgtcaatccattgtgaacactgattattcaaagaaataatagttatttagatttaaaatattttaagtttaaaataataggttattaagatagctatttattaatggcctgatttattaaaattagtcatttaaaatattatcaaataataaagcagtgtctgaattatttctcctaaatgttcatttgaggcagtaaggtgattgcctgcttttcctctcttcactctttttataggtattgatgatattgatggaatttggaacatgagccattaaatacctagaaaaaaattccatagggttttaggtaattgaagcaaaattaatattgctacttttagtaggagactatcttattttgcctttgtgaggcagaacctttttcctgtttgttggagccactggccaccaggtggtgctttttgcattctttacagaataacacgacggtttttcctctggttactgtcagacattgtcatatttagctaattaaaatttccaatgacaaatataatgtaggaagttagaactaatatgaaacttcttgctgtggtagatagctgttcaaagaaggaagagtttgttactgaatttgttggtatccactgagctttagtgttgtctgcttccctctctctgattcttaggctatggtggcagatagtttcttgcagttgccagcaactaggttctcagattattcgaggtcctcagtatatagaacctttggacttgtccacctcagtgctaaacattttatcttttattgggtgcttatttcaatgccttatctgaaatttatctgaaa

SEQ ID NO: 269035 - DNA, 301 bp, Homo sapiens
gctctacccatatgaagcaattcgtagttctgtagccgagacttgatatctcaggccctgcacctttctttacaggcctttccatcttcctagagtgcctaacctggcctgtgtgcttgtaagcttctgctcattcttcaatacccagcagagacttcctcctccatgcagccttccaagacccacctgagtacaggtatcagacctttgggccactcctagtcctactgctgcatttatctcactggatttcagtcaagtgtgtagacagctaatttgtgcatgcctggtctgtgagctc

SEQ ID NO: 269036 - DNA, 774 bp, Homo sapiens
tggaaaattgttagggaaaatctaatcaacttaatttaaatggcataaatgatgattagagctaattatcgtcagaatttgggctggtgtttctaaaatgaaactacagagtttctttaaatggggtcatcaggttaggattcagttgtcaagaaagatcaatgatttgtgtgaactcacagtcttctcagcttacctggtagccaggggtaatatttcacacttcggagtgaattgcatttatattctttttcttcatagctcactcaggatttttagaagatgaaagaattgaatcttatggcaacaaagcccatttcttcacagtggaactataaatgcagacttaagtaattaatttgtaaacctttgtatctttttaaaacatcatcctatccccaaggcctaacataagttttgttgactaggtgaaatgattgaatcagtgaatgattgaataaatgaaaaatataggatgcagttcaggaaagaaaaccacaagagtgcggcggctatttaaaaaatgccatccctgtaattactgttattgccaattcctgtttgtgtttatgaagcctgaggaattttggagggcactaccagtaatttgtatctcattactcaagctaagggagggataaatgaatcctaaatgtaaaccttttaccgtcaaaatggaaaacctgtgtttttccagtgatgtgtcagcagtagctattaatattaaaatcacgaacctacacacatacctttaagaaatggactccaggcttg

SEQ ID NO: 269037 - DNA, 711 bp, Homo sapiens
atatgctgtttcttatagctaaaaccattgtagcttttgtgagatattatagtaggttctggaacatagaagatacatgctcaagttagctaccatatgccctagagactgccagggtcagaaaaccatgcatgccaccaacacatctgtccctcagcatttttatatagacaaaatcaagttaaaatgaataccatggatggtcttaagtgggcacagaaatccttagccttcttcagtattatggagggggctatctaacctttttttactttcttgaaggtagagctgattggggtgggcagtcagtggtgctagtatataagctttctgctttttttctttctctttttatttttattactattattattattatttttttggctgcttctctgagtcactgccaaagattgtaggacatcttattattaagatggggtgattactgaaattagctctaacttcacatggctctgcaagaattgggtgaagcgtgaaccctggagatagtcatctctttctcaagagtcagctacatgcacactggtctgaatgtgatccttcactttgtccaagggtaggaagcattagtccctttgtaatgatgattatttttgtttgagggtgggtgggtaattacttttggtgttcatattcttttattgaaaatgaaaatatattttattttctgataatgccttaaaaaaa

SEQ ID NO: 269038 - DNA, 520 bp, Homo sapiens
gtttttaatcctttgtaatttttggtgataaccctgggattctctttccctgaatgggtggcaggagaattagtccaggttttttcatgtgattgtatgcacaggaccaacattctatatagtgtgtgaaaggatttatttttcctgaactttctttttttagatggagtctggctctgtcgccaggctggagtgcagtggcgcaatctcggctcactgcaagctctgcctcccgggtttacgccattctcctgcctcagcctcccaagtagctgggactatgggtgcccgccaccacgcccagctaattttttgtatttttagtagagacggggtttcaccgtgttagccaggatggtcttgatctgaccttgtgatctacccacctcagcctcctaaagtgctaggattacaggcatgagccaccacacctggccaatttttcctgaactttcataggaaactcctttaagggtacaactgttaaatcaccttgaaaggcatatttaacaaatcacct

SEQ ID NO: 269039 - DNA, 490 bp, Homo sapiens
atccctttgctctcaaactccccgatgcaatgccttctgatttcaacagaaaagcaagaggctccaggcaccccattcagggactgccaccaaagtacccgcaaatccttcatgaaaggggagacattgacacattctttttttattctctggcatggagatgaacatacttggtatcatccactctcctgcactgctggctcagtcaccagccttttcaggcacggggtctgcaacctctctcatggtttgtgccatctcttgagtcaggagccacagacctcatccaggacttacagcctgacagattaaggagtccgataaatccacacattctgagttgttatgctggcaaaagccatgcccatccacaagccagactcttggcctccactggaagctttggaactttattcccatcaaacactgacctaatccttgcactgagactgctatttacattaaaattggtcacataatgaaaaaaaaa

SEQ ID NO: 269040 - DNA, 368 bp, Homo sapiens
gctctccacatacagggctggggagcaggggctgatcttggatcttaggttctttttgctgtagaaaatagtggttgactggtcccttaattttattttctaaaatcaactttcttgaggtatacatgtaatcccagcacttcaggacccagggcgggcggatcacctgaggtcaggagttcgagaccagcctgaccaatatgatgaaaccctgtctctcctaaaaatacaaaaattagcccggtgtggtgcatgcgcctgtagtcccagctgagacaggagaatctctagaaccgggaggcgtaggttgcagtgagctgagatcgcaccattgcacctgggcaataagagcgaaactccatctcaaa

SEQ ID NO: 269041 - DNA, 411 bp, Homo sapiens
catttctgtaatcacaattttaacatggaaaaaggaaaacacacacacattcagggagtgggagcattaatgaatttcctgccattttctttctctgaaaacctccgtttaggataatttcatattagtcctgtaaagcagaatgtttttcgagtgcattggtttctcacactccaaaattgaggtttcagtggcagtatgccgcttctacccccagctttcaaacatttctccagcttctcataatcacagcttggttagtctgaatccaaacatttgaatctaatagaggggaattctagtcactaacaggtttacaatatagtaattttccccaaagttatccatgataaatgggcttcccaaatagcctctagcaatcacagcataacgcattagatggaacactcc

SEQ ID NO: 269042 - DNA, 479 bp, Homo sapiens
tgattaaagcattcctttcacagtacattcagaggagcagcaatcagataatttactacaagctgtaaaattaaattataatcactagaaccagttattgttaacatagttcattctgtgtaatctctctcaacaacctcctcctacacatataacacagtggggaatggtgttgatgagcatgtaatcctatcagagttgctgactaccatagaccaccaatgatccatcttgtatttggtttaggaataaaagcatgttgtttgaacaagaattttagggttttggccaggcgcagtggctaacacctataaccccagcactttgggaggccgaggtgggcaaatcacttatgaaggtgtctgaaattgcttgaaggtgagaactgctcaaaccaggaaggtggaagttgcagtgagccgagatcgcgccgctgcactacagcctgggtgatgatggagcgagacgctgtctccaaa

SEQ ID NO: 269043 - DNA, 334 bp, Homo sapiens
ggctctgggcagaagaccctagatgttaaagtagggtaacctgaggttctctcattggtctccttttaggtccttcttcattttcatgtcaccagattatcccctccctctgaaccgaggtgcctgtgttttagaaatgccagggaaatgcttactggggctggcaaacaggagcatttgtgggctctggagcacccagtgctggctgcctggcactgccagtccactaagtggccttgagcaagtggcctggcctccaggagccccaatttcctcacctgtaaagtacagataatccttccccactccccgtgggattgtgatgagcaccaaa

SEQ ID NO: 269044 - DNA, 302 bp, Homo sapiens
tcccactagcttcccaccttccgtatgggcacctcctgagcatctgatgagcatcacagagtagagaatgtcaatgtgttttctcccacatcctgctctgaatttataaggccaatttatcctcgcctcacacatgagctgcccttgtcttcagggatgtgatccttgtttctctcacatcctgtcacagtgttgacaacctagttttgacttcactccatgaatccttttggaaatattatggtcaacaagttgtcgtccttgaataacacacaataaaaataacaaatattcagaaggtt

SEQ ID NO: 269045 - DNA, 970 bp, Homo sapiens
ttttctctaggattcagaatttcccatagatatgcaaccaaatccaaacctgaatgtttctaaagaaagtctttctccagcaaaatttgactacaagctgaaaaacatttttagactccatgaacttccagtgagctgtgtctccatgcaaccccacaaagacatcctagtctcctgtggcgaggaccgactctggaaggtgttgggccttccaaaatgcaatgtgcttctcacgggatttggccacactgactggctttcagactgctgcttccatcccagtgaaagatgcagatgtactttgtatggacatacagattctgtgaacagcattgagttttttcctttctccaatactcttctcacaagctctgcagacaagaccctgtctatatgggatgcaagaacaggtatatgtgagcagtcactttatggtcacatgcattctatcaatgatgccatttttgatcccaggggtcacatgatagcatcctgtgatgcctgtggggttacaaagctgtgggactttcggaagctgttaccaattgtgtccatcgatataggtccaagtcctggcaatgaggtgaattttgattcatcaggtcgagttttagctcaggcaagtggcaatggtgttatccatttgctagatcttaaatctggggagattcacaaattgatgggccacgaaaacgaggcacacacggttgtgttttctcacgacggggagattctcttttctggaggctctgacggcacagttcgaacgtggtcttgaccgtcagcacatcccgctgcagagggcattccctttaaggcttgaaaatgcctcctgtagtcccaaaccagcaaagaactggttaaatgtgccagcaggtaacatttacagtctgctttaaaacatgctttggacatatattttagtgctcatactgttactaataaaaaaataactttatgctcaaaaaaa

SEQ ID NO: 269046 - DNA, 631 bp, Homo sapiens
ttttctctaggattcagaatttcccatagatatgcaaccaaatccaaacctgaatgtttctaaagaaagtctttctccagcaaaatttgactacaagctgaaaaacatttttagactccatgaacttccagtgagctggtaggatttttgatgttttattaatacttttgagattttattttcatgtcaaaattttaatgctcttacagccattcatggttgaaatggtttgcttttagcctttcaaaattgctactcatagcatgaaagaatctgcttatagtagctgtaagaatcttaaaagtaattggtttaagcacttggtggcagtacagactaagtgcactattgtgtattttattgtagaggttggagtaaaaatgcacaaatcatttttagagaagtttctaggattactttaaagataggatctcagcaactatacatttcatttgtttattttactcaccaattttaccaatgtactttttccctgttaataagttctttttacttgtttgttatgaggactgtaattttgtgaactataattacataggtttaaagatgagacttagtattactcaacatttattgaaataaattgttttatgaatctgcgtatttatat

SEQ ID NO: 269047 - DNA, 1029 bp, Homo sapiens
ttttctctaggattcagaatttcccatagatatgcaaccaaatccaaacctgaatgtttctaaagaaagtctttctccagcaaaatttgactacaagctgaaaaacatttttagactccatgaacttccagtgagctgtgtctccatgcaaccccacaaagacatcctagtctcctgtggcgaggaccgactctggaaggtgttgggccttccaaaatgcaatgtgcttctcacgggatttggccacactgactggctttcagactgctgcttccatcccagtgaaagatgcagatgtactttgtatggacatacagattctgtgaacagcattgagttttttcctttctccaatactcttctcacaagctctgcagacaagaccctgtctatatgggatgcaagaacaggtatatgtgagcagtcactttatggtcacatgcattctatcaatgatgccatttttgatcccaggcacaaaggccttcatgaaatgatggtgccatgctctgggacttcccagcctccagaactggtcacatgatagcatcctgtgatgcctgtggggttacaaagctgtgggactttcggaagctgttaccaattgtgtccatcgatataggtccaagtcctggcaatgaggtgaattttgattcatcaggtcgagttttagctcaggcaagtggcaatggtgttatccatttgctagatcttaaatctggggagattcacaaattgatgggccacgaaaacgaggcacacacggttgtgttttctcacgacggggagattctcttttctggaggctctgacggcacagttcgaacgtggtcttgaccgtcagcacatcccgctgcagagggcattccctttaaggcttgaaaatgcctcctgtagtcccaaaccagcaaagaactggttaaatgtgccagcaggtaacatttacagtctgctttaaaacatgctttggacatatattttagtgctcatactgttactaataaaaaaataactttatgctcaaaaaaa

SEQ ID NO: 269048 - DNA, 578 bp, Homo sapiens
tactttatagagatgtttgaatctggctgttttggtcagatatttttcttctttgcatacgtagctgattttccatgaatatcaggaaaaggcatagaattctgatcaagatttctctctctttgattaccttagtcccaggtggtatcagagccagggaagtactcaactgtggaaaatatagagggcagttcttttggggactaatatggtatatgatcggagactaaagttcaaaaggcaatatgctgagtcatttagacactgaagatagaagaacagataccatttgtaatttagtttttagatgtactggacttatacattgttgagaaaatgaatagaatttagcaaagccagaaaagataatctatactaaatttgaaggtgggaaacaatcacatcttactcttggttcaaagctgcttctctttcagggcagttagaaaccttttacccttttatttgaagacaacttccaaaaacatattcatctggatatttcattaaatacagaacagagagagtaccacatgtacagtactaactagtgttgccacgttttggaattccacgaa

SEQ ID NO: 269049 - DNA, 300 bp, Homo sapiens
ttctttgttgataattatgttgagtgatagatttcacttcagatatttttttggctgggtacaatggtttacgcctgtaatcccagccaagacaggaagatctcttgagcacaggggttggagaccagcctgggcaacatagctagacctcatctctacaaaaaaaacaaaaaatttagccgggcatggtggtgcacctgtagtctcagctcaggagactgaggtgggaggttgagaccccagtgagctgtgacattccactgtactctagcctaggtgacagagtgaaatcctgtctca

SEQ ID NO: 269050 - DNA, 255 bp, Homo sapiens
taatattgtataacataataatagtaatcataggtgatgtcatttattgagtacttagtatgtgctgagtgctctgctaagtctggtttagacattatctcagttaaccttcctggtgtcccccaagatggatattgttacctccattttctcctaggaagaaacggacttgggggggatgattaggtatttgctagatgtctattctgtaccatccctgcactaggccctgtgaatacagagataaataaagac

SEQ ID NO: 269051 - DNA, 644 bp, Homo sapiens
tgaaactctagggggtggagagtgggcaaagcttgcccttagcacactcccattttcctcttgccttgaccaagagactggttggcatttgctgactctaagcttttcctaatctctgtgaaaaaaaaaaaaacagaaaaaacaaaaacaaaaaaacccacaaaaaacaacttgggacccaaatttactatattaaaggggaagttaagcttggggactgagtcaccaatattgtcttccttttgttcttaaacccatagttataatttcacaatcccatatcagactcatttcctctactccctctttttatgtgtttatcttatataaaatgtagatttactaagcaagagacaatgagaaattgacttttttttttcctctactccttttcacatgtaaaatgtagatttatgggtggggtgggacgggacgggggtgggcttagcagagcctcacaaaaatgtaaccatctgcctcactgcctatcctccctccctttgttccccctcctgcctgtcttccccctttaaagactgaagttcccaaaaccccctttagaaaagagatcacagatgctcctgcgatttgtgtttgtttttccagggtgtgtccttggataaataaactgtgaatcgattgag

SEQ ID NO: 269052 - DNA, 624 bp, Homo sapiens
gtagcatgtatcagtactacattccacttcattgtttaataataataataataatagttcattgtatgggaataccacgtttgtgactggcttctctcacttagcatagtgtttttaagatccatccatattgtagcattatcagtatacattccacttcattgtttgaataataataatacttcattgtgtgggtataccacatttatccatttatcagttgatggatatttgagctgtttccactttttagcaattatgaataatgcctcatctaacactttgattatactttttattatcatatgtgtggcttcaggtttttgtttggttggttggttttgcctgtgtctgtttttatcacttgattataaacttctggaaaaagatcattattttcactctgaaatttccatacagcaagtattcaataagtgtttggcagatggatgaatgggcagatattataggttcttaccatgttgattatgaagaagtacaaagtattcagaataaaaacactaagcacagtaataaaccaagggtgtgccagtaaatttacccagtaaattataactttcaaaaactgacggttcttaaataaactttaatctctgcactatt

SEQ ID NO: 269053 - DNA, 482 bp, Homo sapiens
ctctgtgcctgatgtaagatgctaattctcatattatctcctctgcaataagcttctaattatatccagataatcaagaccaatgcctgtgcacgctttctctaactttctctaaaaggactgcatataaagacttcaaataactgaaatgctgcattagaatttatatgtttttgccttaaatacttttccaaaataaaagtggtagccagtagcaacctcagtgacaattaatgtacatgatgctctccagccgagtacaaaaatatgaatacttaacaatgaacaaaaatggtagaagtgtgggtggatttacaattatgaacaatcaccgcactgtttgttgctctgcaatctgggagctttgcagccagggataatcatgtgatcataaagagcagcccccaaaaagcctgggcacaggtgaaagaaactctttatatgatgtataagaatgaaactgaagcaaccaaaatgacaaa

SEQ ID NO: 269054 - DNA, 360 bp, Homo sapiens
ttaggggtggctgctggtctacgagaaaacagtctcggagctaaaaatgaatgggaataatccacatgagagttgctccttctgcctgggcctgggaatgagaagacctgtggagctgagctactgcttacccacaacctgcatatacataaatcagaagccagcactggttgttcttgatgaagatgaccttaggcacagtgaccctgaaggccacatgttaaagacagtggagccacaggatggaaggaagctggttccctgaatcatcacgtggcagagagcggaccactaatcaggatcatgtgtttcagatttcacttgaccaataaatcaatttcaattttgttacactgctaa

SEQ ID NO: 269055 - DNA, 381 bp, Homo sapiens
tcccttaggagggggccggctgcattaggggtggctgctggtttgtaacaatgggaataatccacatgagagttgctccttctgcctgggcctgggaatgagaagacctgtggagctgagctactgcttacccacaacctgcatatacataaatcagaagccagcactggttgttgtgagtcgcttagattttgggcttgatgaagatgaccttaggcacagtgaccctgaaggccacatgttaaagacagtggagccacaggatggaaggaagctggttccctgaatcatcacgtggcagagagcggaccactaatcaggatcatgtgtttcagatttcacttgaccaataaatcaatttcaattttgttacactgctaa

SEQ ID NO: 269056 - DNA, 383 bp, Homo sapiens
gtgtaaataggctgaaagcatggagaatctgcaagaaagaagagaaaaggaacagctcatgtgagcctgtggctgtggattttccagaggaggaggaccggatgtccatcccacacacagaatgacaaatggagcacaggatgcagtgtctgagaagctttctacgtcctactggctctcacaggcttgctctcttggtttgtttttactggttggcactgccagggtgtttaatatattcaccaaaaatagactgaaataacagcacactgtaaaggctttcttggttttctgtgccactgatccccaggtatcttctgtgtgttatgcggtatatcgttaataatgttttagtttctggaataaatcatcttctaattaaa

SEQ ID NO: 269057 - DNA, 1977 bp, Homo sapiens
ttattattgtgaacttagtgacaagtgtggcactattacccatttccttgtctgcccccaaccctggggtcttgggcagagaacaggagttcttgccattttctcccagctcccaccttgtgctggcttgcgggtgctgaggtcatatttgctgggtgagagggtgcaggccagatatgagccaggcctggcagagagggttttggtcagcagtgatacctgcagtgttctctgcagttggtttgggctggccctgctcctgagaactcctgggttgtcccttcaggcaaccagggaaggctccttggagcagcagcatctccccttaccactcgccgacaccagcttccgcctgacccagagaaggagtttggggacagccacagcacgtccagggctcccaaggcagctggcagagccaatgaggagaccccaacacccatccgacggctgcagctctccctgacgtgtgtcacccgcagccctggtcccagccgctgtgcttctcagggcctgcctgcccagcccgggtggatatggtgcccaggcgggccccggggacacaatgagggccattctcagagccaggcagagcgtgtggggcagtcctgtcagtcctatgtgcaacagctgggatattgtttagggagtgctggcatcaggctggggctctcctcctctggccctgccctttgggatgagcaagcccccaaaggccttcctgggttcctctggtgcacgtgccctggagttacccttctgaaggaggtagacttgtcctcctgtcctgggtgcctggggtgcaggggtgtgaattgggctatgtcaagatatgctgggcagtactgtgaggtgggggcagaggggagaaggtgtcccaggaggagccttcctggaggggatgatagtccagcatgttctgaagtgggagtagggtgcggcaggagtagggtaccagagaatgagtgagtcaggcagcagcctccactgcgccttggacacaggtggctgacagtgtccacctggactggctttgcaccccttctgaggtcacagttgtgtcccttgaaaacttgggcaggagcacctgactggcccagcttgggtcatgccctaggcccagcagtgcgggaggccaggaaagtaggcttggggaggctggcctctcctccagtttgaagcatggcaggggttccgggggaggctgctggggggcctgcgagcatgtccagagcaggaatgcttggggtggtgtgtgctttgctcgtctgggcttatctggccgtggggaagctggttgtgcggatgacgttcactgagctgtgcacgcatcatccatggagtctgcggtgtgagtccttttgccgctccagggtcacagcctgcctccctgctccagccccctggctgaggcccttcctctgccccatgctcttctcagacaggaatcctgtggaatgtcatctctttggggaggccgtctctgaccctgtatgcaaaggccttctcccacattatttttggcaccccactttcttccccgtgaaagcaaattgtttggtgtctttctgtcccactacagtataggcccggttcagacagaggccttgtccactaggcctgcgctatctctgcggagcccagccaaagcaggggccaggcgaatcttttgttaaaagaacaatgcgcgctgggcacagtggctcacgcctgtaatcccagcactttgggagtccgaagctggaggatcacttgagcccaagagtttgagaccaccctgggcaacataaggagaacccatctctacacaaaattagctgggcgtggtggtgtatgcctgtagtcctagctacttgggaggctaaggtgggaggtggctgaggtgggaggatcacttgagcctgggaggttgttgcagtgagagccatgatcgcgctactgggcaatagagcagaacccagtctcaaaaaaaaaaaa

SEQ ID NO: 269058 - DNA, 182 bp, Homo sapiens
ttgtcagtaattttttgaacctaataatagttttattaatgttaatttcccttccatcaactatcaatgacacccatgtgccagcagggtaaagttcatagctattaattgatcttcacattttcttgtcccaatgcctgttttaactttataactctacttacaggaaattttgtcacagt

SEQ ID NO: 269059 - DNA, 413 bp, Homo sapiens
tgacagcaccaccatgcaaaagactagattgagtactggtacagcaaatatgactactaagcatttctatccaatattcaatagataggtttattcaaactttatggctttcatgactccctactcatattctgtatgaataataaaaaataataatttccaacccagtttttcatgagagatagtgtggcatgatgtaaaaagccctggctttggagtaagaaataactggattcaacttatggtcctcttaggctgtgtgacttgaggctaggtatatgagctctctaaacttcagtttactcagctaaaaagtaggttataacataaagggctttgtagggattaagtgagcaaaatcatttatattacattctttttatttatgttgtaactgctagagaaggagattt

SEQ ID NO: 269060 - DNA, 502 bp, Homo sapiens
aggggagcttttccttcatttatgtttatttaggcatttcatcttaaaatgccctaatttggggttgtattaggaaagtttaagaatattacagtgattgtaggagtgcttttagccaagcagactgtatggagaatcgagggcagctggtttcatttaaatttaccaatctaagaaggagtggaaaacacatgtggtttcgctttctcatcagctgagccaaacacctgatgcttcagaggaagacggcagtagttcaattctcccttgcccattactcagagactgcaatgcagagaagttattatgattctcctgagtgtcataagtagactgtggtaaagatggtctgattttagccttcagggtaaatgctttggcacagaactttgaaactgctgtccgcagctacgtgaggggacagagcgttgataacatttgattgccacttgaattctaagaagttcttttaaaacagaatcaacaataaaaggttttattg

SEQ ID NO: 269061 - DNA, 354 bp, Homo sapiens
ttttcttgctatttccaccacactgcagcaacttcctctactggtcttgaacccctcagagttgtccatgacagttgtattcaccttctaaacccttgctaatgttcttttgagctcctcccatgaatcacaaatgttcttaatggcaaatagaatggcaaatagaattactaaaatttagtagtactttttaacttgccttaacataatgcatgatattttaaattattaaacaggacaaggtaatgcttccattttgaatacaaataaatattataaatcaaaatgctttgctggaaaaatccatgatgcattgatgcaataaaaatgaaatgtcttgttaactttcagaga

SEQ ID NO: 269062 - DNA, 876 bp, Homo sapiens
ctgttagccgagtctgagcatctcggaggatgcggcgcggcgatcggctgcagtgacgcgcgcaaggtgaacacgggggctgcggcgcgcaggctcatccagtgaggactggaaggtgggggctttaggcccaggcatcggagtagaccatggcctccagcccatggggctgtgtatgtggccttctgctgttgctgctgccactcctggggactggccctgccctggggaggggctttcccaggccacttgaaaactccgaaatccctatgatccctggagcccaccccaagggctctgtgggctcagagccccaggcctttgacgtgttcccggagaaccccagagctgacagtcacaggaactctgatgtccgccacgcccctgctgaagagatgcctgagaagcctgtagcctctccccttggcccagccctgtacgggcccaaagcagcacaaggagctcagagagaacgactcccagtaactgatgacctccagatggctcaaggaccaagctcccacggctggacaggacctctggactcacaagagcttctggagcaagaagcagtggctccccacccagtgggccaccctcatctcactttcatccccacaactcccagacgtcaactcagggtagccacagttcctccctccctgcagcatgaaggccaagagggacagtggccacctagagatgagggtctgaaggccaaaactaagagcagggtcccacccacttctccctcagaccaccagggcccaccccacacccttgtttcccactcaggtactgtcaagaggccagtgctggaaggacagggtgggtttgaggaacacttgcaggaggcagctcaaggtccccacttca

SEQ ID NO: 269063 - DNA, 828 bp, Homo sapiens
ccaggaggtgacggtgctcagtttccctcctgtcccaggaccttgtgctgtgcgcgactgtactcgtgtgtgctttgtgccctggtcattcggatgtcaccatggcctccagcccatggggctgtgtatgtggccttctgctgttgctgctgccactcctggggactggccctgccctggggaggggctttcccaggccacttgaaaactccgaaatccctatgatccctggagcccaccccaagggctctgtgggctcagagccccaggcctttgacgtgttcccggagaaccccagagctgacagtcacaggaactctgatgtccgccacgcccctgctgaagagatgcctgagaagcctgtagcctctccccttggcccagccctgtacgggcccaaagcagcacaaggagctcagagagaacgactcccagtaactgatgacctccagatggctcaaggaccaagctcccacggctggacaggacctctggactcacaagagcttctggagcaagaagcagtggctccccacccagtgggccaccctcatctcactttcatccccacaactcccagacgtcaactcagggtagccacagttcctccctccctgcagcatgaaggccaagagggacagtggccacctagagatgagggtctgaaggccaaaactaagagcagggtcccacccacttctccctcagaccaccagggcccaccccacacccttgtttcccactcaggtactgtcaagaggccagtgctggaaggacagggtgggtttgaggaacacttgcaggaggcagctcaaggtccccacttca

SEQ ID NO: 269064 - DNA, 364 bp, Homo sapiens
atggggcatgtaaatatgggaatttacaatttaatttaagggacaaagtatattttttcataacacagtcatcacattttaaaaaataaggctaggcgcagtggctcacatgcctgtaatcccagcactttggaaggctgagacgggcggatcatgaggtcaggtgttcgaaaccagcctggccaatatggcaaaactctgtctctactaaaagtacaaaaactagctgggtgcggtggcaggcacctgtagtcccagctactcaggaggctgaggcaggagaattgcttgaacccgggaggcggaggttgcagtgagctgagattgtgccactgcactccagcctgggtgacagagtaggctc

SEQ ID NO: 269065 - DNA, 312 bp, Homo sapiens
gcactttattattcccctacagatagcagtcttatgaccaaaaaccctaaaatgtgtcagattccccttgtgataaggtcttgctcagattcagattgtcagaccctgacagcaatgaattcaatcctgtcttgattgtctgactatatactagggctcctttccaatttctttttctcttgatggctctgttcctgaagacttgagatgacagtaacaaaattttaattagacatataatggagaaaataatacaagtactttttttcagggttgtaagataagcattactaatctatatattatcttaaa

SEQ ID NO: 269066 - DNA, 407 bp, Homo sapiens
atggataatacatatatgtatatgggtacatatgtatgtgtatatctatcaaaaattggatatgtatcacatataaatatgtgtatgtatatgtaaaatcacaaaatagataagtgggatatgcctggaatgatatacaaaaaaactggtaacactagtcacgtgcctctaggggacaaggtattaggaaaaatgcttgctgtgtgtgccttttgtaccttttgaattttataccatgtgaaagttttgcctgtctaaaaagttaaactacaaattgatcataaaaaagaacaatgtgacacatacataaaaactctgaagcagaaaataaaaagagcttagagggaaatagaaaaggcatgtagctagccaagggtgggcgagattccaagctcctggtaaccagg

SEQ ID NO: 269067 - DNA, 1084 bp, Homo sapiens
gtattataataattattagatatgatacctggcacaaagtagtaattcaggtgtttttttgtgtgcattagtgaacaagtaaaaacaagtatatttcttgaatataatgtatagaagtaattttattctttttatctttaagttagaagaaaaattaaagtatattccaaaggttagataaatgcagtgtgtatgggaatcccttgagtttttcagtaaaattctatttgggtggctgtcaagtccagtctgcatagtcttgacatgtcttggataagatccttatactatcacttttcctgtcatggacactacaaattatattgaatcagaaatctaatttaatccattcttattcaattggaagcagtaattgctttcaatttaatgggattggattcagtattagaaattttgatgttccttcaaacttaatacagtatggttatatatatttccatttatttgtgtgtgttcctgtgccctcgcagagagatgatcttggagtattacttgtattcacttgagttatttgcaacggttggtaaagaggcatattgtaagggtgggaatgagagtggcattctctttgttttttttcttttctacccatggaataatgaagagagaaataataagggccttcaaaatgggatttccatccactcagaaataaggaaaggaaatttagagtctctggagaagatctggaatgctatttactcttgagggtagacagcatccagccctactaaagatgaaaaaaggagagcctggggatgaaattaaatccatcaaaaaattcactgttggtcaggcctggtggctcacgcctgtaatcccaggctgaggtgggcggatcacttgaggttaggagttccagaagagcctgaccaacatggtgaaacctcgtccctactgaaaatacaaaaaaaattaatcggctatggtggtgggcgcctgtaatcccagctactcgggaggctgaggcagaagaattgctttgacctggaaggtggaggctgcagtgagccaagatcatgccactacactccagcctgggcaatagagtgagactccatct

SEQ ID NO: 269068 - DNA, 617 bp, Homo sapiens
aaaaaaaaaaaaaaaaaattatcaaagaagaaaaaggtcaggcaaaagttggaaagataatttaactaactctataaagcactgtagtcctggatttatatgatcagtgggtatccgagagtctttttctagttatattttatttcatattctagagacagttatatggaggcatatacttgggaattctcaaaagtcttttatcctctagaatatcagatgttttcagtagaattgacaagcgttggtctataattttcaagtcaatacttttcttatgtttttgaagatggtaacaacaaatttgaagttatctaatgtaggttctataaagcaattacagaataaagagcttggcttgagatagttaatctagtatcctggtccagtctttcaaagtacctgccactgatcagagcatatctggaagactatggtcagtttggaggtttatattttaagagggaagttgacatattaaagcaaggtccaggccgggtgcagtggctcacacttgtaatctcagcactttgggaggccgaggtgggtggatcacttgaggccaggagtttgaaaccaacctggccaacatggtgaaaccccgtctctacccaaaa

SEQ ID NO: 269069 - DNA, 221 bp, Homo sapiens
cagtgagccaagatcacaccactgcactccaacctgggcaacaagagcaaaactctatctcaaaaaaaataaaaaatagccaagcatggcgacacgcttctatagtcccagttactcaggagtctgaggcaggaggatcgcgtgagcctaggaggtcaaggctacagtgagtcaagatcaaagcactccagcctaggcaacaaagcaagaccctgtctcaa

SEQ ID NO: 269070 - DNA, 546 bp, Homo sapiens
cacgagggtagcttccaacttaaagtatacctgccacaagaacgaaagtaataatctcacctccctttttgtgtagagactgaattctaattagttgtgttaatagtatttgctgaatacctttcaattcctaaaactggggtcaaagtagtcaacattgcagttaattatttttgaagaggatatgaactattctgttatttaagatattttaacctaaataccattatgagttaaaatgcataccatgatataacaatttacctattaactgttgacaatcttgcagccaattaagttttttaaagaaccagtgttcttaggtatgtttgttgagccttctactttttttccctttgatgtggggaatagcatcaagcagcaagaaaagagtgttgatcgatttctctctctttctctctctctctctgtatccttgccgtttaaaatatgcactttccaactagtatttggccgttagggagttagtatctttgtaaagattaagtcagcagaggaaggtgggcaaataatatttttgataaa

SEQ ID NO: 269071 - DNA, 406 bp, Homo sapiens
ctactgcacgtggcctcatctgggcattcttaattttgttacttatcatttctgggttagtttttgaaggaggtaataggtttttcacaaaatttgataataaataacgtgtacctgaggcataatagacttacctttaattttattttgccatttgataattggcaaagtttacaaagaaatatactgacaaggtttttagttcaccacatctagatttgattgtgtctatgagctccaaataaatatataggaagcataatttcctgtcaatgcattcagtttttttaaagttttatagtcatgttgaatgtgaagtgatccgggacaattgaggtcatcattgttgaagaattttgaacatttgattcatgctctcatttagttctttaactgattatgtgca

SEQ ID NO: 269072 - DNA, 848 bp, Homo sapiens
taatgatatgcatacatatagttgcctacaatgactgtttttctagttatttctataatattaaaatgatttttttgctgaaattccagaaatctaaaaacattgaaaaataatgataatgagaaaaacaattcttacttgttagggtatatgttatttagtaatgaagcatttagattttggattctctcatttcagttggaaatagtattggtgtaagtgagtgttgccatgggaacctccacatagatataaaaggcaatactgtctaagtggaggaggaggggcgatgtactgaaataccactggcctaaatgatctattttatgtatgtgtgttggtgtgggggtgagagctaggatgaaaaggggagagaaagtactacagaaagtaaatgttagcagtcaaagcaatttactcacacttttggattcttttagatagaagtgttttaaagctcgaaatgtgattcttaattattggtatcatcatgcacacactggggagtctttgcatatcttatttttaatgtacagtggaatatgtttaacttacttggttttagataaaatttaatttagtgaaatttgagagttaggatttcagtctttgaaatggctttatacatgttattaaagatgttatatttaattctttttaaatatctgaaatttagaaaaactgattaggacacagttaatgtggctttcaaagaaaagctggcattttggctttatagtatttttaatactagatttttagtaattttctataaatatataggcaaggaaacaatgacttactgtatctgcatgtgtaatattttatggttaaaaaaataaagaatg

SEQ ID NO: 269073 - DNA, 469 bp, Homo sapiens
caaactttgtctgtgtcaaaagaatacaactgaagatgccattatgaaacaaaccatggtgagaattttgactagtttacagaaaagatgcatgatgaaaaactcaatgaacttagaaaaggactaaactttctacagcattaatcatcgaatacaaataaaataagtgatgctgctgtgaaatgcagttacataataagtgaaaaaattgtccgtgcttcaaaatcttttacagatggtgagtttataaaagactgtctattgagtgcagcggaaatcatgtgtcctgaacagaaagaagcatttgcagacataagcctaaccagaaaaactgttgctcagagagtaaaagatatggctgagaatttacaggataagttgtgagaaaaagtgagatcatttgtgacattttctattgcagttgatgagtgcacatatgtaaataatacaagtcagttaattatgttta

SEQ ID NO: 269074 - DNA, 1371 bp, Homo sapiens
gtatgacaaggcggtacagtcttataaggatgtcttctcctacttgccaactgacaataaggtgatgctggagctggcgcagctctacctgctccaggggcacctggacctgtgtgagcagcactgtgccatcctcctgcagactgagcagaaccatgagaccgcttctgtgttgatggctgacctgatgtttagaaaacagaaacatgaagcggccatcaatctttaccaccaagtcttggagaaagcgccagacaattttttggtattgcataaattaatcgatctgctaagaagaagtggaaaacttgaagacattcctgccttctttgaattggccaagaaggtgtctagccgggtgcctttggaaccagggttcaattactgcagaggtatctactgctggcacatagggcagcccaacgaagccttaaagttcctgaacaaggcacgcaaggacagcacttggggccagagcgccatctaccacatggtgcagatctgtctgaatccagacaacgaggttgtgggcggagaggcttttgagaaccagggagctgagagcaactacatggagaagaaggagttggagcagcagggtgtgagcaccgccgagaaactgctgcgtgagttttacccacattcagactccagccagacccagctgcggctgctgcagggcctctgccggctggccaccagggagaaggctaacatggaggctgcgctgggcagcttcatccagatagcgcaggctgagaaggacagcgtccctgccctgctggccttggcacaagcctacgtgttcctgaagcagatccccaaggcgcgtatgcagttgaagcgcctggccaagaccccctgggtgctgagtgaggctgaggacctggagaagagctggctcctgctggctgacatttactgccagggcagcaagttcgacctcgccttagaactgctgcggcgctgtgtgcaatacaacaagtcctgctacaaggcctatgagtacatgggcttcatcatggagaaggagcagtcctacaaggatgcagtcaccaactacaaactggcctggaagtacagtcatcacgccaaccctgccattggcttcaaacttgctttcaactacctgaaggacaagaaatttgtggaggccatcgaaatctgcaacgatgtcctcagggagcaccccgactaccccaagatcagggaggaaattttggaaaaggcccgaaagtccctgaggccctagctggggtcaaggggcctggaccagtagaagccatcaacctactgaagttgtgtggagggatggaaagtgggtcagtggagaagggattcagaaaatgacacattcttccccaaactata

SEQ ID NO: 269075 - DNA, 1237 bp, Homo sapiens
gtatgacaaggcggtacagtcttataaggatgtcttctcctacttgccaactgacaataaggtgatgctggagctggcgcagctctacctgctccaggggcacctggacctgtgtgagcagcactgtgccatcctcctgcagactgagcagaaccatgagaccgcttctgtgttgatggctgacctgatgtttagaaaacagaaacatgaagcggccatcaatctttaccaccaagtcttggagaaagcgccagacaattttttggtattgcataaattaatcgatctgctaagaagaagtggaaaacttgaagacattcctgccttctttgaattggccaagaaggtgtctagccgggtgcctttggaaccagggttcaattactgcagaggtatctactgctggcacatagggcagcccaacgaagccttaaagttcctgaacaaggcacgcaaggacagcacttggggccagagcgccatctaccacatggtgcagatctgtctgaatccagacaacgaggttgtgggcggagaggcttttgagaaccagggagctgagagcaactacatggagaagaaggagttggagcagcagggtgtgagcaccgccgagaaactgctgcaaggacagcgtccctgccctgctggccttggcacaagcctacgtgttcctgaagcagatccccaaggcgcgtatgcagttgaagcgcctggccaagaccccctgggtgctgagtgaggctgaggacctggagaagagctggctcctgctggctgacatttactgccagggcagcaagttcgacctcgccttagaactgctgcggcgctgtgtgcaatacaacaagtcctgctacaaggcctatgagtacatgggcttcatcatggagaaggagcagtcctacaaggatgcagtcaccaactacaaactggcctggaagtacagtcatcacgccaaccctgccattggcttcaaacttgctttcaactacctgaaggacaagaaatttgtggaggccatcgaaatctgcaacgatgtcctcagggagcaccccgactaccccaagatcagggaggaaattttggaaaaggcccgaaagtccctgaggccctagctggggtcaaggggcctggaccagtagaagccatcaacctactgaagttgtgtggagggatggaaagtgggtcagtggagaagggattcagaaaatgacacattcttccccaaactata

SEQ ID NO: 269076 - DNA, 1458 bp, Homo sapiens
gtatgacaaggcggtacagtcttataaggatgtcttctcctacttgccaactgacaataaggtgatgctggagctggcgcagctctacctgctccaggggcacctggacctgtgtgagcagcactgtgccatcctcctgcagactgagcagaaccatgagaccgcttctgtgttgatggctgacctgatgtttagaaaacagaaacatgaagcggccatcaatctttaccaccaagtcttggagaaagcgccagacaattttttggtattgcataaattaatcgatctgctaagaagaagtggaaaacttgaagacattcctgccttctttgaattggccaagaaggtgtctagccgggtgcctttggaaccagggttcaattactgcagaggtatctactgctggcacatagggcagcccaacgaagccttaaagttcctgaacaaggcacgcaaggacagcacttggggccagagcgccatctaccacatggtgcagatctgtctgaatccagacaacgaggttgtgggcggagaggcttttgagaaccagggagctgagagcaactacatggagaagaaggagttggagcagcagggtgtgagcaccgccgagaaactgctgcgtgagttttacccacattcagactccagccagacccagctgcggctgctgcagggcctctgccggctggccaccagggagaaggctaacatggaggctgcgctgggcagcttcatccagatagcgcaggctgagaaggacagcgtccctgccctgctggccttggcacaagcctacgtgttcctgaagcagatccccaaggcgcgtatgcagttgaagcgcctggccaagaccccctgggtgctgagtgaggctgaggacctggagaagagctggctcctgctggctgacatttactgccagggcagcaagttcgacctcgccttagaactgctgcggcgctgtgtgcaatacaacaagtcctgctacaaggcctatgagtacatgggcttcatcatggagaaggagcagtcctacaaggatgcagtcaccaactacaaactggcctggaagtacagtcatcacgccaaccctgccattggcttcaaacttgctttcaactacctgaaggacaagaaatttgtggaggccatcgaaatctgcaacgatgtaagccagcagccttggtggggagggcctggtgtagtggtggggaaacctgcatgatactgcacacccattctctctctgttccaggtcctcagggagcaccccgactaccccaagatcagggaggaaattttggaaaaggcccgaaagtccctgaggccctagctggggtcaaggggcctggaccagtagaagccatcaacctactgaagttgtgtggagggatggaaagtgggtcagtggagaagggattcagaaaatgacacattcttccccaaactata

SEQ ID NO: 269077 - DNA, 724 bp, Homo sapiens
  misc_feature (723)..(724): n is a, c, g, or t
caatggattcccatgagggcagattttcatgaactgggaaatgtttagtgtggaattcattgagccaaactcaggaaaccctagaccgatgagaaaaatggaagtcagaaacaaagaggaaagtgtggaggccacatcccacacagcgtcattccgttgcactcccgtttgactctgggtatgaaagccatcaaatcaggagttagccaggatggacccaatttgcacaccaaatgtttttggcgtgttggagtactcccacctcaacatcgggccattgtatggactgcttgtgcaattaaaggaatgtgcgaatggtgttggaagcaccttctgtgtcatctgtctttctcagtgttgcaggtgaagttgtaggacccaatccatctctcaccagattgtatcctcaccccatctgactgtattgcttcttacactgtatgtcccaggatgaaatcctaagatgatggaggagggtcccctcatgatgtaaagtacctgctcagataggaatctaatttgaggtaaattccaggggtccagtggacaggattgctagtgtctctctctgagatggctgcaggacaataaaatacaggaagatgtctgttttttggtggggtgtgttcctcttctttctagaagagtggcttttcttttgcagggggagttgatttggatgccggcaggtcttggcatgcctcccaattcacagtggattcnn

SEQ ID NO: 269078 - DNA, 660 bp, Homo sapiens
catgtctactaaaaatacaaaaattagctgggcatggtggcacatgcctgtaatcccagctactcaggaggctgaggcatgaggatcactggatcctggggggcagaggttgcagtaacccaacattgtgccattgcactccagcctgggcaacagtgcaaaaccctgtctcataaataagtaaataaataaataaataaataaagactgttgtctatgagccaagacggggaccctcaccagacatcaaatctactagtgctttgctcttggactcacagcctccagaacagaattgaatttctgtttttgataactacccagttcataatattttgctatagtaaccctaacaaactaagattagatagatagatagatagatagatagatagatagattaaggtcattcatattaaagcttcgcaagtgacacaaaggatggcatcttaagcaatcacttaaagctggtccattgagtatgtaaacctatacactgatgttatctttcatctctcctcattgatcttagtcctcggtatcatctctaatttcctcgcctacgtacctccttctgccctatactcccctcttctacatctctttttcattcctacatatcctccttcatccgctttagcttttacatcctcctttcct

SEQ ID NO: 269079 - DNA, 612 bp, Homo sapiens
taatagtatatcaagggctagcttttaaaatttttagtgttttcctgactattcttgcatgtctgtttttctgttgaactttagtatcagcttttctgtctcaatgaaaaagcttgcaggtgtttttattggggttatgttaaatttataaattaacatggaagactgactttttaatgctgttgttttgtgctgagatttctgtccaagaacaaagaatatctttccatttgttcagatctacttttgtgtctttcaggaatgttttaaagttttcttcgtatttaactcctcgataaattctccttttttttttcagctcaataatatgccttgtagatctttcttttgtatgtctgcatgattttctacagtgtggatgtaccataatttatttaacctggctgatattggtggacattaaagttatttaaaatttttcactattgtaaacagttctggaataagtaaatatccttgtagaagtctagttacttccttatgataaatttatcaaaggagaattgcctcatcaaaggtcttttgacacataaaagtttctgaaacatattgttaacagctttccatattaataaaatgtatacctccact

SEQ ID NO: 269080 - DNA, 702 bp, Homo sapiens
  misc_feature (51)..(51): n is a, c, g, or t
  misc_feature (174)..(174): n is a, c, g, or t
ttttggagatgagctttccgctcttgttgcacaggcttgagggcaatggcngatctcggctcacaacaatctcggcatcctgggtcaagcgaatctcctgcatcagctactcagaagactgagtcaggagtatcactgagccccaggagttcaaagctgcagtaggctatgatnttgaacgcactgcagcctgggcgacaggaagaccttgccttaaaaataaaaacaggccgagtgcgatggctgttacatgcctgtaatcccaacactttgggaggctgaggtgggaggattgcttgagtccaggagaatcacttgaacccaggaggcggaggttgcagtgagccgagatcgcgtcattgcacttcactcagtctgggcaacaagagtgaaactgcatctcaaaaaaaaaaaaagatgttagtataagcaccctggagagttgagacccctagactaatacttgaatcttatttagaatcttagaatgggggagccagaaagagccttctaagtctaatctggtatttctcatgttctgaagattattgtttcaggggatattattagggtattctcagaaaagggttccttagccaaatgtgtctggaaactgtagcatgtgctatatcgtctcttggaaattcactgtgcttgttagaacattaaaggctctgagaagtccagaatttaaaaaaaaaa

SEQ ID NO: 269081 - DNA, 595 bp, Homo sapiens
gatctgtttatagctataggtcaggagatacttgtgggtaattgggatgagacatgaagagaattgactcatcaaaggagttatagggctttcaggcaaagcttaacagacttatcaagtaaggaagaaggagagtctgcctctgctgacggtaacaggaatggctccaaatgttgttagcgctcctatacagcctcatccaattctcagcttcccagccactcctaaccatgccctcactctcacatacgacacctcacgaggttgtgaattcaactgttgtaaattggcagcccataggatcaaactgtgaaattgtttttatcggagccctgtgcctgcaagacatgagagattctcttaacaaggtcacagaaagtgcttgagcttccttatgtgccttgagcaaagaatgtaggaattggatctgaccatcatctttccttatgctacccagaagcagccacgcccctgtatcttccttgatttcctcccgtcatttatgctttcacaaaacagtgtccactcagtttcccaaaaccttgctgcaatgagcaccgcattctaagtaaccacaggcagtatttcaattcat

SEQ ID NO: 269082 - DNA, 726 bp, Homo sapiens
ctgcaatcccagcttcttgggaagctgaggcagcagaattgcttgagccacggaggcggaggttgcagtgagtcaagatcgcgccactgcactccagcctgggtggcagggcaagactgtctcaaaaaataaaaattaaaattaaaaaaatctgttaccattaatactcaatagtcctatttttcctattgtaaaatccaccatgctaattgcagaaggtatattagaagtcaactggagccattcattattaacaatcacttaagaggcagtttcattcaagcaagcttttataaatcccaactgtattctcccccagaaaggcagcagtcaacatccttaaacatactaacttaataatcaagtgatctaagtcttcacacaagtcaatgaagaaaacatttaacaaaatagaatcaaagaaagcattttacctcaccactaaagagcacctttgaaactagtggctatgctttcagagaagggctgttaaaatagctaggcttacaattatataaaacacatttctctagctctttaacaaggtgtcacaagcgattattacatgcctttgtgaaattaagagctggtatgtatggctaaggaaccctgttgatccctctgtaaatgtcatgcagtccacataaaggaaccaagagacagaaatgtcaagacaagttcacgtgccatcctaatgaggaactaagactagaaaccaagtcttca

SEQ ID NO: 269083 - DNA, 407 bp, Homo sapiens
gatgggcgggtggaacgggcatggtgtcctcagcagaggagcagagctgcgtgcccaagagctcaggcggggactccagcaatgcggggccagggcttggcctactgcctccttgctgcatgacctgccgtgagtcacgtcttctctgcctcagtttccccttccgtcaaacaggggccagaaaaggtttgccctctcaggtctgccctctcaggtctgcagtgcggtggcagtgacctcctctcagggccatcccatgtgtgatgtggaaggagcctatggctgaagggactctgtgtgcactataggcaccccagatttcacattggttatgagcgagtttccaaagtgacttcatctaacaaaatccatacactatgacacgtgtccaacaagtagatgttgtg

SEQ ID NO: 269084 - DNA, 265 bp, Homo sapiens
cttaggccgtaacagtaaaattgaaaccagaagaaaaaagttacaagagctgacaaaaaggctgagttaccatctcaggccttctcaacagagaaaaggcagaaacagattatagaattattatgaaaagcagaagttcaattaattttattgagagcaaatcaatactttaaagaagctttgttttaacatacaggactattataaatgatttccttttttaaaaagtccattaaaacatttttttttaaatttttttctaaga

SEQ ID NO: 269085 - DNA, 437 bp, Homo sapiens
caacaaacatgccagttaataagaccctggtccctgtcctgtggcacttaggagggtcagatgaaatgctactttttgcatgaagcccttcctgacctcattaactggaagtaatacctttctgtcctgatgcccacagatgtactgttacatttaaaagtttttccatgttttttttttctattcaagatagattataaactccttgaggcagggacagctaattgcatggaagtaatcaattatagtagaatatcagatgtgttaggcattaaattgcttgttttagtcagatcactaaaattttgatttcactaataatcagttggggtgtaagtgcaaagctaagatttgaattctaattgtgacactaaagccttaactattatatgcattaactattatatgcttaactattatatgcattgttccatagt

SEQ ID NO: 269086 - DNA, 482 bp, Homo sapiens
ctacaacccactgaatcagaacattctagattggtactggaatctaaacattgctccaaattaataacttataaccaaatacataatttgtcaattgcaaaaagttatcccattgcttgttttcgggattgggaatatagttgaagggttctacaagtaaaaagattcatgaggtaatcagactatatacagctagaaataaaacaatttaaagggaaataaagtcttgaaactcaagttttatgtgttaattacatgaatatagatttctcccccctccccatagaaatcaagttccattggctgtattaggcaaaatactataacattattttgaaatattgaacacgttgaaggcttttaaaacaaaaggtgactttggtgataaagatgtcaacagaaatagtaatgaatcaaactttgcgttaaattgggccagaagtgctccataaaaagaaaatctctataacattaaaaaaaaa

SEQ ID NO: 269087 - DNA, 343 bp, Homo sapiens
ctgaggccagcttcactggacagatgcacagtattgtcatttatcatactgttaaaaagttcccaggattattttctagtagatttctaaatggatccaaattatcaaatgttctgtgcccttgtggaatttttagaggaagccaagtagaaattttaataataggaaattgataatatggggtaggcctgtttcccttgttttgcctttttctagaaactgggcctggggacagtctgcctgaaggaataatgtcttaaacttgtcttctttggaacgtttgtaaattctccctgcagcgcaggatcattaggaggcatacaatactgctttacgtgtcctg

SEQ ID NO: 269088 - DNA, 126 bp, Homo sapiens
tcactggtgtttagttgggggaaggaggttaaaaaaagcaaggaacagatttgtgcaaacaaactttacaattttgaagtaattagtgagctgtgcaggtgtctattaaaacaaactgacaataaa

SEQ ID NO: 269089 - DNA, 380 bp, Homo sapiens
acgtataatatatcttatacagtagttggtataaaattttaaattttaccatgaattattttcttactatggttttatctcacttaaacctcacaaccctatgaagtaagagctacgtttacaaatgagaaaactaaggctaagaacgttaggaaatgaggccaggcgcggcggctcacccctgtaatcccaacaccttgggaggccaaatcacctgaggtcaggagttcaagaccagcctggctaacatggcaaaaccctgtctatactaaaaatacaaaaattaaccaggtttgctggcatgcgtctgtaatccaggctactcgggagcgggaggcacgagagtggcttgaacccggcaggcagacgttgcagtgagc

SEQ ID NO: 269090 - DNA, 561 bp, Homo sapiens
aaagtagcatttttattctagagatgcctccattgaccacaatgtttttatgtcatcaatttttctgtttgtattgtttcgttagattatgtcttttatgtttcttcggtgtcaggaaattgtttacttttaaatgcaattctgaattttgcgagctaaaaaaccagctggaaacaaatagagtgaacaatatggattatgtatttttttagtttttagtttttggtcatgtggcttggttctgatttcaaggagtggctgaaaaattaagcaggaaagcaattttcaaggaagtttaaaaaaacattttgtggtagaatagttggaatatgtctttaatatcaaaatgtaacaaactggaagatacataataaataccccttgttttgtttttaaaataataatttcattaatttatatagaaacaaacatccttttattcctttttattgaatatatacaatttaagtaacattactcatggcaaaacgctaatggccaaaccagaaccctaaatccagcagcaaaaaaaattccacctatgcacgtgctttttccttt

SEQ ID NO: 269091 - DNA, 367 bp, Homo sapiens
ggccgcaagaggggccatagctctctcaggctccttataaacagccattcctgccaccaggaacgtggcacagggtagggaagcccaagaggagatgctggaacacaggcagggctgtctggggtgccacatcccagggacaagaatagctggcattaactgctctaactagaactcctcccagtgtgagcactgctgcggctgcaagaagccctttgaggggctgcgaccccaaggcgcaggctcaaggatgcaaggctgattgcaacaccccggtaaggaagcagggcctggctgactttcttttagctgagtgaatgcagctctgaagcctgacctgggctgggacagcgaggcggccaccaga

SEQ ID NO: 269092 - DNA, 292 bp, Homo sapiens
ccaagggcccaaggacctgcccatctggcttgctgctgacaccactggcacctatgcacacctcctggaggcctaaggactggcccacccagaactaccactggtgcccacttatgccatctgggagcctgtggaccagcatgcctggcctcctgctgccaccactggttcctgaggactagcccacctggcattcctgtccccagcaaaacctcaccaaagtctttactaacaaccacaacccaagccactgaggaactcacagatatcattgatgctgataacagccaaa

SEQ ID NO: 269093 - DNA, 698 bp, Homo sapiens
accccggggggggcggggcctcgcggccctgcagcctcgtcaggctcagtcccctcccgataaacccctaaatagggactttcccggggggtgaccctggcttttttggcgaaaacccccagtttaaggaggccttccccctggcttcacgttgtggagtcgaaaggaaccttgaagcggagaatgagctcgtgacgtggacccgaggaaaaaacctgccaaccaggatttaatagaattcagctctttcaggctttggagggaaggcgatttgaacgggatttcaatgaaaaaccctgtcccttcggctttttttttttcctctctcgggtctcgtcacgtgatggtcctactttatttttaaaaattaaatggcgcatattccccagcatcctaaatctagtgcaacctagtggcaagtggagaaaaaaataactgccaacctggcttcctacgaggtcccccggagttctcgcaaagttgcgacccagttggcaaaaatacagtgtgtgcaaagactcaactggacattgccaccaagaatcaagagatttttggggactttagcaagaaaacgttatttttaaaagccctgctccaaagctggttacaaatgaatactgcgtttccagtgacaggttgggcgagcagaaaggaaatcttacggttagtttcaaacactttgtgttttaggtggc

SEQ ID NO: 269094 - DNA, 346 bp, Homo sapiens
  misc_feature (15)..(15): n is a, c, g, or t
ctaagaagaacaccnggcttccgccaactagctctagtgaaggagaaataaaatcctttacagacaagcaaatgctgagagattttgtcaccaccaggcctgccttataagagctcctgaaggaggcactaaacatggaaaggaacaaccagtaccagccactgcaaaaacatgccaaattgtaaagaccgtcgatgctaggaagaaactgcatcaactaacgatgatgtacttttaaagaatgattaattaactaattcttagtcttataataattacttttctgatattttttacaacatagagaagtcaaaataaatagtaccttattggtcttatattccaa

SEQ ID NO: 269095 - DNA, 241 bp, Homo sapiens
tagaggtctgtgtagctggaggatgctgggaaatgtgaggagaagatgtttcctccttaaaattggaatctttctgatcacctgaattctcctgctagccacaaatcccactcactcttatcttatccttgtccttctgtcatcgtttacctgcctaatccctgaaggtagtgagccgagatcgcgccattacacttcagcctgggcaacaagagcaaaaaaatccgtcaaaaaaaaaaaa

SEQ ID NO: 269096 - DNA, 446 bp, Homo sapiens
catgctgcccaggggccaacgaagaagtacccggaggcacagactgaaaaccaggaaattgggtgggactcagaagccttggtcgacccagaacgccgtgaccacaggatgaaccacttcagggtctacagtgacatcactctgtacaaagctaaaatgtggagcttgggagaagatgatcgccacaagtagcatctcagctgtggagtcaggccctggatttaatgccctaaatatccactgcctagaagactaaacattattttaaccccccgtcccccatccataattcatggataatggcaaaaattaggaagcataaaaaatatgcggaagaaggaaataaaaattgcccattatctcaccatatggaagtgactaatgttagcattttaaaccatttgtttttaaaattaataataaattgcatatatttattgtgtaca

SEQ ID NO: 269097 - DNA, 654 bp, Homo sapiens
aaagaaaccaatacacagcgcccacattgggtcagacactcatgttgctttcaaatatatggaaaaattctagttacaattgagtacctactgtgtaccaggtttttaaaaaattaacctcctttaaaatatgcaaaatataatgatcctgcctctaaagagataaaaactgagactcataaaaggtcaagtgacttgcccaagcccacacagatagtaaatctgtggatccaaaatccatatttgaaaccaaatctgacttcatagtctaagtttatcttctacactcagtaacctcttttaccataaacatttggagcagcattttagggtctcatgtcctggactggtactttagttaaaacgttataaagccgggtgtgatggctcacgcctgtaatcccagcactttgggaggccgaggtggacggatcacctgaggttgggagttcgagaccagcctgaccaacatggagaaaccccatctctactaaaaatacaaaattagctgcgcatggtgctgcatgcctataatcccagctactcgggaggctgaggcaggagaattggttgaacctgggaggtggaggttgcagtgaaccgagatcgtgccattgcactccagcctgggcaacaagagcaaaactccgtcaa

SEQ ID NO: 269098 - DNA, 412 bp, Homo sapiens
gcttgtgaatttatcagtcattagcatatagcagaaatgatggctgtgtgaccttttaggctaagtcatataaaatgatgcagcttttgcctgattaattggaacacttatacttgtagccctgagctgccatgtaagaagtccaactgagacagtcatgctgtagagaccaaatgtagaaactctggtcaacagctcagttgagctcttagctgacaagcagtatcgactataagccatttgagtgagccttcttggacatccagtaaagttttcagatgactgcagcccaagctgacatctaactacaactgcaagaaagacccaaagagaacattttccagctgagcccttcccaaattcctgactcaaaaattgtgagaaaaataaaatgattgttttaagccactaa

SEQ ID NO: 269099 - DNA, 471 bp, Homo sapiens
cattttaaaacacttgtctccaataatcttccaccaaaagctctaagtaatatgtacaatgtaagatgtgaaaagtacgtaaagaattccttttgtttagagactaggtctgagcccagtgcaacataaggtagtatgtgctgtgttaaaaataagattaaaagaaagtaaaactggccaggcgcagtggctcacgcctgtaatcccagcactttgggaggccaaggtgggtggatcacctgaggtcaggagtttgagaccagcctagccaacatgatgaaaccccgtctctactaaaaatacaaaaaaaaattagccgtgcgtggtggcgggcacctgtaatctcagctaactgggagggtgaggcagaagaatcgcttgaacctgggaggcggaggttgcagtgagctgagattgcaccacttccctccagcctgggcaacagaccgagattctgtctcaaaaaaaaaa

SEQ ID NO: 269100 - DNA, 369 bp, Homo sapiens
gctatagacaagatgcaaatgaataggctctgtttcaataaaactttgtttagaaaagcagacaacagggcagatctggctcagaaactgtaatatgctgatactcactctagaggaatcatttggcaggtgacctgaatggtaaaacacaagacagtggctttcacactggcaaaggctctgctgtggaaccctacccctgtgcattcttatccatgaatattcatgaatggagcatttggttaggaaattggttttatgaaactataggcttgcttatcaattacaagaatactctcattattgggttgtttttttttttttgtcttgctcccattctggcactagaagttttaaactactattgtc

SEQ ID NO: 269101 - DNA, 470 bp, Homo sapiens
agaaaagtaacttgtatttcctaaaaggaggcatattttaggagctatatgaactgggcatttttaattttttttcattactttggggaatatttcaggatctcatcagcattcattacatgggaggacaggggattaaaaaaacaaaattgattgttaatgaatttttttttttttgtatttaggaagaagaaagactgtaacttaaaaagaattgtggcaaattatatatgttaaatattctggtctagaaatgtggtatagaggttccctagaagcttctgttccactgtggttaaaatgttttctcaccttcttgaactgtctttgtaggtgatgtcatgaaatgtcccaagagaacgttgtataaaacttcctttgacctttctggactcagggctgagctccttagacctacagtttcttgttaaaatcgagtaggttgtgtttgaaaaataaagtttatttgt

SEQ ID NO: 269102 - DNA, 448 bp, Homo sapiens
acaagcataatgagtcttaaactcagtattttacctccaaaaatactactgggaagaaatagaaatgaatttggacaaattcatgaataacatggttagaaaaagcttttcagaaggaacagccagaattcctaccgtgtaagtcgtttcctggaaaccatgctctggatcctcccattggtgttggaagatcaactacagcttcaaggcaccaagcagatcatgaaataatcaggagccagaggggtaaattatgtaccctgagattctgatttactaaaaacaaagtatcaaatttttgactaattctaatttctaaggaaaactatctcaacaactataatttcccagttacttgaatcttcaacttgctactatgattagatgtctggttcagacatccttggtaataaatgaaattctttatgtttcaaaaaaaaaagcatta

SEQ ID NO: 269103 - DNA, 505 bp, Homo sapiens
tctgaggggtaggatgggcttcgtcttctaactaaaacaaccagatcgtcgaggtctcactctgtcacctaggctggagtgcagtggtgcaaccctagctcactgcagccttgaattcctggattcaagcaattctcccatctaagcctcccaaagtgctgggattttatagggaacagccagaattcctaccgtgtaagtcgtttcctggaaaccatgctctggatcctcccattggtgttggaagatcaactacagcttcaaggcaccaagcagatcatgaaataatcaggagccagaggggtaaattatgtaccctgagattctgatttactaaaaacaaagtatcaaatttttgactaattctaatttctaaggaaaactatctcaacaactataatttcccagttacttgaatcttcaacttgctactatgattagatgtctggttcagacatccttggtaataaatgaaattctttatgtttcaaaaaaaaaagcatta

SEQ ID NO: 269104 - DNA, 492 bp, Homo sapiens
aactcttaccggttcacagaactgtcatgggcccttctaaaattagaagatacatatcccatgtaaatactaaaataataaattaggaaccctaatactggtattaaaataaataatactaatcattaataactgaaaaatgcccatgacctcatctggctccaggtgggtaaggtctagttgaaaagccgagagaagttctagtttatggacaatatgaatgctctgtattttaataaactctgcaattatcctacattatttattcagcttacattgaatcaaatggctaaagaaaactgattaatatttagggtaaatggccgtaagaaatgaactctacaataatttataaaagaccatcaacatcttggttaaaaaaaaaaaagcccaaacattttcaaaacttttcaaaaaacattttcaaaaaatttttaaaaaccatgtaaaacaccacacaatggcctactagttaccttgtacaaaaaaaaa

SEQ ID NO: 269105 - DNA, 481 bp, Homo sapiens
taccaactttatattgctctcttcgaggtctgtgccaccacgtaagaagtataactatgctgcttctagtgaagttgagcctcacccagatgtctcagctaccataattaaggcactagacatgtgggtgagccatttggattttccatcctcatgcccagctgaactcccagggcaatggagctgcataaattggaccatttggaatagaaggacatcccagatgattccagtcagcccagaatcataagaatcctgagaaataatatgtcatgattgtcttaagcaactaaatgaaaacatagttggatacaaagcagtatataactacaaaagccttttagttcaagagctagtttaactttacagtaaatattcagtagaaaatctctggtctgtggtttctgtctcctgactggatcttgacagatccaaacataaatgctgaaaccaataaaataatctggtctaatgttaaatg

SEQ ID NO: 269106 - DNA, 493 bp, Homo sapiens
aaaacaatcagttgccatctgaagaaaagacagtgagaatcagaatattaaagctcgaaggaactttaaggaagatcggaatggaaaggatctgtaatttaaaaaaacactggaaacacaggaagagacagagccttgagcagaagctccagtaccgtggcaaattcagggggagctgctgtgggcaggggacccctccattcctcttgtagcacccacatgtaccaagtatcctttaccaggtgttccttgcttgtaaatacgatggttgagttggacccattgttttaatagcctctctgaccttatttttttatctaagggacttagtgagtttgtgaccaaggtcacagcttattaataataactgttaagtagaacctcaatctttttcctactccattgcctgattctgtaaataggtcacacatcagccaacttctagtcctccaacctagggccaagattagaatgcttcctaggcaaagtgctg

SEQ ID NO: 269107 - DNA, 845 bp, Homo sapiens
gcttatccatgtaatgtttcattaattctttgatgctgaagtttcacctcctgcagggagcatttgcagcaccccaggcgagttgtcagcagttgctgcctggcagtagcacacattaactctagtgagcagaagtggagctcgaaggctccccacactgctgcaccttgagctgctcttcctggcccagcccgttctgcttcctgggaccccagatctggtctccaagtactgtttctcttctaagtgtagtcattaacttcccagagtgagaagaagagactaaaaaaaaagagagacagactgtctcttagttttaattaattgttgaaagaatagagaggggccatatttctactgaaagaaaggagaagttggggaatgggaatattctgaaccggaatgaaaaagtgaatgaaaggtaatctttagattcagtctctttgccctagtctttaaaagtttctgttgggggttatttgccctagtctttaaaagtttctgttgggggttacaaagtttgaaatctgtcttaaggagggatgtattactcaaaataaattgcctctatcattcagtgtgatatgatggacttggaaggggcaggattagaggaggtgagggataaaaatctacatattgtgtacagtgtatactactccagtgatagatgcactaaaatctcagccttcaccacagttcatgcatgtaaccaaaaccactgctaccccaaaagctgctgaaataaaaagcaacaacaacaaaaacaaatggactctagcttgttttcctttcagatcttctcttttaaatgtcattctggctaaaacaattttttaaaaatg

SEQ ID NO: 269108 - DNA, 476 bp, Homo sapiens
acctatagtactaagtaaaaatctttttatacagtatttgtcttgtgtgggtcatgagcattagcatccaatggtaggtgtgtgattaaaatgcagattccttggccccgtcccaaatttactaaataggcctttgtgggttatagccttgggatctacaaatttaacaagattgagaaaacctaaggcctaattatctttcagcctcatctaatccttccctcccaaagacgtgagcgccacatacattcttttgcagcctctcaacacaccattccttttcgcatctccatacctctgtaaatgtttctttccctgcctggaatgtgttcttacccttcaagagtcagctcaaattcacatctgtgaaatctaccttagtttgtacatatcaaataacagatgtgtgtttttgtgattcttcacattatgaacagcataaggtatttgccattgttagtattatcccatatgag

SEQ ID NO: 269109 - DNA, 563 bp, Homo sapiens
aggggcagaggggagcagccagcagtcttatgctaccactgtggctcatcctgcgacctgagagaaacctgggcaactgtgagcaccagaggccaagtcctggacagtctttaggccatgttggaactacatttggaaaggtggttgttaaacatttcccagcacacacctggatctgcatctgctgtgtcaattgaaccactcactggttctgtgacctcagttcttcgtagactctggaatggagctggaagctgtcatcctcagcacactaacgcaggaacagaaaaccaagcactgcatgttcccacttataagtgagagctgaacgagcagaacacatggacatatgaaggggaacaacacactctggggcctgtgaggtgcagggagagcatcaagaagaacagctaatgggtgctgggcttaatacctgggtgatgggttgatctgtgcggcaaaccaccatggcacacatttacctatgtaacaaaccttgacatcctgcacatgtaccccggaacttaaaaataaaagttgacaaaaagaaaacataacttact

SEQ ID NO: 269110 - DNA, 785 bp, Homo sapiens
aggggcagaggggagcagccagcagtcttatgctaccactgtggctcatcctgcgacctgagagaaacctgggcaactgtgagcaccagaggccaagtcctggacagtctttaggccatgttggaactacatttggaaaggtggttgttaaacatttcccagcacacacctggatctgcatctgctgtgtcaattgaaccactcactggttctgtgacctcaggcaagtcatttaaattataagccttggttttatcctccacagaatacttcctcctaaaatgtgttgtgaaaattagaatagatgaaggcacccttgaaaagatgactgatgcggttggttgccccaccacttcctactacttggcagagcctcctcgttggcagatccttctctcactagagcatgtatatggatgcatgctctctcaccctcccttgtagcttagagcagagcataccaatctatgtgccagcataccctggtatgtctcagatgggtcatagatgtgataaggtatggatcccttaagcccttgggacattcaagtgaggctgagctgctgaagccctgggatggtatgactggccacaagcaacattacccaggtacccctctgtgtcacaaaaacgttatctttgtatttgtgtcatggtgtgaaaaaattgagaagcactgcctggggacatagtgaggtagcccaattctggataaaggaaattgagaagtcttgagggggtagagaggttttcttccctaataagaagaatcacaggagagaaaa

SEQ ID NO: 269111 - DNA, 428 bp, Homo sapiens
aggggcagaggggagcagccagcagtcttatgctaccactgtggctcatcctgcgacctgagagaaacctgggcaactgtgagcaccagaggccaagtcctggacagtctttaggccatgttggaactacatttggaaaggtggttgttaaacatttcccagcacacacctggatctgcatctgctgtgtcaattgaaccactcactggttctgtgacctcagttcttcgtagactctggaatggagctggaagctgtcatcctcagcacactaacgcaggaacagaaaaccaagcactgcatgttcccacttataagtgagagctgaacgagcagaacacatttacctatgtaacaaaccttgacatcctgcacatgtaccccggaacttaaaaataaaagttgacaaaaagaaaacataacttact

SEQ ID NO: 269112 - DNA, 474 bp, Homo sapiens
aggagagagagaagtggaggtgggaataatttggttttatgtacaatcggcatgagataataaatgtaataagtcatcaatgtacccaacccactgtcatttgtgggtgacagtaaccattagattgtgtagtggttaggacccttctgggtgcaggaaacttaaaacccaatctaagctggtaaagatagaaggataagctgggtgtgatggctcatgcccgtaatcccagcactttgggaggccaaggtgggtggattgcctgagctcaggagttcgagaccagcctgtgcaacatggcgaaacctcgtctctactaaaatacaaaaaattagctgggcatgttggcacgtgcctgtagtcccagctactcagggaggctgaggcataagaattgcttgagcccaggaggtggaggttgcagtgagctgagatcccaccactgcactcagcagagtaagactctgtcttggg

SEQ ID NO: 269113 - DNA, 1288 bp, Homo sapiens
accctgctccctctgccacaatccaatttccctcatgatgccctgcccagtggccaccttctccaggagctccttccccatctttcgattcgaaatcacttacgccatccttagagtcctcaaaccagttcatccaccccctctggccctaatttcgtctgcacatctaggggtagattatctctgggatctttaagaaaagaccttctaacttgatcatatctctctctgtcttgtagatgattttttaaggtcccacttatgtccctcactcatctacaggctccatgaagtcagatatcaaacatttccattgctacattctccaggcctaatctggatcctcccagagtggctcttcagtgaacatctactgaattgaacagacatgcacagagcagatggacagcactagggacttgtcctctggccccagaggcccatgaaagagtatccaggcaggctggactatgctgggaagggggaaggcctgggccctcatcgaaagggaaggaccccaaaaggaagagaaacccatcaacatcctgttaactaaacggagagaaatgctgtttaggggaaaaaaaaaaaaacataataaataaaattcctgagagaagctgctaagtcagggagcaccacactcatccccttctgcaagagaatgagaagatggagctacagctcccgtcccacatcagcatctggtgtggccttcccgccacgggccatgggtcggacctggctccacagacaaaggggctgcttaggctgggcttgaaataggctgagtgaaaacctgcgagcccctggctgcttccctgtgcatggaaaggagctgttggtgagtatggagatctctgcccttgtcagaggaaggcttcctcatcacaaggcagggcaggtgtctgtgcccaagagctgagcagagaacaagcagccagtggaggctttcgcctgaactgtgcaatccttacctgattgggaagtgcaagtgacaattaataaattaatagcgagtcactttatgtaaatacctctctttttgtacactatatttagagaaacaaactgctttggcatttagagataaattttatgtaagagtttattgctgcttctgctgttgttactgttcatcatccagataataaaagcaaactagaaatactcaaatgccagtaccacctccaatatataaaatatatcctaggcccctttcagtcatcacattcttaacttttaggaagagcccttgtcataatctgatgcttgacaaaatgttttc

SEQ ID NO: 269114 - DNA, 1265 bp, Homo sapiens
aagccctgatggagtccaggaactcaagtcccagttctggttccttcgccattcagctgtgccatcatgggcacatcacttagcctcactggagttcagtttcctcagtagtaaaatgtggtaagcacatctcaattcagaccagccacactccagtgctcgacagccacctgtggctcacggcctgtactggacagtgcagctggaacccaatggatgattttttaaggtcccacttatgtccctcactcatctacaggctccatgaagtcagatatcaaacatttccattgctacattctccaggcctaatctggatcctcccagagtggctcttcagtgaacatctactgaattgaacagacatgcacagagcagatggacagcactagggacttgtcctctggccccagaggcccatgaaagagtatccaggcaggctggactatgctgggaagggggaaggcctgggccctcatcgaaagggaaggaccccaaaaggaagagaaacccatcaacatcctgttaactaaacggagagaaatgctgtttaggggaaaaaaaaaaaaacataataaataaaattcctgagagaagctgctaagtcagggagcaccacactcatccccttctgcaagagaatgagaagatggagctacagctcccgtcccacatcagcatctggtgtggccttcccgccacgggccatgggtcggacctggctccacagacaaaggggctgcttaggctgggcttgaaataggctgagtgaaaacctgcgagcccctggctgcttccctgtgcatggaaaggagctgttggtgagtatggagatctctgcccttgtcagaggaaggcttcctcatcacaaggcagggcaggtgtctgtgcccaagagctgagcagagaacaagcagccagtggaggctttcgcctgaactgtgcaatccttacctgattgggaagtgcaagtgacaattaataaattaatagcgagtcactttatgtaaatacctctctttttgtacactatatttagagaaacaaactgctttggcatttagagataaattttatgtaagagtttattgctgcttctgctgttgttactgttcatcatccagataataaaagcaaactagaaatactcaaatgccagtaccacctccaatatataaaatatatcctaggcccctttcagtcatcacattcttaacttttaggaagagcccttgtcataatctgatgcttgacaaaatgttttc

SEQ ID NO: 269115 - DNA, 243 bp, Homo sapiens
gcacatcacttagcctcactggagttcagtttcctcagtagtaaaatgtggtaaggtaaggggaaggactaataatttatcttcacttacaactctgagttattattctatgaaaaaaatatgttggctgggcatgttggctcatgtctctaatcccagcactttgggagtttgagacaggaggattgcttgagccaggagttcaagaccagcctgggcaacatagcgagatcctgtctctac

SEQ ID NO: 269116 - DNA, 444 bp, Homo sapiens
ctgattcaattgctgttggccaagcttgatttgggaattcttctaggtgaaagaaacacaaaccagttaaatattttcagtctccagccccaatctaacaaagtgcctttattgtgagactagatgacctctgaaatgtcagggcccacagcccaccagcaagaacctgaacaggcacagagatagaggaagccacccagattgtctacaacacaccccaaagcttcccactctctatttccttacccagctttattttacgttatggaatcttccaccaagctgaaagcatgttccatgtctgtaacggtgtgtgatgtttatttattctgcctctcacgtaggtgccatgacagggaactcatctcattcacactgtggccccaacatctaggacaatgccctgtaaatactggaacccaataaacatttattgaatcaaca

SEQ ID NO: 269117 - DNA, 628 bp, Homo sapiens
gggaagagagacccccaccgtgtgcaagatgcatctctccctagatgtgcatcatgagcatttcattaaatctcactgctgtaaagaggcaacagagctagtgatttggcaatatgggaaaaagatgcattttcaactgtgctttctataatcttgatgatgatgttacccaaagaccaacctcatttttgtgtcccgtatgagagctctgttaaagaataatttgtttatgtcacacagctacatacatgtatgatttactagtctatctatttcagcatgcaatactagctataaagcagaaaaaatcgtaagtagggggaaaaaaaaccctggcagtatatgtttattagccttagtctcagggaagtaatgtttgaattcttgatatgaaatctggacacaaaaatcaggaagagtcttgttccttaaagggcagcaatctcctctagcttactttttaaaatttaaagtgtagctaaacatacacaaaaaattaagcaccgacagcctcaaaagcgcaggtttgcaaaagttaacactgttcacccctaaacactgaaaaataatccagttgagatatgtatttttaaagatgggatgaggcaaatatcataaacatacattt

SEQ ID NO: 269118 - DNA, 555 bp, Homo sapiens
gcgcgtgcggccgtcagccacattatctgcttatactctcactccctcaaatcaggtttctactgtacaatttctcattgaaaactgcctcagcattttttaagaagacatcacttcccccttggggaagaaagaactcaatgacttgaagaaactgatgcttcaggtaccttgaaaaattcagctggttttgatgagaaacagtcaatggggctgttaggggtcctggcggatgcttaggcagtggctgtcctggattccagggaatgccccaaacccagtgatgcaggacccaggactccatctgctcattcttcataaggttggctcacaggtcatctgctgagaaggtcatcttctccgtcttcactgggctcactgaatgaggacattccaagatcccagctcatctcatttgagctttccttttcctaatcccatgcatctgtgtttgagaaaatcttcccaagtgatagatcttctattttccgatttcttccatgttgtattactttttttattaataataataaatacacatatttttggtgtgta

SEQ ID NO: 269119 - DNA, 617 bp, Homo sapiens
gcgcgtgcggccgtcagccacattatctgcttatactctcactccctcaaatcaggtttctactgtacaatttctcattgaaaactgcctcagcattttttaagaagacatcacttcccccttggggaagaaagaactcaatgacttgaagaaactgatgcttcaggtaccttgaaaaattcagctggttttgatgagaaacagtcaatggggctgttaggggtcctggcggatgcttaggcagtggctgtcctggattccagggaatgccccaaacccagtgatgcaggacccaggactccatctgctcattcttcataaggttggctcacaggtcatctgctgagaaggtcatcttctccgtcttcactgggctcactgaatgaggacattccaagatcccagctcatctcatttgagctttccttttcctaatcccatgcatctgtgtttgagaaaatcttcccaagtgatagatcttctattttccgatttcttccatgttgtattactttttttattaataataataaatacacatatttttggtgtgtaaaaaaaacaaccatatatcaataacacgaaccgaaaaaacaaaatggcctttttggccttaa

SEQ ID NO: 269120 - DNA, 347 bp, Homo sapiens
gactccatctcataaataaataaataaataaataaataaataaatacacaaataaatataaactttttaaaacttaaaaagtactattttaaccttttaaaaatgtacagctcaggccaggtgcagtggctcatacctgtaatcccagcactttgggaggctgaggcggatgcatcacttgaaatcaggagttcaaaaccagcctggccaacattgtaaaaccctgtctctatcaaaaatacaaaaattagacaggtgtggtggtgggcgcccataatcccagctactcgggaggcggaggcacaaaaattgcttgaacccgggaggcggaggttgcagtgagccaa

SEQ ID NO: 269121 - DNA, 174 bp, Homo sapiens
gaaatgtgggggctgtttcccccatggtgttctcatgatagtgagtgagttctcacgagatctgatggttttatgaggggctcttccccctttgctctgcacttctccttcctgctgccttgtgaaggaggtgccttgcttcccctttgccttccgctgtgattgtaaatttcc

SEQ ID NO: 269122 - DNA, 304 bp, Homo sapiens
atgtctgcctctaacctgtggaatattccaccttcttcttttcatctgccccaaacagaagtaactgaccaacccactttagaagactcctccctagggtctccttgcctccaaaccggatctcttttaatctgcccttcacattgattcctgggtaacttctcctaaaacacagatgcctgctcctgtgccttccaccacaaatgtaagcctccagaggctccccagagcaaatgccagtgttatgcttccagtacctcctgcagaaccataacccaattaaacttcttttcttaataaatta

SEQ ID NO: 269123 - DNA, 555 bp, Homo sapiens
atgtctgcctctaacctgtggaatattccaccttcttcttttcatctgccccaaacagaagtaactgaccaacccactttagaagactcctccctagggtctccttgcctccaaaccggatctcttttaatctgcccttcacattgattcctgggtaacttctcctaaaacacaggtcagataatatcttttacttcctcattttttcttcaatagctttctaatgaaaaaaaaaaaaaaattccccagtgttggaggtgggacctggtgggaggtaattggatcatcggagtgggtttctcatgaatggttttgcaccatcctcttggtgttgttctcataatactgagttcttgctagatctgattgtttaaaagtgtgtggcacctctctctctcttccttgctgctgctctcaacatgtgagatgcctgctcctgtgccttccaccacaaatgtaagcctccagaggctccccagagcaaatgccagtgttatgcttccagtacctcctgcagaaccataacccaattaaacttcttttcttaataaatta

SEQ ID NO: 269124 - DNA, 409 bp, Homo sapiens
tcaccgtgttaggccaggatggtcttgatctcctgacctcgtgatccacctgcctcggcctcccaaagtgccgggattacaggtgtgagccaccgtgccgggccctcacctgtatctttgtaatagcgacttcctagtttccctgtcccaagttagttcctctctcctccactcaccttccatgttgccatcaggaatagcacagatcagattatgtctctcctttcttctaaaacttttagtattgttccatggcttgcagaataaagttcagactcttctgtttagcattcaaagcatttgagaggtgggagaatcacttgaacctgggaggcggaggttgcaatgagccaagattgcaccactgcactccagcttgggagacagagcaagaccctgtctcaaaaaa

SEQ ID NO: 269125 - DNA, 182 bp, Homo sapiens
gttcttctctcaggtcccgctccgggccctcctcccagaagcctcccctgactagtccagctcaccgtgactcttctgaactcacggcgtttactgccaaggctattacattggcgctcgctcatgtcattattaggaaatatgcatttttactgtctttgatgttatttaaacttgcctgt

SEQ ID NO: 269126 - DNA, 459 bp, Homo sapiens
tagaactaatgtatattttggtagtcctgttacctttgatgtacctgaattcctaagaatttgtgtgtgttatatttaatttttgtaagaatacacaagcatgtcttcctgagatagtactagcttttaagcttcttatcaagtagtactagttcatcctggaaaaataagagcccagacaatttaaaatttcttagcaggttttaaaatctatattctgtatataatatcccattccaattttaaaatactttaagtgtcaggaatttatatctacttcatgttttttcctcctgcttctggtaaaatgcaaatcttccttttctgtttttagaaatgaaattagtcatagtctcttatataataaccgaggtggtaaagtcagcaagttaaaaatacttcttactttgattttgtaccaagtcgagaaacagaaccaatcgtatttattattttaaa

SEQ ID NO: 269127 - DNA, 233 bp, Homo sapiens
acctgattacctaaattctgcaacacataccacaataataaacttacaaaccagtttgtttcccttgctgtaaattcagttcaagccagatgcagtggctcgtgcctgtaatcccaacattttgggaaatgaagttgggaaaatcacttgaagccaaaaggcggaggttgtggtgagccgagatcgtgccattgcactccagcctgggcaacaagagtgaaactccgtctcca

SEQ ID NO: 269128 - DNA, 280 bp, Homo sapiens
tgggggaccagaaggcagcttgtcttggaactgcctcattcacagaagaccccattgagtacagaaactgcacatcaaagggaggagtaaggaaaacaagatggtgaatcctcaaaaattaaacaaaattacctttttaattttttttttttgtagaaacggggtctcactttgtcacccagactggtcttgaagtcctaggctcaagcaattctcccatctcagcctcccaaagtgctggatttacaggtgtgagccactcacctcagccagaattacc

SEQ ID NO: 269129 - DNA, 125 bp, Homo sapiens
caccgtattaccatcacttgggactgacagcttactagtgcttacttatctataatgacatttaacatttcagtcctcacaaccactctgtgactttggccacgattatacctcctatttttatg

SEQ ID NO: 269130 - DNA, 833 bp, Homo sapiens
agagatttccacctctaccatacccaaataactggtattggctgtacctttctaatgtgagcaactttaaaattgaacagaatatatgaaacctctcttttcagacattgaacagcatgtagcacagcaccgtgattcctgaaagtagggaacaaatggggcaaaccctatcactctaactttctgctgaaaaatgctgtctaaattgcagcacaatgagggggaacccaagcagagcatagtggtcttgctgagttgaggagatagttgagcagacttttcaaggcagagtatcagaaaggagagaatataacagcaaaacaggctcctggaatccctgtgaatctgttgctgaatactaagctgcacatgcataaggtgaaacttcacagtgcgatgcaaagaactactgcggagctgtgagctgattggttcccagggctcactgggcaatgtttgagtttcaactcgccaatgtgaagaaaccttgctgactgtccagggaattcagtagaaatcccaaaagggtaaggcattaggagaagggctaactaagccgaaaagtgaggtaactctagacttcctccaacaaggtttagaaagcagcctcaaaaagaggaagttcatccgctactaccgtaactgccagccaaaacaaattttaccatttttaaaacaacaaaatacagacatttaacaacattaaattcagaatgttaaaaatactagatatgcaaataagtaggcaaatagaacccaaaatcaggagaaaaatcatttaatagaaacaaaccccaaaatgacagagataataacgttagcagacaaggact

SEQ ID NO: 269131 - DNA, 410 bp, Homo sapiens
gatgaattcagcctcttttaacaaaacttctgagatcaactctacttttagtgtttgtaaaaatagacgatttctatttggattattcagaataaacttgcttcattcaatttaaaggatttcagcattcagcctgctaaaaccatagggtggtaacctaatgatttcagtcagcatgatcaaactgggttcaattgctgtatcttctctataagttaccttagccatatgtttgtcagagatcaattaactggacactaacagtagcttcttggtagagttttcacatttgtcctaagtttacatttaaaatggtagtttattgtaagatatttttatttagaggaatgatcatttagccctgtgtgtgtgtgtgtgtgtgtgtgtgtgcatgtgtgtgtgagagagag

SEQ ID NO: 269132 - DNA, 503 bp, Homo sapiens
agagagagagagagttaagtctcagctgtctcccgggctggagtgcagtggcaaggtcacagctcactgcagccttgaactcttgggctcagacgatcctcccacctcagcctcctgagtagctgggactgaggtgcatccaccacgcccgctattgtagagacgtacctgttgcccggctgatctcgaactcctgggctcagcattcgcctgcttcagccttccaaaatactgggattacggtgtaatgggtttttttttaaggctttaaaatttccagaacattttttctcatttcctcctgatcattacaaaaatctttactgaaaggtagggcattgtaagagagttaacttcattttgcagatacactcagaggggttaaaaatttgcaggtacatatgcacatgactattaagtgataaaacaagtctcaaagctgtttttaccctttctttctttttttttgagacagcctgggtgacagaatgagaccccgttgc

SEQ ID NO: 269133 - DNA, 342 bp, Homo sapiens
ttgtgtctccaactcttggtaccgggcgtgggaggttactcaaaagttagttgagcctctggctgtagcctggatcgtaggttgttgtattttttaccacatgaagactgaagaacgaagctggtgagtaggaagtgtaacttaacatttgcacgagatacactacacagatgctcttcttagggcctctacatctcacacttaccaaaccaactggtgggccccagactcttaaaacctctaaaacacaacacactcacagctggcagatgactttccaggacgccctggcacttgtgatgcggtctgttgggctgtttaccaagtcatttaggtttgttt

SEQ ID NO: 269134 - DNA, 586 bp, Homo sapiens
catagagtatacttacacaaacctagatgatatacctcgatatggtttagctctgtgtccccacctaaatctcaccttgaattgtagttcccatatccccatgtgtcatgggatggacccggtggaaggtaatttaatcatgggagcagttaccctcatgctattctcgtgatattgagtgagttctcacgagatctgatggttttataaggggctttccccctacggctcggcacttttcccttttgctgccatgtgaaggacatgtttgcctccttttccaccatgattgtaagtttcctgaggtctcccaagccctgcgaaactgtgagtcaaacctctttcttagtctcgggcagttctttatagcagcattagaatggactaatacaagtctattacacaactagactatatggtatagcctcgtgctcctaggctgcaaacttctccagctgttactatagtaaatactgcaggcagttgtaacccaaagacaagtgtttgtgtctctaaacatagaaaatggacagtaaaaatatggtataaaagattaaaaatggtacacctgtatttgacacttatg

SEQ ID NO: 269135 - DNA, 376 bp, Homo sapiens
ggtttgggaacatgggaagatgtgggatccgagtgtgccaagcagaggggcaggcagttagtccacttagaaagcagacagagtgggccgggcgcggtggctcatgcctgtaatcccaacactttgggaggccaagacgggtggatcacctgaggtcaggagttcaagaccagcctgaccaacatggcaaaacccccgtctctgctaaaaatacaaaattagccgggtttggtggcgtatgcctgtaatcccagctacttgggaggctgaggcaagaggattgcttgaacctgggaggtggaggttgcagtgagccaagatcatgccactgcactccagcctgggtgacagagcaagactccgtcaaaaaaaaaaa

SEQ ID NO: 269136 - DNA, 426 bp, Homo sapiens
aatgactctgctgtggataaccattcaaaatgttcacatattacgactatcacaagttcacaaaagtttatgcaagtcaggtaactttttaaaataagaaaatgctttaatctctgaaataatttatagatatcaactcagaaaaaatacaaaaattatatttattccattttagattgttaaccccacagaaacaatcaaattccaatcagtggtcggaaaaaggggataaaggtatttgccgtttatatttttcttctaagaagtcggggtaacaaattatatcaggtttttacattagtcaaataaattgtttcgattatttgcatctctggttaactgaccatgcacgcctggctttaaaatacatcttccctaaatatagaacaaatacattttattgtagaatatttggaaaacaaagat

SEQ ID NO: 269137 - DNA, 331 bp, Homo sapiens
gggtggtctctacggggagattgcaaactcctgctgacagccagcaaggaaacagtcctacaactacaaggaaactaattctgacaacaacttaaatgaactcagaagtggcaccttcccagagcttccagataagagtctttcccagtcaacacatcgattttaaccttgtaagacctggaacagattacccagttgaccctacccagacttctgcctcaaagaaacggagtgatgataaatgtgatgctttaaattgccaaatctgtggaataggttacacaacagtaggaaactaataaacatactatgtttattttcttaatagata

SEQ ID NO: 269138 - DNA, 332 bp, Homo sapiens
gcccatacttgatcccagctaaatcaatcttcctagcattccacccagaaaggattttgacaactttattaaatgaaactgggaagtgaagattaggctcagtggagccagattggaatccagacaacatggcttaaggaaaaagaggaaacacgaaaggtgacataaagggcaaaagaatgaaatggagcctgaagacatttacaggcaagattaacaaaaattgagcctgagttctgcaattcacagtcctaaaactattttttatttatcctgctcagtactcaaagtatacttttgatatggaataaatcttttctcaattctggaaa

SEQ ID NO: 269139 - DNA, 577 bp, Homo sapiens
caagagagttaatgaatcttcagtgattgtgttggataagtaataacattctgttctctgcttatgaacgtcaaaacaactgttataacagtgatactttggtactggtatgcttcgtaagtagtggtcccgcatcagcattgacagaaagaattcttcagcctaaagaaactaaatgagactaagcttcttttcaactgaaaatttggttcttgttcttcaaagttaacagagtaaatatatagattgatataactaaatatatgggttaggtactcttgtttgcccataaggaatattcattagttctttatatgagatctttgtttaggtttgattgttccatatgctacttgttggtgcttttgacacagtgtaacttatggatttgtctgttatttatagtcactttttttctctaattctaaaagccatggctagctgctctttgaaaatcacccaaagtttccaccatttggagacaaccaacattttgggaaatttctgccatttgtaaacatagttatatgcatgtttggatattttacaatttttaaactatacctaccatcttgta

SEQ ID NO: 269140 - DNA, 419 bp, Homo sapiens
taatcaccactctgacatttctttaaccattctcgttttttctctgcagttttaccacataggcatgtatccctaaacaatatagttcagctttgtttattttgaaacattttaaaaacagtatcacactggatgtattcttttgcaccttgcttttttcacttggcattaaaactttttttattcagtgtttaggagtgacagtaaataggcttctaaaatcaaatctaagaatgtgtattggcctgcttactaatggccagatgcccattctgaaagtcaattagtgaaaaaaattgtggacatcttatgaagcaggacttagcctatgatttgcaatgtagaagatggagagggggatacctggtagtgtcaactttagctaaaataaaattattaattttgtgcattttctgaaa

SEQ ID NO: 269141 - DNA, 355 bp, Homo sapiens
acactgctaaaggcagtgtccatacacacaacacaaatctggagcacttcagagggcaggatgaagaactagatcacccggcaagggtgagaaatgagctcccatctgtgcctcacctaaataggtcacagtgaatgactccttgtagtgacaaaatcttaatgatttatgctcagtttcaaaactggactatatttttgatgttctcttttttaaagtagggtttattgaggtataatttacatagagtaaatttaatcctttcattgcacaagtctctgggttggaaaaactcacacaatcctgtaactactagcaccatcaagatataaaagtttcattgtcccccaaattc

SEQ ID NO: 269142 - DNA, 373 bp, Homo sapiens
  misc_feature (23)..(23): n is a, c, g, or t
  misc_feature (53)..(53): n is a, c, g, or t
  misc_feature (74)..(74): n is a, c, g, or t
  misc_feature (86)..(88): n is a, c, g, or t
acggccgtcaccgcaagggacantgtggggcttgccgatctcccctgtctctntctgcgccgtaacggctgcgngaagacgacagnnntccgaaggagggaatccattgttttttatctgcacttcaatcttaagggggctagttggttaagtcctatgtaaccactaagcaatcatgaaagttatgtggtatgtactatgagtccaggcactattctaagcactgtgcaaataagtaaatgaagaatagaaatgttaagtaatttgcccaaagtcttataactagtaaatggcataggcgggatttgaactcaggcagtctggttcttaattaaattgcctttcatggggacaaaagaaaggtccaacagtc

SEQ ID NO: 269143 - DNA, 497 bp, Homo sapiens
ttctcttatccacaggttgcagactggtggcctgcatacctgttttgcttcctacagtagtttaaaaacagcattttacgtaaaatttcagatttcttagaaaaaatcagtagctgtgacaacactgggctggcatttccgcacagaaccagtcagcaggaactgagcagcagggcccttctgggtgggacaggcactcaccagtgtccccacactggcccagggactcatttattcgcactggcacctgcaggcatatgaggctgattcctgccaattcagcctaccccaaactcttgtttcgccgtgtcttttcctttctgccttgctgcgtcttaagtgtgcctctgacccaccctcatcactgcactgaggtttatcttcccccatacagctgtctcctccagttgactgcaagcccgagggcagaaacaatgcttccataaggttctcagtgaatgtacattgaataaacacacgtcttgcctttgaaaaaa

SEQ ID NO: 269144 - DNA, 408 bp, Homo sapiens
  misc_feature (408)..(408): n is a, c, g, or t
ctacgtctcaaaacaaataaataaataaaatcaaataaaatggaatgccagaccatataattcaaatgctaagcatatgccagtttaaactttttcttcttttttaacttaagaggagaatcactatgattatttttaatataaagactatatagtgatttattggattttactcattagggtttcaaaaattgcagatactttttattctgcacatttttatctccagaagcctatattcatcaaaaggatagcagctgcatactttccccatgaaatgttaacaaataaatggcattcctgtttatttatctatttttgaattttaatgattagtccttgtgctaattaacaaattctcgtattcatctttctatatatagttatcagtggatgtgttcatggctn

SEQ ID NO: 269145 - DNA, 471 bp, Homo sapiens
cacatgtttatgcaggtaaacttttaccttgctgtgtttgctaatggagagcctcaagaacactcaaaggcaaaaactgttttctaattacctctatacccagtgaatgcctgggattatactctacttcgtaaatatgtaagcgaagattcccatgaatggcaaaatccaccagtaggtgatgatacctatgttatgattgggtaaattttggggtgaaaggggtgttccttataaaatattgcagttgaagacagcagggagaggagtgcctgtattagttaacacatagtttgactatatttttagacgatttccttgattggagaggatggcacttaatattaaagatggtgtcctggctaggtgccatggctcacacctgtaatctcagtattttgggaggctgagctgggaagataattcttgagaccagcctgggtaatgtagtgagaccctgtctctaccaaa

SEQ ID NO: 269146 - DNA, 443 bp, Homo sapiens
ctgaaagtcagggacatggtttatctgagcaaaacgcttgacccatagtggatattcagtaaatactgttgaatgaatgaaaaacaatctcccagtggttctaaattgcctttgaatcatggatttctttgaaatctgatggaagccagggtgatatgattttgctctgtgtccccacccaaatctcatctcgaattgtaatccccatggggaggggcctggtgggaggtgattggatcaagggggtggtttcccctaggctgttctcctgatagtaagtgagttctcacgagatctgatggtttaaaagtgtggcacttcccctgcatcttgccgtctgcctcacttccccttctccttttgccaaaaatgtaagtttcctgaggctaccccagccatgcggaaccgtgagtcaattaaacctcttttcttcataaactaaa

SEQ ID NO: 269147 - DNA, 559 bp, Homo sapiens
tattttgaagatgagggaaggcatctaggtatagcaaatgacaccaaatacacacacattcttatttccctgtgctgctacctactcagcatagtttactaaaggtaaaattctttacataagaattcttactattcttttaccaagaagaatgaatagaggaagattccagaggaatccctgccgaaatttaaccatctctaatttataatctaatgtagtatctgttgaagaacttcaaggacctctactacactaaaaaaataaaaaaaaaaaacctctgtcatgtagatctaaacatattcagacaatattttaaagtctatcacattaaagtaaaatattttataggggtaagattaaaccaagtcattctagtgctttcacaaacatgtgcattcacacaagttaacaatccaacagacaaccctttcttcatgtgaatacactctggtttgtgtaccacagttgacatccattttgtgtagaaaaaaaaagaaatagctggtgtcaattagaatgaacagaggatctcagaaaaataatgtagtcagttagt

SEQ ID NO: 269148 - DNA, 505 bp, Homo sapiens
tattttgaagatgagggaaggcatctaggtatagcaaatgacaccaaatacacacacattcttatttccctgtgctgctacctactcagcatagtttactaaaggtaaaattctttacataagaattcttactattcttttaccaagaagaatgaatagaggaagattccagaggaatccctgccgaaatttaaccatctctaatttataatctaatgtagtatctgttgaagaacttcaaggacctctactacactaaaaaaaaagtctatcacattaaagtaaaatattttataggggtaagattaaaccaagtcattctagtgctttcacaaacatgtgcattcacacaagttaacaatccaacagacaaccctttcttcatgtgaatacactctggtttgtgtaccacagttgacatccattttgtgtagaaaaaaaaagaaatagctggtgtcaattagaatgaacagaggatctcagaaaaataatgtagtcagttagt

SEQ ID NO: 269149 - DNA, 570 bp, Homo sapiens
atgaaaattgggtgtaataacagtaaataaataaatcattagtaagtaaataaaatagcttaccagcaactattaatatactcatgatacactttttatatttctttgctacatacctagatcctatatgctgtcattatatttcagtattttgcatttatatttgcattgtgagatgaatctatggttttctttttagaatgcttttaccaattagtattgcactcatggatttgaaagtttaacattatacaataccaatttattatttccaaatgttgacattttattatagtgattttctattccaaaatgtctacaatttagctaaaaattatctagtcctgctaatttattggttgaagatcattatttgcatttcttatccttgccataaaaaatgtattctctactttgttaaatttcttgctgtagtaatcaaaaagggcaaatgttaatatctttatctgtatagtgttgagtttacggtggctagtaagttgtcagctgcatttttcatttttttaaatttcagaattaaaaaataaaacataagagttttcattacta

SEQ ID NO: 269150 - DNA, 368 bp, Homo sapiens
acaatgggaatcacatttcaacatgagacttggagaggatgaacatccaaatcatatcaaatgcataatatatctttctcaaagtgagtaaaactgaagaaagttatttgagccgattctatggtccataggtttctaaactgatgagtttcccaaataaattcagggattaactatctatatcaagaatatgaactttagagtcagacttccttgaattcaagtcttggttctaccacaaaccagttgtgtgaatattggcaattacttggtttctcttagcttcagttttcattcctataacataagcattttatacaatgctggtacatggcaggtatataataaatgtctaacacaattattca

SEQ ID NO: 269151 - DNA, 355 bp, Homo sapiens
ggtgccctgtgtcatgggcattgctgtgcgttagtaaagaaaagtgacacaggtctctcaggtctagtttgctttcttttttttaattggcaagttgagaattattttgtcaacaacttaattgagagcaaaggttgctcttgtggagggtttatggtgtgatacctaatttttggactgtttcccacacttcagcccagtcagaagaggtggtgtctgcttgtagcagttaggtttaaggagaggacagtgtggtcttgattcaggacaaattatccttatataaaactctgggtgtctgaaccctaggtcccctgacactaacctatgcttagttatttttaccttattttat

SEQ ID NO: 269152 - DNA, 617 bp, Homo sapiens
cgcggtggctcacgtctgtaatcccagcactttgggaggccgaggcaggtggatcacgaggtcaggagattgagaccatctggctaacatggtgaaaccccatctctactaaaaaatacaaaaaaaaattatccgggcgtggtggcgggcgcctgtagtcccagctactcgggaggctgaggcagaagaatggcgtgaacccaggaggcagagcttgcagtgagccgagatcgcgccactgcactccagcctgggtgacagagtgagactccgtctcaaaaaaaaaaaaaaaaaattagccaagagtggtggcttgtacctgtagtcccagctactcaggaggctgggctgaggcatgggaaaatcacttaagcccaggagttccgggctgcagagagtcatcattgcaccattgcactctatcctgggtaagcgtgtgagtgagacctgtctcttaaaaatagaacttctgggccaagcacggtggcttacgcctgtaatcccagcacttagggaggccaaggtgggcacatcacgaggtcaggagatcgagaccatcctggccaacatggtaaaacccgtctctacttaatttgaaggcttaggccaggagtcct

SEQ ID NO: 269153 - DNA, 321 bp, Homo sapiens
tcactatgtcacctaggctgatctcaaactcctgccctcaagcaatcctcccgccttggcctcccaaagtgctgagattacaggtgtgagccactgtgaccagcttggtctcttaagcttcctgtttcatgcattctatttaattgtggtcattgcttattagcattttttggagacttagctatgtatcattttctgaaagctcttacatacagacttggattattttcatagaatactgccaaaagggtgtagtgaacagcaatcatgttggcttttcaattatgtatttattttttcatgaaaactttttttaattcc

SEQ ID NO: 269154 - DNA, 513 bp, Homo sapiens
gtctggcattttccttcatttcctgggaggtaatctctaagcacatggaatatgcttagataggagtgccttataagaatgcctttgtttaccttcaagacttggggaatcctaaatactctatgctaaccatgtgacttacagtgcaggctttggactatctggtaatatcttgacctctggaggggatggggacaaaggctggtcatgcgggaagtctaccaaaatttgtgactgatcatcaatagaagctctggacaccaaggcctggatgatcttcattagttggtagtattccatgggtgtcatcacacatcaatgagaaaagaaaaatcattgttttgcataacttcactgggagaaactagaagttgtcctccaccgagaagaccaccagaagctcatgctcgaaaacctcttgggtcccaccctgtgcactctctccttgaatgattttaattggtatcctttcactataataaactgtcaccatgagtctgacaggtttggaga

SEQ ID NO: 269155 - DNA, 670 bp, Homo sapiens
ttaaacccaaaaggaagtgacttccggactcctaggggaatgtctccatttgctcttgttgaaggaagaagggcgagaatttccaggtctgtggagaccccacatcccaggtacagaattgccggggacctggaggcacagcctcaatacaacacagagcaaaactcaccgccgcagtgtgacttccagtccacgcgatccgcttcctggtccgggcgaatctacaagcacaggacagaagccaggcctccgtggagccaacgagtacctgttttaagaaaaaaaacaacaaggaagtaaaaccgaagacaggcagccctgcgccacgcccaaaaccaggcctgggcctgcctggcctaaacccaatagttaaaaatcaactcataacttagaaaccaatgtttttcatagattccagacattgtatagaagaacattatgaaactccctgccctgttctgtttctctctaccagtgcacgaaacccctgtgtatatatctgggactgtagtccctgttacgtatcccctagattgctcaatcacgactcttttatgtgaaatctttagtgttgtgagcccttaaaagggacagaaattgtgcacccggggagctcggattttaaggcagcttgccgctgctcccagctgaataaagcccttccttctac

SEQ ID NO: 269156 - DNA, 354 bp, Homo sapiens
tctcttcattactacattctctagcctaacattccgtccctgctgaattaactaatattcagatacattcaagatagaactaacactcaattctatctttccaaaatttaaggggatgataggtcttcactcacatggtaacaaacacagcagcaaaccccataaaactgaacatcaactgccttctggaagttctcatctggcaagctagtgcaggtatcttgtgcatgggtcaagagagtgaagctcagagcacattgcttggcacccagcaggtgttcaggacatgttttagctcagccctcctagaaaactatgaaataaaatccaaacaaaagtattaagattgaagta

SEQ ID NO: 269157 - DNA, 418 bp, Homo sapiens
tttaaggtttcaattcattgtagttgctggagtaatgtttttgaataccactagaaagaggaccaaaaatacagatgatgtgttcttgtacacaaaatctttgagtgaggaagaatgtgctttaacttctatgatgtattttaatagaaagctagaaatatgccacttcctgaagggctacagttttgaagtttgctttttttatgagaagatatttgacaaatcacactaagccatttccttgagaaacaggacaaaacacctgatcaagctatgtcttaatattaggccttgggcagtgggcaaataattggtatttgtatttaaatcagaatgggaacaactatttttcttatattaaacctaacatatatatatatatttgtttttttattttaaagcatccagactttaccaa

SEQ ID NO: 269158 - DNA, 373 bp, Homo sapiens
cagtagtcaattttgagaaagaatgtaaagttgaagaggcattgcctggaaataaataagtaagactaggccgggcgcagtggctcacacctataatcccaacactttgggaggccgagacgggtggatcaggaggttggtcaggagatcgagaccatcctggctaacacagtgaaaccctgtctctactaaaaatacaaacaacaacaacaacaacaacaaaaaacccgggtgtggtggcacacgtctatagtcccagctgctcagaaggctgaggcaggagaattgcttgaacctgtgaggcagaggttgcagtgagctgagatcatgccacagcacttcagcctgagcgacagagcgagactccacctca

SEQ ID NO: 269159 - DNA, 387 bp, Homo sapiens
caaacctagcagaagaaaagaaataacaaagatgagagcagaactaaatgaaactgaaacaaaagagacaataaaaaagataaatgaaacgaaaagctggctctttgaaaagataaaccaaattgatagaatgtgagattaaccaagaaaagatgagagaagatccaaataagctcaattagaaatgaaatgggagatattacaactgataccacagaaacagaaaagatcattcagggctaccatgaacacctttatgcacacaaactggaaaacctagaggagatggataaattcctggaaatatacaaccctcctagattaaaccaggaagaaataggaactctgaacagaccagtaacaagcagtgagattgaaatggtaatt

SEQ ID NO: 269160 - DNA, 1170 bp, Homo sapiens
acgatacatgtgcagcaggtctcattttggactggccccgtttcaagggctcaccaactgaatgcagcttccagactggagagtgcatgtctggagcaagtggggacaaggacagatggagcttcaggaaggcctctctgaagaggtagatagtgagctttgacatggaggccagggaggcactcagcacacagccacatgaggaatgctgcctggagcggccactgcaaaggccctgtggcagggacaggcaaggcacattggacggtcaggtagggccagggtggctggaggggagtgagggcagggacagaggtaggaggtggtgtctgagagtggacagggcgggccacccagggcctcgtggtgcacagtgagcagtttggaactgattctgggagtgacagaggcattggaggcttttaaagaggggaatcactaggtcagctgctggctggggaatgggccccgggctgggaggggtggaagcctgggcccagcggggaggccccagtgcgtgaggaagtcgatggcttgaacaggatggggcagctgctatcaggagggaacggaagtggggaagagctccagccctgggcttcagacctccagaagcagcaggaagaggggtgataacagtgtccctccttgcttcggggtcatttatttattcattcatgcattcactgcaaggccctttgcacaggtcaggggatgcagatgaccagaacataagatctgcagcaaagatgggcaaggcaggcctttaggcaagttactacagtcacacgaaggacaggagagctgtgatcacagagctcaaggggcagtggagatgggcgagtggctgccatggcaggggaagggatgctgcccactggcaggtcatcaggaaaggctgtttttggatgcatggaccagaaagccactctctgaggtggcccccacctgcatcatcctagggccacaggccgaggccttctgaggggccttggggctgccccgctgctctgctggtcttggctcctctgcagcacctgcttcctttagcactggtgaatgattcttcctcttcccctgtctcagggaaggcttgcctgcttccatgcttgcatgctgggtgacaataaagcattcctggttcttcaccttggctttcagacctgaaac

SEQ ID NO: 269161 - DNA, 375 bp, Homo sapiens
cagagcaagactctgtctcaaaaaaaacaaaaacaaaaacaaaaacaaaaaaacactttcctgatactttcagaatagttttttttccattcatttgtgtttttaagttactttttaaaaagtagaccgagcacggtggcaaacacctgaggtcaggagtttgagaccagcctggccaacgtggtgaagcccatctctactaaaaatacaaaaaattagccaggcgtggtggcgggcacctgtaatcccagctactcaggaggctgaggcaggagaatcacttgttgaacccgggggggtggaggttgcagtgagctgagatcacaccattgcactccagcctgggccaaaagagcaaaactgtgtctccaaaaa

SEQ ID NO: 269162 - DNA, 254 bp, Homo sapiens
acctcaatactgttggcaaccttcctacgagcctcatgcaattactgctaccactttgcagatgagaaaaagaaaactgatgctaagcaaagtttagtaacttgcccaatatcacaagaagtagtgagtgacagaggaagacttagctcacatctgagtgtctccaaatcccaaatcccaaagcctcatgctctacctttttactggaagttaaaataaatattatgacagatacctttttaaaaccttaaaga

SEQ ID NO: 269163 - DNA, 406 bp, Homo sapiens
ggccacggagccgcgcagatccggttcccgggtgaccactctgtcgccattgggcgagaccgacctagtcctgacgacaacggacaaaggccttcaggggcctggaaggtgatcaaaatggaacacaattgctaccagaagagaactgctcccctgcagtggagcagtgaagaggccttttacatctaagaccaaaggagagtctgtggcagtctgaggaagtgctggcctgtggtaggatccacagcaccacttctaaaagccctgtcaggtggctgcccttggactgccatgagaaagcgatggaggatggagagagcactatgttctggggctctgggtcttgtcattttaaaaaatgtgtggtttctgcattcaactgcttgttcctgaaagctgtgttctc

SEQ ID NO: 269164 - DNA, 348 bp, Homo sapiens
gtaccagacagagtaaaaatgaccagtgtctagtcctggctttcacctcacaaaaggaaaaatagatccaatgtcaggccggttcaagacaaaattagcaactgatgaagctgaaaaactgtggagagtcttcaagcatcaaaaagttgggctagatgaccatgaaggcctgttattaccactgtatgctatgattttacctccttatctccagcaggggccaggctgtcctgcattccccgcttctctgtctataagttctccattcccccctctccattctctacaagaaaaataaagacacaatatatcagctatgcgggccttcacagagcctttatactcgtt

SEQ ID NO: 269165 - DNA, 180 bp, Homo sapiens
agcttttaaaaatataataatctacctccttacctgacacgtcggaagggctgattttccaggtcacacatgtcttattactttcgaaaataatcatgtggaaaggcttttcattgtgtttgctgttacatttctgcacagtggtgactgcgaagccaaaatcaaactaatagcagggga

SEQ ID NO: 269166 - DNA, 412 bp, Homo sapiens
tctcacagctccgacacttattgcgagccatacacaagctggtgtcaggacacgtactcccaaagtcccaccaatcccgtactagctgtggcttccaaaaacaagcacttgagggctttctctggcattctgggctggtgatagacacaaggattgcagggcttgatattcccaagaaatagctctctgtcaatgacagggtttggaactcgcgtggagccgtaataaacacctggcaggatatctccaaggctgggaaatcattccccacttaaggaggtttgaatagagacaataggcactcgcaggcaataaaatgacaacaaaagcaagaaagcctgtctgctgaataactgaagaagcctaagactgagatatgattgagttaagaaaaaaaatgtgtatatatatt

SEQ ID NO: 269167 - DNA, 603 bp, Homo sapiens
tctcacagctccgacacttattgcgagccatacacaagctggtgtcaggacacgtactcccaaagtcccaccaatcccgtactagctgtggcttccaaaaacaagcacttgagggctttctctggcattctgggctggtgatagacacaaggattgcagggcttgatattcccaagaaatagctctctgtcaatgacagccttaggcacaactggactttcaatcacacatattttcccagagaggtgcatgacaaaggtgcccagcacatcctcaactggaaatagagttggcctgttgcccaggctggagtgcaatggcgcgatctcagctcactgcaacctcctcctctcggatgaagagactaaaatttatagagatggaaagactgaatgcactatatcatagttataacagcatggatctacataacacatgagcaaagacaaattcgcattccttttttgaagcaactttaatgacaacatttgtgaataattgtaaaattccaagtgcagtccttggtacatgttaggtgctcaatacattttagttctctaattctttatcaaataaacttagtagtaaaacaaataatggcta

SEQ ID NO: 269168 - DNA, 531 bp, Homo sapiens
tctcacagctccgacacttattgcgagccatacacaagctggtgtcaggacacgtactcccaaagtcccaccaatcccgtactagctgtggcttccaaaaacaagcacttgagggctttctctggcattctgggctggtgatagacacaaggattgcagggcttgatattcccaagaaatagctctctgtcaatgacagccttaggcacaactggactttcaatcacacatattttcccagagaggtgcatgacaaaggtgcccagcacatcctcaactggaaatgaagagactaaaatttatagagatggaaagactgaatgcactatatcatagttataacagcatggatctacataacacatgagcaaagacaaattcgcattccttttttgaagcaactttaatgacaacatttgtgaataattgtaaaattccaagtgcagtccttggtacatgttaggtgctcaatacattttagttctctaattctttatcaaataaacttagtagtaaaacaaataatggcta

SEQ ID NO: 269169 - DNA, 563 bp, Homo sapiens
tctcacagctccgacacttattgcgagccatacacaagctggtgtcaggacacgtactcccaaagtaagcccaagatgcaaagtttggttcagtgggggttagacagctatgactatctccaaaatgcacctcctggattttttccgagacttggtgttattggttttgctggccttattggactccttttgactagaggttcaaaaatgaagaagctagtgtatctgcctggtttcatgagattagctgcctccctgtattatccacaacaaaccatcgtgtttgcccaggtcagtggggagagattatatgactggagtttaagatttgtggaaggagaactttcaaaagccaggaaatgtgaagaattcacctggaactaagtagaaaactccatgatctgcccatcttaacttatttaagttacctatattaagttacctacaacttaatcagttataggtacacattggaaactccacagagtaaatcagtatttctacagaaaaatgtcagagaagtcagtattgaatgtattaaattggctttcttcttcaggaaa

SEQ ID NO: 269170 - DNA, 537 bp, Homo sapiens
atttacaaattgaactgtcataattttctttaaaatatatctatatctatatctatatctatatctatatctatatatatctaccccaaagtcttgaaaaagggaagtgaagtaaaatttaaaaacaagagggtagaggggaactaacatataggaaaagtaagattgcaaaacataaggtgaaggtaacataatgtttccttacaatctacttttaatgaagttgatgttaagcatggtagcaagcaatataaagcggaagaaaagatgaaagatttactgggccagtatggtggttcatgcctctaatcccagcactttgggaggccaaagtgggaggattgcttgagttcaggagttcgagatcagtctgggcaacatggtgaaaccctgtctctagaaaacctacaaaaattagctgggtgtggtgatgcacacctggtgggaggatcacctgagcccaggaggttgaggctgcagtgagctgagatcatgccactgcactccagcctgggtgacagtggaagaccctttctc

SEQ ID NO: 269171 - DNA, 746 bp, Homo sapiens
atctttgattttctttgttagttagctataggaaggttaagaatttatttactaaggtcgtaagaacagaagaaagtttctttgaaagagaaactgtttttttatttcaaagagcttcatgtatacttccctctcttattccatgtaattagtaagggaaaataaactatgtcttagaatgttgaggaaagtattttgatagcttttaataattcttgaaatactctttactctgtctgtagttttgagaaattacagaaattcatagtataaggatgagaaggggcccatttgcccatatttgataacacagacttggattgagtgtctgtcatgcctgctggcagttaagtctcagtggtattgactgctaggcattttctatattttttgcaagttagctggtaaaacttggtaaagttttgtgtttttcagaaggaaccctattattatttccattttaaacatatttcaatattgtctcattgtaatagttccatttatgtgacatctgaggaattaaatcatacttccagatggtttggtctaatgtatacagtttaggaaagtttattcttttttattttattttatttttttaaatttcttttagaaactgggttttgctctgttgcccaggctgatcttaaactcctggcctcagatgtggagacccagctgggactacaggcatgagccaccacgctcagtagaaagtttgttctttttcagttctgtcattgaaa

SEQ ID NO: 269172 - DNA, 533 bp, Homo sapiens
gagcaactcagtccaggctgcacaaattgagtagcactgctctgcagctcgctgcactaaaagtggaagatattttccattacagcaagtgctcccacagaaggatcacgagccacacacggagccttactctccaaataggcgcccatggcccagtcgtcccttagcctaagaactcagagagccaggctgtaataatggggctgccgtgtgagcacagcagccatcgagctgctccggttcatttcccagaggttgagctgcagtgtgtccagtatttaaaagtatggaacttgtttcagggctgacccattcttgcccaattcatcttccccgtgtgaagttatttagcaaacagccaagttcagctggaaatcgtttttcatcccctccaacttctagtcacatgggcagctggccagctacatgttaacaagcgcctcagaactcctaagacaccaccggcctctgttcccttcagtgcattcttgtaaataaataaataataaaacctgcctttaccaccccccaaa

SEQ ID NO: 269173 - DNA, 415 bp, Homo sapiens
cagagagtaaatattttaggttttgtgagccagtttctgtcttaactactaaactatgccactgttgtgtgaaagtggtcagagacaattggtagatgaatgaccatggctatgtcatgaaacattattaaaccacttaaaaatgtaaaaaccattcttagcacatggccctataaagacaggtggcagacagatttcactcatagttagctgactcagcagagttcaaaaccagaggccttggagacaaaagaaggaagattatttgtcaagaacttcattctttccctaacctcccacctccaccccactttcgtaaaaaatgctatttagaggacaaaatgaaatgatcaggaggaaagtctctatccactctccttattttccagtttctttccctgctttttctcatctc

SEQ ID NO: 269174 - DNA, 397 bp, Homo sapiens
tagttttttatatcacagaccatgctgaaccaagagacacagcaaatgttcctgggagacacagcccttgtcacaagaagaagagaatgtaaagccaagcataggctggaggatgaaacttgggtggctctgcagctggctgaacaactacattcgaagacctgtggtcaaccgacagaaaggtttgaaacagcgtgccacgtggttctgccttctcataaaacatgttaagacttggacaaagacacagaaggcttagttatcaaatgtgcaagctgtatgaggttggaaagccttattaacatcgtagatgacagaatcaagatttaaaacaaggctatgaaaccaaccagataacatttaatagggtggatgtaaagttttacatgaggttatt

SEQ ID NO: 269175 - DNA, 548 bp, Homo sapiens
cagaaactgaggcttgaaactttcagcaatttgtctacacttattagcagagcttctattcaacaaagagcccccggtggccccaggccgagtctctgggtcttgtctccttgagcctcctgaaggtgtcttaaggcagaaaaacaagtcaggccagcttgtcacccagagattgtcacccagagacgccattgcccagaatacattttgagctgtgactttagatcaatagttaattcaccatttactgtgagtgccagcccagtaccctaacctggggagggggccagaaggtcagcccagacccccttgtccccatcacaggcccaatgcagccccctagctgtgcacaggatcccgcagcccctggagttagtgctggaggattccgcaggcagcctgtggcctgaacgcagcttttcagctgtgcccatcaatactgccctctcgtggtcgcatgtccccagacgatggctgcagctacttagaatctttttttgctttctctgattctaaaggtaatgtttactcatcaaaaatttggagga

SEQ ID NO: 269176 - DNA, 418 bp, Homo sapiens
aaagtgctgtgattacatgtgtgagtcaccgcaccgggccaaaacttgctttcaatatattcgtattagttaatacgcctaaatggcattctttgttatggttacaatcctgtcattcgttagttctaacagatcctgctttttcctgcctcctacccccactttttttttcctgttttttttcctctgcttctggtccctgctcaggcatcctgtgcagtggtaattggctgcagcacagaccagtgccctgtttctggccttaaattagaggaaatgcatcccacgtttactgttgattatgatgttttatgagatgttcttgtttaatatcatgttttttttgtttgtttgttttccaatttcattcttggcctgagtattaattatctagtaatttcttaaggtatgtcctgct

SEQ ID NO: 269177 - DNA, 340 bp, Homo sapiens
aagtaaatgctgtatttacaaagaagatttaacagagtgatacatgtatgtttagaaaaaaataatttgacaagttttttttaaacaaaaggctatttgcaatcagattacataataattagaattatttagtgtataatttaccatctgtatcccaatctataatatttataagttgtacaagtttaacatttgttaatcatgcctatgtgtgattcactcctgcatgttactaaaaaagaaagatctccaatttatgttttattaattttaaaatactgcaaggaagccacagtgcaaaatttgaaaattctttatgtttggatagtccatctccttc

SEQ ID NO: 269178 - DNA, 309 bp, Homo sapiens
ggtttaaacaggccatttcattttcctagggctcaatttcctcatccataaaacaagaagttctcttgccagccataatatttctaagaattactttcacgccctagtcactgctgtgtaatcttcatgttaagagaaaagtaatatgcatggagaaatctaaaatagagtaaataaaaaattaaagcaagctatgccaggtgtggtagctcacacctgtatcccagctgaggacgcttatgtgtaaggattgatgagcccaggagttctagtccagttggacaacgttgcaagatcctgtctcaaaaa

SEQ ID NO: 269179 - DNA, 360 bp, Homo sapiens
caggggaaggtgtgcctggcctggcagatagtgcacttatgtagttggagtcaagaatgcagacttgagtcagaaaacctgtaatctctgtctcctactggctttgcagtgttgagtgtaaccacccctttgagtctgggtgtccttgtctgccagaggatggttggactagataccctctcatggcaatcgtttttgattctgcagtttagtgtagtacagtgtcaagacttctgtcactggccaggcatagtgactcatgtctgtaatcccagcacttttgggaggctgaggtgggaggatcagttgagcccaggagttcaaggccagcctgggcaacatgtgaggccttgtctctac

SEQ ID NO: 269180 - DNA, 275 bp, Homo sapiens
cttttaaaataaaatctcatttggaagtactgaagctggctgaaaagaagaaatttagaaaacgcgttggagaatcggacctgacattttccgccttggcactcactcatcatcttgacaactctgactctctgtacccagtgttcttcatacccccccttccctgtccctctcaacaggacctcagataaaaattgggagtctccatgacttcctaagggttagaaaaatggtagtctgtctttctgcctataaaaaagatcgatggaaacact

SEQ ID NO: 269181 - DNA, 358 bp, Homo sapiens
tgaccccaggccagaaaagaaaacaggactcctcctatgtcccactaaaaacaggataaggaggctgagaggagcacctgaaagatgccatttcacatctaatcacttcttgtcacgttgcaaccattttcctcatatggagcctcacgctgatagatcagaaataacattttgaaagttatgtctgcaaggaaatggctattaatgttcttcctctccttttagagcatcaaggaatacatattaattttctctctacttacattgcctatttgcaaattgtattcactactcagtgctccaatttgtcccacccctgaagagattatgatgaataaatgtgttcctggaaataaaa

SEQ ID NO: 269182 - DNA, 332 bp, Homo sapiens
gagccctaaatgtttttttgtttgacattcatgcttaacagaaaatgatgaatccattagcaactccttccgttgccaaaagaaacagacttgcacttgtagattgctttcattctgcgctatcaagccactgcatgtgctgctttcacaaagctgacagtcatctatcatttttaaatgggtttagaggtggaagagatgtacccaggacctctgtagaagcaggtacaagctaccaaaagttcctactttatttattttgagtttggaatgagcaactacaaggaaaggaagaaaattgtcaaataaaagaaaattttataaattaaaaa

SEQ ID NO: 269183 - DNA, 484 bp, Homo sapiens
aatacacttagttcagttcctgtttctttagtaggagctggtggtatttttaatggtggtgatgtcattaaattataatatcatggggccaaatccaatacagaaaaccagaaagcaccaaatgaagtttttagtgcttaaagcaacaaaattatgtatagattatttaatacaatgaatgagtcacaaataaaatgccattaggggccaggcacggtggctcacgcctgtaatcccagcacttttggaggccgaggcaggtggaccacctgaggtcagaattcgagaccagcctggccaacatggtgaaaccccatctctactaaaaattcaaaaaaaatagctggatgtggtggtgggcacctgcagtcccagctactcaggaggctgaggcaggagaatcgcttgaacctgggaggcagaggttgcagtgagtcaagatcagttcactgtattccagcctgggtgacagaacgagactatc

SEQ ID NO: 269184 - DNA, 214 bp, Homo sapiens
ccatgatgcagactggctaacttcaatttgtcttcaatttgtttggttattcagggccacatcaggactgggtgttttctgtgggtgttaacatggaattgaggctcaaccgacatggaccgttttcgtctcatgatagatgccgctgggcctgtccagtgaatgactctatgggtcacatagaagccaatacacacgggcacttggaatcaca

SEQ ID NO: 269185 - DNA, 452 bp, Homo sapiens
atcacataaattaaagtaaaattgccactctacagagtcccagcagaaaacagaatccaaatgaagagagatgagtgaaaagacaacttcgaaaaatagaggcatggttatttgaactggtgtaaggcaaaccagaggcaggactctcaggagtccgtgagagctggagccagggaagaggaacttgagcctggagagaagcagctacttgtaaaaacatagacaatagcagaaagggagtggggagtacatgccctgacttctctcttctcccaccctcccagcttctgccactgcctcccatccctggaacccaatagaagccagctaaggaactgggcatggtggtgtatgcctgtagtcccagctgctggggaggctgaggctggaggatggtttgagcctaggcattcaaatccggactgggcaacatggtgagaccttatcgctag

SEQ ID NO: 269186 - DNA, 352 bp, Homo sapiens
aaagctcgcactcttccccatcctaacattttttaaaatccctcacctcaaagacactacccaagctcagaaggtaagtgctgggtcgggaggggaatggaacaaggtttttggattttttttttttttttgtagaaaatgagctgctagaaggaaaaggcccaagtgaaagcctcagaggcggagtcgtgagcgaacctggcaggagacgaggttcctgtggcagagaaactcgtgaccggggagctgggttcccgctgggtaccccacccggcctcaggcaccgcctctacccgaaatgaatccccccgccgcccccccaggcctcctgcctctaggagcgccgcggccg

SEQ ID NO: 269187 - DNA, 410 bp, Homo sapiens
cacatgactgtactgaagctttaggtttactcatctaagtttatttctaaaacaactttaaaaagatagtgttctgtggtaataactcctaaaactatggacacgaaagtgatattaataattttcttggccgggcacggtggctcacgcctgtaatcccagcactttgggaggccgagacgggtggatcacaaggtcaggagatcgagaccatcctggctaacatgctgaaaccctgtctctactaaaaatacaaaaagttagccgggtgtggtggcgggcacctgtagtcccagctactagggaggctgaggcaggagaatcacttgaacctgggaggcagagcttgcagtgagcctagatcgcgccaccgcactccagcctgggtgaaagagtgagactctgtctcc

SEQ ID NO: 269188 - DNA, 463 bp, Homo sapiens
cctaaaaagcacatagaatagtgtctgctgcatagtaaatggtcagtaaatattagctatatttagctattattatgttttatttgagaaatctacttactagtagggggcatcctgaatcatcctgcttggatgatgaaaaggaaagggggcaccatgtcccgcatctctcaaagtatttattgttctatatctatttgtacagcttatttgactatacttaaatatcaacattagattgtgctattttaagcacagttaagtggggccactgtcatattcggtagacaaaaattaaaatgacctcatttctcattttatctaaatttgaaaccaacatggctgttttattttattaaataaacatataaataaagaaacaaatgagatttccagttgggaaatatagcagtgatgagaagaatggtacgtgtattttaagtgacatttttctatctggaaa

SEQ ID NO: 269189 - DNA, 457 bp, Homo sapiens
tgctaggattacatgcgtgagccaccccgcctggtgaaagctatgtaatatttcaagtgagagctaagaatggcttggtcaaaagtagaagagttgtggattaagagaagtggtctgattctggaaggtagagctacctgggaaagagaacaagataatctgggagtgagacctggaagatatagctgtggaatgtaagtctatagtagaggtagccagggcaactccgggggcacagatggttagttaaggaagactggagagttggggaaggtggcctagaggagaggatgcttgagcagagcctggacagatgaataggtggagatagggtgatgggcaccctagaccaagagaccccacttgtatatttattgagattgagaatatgtactaaaggagactggatagttggctgaaataaactagataagtttcccaagggccaaaaaaaaaa

SEQ ID NO: 269190 - DNA, 408 bp, Homo sapiens
aagaccatgtgaagacacagaaaaaagatggccatctgcaagccaaggaaggaggcctcagaagaaactaatcctgccatcactttggtctcagacctctaccctttagcgttgtgataaaataaatttctgtgtttaagctatccagtcttaaactggatactttgttatggcagccctagctaactaatacaaggaccaaaaggtgagaaaccacaagaccagaatattttatagaagagttatgttaaatttgatataaaaggaactggggcaagagctgagacagggccccacacaatggagatagattcctgggaagatctccattattggatctggggcaaggatcaaagcatgactaatagtaaaaccagatagatgctaagttgctgctctaaagattct

SEQ ID NO: 269191 - DNA, 168 bp, Homo sapiens
gcccgcgggagcgagatccttgggctctgtcacagggatcaaaggtccttgtggttggaaaggattaagccctgtcacccatttgagtgtttgtggttgcaagaagttttagctgaggagtttacaaggaaataaacgcagtaattgcatgagttgaattgcagatca

SEQ ID NO: 269192 - DNA, 367 bp, Homo sapiens
aacattttgaatatttcattccattttcttcttgcttgcatggtttctgagatgtgaaatgtaattcttatctttgttcctccataggtaaggtgtggtttttgtccttttaacttctttaagaatttttgctgtatcttggattttctgtagttagaaactgatatgcttatgtgtagttttttggcatttatcatgctcgatgttctttttttggacctgtagtttgatgtctgacaataattgaaggttcttggtcattattccttcaggtatctttttcttttcttttctttttctttctttcttcttttgttattcctattacacataatttataccttttgcataatagttgtcccacagt

SEQ ID NO: 269193 - DNA, 521 bp, Homo sapiens
gtgaatgttcacagcaactttgttcataataacctcaaactgcaaccaacccaaatatccgtcacctggtaagcagatgagcaaattgtgctatatctatacagtggaattctactcaatacagtggaacaactacttttacatgcaaaaacatggatgagtctcaaaagtgtttcacaaagtgaaagaagccagacaccagagactgtatactataatatgattccattaaatgaaattcttaaagagcaaaactgtaatgatacaaattagatcagtggttcctaggggtgaagtgaggaaattaactgcaaagagcaggagggaaattttgggtagtggaagtgtttctgtatcttcatcgtggtgatggtcacacaactctatgcatctatcaaaactcaaactttaccactgaaatgggtgcattttactgtactcaaattagtcctcagtataattgtttaaaaataggaccatagtggtatttgaggggaaaagaggtaggggtgatgggtgtt

SEQ ID NO: 269194 - DNA, 350 bp, Homo sapiens
cctgaattcattcccaccttagtgaatctcaatttactttgtaatttttgtgtttatttcctttcctttcaccccagatattaaactcacttcattagagaaatgtgcaaacacagaacagtttcttcatttgattttatgctgcctgaaatgttttcccaaatgttaaaaatactttaatcatttcttttaaattaatatacaaaatacttgatattttctatgagcctctacataaccagacactgcctacctcttccatgtcacctccttcaactctgtctttactcctgcatctcagccatactggccttcttacagtgtttccaagagttcaggctgctttctac

SEQ ID NO: 269195 - DNA, 406 bp, Homo sapiens
tcatctcctctagagctaatttattatctcaagagtgagaactcactcaccttcagggaggacattaatctgtttatgaggcatccatgcccatgacccagacaccaccctctgggccccagctcccaataccaccacactggggatcaaattccaacatgagatttgatggagacagacaaaccatatccaaactatagcatggactgaaaaaactccaattaaaaggaaaagattgtcagaccagctacaaaattaagactgcctgcggtctacatgatacgtactttatttatttgtttgtttgtttatttatttatttttgatacggagtctcgctctgtcacccaggtgagatcgtgccactgcagtccagcctggccaacagagtgagactccttctgaa

SEQ ID NO: 269196 - DNA, 224 bp, Homo sapiens
gcagaacagcatcaatcagaattagagaaacttggaaatgaagtgacaactcaggaaaaaagtagaactaaaaataattattctgtaaggtagactaattattatgaatccatggatttaaatacatttgatggatgtcaatacctgtgttcctggaaggaacacaaaagtaaacaaatacaagggtaatgcctcgagagacataaaaggtgaaataagacaaa

SEQ ID NO: 269197 - DNA, 324 bp, Homo sapiens
ctgcctggaagggggacaaaacacgatactagattacaacaatcaggtttaagtataaaaaaagaaaacaataacatttaaggaatataggtataactttgctatgagggagatctttaaaatctagttggaaaatccaggaataattttttaaaaagactgaaatcattggcttcataaacattcaaaaattgtgttcagtgggaagcatcataaaccaagtcataatgcaaacagactaagaagaaatatttgcaacacaaattgttgcaacacaaattggcttaagtccctgatatacaaagaatgcttacaaattgattt

SEQ ID NO: 269198 - DNA, 301 bp, Homo sapiens
gatggtctcagggaccctgacacagcaccaaagagagtgtttaaggcagagaaaacagcagactcaaaaaccccgtgacatccctgagcatctcgacatgagaagtgtaacaaaagctggttaggtgggaatggaagagaaagcaggtgtgtgacactaggtgtccacattctctcttcactggtgaatggacacctgtgattgttgttcactgttggcatcaccaccacataccattatgcttggcatgtcattgatgcccaagagtatccattaaataaatgaattataaataagcaaa

SEQ ID NO: 269199 - DNA, 314 bp, Homo sapiens
tccaggctcccaagccaagcaagcgtttgaaaatgccaccgtgtccagcccagtagagggtttcacaaatcacaaggtggctatcatcagacaggacccaggacagggggaggggcaaccagattgccccttcctctacccctgcctaggccctggcggcatcctgtctcgggagtcactgtgttttgttcccttctccctgtcttgtcttcctgcctccccacccctaccctcatgtcccagacaaaagggctgtcagaaaagacaaactcactccacagaggtttctgtgaccaaggaggctctgtgatgga

SEQ ID NO: 269200 - DNA, 703 bp, Homo sapiens
tttaaaaatcacatatttaatcagaaacttagaaaaggctgaaaatagattcaattatgagatcagcacatttgttcccaagcattacattttcatctgcgttcaacacatgcctcttctacttaagggtcccttccatcaccttcggtttagtctgcaatatgatcatcctatacttaagataaaggcatttatacagtatatgttgtaaataattattttttcactctccccttagcaggtatttgcatctaagttcaagtcaaactgaggaggaggactggggttagaagattcaagcaaggcacggcagtaaaaaaggaggcaaggccgaggcaggatataaagaaagattgttctacaagcaaaactcatagaaagccttatttcagtcatgcagtaagagtaaggttactccagtagtttggtgaagaggaaggaaaagttttaggtacatatactgaatcacctttggactaagtcatagattacaactaattaaatgcataataaattggtcctgacaattacataataaatgctatcaaatgacatttgaaaggttattcttttcaaaaataaaactgcccctattcagctattggtgcagtacctacaccacacatctgtatttgttcaaatggcatttaggctcagagagtttgttcccatttacaattggagctcgtgccgaatcctgcac

SEQ ID NO: 269201 - DNA, 648 bp, Homo sapiens
tttaaaaatcacatatttaatcagaaacttagaaaaggctgaaaatagattcaattatgagatcagcacatttgttcccaagcattacattttcatctgcgttcaacacatgcctcttctacttaagggtcccttccatcaccttcggtttagtctgcaatatgatcatcctatacttaagataaaggcatttatacagtatatgttgtaaataattattttttcactctccccttagcaggtatttgcatctaagttcaagtcaaactgaggaggaggactggggttagaagattcaagcaaggcacggcagtaaaaaaggaggcaaggccgaggcaggatataaagaaagattgttctacaagcaaaactcatagaaagccttatttcagtcatgtacatatactgaatcacctttggactaagtcatagattacaactaattaaatgcataataaattggtcctgacaattacataataaatgctatcaaatgacatttgaaaggttattcttttcaaaaataaaactgcccctattcagctattggtgcagtacctacaccacacatctgtatttgttcaaatggcatttaggctcagagagtttgttcccatttacaattggagctcgtgccgaatcctgcac

SEQ ID NO: 269202 - DNA, 2720 bp, Homo sapiens
agcggaggctatcagcgtgaatgaaaccattgtccttgtggaaaccagaatccgggcaatggataaggatgccaagaaaagaatccataatttctctgtcatcaatcctgttcctggacaagctataactcagatttttgcagttgacaatagagaagatcttcagaagtggatggaagccttctggcagcatttctttgatcttagccaatggaagcactgttgtgaagaacttatgaaaattgagattatgtcaccacggaaaccacctttgttcttgacaaaagaggcaacctcagtctaccatgatatgagcattgattcacctatgaaacttgaaagtttaacggatataatacaaaaaaaaattgaagagacaaatgggcagttccttattggtcagcgtgaagaatccttaccacctccttgggccacactctttgatggtaaccatcaaatggtcatccagaaaaaggtactgtatcctgcaagtgagccattacatgatgaaaaagggaaaaagagacaagctccccttcctccttctgataaacttccattcagcttaaaatcacagagtaacacagatcaattggttaaggacaactggggaaaaacaagtgtatctcagacatcgtctttggataccaaactatcaactctaatgcatcacttacagaaaccaatggctgctcctcgaaaacttctgcctgccaggagaaatagattaagtgatggtgagcacacagacactaaaaccaattttgaagccaagccagtgccagctccaaggcagaaatccatcaaagacattctggaccctagatcatggctgcaggcacaagtatagaaaactcttaatgataaaacatttaacaaaatctataactgtgaagcttaattcagaggcattatagaataatgtgtaattatataggtaaatatagtgatttataccaataattaataagctattaggtatagaaaaacattttataatgaagaagtggatttctcttttactcctgatttgcagaatgtaagtgatttctccagcagtgtgcaagaggcagtttctagacaatatcctaatgttggaagggttaatttattcctgaattagtaccaggcagtgaataagccctaggcagaataaagcattaaaatttctttggggagagactgtctagtaatttaaaatgtgttaaatatgaaccatattctcattgtgagaattttaatactaatggaatgtttcaaaggttttattcaaaccacaaattatagaatccacccaagaaaattttcttagcattctggaattctcatctaatggttcactggctctcatctattgtttaactcactagtttataggcctgaccttttaaattcctgggataaattttagaatattaaattcttcatctttaaagggaattgtaatgtgctattcaaacttgtttccttgatgagccctgaaatactgttgacattaactttcataaatgaagcataacacttactagtttagagaaatggtagatgaaatgctctttacattcaattttctgtgtgtggtgctaatttccattgtgactttggaatttagggaagtgagtagctgatcaacaccttaaaattcatttaatacttatttaaaaagaagatgagagattcaaaaatatcagaaaagttggccatggtaaataattttcagaattcttttttaaaattttaattagatttccttttcctagtaagagttgatgtctgctagtggtatttttcattaaatgtcatattcttacaacagtgacattggaatcatttccataggaggtaatttccatagcaactaatcatagtgacccaaacaggattataaagtcaagtgaggaataaatagcagaaaaataccttaaaggaacaaaaaatccattttttataataatgctttttgtaaacaagagcagaacagttttaaaaatctaattagaatttccaaataaaacagtttccataaggtgtcagcaacagcactaaaaatctcaaatcacactgaaccctaaatgtcattgcaagaaataaaaatttaagaattaaattgctgccctgtgtataatctcttgagatctttttaaagctagcaagaactctatttggatcagaactacattattacaaaacaaaatgaacacttgaccaaaaaaccacattaatttaaatggagcctttcattattttcagatagcggggtctttaccatttatagagaatgatgtaactgccaggacacttttgtgtttgcccaggactcctagtaagaattgaatcttgagggagtaatgataaccaaaggtttcttgtgactggtaacatcaagacagacagagatttggtgaaagaaatactatatgcctgctgatagcatgtcgagatcatcacatgtatgtgaaaccttaaaaagtaactaatttctaactaaacgccccaacaagtccggagatgcctcacaaagcatgaggctaagacatacgagaaaaggcaaaaaaaaagaagcggatgaagaagcgaaacatcacaactggcagaacgccagaacgtggagaacaaaacagacaaaagaacaaggaaagaacgaaagaggcgcgcaaacacgaagaaaaccacacaagcaaaaagacacaaacacacaagacaacaacacacacaacaaa

SEQ ID NO: 269203 - DNA, 830 bp, Homo sapiens
tggttttatgcattttaacctagattgttaatgtagctattatcttaggttcaacaatgatttgtttttagccaggtttagcattcagaggcctttttccacatcagtagacatatcccacagcatcattgtttatgacttcatagtattctgttatatgattgcaccatattttttattacttaattttttgatagataatacatgtacgtagtgtaaaatacaaacgatctgaaagagtatacagtgtttctttttttttttttttttgagacggagtttcgctttcgttgaccaggctggagtgcaatggcacgatttcatttcaccgcaatctccacctccctggttcaagtgattctcctgcttcagcctcccgagtagctgggactacaggcacatgctaccacacccagttaatttttgtatttttagtggagatggggcttcaccatgttggccaggatggtctcaatctcctgaccttgtgatctgcctgcctcggcctcccaaagtgctgggattagaggcgtgagccactgtgtctggcctacacatttcttttgttcctccagagatattctacataaatacaaaccaatacataatcatgtatgatatatatgcacacacaaaaatggcaacgtattgtaccttctgttgtgtataatgcgtgttcttccccctcaattaaaagatgttccatagaggttcataaaattttgcttcattgttttccggttgcttaatattctggtttatgagtctgccataatttatttaactagtttattttgactattcaattttcagattgtttgttctgtcag

SEQ ID NO: 269204 - DNA, 425 bp, Homo sapiens
aattaaaattagcgtatcttccatctgccaagactgaatttaaattatcttttacagactctagctatggttactagattaagcaaaacacaaaattccattggtaattccatttgtagttttctcaaaagaaaaataaatcaagatttgcttgagttgcagcaaattatgataatgtgaatattctgaattaaaccttctctgacttggtaattactgggagctctttcactgtatatcctggattatagaattattcatatgtaacaatacatatcatagtcagattcagggagagatttattacatcacttataatttagaacaaaatgtagggatttagtgtatgtgttatttgttgtaatactgagaagatcagaaaatttatgagaaagatttgcctaatttaggctaagaagattttg

SEQ ID NO: 269205 - DNA, 342 bp, Homo sapiens
ctcccaaagtgctgggattacaggtgtgagccactgcacccggctgcatgtgtatttttaaattgtagtaaatctgttttgctagattgccttccaaaaggctgagacagctgacagctgcacgtgggatcacaccagagcccaaagacctgactggttttaccattttgcctgtctggtgggcgttggcactgcctctgtggctctcatgcacactccagggcagcgcacctgctgagaactggcatctttccacaagctgttccggccctctaaaacaccgcattcatctgtaatattggcgtcataaaaattaaacatttgtcatttctattgtaaata

SEQ ID NO: 269206 - DNA, 583 bp, Homo sapiens
aacccaaagtatccatcagcttatagataagcaaaatgtggtgtatccatgcaatggagtgctgtttagccctaaacagaaggaaatactgttgtatgttacaacattaataaaccttacaaactttatgcttaatgaaggaaatcagacaccaaagattacatattacaggataattatatgaaatgaccacaaaaggaaatttacagagactgaaagcagaagtgaacaaaggacttgtcagaattgccagtactttctattctagctgcaaatcccgataaaaggttctctcactactgttaggctacttttccagtataatcttccatattcttcacttaccagttgaactttgtgcttattgaagttctgttgtatttttcaaacctgtgtattcgaattgtacttattattaatatataattaatattgtgtaaattgataaaatcttgtgaaaaaaataaaattttttatttggcaagctagattggatgctttggaaagacttcataaaagcaaatggctacatactggtttgaattaagtgtaggtaatttaagacattagagtgaaaatagta

SEQ ID NO: 269207 - DNA, 451 bp, Homo sapiens
aaggatgtgttagaagataaattttaatctgtgcattttttatttaaaagcaaagagagccaaaaagcctataaataatttaaaattgaatgatgaaaaacatttaattatcccaaagaagaaagaaaagaaggaataaaaaataattataaaatggtgaacatttcccaaacattaatcacattttttttttgtagctgggattacaggattgtgccaccatgcctgctaatttgtaaatttttgtagaggtgaagtctcactataatgcccagtcttgtcctgaactcccggcatcaaaagatcatcctgcctgggccttccaaagtgctagtattacaagtgtgagccaccatatctggactactttaaatttaaatggactacacatacctaataaaacatgaaaactgtaagaatgaattaaaaaaatgcaagactcaactatata

SEQ ID NO: 269208 - DNA, 363 bp, Homo sapiens
ccaacgaggggacctgaggaccctacgccctgacccacaccaacgagggaacatggaggatgccacgctccacagaagctgccaggcaccacagccggcaggatggggttccccagcaggccagcagggagcagccagaccaggcgaggccacggcgagggggcattggggttgtcggagccggggtgggggaagggagagcaggggtggccactcatgggcaagggtttctttctggggacaagaaaatgttctgaaattggtggtggccgcataattatgtgaagccaccaaaacccaccgaattatacactttgagtgaattaaatggtgtatagatcatatttcgataaagctgatata

SEQ ID NO: 269209 - DNA, 375 bp, Homo sapiens
agtttacagaagaactaggtagcctgttcccactcagaaactcattccacatggtttgggtggtcctaccactgccctcacccgcgtcaacaaaggagtgggaaccgaactcaggccctgcccatcagatcatcgaattcctctggccacagtgattgggttgtgatcagttaggattctgcacttgtgactgaaaaatccttgtacaggaaccaaccttctggaaacttctcccatgtgtcaggcccacagcacctagcactggatgagacacatcacaaatcctggacaaactcttgctgaaaccatgacatgtcgatggcccttcacagaagacttcacaaaaggcttcccataaccctattaatggaaaaa

SEQ ID NO: 269210 - DNA, 466 bp, Homo sapiens
agatctacttattttccaagaatggcgctatatttggggaatactacgatgggactatctatttttttctagtctaagtctttgtgccttttcacatatattttagaatttgttgccaacatctgaaaactgatattttgattgggattgtgctgaatttctaatacagcaagttgtctatccatttgtatctcatttgtgatttcctcccactgaatgcaatatggaaaggcgtgggaagtgacagtaactttataggggagacacttgacaaacactacctcagccaggtgacaaagatcatgcctggaggtagcaatcactccacccaccaggagctgtggatccaacagcaaaaaaggcagagtccctaccatcaaggagatgcagccagggaagtggtgaatgtggtggagaaagtaaagaagacacagtaaagtaaacatgtaatcatctagtattgtga

SEQ ID NO: 269211 - DNA, 419 bp, Homo sapiens
attagtaaaaggttgtctactcacacctttttttctctagatcactctgtccaatgttagcatctttcatcctctagagagaccgagaattttcaaaatcatcaagtcctggttactttttgttgaacagttttcccctcaatttatctctctcatcttacattttattataagcagcaagaaaaaacttaggcctcactttcaacacatggattgggtcatcacttacaagttgtgctttctacgagactacaggagaccatttcactaagctttttgccactaaataacaagtgtctccctccagtggccaataacatgttccaggtctagatttctgctctcagtctgttcagggcaatttatgcattttttatcatgcttctcaaaattcttccaacctgtatcaatgaatagtc

SEQ ID NO: 269212 - DNA, 322 bp, Homo sapiens
gacagttttctctttgaaaagtcatgttcctttgaatttaactaaaacgtaacaggatgttaaaacgaaaccctggcatttttctttccttcagaaatatgcccacattttatagagaaagctatatattgaggttctgcaaacaacaaaatgcaattttcacattaaacatggattctaacatctggcatttctcctagtgcttgcacataattatccaaaattgcagtttttccaacaggggacccacagtggtagctctgattcattccacattatatatatgaccctttctcatagtgagggtggtcttcaacaccaa

SEQ ID NO: 269213 - DNA, 242 bp, Homo sapiens
taagaagggaggagccaatggatacagaatgagaagaatattttgagaatgaggcaggaagaggaatataagacctggagaagttcattcagctcaactgagaggagacggaagtcagaacacggtgcaaagggaagaggagtatgacctatgctgcagtagaaatgttatctggagtttggggaattatttatagggattgagtcctgtatgttggggagatagggctacattatattcag

SEQ ID NO: 269214 - DNA, 499 bp, Homo sapiens
ctacttcagttcagatggcctacttgagttgctgaagtatcattgcggaggtgactggactaaaatagctagtccgtacatatagttctaaaaagtcttcttggattagaaagtagtgtttctaatttttgttgttccaaaagacagagctttgggaaagtccatctggttatgcaattcccaagtaaaatttgacacatatatttggacaatgtgaaaaaagttcttcaggaaacactaatgtttaatgagctataactggccctggtaaacaaacatactattcttttttcatcttatagggaataattatgaaggcatatgaggatggtagcatctactactcacatctgccttacttgccactgttttctattgcctgaatttacccaaccctcatagttgctgatatatttttacactttctacgtatttgcagccaagaaagtcactaaaagggacaccccaaaaatagttccacactacagcatgagaaaat

SEQ ID NO: 269215 - DNA, 679 bp, Homo sapiens
tcccccgggctgcaggaatcggcacgaggcagactttattattaaattttcaagatgttattctatattacaggaacatcattacaatgtgatggggagtacaataaccccaatgagggccaggagtggtggctcacgcctgtgatcccagcactttgggaggccgaggtgggcagatcgtgaggtcaggagattgagaccatcctgaccaacatggtgaaaccccttctctactaaaaatacaaaaattatctgggcatggtggcacgtgcctgtaatcccaattactcgggaggctggggcaggagaattgcttgaaccagggaggcgtagattgcagtgagccgagattgggccactgcactccagcctggcaacagagggagactctgtctcaattatttatcatacagatagaaacatttttaaagattctgagaaaaaaatgaagacaataaatatataacacaattttgtctaatccagaaatgtctcagacaacctgaatttaaagttatccaccagtaatgccatggatttcaaaccatgatattaaatatgtggttgtaaaatgaattatttgcatgaaagcattgccattatagttcctcgtgatattgtgtaaggcatcgaacaagcccaagcacgctggaattgacagtaagtagaaagaaaccca

SEQ ID NO: 269216 - DNA, 666 bp, Homo sapiens
aattagggcccgaaaattttaaagtaccctcatgaatatatggatattttatgaccacattaattaccatgacaggaaaaggcatatgaaaaaaacttctctgctctagcagtcatttttagtatcctttttagaaaaccaaatagttcatgaaaagactgcctatatgttctggtttcaaggcagacttactttgtttgtttgttttaatttataatatggtactttgaagggcaaagtagcatcacatgtttacctatacactttcaattaaaaatttagatattttcagtatcttcacctcaacattggcaccatgttgattccaaggctatctaacctatgaataatattgagaatttacttctaaaacttactaatagatagttgtatacttagaaacagagccagcttcattttcctcaatcccttctaatagacactaacacattctaaagtgatatataagaaaactgctttcttatctattagctttttacctaaataaatggtaaaagtatttcttcaattagaattgtcatttagaactacagtttagttataccattattattatcaatcattgttgaatttttcacaaattatcatcaacatcatcagcaaacaaaactaacaaagagaccaaaataaataaatggacttttg

SEQ ID NO: 269217 - DNA, 420 bp, Homo sapiens
tcagagacttaataggatctagtgggcttctgcagaacttcgctgattatcttaaagaaataggggttgaatgaaactttgagggcactcagaacactgagaagttgaggggaagctgagtaaaaaacaagaaattacattacaggatggtatgccagcagaaattgacaattaaaactcagtatctgatctcaccaatgtgtaaagttatacacagacgaccagatcatggcatgttttgaaaattttctgataagaatctgcaactatgactagcaacggaaagcaagcaggaagtctagtgttgggctgagtatctgatgatttaatgtgtttccctggattttcctttgcttggcaagcaggtaacttgctgaatcttctgctggctatctttaaaaatatatttaagcttgaaat

SEQ ID NO: 269218 - DNA, 466 bp, Homo sapiens
caggaaatcaggcattactattataaaatctattaactgtacttaaattttaccagttgtcccactgatgtctttcttctggtctaaaacccaattcaggatcacatgttgcatttagttacttttaatctggaacttatgaacactttgacaaatacttgtcagtattttgtatatcctctctcattttggttttgtattgcatttttcatggttaaattcaggttaggcatttttagcaaaacatcaaagtcatgtgtcctcagtgaatttccatgatttggccccttaactggtgattttaaccttgatcacttggttaaggtggtatctgccacatttttcccctataaaattactattttttccctttgtaatatataattatctgtggttgcccatatgatatttcaagtctgtgtaaatattctcatattttgcctttatataatcttccattaatttt

SEQ ID NO: 269219 - DNA, 509 bp, Homo sapiens
tacttcaatactgttcactatgttagacatcttacatccattatctgctattaactcctataatatgtagtattatccctaaaatataggaaaataaatagacacagatgtagcaatacatagtaacaaactgatctttttgcaagatacagattacaaaattatttaacctctgagtgtcttactttccattttacaaaatggggttttaaacataagacccaaaaccataaaaaccctagaagaaaacctaggcagtaacattcaggacataggcatgggcttagacttcatgactaaaacacgaaaagcaatggcaacaatgccaaaattgacaaatgggatctaattaaactaaatagcttctgcacagcaaaagaaactatcaccggagttaaaaaggcaacctacagaatgggagaaaatttttgcaacctatccatctgacaaagggataatatccagaatctacaaagaacttaaacaagtttacaaaaaaaaaaaaaaaa

SEQ ID NO: 269220 - DNA, 551 bp, Homo sapiens
ttctttttaagatattacttctccaataaactgtttgcattgttaactcatgttgacatttgctttctagagaatctaacaatgaagaagactgaaaaaacatgtaatggaatgtgaaaacaaaagtctttcagtagagctcagtgataccaggcacctaccaggcagtcctctccccacttctgggtgggtgggagacttcggagcagtcacacacagagtggaacaagcacaaaggatggctctgtcgcccaggctggagtgcagtggcacgatctcaggtcgctgcaacctctgtctcctgggttcaggcaattctcttgcctcagtctcctgagtagctgggattataggcacccaccaccacgccctgctaatttttgtatttttagtagagatgtggtttcactatgttggccaggctggtcttgaacttctgacctcaagtcatccaccagcttcagcctcccagagtgctgggattacaggaatgagccactgttccctgccaactctctgtcttttggggtattgattctgcactctacaac

SEQ ID NO: 269221 - DNA, 422 bp, Homo sapiens
gcccagaagctcaatgttgaacacagaattcagtgttatgaaattagttgaaactctgtctggtgtttcaaccagctgccacttttgcccatcattttgcttttcaagtacactagaatattggtaaaaggtaaaaaaaaaaccaaggtttccaagtttgtaatctttcctcaacattgaattctcaagttctggcttctacagtatttctttaatgacaagacaaattccttttaatatgctttgtcaaatttcctagactgccaaaccaacctcaaagacagtaagtatgccttggcttagtctgctatgacctgaggttggttgactattaccaatatattggtatttttaataaacttgaaaacaataatataacatgagaatagactattcagaaagtatatcaagttagtcacaaa

SEQ ID NO: 269222 - DNA, 339 bp, Homo sapiens
cctgatttgccctctctcattctcaggatggaagacctctctagccaatgggaagatggcaagatgtgtgaatgtacccctgggagcaaaatcacagagcctgtgtaatcctctatacatgtagggactgagtgtgggtatctctggccagtgtggatgttgaccacgttgtttcgtaaccctgcctcacttgctcctctctccccaacctccagaactgcctatctaactcatctgtggtgatggaatgctatttctttcacattaccctgattaagtatcattagaaaggtaactgctgtgcttaaaacaaataaatcacctaacacattccagaga

SEQ ID NO: 269223 - DNA, 81 bp, Homo sapiens
ccatgtagagattcaggcgctgcagaagagtctgtttgtatctgtcttttaaacggcaaataaaatgtcattgatatcctc

SEQ ID NO: 269224 - DNA, 316 bp, Homo sapiens
ttataactatatctgcaatcttttacaaaagtggatgcagatgtggaattattaaaagacaacatagcataaatattctgataaaaagtaagattacaaccagagataaaactgacatatcttcttttaccttctcctattcatcattcaacaattagggtatttctcttcatctcatttttgttttactatttttaattttttaaaataacatttgcatttgattatccattatacatctaatttttaaaaacagaaaatgcaggaatttttaaaactccagaataatgaatgtgtttatgctttaaattaaaaa

SEQ ID NO: 269225 - DNA, 493 bp, Homo sapiens
gagccgaagtacagaaaccatatttacaggtacatgtgacagcgttgcagctatgagtggaattttaaaggggaagtttgaagaagtcaacggctcctcaccctgctcttcagtgcaggaatcagatgatgaagttttcagctgtgacagtactgagagtgttgatagtgtcaatcgttcagttttaatgattttaccagaaaaaatgaggaaatatcaacagactgaaaatatgttttcagaggcatagaatcttcaggaaaatactggagttcctgagatctcaagatggagagccacttagcttgcagactgccatctccctaacgtatcagaacaatgaacttggttccaagagtatagaactcagtgaatgtaaaatggatgaatgtatgaattaatgcataaatcaataaatgaacccagatgaataatatgccaaagttgtttctgtatatctctgtgatacaaataaacatatgctcattctatt

SEQ ID NO: 269226 - DNA, 626 bp, Homo sapiens
ataaacatcagtttctctgtttttaaaacaagaattgagtaagaacagagattaaagtaacaaatccgtagtatgatttctgagctcccttgttctccttcttcaagggagcagagctcttcatctgcagggagcatttcccccaaaaaaggcagctttggagggcacgggatttatttgaaagggctttgacattatttggtggaaatagaaaataacgtgttctgtagtagctttatatttttggttattgacaggatgtttacgaagatctgattgctcttgattttcttgacaaaaataaaatgagacacacacatagcaaaattctttaaacacgaatggttgtcttctccctataatcaaccatttaatttggtttcaagaaaacaaatacatatgttcctaatatatttagatgtattcaataaacattgttaattaaaaaatttgtgttcattctaaccaaactggaatacatccatagtgatatgactttcacagaagtttatatgtagatttccagattttatccagcttagccttacaggtaggaaggcatcctcgtgttctaaagagatgtctgctgccctcgttttaaaggcctgaagcttcttggttttgtt

SEQ ID NO: 269227 - DNA, 372 bp, Homo sapiens
aggtgagtgtaagcccctagtgagccaagaacactaacattcccactttctaacccaccaggccagtctaacccttgtgcctttcctacctggtacttgaaggctcttgagtttgcacgccgtgagcctccccatattcagggaaaggctgttttctgtgagctgacatatttgggcacagacgtaggttaggaacttaggaaggttgattttaaaggctggagatcctggccagtccttggagttccacacattaggggatgcagaaggaaacagggaaggcattctttagccaaaacggagaattcagatttgctgtgaagaacaagaacaaaataaagctcagagcttttcaatgcatatatatttaaa

SEQ ID NO: 269228 - DNA, 444 bp, Homo sapiens
gcagagcagggacaggaggctgatgtcccctccctctgccagggcacgggcagccaggcagtgaggccacattaggactcaattcaggctggcctgagcatctgagaaagggaagtaggatagaggggcaggctggggacagatccatgggcaacatggatcacccaagactagtacaaagaaaggggctggggcactaaggtacagattgggcaatcagcacacagtatgtgccaggtgcagggctgggtgctgggattccagggtgagcaaaaagacacctaccctcatgagactcctgcccagtgcaggaaattcagggcacataccttttctcctaccgctcacacctgctcctcctgcctcctcatttttccttccagctagaatgggtggagtttccctcttcccattcattcactctattattcacccaagtattta

SEQ ID NO: 269229 - DNA, 199 bp, Homo sapiens
ctcccgcctcaggccgagatgaggagcccttcagaatagctgctgtctctgggaggacccgggcgtccttggcagcccagctgctctggacaaagccctgccagtcaggcctccgctggcaggaaccatggcagaggctggggatgctgcgctatcggtggccgagtggctgcgggcattgcacctggagcagtacacg

SEQ ID NO: 269230 - DNA, 395 bp, Homo sapiens
tgccaatcaagatatagaaactatctacaaagtccccttgtgcccctttctagtcaatacccttccaagctcaaaggaaacaactactttgatttctattgccacagattagttttgaccttcatattgatggaattgtacagtacctaactcttttgtgtctgccttcttttactcaacatgtttttaagattcacccaggctgtagtgtatatcaacagtgtgtattactctgagtagtatatcacaatttatatttttctgttgatgaatatttgtgttgtttttgactttttggtatttttaataaattagccgttaattctaattgagcaaaatatttccccctaataggacatgaaatttgaaatatcttaagaaatttcttattcata

SEQ ID NO: 269231 - DNA, 241 bp, Homo sapiens
ttaaccgacatgtagtcagacttccagcaatggatgcagcaaacacacagggttataaaacttttgtcttgttactcatacatttgttgacatcagtagtttactctccctacatgcacatggctcataaatcagcattgttaacatgtctaaaaacattagcataagatcattatgattcacttaggcactggctccatcagttacacatgaagagaggtgttgaatctgacaaaaagaa

SEQ ID NO: 269232 - DNA, 216 bp, Homo sapiens
caggtttagatcctcaccttccctagaggagagaatggctggccagtgagctatatttaaactttttttttttccccctgagagacagggtcattacctcctgggctcgggtgatcatcccacctcagcctcccaaatagctgggattacaggcgcataccactatgcctggctaattttttttatttttagtagagatgaggtttcgccatctct

SEQ ID NO: 269233 - DNA, 436 bp, Homo sapiens
aaaccacagcaactgccaagcttctttcactgcctggacactgcacctctggaatgaagctcctggaagactcctttctaaaaatggggctgcgaaccttagttaaggtgacataatgaaactcagaggcaggtcctatcaaaaaggtgatcttttaaaagctgaccctcttgtctttcagaaatcttgattttgttttcatttcaccccactgcaactaaaaccatttcatttccaacatataacagaagaatgcctgagaaattaaatgtttgaataaaatatgtgcagtattttaacaccagcaatgtatcccgaattaaccaatcttattaatatttctacacaatcaggaaaccaaattctttagttttctttgcaactcagtgaatatacatttctgtaaagagaatcattaaagaaatgtggctactat

SEQ ID NO: 269234 - DNA, 1910 bp, Homo sapiens
tcctcctcatcatcttaccatttaatcaataattgcaatcagcctgtcagaatacgtaaagggaatccatgtaattcacaggcgggagttgttatttctgtagtaaagacctgactgcagcatttacacatgataaataggaaatggcaaacctggggaagcaagtttgaactcaatctggaagtaatagcctaagcagcttgctcttcacactgtgtttcccatgtcacccttttcctcttaggtatcttgcttctccctctcatttcaatctcctccttccttctgttcctccatccttccatccctccctcctgtctttctctgacacaatgactcagctagtttaagagaatggtattattttgaagtctgaaaatgtttctgtgatattttgctttttactgatctttaaagcaactcacagaagtgtattagccttagatacgtaatcaccccttgagatatatagtcaacagtacacactgacatgttcatagtaaaaactgcctttatgtttcactgcattcaagcaagtagatatttgtttgtttcacgtattgcaaagcctatgttcttaagcatgtaccaaaatcacatttatttcattaatccatttactcattcaccagaatgtaacaaaatttagtgaatatctgctatgtgtcaggcacttttcttggctcttgatatacaatgatattcaaataaaactcatagtctggtaggggaggtaggagacaaatatgtactgatgttaatagatattcctgaaataaataaaggaattaggatggttaggaacgtccttccagaagaaatgcaaggctggccatgaaaggtgactatatcgtaataggcagaaggtggcagcgcaggtatgggtcgtaagaagaaccttataggaaaggaggtcaacttgccccagtgccatgagctcagcactacaacctggtgcaggacttcgaagtaatagaaagcgaggctgcaaaggtggacagggacctgaagacagagggccaggttagtgagagcagacttaccacgggcatagcttagcagttttaagaataggatcagattttcatttgataaaatcaccctgatgacaaggtggagagtggattagatgtgggtaacatcgaagataaagaagcaggtacagagactcataaaatatgcagatgagaggtagtggagaccagaatcaaaactgtgaggaataggaatgtttaaatatgtcccaagttacaattcagttacatatttcatcagccagcatgtcctgtgcacacacgacctgctcttactgctttccatgttctgtatgtggaaggagatcagtcaatcttgaactcatggcctcagtattttgtactttataatttatattttttcctatagaggcttttctatttatgtgtattccacttccccatatcactaaactgtctttttccacaggattcaattcttgaactagtaggagtgaagggcagtctgttgaaacctgtaatctcttaggcttgtattttctttgaacatagtttccacagaattcttccctgtaggggaaggcctgggcacttcttgatgtcagaacatgttgtctttagtttggaatctgccaaaacaaaagttaaatcaaaaatgttaattcctgtcaccccagcacttcgggaggccaaagcaggaggattgcttgagcccaggagtccgagactggcctgggtaacatagcgagacctcgtctctacattaaaatttaaaaattagctggatgtgctggcatgcactcatagtcccagctgctcaggaggctaaggcgggaggattgcttgagtctgggaggtcgaggctgcagtgagccactgcactccagcgagtgatggagtgagaccctgtctcag

SEQ ID NO: 269235 - DNA, 1856 bp, Homo sapiens
tcctcctcatcatcttaccatttaatcaataattgcaatcagcctgtcagaatacgtaaagggaatccatgtaattcacaggcgggagttgttatttctgtagtaaagacctgactgcagcatttacacatgataaataggaaatggcaaacctggggaagcaagtttgaactcaatctggaagtaatagcctaagcagcttgctcttcacactgtgtttcccatgtcacccttttcctcttaggtatcttgcttctccctctcatttcaatctcctccttccttctgttcctccatccttccatccctccctcctgtctttctctgacacaatgactcagctagtttaagagaatggtattattttgaagtctgaaaatgtttctgtgatattttgctttttactgatctttaaagcaactcacagaagtgtattagccttagatacgtaatcaccccttgagatatatagtcaacagtacacactgacatgttcatagtaaaaactgcctttatgtttcactgcattcaagcaagtagatatttgtttgtttcacgtattgcaaagcctatgttcttaagcatgtaccaaaatcacatttatttcattaatccatttactcattcaccagaatgtaacaaaatttagtgaatatctgctatgtgtcaggcacttttcttggctcttgatatacaatgatattcaaataaaactcatagtctggtaggggaggtaggagacaaatatgtactgatgttaatagatattcctgaaataaataaaggaattaggatggttaggaacgtccttccagaagaaatgcaaggctggccatgaaaggtgactatatcgtaataggcagaaggtggcagcgcaggtatgggtcgtaagaagaaccttataggaaaggaggtcaacttgccccagtgccatgagctcagcactacaacctggtgcaggacttcgaagtaatagaaagcgaggctgcaaaggtggacagggacctgaagacagagggccaggttagtgagagcagacttaccacgggcatagcttagcagttttaagaataggatcagattttcatttgataaaatcaccctgatgacaaggtggagagtggattagatgtgggtaacatcgaagataaagaagcaggtacagagactcataaaatatgcagatgagaggtagtggagaccagaatcatatttcatcagccagcatgtcctgtgcacacacgacctgctcttactgctttccatgttctgtatgtggaaggagatcagtcaatcttgaactcatggcctcagtattttgtactttataatttatattttttcctatagaggcttttctatttatgtgtattccacttccccatatcactaaactgtctttttccacaggattcaattcttgaactagtaggagtgaagggcagtctgttgaaacctgtaatctcttaggcttgtattttctttgaacatagtttccacagaattcttccctgtaggggaaggcctgggcacttcttgatgtcagaacatgttgtctttagtttggaatctgccaaaacaaaagttaaatcaaaaatgttaattcctgtcaccccagcacttcgggaggccaaagcaggaggattgcttgagcccaggagtccgagactggcctgggtaacatagcgagacctcgtctctacattaaaatttaaaaattagctggatgtgctggcatgcactcatagtcccagctgctcaggaggctaaggcgggaggattgcttgagtctgggaggtcgaggctgcagtgagccactgcactccagcgagtgatggagtgagaccctgtctcag

SEQ ID NO: 269236 - DNA, 416 bp, Homo sapiens
tacaaataagagtgatctttacatttaaaaagagttttacaaagaagaggaatagtgtgcaacagagactgtatgttgctcccaaagcctaaaatatttaccatctagtcctttagaaaaaaaaaaaaatcaaacaaacttgccaacccctaacatagaacgggtgagagagtagtaaatctttgtcatcttcatctactgagattttgttacctcagcataacctagtgttaacctgactgatacaccaggggaagagggaaggaaaaccatggtgagcagagggcacaaaggcaaaacagcagtatctattcaaggcaatggaagggattcagggtgattcaagggtggggttcaaatggactaacaatgtgaagtaagacaaaaaaaaaaaggcaaggactggattagctgga

SEQ ID NO: 269237 - DNA, 359 bp, Homo sapiens
tacaaataagagtgatctttacatttaaaaagagttttacaaagaagaggaatagtgtgcaacagagactgtatgttgctcccaaagcctaaaatatttaccatctagtcctttagaataaatctttgtcatcttcatctactgagattttgttacctcagcataacctagtgttaacctgactgatacaccaggggaagagggaaggaaaaccatggtgagcagagggcacaaaggcaaaacagcagtatctattcaaggcaatggaagggattcagggtgattcaagggtggggttcaaatggactaacaatgtgaagtaagacaaaaaaaaaaaggcaaggactggattagctgga

SEQ ID NO: 269238 - DNA, 426 bp, Homo sapiens
ttgagccattctttggacttttctactcgtttaggtcatgataatacagttgcattggaatggggtgaaattatgggattatagagcatttcaaacctggctgtgaataatgtctgtacatataggagagtgataagtcactgtaacttcactgagccacagtttcctcatctattaaaatgaaataattaaatattaattattaaaacagcataattcttggcaagtaattaataagtactcaattgatagtagctatggtttttactatttttttcatagacaaataatatcaaagctgctttacctttcaaagttagaaaccaaactatataaaaataattttatacccacaataggttttctgatataacaaattgtatgccacttttaaattttgaaataaatcattttgttttccattga

SEQ ID NO: 269239 - DNA, 569 bp, Homo sapiens
tctccgtccgtgttagttattaagaagaaagcactagtggttgctagcaacaggtctctatagaggacaaggtaccagaggaaaaagcctcctttgactgaatatagaggtgggagggtaggaaaggtgggggtcaaagacctctgaatagcaggccagctatagggaatggttggtttgtcctccaagaccagccctttccccaggccttagcaaactccgcctttacaaccctcaggattggtggtaggaggaaggccttaggcactcctccattcctgccaggaggagggaacctggtttccatagcaacccagaaacaatcctggccttgttttgcttatggcttctctgtaaccccctcttgggacacacactatcatagactcccttctctgaccctcaacttctgatttgagggagagagcccatagaaaggttggggggtagtgccacaaaagctggtctcacttggtcctaaagtgacctattaagactacaaaggaggggtgacttaggggtaaggtcctccaggtatcctctgacctctgcatcttataaggggctgt

SEQ ID NO: 269240 - DNA, 375 bp, Homo sapiens
gaaatattttaaaaaataattcaataaatacatttgattacatacaaagtaggactggggtggttttattttttgctttactttttaacagctttgttaaggtatatgataaactgcacatattatatgacatatgataaactgcacatatttaaatatgtatgatttgataagttttaacatatgtatacacctgtgaaaccatctccatgatccaaatggtgaatatagtcaccacctctgaaagtttttatgtactccttggtaatccatgcctcttgctcctccccccaccatcctaggaaccacaatttttttgtcactatagatgagtttgcatttattttctagaattgtatttaagtggaatcatgc

SEQ ID NO: 269241 - DNA, 455 bp, Homo sapiens
atccctgaggctgcggagtactcctcacgacaagaacgaccctcgggtgagagagcagcccagggtcacgcaggccgacctgtcctcgagatctcggatggcggcacgacttttggggagacccacccaaccaacaccatccgggcaggcctgaggctgggatcctgtgctgcttccgccgtacccccctggggcttcctcatcctggtcggccctttgtgactcctggaatccggagacgttcacgtcgaccccgtggagaggtcaggccggagcctcacagccccgacacccaagcactgccacggagggctcctgctttgccaagcctcggggactggtttctaagacaaccgaaggaaccactgtgaagggagaagccactagagcctcgcgcatgcgcattggctgggacgactcgcgctcagctcctggcagtcaggctacgtcccctt

SEQ ID NO: 269242 - DNA, 397 bp, Homo sapiens
tttaaaaactgcattacacaaggtattgtaagcaaagttcaacagcaaggggtaaattagaagaatttataattcagagatagacacaaccaaatgtcctatgtatataaggatctcttaaaaatctccaaaaacaggccggatgcagtggctcacaactgtaatcctagcactttgggaggctgaggcaggcagatcacttgagaccaggagttcgagaccagcctgacaatcatggtgaaaccttatctctagtaaaaatacaaaaaaaaattagccaggcattgtggtacatgcctgtaatcttagttacttcagaggctgaggtgggacaactgcttgaacctgggaggtggaggtggcagtgagctgagatcaccaactgcacactccagcc

SEQ ID NO: 269243 - DNA, 186 bp, Homo sapiens
taaattttttttggctccactcttccaatttcaataaacttggtgaagaagaatatagaataaaagttgaaagccaggtgcagtaactcatgcctgtaatcccagcactttgggaggctgaggccggcagatcacttgaggtcaggagttcaagaccagcctggcaaatatggtgaaaccctatcc

SEQ ID NO: 269244 - DNA, 419 bp, Homo sapiens
ctgaagtacctaaagttaactcaggaattctgttctctgccactctatcaaataaaataaaaatttatcttgattagacaaaatcaaacctaacctaaaacagaattaccttccccaggaagggggaatactacttatactacaaattaattggagaaagcaggatgcaaaattgtttattcagtgtgatctcaaatgtgtaaaataatatttgctggaagaatgaagtacggcaagatgttaacagtttttacttctgggtgatgcaatcatgtatgatttgtattttcttatctattctgtgtttgccaaattttctaaactatcttttatgattcttaaatcttttatgatttaagaattatatgtatccactatttaattttttaattgctacataatatagatattttcgtggt

SEQ ID NO: 269245 - DNA, 786 bp, Homo sapiens
ctaaggaaattgatctgttaatgaaagttggcttgcttgacttcagaatatctgtattattcaatgatgtgtttttctggttgctttgtttgagcatagtgtaaatatcacccattgcatagctatggcagtgacataaatctagcagcgtaagatcgagaaaagctagaagtcccaccacagattgtatttcagtgaaagggattcattttaactgcttataaaactaaagaaaacttataaacatggaaaacaattattaaacccaccatatgctcatactgatattaaatggtgtgccagattctagaaagagttaccttttggtaagagcactgcttgttaactatggttggttgctttagatgtctagtgtgtacacaaaagcatgaattttattccttataaccaaagtagaaacctactctgagcaatttgacaaaaggtttacattatttattttagtgtagtttaagattacagtaagatgcaattcccaaagagtgaaatataaggctgggcatggtggatcacgcctgtaatcctaacactttgggaggctgaggcaggtgcatcacctgagatcaggagttcgagaccagcctggccaacatgacgaaaccccatctctactaaaaatacaacaattagccagatgtggtggtgcccacctgtaatcccagctactagggaggctgaggcaggagaatcccttgaacctgggggggtggaggctggagtgagctgagatcatgccattgcactccagcctgggcacactctcaa

SEQ ID NO: 269246 - DNA, 226 bp, Homo sapiens
cagctcatccttctccttaaaggaaatttctagttattcagatttaacctactcaaataaaaatgttattcttacaaatgtatgctttagtaattgtatcttttcaggatgaatagaagcaactcatacacaaatatctgtcagttaatgctgtcaaagactattctgggttggaaataccttgtcattaaaagtgaataggccaggaaaaagaaaagaaggtaga

SEQ ID NO: 269247 - DNA, 484 bp, Homo sapiens
  misc_feature (90)..(90): n is a, c, g, or t
gccaaacaggaaggatgttgtctcattagcacgaatttccaagatgtgaaagcatatctaccaacacttatcagcctaccagccaccccnaacttcccccaattttcatgcaaatgaagtgacagaaaaaaaaagttatgataccctgtgagtgttcacagccttttcccacccccaggggtgttcattctctcctagctcagttcctaggcttatgtatagggcagaaaaattaggggctgggcagcaggtagagggggtcttgaggtgccattgtcttgctctggaaaaggccaagatctggaaatggaggggttaggggtagagagagagaccaaagtctctgagcattggaggaggagattggaaaggggaaccttcatggtgtaggtaacaggagggttttgcttgcttgcttcccaacatcaccttttgtaacatcccagagttacaaaaggcaatgttgaaaactgggaaaagaata

SEQ ID NO: 269248 - DNA, 428 bp, Homo sapiens
caaaaagatttacacagaagagattttttaattatggtatattcattgaatggaacactactcagcaatagaaaaataaattgccactgttacatgcaacaacacagatgaatgttaaaaaatagtacgttgaacaaaataagacaaatattaaaacatacctactgtatgatcccacttacataaagttttagaataggcaacttaaacctattgtgaaaaagagaatatgaacagcagttacctgggtgcaggcaagaggggattattaacagagaaagcacacaaggaaactttctaggtgatggaaatgttctataacttgagagacgtgtggatgagacagatacaaccatttgtcaaaagtgcatagttaaggtttgtatctttcaatgtatgtaaattttaccttacaaaaagccataaaa

SEQ ID NO: 269249 - DNA, 394 bp, Homo sapiens
gagatgcggtttccctcatgtcacccagcctggaatgcagtggcgcgatctcggctcattgcaacctccgcctcctgggttcaagcgattctcctgcctcagcctcccgagtatctgggattacagccatgcgcctccacacccagctaatttttgtattttcagtagagacggagtttcaccatgttggccaggctggtctcgaactcctgacctcaagtgatctgcccaccttggcctcccaaggtgttgggattacaggagtgagccaccgcacccggccaattcatactattctttatcatgttgttatgaagatgaaatgggaagctgcatgtgaaattcttggcacagtgctcacttagcatgcaataataccttttatcattactct

SEQ ID NO: 269250 - DNA, 543 bp, Homo sapiens
tgagggttccccacctgtgagacaaggaaatacctcgagtgtaatagagcctatcaacacatggactaactttgagaaagcacctagttcagggcctggcacatgggaaggcatctgataaatatgtgttcttttattcactgatatattccaaaaaatgtgttattttaacaaggaattagttttttaattctttcactgaaaaaggaaaaagcagtaaatgattttgttaaatgtcattggcaacttaatcagaaactaatccaaacaactttaggccttctagattaaagcatttgtcccttactagttacatttacctattaaaattgacttaagaattttggttatgagcagcaggagtctcacataaactgacagcacaacttggagacaatgtttaatattttatatctcatgttttacaaacttttagagcagaagtctgtgttaaatcactttagagatgacttgcacaattctgcttgtgtgtgtgtgtgtgtgtgtatatatgcatgccagagagaaaggaggaaaaaaaaa

SEQ ID NO: 269251 - DNA, 245 bp, Homo sapiens
gatcggccaagttcacccccaatggcagcagcttcagcatttcctggcaatctcctccggtcactttcacaggcatcccagacctcacaaaagcttcttattgtcaaccactggcatctcccggaggtttccagcaaagtctaacgccttctgtggaactgataaaaatgaaagtggctgaatgaattgtgctgtgctctgttgatgaatatttattaaattccatagaggaatagccaagaata

SEQ ID NO: 269252 - DNA, 643 bp, Homo sapiens
cttgtctcccagccatctcatttccaacgggaagggtctgaccttatacaatactttagaagtatttcaggtgtcatgtagggaaactaaactctatagcctcatcattcagacagcagacaccatttaggaaatattaggaattgcaaagaagctaaatttttaaaagaaggcttcttgcattttgtttcatcaagaaccttagtgaaatttcaaaagcaatggggtttacaatcacaaggctctggataaccatttggtgataaattgcaggtattctaatttggaggaagctcttctttcccagacaactctgtctcatcttaacattagcactagtctgaaggtgtatagtttctgaaaggcatggactacggcctttttctttcaaactttgtattcaaatgcttagcacttgagactataaacctagtatttataaatcggtaacttgttgctttattaattggtgagaatgtccacaaaagtgtgaatttgtagcaggttcatgagcaaagtggtaataggctgcatgtttattttattttattattattattattatttttgagacagagtctcgctctgtcgcccagactggagtgcagtggtgcgatctcggctcactgcaagccgcctcaag

SEQ ID NO: 269253 - DNA, 438 bp, Homo sapiens
gcaatgaggatcgaggcttggaggcggatccacattttgtgggacacgaacgttattcaatctggggggccttaagaaaaataatacaaaatgacaaggacagagccttggaagggtccatgcaagtgaggggccctgagatgacagtttcattagtatcagattcgggccaaatctgcctctgcagaagcccattattcattcaactgcagataaagatgctgacgatactatatttcatcaattctaagaaatacattttaacatctctgaagtaggatcaatggcaccttatgacttctgtgggctaaggcagtcaggtgcaatcgtcaatgcgcacaccaacatcgtggcagcatcaagacttgcagaatgggcatccacggcttggaagaaactccctaagacaggaatggtgcacgtttttaactcatggaa

SEQ ID NO: 269254 - DNA, 470 bp, Homo sapiens
tgccagccaccagtccctgtcactgtgcatctttgccaagctaatgtgctccctggaggatgggaccagcacagagtcagtaatgacacttcacctccctgaaggcaggagccaggttaaaggggcatgttggagtgatcttaaatgacagctgtgactgtgacaggaaccccctgtgtttatgatttgagattttatgtaactgcacttgaaatattcatgtgtgtggattttgtatatgcatgggtagttgcatgttgtctccagtgcatgtacataatctgtgtcatgtattacatgtgttctatatgggggcaagaacaggttacacgttatatgtgatatactaatgtatgagttacatattgtacagtttgggtgttacagtttttgggtttatgggctacatgtcagtattatggctgctgtattgttataatttatctgttgtatattgtatttaacttgca

SEQ ID NO: 269255 - DNA, 409 bp, Homo sapiens
cccacttctctccctgtctggagattatttctatgataagaaattaattagcctgtctgtactacctgttccaggagactttgaacaactgcgtgggtaaacactagatgtggtcaccaaagagtcggaaaataagtttttactttttcattagcaaaagttaattgtcaaccaggagatgtaacaggcttgctccatttctgctgccgcttcttggatttctttcttgcatgtggagaatttcctgaggtttcaccagactgaagagattctgagttcttgaagtgatggagataaagatcttgttgtcataaaacagcaaagagcactgtgattgggtttgaaagatttttgattgtgttatggacagtgctcttactggtttttaaaaagttgatgttttcttctg

SEQ ID NO: 269256 - DNA, 470 bp, Homo sapiens
tatctgcgccagccagagaccacctgggcaagaagcgtgacccagacatcgaggagggtgaagcctcgctgggccgccccgcaaccccaggaagccccggaccagcgagaggctcccgggcggtctcttgccgacaccccggcacgggctcacccgcgcgctcacactccgcccgctccccgctaagggactgggttcgctccaaaggcagaggaaacctatgggctccccggctcgtgtctcccgactcgtgtctcttgcctccgcttcccagctttcccgaccctgcccggacggggtttcggggttccctgctcgggccccgcgcgctcccctcccacaggctggctgggctccgggcgcggcgggaggcagcggggacgtgagaccggggtcgccccacacgccctccgcgcccctcgggccgcggcccctgcgcaacggccccccgtgcccgaccacgcggccgc

SEQ ID NO: 269257 - DNA, 389 bp, Homo sapiens
ccaacatgaattttttttcctttttttttaaaaaaaaaaaaaaagaaatatctagttgttgtcttttgggacactaagaaacaacagctgtagatcacacgtgaagaacaataacaaaatcaaaaagtaaataaatttatatcctgtactcttgagatgatgtgaaggactaggaagaggggaaaatgaatcctgatgtaaaaaaacaagatctcgcagtaaattcctaaaggcttgcaagagaaagtggggaataaaaaagtcaagggtggccggtcgcggcggctcacgcctgtaatcccagcactttgggagatcaaggcgggtggatcaaccgaggtcagaagttcgagaccagcctcgccaacatgatgaaaccccgcctctac

SEQ ID NO: 269258 - DNA, 708 bp, Homo sapiens
ttcaagatggtgctgtgcagtagtagcttgggtcatgggatgggaggagccacagtatgggctcttactctagaataatgcagccatatgaactccaggcagcttccaaaactggacttaggtcctgtgagaactgcaggattctccagcaacaaagactgctggtgtccacagatataatgggggcttctggggacttctttaccttttgttttcagggaaaagcccctcctaggcttgaatcccagcctgcattccaagctgatcctgactgaggagacagagttgcagaggcaggttgcagggttccattcccttctttatgtagccatcctgagtttctgtgatccacaagatttctgccattcccctgctgtacttcagtgctctcctttagacactccagtcaaaatgtagttgtttccttattgtttcagtctttttttaggcggggaggaggatgagtaatagacacctctagtcagccatcttgccgacatcaccgacaatgtcttttctcttaaaataatagaaatatggcttccatttactacacaagttttctgtctccctttataaagttttcagtgcaccaggtgtggtggctcatgctataatctcagcactttgggaggttgaggcgggaggatcgcttgacatcaggtgtttcagaccagcctgggcaacatagcaaaatcttgtctctac

SEQ ID NO: 269259 - DNA, 634 bp, Homo sapiens
  misc_feature (552)..(552): n is a, c, g, or t
ggcctaaatgcctttttatttattgccctgcctagctccaagagctgtgctactggtcagtcttctggggaccacagttttccaaggaaagacagtgactctaagatattccatgcctcaggacaaagcaaatattctggtactatggatggaactgatgtttaaaagtttccaaaaacaaaaaaacacatttcagccgaaaagctgaattcctagtaattcaccctttagtaatccaaagcaattgtcattttcatctggtaaggaaagaataaagttttgtcttagggaaagtataatatttttcaaggggcagaggctctgagggttggataaacaaatgcccacacagcccatagctattaggggttgtgacatttttatgggctgctgcaagttggggagacgaggagagagcagagcacaattttatcatcttatcaccacacctggcctaaatgcctttttatttattgccctgcctagctccaagagctgtgctactggtcagtcttctggggaccacagttttccaaggaaagacagtgactntaagatattccatgcctcaggacaaagcaaatattctggtactatggatggaactgatgtttaaagagtttccaaaaaaaaa

SEQ ID NO: 269260 - DNA, 473 bp, Homo sapiens
ggcctaaatgcctttttatttattgccctgcctagctccaagagctgtgctactggtcagtcttctggggaccacagttttccaaggaaagacagtgactctaagatattccatgcctcaggacaaagcaaatattctggtactatggatggaactgatgtttaaaagtttccaaaaacaaaaaaacacatttcagccgaaaagctgaattcctagtaattcaccctttagtaatccaaagcaattgtcattttcatctggtaaggaaagaataaagttttgtcttagggaaagtataatatttttcaaggggcagaggctctgagggttggataaacaaatgcccacacagcccatagctattaggggttgtgacatttttatgggctgctgcaagttggggagacgaggagagagcagagcacaattttatcatcttatcaccagaaaagagccccaggccgggagtggtg

SEQ ID NO: 269261 - DNA, 488 bp, Homo sapiens
  misc_feature (16)..(16): n is a, c, g, or t
  misc_feature (53)..(53): n is a, c, g, or t
ccggatgactgctggntaagactgaagacacctgtcatacaaggtatggagantcgcttgactacactgtgtggagcagtcaagagcaaggactcagaattcatgattgagaatgcaggcgacctgttatcctaaactagggtttttaatgaccacaacaagcagctgcgcttatgcttgaaggctggagtgcagtggtgtaacctcggctcactgcaatctccacctcctgggttcaagtgattctcctgcctcagcctcctgagtagctgggactacaggtatgtgccaccacacccagctaatttttgtatttttagtagagatggggtttcaccatgttggccaggatggtctcagtctcttgaccttgtgatctgtctgcctcagcctcccaaagtgctgggattataggcgtgagccactgtacccggcctcattttataattattagtttattaaaacttttatgtgtatgattagaactt

SEQ ID NO: 269262 - DNA, 527 bp, Homo sapiens
aacatttcacagccccatgatagaattcctgccgatgtggagctcggccaaggcagcgaacggcatcaaaactccaaacacttttagtccctaggaagaccctcggttaagatttctccccagagtgcccgggccctttagtcctacaaaaccaaggaaagggaggcagcatagctgcatccgccaggggatgcccaccacccacctgtcccccggctctgctccagcatccgtctgtcctctttagtgccatatttcaccctcagccccagtgcaggtgcccgcagccaagcccacaccagctctggggcacgcctgttccagttgcatttggatacttttgcaggtgtgagagttgggtgctaaacgttgggaggtttgtttatattaaaatatagaggtaggtggggcacagtggctcacatctgtaatcccaacactttgagaggccaagacagaaggatcacttgaggccaggaatttaagagcaggttggacaacatagtgagattccccatctctacaaa

SEQ ID NO: 269263 - DNA, 455 bp, Homo sapiens
gctatcacatactttatgagattgaaatagaaatataattgtatcacttttatgcttccaattatccatttagcccttcccatataattttattagcagtcctcaagatcaaaaattgttcccaaatactagagcttactttgaccatatgatacggtttagctgtgtccccacacaaatctcaccttgaattgtagttcccataatctcaacatctgtttggagggatctgattggaggtaattgaatcatggaagcagttactcccatgatgttctcaagaatgtgaatgagttctcataaaatccaatggatttataaggtgatttccctcctgtgcttggcacttttctctcctgctaccatgtgaagaaggatgtgtctgcttccctttcagccatgactgtaagtttcctgaggcctccccagccatgctgaactataagtcacttaaa

SEQ ID NO: 269264 - DNA, 510 bp, Homo sapiens
gcttatttaaataaaaattgacttggagtttcaccttcaggtagcactataaatttgaactccttaagatgtttttcatgctctaaaattctaatccctaaggtaaatatctaagatgctaggaacaatttaaatataattttactgtacctgcgtttctgttaagcagatcatagatcgtagagctttaggataacttctttgttcctcttaaaaccctgaggggtggagtgggggatgtgtaagtgagcagtgtgcctaatcttccttcctctctctcaagtgatcactcaatttttgaattgctattggttgtaatagggccaagataacagctacttgcatttgtattcattttggttcacatttatgagcaggtttgctactatgtttgtggcacctttccctgtgaaacttttgttaataggatattcctcttcacttatctttaaaatgaataaatgagagaaatacaagtccttggagatagaatttatggtaaaaaaaaaa

SEQ ID NO: 269265 - DNA, 233 bp, Homo sapiens
gtcagcgccaaaacgccaggacttcagtgggaaaatgttcaaagttgtttgttcctccagagtttttctcgggaaaaaaaaaaaaaaaaactcttgagtgcttgagtgaggatctggcttagctctttgacctgtaagatgctttgaacatctcaatttttatttctaatgaagggaggtgtttgtagaggtaattgcctgcaaattaaaatgtcaccaattttagtcacaaa

SEQ ID NO: 269266 - DNA, 449 bp, Homo sapiens
ctctttcctcctgcagaatctctcttctggtccacactctgggaggtagacgggactaagcagaaggtcacttccccagtgcaagaaaatgtactactccactctcacattctacctttggtttgagcaaaggccacattttgcaagcccgtttgctgcccagttaatctgtcagggtgaactttctctcaccctctgctgacacctctgccacccagccccatctcctttgagagggggaacccccccaccatggagctttgtgttttcctccacttcctccttttagcagggtaagcctccacacttctgcccaggctgttgggcccaccatctcctcttttaacacagcttccgaagtgctggggatggagagggtgtcaatgtggcaaacgttcctttgcccactgatgagaagtttcagcccttcccaagacatgtctggaaat

SEQ ID NO: 269267 - DNA, 375 bp, Homo sapiens
agcaccacatgttctgcaaaacattagcaattatcattattacttttctgctccaagtcaaattaggccagagtttacactcactcgagaatgatgagtctgaagaggtatctagagtaggaattgaaatgtaaaaatcagagtagtagagagagagaatggaggcaaggctttaagagattaagtaaaagaggtttggaaaaacaaaatcttgattataaaaagtaaaatagaaaggatggatatgaaagactttatgaatgagtcatcatctattttatttatcttcttttaaaaaattcttacatggcaccacctgcttctgtcacacttcacacccccaggcccaaactaccttctctgagccctttcttt

SEQ ID NO: 269268 - DNA, 289 bp, Homo sapiens
cggggttcttccccgggggcccaaggaaggagaggcaggactgcgggattgagtccaggtggggcgcgagggttgagaggcgcaccagagcaagtggacaggcaggagaggtcctcaatattttggtggaaaatagaaaccaacctacccaccttccttccctccttccctccctccctccctcccttccttccttccaccgtttattaaacaactgtttgcctgacactgttctagatgttggggatgtagcatgcaataaaagacactgtctcttagagtccagcca

SEQ ID NO: 269269 - DNA, 730 bp, Homo sapiens
gtgatgaatgggccattacaaaatgagtctatttttgtttgttttcttttgtttttgagactgagtcttgctctgtcgccaggctgaagtgtagtggcgcgatcttggctcactgcaacctccacctcccgggttcaagtaatccccctgccttagcctcctacaggcgcgtgccgacatgcctggctaattttttgtattttagtagagacggggtttcattgtactggccaggatggtcttgatttcctgaccttgtgatccaccccaccttggcctcccaaggtgctgagattacaggagtgagccactgcgaccggcccatgagtctttattaatagagatttcttactggtgttatgtggcagattctgcatattcctcacccatcatatgtattccactttcctttattatggggaaaactactctttttggcatgatacaatgttgactccattttctttgctaataaggacttggtatcaatttatcagtatgtaaagtttaccatagagtattgtctcatgtgaatcattcccattttttgctctttactctttgtcgttatttctgagtattatttggatggttcattttgacttaaggatagccctgtgatatgacaatatttttatctaatctgatggagaaagcatttagtctcctgatcaagtatgatgttagctgcaggtttttaataaatgccttaattcagtttgaagaagtt

SEQ ID NO: 269270 - DNA, 357 bp, Homo sapiens
caaaaccacacagtgtgcaggcagcagaggcagaggtcaacttcaagttttcagaatctaagtagaatattcttcctaccatgttctgctctacatacacctcccctgtagccttttgttttgttttgttttgttttgtttattctcctggatcttcaatgaataccccccactttttttcatttctgggccaggtttccattattttcccttctgtgcattccactttcctcagaactttcaggtatggccacccctataaatattttcatttcttcataatacagaaccaagtgcataagggttgaaaatctatattaagttcataggaaaaacaatcccacgccaaaacatttt

SEQ ID NO: 269271 - DNA, 451 bp, Homo sapiens
tggtgatgtgaatcctccgtgattgcacatccattcataggctctttgcagggggaagcacatcacacgctgttggctcgttctggcagtccaacctggcattgtctttacacaatcctgcatgcaattttgtatttacaataatcaggagcatttcatcttttattccgtagcaatagtttcagggggtctccctacacatggggattattacaattcaaggtaagattttggcagggacacacctggccaacatggcgaaaccccatctctactaaaaatacaaaaattagccaggtgtggtggcacatgcctgtaatcgcagctacttgggaggctgaggcaggagaatcacttgaacctgggaggcggagattgcagtgagccaagatcgcaccattgcactccagcctgggcaacaagagcagaagagcagaactctgtctcaaaa

SEQ ID NO: 269272 - DNA, 424 bp, Homo sapiens
attattttaaaaaaatcttctccctcattgtatgttaaaccgccagagggaagggattgtgtgcttggttccccggtatttacacagtgcctcgcacataagtatgctcagtgaatattttaaaaatgaattagaggcggggagcggcgcctcatgcctgtaattccagcattttgggaggccgaggcggccagatcacctgaggtaaggagtttgagaccagcctggccaacatggggaaaccctgtctctactaaaaatataaaagaacattaactgggcatggttgcgcacacctgtaatcccagctactcgggaggctgaagcaggagaatggcgtgaacccgggaggcggaggttgcggtgagctgagatcgcgccactgcactccagcctgggtgacagagcgagactccgtctcaaa

SEQ ID NO: 269273 - DNA, 466 bp, Homo sapiens
taaacaaaacaacaaaacgttaagtttcattgagccattcctctgaattactgagcaagtgccctactcactgtgtagtggaaactttggccagctgagaaggcagctaacccttttcaggccagtaggataaaggttggataaggaaataatcaagtcaaagacttaatctacctccccaaggaacctatattatgagttaagacagttttcttatctggattggatccattgagtctaaatgagaataacatggttctaattatgacaagcatagtaattttctcacatccattacattttagatttgagactttgattggtgagtggccatttttaaatattctgttaggccaggtgtgatggtcacgcctttaatcccaggactttgggaagccaaggtgggaggatcgcttgagcccaggagtttgagaacagcctgggaaacatagcaagaccttgactc

SEQ ID NO: 269274 - DNA, 493 bp, Homo sapiens
actaaaatcatcaatatataattcttaatagaactcctagtttagtttactctttgtagttcactttaggaaacactagtaagtttctatctctatgtagtcaactgattatacaggttgtttctgttgagtgcctcccatatctcaggaactttttgtgagaactttacatgaattaactcatttaaacatctgcgtaagtaagtatagtttccttaagcaccaactgaaagccagtggtactgtccaccacattctggatgaggggctccatgaagcacatgggtctaaaaacagctcattgaccttcacctcataagttcttagaatatttcccagagcttaactatttttatcatcttcctcctcctcactgtcatctcataagtcaatagtaggatactttatcatctgtatttcaacagaaatgcaaacttttctggcattaatgtccattacaagaaaataaatgcttttcctatagattttcaga

SEQ ID NO: 269275 - DNA, 1295 bp, Homo sapiens
tggtctagatccatctgtaccaacaagttcatcactttacagaacgaatctttttatccgtacaggaggttcaaaccatgtctgcctcttcctttgtaatgaatgacctttctatgagctgtgacaaaatttccgaacaattagctaaggatttgggaagagggggtggcaaacggggctttctgttttcctgcctcagcatgaaaacatctgatttatgctttatggaagccttacctccaatccccaactgttaagtcccatgaaaccacagttgctctgggctgatggaaacaaaaggaaacagtatgaagagttccttaatcatttttgaaacaaaaatgttaagggattttaaacatatgattatttttaattttatgccttttcagtactaaacacccatttcattgctgattcctgtctaagaagccattcacgtcagcatggcgatagaaagaatgaaaaaaccctgctgaatcatacagtaattttctttaaagcacatagtagttacataaatatatatatataaatatatttttgtttataactaacacaaggcaggatcttgtgactctaagagtgcgttttgtcatcaagacaaaacagatgcaagatgcatcactgcattacttccatagagttgtaaaataatccttaatattagaatatttttctgtcacttagcaaaagtggttcagttcattgccgcgcccatcatgttcttgactatttgatccactttttcgtttatgtcaaccccttccctctctggctaaataaagtggatgcagaaagctccttaaatggagatatcgattgccttggaatcacaatcctgattttgaaaattcctcatgaatgaagaaaggaatggcatcccttgagaaggaaagtggttaatatacatactgagctcctaaagtttaaattcaggtactgagtgtacaatttcaccaacattctaacccatgaaacttttacactctgtgccaagaaactgttggcttttgtaaggtacagtgctcaacatttgcagattcaggtctcaagaagcagagatgtctcataagcagcattttcccaacagtttagcatctgtacacatctgccttggtcatcagtccactcacagagtaccatactttatcatcacaagtgtctgacgtgaacgaatgccattttctattccatatattttgctttacaattttaagtatttgatgaagatggtaactttttcctaacttagttaactattaaaaaaaattttgaaaagcaaaaaaattgaa

SEQ ID NO: 269276 - DNA, 620 bp, Homo sapiens
gagaccaaaagattcaaatctcctctttgtgaaatcccagctgcatttcattttttattattttatgttcccctcaatagattgttttaagtgtttacttttcatcttttatagatgtaatctgattttcaaaaatcgataacagtttttaattagtattgactaagactttttccccctggaatcgaggctctgtgtccgtcatcccagcccccagttggagactgctctttgaactctgctgccctcctcagcagcttctgtcctcttctgtgagtcagtcagcaagttcttgggatccgcatccagccgtgctgagcacacaacaggctgtgtatggaaatggccaccatcattctccttcccgaccccaccacaaaaagagaagctgtgtctttagacaaccctgagctgtctgtgttacaatcattctgtgtttgacatttgtgtaaagtaatgcatgcaatcttgtactgtggcctaagaacaaaactgtaactgcatttgaaaccatgaaaaaattagatattgttttgtgacttttagacagtgataaatgtagaaccatgaattctggacacattccatttctctccaacatgaaggatcaaaaaatgttt

SEQ ID NO: 269277 - DNA, 478 bp, Homo sapiens
caaaacaaaacaaaaaaaacccctctggctttggaagactttctcagtaatgtcctggaattaaggttacagcctgcatttcatgttaactgaacagaaaaccagcctccaacatccttctgccccgtggcttgctctcagctcctcttggttgggcctagggcagtcagactgtctggttccaatccttgctctgccacctgtgactttggacaagttacctaccttcagttgcctcatccgtaaaatgcagatattaataataccctcttttaaagttattaagaggattgaaagagctaataaaaagtaaaaaataaaaagacttggtaagcataggcacagagggaaacaaaaaaagtaaaaataagtaaataaaaagactagtgcctagcacataaaagttcatcaggaattaattttataacatgaactcaattttgcaaaacttcaaagtacatataacttttactatggt

SEQ ID NO: 269278 - DNA, 501 bp, Homo sapiens
ctcttttttagaaataggagggaaaggtagagtggaaattgatttcttgcagagactgaggcgctgaatgatagagggaataaacatttgccctggataaaaatgttcttggctgttgtccagctctaatgatgtcctagagcagaagtgtttcttctgatgtctcattttaacaagaggatgatgtctgtgtatgtctctgtgttttagagaggctggcaaatgctgctaagaggatctgaggttcacataaagaggatgaaaattctgaattactttcattgcaaataaaccttaacaattgtgagagttagagagcatacttttcacataagactttggtatgctgcctaaagctacttacataatttgctattcagagaaatgcatttgtttattgaggacccacccggacttaaattggaaaaatgtaacattcagatttttattttatatgtgaaataaatgtgtgattgctgttcttaaaaatttgaaaaaaaa

SEQ ID NO: 269279 - DNA, 514 bp, Homo sapiens
taaggatccaaaaggatctgcaggatgcctcaggcctgcctagtcatcgtaggggtgagaaattctacactgaataagactggttgggactcaaagaagctacaaggatgcacttttccagcacaaacatgttctaggttggatgatcaaatgcatatgcctagcaattgaaatctccaactaggaacaaaaaactaatcacaaaaagcaaaggattcactttggtgttcacagtaggagcaacagcagcatcttgtttgcagttctggtagcagcagcagctgcaatggcttcagccatatcaaatatcctgtggcacagagggcttcgaggttaagagatacaaatttgcttaccgcatgaactttgcagtttgatttttactttgatttggtcaccttgctttctttgctcttgattgttttctagccctacttctgtgactacattaaataattctttagctaataataatccttccaataaattcactcttctgcttgaatgattcaca

SEQ ID NO: 269280 - DNA, 773 bp, Homo sapiens
gcggaggaggccgagtcgctaggcgctttcgggggcgctgtgccggtgaggcttaggcaaggggacggggaaccgtggttagatgcagcagcggcgcagcagccctcccaggtcccacttctttggcgttcctgctgcctgtgactcaagacaattgacttccacctgaaccctcagctccgaacgccttgcattagaagctagagctttggaggttctgaggacggtccctggggagcaagtggtaggtttcgaggcgcccgcttcccctctgattcctgcagtaactgagagagagtgtgccagaaatggctttgctgccgaatgcattatcttgccattttcgtgtcccaatactgaacaaacgatcgcctgatcgatcggctgttgtccagctctaatgatgtcctagagcagaagtgtttcttctgatgtctcattttaacaagaggatgatgtctgtgtatgtctctgtgttttagagaggctggcaaatgctgctaagaggatctgaggttcacataaagaggatgaaaattctgaattactttcattgcaaataaaccttaacaattgtgagagttagagagcatacttttcacataagactttggtatgctgcctaaagctacttacataatttgctattcagagaaatgcatttgtttattgaggacccacccggacttaaattggaaaaatgtaacattcagatttttattttatatgtgaaataaatgtgtgattgctgttcttaaaaatttgaaaaaaaa

SEQ ID NO: 269281 - DNA, 654 bp, Homo sapiens
gcggaggaggccgagtcgctaggcgctttcgggggcgctgtgccggtgaggcttaggcaaggggacggggaaccgtggttagatgcagcagcggcgcagcagccctcccaggtcccacttctttggcgttcctgctgcctgtgactcaagacaattgacttccacctgaaccctcagctccgaacgccttgcattagaagctagagctttggaggttctgaggacggtccctggggagcaagtggtaggtttcgaggcgcccgcttcccctctgattcctgcagtaactgagagagagtgtgccagaaatggctttgctgccgaatgcattatcttgccattttcgtgtcccaatactgaacaaacgatcgcctgatcgatcggtaagattagctttattccttctccctattcctctccttggccccattccctctgcaagtccaaaccccagtctctctctctctctctctctccctccctctctctctctctctctctctctccaggaacttcttcctctttgaaaccggtttcccaagggaactgcctgtgtgactgagaggctagtaatctgtttgtagatgatttatattttggctgcagaatgaatccccctccctactcggagtactctccttagagatgatcccc

SEQ ID NO: 269282 - DNA, 477 bp, Homo sapiens
agtgtgtgaagaccagctttgtcaacttcttatgattaagtatatatccctggaatcaagatctcagagaatatgccctacatactgaaaattttcaccatggcactgcagacagttgagtgtacatgagagaaaggcattgacgtcgcacagagttgatgaccttcagaaagcaagaaaacaacagaaacatgggtgaggattggattcattcaagaaagagttcctacttgagggtgaagggtgggaggagggtgagaatcacaaaactacctattgggtactgtgatcactacctgggtgacaaaataatttgtgcaccaaaccccagtgacacacgatttacacctgcaacaaacctttcgtgtacctcctgatccaaaaacaaaagttggaaggggggaaaaaaaagaactaggtatgttttatatgtatgccacagttttaatttaaaaaaatatatgcctactctaaact

SEQ ID NO: 269283 - DNA, 2713 bp, Homo sapiens
atgagtgccatcacagtggcccttctcagcctcttgtttatcaccagtgggaccattgaaaaccacaaagatttaggaggccattttttttcaaccacccaaagccctccagccacccagggctccacagctgcccaacgctccacagccacccagcattccacagccacccagagctccacagccactcaaacttctccagtgcctttaaccccagagtctcctctatttcagaacttcagtggctaccatattggtgttggacgagctgactgcacaggacaagtagcagatatcaatttgatgggctatggcaaatccggccagaatgcacagggcatcctcaccaggctatacagtcgtgccttcatcatggcagaacctgatgggtccaatcgaacagtgtttgtcagcatcgacataggcatggtatcacaaaggctcaggctggaggtcctgaacagactgcagagtaaatatggctccctgtacagaagagataatgtcatcctgagtggcactcacactcattcaggtcctgcaggatatttccagtataccgtgtttgtaattgccagtgaaggatttagcaatcaaacttttcagcacatggtcactggtatcttgaagagcattgacatagcacacacaaatatgaaaccaggcaaaatcttcatcaataaaggaaatgtggatggtgtgcagatcaacagaagtccgtattcttaccttcaaaatccgcagtcagagagagcaaggtatccttcaaatacagacaaggaaatgatagttttgaaaatggtagatttgaatggagatgacttgggccttatcagctggtttgccatccacccggtcagcatgaacaacagtaaccatcttgtaaacagtgacaatgtgggctatgcatcttacctgcttgagcaagagaagaacaaaggatatctacctggacaggggccatttgtagcagcctttgcttcatcaaacctaggagatgtgtcccccaacattcttggaccacgttgcatcaacacaggagagtcctgtgataacgccaatagcacttgtcccattggtgggcctagcatgtgcattgctaagggacctggacaggatatgtttgacagcacacaaattataggacgggccatgtatcagagagcaaaggaactctatgcctctgcctcccaggaggtaacaggaccactggcttcagcacaccagtgggtggatatgacagatgtgactgtctggctcaattccacacatgcatcaaaaacatgtaaaccagcattgggctacagttttgcggctggcactattgatggagttggaggcctcaattttacacaggggaaaacagaaggggatccattttgggacaccattcgggaccagatcctgggaaagccatctgaagaaattaaagaatgtcataaaccaaagcccatccttcttcacaccggagaactatcaaaacctcacccctggcatccagacattgttgatgttcagattattacccttgggtccttggccataactgccatccccggggagtttacgaccatgtctggacgaagacttcgagaggcagttcaagcagaatttgcatctcatgggatgcagaacatgactgttgttatttcaggtctatgcaacgtctatacacattacattaccacttatgaagaataccaggctcagcgatatgaggcagcatcgacaatttatggaccgcacgcattatctgcttacattcagctcttcagaaaccttgctaaggctattgctacggacacggtagccaacctgagcagaggtccagaacctccctttttcaaacaattaatagttccattaattcctagtattgtggatagagcaccaaaaggcagaactttcggggatgtcctgcagccagcaaaacctgaatacagagtgggggaagttgctgaagttatatttgtaggtgctaacccgaagaattcagtacaaaaccagacccatcagaccttcctcactgtggagaaatatgaggctacttcaacatcgtggcagatagtgtgtaatgatgcctcctgggagactcgtttttattggcacaagggactcctgggtctgagtaatgcaacagtggaatggcatattccagacactgcccagcctggaatctacagaataagatattttggacacaatcggaagcaggacattctgaagcctgctgtcatactttcatttgaaggcacttccccggcttttgaagttgtaactatttagtgaaaagttgatagatcatttaaagaacagctttactctctacacattatataagtgatttcaaatgaatgtgaactagtgaactaccatgttgacttctataatcgtccctgtttggggacagatagtttactgctaatggggtggaggggtgtgtgtgtgtgtgtgtgtgtgtgtgtgtgtgtgtagagagagagagagagagagagagagaggtttgtcccatatatcttgctccagcagccatatatcttgtggtctacagcctaaagcatgatttcccttgaagtcttggggttgtttaaaggagagtcccttcaatataaaacctctgaaatattagtgagaatggctcactaatgtgaacaatgtttaaattatttatttatatatagaattactgaatattagtactgggaaaatttat

SEQ ID NO: 269284 - DNA, 1060 bp, Homo sapiens
gagcggtccgacggtgtggaagcggacctgaggagtcgcaattgtgaacaggctcagcgatatgaggcagcatcgacaatttatggaccgcacgcattatctgcttacattcagctcttcagaaaccttgctaaggctattgctacggacacggtagccaacctgagcagaggtccagaacctccctttttcaaacaattaatagttccattaattcctagtattgtggatagagcaccaaaaggcagaactttcggggatgtcctgcagccagcaaaacctgaatacagagtgggggaagttgctgaagttatatttgtaggtgctaacccgaagaattcagtacaaaaccagacccatcagaccttcctcactgtggagaaatatgaggctacttcaacatcgtggcagatagtgtgtaatgatgcctcctgggagactcgtttttattggcacaagggactcctgggtctgagtaatgcaacagtggaatggcatattccagacactgcccagcctggaatctacagaataagatattttggacacaatcggaagcaggacattctgaagcctgctgtcatactttcatttgaaggcacttccccggcttttgaagttgtaactatttagtgaaaagttgatagatcatttaaagaacagctttactctctacacattatataagtgatttcaaatgaatgtgaactagtgaactaccatgttgacttctataatcgtccctgtttggggacagatagtttactgctaatggggtggaggggtgtgtgtgtgtgtgtgtgtgtgtgtgtgtgtgtgtagagagagagagagagagagagagagaggtttgtcccatatatcttgctccagcagccatatatcttgtggtctacagcctaaagcatgatttcccttgaagtcttggggttgtttaaaggagagtcccttcaatataaaacctctgaaatattagtgagaatggctcactaatgtgaacaatgtttaaattatttatttatatatagaattactgaatattagtactgggaaaatttat

SEQ ID NO: 269285 - DNA, 953 bp, Homo sapiens
gcgtgtaatttcgtgaccaggggctggtgttacgtgtactacggtatcggacctggagcctgacagtccagaacctccctttttcaaacaattaatagttccattaattcctagtattgtggatagagcaccaaaaggcagaactttcggggatgtcctgcagccagcaaaacctgaatacagagtgggggaagttgctgaagttatatttgtaggtgctaacccgaagaattcagtacaaaaccagacccatcagaccttcctcactgtggagaaatatgaggctacttcaacatcgtggcagatagtgtgtaatgatgcctcctgggagactcgtttttattggcacaagggactcctgggtctgagtaatgcaacagtggaatggcatattccagacactgcccagcctggaatctacagaataagatattttggacacaatcggaagcaggacattctgaagcctgctgtcatactttcatttgaaggcacttccccggcttttgaagttgtaactatttagtgaaaagttgatagatcatttaaagaacagctttactctctacacattatataagtgatttcaaatgaatgtgaactagtgaactaccatgttgacttctataatcgtccctgtttggggacagatagtttactgctaatggggtggaggggtgtgtgtgtgtgtgtgtgtgtgtgtgtgtgtgtgtagagagagagagagagagagagagagaggtttgtcccatatatcttgctccagcagccatatatcttgtggtctacagcctaaagcatgatttcccttgaagtcttggggttgtttaaaggagagtcccttcaatataaaacctctgaaatattagtgagaatggctcactaatgtgaacaatgtttaaattatttatttatatatagaattactgaatattagtactgggaaaatttat

SEQ ID NO: 269286 - DNA, 876 bp, Homo sapiens
  misc_feature (1)..(2): n is a, c, g, or t
  misc_feature (7)..(8): n is a, c, g, or t
nncacanncctggctttcccacaggcaccatagcatgtgtcatggggcaggagcgcttcaggggagtggctcggagacaggtgttatggccacttctgccacccccacccctttaagacactgaaacatgccggacagcagattcacaagtgaagagcaggaaacagggtttgaggatagtggttaaccatggctgcattcttctgggagcctttaaaaaatacccacgtctcatgtctgggcccaaccctataccagcatctgtggggtggggggcttcaggctggtgatgtgggggtggggagggagtggaaggtgcaggggggccaagattctgcatttctaacaagctcccaggtgaggcctcgctaccatacttggaccacgctcccagtgccaaagcccaggtgtcttcaggggttgtcatgatggctattaacttatgtgttgcttgccgcatcccaaaacgatttaaggtgactcacatcgaggtataagtgtttcatgagaacttctcaaggagagggaatagaatagatgatgacaacaaagcagcccaatatcatctacctttatctgttcgcaaaatctacacccatgaggtcgctcatgcctgtaaccccagcactttgggaggccaaagtgggtggatcacctgaggccaagagttcgagaccagcctggccaacatggcaaaacctcatctgtactaaaaatataaaaattatccgggcacgatgacgcgtgcctgtaatgccagttgctcgggaggctgaggcacaagaactgcttgaacctgggaggtagaggttgtggcgaactgagatcgcaccactgcactccagcctgggcaagagagtgagactatttctcaaa

SEQ ID NO: 269287 - DNA, 549 bp, Homo sapiens
aaggaaaattaatgtagattgtttaaaattaacgtgcatttcagttactctaaatttctgtttatttgtatttttccacgtgtatgggttttacaacaagcttcccaaagctttcagaattgttgtaagcatccctgaccaggaaataagactattgtgggttgtttgaaatgtctcaccacattatggatgctctttatattgagagatagtaaagaaggttgatgcgtaatagattttaaaacattttattaaacgagataagtggaaggaattagaatatatcttgtagtaaggatttctataacttctaagaagtctgatttatcttttaatatttatccagttttcatatatttttgattttattttgcttttcgatctccttattacatgagtggtgttatagggagggtttagtagctttctttttctttaaatcatcttctggcctcttgctatagcttcatttggtggggacctttatttacatgtggaggatacaaggaaatataagtcatgactctttccctgagagtccaatctatt

SEQ ID NO: 269288 - DNA, 471 bp, Homo sapiens
cgtggtcatatctgacctgtgtgttaccttgtttctcaaaattgttgtaagcatccctgaccaggaaataagactattgtgggttgtttgaaatgtctcaccacattatggatgctctttatattgagagatagtaaagaaggttgatgcgtaatagattttaaaacattttattaaacgagataagtggaaggaattagaatatatcttgtagtaaggatttctataacttctaagaagtctgatttatcttttaatatttatccagttttcatatatttttgattttattttgcttttcgatctccttattacatgagtggtgttatagggagggtttagtagctttctttttctttaaatcatcttctggcctcttgctatagcttcatttggtggggacctttatttacatgtggaggatacaaggaaatataagtcatgactctttccctgagagtccaatctatt

SEQ ID NO: 269289 - DNA, 707 bp, Homo sapiens
ttcgttttttttttttgagacaagagtttcgctcttgttgcccaggctggagtgcagtggcgcgatcttggctcaccacaacctccacctcccaggttcaagcaattcttctgcctcagcctcccgagtagctgggattacaggcatgcgccaccacgcctggccagttctgttatttttaaaacccaagtttccctggtcatatcttggttggatgaagcgtattttcaatagattaccctggaaaggctagtgagtacggtattcttctacattttagacttttcttagtcttgctacttcaaggacagctaggctgcatataaaattcttggctcatactttttccccataaatttctatgagaaagtctaatgataactgattttctttattttgtaacttagtctttttgcttagaggctctctgaggatgggagggggttcttcctcccatccctaggaatttttcttttttttaaattcctaatcactagaccaccaggaagattgtttgttttgttttgtttttattcttcagggaccccatttatacatacgttaaataaatactgtttgccaatgtatcaaccattttgcttcttatttatttttgttcctttggttctttttcatggctttgctttggtgctccttagattttcagtcagatgtatttgtccttgggtaccttgtaatcagtatta

SEQ ID NO: 269290 - DNA, 201 bp, Homo sapiens
ctgtcactattcaccgatgatatgatagcatacctagaaaaccctaaagactcatccaaaaagatcctagatctgataaataaatccagcaaagtttcaggatacaaaatcaatgtgcgcaaaccagtagcattgctatacaccaacagcaaccaagctgagaatcaaatcaattactctaccccccttacaacacctgcc

SEQ ID NO: 269291 - DNA, 386 bp, Homo sapiens
ttgacaaagaacccaggaatggcgttaaagacttctttgggcagtgtccaatttatggagcaattttgttggccacatctacggagcttttgtgaaacttgcgtaggctcatggagtatccaaatgaggcaacatcaccatcagtcctccttccctggctcactgcctcaggaaaccaacctgaccctgaaggtatgtaagcctcaggccccacaaaagttggatccaaccttgagcagttgctttttcattgagtcctgtggagctcaggttcctgtggagggtagcagaagggaaacttcaattacagtataactggtctgatctgttctacatattaaagttcatgctattttctttgtgataaataaagactgttctgctgc

SEQ ID NO: 269292 - DNA, 455 bp, Homo sapiens
ggcagtggaaggcagcaggcttggctctcccatccccaaggggcctcactatgaagaagctaagtaatggacgataggaatgtattctgtattctgctgaaaagacaaatgtattctgctgaaaagacaatcttgcacacacgaagaacagtgtaaattaaaaccaaaccaaaggctgggtgtggcggctatgcctgtaatcccagcactttgggaggctgaggtgggcagattgcttgagattaggagtttgagcctgggcaacatagtgaaaccctgtctttataaaaaatacaaaaattagccagacatagtggtgcacatctgtagttccagctactcaggaggctgaggtaggaggattgcttgagccagggaggtggaggttgcagtgagctgaaattgcaccactgcactccatcctgggtgacagaacaagaccctgtctcaaagaa

SEQ ID NO: 269293 - DNA, 376 bp, Homo sapiens
gatggatgagtaccaagaggttcatgaatatgagcttgggttgttgatttgcaataaaaggacttcttttagctgaagttcagtgtggtagagtagaaagagatagggcttttgccctagatggacaagttcaaatcctggctcagtcacttaggaaatttggctgtttgtcttgggcaagttgctcaaattctctgaacttgattttctacatctatgaaatagggatcttatctcccagattaatgtaggaatgaaaacaaaatcgtatatggtgtcaggaacatagcaggtattctgcaagagagggcaccattgactagacaagtgtccacagtgctagacggaggcgcacctgggaacagtttcctgctgg

SEQ ID NO: 269294 - DNA, 438 bp, Homo sapiens
tcagccagaacgacgtagctaggttttatcttgaagtctgtttcagagctaatatgaagatagaacacccatgccactacaccagagctgggagcagggacagtggcccacttctgcagtgaaacttatgctctacaagaatgtgggactattatcttcccctgtgcttcttgaagttggtgtgactgtgatctgatttggtcgacataatgtgagaagtctgtcacttccaagcagcatcatttaattgctgctgcgtgcttctctatcttctcttctctgttgcaacaaatcctggagccttgtgacgatcataaaatgggaacatctttgttatcccaggtcctgcacggtaactgtgtgaagcacagccctcacccctctggctggacatgttgcgtgagcaagaaataaatcttagttgttctaggtcaaaaa

SEQ ID NO: 269295 - DNA, 359 bp, Homo sapiens
tcagccagaacgacgtagctaggttttatcttgaagtctgtttcagagctaatatgaaggaatgtgggactattatcttcccctgtgcttcttgaagttggtgtgactgtgatctgatttggtcgacataatgtgagaagtctgtcacttccaagcagcatcatttaattgctgctgcgtgcttctctatcttctcttctctgttgcaacaaatcctggagccttgtgacgatcataaaatgggaacatctttgttatcccaggtcctgcacggtaactgtgtgaagcacagccctcacccctctggctggacatgttgcgtgagcaagaaataaatcttagttgttctaggtcaaaaa

SEQ ID NO: 269296 - DNA, 441 bp, Homo sapiens
gcagtgttaagcttgagatgcctatttgacctccaagtaaggatatagagtaagtaatctttacattaaaaaaaatcaaactcaagggagatggtgaggctcacaatgttttttggaattattagcaagccattggactggatgagttcaccaaagaatatctttagccaggtgcggtggctcatgcctgtaatcccagcactttgggaggccgagacgaggttgggagtttgagaccagcctggccaacatggtgaaaccccgtctctactaaaaatacaaaaattagccgggtgtggtggcgggtgcctgtaattccagctactagggaggctgaggcaggagaattgcttgaacccaggaggtggaggttgcagtgagccgagatcatgccactgcactccagcttggaggacagagcaagactccatctcagaaaaa

SEQ ID NO: 269297 - DNA, 473 bp, Homo sapiens
acacactgatcatgacatcaaactccagaggaagccggctaaggatgtgcttgttttgatgtgacatgtgcctgcgatgattaactctcatgctcccacaatctctccagggccccagacttggtccttcctcgcctgtaaacaggatcaggatgcatcctggagttcagccaagggcatctggccttgggtaagacagactccacaaaacacatacattgttcctggcaagggaaccacgagggaaggaaaaggagagaaggaaggcagcatgggacactgacatccatccacctatgacaaatcacatcagatgcaactgagcacatgcaactcagagggaaaagacaggaataggcccatggaacacattcaccttctacatgatcaacagcttcgggaaagcaatacagccaagtgccaagtgagaaaaagggaaaagcatgtaaaatgaatgaaatgttgactgcaat

SEQ ID NO: 269298 - DNA, 132 bp, Homo sapiens
ttaacaatggctggttcgctagctgggaatttgcaagaactctccgcccgatatctgagctcctcggccttcgagccttactcccggaccaacaataaagaaggggccgagaaaaaagcgctggactgattt

SEQ ID NO: 269299 - DNA, 194 bp, Homo sapiens
agcctgggcaacaagagcgaaaactccgtctcaaaaataaataaataaaaaataaaacttttcatatggcaaaagatactgagcaaagccaaaaccaaaagatagattggggaaaaagcatttggaaaacatcgcaggcaaagggttcatagcatgactacactagaaaacccttcatattagtaaaggtacca

SEQ ID NO: 269300 - DNA, 854 bp, Homo sapiens
gaccacttactgttgtatctcagggtcaacgcacagggttggagctcctctgtaaagttgtgttaaaggaaatgaaatctttctgatgaaactgaacaggtgagggtgctgtaggcagggctggggagacctgtgagcagtacttgatagagttgctccaatcaaattctctctgacttcaacaaaacaacagtaaaagtaatgtattcagcgctcaccatgtgctgggtcccgtgctgcacaatttgtgccttatcacactcagtcctctgaacaactctgtaaggtaactatctctgttttacaaaggcaaaacagagaagtccagagaggttacttgtccaccacgaatgtcagggttagattcaagcccagccctgttggggtttgaaattgctatcaggtcatttagtctgaagtctccttggggccaaagccatgtcagctgaggcttgaaggggaagcagacagatgtgactagaactgcagctcatcagcaactgactgccagtgctcagggcacctgaaggagcacagcaaaaaggacagccttttgctccaggtttccactttttgagagatatgaacacattagtaaaatgcctgtgtctgggaacaggcagccagggtgagaaaataatcagatctacacaaaatggataaagaatgtgtggagggacctccaaagggtgagaaaccacttctggctgctaatgcaatctgggttcacatactcaattcttaaaaaataagtccatgaagcagaaacatcaaaaagcatgggatttggaatttgagacctgactttgaagcccacacagaacacagacaagtcaaccatgctatttggggta

SEQ ID NO: 269301 - DNA, 212 bp, Homo sapiens
gcaccctctattctgctagtgagagaataaatccatacaagccttctagggagcaatttgacaataacatatcaacattctttaaaatctgcatatcctttatcctagcaattccttttctggaaatttatcccaaggacataattaaggatgtgcacagagtttcagctacaaggatattcatttaagaagatgcttacgatactaaaaaa

SEQ ID NO: 269302 - DNA, 374 bp, Homo sapiens
atgcaaaatacagcagtaaaatttatactgcagtgtcgaacacattcagcacagcttcagactcctggctgtgcgtgaaaactccaagaggataccactggtttatgtcacttgagactccagacattgaacagtaattagggaacatgacagtaatttgatttaaagtctgcagccacagagttcaggctccatccctctctccatcattctccctgagtgcaaatccagagggagggcaagtaggtcgaagcagactctgatggtgtttacttacttgccagagattagagaaagtgtgcccactaggtctacagtagtgcaaaaccaagccaaaaagtgagcacttcagtgcactcaatgccaaaaaaaaa

SEQ ID NO: 269303 - DNA, 140 bp, Homo sapiens
aaggaatagaaatggaagagttagaggcagtgttatgctagagctgtcccttagcgagctgattttaaagcttgaaatcggccatggataaattcccagaagtggaagacattgccaagtttttcttcagaaagatggta

SEQ ID NO: 269304 - DNA, 187 bp, Homo sapiens
taaagacctgcccagaccccacagccaagggcagcccctcagagattcaggccaggagcggcctttgttccccacacctggagctcagagcttgcttagcctgcggtggaagctctggtttaattaaggatcttaggagagaattctctcttgttattttctgaataaattaaggaagtaactttga

SEQ ID NO: 269305 - DNA, 527 bp, Homo sapiens
catcattcccagcaacatggatgaccctggagcacataatgttgagtaaaataaaccaggcacagaaagataaattctgcatggtctcacttatatgtggaagctttaaaagttgatctcataggagtagagagtagaatagtggttactagaggctggaaaagtgaagggaaatagccaaaggttggttaatggatacaacagcacagctagataggaagaataaattatagtgttctataacactgtggggtgactataatttacagtaattgattgtatacttgtaaatagccaaaagagcagcttttcagtgttctcaacacaggaagtaagtgtttgaggtaatggatatgccagttactgatctgatcattacacattgcatacatatcttaaaatagcacactacctcataaataggtacaattatttgtcaattaaaaatactaaaaagcaagaataatcacttaattagaaaatatattttttcctctatactagagtgtaagctcctttgggtcaag

SEQ ID NO: 269306 - DNA, 463 bp, Homo sapiens
ctatttctcagaccttcatcttccaaaatgatgtttactgggaacatagagaacaaaagatagcccaaacatacatctctaatgataggtgtgcctttatcttctgtactcactctgacacttccctgtgcttattccacatcactctcctgaaccttggctgctggcatgatccctacacagacaagtgggagaattagacaggctcgcttggggtactagagagataagaaagatattttcttaacacattacatttcatgggattttttttttttctgcccagagaagcgttctagggctgttcgctcactattttccccaagtctctgaaaaagttattcaattgaaaacttcagaacccgaacaaggatgataatactgaggacccatcaacatattataggcactctgaggacaaggagatagcttttattaaagaaatacattttctatagtacta

SEQ ID NO: 269307 - DNA, 434 bp, Homo sapiens
aaggaactcatcgtccaccaccttcaggaaggaggctcctggggccctttaagagagcagtttcagtggaggctgcaggcaggttggcagaaacaagattatgagatggtctgtaccaggtatcaggcttgagggttagtgcctctagacttctctgagaagtctagctttgaagggaaggctggagagctagcacaatactcaataataacaagacctaaggcacttactgtgtgccaggcatgttctaagaactcagcacacttcagctcatttaatccttacaactatacaaagtttgtagtcttttcattataccttttgacaggtgagttacttgctggaattcacgtggctagtaaatactggagctgagatttgaaagcaggcaatctggctccagaatctgtgttttcaacccacatactatattg

SEQ ID NO: 269308 - DNA, 348 bp, Homo sapiens
cgacatgaatccttctccattgtgtccctgctcagccacgagaacagtgtgctgccagggtgctcagtctgtaactctgctcaggatgcaggctccagggagggagtgtccaactgggctaatagggcccaccctttggctctgggagagctgggctccttgatgataatcccagcacactgtcagctgtgggtaggatgaggcaagttcctcagggggtgaagtgtgttttgggatagtcaacagccagtgactgttcaccacaggactaaaccttccatttccagtgctccagtgccccaactggcctgtctggtgtgatttgccaagtgttctgagcaagcaggg

SEQ ID NO: 269309 - DNA, 486 bp, Homo sapiens
ttcgtgttaggtggcattgtaaccattacaatgcagtatttgaggccatgccctcaggaacttatagtaaggatccaatggagcaagattataggttaccccacctgaacatcctcctgggaggaagcagggcatgaatccgaaggaattagtgaagtccttccatagccatccttgatggtggagcgggggtgtgtctcagcaaaaagggctgaagtataaggtgctgggaccagttgtcagtaaaggcagtatgattcaatgaatcaattaaatcaggatggagaagggaagcaaaaagtccaagccagataagtggaactacccatgaaactggagggtgtggtgaacaaaagcaaaatgattagtcacaaggtcaggagcaagtggccccaggatgaagaaaggtagctagatggaggatggttctcctcattccgcagatgatgaacttgaaaccagtgacagtgagtgagtttcaggtca

SEQ ID NO: 269310 - DNA, 213 bp, Homo sapiens
acttctggggttgttttcttgggaccgaagctgagattgcagatggtaatggctatgtgtgctttagcttgttccattggcgaaacataccaattaaacttcaaatgaaccaattcttgtttctttacaatgtaccttggcttgaagttggagttttagccagaatttccattggcctgttacaacacatgcaaaaatgctgggtattctagg

SEQ ID NO: 269311 - DNA, 615 bp, Homo sapiens
tgtgtctctatgagccagcaaaagcttttgagctaatagaattagatcttattctactcctgtgaaaggatcttagataagaataatccaaaatccataagcctctatttctgatgaggaagatgaaaaaatcaggagcttgttctgtcctcagtaaaaggtatagagttcaagtggctgtaagataactacaaagggtctggtccatattcacagattgtaacttatgatattctactctagtttttttattttttattctacattaaataaatttattctacattaaaattctacatttattctacaataaaaaatgatgagaatttacagagtgcatccatggtccaggaagagcccttaatatttcagctactgttggctacatccattccaaggaacaaaagccagggaccatgggagaatagtttgttctgggtacaggggtaagagaaagggatgggcacttaatgagtgcttccctcctttgattacaatattctacctgtttcatgctcctttttctcttagatgtctggttataatcattcagaagtcattcagccactataaatagataatatattgtgtgtgtgtgtgtgttatgtgggaaca

SEQ ID NO: 269312 - DNA, 566 bp, Homo sapiens
ttgtctttgggcatggcagttaagaatcatttgtaagtttctgaaatttggaaaatttgcagtgtggctaatttgagactggaacattctgagttcataatatctaatcacatgttcgttccaataatttatcttcttatatgcaagatcttcttattttatttatagttgattttgtcatttgtattaagaaacctcttctttagttgctaaaactatgctattttattatagtctttaatcattctgctcctcatttcaataagtaggaacctggccgggcgcggtggctcacgcctgtaatctcagcacttcaggaggctgaggcaggcggatcatgaggtcaggagatcgagaccatcctggctaacacggtgaaaccccgtctctactaaaaattcaaaaaaaattatccgggcatggtggcaggtgcctgtaagtcccagctgctcgggaggccgaggcaggagaatggtgtgaacccaggaggcggagcttgcagtgagccaagatggcgccactgcactccagcctgggcgacagaaagagactctgtctcaaaaaaa

SEQ ID NO: 269313 - DNA, 756 bp, Homo sapiens
aaagatgggaatctcactatgtttcccaggctggtcttgaactcctgggctcaagtaatactgccttggcctcctgagtagctgggaccatagacatatgccactgtgtctggcttaaatatttccttctgtcggaatgccctttgttccttcatctgtgcccccctgctccatcctcttttaattcctagcccaaaagtctaacccacccattgggagggattctgcagaactcatagagtttacaacatcttgtccttcaattgcagtcagtctctgtcttgaactggatttgtgagctccttgaagttgtttgtatctcacagctctttgctgtaacatccctggggattcaagcacgcacacatagtagatgctcacacatctatgcaataaattactttagtgtctttctcaaatgatcagcacaggaagcaaatgataaaatgcaaaccagaaaacagacctcactgggctctgtgcttgtcagccttgggaatggatttctggcgaagatccggcccctctacaaatgacagagatgacttggctcttttcaggaattgaagagaatcctgacaagtggcatgttgggaaaggcctgaaggaagccagaccagcttgctctcagagctccttgggtcccctgcggcccccaggtgatcttcagcaagacctggtatgtaaatgagcctcatctgctggctcagcctgctgcccactgctagggatgctagaattccagggtaagcttct

SEQ ID NO: 269314 - DNA, 1670 bp, Homo sapiens
atattgttacctacttttccagctctaaaaacaaaaacttattattattgaagatgttcagtgatgctttctcaagattgccaaggaaaagtttacgaaaatcttaccttgaaacagtaggtttgagtgaccctttgaagagatagtccagactgtcctgtaaagttatatatgatataacaaatagctttactaattggattggactacacatcttttttctgtcctcttttcatttgtgccgttatctggaaatccatctaattgcctttttaaaataatgttatctttgatttccttgttttggtaaactgactgaactgcagtagataaaaacctggttctagtgaactaacattttagagaccttacctccttaagctattaggggtgtgtctagttttttgtttttgtaaagagcaagcccattgggaaggaatgatgtaaattttctgttaaacttaaatcatcagcactttttccaaaaaataaaattcattctcatttcttgaccactgggctaccatttagaaagttatttattgatgtaaaatcctttatgtattacttcagaagataggctatgcctccgtgttaagaggattctctatttcatttgttctttagtggattttttttctttaacgactttggtatataattcacataccgtaaacttcaccaattttaaatgtacagtttagtggattttagtacattcacagcgttgtgtgaccgtcactacaatttaattttagaacatttttgtcactccaaaaagatatccataccctttactggtcattcccattgctggcatcctccctcccctcaagcctcagacaatcatgaatagaaatggaatcatgcaatatgtagtcttttgtgactggcttgtttcacttggtgtaatgtttagaaaattatacttaaagtctcataaaacttgaccaaagctatcctcatattttaactgtggtatcttttattggtactagcacctagaattcttaaagcagagtagtgattagccatgacattgttgcaaagaaaggttgaggtggattatcctgaataattagtaaactgttttaagtagtttctgacagctttattagagcagattgcttcttcctgtgcccttagagtttttcttgtttttgttttgtaggtaggatttttagttttgaaggggttggtagagtgaggctgtttttattgtatgtgctttgcatacacagtcaccctataaaatagattaagtgttccgagttcggttgggttttccgcaattaaaaattgtgttaacagtttagtgtttcttacagataacactgataacactttttttgttttcattgggtcttatcattggtacagactgatccaaaaatccaattggcttgctagtaattttttcctgtgaattgctaagatttatgggtaaattaatttttctttttcttttctttttttttttttttaagcatttgctccttaaatgcaaatcgtaccactaagatcctctcacaacagattaaggtcgaatttgcagagttcttcaatttttcatgaagcagtgagggtagatctgtaccactttttccgttctgtgtaaatcaccgtttatgggaaacacttgttttttaggttggtgctatttaaaaaaa

SEQ ID NO: 269315 - DNA, 900 bp, Homo sapiens
gaagcaggaaaatgagtatgaagcaaggcaacctagaactgcaaaagtgcaaaaggaccacagttggagaagttgagatagagccaccccatctgttttaaacaaggttttaagaaataccagctagaagagccatcttccctgtagcttgtgagggcagtattatgttaggcataaagatgataaagaatgtggaaagttcttgcaagtacatgggataaactggaagtccaggtatatggggagaggaataatgagttaatggaggtgttgcattcttttaattaaggacagttaaaagattaaatatagttttatagtcagaatcagaagacaacagagaggttcttggcgtggtattcaggaaccacgggttcaaggcccacttcattggcagccactggctaaaactgtaggttatctcagtatcaatgataatgaaaagtggtagtctcctgtagcaaaaggagacaaaagaatttcattttaagattacttcattactcttaagttttccaacatgattgactaagtctatttgttggttctcctgagcattttattacaatttatcagaatttaggacttaattttcataatgatgtcctgaagttaccaagaagatatggactgggcacggtggcttacgcctgtaatcccagcactttgggaggccgaggcatgcagatcgcctgagtccaggagtttgagaccagcctgggcaacatagcaaaaccccatctctacaaaaaactacaaaaattagccaggcatggtggtacacacctagctactcaggagtctgagatgggaggagcacctgatcacagggaggtcaggctgcagtgagccgtgatcgtactacagcactccagcctgggtgacagtgatactctgtct

SEQ ID NO: 269316 - DNA, 404 bp, Homo sapiens
gccctgcacacacctgcccgcaccccaccaccccagcgtgcccctgcaggcaccttcagggcgctgcacacacctgcccacaccccaccaccccagcatgcccctgcaggcacctccagggccctgcacacacctgactgcaccccaccaccccagtgtgcccctgcaggcacctccagggccctgcacacacctgcccataccccaccaccgcaacatgcctggaccctgtacatacctgcctgcatcccaccaccacagtgtgccccggcaggcacctttggggtgttgcacacaccatctcccacccagcgtccaccacaggccccacctcccctctacatctgcatagtcaggtttggggcccacagatgctctgacataggtatatccagttcagcttc

SEQ ID NO: 269317 - DNA, 396 bp, Homo sapiens
gggagaacagccaattcacctcagtgcaaggggagggcaggcactgggtgaagttgtctctggaaggtgggagttagggaaaggtgctcaacaagggcttgagctttaatgataagtatgttcttttttaatgagattattagaagtaaatattaataaaatgttaactgtggtaggaattatggttatttttgtatttttctgaaactttcaattttctcagtttaaaataaacttgtaaaattcatgcatagtggagcagggtagatatagatgaaggcactgtgaagaggcagaaagcacagatgcagccagacctaactgtggtctgattatttattgatatctcaaaaaaaggtgacactcagaaaggaagatggctagttatagcaattt

SEQ ID NO: 269318 - DNA, 1041 bp, Homo sapiens
gccctttcctcagtcctgctgatgtcctccagctgattccaggctgttcccggccacccctgaggccgtcctttcgcttcttgtaaaagcctccccgcctcctgagctccctcggtcgcctcccgagaagccaacgggcctctctggtggagcgctaggttgacagcgttttagcaggaccgcgagaaaccggggagatcctcttacgaggaaaaactccaagattacatccctgttatctttcctccaagagctgactaaggctttggaacagaaaccagatgatgcacatatattatcgtcaaagagcttattgtcacattcttcttgggaattactgtgagacggggtttcactgtgttagccaggctggtctcgatttcttgacctcgtgatccacctgcctcggcctcccaaagtgctgggattacacgcgtgagccgccatgcccagccagaaacgcatctttttctacatagttgctgttgctgatgcaaagaagtctcgcgaattcaatccaaataattccactgctgtgctgagaaaagggatatgtgaataccatttaaaaaactatgctgctgctctagaaacttttataggaggacaaaaattagtgcagatgctaatttcagtgactggattaaaaggtgtcaagaagctcagaatggctcagaatctgaggtgagtttcgctcttgttgcccaggctggagtgcagcggcatgatctcagatcattacaacctccacctcctcggttcaagcaattctcctgcttcagcttcctgtgtagctggggttataggcacacgccaccatgcctggctaatttctgtatttttagtagaaacgggggtttcaccatgttgaccaggctggtctcgaactcctgatctcaggtgatccacccaccttggcctccgaaagtgctgagattacaggcgtgagctaccatgcccggcccttaccaggattttggtctgcctctggtcctgtccacattgtgtagaatttgtttaataaaataattttgagtaatc

SEQ ID NO: 269319 - DNA, 559 bp, Homo sapiens
gggtaacaaaatactccaaaacatagcatttaacaccacaaatattttttatctcacagtgctcgacggttagaaatctgaaagcagcttagctggatggttctggctcagagtctctcatgaggttgcaataaagcttccagctgaagcagacatctccaggcttgttcagtggctgatgtctggaagcctgaggttctttctccattgcccgatctagtctacctgagcattgtcacaacgtggcagatgccttcacccaaagcaaaggatctttgtgtgtgtgtgtgtgtgtgtgtgtgtgtgtgtgaatgagagcgagagagagagagagagagcaagtacccaagacggaagctgtagtcttttataactattcacagcagtgacttaccatcacttctgcagtatggtattagacacatagaccaatcctagtgtaatgcaggaaggactatgtatgagtgtgggggtggggatcactatggcccatcttggaggctggctacctcaccatttaatatctgattcatcttcaaatttctccaaatggcctaaa

SEQ ID NO: 269320 - DNA, 442 bp, Homo sapiens
tacaatgttaaatttgggggaaacttaaaaatatctatatatttgtaatacaaaatacagaaaataaactcttttggtaggtaataatagaaagtacagtaatttttaaaccagtgcactcctaaattatcagtggatcaaagaaagaaattacaagataaatttaatacttaagattaatgaaaacaaaaacttaacataccaaaactcatgaaatgcagctaaagctgtgcttggaggaaaatttatagcttataaacatctatattaaaaaaaatatatatcgaatcagtaatttaaccttctaccttaagaaattagaaaaagaagagtcaactcaacccaaagcaagtagaaaaaaggaactaatgtagattagagtgaaattaaaaaaataaagaacagaaaaacaattgaggagatccaggaaactaaatgtttg

SEQ ID NO: 269321 - DNA, 401 bp, Homo sapiens
tcataggacataacaaagttgctactggattgattattccttgtgtaatcattatgaattctgaattagtggtaaataataaaattttacattcttctcttatccatccaaccagtcatcccattcattcaaaaactattattgaccactagttatccatgaggcagtttgctatagcacgacaaataggaaaatgaactggtttcttgcttttaagaaatgtataatttagttacatggtaaattactccttattacaataacaggtcatcagaattagttagccaatgttatttctgtacttattcatagttttagtcattaactttggttagcgttctttcttgttagctctagtttcactaatgaaaataatggagctgtgtagtacagaaagttac

SEQ ID NO: 269322 - DNA, 559 bp, Homo sapiens
gcactccagcctgggcgacagagcgagactccatctgaaaaaaaattgagtctatgctgcctactcccttgttggaatcctacctaaggattaaaaagtaagagggaagaaatgtgcttgtatttagcataatttagcataaagcatataaaatagatgtccttaaagtaaaacctaacacagttcgaatgcacacgaggtacttagtaaaacatattgaataaatgtcttagtatgttctggctgctataacataataccataattggtggcttattaataatagaaatttgtgtctcacaatctgtaggctgaggattccaagatcaaggcatcagcaaatttggtgtctggtgaaggcaacttcttggttcatagatggtgctttcactatgtgtcctcaaatattgaaaggagccaagaaggtctctagtggcttcttttgtaaggagagtcatgagtcatcccattcatgacagctccaacctcatcaattagtcacctcccaaaggttgtacctctgaataccatcaaattgatggttaggattgagacacat

SEQ ID NO: 269323 - DNA, 529 bp, Homo sapiens
tgtgagggtggctgcagccccaggcccacggccagaaggaagcacactgttgctcagagacacattagaacatgtactgtcaacggcccctctgcctcccaggaccttatgctgtagttggggagagagggcatctgccaaactcaatgcaggaaataagctgcgttgctgctaaggactggcccaaggtagtgggaaaagcccattttagagacgggaatgcagagtcacaaggaagctgggtgatcaccatcagggacccagaagccagtgctatccagtaagaaatgcctgatggtgggtgggcagggacgtcagagccctgtgggtgtcagagcttcatggggcctgcccggccacctgacctgccaccagggaggctcagtcattcataaggctctcccctgcccattcccctctgcctctcagagatagtgatggcagagacaagtggcatgggaggcccacttgtagcagacacacccttttcagattttgttgaacagacatctctttctccactcttctt

SEQ ID NO: 269324 - DNA, 420 bp, Homo sapiens
gttcttacctttggccactttttccattttgaccctctcttctttcctccagggtcactgggttttactacagtggctttgcttctggctagtaaatcttctaatcttgttttgatctctgggcctttgtatttgcttttgctgctgggaatgttctgctcgaaagtcttctcacccttgacccctggaagttcagacagaagccaaatgttagctccttagaaaggctaatgtagcccactaagagagttctattggcccttttttattgtcttcattgtacttgtctgtagttattttaattgtctactgtctacctccaggatagtataaacttattgaatgttcttgttcacactgactcctcagcatgtagaacagtccctagaagtagtaaatattcagtaaatatgtattggg

SEQ ID NO: 269325 - DNA, 264 bp, Homo sapiens
tttgcttcaacaaaatcctatggtctattgtagccaaatattctgccattatgccctaaaatgtgtaatctatttcaacatttaaagttagtgcactgttagagtttaatacaaatatattaagctgttggttattttgcttattagaaaaaacttgccatgtttaagttttattaatacagaaatcactagggaaaataatctataacagatgaatagaaggattaaaattcaaagttcctattaagcctgttctgattcttt

SEQ ID NO: 269326 - DNA, 345 bp, Homo sapiens
tccccaagactcgtgtatcctatacttttttctctcagaattttgatttgttcattttcgtgtaaatgtacttaaatctcacaaacatctataatttgtagtatcactctggcatttgtggcagagaaccaaaaagaatggaaatgagttttgtcattcacaaatgtggctcacattgttttcccagtaataaaagcagaccaatgaaacagaacctttaatggatactattttaggaggttccaattcttattactatcacatagataagatgcaatagcagataaatatgatttcatgtatactggctgtttgacatacttagggtttaagataaaaatgttt

SEQ ID NO: 269327 - DNA, 511 bp, Homo sapiens
ttactgctttgcatgagaacacatttgtacatccaaccctccctggaggctttgagcatcttgagggactggaccgctggtgtattcttcttggaattcactgtgtctagtacaggtctgttgaatgatggaataacagcagcaacaaacccacatccacgacaacaacagttaaccttgactgggagcatttatgctgtgctgaatgctttgctaaatgctttacaagcctcagctcagtcctttaaggaaagtgacactactacccccattttttggtgaacgtaagtgctaatttggtcaggacctggagttcatctttgttttgcctagggaacaaaaacttatgaggcttacacatatcaccaatagaatgtttaaaaaaaaactttaaaatactggagtataactttttaaatccattctaacatgttagaggctcttgctttcatatgcaaagagctgatgtgccaatcataaattcaatctaactgctaaagcaatctccaaa

SEQ ID NO: 269328 - DNA, 356 bp, Homo sapiens
actagaaagaagctatctgtgaaactgctttgtgatgtgtggatttatctctttgattctgcagtttggaaacactttctttatagaatctgtgaagggacgtttgtaatccccctgaggcctaaggggaaaaactgaatatccccaaataaaaactagaaagaagttatctgtgaaactgcttagtgatgtgtggattcgtctcacaaagttaaacctttcttttgatttggcagcttggaaatactctttttgtagaatctgcaaagggacatttgcaatcccattaaggcctatggggaaaaaacaaatatctacagataaaaccttgaaataaagtgtctgtgagactgctt

SEQ ID NO: 269329 - DNA, 785 bp, Homo sapiens
gaaaaatgaccgagtgtgaaagctagaagggacagaagggtcataaagtccccatttctcttcaaacagttgcaggctcacaatttgctaactgctttgctggggtgagcagaaacaggcgtggtctcaaacttcatcaagcatctacacttgtaaagaaaatagatagtaataaatcatcctccaaaattgtataaaatggcagctcaggtaaatggtttgaaggagaggtccacggggtgttgagaagctataatggacatggacctagttagaggaggtttctctgaggacatgagatctgaagggaagaaggctttccgtggtatggcaacaagtgcaaaagccctgtggtaggaagggacatggagaccagtgagagtatagaagcccaaagaaatatggcaccaggtgaggcaggaaggggctggccatgcaggactgtgagcactactatgggatttttgtctgtattttaagagtactgggaagccagtcgggcatggtggctcacgcctgtaatcccagcactttgggaggtcaaggcaggcggatcacttgaggtctggagtttgagaccagactgaccaacagggtgaaaccccgtctctactaaaaatacaaaaatcagccgggtgttgtggcatgtgcctgtaatcccagctactggggaggctgaggtagaattgcttgcccctgggaggcggaggttgcagtgagccgagattgtgccactgcgttacagcctgggtaggagagtgagactccatctcaaaaaaaaaaaa

SEQ ID NO: 269330 - DNA, 435 bp, Homo sapiens
agggaaggtcagcagataaacaagtgaacaaaggtctctggttttcctaggcagaggaccctgcggccttccgcagtgtttgtgtccctgggtacttaagattagggagtggtgatgactcttaacaattctttcagtttttctacatagacaatcatgtcacctgtgaaccaaaacagttttctttcttctcaatctgtatattttttatttcctttccttgtcttattgcattagctagaacttagaggatgatgttgaaaaccagtgttgagagggaacattcttaccttgttcctgattttagtgggaaggtgtcaactttttcactaatacgtatgatgttagctgtaggttttttgcaggtgttctttatcacgttgaggaaattctcctctatttgccttttgtttgtacactcctttctcctaaaaa

SEQ ID NO: 269331 - DNA, 427 bp, Homo sapiens
actcaaagaagaacattgcttgctgagggctacaatgaagaaaagtgagcacaaaatgaggcttggcaagtaaattaggacagataacataatttttagtttactatttttaatgggaacatatgaagcaattgcaagggcttgttaagaaaaaagtttgatgggatttatgtgtttttgcaggactctgtggtcagctaggaggaccagagatgaaagctaaaggggtcagtttggtggggggataatgaaataggttcttaaattgatggtggtgatggaggcacaactctgaaaatacttagaaccattaaattgtgcacttgaatggtcaaattgtatagtatgtaaattatatcttgctaactgcttttttaaaataaaaaacccaaacaaaataaatcacttaaaagaaatataataaaaa

SEQ ID NO: 269332 - DNA, 562 bp, Homo sapiens
tctccagtcttcactatttgaggaaaaaaattaagttaaatacataagaagcatgagccaccacgcccagtctgtctttttgtaacctagcctcagaagtgacatgccatcacttttgccacatagaagtgcatcactaggtccagcccatattcaaggagaggggattacaaatatgtatgaataccagcaggtggtgatttattggggcctatcctagaagctgcctaccacaaggaataatgggaaataagattggaaatatgggctgggacagataaaagaaagccatagaagctaatctgcgaatgaaactatacagttggaaatggagggtagagaaaagcaaattttatgtgtaagcccacttttggcaaattgtagtgctggataaatagaattttgagggtcatcttaaaaaccagttgtttaacaacaagtagaaaatgtcaaccaatgacagcttccaggaaacagaaccactctattttatcaggaaataatggtcaaaaaattgtacagaacatagctacctaccttcaataaatagttctaacaatct

SEQ ID NO: 269333 - DNA, 388 bp, Homo sapiens
aaatttttaaactgtgtgcacttatgctaactgctggaaggtttaattgcttccttgatattttcagcatgtcagaaatctccacctcctagtccttagattttagattgtaacaaattgcagccaaacagctaaggtttgaattcttattctttatttatatatgttatagattttactgtcaataaaactaggataattatgagttattaagaagtttaagttagatagtctaagtaaagtgcttaatataaaacagtggctggcatctgtaatcctagctactcgggatccgggacaatcgcttgaacctgggaggccgaggttgcggtgagccgaaatcacgccactgcactccagcctgggtgacagagccagactctgtctc

SEQ ID NO: 269334 - DNA, 404 bp, Homo sapiens
cactcatgttacctacaatggccgttctcttacagacatcatgtttttagcacgttattcctagcaaaatccccaaggagtgtaatagtaggttgcctaattcattctgtttgagcattatgaactcagaatcaatatttgaatttttagagcttcctgttttcagagtcctgtgttccaggcatctgataagaatgactgcataattgtcctaacttctgtaatacttttgctcgagtatgatctcggtatacagacttaatgcttatgacaggtccacattatttgagtaaaccgattgaaaaccaagagctgattgagaacgtcccttaatctagcggctgcattatcaatttgtgagcatgtccacattctggtctttgagggagaaaatacagtaaaaa

SEQ ID NO: 269335 - DNA, 448 bp, Homo sapiens
gtaatgctggttgtaactcactaaattgatttcacaacctgcccatggatctcagcctgcagtgtgaaacacagtaacctagggaaaatgagtctagatggcttttaccaagggtagtggaagtggggcccacattgtgagaaatacaaccataagtaaaaagtgctaaatggcctctctttaaccagagaccacagtctgtaacttcccctgctttcagtggttacctctgggtttcccctgttgtgatttatagaaaatgactatcactttggaattgagctggtggatttctacaaagattcttggtatttcatggttattttctgatgtagagcaagacttcatgtgaatgaaagcagattcattttgcctttcttgcttgggtaccccaggctgatgtggaataaaaaattgttgggtgatttctcttacatttctgcataat

SEQ ID NO: 269336 - DNA, 395 bp, Homo sapiens
gcaacagagcgagactctgtctcaagaaaaaaaaaaaaaagaacgaaaattttaaaatatatttttacaaaacaggaaaatatgatctgtgtttacaaaaaaaggcaatgaacgggcccggcgcagtggctcacgccggtaatcccagcactttgggaggccaaggcaggcggatcacgaggtcagcagatcgagaccatcctggctaacatggtgaaaccccgtctctgctaaaaatacaaaaaattagctgggcgtggtggcgggtgcctgtagtcccagctacttgggaggctgaggcaggagaatggcgtgaacctgggaggcggagcttgcagtgagctgagatcgcaccactgcactccagcctgggtgacagagcaagactctgtctc

SEQ ID NO: 269337 - DNA, 296 bp, Homo sapiens
tggttctcaaatgttatatcaaaatcacttgaagcacttatttctagccctacccaagacctgaactcctcagaagatatcaaaagcatctcatttttaactggctaccattacgtttctgatacatacccatattttgaaaataaagctctaaagagccagaatttgaaagtaaaaaactatcttatgcaggtttcttatacaggtttagcatccctaattcaaaaatttcaaatccataatgctccaaaatctgaaactttttgagtgccgatatgatgccgtaagtggaaaat

SEQ ID NO: 269338 - DNA, 239 bp, Homo sapiens
atataaaaaaaaggtcactttattcaacaagttttattttatagctcaaaaatgcacccaggcgtacaagaaaactaattagacttgaagactaccaagtgatgccatcttgtgacagcttatagtgacaaagcttcttagcagttgtgaaaaagactttcataaaaaatatgttgttcctatataaaaatcatcgatcgggcaattttttaaatgactactttgaaatgggaagagtg

SEQ ID NO: 269339 - DNA, 232 bp, Homo sapiens
attgtttaaacttcttcatattcaccctgaagggaccataaattactcctgttccttttcccctactctatttttttttgactagcattttctcttactgcaattaccctaaggtattaaatggatatattatttccttacaagaaagctaaagaagaaagcaacataagaagagaaaagcagtgtgtgctttcatgaaataaaagaatgccaaaaatggagaaacatagac

SEQ ID NO: 269340 - DNA, 404 bp, Homo sapiens
agaggaaccaggagtatgggaggaacatgaaagtggacaaggaacgtgaccattgaagcaccacagggaggggtttagacctctggatgactgtgggcaggcctggatgatatccagccttccataagaagctggtggagcagagtgttccctgactcctccaagtaaaggagactccctttcccggtctgctcagtaatgggtgccttcccagacactggtgttaccacttgaccaaggggccctcaagcagcccttatgcgggtgtgacagagggctcacctcttgccttctattcacttctcacaatgtcccttcagcacctgaccctacacccactggttattactagattatgttagtaatgcaacaaaaagtaatattaaaagctaatgattaataat

SEQ ID NO: 269341 - DNA, 190 bp, Homo sapiens
gatattacctgtggcagtaaaaactaatagagttcttactggtgacactctcggctgtggtatctccctggtctccttgtgcaggtccctgggaggagaggtactgcatcagcccacacccatgcacactgtttacactgctggagagcatttccgtcttagaaacagtcttttctttcatgagatcttg

SEQ ID NO: 269342 - DNA, 183 bp, Homo sapiens
tctgtctagattttattctgtctcatttttttctgtctagctattcctatgttaataacatgctgttgtaaaaattctagcattaaatattttactacctcatagggaaatccctccttatttccttagctattctcaagcattactccttccaaaataaatttacaattattttatcaagca

SEQ ID NO: 269343 - DNA, 436 bp, Homo sapiens
tctctttattgagaccatgagcaggcaagtaactcagctatgttttatagaacctgtttctgtttgtgattccacttctttggctccctgcactccaaactcaaaatgagtgtcagcctcttagagcctcagaatttttagttgctcatatgctacacttgtcttctgtttggggtcatataatacatccctccatggcattcagaggaagtgatctacctttttcctttaagtctcctgaagtaactatgcaaccttccttgataactctgtaagagatacagtgtattgtagttccagaatatctcgtaccaggctgactctggctttctggctgagccttaaaggtaaatgggggtttgggagaaaccctttttcttagcccttgatatgttaaataaagaaattcagaaaatcctatattgcttataagcaa

SEQ ID NO: 269344 - DNA, 651 bp, Homo sapiens
ttcatcttggaaatgataccacatacccttatattgatgcactgcaagaggccaatctaatgtaggcataaaaagagtaatctggtaatctgctcttctcagcaccctctgctaataatgctgtttgaacaaattctagaaagactgttgatgccagagccaactcagaattaggcaggtgaatgttttcaacttctgctaataataacatcagttctgtactctcctctgggttctttttgctgtattaaagctgcagttcccttaggttagcttctatgcataacctgggaatgcatattttagctttttacttccctcccaaagaaaggagcagaagaggagaaccaaatagccaagatctagaagatgaaactgttgtatccattgtgtggattcagataagcctccacccaaaatatggttcaaatgttaagactaatgagcagccctacacttctctctctctcactttcacacacacacatacacaaacacacgcgcacgcacacacacacacacacacacacacacacacacacacatatacccctaccaagaaagtatgaaagtatgtattacttataaaattatgaggtttttctggggagagcagagcaggcctcccaagaaggtctgaagtagcttgag

SEQ ID NO: 269345 - DNA, 357 bp, Homo sapiens
ctgggcgacagagcgagactccctctcaaaaaaaaagcgggatgctagagcctgaatggaaggaagaagacaggcaggcatggggcagtgacagggacccagcagcctagatctggaagcctgagtgaaagaagcaagggtgtccatgcagggccgtgcctggccccgggtgtgggagaccaaacagggtggggatggcacatatgagaaggggaggcaggcacaggaagttgattacatacctacaggggccgggtggagtaactgaggatgctgagaatagagggagccaagtttctcaaggtcagagaagggcgtgacacagctgggcacagtggctcacacctgtaatcccag

SEQ ID NO: 269346 - DNA, 364 bp, Homo sapiens
ataacatggtgagaaaaacaaagttatttgttctcttcagactgccagtaaattgaagagcatattttaaagttctatgactttcctaaatcctgaatcttcgttggctacttactattattttatagtactgggatctggtcacattactgcgtgaagttgcaatcgtggtaccgttgtgttttctttgtcactagatgatgtaatttcagtgatggatactatggttcttgttttgcctttttgtagggctatttttatagtaaaatctattagtagaatttatgggttgataatctcattgttgtagattttgcttacattttcagagcatctttgtacaacaaggatttttcattacaaa

SEQ ID NO: 269347 - DNA, 445 bp, Homo sapiens
taatcaaagtcataatttcttacctatcaagtgtatcccttctcatttctattattattataaatgtatctatttttacaactgcatctcttgtgttctttttaatggcttggggcagatagcattttatgcctgaaataatatctgaaagatgtaatcataaaccagtgtaggggtgcctcccacagatatcctgattcttaccctgatccggcacagtgtccagtggttacttttgtcaaaaatgattatcaaattcattttgtaaccatttctctggcgagtagaagagtgttctagagagtgtgtattttacattactaggaagaaaatgttctcaagctacatgtcctgttttacatttatggaatttcttcaaaaaaaaaattttttttttttttgagacggagtccagcctgggcaacaagagtgaaactccatctca

SEQ ID NO: 269348 - DNA, 541 bp, Homo sapiens
tctagatggggtttcaccatgttggccagggttgtcttgaactcctgacctcaagtgagccacctgccctgacctcccaaagtgctgggattgcaggcgcgagccacgacaactggctgagactaacatttatactgcttatatctaggcccatgtctgtgaagatatccctgacatctaatcagttatctctcaatttttgccaaaatttccaccttgcatttccatgtcacgaattatatttattctatcttctattcacaatttttttttgagatggagtataaaaatgttcaccaaagttaatctggatgacaggattttgggtgtctgattttcttatgtttttccacatttttgaattttttcaataaatgtaatattgtaaaaaataagaaagcttttcaaaaatttcatcaaaattgcattcattttctttctcctatttaaaactcttgaacacctcatttcacagtggttctccaccggggcaatgcaaatgtttcagggacatttgacaatgtctagagacatttttgtt

SEQ ID NO: 269349 - DNA, 449 bp, Homo sapiens
aaatttgatattggctcttcaatacatttcaatagcagcagacttttcttaggagtatgaagtggtatcgcaagatgcgaaatgaagaggttgggaggaagggcgcgctgcatggcgccaatcaccaggtggtggctgaaaccctgccttccgttcccttgggacaaatgccactcaaagacagccagtagagcttccttcacacaccagtgggtctaggaagtagtacaggtaattcctgccacatcaatcccagaaaaagctctgaacgctaacaatctggttaactgctaaggctttgagcgtccggggcctggccaaggcgcagggaggatctgactgctgccaagtcaggagggttcccaacttacgctcagccttggcactctgccagagacttcgttttttaacatgtaatagatactcactgtaaataaaaataattgtca

SEQ ID NO: 269350 - DNA, 550 bp, Homo sapiens
ggggtgagggataaaaagctacaaattgggttcagcgtacactgcttgggtgatgggtgcaccaaaatctcacaaatccccactaaagaacttactcatgtaaccaaataccacctgttccccccaaatctatggaaattaaaaaaaattaaataaagtgtgcaagtgctggcgaggccccgaaggagccccacattggtgatggcaacgcaggtgacagcactttctctccccagtggggctggtggtgcccattcctggctgccccactctgagtctgaggaggaaccaaggctttcctggaaatgcaggggctgccatcggcctgtgggcttagggtcccaaacagggagagcccattgtttgtcatttctcctcagtaagcagaaagctctaagccctgaagcctccggtaaacgtcagaacatttggacatctgagtccattgtccccaggtctcataattttcctacattaaaaatccaataatgcattttgtggaaaatttagaaagtacagataaacaagagaataaaaaacatgaatttta

SEQ ID NO: 269351 - DNA, 642 bp, Homo sapiens
cataggccgaagtttttggactcctggtatagacaactgccaaatccaccaacaaacagtatgagctttattacactacaaagccaggactggctatttttggtggtctttgttttctagatgagatgtttttctctgagttcatttaaaatgattctgcataaagcacatactctactgtacaaaatacttttgccttcatggtgatgaaaactatggattgagggtcggggtgataccatctttaaagggatgcagctaaaaagtagggactacctgcatttcttatctaaagataaccacagttggcatttagtgatatactggctttgtatcatggccaaaagtatctgtaaagaagcttgtgggcatacttttgaaaccttctgaaaataaatgtaaagcatttacttcgtgtgtaaaattagaagtgtctatggttggtttgaataatatgagtcaaattataagagcattaaagtttgatactgctatctattaaagtcttaatctcttgcagtggctaattcagtgtgtagaattacacatcgcaatttttgttttgttaatttcaagtactagtgtatattaacaaatcacttaaatcatttaaatgtgactttaaaagctttgatgtatata

SEQ ID NO: 269352 - DNA, 618 bp, Homo sapiens
gtttctgagtgtgtcacagttctgtctgtatgggctgcagtggcttattactctcctgcctgcagtatctctgcttataatgaccaggccattgaactttcataaacattaggttttctgtcttcaattattttccccttaagtttcttttttaaataatatatgcattttagttcaggaaattgtacctaaagagcagaaaatgtgataaaactcattgttaacacatgcttgtattatttcaaaatgtaggattaaatcttatgttctgtgatatgaaccgggactttacaaagctgaaactttgtttataagaaaatagcacaggctgggcgtggtggctcatgcctgtaatcacagcactttggtaggctgaggtgggcagatcacttgaggccaggagttcaagactggccaagccaacatgatgaaatcccgtctctactaagagtacaaaaattagctgggtgtggtggtgcacacctgtagtcccagctactcgggaggctgaggcatgagaatcgcatgaacctgggaggcagaggttgcagtgagccgagatcgtgccattgcactccagcctgggcaacagagcaagactctgtctcaaaaaaaaca

SEQ ID NO: 269353 - DNA, 807 bp, Homo sapiens
gtgcttcagggaataggacaattttattccattgtttccagaggatgtcatatgatgcccagtgctgctgagaagcttttcatggggttctataaggaggcatgccctgatatcaaacattccataggccgatgtcacgcagaagacaacgcgagtcacatgtgaactgtaattggtacagaaatacctgggtatttctgtactgtgtgtactgtagcaaactagttggaatgtgcctcttataaaagtacatttacaaatcttcccgtgactgtggctttgagcagtcataggacctagaaatctgtgtatgtccaatagctgaggttattttcagcaaaaataattaaagggttttattttttaattcttgttggttttctaggttgttcacctcaagtgcattgctgtagaggcagaaaaaggaggataaagataacagaagtcctataggccagggatgtattgatagctcttgtgatttccaccagtgttgctgttgtctcaaattgccacagccttcattgcttgccaacatttcctgcatggagggactcatggttgcccttccccaggcctgaagagagagtgcagtcaacatgagattgctaggcattctggtttctgaaagttgggtgatcagatactttattgtgaaacatgttttacaaactttcttgatgtgtaagtgacatgccatagtttacatccatttatggtgtataatttgaagagtttgtcatacaagcctgtgaaaccataatcatgatcatgaacatattcatgattcacctcttgctgttttac

SEQ ID NO: 269354 - DNA, 126 bp, Homo sapiens
gcacgggtggccctggaggccgtgctgcgctgagctgtggccctgagactgcatcggagcggcgccccgttctaggccgtggcctttgccgagactgtagcagagaaaacgtatttattattccag

SEQ ID NO: 269355 - DNA, 400 bp, Homo sapiens
tttgaggtgggatttaagatctaaatttagtgcctcagtgaatcctaaaaatggtgaaattaaaacccaaagaagactaaactgaggcctgctttccagtgttcttctggacagatctgtcatcaaatgtaggtggagcaatcaatttggcttgcctggctagtcataaaagcactatttcaaaataagtagaccaaggtatatttctttgcattgagcctgctgttgttagtctagttctggggttggtatttttttttttttcagtgaaaggtcagataataaatatttaggctttgtaggtcacatattcttttttgaaaaaacaaacaaacaaaaaaaactccttaaaaatgttcttagcttgcaagccaaccccttgactctagtttaaaatgga

SEQ ID NO: 269356 - DNA, 824 bp, Homo sapiens
atgcattctccatttaaatggaatgaaagcttatctctttattgtgccttgatgtcaagtcggcaataaatatggatatcagactatgcaaaattattcctgaattcctgtcattatacccaatcaaaattctaaacactttaactcgatgttcaatgatcagttaggattgttcacatacgtggctagctgtttataattcttcatgtttttcgtcaatgaaaatatttggcttaatctcaaaatcatcaaaaagactagacgtaggttagtccaaaccactcattctttttgtagcaagtactttccaccaagaggatgcccacccagctggaaggaagctgaaagagtgaaagaatttttgccttgattgatgccaggaatgactctgagttattttttccccactggattgatcaaatcaagcctttctgcccttaaaaatataaacagtactatgtccctcagcatgatgagggcaatgacagatctactatggatgaggaacatcagacactctcaaataacatcaaatttaagaaccaagaaaaaaatatactctgtgatcatgagtgatagcgtcgattctggagaagaaagcctggataaggaaggtctctgatgaactacgggacgcagaagagaatgccatgctccagaaagcctgaatcgcacagaacgagacgagaaaacttcccttccactttcatccaaccataaaacttaaactgttttacttttaaattctcagtttcctggttttatctttttttcttcctccctttgtattatttaaaaagtctaataaatgtgttgctaattca

SEQ ID NO: 269357 - DNA, 490 bp, Homo sapiens
cactgagcaacagctcctcctgcgcccagggcgcggtgctctcggaggcatgacctcaatcgtcctcaataacccgaggggacctggaagccaagcacaaaaccccgggtcaccatggttagagaagtgacaatgatatgcccaaggtcgcggcaacgaagtgaactggaagctggaccatgagatcccaaagcctgaggtcttcagaggacacgatgtgttgtttccccaaacccagggaggcgcagaggtacagcccctcaagctccaactacaggcctggtccccgcggggtcagcgggctggaaggcctccaggccggccgccccggggcccgcggggtgggaagccccatctctccatctgccctccctgcagagcagctggccgctctgcgggagcagctgtcagggtgcaggagcctctgtccagccgggaacctggagtaggaggccccaccacgcctcctcgagcagagaaaggcggcttg

SEQ ID NO: 269358 - DNA, 524 bp, Homo sapiens
taatatgagacaagagtctcaggctggagtgcagtggcgtgatcttggctcactgcagcctctgcttcctgtgttcaagagattctcctgccttagcctcctgagtagcagggattacaagtgcccagtaccacgcctggctaatttttgtatttttagtagagatggggtttcaccatgttggccaggctggtcttgaactcctgacctcaagtgatcctcccgcctcggcctcccaaagtgctgggattacaagcatgagccactgtgcctggccaagggccaactgtaatagttattgaattctttcgggtaggtgcatgttttcagacctaggagctatgggcagacatagcactaaggaacaagttatgtactagcatataattatcaaggggaagacctttctcatcagtgatacttctggtctccaaagaaacttagaaaccagctagatttagaacatactaagaataaacattctatcctctttcttggattcaccattggattagtaaaaagac

SEQ ID NO: 269359 - DNA, 380 bp, Homo sapiens
cactctcaatagaattagcagacctcacagacttttcaatgactctcctggaggccttaatgtcataggaaggtgactctaaacatgattagctgtacaacctcattcattccaaattcagctgaattttcctttaagggcagtgaaggcttagatgaagatactccaaaggcgaagggcggaagtgataatcctttgtcaggattgtcagttgccaaagccatgccaagtttcttaggaacaatccaatagggccgggcacggtggctcatgcctgtaatcccagcactttgggaggctgaggcgggcggatcatttgaggtcaggagttcaagaccggcctggacaacacggcgaaaccctgtctctcctaaaaatac

SEQ ID NO: 269360 - DNA, 317 bp, Homo sapiens
ttgtcctgatccaaatccttctccactgggtgctgcttactaggcactgttaactacaaagcatgcctttcaatcctgttggccaccacagcttcaagtcaacactgcaaggcctactgggtattggagcatgcgctaaacacctttggtctttcttctatttgtgttttcactgggtaatgaggttctcacgggcaccacttttggctccactggctgttcatcccttccttcctgggtttcctattttgcaaatggtgccataatctgtctagttgtccatgacagaagccttgactctttcttccaacaaataa

SEQ ID NO: 269361 - DNA, 453 bp, Homo sapiens
attctacaggtatgagggagtttacatttggatttgtcaatggaaccattaggattttttgtttgtttgttttgtaaaaataagaacttttttccttagccttgtgtctgtgccaaaaatgtgacctttttttttctcccaagtgtgcccaaacagtaacaattttttgcttggattatgttaagaattagggcatttgaccataggcattagatgtatgtgcaatgaaagtgatcccctttaataagcataataggaacatggaatttgggcttttgtttgcagcttaggatgatggtgtgtcttgtaacccaaggaggtttttcacttttctgaaagtgagaagactggtcagcctaaacccgtggtgtcactgttcttaagggaaacctagttgaggagtgggagataaccatttcacatgttgtttttgtaccttggagaaaaaaaaga

SEQ ID NO: 269362 - DNA, 338 bp, Homo sapiens
gttgctctgcatcctcaccagcatttggtgtggtcagtattttggattttcaccattctaatagagattcacggatccatccgggtggtccgggcaccactggcgcccctctgcggctattccccagttccattttctgaagccacaggtcagaagccgctgtacaacactttgccgaactccagaatcttgaaggagacgtaaggagcagccacctgccgcgcaggcgcaagcctttctttcggcacaaagaccgtgggaggaggggtcggcgcaagcgctcggtgtctctctgaaaagaacatcatactgcctcctggctgacggagcgcagcgca

SEQ ID NO: 269363 - DNA, 557 bp, Homo sapiens
gcgatctgctatttgtttaaatgttgtttgcaaagttcctgaaaggaataataaaataatttgtcacttttatcttcctgggcaagagtttcctgcaatagtgaagttgtgatgatgaagatggtgcaataataaagctgtgttgatatggatagtaaactgtgtggtagagatggtttccattctgagagacaaatccaataggatgattaggattcttgctaagtaagcatttctttttaagaataactatttatttcctgattataaaagtcttatgtatccactacagataacctctaaaatattaaaaagtatcgtaaaataaaaattgttcttatctcattaagttcatttcaaaatgccataaactggatggcttcaaacaacaaaaatttattctctcacagttctggaggctaaaagtcaaaaatcaaggtgtcacagggccaagctttcatttaggatgggtagacatggcaaggccaagagttttgaagagtcttggagaataaaccagtcattagatcatctgttaaaaagttgtgcgatctgct

SEQ ID NO: 269364 - DNA, 319 bp, Homo sapiens
gaggatatggcccgtaagctgcccaatcttgcctagaactggctgcacctgctgttcttttgcttatgcgaattggctgcacctgttgttcttttgtttatgccttaaccccggttaccctaattcctattctcctgtctcaatagttctttacttctttctctcaaagcacgcttcttttatatttattacaaaggttgactttgtgtttcagataatgtcctctgtctttcaaaaatatttaaaatgtataatgctttattataggatccaccagagactaatgttcattgaaaataaaaaaatgagctaaggcgaa

SEQ ID NO: 269365 - DNA, 544 bp, Homo sapiens
aggtagactggggtaaagacggaggagaggatagtttagtttattacctaacagaaaggctattaaaatggacgagttgtagtcctatccctgacattttatgtccttggttaatgtgcttagccatcttgtgcttcagaaatgtcctcctatctgttcaaacctgtaatttttgaaggtttaaaccatgattttctgataatctcaaactgctcacatctccttgttagaactagtatcttagaaatgctaaaacgattagttctgaaatcacattgctcctaaaagaactaaatttttttgtattatcttcgtcttactattccctttcacttttataaagtcacagagagaagcactaaggtaaaatgaatgctatgttgagtttttaccatatatataacctagagcctaattttacctttcaaaactctagttttccatacctgtcaactcctaattgatgtctttatactgtgagctcactgtgtattcggaacaccaacccctgaaaaagcttaagccagagtagcacaatggaaga

SEQ ID NO: 269366 - DNA, 368 bp, Homo sapiens
ggaaaaatacctttgtgagtgttactttctatgttgttgcaataatattgcctgtgttaccaactgcccaggttggagagtcatgtgccataatctgtgtgaaagcacttttagaagtgctgtgcagttggaagcctgttattactgctacccccacaaccagtgctggtatcatcacatttgtaccctgactttggggtaggatatacggacatacacatttcatttctttccatctattttgagaaatctaagccagggaaatgcagtggaattcttcattaaaaattacctttggccaggtgtgggggctcacgcctggctgggtgacagagcgatacttcatctcaaaaaaaaaaaaaaatttc

SEQ ID NO: 269367 - DNA, 605 bp, Homo sapiens
ctatatggaagccctaacctccagcacctccgaatgactccaaatgagactgcctttggaaataaggtctttaaagaggtgatcaagttaaaatgagctctttagggtgggtgctgatccggtcacactggagtctttatgagaagaggaaagttagatgccaggcgtgtgcatgcactaagattaaaaaaaatagccacacaaaaacacattgggaaggtggccgcctgcaagccaggagagaggcctcaaaagaaaccagccccgtggacaccttgatcttggatttctggcctccagaactgtgaaaaaataaatttctgttgtttaagccacacagtctgtggtcctttgttcagcctaagcaaacaaatacagaaaggagtccggattcaggtgtggaaaatgatgataattcaatgtcaaaatgttgcaacagaaaataagtgtctggacaaagaggaaggagagagaaaagagggagtgggcttaagcaaggatcctggagttgggaaggaccttcaccgatgtctccccacaatcttccctccacggatccttgcgtgaccgatgccccctcatcctcatgagaggccctggctgag

SEQ ID NO: 269368 - DNA, 401 bp, Homo sapiens
tgaggctccgtctcaaacaaacaaacaaacaaacaaacaaacaaacaaacaaacaaaaaacagccgaactctgggcaagaacagtgggactcttgactcaggcctgctttcaatctccccttcctgcttggtcaggtgcaaaggttctgccagggtagggtaaaccatgaggactgatcctgaggctgtataaatgtgcacaggaacagggagtgggcccagcagaaagtaaaagccagggcagatgtggttttgtggcctaaactttgaatgtgttctgctatgcgttggcagagaacagaagcttgaagggctgagatatttgaatacaacctctgttcagtcactggttgacccataggctatacagacacaggggtgaccccgagaaagccaacttt

SEQ ID NO: 269369 - DNA, 419 bp, Homo sapiens
tgacagagcgagacaggtcctgtctcgaaaagaaagaagaagaattaaaaaaagtgattagatcccttgtgtttgggacacttgttggcagcagggatggtagcgtttatgagggttgcatgtaacatcgcctagctcagacatctgtttgactgtcttcccccctgaagcgcaggctctgtgagggcaggtcttttgtctttcttgttaatcttcatatgcttagtgcttgccacatagttgatgctcagtcgatatttggatgaattgaagggattaatgcattgaatctgaaccttgctttcttaatgcatatggggagttctttggaaagccacacagaggagcttggttgcctgcttcctctcttccccagattgtctttttattgttgtggcttcactgaagcactctcactt

SEQ ID NO: 269370 - DNA, 516 bp, Homo sapiens
aatcccaggtagctcacagccatactgttcctcaagtcctgaggtccttagacagtctctcactctcagagtcttcctatgtttatctgttctattgtgtccagagtttctaagacgtaaggatgaggaatggggcaactctacttggacagaaacagaagtctgcctagtagctttttgctttattaaggaaaggagagcaggaaggagggagaaagggagaatttcctttaacttttttgaggtataattatcaataattcacccatttaaagtaccaatccagtgtttttagaacattcaaagagctatgtaaccaacacaaagtcagttttggaagattattatcaccccaaaaagaaaccttgtgcttttttgttttggtgtgtgtgtgtgttttgtttgtttgtttgtttttttgagacggggtttcgctcttgttgcccaggttgcagtgagccgagagcacaccactgcactccagcctgggcaacaaagcgagactccatctccaga

SEQ ID NO: 269371 - DNA, 795 bp, Homo sapiens
agcaggagaaaaattcaacaaaatcctgtttctcagtgggtcattatttttttagttatgcttttaggcatgagctaatctctgattacctcaacactgacaataaaactgatttataaataatcacaatggaaccattcagtattggagcttgacaagcctttgttcaaagcccttcagtcactaaaaataatgtcccaataagacttaaatgtcataaaaccttttgcaacgaaaataaaagtttcatacatccactgaaacttgtacagtaagagaagcctgctaagcccttacctctcggctttcttgattaaaatgaaaagatattttactcttgagattgcctattttagagaaaaattacattttgaggatgggctcctgcttacccgatctctagaaagtggtctgacagtagcctctggttttgatttaatgagttgctttatcatttttttttctccttttaaaaatgaaaacagactgggcacggtggctataatctcagcactttgggaggccaagccaggcagatcacaaggtcaggagtttaagaccagctgggccaatatggtgaaaccctgtctgtactaaaaatacaaaaatcagccaggcgtggtgggcacctgtattcccagctacttggaaggctgagacaggagaatcgcttgaacctgggaggcggaggttgcagtgagccgagagcacaccactgcactccagcctgggcaacaaagcgagactccatctccagaaaaaaaaaaaaagaaagaaagaaaagaaaagaaaaca

SEQ ID NO: 269372 - DNA, 467 bp, Homo sapiens
caagtcccttatgtaaaatggtatagtattttcatataacctacatataacctcccatatactttaaatcatctctagattatttataacagctaatacagtataaatgctgtagtctttatactgtttttattgctattattttttatttttttcaaatatttttgatccacggtaggttgaatccacagatgtggaacccacacatacggagggctgactgtgtatgcttaatgacattttttcccttgtatgtacatagaaaaatattgtatacattgttagtccccctcatattctgtaatgagtttttcatttgttgatgttagtgtcaaataatttaaaatttaggctgggtgtggtggctcatgctggtaatcccagtgttttaggagggtgaggcaggagaatcacttgagcgcaggagttcaagaccagcctgggcaacgtagggagacccattctac

SEQ ID NO: 269373 - DNA, 456 bp, Homo sapiens
aactgaggctctggggattaagatcgtgaactgtggggagtggaggaggcacagctggagtgaacttgggtgtccagggttctgtttcgtctcacagaggatgtgcgagggtgtatgtgtgcatttgagaatgtgtgaggttgtgtgtgtttaagaaaatgagaatgaggctgggcacagtggctcatgcctgtaatcccaacactttgagaggctgagctgggtggatgacttgagcccaggagttcaagaccagactggggaacatggtgatgaaaccctgtctctacaaaaaaatacaaaaaattagcagggcatggcaatccatgcctgtagtcccagctacttgggaggctgaggtgggaggattgcttgaacccaggagataaaggctgcagtgagccatgatcgcaccactgcactccagcctgggcaacagagtgagaccctgtctcc

SEQ ID NO: 269374 - DNA, 447 bp, Homo sapiens
acatgaggacagagtgagaagatggctgtctgcaactgccctaagggccatcacaagaactcaaccgtgcaggtcttgatctcagacttccagcctccagaactgggaaacgccatgtgaagattatggatttctgctgccacaagccaagtaactaccagaagccaggagagagggctggagcaagggagcctggccctgacgacaccttgatctcagacttcgggcctccataattgcacgagccaccatgcccgaccaggaccggtgttcttataagaagagagagacatcaggaatgggtgtgtacagagaaaaggacacagcaagatggtggccatttgcaagccaaggagagagacctcaggagaaaccaacccgccagcaccttgatcttagacttccagtctccaaaattgggagaaaataaacgtttgttgtttaaga

SEQ ID NO: 269375 - DNA, 302 bp, Homo sapiens
gacatttccccaatatattattgtgaaaatttgcaaacagagcaaagttgaaaaaattttatagtgaacagcatatacctaccatgtagactaccactaacatttcactatagttggcttatcacatgtctgtacctttctctaagcattcgtcaatccctgttttttttttttttgggcgcatttaaaagtaaattgtagacatcagtagacttccgcctaaataactcagcatgtatatcattgactaggttaaatatttgttgacttttttcttttgaagtaaaatatgtatacaatga

SEQ ID NO: 269376 - DNA, 636 bp, Homo sapiens
actagcgcggcggccgccggcccgcaatggtgctaccctggttgctgctcgagactgcgcgcagggcggtcctcgggtccgcggaggctgcgctctgcgccatgaaaatgacagatgaaaatagaaaagtgtggctggtctgaagtggatgaagtaggtgaagctctacagatgaatccaagagacttcaaagagaagtacaatgaagtaaaaccatccaaatctgacagctagtgttttcttatttagccggagtgagaagcaagaaggccctggacacagcaatatctctgggctttcacagttactatgagaggtgtgttaaaatctctctctgaaagaaagaaagaaagaagaaaagaaagaaagaaaggaaagaaagagagaaagaaagagacaaccgtgaagcttgctgcatcagtggactcttcctttcacaaaacatttttctgtagtatgctatgctgtttgacagcattttactcacagtagaactgctttcaaaattggagtcagtcctctcaggccttgccaatactttctcaactaagtttatgtagtattgtaattcctttgttgtcatttaaacaatgttcatagcatcttcaccaggaatagattccatctcaagaaacc

SEQ ID NO: 269377 - DNA, 608 bp, Homo sapiens
actagcgcggcggccgccggcccgcaatggtgctaccctggttgctgctcgagactgcgcgcagggcggtcctcgggtccgcggaggctgcgctctgcgccatgaaaatgacagatgaaaatagaaaagtgtggctggtctgaaggtttgacgtcaataaagggaaactgccacaatttttatactgctatttctaaagatgtcacttataaggaacttaaaaacctgttgaattctaaaaatattatgttaattgatgttagagagatatgggaaattctggagtatcaaaaaatccctgagtctatcaatgtaccattggatgaagtaggtgaagctctacagatgaatccaagagacttcaaagagaagtacaatgaagtaaaaccatccaaatctgacagctagtgttttcttatttagccggagtgagaagcaagaaggccctggacacagcaatatctctgggctttcacaggtgtgtagatgaatgaaaaaatggattgataaatgtataatccaatgtttcatatatattacatttttatatgtctatttaagaatttcttgtaattactgtcagtaaaggcaggatagcaaaactaaga

SEQ ID NO: 269378 - DNA, 389 bp, Homo sapiens
cagtacttcatttttatgactaatattccattgtatgtatacatcacattttatttatccataatctgctgatgaacacttgggttgtttccaccttttggttattgtgaataaatataagcattagtgtacaagtatttgtttgagcccctgttttcatttgagcatatacatgggagtggaatagctggaaacctgttcgtttaaacctttatagctatttgtccatttttatgttactttcctagccatgaaaatgacagatgaaaatagaaaagtgtggctggtctgaaggtaagtgagttacctcaattgattgtccagtcagttacagatcgaacttgttctactctttccctccttctcactactgcacttgactagtctta

SEQ ID NO: 269379 - DNA, 389 bp, Homo sapiens
tccctgagtctatcaatgtaccatgtaagtgacatgtgtcttaaattaatttattaaaaaacatataaataatttactatatctaaaatctaactgaaattcttaacattttctttcagtggatgaagtaggtgaagctctacagatgaatccaagagacttcaaagagaagtacaatgaagtaaaaccatccaaatctgacagctagtgttttcttatttagccggagtgagaagcaagaaggccctggacacagcaatatctctgggctttcacaggtgtgtagatgaatgaaaaaatggattgataaatgtataatccaatgtttcatatatattacatttttatatgtctatttaagaatttcttgtaattactgtcagtaaagg

SEQ ID NO: 269380 - DNA, 874 bp, Homo sapiens
tgcttctcaaaaacatttaactctaggtggctattatcttactttaaaatgtggaattcagcccgacaccgtggctcacacctgtaatcccagcactttgggaggccaaggcaggcggctcacgatgtcaagagtttgagaccagcctggccagcatggtgaaaccccatctctactaaaaatacaacaattagccatgtgtggtggcggatgcctgtaatcccagctatttgggaggctgaggcagaagaattgcttgaacccaggaggcagaggttttactgagctgagattgcatcgctgcactccagcctgggtgacaaagcaagactctgtctcgaaaaaaaaaaaaaaaaagtggaattcgtgtttgaactaaaatgagtattatttcttcttcatgtgaaagtttataatattacctaatttagtaataatctatttgaattttaagctcttcttaataaggaaagagataaaaagaaaatcaacacatctataagttaaaacctatatgttattacatatttgaaaagtatttattgtatacctacaattcaagattgaaggaattttcattagcacatttttgttatgccttacagattttacttaatccaatttcatgagtgacacgctgtctttaaaaaggatgtttagaagcctcatgatttatatattctttgtgatggcatttttcaaaatcttaaatggcagtgaaaaatgccttcccaaatgctttgtagttcgtgtttcacaagttctcttgttggctcaattttgaaatgtgcaacatctgtttgatagtttcactaattctacaaatagaaatctataaatactttagacttctaaatttatgaatacagtaaca

SEQ ID NO: 269381 - DNA, 419 bp, Homo sapiens
tcggccgccccaaacttgcttacgtccaccctgctctccttctgaccgaccccaggatatctggagagatgtgaaaagtgtgctgacgcggaagaagtcggtttttccgcgagcaaagtgtcgtcccctcacgctctccacctgcagctccaggtgagctgcagcccagaccctggcgccgcccaacagcgtccgcgcgcggggaggactctgggtgggcttcacccgaccctcgaggttcctctcccagcccctttccactgtctccagagttacctctcagcagagcagcagcagccttcgctgccagcgagcaagacgatcacgttcactcgatttgaatttagttgttttaaccgtgctggaaaaaccctttaaacacagctttcctcccatcccttagacccctaacaccaaaa

SEQ ID NO: 269382 - DNA, 628 bp, Homo sapiens
ggtccaaagggaaaagagaaagagacatctttgtaacccttctcagaagagtgaggaacatctttcctaaaaagaccctcatgtgatggccacgccccctcttacgatgttatatcacgtgatccttcctatgctggatcttagtacagtcactcttcaaccacgggtaggatcagattcacaagacacctgagctgagtggaaaatcagccagtacattaatacaactggtgttttcttgggaagaagaaatgagagaatggatgccagacgcacaaccaaaaacaacccaaattccaacttgccaaaaattcttttttacccgaatagagtcaaagcaaaccatcctaatgaccatccctctgttgttcagtattaactcatgttggttttattaaatataaaatgctgcctggtcaaggaatctatgtttttcacaataatttcatagacatagtattaggggaaaatgtaaataattatttattttgaaagaaaccatttcatgtaacaccaagattcactttcttctgtattctgcatacctgaaatagtacaggaaacatggtggcccgccaaaaataatgatactatttctttccatttctatatattttcactttgggct

SEQ ID NO: 269383 - DNA, 419 bp, Homo sapiens
tgctttggttgctcagaggcaggtgttgtgtgactgagctttaattgaggagaacctgttgacttgtaaattgtaagtactcagttttcacatagtttcattttcctattaatctttgttttccttgacctgatttatatatgacttcctatagcccacctcagattcttaaatgatagtttgatgggacaatcatgaacacgaatatactgactttagttttaatttaccattttctttaaagctttgttgatttgttatagtttgttcctatgatttggttttggctcttataagtttcctgttacatttccaactttatttttttttagtcatgccacttttttctaacttaaactgagaataacaatatgacattcattcctaaggtgatttttctttttttttttccccctcaa

SEQ ID NO: 269384 - DNA, 315 bp, Homo sapiens
aaagaggaatgggccccagctgaccccctgaacccaggtggtgacatgtgcacggtggtgcctgctgaaggtgggcaagggagctgagcagggaccgggggctactgtacctccttttcacctcctcccgcatctggagcccctcctcctccacatgtgcgaatccaggagccacagaaggtggggcgcagtgggacatgggtaggaggaggaagaatatggggagattctagtccctcccacttagagatgcggtcgccatggtgactgaggaccagtgaggcgggatggggttgagaatgggggtgggggtgt

SEQ ID NO: 269385 - DNA, 664 bp, Homo sapiens
taagccccatttgtattagtatttttgggctgctataacaaattaccaaaactttggtagcttaaagaaatagaaatatattctcttatagttctggaggccagaagtccagcatcagtttcagcagccaggagcaggctgtcatcagacaaagctgctccagggtctccaggggcaagtctatttttttttacttctcttagcttttgttggtttaagctttcattggcttgagtccaaatcatttcaatctctgttgctgtcttcagatggccttctcttctgcaggatttttaaaaatgacatttaacaaagacaggcccctttagggcccacctggtcaatacaggataatctgcctgttttataatccttaatttcatgtgcaaaggctcttttcctgtgaaaggtacctgtatagtttccatggaatacagcctgatcatttgagcaccatactcagcactaaaccattatagaatgactcttcagtgttggtactatacacacatcacacgctcttctctctctctctcctcctctcgttccctctttcttccttctgattataaatctcctcacttccctaagcgtatccagtgccacctatgtctaggttagagcagcacacataggagggcctgcataggtatcattgtccctg

SEQ ID NO: 269386 - DNA, 393 bp, Homo sapiens
agaatttgctaatgtccagtattaatgaggaagaagagatgagaaaacagcattgctgttgatggcagcagaaattaatgcaatttaaaaagaaagtttggcaatatttatcaaaagaaaagaaattacacatgcatttggactcaacagttatgtttctagaaattttagtcaagtatattcacataaaacatgaaaagttatatgtacaaggatgtttaatgtaacattgtttgaaattgtataaaactgtgaatgaacagagtgatgtatacttaaagagactaatgaaataatggtaagtagaatactctttagttattaaaaagaatgagatgaatgtgtacgtactgataggaaagatgtgcaggataaattaagtgaaaaaaataa

SEQ ID NO: 269387 - DNA, 543 bp, Homo sapiens
ggctgcatagtgcaccggctggagcagcacgacagctgccccgtctgccgaaaaagcctcccgggacacaacacggccacgaacacccccgccccgggcccgactgggatgaactgctcctcctcgtggtcctccccctcctccagctcgcccagtaaagagaacgccacaagtaactcctgagcccgcgtgggccggcacccaccactgcccgctgcgcctgaggctgcggggaaaccgcggggactttcccaaccaccctcagccagggccgcacggcacccacagactgggtgccccagaggcgccagtcttggctggtcagcgctacaggccccgcctgttccagggcaggatcctggaccggcccaccggctccctggctcgggaaggcgtgggccacatggtcccctctggggcgccttcagcctccccgtcttttgtctaacctcaccctctaaacgttcagcggtggaaagatttttagaattttaaattattactgctttgaaataaatggaagttttagctcaaaaaaaaaca

SEQ ID NO: 269388 - DNA, 404 bp, Homo sapiens
cagggcagaatttagtgactgactggatttgaagccgagagtttggtggttgggggagtgaaggataacagttgaattattggtttgagtgactgggtaccaccttcagaatttgaagaaagaggccgggcgcggtggctcacgcctgtaatcccagcactttgggaggccgaggcgggcggatcacgaggtcaggagatcgagaccatcctggctaacaaggttaaaccccgtctctactaaaaatacaaaaaatcagccgggcgtggtggcgggcgcctgtagtcccagctactcgggaggctgaggcaggagaatggcgtgaacccgggaggcggagcttgcagtgagccgagatcgcgccactgcactccagcctgggcaagagtgcaagactccgtctc

SEQ ID NO: 269389 - DNA, 273 bp, Homo sapiens
ggtgtcagcactctccttcctcccagacctgctgtgaggattaaacgagactttacaggatctgaaagcactttctaaatgctaatgtgatgtccaaatagaaggcagtgttcatctccctcagccacttttgctgacttcagtctccccactaagtgaaatttcttaaatcccaaagcggaggctcccctcaaaaagggcatcataaattccctctgtagccaggagtcttaaagcttccctgaatttccccaaaccaagcaacacatttca

SEQ ID NO: 269390 - DNA, 509 bp, Homo sapiens
  misc_feature (286)..(286): n is a, c, g, or t
  misc_feature (387)..(387): n is a, c, g, or t
  misc_feature (414)..(414): n is a, c, g, or t
  misc_feature (469)..(469): n is a, c, g, or t
  misc_feature (502)..(502): n is a, c, g, or t
gcctattgactgcattaaaactgtggttattgttgagtgtttgcttcaaaagctgtttggttttaaaagcaagtaagagtttctttggcactaaagaaatttcagtatctgggcggatcacttgagctcaggggtttgagaccagctgggcaacatggcaaaaccctgttattacaaaaaaaaaaaaaaaattagaaaaaattagtcgggtgtggtgacatgcatcttttatcccagcctccagagtagctgggattacagtgcacaccggctgcactcggctgantttttgcatattaatagagaagagtttcaccagttggccaggctggtctaaactcccaacctcagtaacccactcacttcagcctcccaaactgctaggantacggggcatgagccaccacgcccggnctggtttttaaagaatgctcaagtatttctcatcatcatccatggagtttaaggngatttatttctatcatggaagtagccacttggncagtttg

SEQ ID NO: 269391 - DNA, 676 bp, Homo sapiens
cattatcttaagagaaacaactcagaaacagtcaataccacatgttcttataagtgggagctattaataaaaaatgtgcacacattgacatatatataatgtggaatgatagtcattactgactgagaagggtggattgggtgtggggagttaaggaatgagaaattacttaatgggtataatgtatactattcaggtgatggatacactaaaagcccaaatttcaccactatgcaatatatctatctaacaaaactgcacttgtaccccttaaatttatttttttaaaaagcgtgtatcctaatttgaatgagctgtttcttgccagaaccctaactgatatgtcctttgtctagcaattctacttctggaaattttcccacacttaaactggcacatgtgcaaaatgaaagagatttccttgcagaagagactggaaataattcaaatgtctatagtaggggtactaattatataaataatggtgtgtctatagagtagaactgtatccagctatttaaaaaacaaggatagaaagatcttccaaacatatttttaagtggaaaaagcagggtggaacagggactatacatgctatctcttgtctaaagatggggaaattaggaatatgtatttgtttttgcttatgcatgaagatactctgaaggattcacaa

SEQ ID NO: 269392 - DNA, 294 bp, Homo sapiens
gtctgtagaaacgacggaattgcctaacaggggcaagagaaaggcagttggaagcttctgcaaggcaccgttggtaccattctgaaaattcatgtttcctgtttgccaacacgtctgctttaaatccctcaagctgttaattacttgctagtgttatataccagcttttcttcatatttatagctttcatttctctttgaagttattcaagtaatatatgcttgttgtcaaaaatgtaaaatacagataagcgtaaaaaagaaaataaaaattccccataatatcaccacttga

SEQ ID NO: 269393 - DNA, 416 bp, Homo sapiens
ggaacagcactgtaaggtgataacttggggcaaacatgtaaataataaaacatatgttttaaatattcaggttagcacattttatgtttctgtgagattaaaattgtgtgtgacatacccgcttccttaaaggcaatgtttctgaaaatgttgtacctgctattcctgaatcagggatgggtcccagaatctgccttttaaacatctcagataatctgaagcctgcttaagtttgtaaggcactgcttttgcactctaaggaagaaaaaaacaagttttaattcccgtctctagaacatctcagtgaagcaaaacaggaaagcaaattataagttagtatatgtaagatttcagaaggcaaagttgtaaagattagatttccttagcctgggaacatggcaaaaccacgtctctac

SEQ ID NO: 269394 - DNA, 482 bp, Homo sapiens
agatttaataaaaacaataagatggcaccttagtgaggaatttttaaaattctgaaatatcagtataatcccttcactacacaattaaaattgtgacattttcaactattagttgcaaagagagatcctattattaagacctgacagtgttcacttctgcctgtaaagcaagacagttggactaaggtaatttctgtttagtgtcactcatcatattccagctgtggtacagctagctatgggaaaggctcagcaaagaggcagaagagaagggcaccggtgttccaagttgtttttacaagtccacgcaacagtacctgtggcctgaatagatgtctttttttcattagtcctgaagcctcttaggaagaacatgcaccagtcatttccctttctaaggaaagtgttgcagccttttttcagtagctgctgcaggctgagatttatgagaatagtcttgctagctgaactatgtttgaaaa

SEQ ID NO: 269395 - DNA, 484 bp, Homo sapiens
aaactatctaaataaataaacatccagtgttcataaatcaaaataatattgttaagatggcaatactctccaaatatatctacagattcaacacagtccttttcagaattccagttggcttctttgtggaaattgacaagttgattttctaaaatttatatggaatttcaagagaccctgaatagccagaacaatcttgaaaaagaaaattggccgactcatacttccaagtttcaaaacttacgtgaaacaataatcaaaacagtatggtactggcataatgatagacatataaatcagtggaattgaattgaggatccagaaataaacccatgggtctttagccagctaattttcaacaaggatgccaagaccattcactggggaaatcatcttccgatagcaacattcaaaagaataatgttggattactagtataagtttctaagggctgctgcaacaattattaccacaaactgggtga

SEQ ID NO: 269396 - DNA, 616 bp, Homo sapiens
catccagctatttttttgtatttttagtagagctagggtttcaccatgttgtccaagctggtctcaaactcctgaccttcagtgatccgcctgtcttggactgccaaagtgctgtgtttacaggcatgaaccactgcacctggcccataaagctttattctattttaatgaagcaaaaatgcataagtgtgtaagtgtgatcatatgtgtgtgtatgtctaacaggagcactacatagcaaaatgcgaatgctgcttatctttggtgttggtatcacgtgtgatttaaaatctgttttcttctatttttaaaaactttcaaaatgagtcatgactttgattattagggagctgggagaaatgagagattcctttgcaggtgtcacctccctaccagaaaattggccttgcaggaatgtcctacaagccagatgtgtctctttcccccagtccctgtgcctggtgtgaggtcgtacagacagtgagcatccttcacagagtctgacctgccaaggtaggggggaagtgggggtttagtgacattcaaaacccgggggagccgaacaggtgtgactgtatgtttgcagggtgacctctcccctcaaagagcaagaaat

SEQ ID NO: 269397 - DNA, 653 bp, Homo sapiens
catccagctatttttttgtatttttagtagagctagggtttcaccatgttgtccaagctggtctcaaactcctgaccttcagtgatccgcctgtgtttacaggcatgaaccactgcacctggcccataaagctttattctattttaatgaagcaaaaatgcataagtgtgtaagtgtgatcatatgtgtgtgtatgtctaacaggagcactacatagcaaaatgcgaatgctgcttatctttggtgttggtatcacgtgtgatttaaaatctgttttcttctatttttaaaaactttcaaaatgagtcatgactttgattattagaaaagaaatctataacaattgagaggaaagaaaaccccacctgttgttgaaactggctggagctgggagaaatgagagattcctttgcaggtgtcacctccctaccagaaaattggccttgcaggaatgtcctacaagccagatgtgtctctttcccccagtccctgtgcctggtgtgaggtcgtacagacagtgagcatccttcacagagtctgacctgccaaggtaggggggaagtgggggtttagtgacattcaaaacccgggggagccgaacaggtgtgactgtatgtttgcagggtgacctctcccctcaaagagcaagaaat

SEQ ID NO: 269398 - DNA, 386 bp, Homo sapiens
cacagaagtgagctaggccagggattgcaagatgcggtggcctgcccgtagcagagagctgtggggccctgatccgcggtaccccgcatggggacgctgtcacagagcaaggcaggaggaaaatgtggtggtcagtgacccggggaataggaagggagcagctagggttgagatgccaggccctggccagcaggtttggagtaaggggtgtagagaaacaggaagtgttactcagcctgggttcccctgttcctcccgatggctgcacccctcccctctccccggctgcagcagtcccagctaggccggactgctaagcctggcccagagcacggctgacaattcacggcagcctccctggcccagcctcctgcaagagaaggagg

SEQ ID NO: 269399 - DNA, 344 bp, Homo sapiens
ttgcctgctcactggaggggcaggggaagaagcagaagcaacagccatttgagggttgactggctctaaggaaaagctgtttgctggcagacacaggtggctggtgacaaagggaacagagcaggggaatggatagctcaaaacgagcctcgccactcctgaacagaacagcaatcccagctgtgtcctttcgagggtgagtgaaagcacatgctgtcctttacatgcttgaggcggacttgcctgtctcttcaggccggatgctcttcagggccctgtggggcttaaacacatgtactgagctagctccaatcttaatctgcacaacatcgcaacccctgagt

SEQ ID NO: 269400 - DNA, 427 bp, Homo sapiens
tgctctgtcatcagtgcccttcatgggacagaagacaaaattgtgtggaaaacacagacatctaacaactctgagtagaaaaggatgtgaaagagcaggactctgaatgtgaagaaattcttggaataccttcatcaaattatttcatttcaaatttaatttttaatgtatgttcaagaatgatagataaaatccaaatgtgaagaagtctgcaagagcccttttaatgggcataattaaaacttctgaatgataagaaattgtgtcatgtcagtttgacagtcatttgtcttttttagtagtacattaagatttagattcgataaaatggacatgttaattagcttgatttaatcattccacaatttatacatttatcaaaacatcacattgcacctcatgaatatatatatagttattatttgtc

SEQ ID NO: 269401 - DNA, 200 bp, Homo sapiens
tcattgtgataggaattttcttccaaagacattaatgcgctatgattattctcacattcccccttcctaacaccaatttgggaacatcactacttgtatattatcctactttgatagcaaattgctaaaagctataaatttttgtttttgacttacctggggctaaataaagtgttatttgcttcaaaatgatttaagtc

SEQ ID NO: 269402 - DNA, 632 bp, Homo sapiens
tgcggtgcctcacgcctgtaatcccagcactttgggaagccgaggcgggcagatcacgaggtcaggagatggagaccatcctggctaacatggtgaaaccctgtctctactaaaattagctgggcacagtggcgtgtgcctatagtcccagatacgcaagaggagaggctgaggcaggagaatcacttgaatccaggaggcggaggttgcagtgagccgagatcgcaccacactgcactccagcctggcaagagtgagactccatctcaaaaaaaaaaagaaaaactttagtttttcctgttataaaaaataatgcttgtaattcaagccgtagaataaagtgaaccgtgatcaggaagggaacgagggatagagtcaaggaagtgggtggctcacgttgcatgatagaaaaagagacttagcagccgggcacgttggctcacgcctgtaatcccagcgctctgggaggctgaggtgggcagatcacctgaagtcaaaagcttgagaccagcctggccaacatggtgaaaccccacctctactaaagatacatgaggaaggagaattgcttgaacctgggaggcagaggttgcagtgagccgagatcgcgccactgaactccagcctgggtg

SEQ ID NO: 269403 - DNA, 702 bp, Homo sapiens
atggcatcctttagagtaataggccaatttcagagtaaaataatgttactaatttcagtgacatattatgggatcttgttatttctcatacaattctacctgctcagcataaagcatttatcaggcagtttgtttaaatttataatgaatactcatagttaaaaataatcaagtaacaataagacacaatagtctgaggcttaagaaacttttccttcataatcagctagatgtattacagaactcctgcctaaaaagatctagaggttaaagtgtactgtagactcaggtattatcagtgtacccaactctataacaacatacatgattccattcagttgttctttgatctgtgatttagagataagatgatcataaactctttgcttatacttttagatttgtgggtcattgatcattggatccataagagatgttataggtgatcttttccaatcctcttaatttataaatgagaaaagaagatacagaaatgttatgtattgtggcccaggttatttaacaaattactgggtatatggcaggatttggagttagaactcaaggttgtcttgtttctgtattcccctagtcagctcttcatagacctttaggacttagctatattctgaagtactataaaaagagaaataaacatggttttcactaatgggaatttcatttagaaaaacaaattttcag

SEQ ID NO: 269404 - DNA, 474 bp, Homo sapiens
aaaaaaaagaactaaaagtattctagctctgtcaccaactagcaatgtgactcagggcaaatcatttaacctctttgggtttcagttttctcgtttgtagaataaatgagcttgctaagatcttatccagctatattctacttcaatgactaaacagatacttgtaaaatgacatttgtaatttatcagatttctggatctcacgtagtagttagttggaatatttttgtcctactcctaagtagcatgtttcaagaatacagggccttaaactattagaagacacactctaaactacctgctgctacaattttaatcagtgattcaatcttaaattctttactttcattcctaagagcagataggtaaactccttggaaataatgcttttaattgggcttacaagtgaatacactgggctaaagggttgattccttgatattatcatgtgaataagatacccagagatgacag

SEQ ID NO: 269405 - DNA, 113 bp, Homo sapiens
aatcccgtgggggagggggttcaagttctgagagttgagggactgcagccaacatgcctgggttccaatcgagggtcacccacttcctaacctaacagtataaacaagttacc

SEQ ID NO: 269406 - DNA, 408 bp, Homo sapiens
ttttcacagattatcccttaatctgtgtctaataaaatctaattctgtattattgaagtaaaacacacactaaagtgcacaaatcttaagtgtacagcttgtagaacgctgttgaacatactgccatatgcttattggccaagctctgcttcacttaactctcagccattgtttggaatcagcagaaacctctagaggaaatgccactacaaatgccaagcttgcattctggtttccttcctttcacagatcttaattttatgcttttcctagactttttctcaggaggaacatttatctgaataacctaatctgcaattgctagaagtgaaaatctcttctatttaattcttgttttcagggaattagagataagaaatagttcatcgtcaggtgaaaaaaaaaaaa

SEQ ID NO: 269407 - DNA, 609 bp, Homo sapiens
tagaagtgattttcattcattcacccatccattcattcatgtgtttgttcaacacatttttattgagcgtccttgtggacgtggcacagttccgagtgcagtgaataaatgtctccccctccttgagcttatattctatttttatttttgatgtgtcatagttacttctgttaatcagttcagtagaagtgctgagatactctgtgacaaaacagatcccatcgacatcatttttacaaataagaccagatgtcctttagccttgtcaacaggcttgggccatggtgaacaatgtctgcctctgaagtgctcagcagaccgtgtgaaagaagaaggtccgggtgtttggaaacaatggctgagtggcggtagtggtgcattgtgacctcattattctgcttttggtttctcgccttgtaatatgaataaggcacatgaggatttagtgtgtgtcataagataagtgactgtcacgttaagcttaatgtctctgtttctgtaactttctccataatctggcagtatctcatttcttcgtggccagtgtttgggcactgaaaaggtcaatcaatacatagaattgtgactcaactcacgctgaaaaaaaaa

SEQ ID NO: 269408 - DNA, 3307 bp, Homo sapiens
  misc_feature (525)..(525): n is a, c, g, or t
  misc_feature (641)..(641): n is a, c, g, or t
  misc_feature (856)..(856): n is a, c, g, or t
  misc_feature (1292)..(1292): n is a, c, g, or t
  misc_feature (1296)..(1296): n is a, c, g, or t
  misc_feature (2323)..(2323): n is a, c, g, or t
  misc_feature (2714)..(2714): n is a, c, g, or t
tccagccttattcatatgctgctcctgtttgatcttggtctactctgggaatggggctgtcttctgagaatgaatatttgtggtcagtctctaagacctactactactggtttcctctgaactccttgtgcctgcctactgtatcaccagagcatctcaccagttctgtggactttctttgacagtagttttggagaaggtgaaattacagctttatagggactttttcccccttgtttgtttcctctatttcatttcttaaatgagcacttggaagatttggaaccatgctgctgccatgtttcccaatattgacttaatgacagagttttgatgactgtgagagcaaaatcaaaagagtaaaattttttttgccttataactattatgcctaaatgagtgatgtgaattctcaagatcatttcattattacaatttggtagtcttaagatgtagtttatctaggaaaaggaaaatatttctttagccactctaactcttggaagagtatgtgtgtaaactctntttttttttttttgagacagagtttcgctcttgttgcccaggctgcagtgcattggcatgatcttggctcactgcaacctccgcctcccgggttccaagtagctgggaattacagncgcccacgaccacgcccgactaatttttttttgtaatttttggtagagatggggtttcaccgtattggccaggctggtctcaaactcctgacctcaggtgatccaccagcctcggcctcccaaagtgctgggattacaggcgtgagccaccgcaccagcctgtataaactctttagttaattttataaacgtcgtagtcccatcttccatcatgnggctatttagaatataaattcaatataaatttgtatcattttgtttgttatcttctaggccaattttttctttctgcttcatctttataaaattttgttttcttcttttttttccacccgaaacagggtcttgctcttttgcccaggcatggtgcagttgaggctcactgcagcctcaacctcctgggctctcaacctcctggactcaagtgatcttaccacctcagcctcctgagtaacagggaccacaggaacacaccaccacactggccaatatttgtaatttttttccagagacagggtttctctatgttgcccaagctggtcttgaactgctgggctcaagtgatccactcgcctggcctgggtctcccaaagtgttgggattacaggcatgagccaccatgcccagtctatggttttggttttttttttntttnttttttttttttttcagacagtcttgctctgtcgcccagcctggagtgcagtggcacaatcttggctcactgcaacttccgcctcccgggttcaaacaattctcctgcttcagcctcctgagtagctaggattacaggtgcctgttacctggctaatttttgttgtatttttagtagaaatgttgtttcaccatgttggccagcctggtctcgaactcctgacctcgagtaatctgcccacatggacctcccaaagtgctggaattacaggcatgagccaccgcgcctcgcccaatttttcatttacatgtaaaaaagtccctctttcttccttaggtttgagttagtcatggaatcggatttgaaataaatctttgtggacgagagttttatgttttgttgttaagaaaaacaaaagtcatgcatgacatagatattcattcttttactcaacaaacacttagaaacttttttcttaacttcttatttgtaaaccttttttccttaagacttttatagcaaaatttgaatgtcattaatataagaagagatttatatggaggttatcattgaacattggaccacaggtagctaggctgtttggatttaaatgccccattagcacctatctatgataagtataacagcatcttagaagaattttatgtggtctacaagagcctctttatcttgaaaatgtcgaattttttagaatgcttgggtgtcagcttagagtttcattcagttttcacctacctcgaagtttcctttgaaatataaaccttctgggcttcaggcaacatgaaggcagagcagtaagctcataagtcagaactgtagcaaccctggaggttgctagcggttatggttttaatgttcacaagaacaggaagaaagccttgggccacccagaaatggggaactgtaatcgatccctgcataaagcagagaccctggaagggcagctccctcaaagaaaggagaactaggaaaatgttttcgccatctcccaaagatgataggaaanttctgagcagggttctgggtatagccccttgtgagaaattcaaggcccaatcaatgccatagatgagttatatattccaaatttacactacttatgtaggtgtagtaacctccaaatcaataaattaatataaaattggcccaggactggtgaaacctagagtcctgtcagaagcaaatacaaagcagccctttaacaacagttttaaatttagggccttcaagacccccagctgaaaagaaagtctctactgaaagtgagctcacaatttaacaggagagagagagaaagatacactgtgaaggatagtcaaaagacattgcaaagaggaggactggtactgtccccacccccactaagagcttaagatagaacagtctgaatgagactntgaaatatatttaaaatgatgaaagaaaaatgtcagctttcctctttccagtcaagacaggtgggatcccattgtttaatctagaaatacctgtgtgagatactagtattgatggtgagacgtcaatagtaaaatatcttggaggtaaaactaaacattcttcagtcatttaaataccagcacagcaggcctgtttgccagttcactaactaccttgttgccacagtagttgactgcctttttttcagcaaagggaataatgatttagagggtagacgagtgagtcacaatgtaacttggctcagacaagaagaataaagcaaggattactatgcagatggaattggctgttactatgatgacagtaatgtgttaaggggcttttccagcacaggatcctgaagaaacttaacccaaatctacatctgttcccttttcattgaaatctaacctcccattggccacagagcctcaagcctaatatttgaggacagtcagcatgcacgcaagaatgctttacctcataagtaggaaagagaatttgggtcacagaaaccagggcaaattttctgctcttaaaatgaaaagaaaaa

SEQ ID NO: 269409 - DNA, 379 bp, Homo sapiens
atacatctgtcattcagtaacatgggatccaataggtgactggttcaggatttgaggatattggtttccagccattaatttctttgtatcaggaaacaagatacaaagagacaagaccacaaatcaagtgtttaaaatttatcaatgtaagtcgttatactcggtattatgcagttttctcttattttttaaatctctgttactgtaggtgtctgtttctgtttatagacatagttttttgtttatttgaattttgtgtttatttcttaaaattttaacctgaagtttcagttcaaaaattttaattctttatataataaatgacatttttaaacagaaccatctttagagtaaatttaaattttttatgtttttggaa

SEQ ID NO: 269410 - DNA, 182 bp, Homo sapiens
agagcaatatttcatcattaaaagttgcaactgctatgagaagctacgttccttgaaaacagagtttttggccaggaatagttgcttatgcctgtagttccagctacttgggaggctgaggcaggaggatcccttaagcccaggaggtggaggccaacctgggcaacatagccaggcccggt

SEQ ID NO: 269411 - DNA, 689 bp, Homo sapiens
tgagatggaatctcactctgtcacccagcctggagtgcagtggcatgatctcagctcactgcaacctctgcctcccgggttcaagcaattctctgatctcagcttcctgagtagctcggattacaggcacgcaccaccacacccagaaaatttttgtatttttagtagagacagggtttcaccatgttggccaggctggtcctgaaatcccgacctcaggtgatccgcccaccttggcctcccaaagtgctgggattacaggtgtgagccactgtgcccggctcaggttaataattcttaaggtactcaattgactagattgatatttctttaatgtttacttcataaattagtgttatctaatacggcatttaaaatgtttacatttaagcatggggggtaatgagaatagcataatgaagggaaagcattcatggggatgtcagttctctgcacaaagacaccacatatagccctctactgtaatgcagggggagctaactctgggacctacaggatgcctgaaatctctgaaatagagcacattcttatatgcaggcatcttgctggaagagacagaaaggatataccactagagtgggactgaccagaaacccaattccaattctctttagctgtgtgatgtgtgaaatctttgcctgtttccttatctgaaaaatgtggataat

SEQ ID NO: 269412 - DNA, 231 bp, Homo sapiens
gtccttattgtctctgctaagttctatttggattctactgccagcagtttctcctctatttgggctttgtcttggaaggaagtgttgatttgttagtctcaagatctcataaagttcagaccactccaatatctccagaactttaaaaattagaacagaaatcaatgaaattgaaaacagaaaataaagagaaaaaaatcaacaaaatcaaaagatgattctttgaaaaga

SEQ ID NO: 269413 - DNA, 361 bp, Homo sapiens
ctccctgtatcacctggtgcacatgtggtgtatgctaaaggtggccagggagggtcatggaaaggagggaaggtgtcccaggggagagcctggacaaggggaagcagggcctgagtcttgagggtcaagtgtgaatcagctccgagaagagagggcaggggacagtcccagcacaggtcatgggaaagagctgaggagcatccgctgggcttggcacatgagctgagatattcctactgtgaacctaataggtatcattttagatcctgagttatttaaaagaaagtcgaagccccctcactttactacagtgcgacatatcagtgtagcaaaattacacttgtatgttgtgaatatacac

SEQ ID NO: 269414 - DNA, 399 bp, Homo sapiens
agattttttttgtttagggattatttcatgtcctccattatagtattttgattttattaatgtcttgcatatcttttttgttgttgttagatttattcctaggaatcttatggttgctattgtaaattcttttaattgacattttccagttgtttattgctgttgtatcggaatgttaatttttcatttattgatcatatatagagcaatcttggtgatttattgtcataaaattgtttatagtattcacataatttttttttaacatggagtttatggccgggcgcggtggctcacgcctgtaatcctagcactttgggaggccgaggcaggcggattgcctgagctcaggagtttagcctgggcagcacagtgaaacctcgtctctactaaaataca

SEQ ID NO: 269415 - DNA, 389 bp, Homo sapiens
ctgataggtgaggaattgctaaaatatttttttaaattgggaggtcatgtataataattaaaaaatatatatataaattgggaggtcattaggctggaatggctcctgggctttaagttcccactaagcaaaccaaatcccagcataaaacagtgaaatgaaactagcgcctttatcagtcagaaaccaccaacagaagttagtttgtggttgctgactggtaaagactctagtcgatattgaaatacgttttctttgccttccttctgcatttagcccataaacttgctgtccaagctgctgcagcagtcttctgaactgcttctggttctgagtgctgcccaactcatgagttgttctgtggacaaataaactctgttaaatttatt

SEQ ID NO: 269416 - DNA, 457 bp, Homo sapiens
aggctgacatttgaacaaaggtttggatattaccaggcagagagatggaggtggtaggaattccaggtaaagcgactgggaaaacacatgctgtgcttgggtggcaggagcagtccagggaggacatggtgggactgtgctgcaagaagccttgtatgccaaggagatgagacttcccttgtacatacagccaaggataagaatttgatgacgatttctaatgtatcttagcatctaagttcccttaatttgtgctcactggaaaccacagagttttagaaggcttttgtcattgtggtttaaaagaaaaaaatagattgttcaaagaacagtgatacatagggaaaatattttgactcaggaacgtaatttctcactaaaattggcaatatttgtagccccatgggaactatgtttccataggacattctgttcgctgtccttgggaagctatcta

SEQ ID NO: 269417 - DNA, 373 bp, Homo sapiens
atgcattgtcaaaaatgaatctagtgtatcaaaaccatactgtcacaaagagtattgcttacagttaagctaggtttaaaaatttctatcttaatttacaaatgatcattagatatggcaaaaatcattgtagatatttgaggatgggttggaaattgcaactcaattcacaatctcattctgcttcaccttatgccccacacctatctgaatttccagttgctgtaagaagatgtaccaatgtcactgtgatcatttttcaatatgaagactcaaagaagactagaagcctaatatatagaacatgtttcttcagatgctttcatcacattaaaaataccaagacattttataaaacttaatgacttttata

SEQ ID NO: 269418 - DNA, 431 bp, Homo sapiens
gcctactactactaaattcgcggccgcgtcgatctccattttcattctggccatgacagatcaagaggttatattctcccatcagaccttactactttcctgtagagttgaatattattctgattttatgccatgtctgtgaatgtctttgtgtgcacgctacctagttatgcatctcctctttcaaagcatgttaaaagataccaatagtaaatgattctgcttatatgaggctaactaaagtagtcaaattcatagaaagtagaatggtggtgaccagggactggggagagagggaaagaggaattgtttaatgagtagagcttgagatttgttacatacatacagttctactgaactgtacacttaaatatggttaagatggtaaacttttatgttgtattctttttagcacaattaaaaaaaaagaa

SEQ ID NO: 269419 - DNA, 314 bp, Homo sapiens
cagtttatttttctgaaatatctagtttatctctaggcttaacttttacataaaattttatataaaatcagaattgttaattgatggacatgtaagtgacttatcatcattgctttacttgtatgccagtgaatgattagaccactttcttcagtttttaaaaaattaacacttttcttctaaggagagctttcttaggcatttcaaagaactttcgaaaaagtgtgtgctggtattgttactatcagcacattggtgaacttatttaccaataaatcaagtcttactattccccacccaactaaaccacatgt

SEQ ID NO: 269420 - DNA, 444 bp, Homo sapiens
tggagagatttttatatattcaggatacgagtcctctgtcaaatgtgtcatttacacacatttctcccagtcagtggcgtctcttttcaccctcttaacagattctcctacaaagccacattttaaactgtgattaattccagttcatccattttgttttacgaattgtgcttttggtgttccaactccttttaaaatccaagatcagaagaggtacctggacaaattacctgataccccccgcttccccagtgactagtttcctcatatgtaacacagggaagataattatggcatctacttcataagttgcatcaaaagagtaaagagtaaagctatatacgcacttaaaacactgtctgacacccctagtgtttgctgttactatttttactaatgaaaataatatcttcatttgttcagactaccttatgaaagtcctct

SEQ ID NO: 269421 - DNA, 1227 bp, Homo sapiens
cactgaaattcagagtgagcttaccaaattgaacttccaacgtttagttaggtaaatatgtactttcttaccacattaatacttttatgtttttcccatctctgctgcttttattttgcaacttttaataatttaggtagatttgcaatgaactttttggtttgtttctgtaaaatagtagtggatttccttctcttttatattcctttgtgatatgtagtgcaacacagtcttactgcttaaggttttcatccttacctctttgagttcaaagagatatttaaaacttgccattatttggttacctttatttggttgtcatgttgttagtgtatggcagaactattagtttcctctttttctgcatcacatttcataagtggtcaaggcatttggacatattcacctcctattacctattaaaaatacttcttaaagattgcttccttcgaaaaactgcttgtcatggagaggctgaggacatttgtaatttaaacctgtattttccttttcccagttgatacctgcccccagagaacactttagttcttgtctataaggcttaccaaaagtttgcgggaaaggtggtcctgtgctgttaccactttgaccaagagaagaacctggagattgggatgtttttgcatgtcaggatttattaattcaataacagagagggatgatgcttctcacttattctgatgaatcagcaaagattgcaaagcataatattaatgcttatgtcttgaattggcacattaaaaatgacactagcattaaaataagccactgttttcaaatgaaaatgataatttgagtaaagagtattgaattggaagaaaacattcttccagaagatttttttcatcataaaactatctgatttaaacatttcatgttttctattcacaacaaggataaatgattaggaattttggatgtctcaaatatttaatactgaatattgttcatgtgttttcttctttgtaaaagtactttgtatctgcctgtttgctgtggaatacttttattttgtaacttcaatgtctttacataagtatttcccctttcctgctctatactaggatctgtggtgttcacagtactaaatacttgtatgtaacgttagtagttgaaggaaatgagaaaagattaggtggaagatagaacgtatatattttatagaacatctaaaaactttaatgttctgaattactttcttaaatg

SEQ ID NO: 269422 - DNA, 435 bp, Homo sapiens
cactgaaattcagagtgagcttaccaaattgaacttccaacgtttagttaggtaaatatgtactttcttaccacattaatacttttatgtttttcccatctctgctgcttttattttgcaacttttaataatttaggtagatttgcaatgaactttttggtttgtttctgtaaaatagtagtggatttccttctcttttatattcctttgtgatatgtagtgcaacacagtcttactgcttaaggttttcatccttacctctttgagttcaaagagatatttaaaacttgccattatttggttacctttatttggttgtcatgttgttagtgtatggcagaactattagtttcctctttttctgcatcacatttcataagtggtcaaggcatttggacatattcacctcctattacctattaaaaatacttctta

SEQ ID NO: 269423 - DNA, 2407 bp, Homo sapiens
  misc_feature (1213)..(1213): n is a, c, g, or t
tgatctgtacaacagtgaggaagcaacctaaaaagacccctttgcctaccccgttggatgaaagagaggcttggcgctgggatgtagactgctaggcgcatgagacctacgaagaactgaggctgcgtccacttacccagagtgtctttggagagtaccttttagtccttcctcggggcagttgccatatagtctgaaaatgaagccacctcaggcagtgggcttcgattggctacaattgtgcccttcttactttagcactttggcaaacattgagaaaattattattatggaaattttctttctgttttgagacaggatctcactctgttgaccaggctggagtgcagtggtgttgtcatagcccactgcaacctcgatctcctatgcttaagcaatcctcccacctcagcttcctgagtagctagggccacaagcacatgccataactccgtggatgccgaaagtagataacgagacctactggatcagaatgaggcagattagtacacatcgcacagcaaatagcaggaatatcagcatgaaagtgctggtgcccctgacctcaagtctcgtggggtgacatgatgggcccagatgatgtctatgcatgaattgggtttgcctacagctgaggaaccaaggaccaccaaggacttagcactttcctttctttttttctttcttttttgtttttttgagatggagtttcgagtttcactcttgttgcccaggctggaatacaatggtgcaatctcggcccactgcaacctcctccgcctcctgggttcaagcaattctcttgcctcagcctagcgagtagctgggattacaggcatgcaccaccatgcccggctaattttttatttttagtagagacggggtttctccatgtttgtcaggctggtctcgaactcctgacctcgggtgatctgcctgcctcggcctcccaaagtgctgggattacaggcgtgagccaccacaccgggcctgggcttagcactttttatagcaagtgatagacaggccaggcttcttctcctcaatgggggcatgtcatgctacagtctccttgaccaacttcatgtcgccagctacaagaagacagaccttgcagtttggcactctcagcaaggacatgcagggatgcttggggcctcggccaaaggcagcatgatatagatggagcatagtttaattaatcatcctgtcntgttatttagaagtttccactttgttcctgtaagaaagaatcctgtaacattcttgtggataaagttttgctcacatttccagtgattttcttaggctagattcctgtaagtggacttactgggttagggagtttaactttgtagtctcttgatatgtactgccaaatgggttttcagaaagtgtgaatcagtttacacctcataccagtatatgatgatacttgttaatttatccttcctgacattgaattactatttttttaaacttttttttgaatttttttttttgaggcagagtcttgctctgtcacccatgctggagtgcagtggtgcgatcttggctcactgcaacctccacctccctggttcaagcaattcccctgcctcagcctcccaagtagccatgcctggctaattttttttgtatttttagtagagaaggggtttcaccatgttggccggactggtcttaaactcctgacctcaggcagtctgcccgcctcagcctcccaaagtgctgagattcaggcatgagctactgcacccggctgaatatttttttaatcttttgggttgctgatataattaaaattttttcctgcctctctcagcattggcagaatgaactttgttctaagaacctcggctagtgtttacatgtattagaatgggaaaattatagcagcttctttcccaggtcgttttttattcatctattcaacagatacttattgaacacctataatgagctggacactctatgggccttgcaatttagacatgaatagagttctcaggtaccttacattctaattagaaggagaactttgacctctaaccaagacctgtttaattcataggagggtttcttttcttttttttaaactgcactcacggtcatccccccaaaggatgagggtttcttaagttatgttgaaaattcaaaccttgagtccgggcatggtggctcacgcctgtaatcccagcactttgggaggccaaggcaggtggatcacgaggtcaggagatcaaaaccatcctggctaacacagtgaaaccttgtctctactaaaagtatgaaaaaattagctgggtatggtggcgggcgtctgtagtcccatctactcaggaggctgaggcaggagaatggcgtgaacccaggaagcctgggcgacagagcgagactccatctc

SEQ ID NO: 269424 - DNA, 410 bp, Homo sapiens
tatggctttgtatttactggttcttagggtagtgtgacatcttgggacagtaattattttatagaaataataatcaagtgttcctttagccaaaaatagtattttagaaaaattgctttgtcatatcattgcatctagtcaacatattgtaaaaatgtttcccatataaaatgaaataaaaacctttttccagttgagttacatgttcctgttttttcttgtgactaaactataaaaatccacggcaatttgacattgaacatctcagcatggtagtaataaagtaataattttataatactggcaattctttatgatttaagaacagatttttatagaagaactatacccaccctgctgggtattagcccagtggtgatgctcattagcagcaggtaagggagaaaata

SEQ ID NO: 269425 - DNA, 348 bp, Homo sapiens
gtaaaagcaaccaaaacagagtccaagtcagggtccttccatcctcaaaccaggctccagtggtctgctctagctcaggcgtgattagatttgcattttagaaagaaactttggctaccacatggagaaataatgaggagaagcaaatgagaagaccgcccaaagcagcagttctggcaggagatgggcactgggtctcctagttggtggctgagtgcagatgctggcaggatgtcctgaaggtagaatggagtgcataattctgcaggtgtgatgtatcttcaaatattagaaaagcaggaacatgctgagagcgaaacagaaaaataaatcaaaaagaaatcaaaa

SEQ ID NO: 269426 - DNA, 295 bp, Homo sapiens
acgccccccaactttggcttcccaaagttttaggattacaggcgtgagccaccattgccagcctctaaaaacctttaaatagtaatactggcctagttgagaaagtcagtgttgaaacattaataacaaagcaatggaaaagattccactagatttctcagaataattttatcttagaaaatattgggccaggcatggtggctcacgcctgtaatcccagcactttgggaggccaaggcggccagatcacctgaagttgggagttcgagaccagactgaccaacatggagaaacc

SEQ ID NO: 269427 - DNA, 438 bp, Homo sapiens
cacagaggtgatatttaacgattagcagcagagcccgctgacagtgccaggctcctttagggattagaggattcggttggttaacaaaagaaggagcccaggagaacagtgctttaattaccagagttgttactggaagacaaccggttgcctcctggaaaaagatctgtagaaggtggctgctcctgaatatcgctgctggttctgcccagtgcccggcttctcacctcagatgttctgaacagttgtcagatccagcccttgaatcgttggggagggaaaggaaagaatgactcgcataggattccatgccaggaaatgttcctgactgcactcggcagcagcgttggagcactccagttagggcagctcttcaggggacagcgtcgcatgcagacttcctgggaccggctctcagggccacagctctttcctcat

SEQ ID NO: 269428 - DNA, 580 bp, Homo sapiens
gtgtctgtaaagtaccatcacccttttctataaagtagtgcatcatgtggaggacatttcgtatctgtaaagcaccatcacccttctccctaatctgtgcatgtgtgtatctgtagaagtgtgcgtgtgcgagaatccacccttcatgatttaattgaaatcacagagcagtgatcagcagcagcgaagatgaccctcacagctggggagcccatgcttgatgtggtcagcattgcctccctgcaggagggcccggctcagggagtccttctcagacccctctgtcttccctatggtctattaatctccccatgcaagggaagatgatggacatcaaatcgactgtaggctgtgctcctctgtgcgctctcacgagcactaacacctcccagcatgattctccaggactgcggctccaagaggaaagctggccccagaagcaggctgctgttcagggcctccttgcctggtccagtccttgcttaggtgaactccagctgaccaagataagcattcactgcatttggtttaagcagcctttcgtgtttattgtgttagtgggtgcttttctttctaaagc

SEQ ID NO: 269429 - DNA, 850 bp, Homo sapiens
tgggcgggggcgggggcgggggcgggggcggggggaggtgcacaactgtaggccgggttctcaagctcgcccttagcagagcagagctgagagccacctactagcggcaggtggagcctcgagacgggtgctgtcgtggtgatggaggcgcacgctcgcttcccacgcagtttggcctttttgacgtccctggctgttgtgggcaaccgatttggttggtcgcgctgcttcctacgctcgccggcggagcagctagtggcacctgctcggagagagggagtggatctctcggaagtgcttggggtttcgctgaagcggacctgaacagaccatgtgtcctttaaatacagccatgcttttagaaacggactgtcactttatgtggactcaaccattgaacagaatgtgtgcttttgtgagtgctgcaattccttcaagtgtaattgcgctactgcatttttgttggtcgcagggaaggggtgtgcctgcaaatgtccgcgtggttcgtcctcagcctcttcctttttacactgtgctaggatgtttacttgcttgtggtggaggtaggggaagccagtatttgtgtactgtgtactgtcctgaaccggctttcattcctaacttttcaaagattgctttaaaggggggggggcgcgggtcaaatattgttttaaagggggggacggggtgaggtcaatggtgtgtgccttgtaagtagaaatgaatgaaaggaattttactaatgtgtcactcaattgtttgagctccttctgttttgcatgccaaaaatataaggcaaggaaaaatgtatcattctatcatgattttatggtgctctaattaaaggtgt

SEQ ID NO: 269430 - DNA, 807 bp, Homo sapiens
aatatggtgaaaccccgtctctactaaaaatacaaaaattagccaggtgtggtggtgggtgtggtggtgggtgcctgtaatcccagctactcaggaggctgaggcaggagaatcacttgaaccttgggaagcagagtttgcagtaagccgaggtcgtgccgctgcattccagcctgggtgagaagagcaaaactctgtctcaaaaaaagaaaagaaatgaaatgaatccctgttccagttgaattccaaagagtcgtgtgacttgtccagcgtcacaggttgttaatggcagaacttcccttaggctgaggtcccctcactgcccagccctgcccaaggactaagaccccagccccggaaagaggccctcctgccacagcagctgtactcacagcacccacgtgcttggcactgcagaccgaggcgctcggtctcttcttcctcttctgcccagaacaattttacagaaaaacaaagcattgccttgggaatatttcagtgttatttgcccctgaggtttctaggaacactggacttgtaagtactataaagctcacatgcctgttacttctgtgcaaatggagccacctgaaagatggtcacaatggtggagttggggagacttgagctggaatggtggttccttccctgacctgcttgtgaactgtggtttccttgcctgcagtagagataatacgagacactagataataccagtcatgcctcagggtcatttcaagggctaaactagatattgcacagtgcctggcacaataaaaaaggtctcctcttttcctcctccttcta

SEQ ID NO: 269431 - DNA, 1215 bp, Homo sapiens
aatatggtgaaaccccgtctctactaaaaatacaaaaattagccaggtgtggtggtgggtgtggtggtgggtgcctgtaatcccagctactcaggaggctgaggcaggagaatcacttgaaccttgggaagcagagtttgcagtaagccgaggtcgtgccgctgcattccagcctgggtgagaagagcaaaactctgtctcaaaaaaagaaaagaaatgaaatgaatccctgttccagttgaattccaaagagtcgtgtgacttgtccagcgtcacaggttgttaatggcagaacttcccttaggctgaggtcccctcactgcccagccctgcccaaggactaagaccccagccccggaaagaggccctcctgccacagcagctgtactcacagcacccacgtgcttggcactgcagaccgaggcgctcggtctcttcttcctcttctgcccagaacaattttacagaaaaacaaagcattgccttgggaatatttcagtgttatttgcccctgaggtttctaggaacactggacttgtaagtactataaagctcacatgcctgttacttctgtgcaaatggagccacctgaaagatggtcacaatggtggagttggggagacttgagctggaatggtggttccttccctgacctgcttgtgaactgtggtttccttgcctgcagtagagataatacgagacactagataataccagtcatgcctcagggtcatttcaagggctaaactagatattgcacagtgcctggcacaataaaaaaggtctcctcttttcctcctccttctaacaattttcatttatttctgtataaatgagaaatagagaaatgggtgatagagagaaaagtagtcattcatgcgtttattttattatcagaaagtatgtgttgaagttgtactggttatacccagcaggtggccatgagcagcagggggaagaactgggggcgaattcgccctcctgaagcccaggctagtgtgggcagtgccgttccagcctctcttgatggcaagagaatcttctggtgcatttcactgggaagttcagctctttaggttctgctgggcctaagggctcagaagatgtcaggatgctctctctttctctctctttctgttttttttttcccttagttcgccttacctcaggcttattccctttttactacagacgggctttctccagactctggaa

SEQ ID NO: 269432 - DNA, 782 bp, Homo sapiens
ccgccaacatgacaaaaccccgtctctactaaaaacacaaaaattagcggggcatggtggtatgtacctgtaatcctagctactcgggaggctgagacaggagaatcacttgaacccaggaggcggaggttgcaatgagccgagatgatgccactgcactccagcctggaagacagagcgagactgtatcaaaaaaaaaaaaaaaaagaaaaagaaaagataaaagaaagtattgtctcattctggatgctggaagtccaaaattatattgtcggaaggaccatgctttcccaaaggctccaggaagaatctgttccattcctttctcttagcttctggtgtcaccagcaatcttggcatttttttaccttgtgcctgcgtaactccaatctccacctctcattgcatggcatttttcctgtgtgtctctttataaggacatcagtcatatgggactaagggcccaccttatttgagtatgacctcatcttaagacattatatctgcagtgaccctatttccaaataagatcacattctgaagtgttagagagttaggacttactatttttgggaggacacaattcaacctttgacacttagcttaagacgtttgagattaatccatgtttttgcatgtgtcagtttattccctttttattgctgtgtagtattccactgtttggatgtattgctctttgtttatccacgtatcagctgaaagacatgtaggttgttttcagtattaggcaattatgaataaagccactataaacattaaaa

SEQ ID NO: 269433 - DNA, 403 bp, Homo sapiens
aacctcaaactcttgaaaagcagtaggtcagtaggtgaaaagtttattacgttatagttgaaaattattctccagggtacagttgtatttttcagaaacttgtcgcttcagtaacaaggagcacattcattggaagaggcacattaggcaagaggcaatgtaataaaagctggaggtcagccagacccaggactaaatcttggctcagccacttgctttctttaaaatgtggagcaaaatacttaacttttctgggctgcagtttgcttatcggtataatgggatacctgtactgtaggatttttatatgaggattcgtgacagtgtaaaaggacctcactgaatgtttggctgctttaacagagatcaaaggaacagtggttttttcaaggaaaaaaaaaaa

SEQ ID NO: 269434 - DNA, 643 bp, Homo sapiens
ggcagcctggctccaacatcccagggaattgtgtcactcccattgagcagctgtggggccctctcccacatggcccaggtccaccactctgtcaaaggtcgcacagcccagacaaaaacaggacacagcagtgtgtgaatgagccgggctttctccttccctccacgtaatagaaggtgcctgaggttgttgaaacacagtccatttctcctgggaatgacaagaatttgagggatgctgactttcaaggaatactgcatgacaggcatcaagataaacctgatgaagaaaacataggccagaatctgggaatcgggagcaaagtaatacagcttcggggacaggcacgtaatgaggtcatgatgtaggagactccctgcaggactggcggcccctgttccctgggttgttctggctctttcagaacctgaccctggaacaggactgagcaggtgcctgtgtgcacagaagaccttgtgtgagtcctttggtaccacgtttgctgcacgaatgtctgagacacctcacagtcgcttggttcagcctctccctcctctctccgctggggaacatcatccctcatcactggaagaaattacaaggattgtgtaaacaattacaagtattctacaaacagtgagca

SEQ ID NO: 269435 - DNA, 431 bp, Homo sapiens
gagaaatgcatcattaggtgatttcgtggttgtgcaagcatcatagagtacatacacaaacctcgatggcacggcctactgcgtaactatgctgtagagtacagcctgttgcttctgggctacaaacctggacagcatgtgactatactgaatactggaggcaactgtgacacaataataatcatttgtgtatctaaacatagaaaagatatggtaaaaataccatattataatcttatggattaatgtatatatgaggtctgtcattgaccaaaatgtcgtgatgtggcacacgattgtattaaaaagacagacagaggctggtactttggatcctagaaaatactcattactctagcactaaattatttctagagttctgtgcaggttcaaattgtacaaaaatgtgcaataaaatatttatgctaaaa

SEQ ID NO: 269436 - DNA, 328 bp, Homo sapiens
tagtggaagacaaccttttaggcttcctcaaaagcctggagttggggtatcttgctggtaattgaaattcctatgtaaaatgttggaataaagaataaagttaatttgggtgtgttctattttttccacataaacttgcaagttagacccacagtttttgcttatgtatcaatgttataatatgctactttaacactagtgctagtttattaatcctatgagttcaactgtgtaattttcatttttttgctgtgttttgtaggattttatgtagtttaatgttttcctccatatctgaaataaaatttaaaaaagtgtgcttgatagt

SEQ ID NO: 269437 - DNA, 437 bp, Homo sapiens
gtacttgatatagtggtatgtaaatcctctatattgttatcgattttattgtctacttgttctgtcagttactgagcaaaagattttacaattcccaactctgtgggtttgtctctttcttcctttagtactgtcaatttttgcttcacacattttgaagctttgttgttaaatctctacatttggattgctgtcttcttgatgagttgatcctccttattgctagtatttctctttatcttgaagtctattttgtcttatactaatataggcatacaagctttcttgtgattagagtttgatggtgtatcttcccattttacttttagcccatctttatatttaaaatgtgcttcttgtaaagagcatgtagttggaacatgcatttttatcttgtcttgttaccatttttttattggaatggttgaactattatt

SEQ ID NO: 269438 - DNA, 418 bp, Homo sapiens
tttaaattttcaagcctaaagctaattcccatattgcgatttttgcccaaattattaaatatctctggacacggagtttcatgcttccttctggaacaagaataaacaaccaagtgactcgatggccacagttctgagactttctgaaagctgtctatgaacaaacagccactggtttgtgatagatgataaatatgatcatgagaaaggtgtcatttaaaagtgttcaccttttaaaaattatatcagcaatacttacaggggatctttaaaaaaaactcccttgaaaatccttaaacaaacatctttttaaaaaattgccttccttcccctctattacccctctacctcctttccttcgtttctcccttccttccttccttgaaagattatttcttacaaatcttgcccccctccc

SEQ ID NO: 269439 - DNA, 447 bp, Homo sapiens
actcacccattatttccagttccgttgattctgctctacttcgtctctttccccatagcacttaatattgtctaatctattatgtaatttacttatgtctattttgtactgtcctccccacacaactagagtatcagccccctgaggacaagaacctttgttttgttcaccattgcaagctaatcccctttaacagtggctgacatagggtatgtatacatagtgtttgtggaatgaatgaagccctggtgcctagaacagggtgtgggatataaaacatgctaatgcatatttagtgagtggatgtaatggtaattcctgaggatttgacttagtccgggggagcttccctgtggagaggggcttggaagtggaccttaaaggctgaatcagacttagaaaaagagtgaggagagagagagagaaacagagagagagagagaaaaa

SEQ ID NO: 269440 - DNA, 457 bp, Homo sapiens
tcccagatctggagtcctcactttctcagcaagggcacctgcatcctgagcttttacatgtacacacacccagcgattgtgtgtgccgagaaagacccacatacgcacattgttttttcctcttccacgattatctgccagaattctactcagttaattgcggtttgagaacacaccatccacaggagagcaccaatggatctagtctagtgaggttacatttacttgtaatcctcccccttccctttcccatttctttgatgatttttcccataagtgtgtaagctactgggacttagtagaagcaggccgctcctcctaaatgtgatttggaccatatgctttctacattcattcccgcttcggcttttcttctctgcactaactgctaacacgttatagtcaccttgaaatttcctctgctattttccaattaaaagcttaatagccctgaaaa

SEQ ID NO: 269441 - DNA, 343 bp, Homo sapiens
tatacttgagtaataataattgctaacattattatataataccttacccataataagtagttttatatctattatcttaattttcacaacaacttagaagttagatactattattctgttttcagcctaagaaactgttagtaatttagccacagttgccacagctattaggtgctaggaccaggactagaatccatatctgaaccaaatgcccattaggttatattgccttccctgggtgatagtatagtagctacaatttaataagcatttacaacttcatgatgtaggtaccattattaccccatgttgtagatgagaaagctggctggaggagtaagta

SEQ ID NO: 269442 - DNA, 620 bp, Homo sapiens
  misc_feature (600)..(600): n is a, c, g, or t
caaatgtttttttctacatgtaaatgcagtgaaaataatgtataaaatgtgatatactgataacttgacaatattatcaaagaactactttttaaaaaaagaaaaactctgggtttgatacatttgctggtaaattcttcagaactttttttgaggaataaacaatttctgtatactacaaaatgttctcagttattaaaaagtaagcaggccaaagaggaatacaaagaaacaaaggtaacacttaaaaaaaaaaaaaaaaaagctatcattcagtttcactttttgaatatagttgtgttccttaaaatattaactggtagaatttatcagaatattggaggaataataagatttaaattaggctaagtctactggactaaaaccttgatagagatatatatcctctatccagaagtcataaatagttcagtattaagaaatatattaattcatcagatgtaataatagctaacatttattgactgcttactttgggttaggtaggcactgttataagcggttttatatttttatttagttatccatgctgtagacagttgtgccatggtcacacaatcacttgatgccagaactggngtaagcacgcgcttctgctt

SEQ ID NO: 269443 - DNA, 527 bp, Homo sapiens
ctagttccataggatatgaactgatgtcaggagaaaaattaaattagaaatttgcttcagtgccagattctcaaagccattcgtatgtgaatgtttagtgcaactctccaaaagagatgatttgatgtgttacatgtggcagtagtatgatgtgcagcccagatcccccttcaaagaacggcttgctccccacttgctgggtgtgatgttagcaggcagcctgcagctgtcagcccttttcaggaattggcatagctgtagaaaaccacttcacctaaggtcacacttttttgtggagtggcccatagccaaggattgatcagtgtggagatacaaagttgttctcttgcccatctgaggacatctccgagggccgttttaactccagagctccctgtggggttggccaaggctgtcgttggacctacattataactcattttctcccaattccgcttctctctctctttgaacaaatgtttggcaaaaggcacttcttaataaatatcctgcaattaaagtatatc

SEQ ID NO: 269444 - DNA, 221 bp, Homo sapiens
acatagcaggactccttattcgtgttgcccagcgcatgcgggggatcatagtccgactgccgcgacagaaaggctgggagtggatctgagactacagttccaacactacggggaaaatttcatcttctctgagactacagttccaacactgaggggataatttcatcttctcctccgcccctccatgtttccagtgcaacacgaataagggtaccgagctc

SEQ ID NO: 269445 - DNA, 546 bp, Homo sapiens
acatagcaggactccttattcgtgttgcccagcgcatgcgggggatcatagtccgactgccgcgacagaaaggctgggagtggatctgagactacagttccaacactacggggaaaatttcatcttctctgagactacagttccaacactgaggggataatttcatcttctcctccgcccctccatgtttccagtgcaattccgccctgctgaggggagcctatctgttcccaaacttctgcgtgcgaggagacagcgtggccagggcaggtggtctcacttgtaattgtgacacagtctccccacgtgccagttgtacgactatttgtgcctgaagtttgatttctctctgacaagacagagcccgggagcctccaacagcctgcccagcgttgccgtaacgcttgctctcggggagctgggcgcgcccagacctttgcagggcccctccctcagccccgacccttctcctcgcccctcccctgccacgcccctttcgacatgctggaaagtcatctacctttaataacagtcatctttgcaaaa

SEQ ID NO: 269446 - DNA, 300 bp, Homo sapiens
gcatatttcactatatttttctatttttctataactgggttttaaatatttttggtagaaaaataattatactttcattgctaaaaataaatatgcataacctacccctctatattgcttataacattttgatgatgtagccagtgaatatgtgctaatttaaataacttttatataaaattaagccaactgccgtattataactggtttctttttaacttaataggatattgttttataatattaaatcatatgtttaagctcattctctttaaaaataaacaataagcaatttctata

SEQ ID NO: 269447 - DNA, 460 bp, Homo sapiens
gaaccgcagacagatcaaaccctggtgagaggaacactttatttcccaactcatcatcctaagccaaggttggagggatgagcattccctaaacaccaaggcgagatcacctggtcccagtgcctcttttcacacaggccctagatttctatctctctgcagtttatgcatcggtaaaaaaaaaaaaatctctcccagtgtgccccgttagttttcagcattttgtaagcaaaatgaacttaacacatagtaattctaattgaaggtatgtacataaaaagcatgatagaatggcaatattgtatcaatggatgtacatttgtaatatttgtaaaaaaaaatccaaaaccttaaaatatgaatttacatgttaatttgcctctaagttctataaattgcacttcagtgatatctaataagtgaatgtttctgttaagtaaataaaaatattcagtaaaat

SEQ ID NO: 269448 - DNA, 294 bp, Homo sapiens
tacagtattgtctaagactactggctgggtaaagcctgcttctgctgcgtatatggcatggtgtagctgcgtatttaaatggagcctagagctgagtgtgctttcatttttaagccctgctgatggtttcatgagggattgttagtttgtaccctttagagggtgggcatagacaccctctatgctgagggtgagatttagcatcatttgtcatctgacttttgtcccttctctgtgtgccaacttgacaaattctaacaatatggctcccgtaacagtatctttaaaggtgcc

SEQ ID NO: 269449 - DNA, 245 bp, Homo sapiens
ctgtctccttcacgtcaccctctcacaatggacattgaagctttccttcagctccttctctgtgcagtctgtgtctccagttccatgtttccagccccagttggctttgtccccctgagtgccccaggctcacagcatgtctaacaacaaaccatccctcaaggccgctttcctttcccaacagcctctctgtgctcatcacagaggagagggagatcagacctcagagtctctttggccttctc

SEQ ID NO: 269450 - DNA, 358 bp, Homo sapiens
ggatcgacctataatacagagaagtataattcaacacagaaattctgatttctaggctattactggaatacactatttcaaggctattaatgactacatttatgttatttttcctaaaatatcaggaccttttaatctaatgactcagctcttctgtgtctctgtttttcttgcactttgtcttattgctttgccatttaaaaatccagccatgaaaggaattttggaaattgtgttcttttccatgtatgtaattgctccttaaaactgaaaagatcaattaggaaattattggctccttcgtacttcttttaccacctctatttattaattgattgaattgggttcgccaggttta

SEQ ID NO: 269451 - DNA, 1255 bp, Homo sapiens
cacgtcagcctcccacgtaactgggactacagagacccatgccaccatgcccagctagtttttttgtatttttgttagagacagggtttctaacatgttgcccaggcttgtctcgaactcctgtgctcaagtgaggcacctcatccagcctctgaattatttgaccaatatatcatagttactctctgtactccagaattgtcaggttacaaggaatgcatttgttttgttcctttttggattataaaattattttgtctcagttgtaattttattttatcaattaatgctatgacattattacagtgatctgaaatacctaattttgaggtgggtttctttttttaatttttatcatgtttttcagatttctttgttcctttcccactcccactacttcatttgactagccttaaaagaaataaattatttaattaaaaatgtttttacatccagtagaaaaatgtagtctgaaaataggatttttttttttctgatttgaaaatttaagaaactcttacttttgtaaaatgttacataacttgagccaaattctttcgtggcccactttactctctgtgactgggaaacaatggaaagttgcattttctgttttgatgtacagtttgttcgtgatcaaaacaaatccgtactcttaaggaacaccatagatttgagggagtttaattctagaactagctaattttcattttatatagttgcttaatgtcaactgagtcttttaaggttatataggcaccatatcaacagaggacagcaacaacaataagatgatcaagacatttaaaaaagaataaagcactacatatttgattgtatacttttactgaaatgttgtaagtaattgcttcatatctttatttaactttccttatgtgtatgctctttaaatttttttaaatgtttaaagttatccatgcaggatgaacagagaagccttcaagtagtaatgaggacttcttagataagcaaataattaaaatagaattttctgcatttagaacagtttttggtcttaacatactgaaataatataaaattcacctaatgagccaggtgcggtggctcacacctgtaatcccagcactttgtgaggccgaggtgggcagatcacctgaggtcaggagttacagaccaacctggccaacatggtgaagccccgtctctactaaaagtacaaaaattagcctggcatgggggcgcatgcctgtaatcccagctacttgggaggcag

SEQ ID NO: 269452 - DNA, 425 bp, Homo sapiens
gtggccccaaggctaggcttgtccagtggtggccagggtctgatgtgtgctgggtttcctgggtcttgagcctgcctgctttgaagtgggtgtggtgcagctcccatgtgaagggactctgtagcgggcctccttgttctgggcagcccatgaccctccctgggcaggcacgggcatgctcccctaggactcaggtgacagcagccccaggaacttcctgcttctattgccaatgctctgctttacacattcattcatttattattatttcttttcgtgacagagtgccaccctgtctcaaaaaaaaaaaaaaaaaagccatttaaattatttattctttatatgtaaaagattatatgtaacaacatagaaaattatgcacttcagcctgggtgacagagtgccaccctgtctcaaaaaaaaaa

SEQ ID NO: 269453 - DNA, 447 bp, Homo sapiens
gactagaataagactcaaagagtctgtgggtccaatttgccacaactctcaaagggacaaagtaacattttctggttatcaggcctctaatgtggattggccaacttgaatcaacctgatgaaactttcaattgtgaagccataaaatagacactaacaacagaattgtctttcctattctttgtcaatttggttcaagccaaatgacatttcaaaaggaaaaacagactgcctagtaataactaatcacctttactttcttggttgacatttgcaaggaaaataaattagtaacaaccataaaatgtgtttctaattaaatgaagaacaaaaacatgtgtctattttatctcgttttgggctttaaaaatcctttccatgctaaatgtgcagataaatgtactcagagttacagaacatctatccagttgtgaatttcctagacct

SEQ ID NO: 269454 - DNA, 421 bp, Homo sapiens
ctcctcaaaacatatttagaagctactgacctgtagatttttaggaattttattagggaaggcatttcttttctttaataagccccaaccaatactgatctgggtttctgagggctgtcaatttcttatttttgtttttgctactgatgatgatgaaagatgtatgagggtacagaaaatgcaatttttggaaagctgcatagtataagatttcatattgcttctttcttttcagagctaaagatattctaacaagagatacctggaaattatcaaaaaatagtattaaaaccaggttaaagtcgttatcagaattatagatttggctaggaagtattcttttcatgtgacaatttggtctatataatttgtgttcttttcagtactcgtactgcataattatgtataaagtaaaaaaaaa

SEQ ID NO: 269455 - DNA, 472 bp, Homo sapiens
cataattatgcaattgtgtacatataatcgcatacttctcctcacctttgtcatagtctgttggttaagaacaagtcacaggttctatctacactgaaagcgagaggggcacacaaggtgtaaacaccaggaggtggggaccaaccatggggggttcacttaaaagggtgtctgccagctggttgcagtggctcacatctgtaatcccagcattttgggaggcctatgcagtaagatcacttgagtctaggatttccaggccagctaggaagcatggtaaaatcccctttctgacaaaaaaaaagaaaagaaaaaatacaaaaattagtttggcatgtgcctgtagtcccagctactaaggaggctgaggctaggtgggaagatcacctgagcctgggaagtcgaggctgccatgagccatgatggcaccactgcactccagcctgggcaacagagcaagaacctgtctcaa

SEQ ID NO: 269456 - DNA, 519 bp, Homo sapiens
ccttttcataaggccaaaaagaaaatataagttattggtcatgacacatttgagttggacctcggattagataaaaagatgaaaatactccagctctgtcctcatggaactcagagacaagcaggaaagaaaatgtgacccaaataactacagtacaaataacccatgttatgacaagattcagagtgctcaaggaacacttcccattcccttaaaaaaaaaaattaagggactatccagtaactaagctggcaactccaagtgccctggaccccagtcaccaatccatcctctcagtctgtcagctttccatcctaaatctctaaaattcatccatatcttcctatcttcactgacactatccaacttaattaagtcattcaacaaatacttgagtacctactatactagatgtcagaaatcagtggtgaacaagacagacacctcatgaagctcacattctagttggaggaaaaaaccttaacaaggaagcaaaagaaataaaatactaagaaacta

SEQ ID NO: 269457 - DNA, 551 bp, Homo sapiens
accacccagaggaaccgcattgctgagcacggagcctcggccccatgacagcctggaggatgtgtgactgccattcaccccaccaggggccggccctgaagctcggagagaagcacatccgctgccaaggggaagggcaaacagccccagcctctgcgcagcccacgcctctggggcaggcgggtgggcctggctgcgctgcacagaccaccacaaagtcccactggggtccacgaagccactgcccacgaacgcccctcccagcccctggaatctcccctgaccagccgagctgaatctggccctcacgcagggccacggaggcctctgtcgggcagctcaggccacctggccctacctaaagccgatgcattattctaagacgattatttatccgtgcaatgctccggggacagcagcgttcccatttcagagcccgcatcctgtatttcctcgccgcctccatcgccccgggcaggcgctgaatgactcgcgatgccactgtcatttttataaagccttgttccgggtaaaaagcctctttgtttcag

SEQ ID NO: 269458 - DNA, 732 bp, Homo sapiens
gagctgtcctgggctgggtgccttgctctttgactgagactggagacagacggcaacagccacaggcagactgaggtggcaataggaaatctgccgagatgttcagtcaggtgcccaggaccccagcctcaggctgctactacctaaattccatgacacctgagggccaggagatgtacttgcgatttgatcagactacaagacgctctccttacaggatgagccggattctagcacgccatcagctagtgactaaaattcaacaagataggaaagtctactgacctccttccctgaaaatttggatcctcatattagcattccattccacttgctgtacttttagttggaaggtctaaggcagacaaagctgcttaaatatttttatcactgacttcctagaagaaggaggaaaaaatcttggcaagaagaagggaaatcagtcttgcagaatatcttgaagaagcctgcgaaggaattccactgactgtgttcattatctattggtcccaatactgagtggaatttttatgtgttatcactggccagggtggccaatccattggagttgcctggagcagcacatgacatggtagcacggggtgtacaaagatgggtatttaccttgtgcctttttctgtgccaatcttccaggagttactctgttggcagaatgttgaaacttctgttgttcttaggagcaaataattgaaacatgttggttgaatttca

SEQ ID NO: 269459 - DNA, 611 bp, Homo sapiens
gagctgtcctgggctgggtgccttgctctttgactgagactggagacagacggcaacagccacaggcagactgaggtggcaataggaaatctgccgagatgttcagtcaggtgcccaggaccccagcctcaggctgctactacctaaattccatgacacctgagggccaggagatgtacttgcgatttgatcagactacaagacgctctccttacaggatgagccggattctagcacgccatcagctagtgactaaaattcaacaaggtgagtggccggcagtggaaggctgttgctcattctgatttctgttggctctatttcatgctaacccagttttttttgtttgtttgtttccactttataacatatggatttctatgccacactacccgtaactttgaaaaataactttaggctgcagttttcagcaaacaggacagtccttagctgccacatagctcaacataaagtgcacaaaaaacttcacggtgggacagtgaatcataaattcccaaactgacgtgtgtctacagaacagatgagaactgttactcagtgtgtatcttaggagcttttctgcagtttcctcacactccgtcacatttaaa

SEQ ID NO: 269460 - DNA, 598 bp, Homo sapiens
gagctgtcctgggctgggtgccttgctctttgactgagactggagacagacggcaacagccacaggcagactgaggtggcaataggaaatctgccgagatgttcagtcaggtgcccaggaccccagcctcaggctgctactacctaaattccatgacacctgagggccaggagatgtacttgcgatttgatcagactacaagacgctctccttacaggatgagccggattctagcacgccatcagctagtgactaaaattcaacaagttgcttgactgactccatcttgaagaatctcttgggatttagtggtaggcagtggctccacaacttcaaaaagctggggatgtatgcatgcagcctccctgagaaataccacaagcgcctgattggaacaatctgtatcaaatgaaagaggagaataaagaactactctgcttcatggaaaacttgagtcaaaacaatctggtcagaaactatttggctgggagagcatctattttctgctttctttttctctcagattgactggggtttggggattgtaaacatttttttctttttaaatactattgggaatacaggcatggaaaatata

SEQ ID NO: 269461 - DNA, 617 bp, Homo sapiens
gagtagaaatcaataagatagaaaacaatagagaaaatcaataaaacaaaaaggttgaatttttgggaagatcaataaaattaataaacctctagtcaaacaaggaaaaaaggaacactcaaattaccaatatcaaggtaagatcagacatcatttcaatattgaatcaaaaaaacgagtgagaatacatcactccaaattttaaggatattaaaggatagtaggcaaacattatgaagactttctgctgataaattctacaacttcagtgaaatgggcaaattccttaaaagacacaaattgccaaatctcaaaatgatgagttaaataacttggacaaaaagtacatgctgtatgtccagtaacatacatttctggaagcacaaactaatgaatagtaacaaaaagtagataagtggttacctggggtcagtgtggaatggggagtgtgagattacaaagtggataaggacatatttgggaataatatatgtgctcattatcctgattgtggtggtgttttcacatgttagacatatgtcaaaatttaaattgtatactttgaatatgtgcagtttgttttatggaattatatctcaataaagctcttagaaata

SEQ ID NO: 269462 - DNA, 598 bp, Homo sapiens
aattcgcggccgcgtcgactcggaagacgacagaaggggtattacatagttgcttgggtcagtgtggaggacaagaagatatagacttcactttctgcgagcttacagcctagtgggcaggaggtcagtaaacctcaccttctaatggaaaccacctgccctttctcagctttttctatctctcatcatctattacaccattagcagctaggagccttacagactgaccttttcacaaagaacttgtgttttattataaaatcctagacgtggaaacatacagacttgacgactatcaaaaatatagatttaatgactccaggtcactcctccaaggacactagcctcaaaaaatcattcaaaatcaacattcctgagttattaaaaaccaacttgaattcctgtataaaaagttatgcttaggccaggcaggtggctcacacctgtaatatcagcacttggggaggctgaggcgggcagaccacttgagctcaggagtttgagatcagcctggtcaacatgggaaaccccatctctactaaaaatacattaacggacatggtggcacatgctctttccagccactcaggagctgggc

SEQ ID NO: 269463 - DNA, 469 bp, Homo sapiens
cagcgttgctcatgctcgcctgttctcagtgtatctgggaaactgacaattttcaatcgtgattctgtattctgggctctctagcacatggctgaaccatcagcaaaactctggccacaggctgtgtctgcatcactaaactcaacaccatccatcagcaagaggcggagcaaattaaaacaccagtaacaccctgtccccttctgaccccccctctcctgatggccttgcttatgccacaggaacagcatgcacatggcctgtacatgccctcagcttggctctcctcacagcaagctggtcttgcaggatcgtgagcagtaactccctctcctgtacatgtgtccacagttctctgccattagaacttaagctcctgaggggcacaggcctgttttttcatttttgtatcttggacacagcagacacaacaaatgtttgtctagagaataaagttcttatttacata

SEQ ID NO: 269464 - DNA, 560 bp, Homo sapiens
gaaatatatcagaagtttgtagtagattagagagtaccaactgggagtctgaaaagctgtccaaagtggcaaaacaggtacttagactctcaatcctaaggctgtatagagctataaacgtggcaagacctttggagtcagacagacccaaactcaaatgttggatccatgtatatggaaagcacctgacaacaagcctagcatatgtacttggtaaaaatgattgccaagtgtagtgttaatgagtttttggatattgagtaagttatttaaatttcaatttcatctttaaaatgaaataattggaaaggataatttgagtgagggtatgaaattatgtgttcataagagagggtatgtggccgagtgactagaggcgagtttataactattctatctaataaaactttgtaatctggtaatttgtgtgctaaaaataactttacctgttgtatagtactctttttttatgccttaaactaaagtgttcaaaatatcatggaaaaatgatctgtgttgcttacagatttggtgacttttaactttcctataatgttgtc

SEQ ID NO: 269465 - DNA, 378 bp, Homo sapiens
tgcatgagactccttttctgggagtttcaactgggtcataaagattaagaaggaagcagttggctgagatcattgagcagaagatgcggggaagttgagaaaaagtcagggacagagactggaaaaagtgactgaagcccacagtgccagcttggagggcttgggtttttatcttgtgggcaatgacatccattagaggtgtgtgtcaagaaactagaaagagagtggcttctgggaaataagaagaagcatgtggaaagtactttcaatctacttggtgctcttgcttcattgctgcttgaaccctatagtgtgttgagtagtgtccccccagaattcatgtctagcctgggcaacatagtaagaccctgtctttac

SEQ ID NO: 269466 - DNA, 368 bp, Homo sapiens
agaatggagccaacttggaaaacatacttcagaatatcattcatgagaatatccccaacctatccagacagaccaacattccaattcaggaaatccagagaatctcagtaagataagccacgagaagatcatccccaagacatataatcatcagattctccaaggtcaaaatgaaagaaacaatgttaaaggcagctagggagaaaggcaatgtcacctgcaaagggaattccatcagacttagcagaattctcagctgaaaccctacaagccagaaaagatattcaacttcttaaagaaaagaaatttcacgtagtatggcagagacagatataccatataataacatggtgttattataaatggtt

SEQ ID NO: 269467 - DNA, 511 bp, Homo sapiens
cctcaacctctgacaaatctattgatatttagtaccagcttttagctgtctttatggtcgaaaccaacaggacaattggctgagagctgggagccctcctccctccagagaatcctgatctccccaaatttggttgagatccaaagtgtattttgctgtacaactccttttctagagttttacttgcttccaacaaggaaagcaagttttcctgcttccatgacaatagaaggcaggtaactcctttctggagttagagctcacttccaacagagaaggcgaatttgagttttcctgcttctagaatggtagagagcagtcttcagcctgagacccattcctaggtaagtgactgaattggggtttcatcttggttaaagttatgatgcagctggtcgtagtttctccttactgttatagcgctcagtaatcatattgttgggtttttgttgttgtttgttctggtctttctcccatcagatttgaccaattctgcctgacttagtcaaat

SEQ ID NO: 269468 - DNA, 350 bp, Homo sapiens
cggttatccacatggctcatccgtcatctcctctatgtgtctgctcaaagatgtcttagtgagaccttcctgatcatcatattcagaattacagtccccacctcctactgggaactcctcaccaccccacccacttcttctatttgttttctccatggacttagtaacattcaccatgttattatttgtatattatttactgtgtctccccacgtagaatgtaagctccctaaggacagggattttgatctgttcagtttattaaggtatcaaccaggtgctagaatagggcctgatagatggtaagttttcaatgaatacttaaagaagccaggcaggaaatgataatc

SEQ ID NO: 269469 - DNA, 331 bp, Homo sapiens
ccagccagagcctccttaccttcccaccttatttccggccacttcccagcacccattcttactccaggtgggtctaaatcctctctgctcctcacgaggctcttccacgcttatcctggctcagaacatctctcatccccctgactgggcctccaccctccacggggaaccaaatcatgggaaagctggattccacaagccgccctgcaagcccactgaccgcagaaggttgccttctacaacagcttagctcaaaaccttcttttcgctaaataaagttgtattttacttccatgcaaaataaacaaaaactcagtttcctgccttcaat

SEQ ID NO: 269470 - DNA, 367 bp, Homo sapiens
gcacaaacaggccatagtttagttgaaggagaaactgcgaactcaaaggagcactgcttctctgcaggaaagatcccgtcagtggacctgcggggcacagctgccaccagtgtcatgtagctattcagtgtcggaaaactagaaatcacaagtgaagagaaattgtaaattacctcaaattctatgcccagaagcaaccactatggaaatccttctagacattgtcccgtataaatatatttccctaaaaaaaattataccccatactctgccacttcaaaaaaatcaagactgtttttccatgtcaataaatatctatatcatttaatgaatacataatactcccttgtttgaatgtacaatattc

SEQ ID NO: 269471 - DNA, 674 bp, Homo sapiens
tttagtagaatgactcatgtagaaaattattcaagttatgctgttatagtaaaaaaaaaagcaaatctcaaaaccatctgtatagtatgcttttactatagtttgcttatacatagaacaattatgaaaagatagtcaagataattttgtaataggtacctccagggaatggagtagaaaatatgggttgatttgcacttcaaatcttatatccttttgtatttcaatacttttataaatacatttactattaaaataaattttaaaatattttctccaagttatgattgaccagagattggcagtctctttagatctcagccagggatgggacatgcttacaggaaatgctcttaatctttgcagaaatgcttatagaaaatgctgttagtccttgaaaaactaaaatagatgcaaaggagaagaaaaagagtctgagtggaagatgaatggactgagaaaagaggccagggaggaataaaaggaaaagtaagggaagtctataggtgaggaagagaaggtgctatggacaatagtggttagattgtgactgggtctgctttactaccacagtgtccctgggttattatacaaggcatgtcaccaagggttccatttgggtgaagggcctataaggaaaaatcatatatagttatggcctcagtatcactcct

SEQ ID NO: 269472 - DNA, 339 bp, Homo sapiens
ggtccagtgaaatgtcacaatcctccttgtgggcaggactctggtgaagagtcacatcacttgggtgctggttttagtgatatatctaaatcttccccgtgggcagggcttaggcaggaaaggagacaaacttcacctaggcaattggcctggatatatgtcacaatggcccctgtgtgcaggaccaaggcaggagggtgaccttaccttgggtacagcaatatgtcacaatctctctggttgtcagggcccaggcaagacagaagaaacatcagctaggtgctgagccaagtgatatgttacaaagcttcctattggcagaaccacccccacctcaaa

SEQ ID NO: 269473 - DNA, 208 bp, Homo sapiens
taatgcaatttcctaaatgaactttaaggaaattaagacttgctctgggcaactcattaccatctacccggctgactgtcaactatcagagtgtagaggtttttaaccagacattcgtttcaatgatgatatttaatcactttcttcccttaatgtccctaccaagagcgaatcattgaatgtgcctactgcaggactctctccttgc

SEQ ID NO: 269474 - DNA, 373 bp, Homo sapiens
tcccaggctcaagcaatcctcccacctcagcctcctaagtagctgggactatggtgggggcacacgccaccatgcctggctaatttttattattattattattattattattattattattattatttgtagagacagggtttcaccatgttgcccaagctgtctcaaactcctgggctcacgcagtctgcccagttaggcctcccaaagtgctgggattacaggcgtgagccagcacgcccagttaagcattatagtttttgatccagtaatcctactactaggaatttatcctaaggaataaaagctatctgtatatgcccctcccccacaaaaaattttaaataaaagatactatatgaaaagctaatat

SEQ ID NO: 269475 - DNA, 383 bp, Homo sapiens
gagtgcctctgcccggcctcctcaccgtctgggaaatgaggagcgcctctgccttgccgccgtcctgtctgcgaagtgaggagtgcctctgcccggcctcctcaccatctgggaaatgagaagcacctctgcctggccgccgtcccatctgggaagtgaggagcacttctgcccagccgccaccctgtctggcaagtgaggagcacctctgcccggccccctcaccgtttgtaagggaggagcgcctctgcccagcccctgcaccgtctgggaagtgaggagcgcctctgcccggccccctcaccatctgggaagtgaggagcgtctctgcccgctgctgtgcaaccttccaagtgtgaagtgacagccttgtgtgtgatctt

SEQ ID NO: 269476 - DNA, 556 bp, Homo sapiens
ctgtaatcccacctactcaggaggctgaggcaggagaatcgcttgaacccgggaggtgaaggttgcagtgagccgagatcacaccagagatgcactccagccttggctacagagtgagactccatctcaaaaagcagaaacttacttctcgtggttctggaggctagaagtccgagaaaaaagcatgtttggtttcccctgaggcttctgtccttggcttgtagatggtcacctgctcactgcatcctcacagcgtttctcctctgtgcctgtgcatccctagtgtgtctctctctgtgtcctcatttcccctcctagaaggatatcagttacattggattagagtccactctaatggcctcattttaacttacatgcagtcactttctgaggcattaggagtttgggcttagaggggtgggacagaggatggggtaggtaaccactgaagatgcagcccaattcagcccataacaaaggcattattttttgttgccccaaagtgtggaggtctgctactggcatcatgggcagggggtcaggcatcctaagtgct

SEQ ID NO: 269477 - DNA, 663 bp, Homo sapiens
aaggagtcaacattttgttaactttgtcaaagttcagatggatataggtgtgcagctttcatcctcagagaaatgtaaatcaaaaccacaatgagataccatctcacaccagtcagaatgaatattatttaaaaagtcaaaaaataacaggtgccgtcaagacttcagagaaaaaggaatgcttatacactgttgatgagaatgtaaatagttcaaccatcgtggaaagtaattttgagattttgcaaagaacttaagcagaactgccatttgagccagcaaacccattactgggtaaataccaaaaggaaaataaattgtaacagacacatgcactcgtacgattatcacagtgctattcacaatagcaaggacatggagtcaaccttggtacccatcaacggtggactggataaataaaatgcagtacctatacaccatggactactacactgcaaaaaacaaacaaacaaacatgaaatcatgtcctttgctgcaacatggatgcaactgtaggccgtaatcctaagcaaattcacacaggaacaggaacagaaaaccaaatactgcatatcctcacattgaatgcccatggacataaagatggcagcaatagacactgaggactactagagaagggaaagagggaggtgggatggtctg

SEQ ID NO: 269478 - DNA, 201 bp, Homo sapiens
aaagactttgggaaaaggcaagatatttttaaactatgaccttgccatgcaataccacattacttttctctctctctcctccctctctcaatctctgtttgtgtgcatatataatgtatatatgtatgtgtatatatacatgtatatacacacacacacacacacagagagagaagagttgtaatggcaaaaactgaaaat

SEQ ID NO: 269479 - DNA, 683 bp, Homo sapiens
tagaagattagagtcatcatgtggttaaaggaaataaagttatttactataacatttaatcaagaatgtgaatgtagcagaacagggtcataacaggagatagaaaatctaatttaaggcctgactgaatctgcagaagtagcccaaataaaaacactcttataagaactctcaacatgggtcaatctttctcatttcttctggaccatcaacttcatccatttgctgtaatgaacttcctttctatggttcagttcctataaggctatctctgatcacctccagatgttctctattacccagtatcttcacaatgacctcctgtatccatccttttccttgaaccctggtccagaggcagatattgtactgaatatcagagagagacatctgaatttgataaagggggtctcatcagcaaatctcaagataaggataaagatgtcaaatcataaaagtttcatcatggaatgtaagattttatgcttcctcttcaatggctaataaaataaaatattaaacaacaaataaagaataattgtcacttttgaaaaaattattctttttaaaattaaaaaatattaatgaatttttattaatgaattagaagcttattctttaaatggcacctcattctaattttttaacaaagttttaaaatgcatgcatgaaagctatttttt

SEQ ID NO: 269480 - DNA, 103 bp, Homo sapiens
cctcagggagagagagatctggacagaattgccggacagatggcagctgccaacaagaagcattagaacaaaccatgctgggttaataaattgcctcattcaa

SEQ ID NO: 269481 - DNA, 569 bp, Homo sapiens
gagtggatattgaaagcagaaagagaaaagcaaataacaaataagggaatttccatactcctggaagcaggcttctcagcagaaacctgacagatgagaatgagtagaatgatatattcaaagtgctgaagggaaacaatcaaacaaacgagaaacctgtcaaccaagaatactgtacacagtaaagctattttttttaaatgaaggaaatctgaaggcattctcaaacaaaagctgagggaattccctgtaaccagatctgccttgcaaaaaaaggtgaagagagtttgtcatactgagagaaaaggatgctactgggtaacatgaaaaaaatctgaagatataaaacccacaggaaaaagtaagtgtccaggcaaattcaacatactctaatgcagtgattgtgggacataaaccacttatggtttaaccttcgttgttaggaagggttaaaagacaaaacaaaaataatagcaactacaataatttgctaaggtataaaaagatgtaaattatgtatataataaggtataataatataataaggtataaaaagatgtatataaaaa

SEQ ID NO: 269482 - DNA, 407 bp, Homo sapiens
gttagttgggggcatatgtcagagatgataaattcctcttcaaaggttttaattccctcttcttccagttctttgtttctctagtttctatagttacccgtgctgtaaacaacccttcctgccctgactgttccctgacatgtcctgacaagtctagacaggccttgcaccataatggatagccttccccttcctgcctagatagctgtattcaatttcaaacattagccaatcaggtcagtttagactgtgcagtccaaccccagccaatggagaaagaacacagcagtaggaaccaattgcattagggataaaaacccctgccctatcccccggctcggtgttctcttgtgatcgtgactggcacaagctgcgtccttctgcagaagtaaatttgccttgctgag

SEQ ID NO: 269483 - DNA, 416 bp, Homo sapiens
tgaggtattgtctgagtggaatgtttattaacatctccagcctctatccactagatactagtggcaccctacccccaatccagataaacaaaaatgtctctaaatattttcaaatgacccctagggggcaaatctacccttagttgagaaacataggtttatgctaattctaatttatactcagttggatttattctgaaaagaagaggggattaatgtctcatatattcagtatagatttccttttggaatgatttctatttaaagaaaattatcttttgaagatgaattaagtttatcttgattgtgttggtggttttgtgagtgtatacaattgtgaaagctcatctaattgtacactttaaataatgcaatttattgtctaaaattatattttaataaagttgatttttttg

SEQ ID NO: 269484 - DNA, 750 bp, Homo sapiens
tgggaggatcatgaggtcaggagatcgagaccatcctggctaacacggtgaaaccccgtctctactaaaaatacaaaaaaattagccaggcgtggtggcgggcacctgtagtcccagctacatgggaggctgaggcaggagaatggtgtgaacccaggaggcagagcttgcagtgaactccatctaaaaaaaaaaaaaaaaaaaaactacatgaaaacccaaggaaaactcttactgacattggtctaggcaaagaattcatgactaagaactcgaaagcacaagcaacaacaacaaaaaaagacaaatgagacaactaaactaaaaagcttctgcacagcaaaagaaataatcaacagaatgaacagacaacttgaagaataggagaaaatatttgcaaactatgcatccaacaaggactgatatccagaatgtaccaagaactcaaacagatcaaagacaacaaaagcaacaaataatcctgttaaaaagtgggcaaatgacatgaatagacatttttcaaaagaagatatataaatggccaaacgagcattatgaaaaaatggaaagcagtgtggagatttctcaaagaactaaaaatagaactactgtatgatccaacaattccactactaggtatatatgcccaaaggaaaagaaaccattatcttagatcctacacttatatggtattacaggtcaaccataattgcaaggccttttacctaagtggccaattggaggactggt

SEQ ID NO: 269485 - DNA, 320 bp, Homo sapiens
caagaccaacctgggcaacacagtccctgtctctacaaaaagccaaaagttaaggtgggtgtggtggcacacacctatggtcccagctccttagctccttgggaggctgaggtgagggatgaggactgcttgagggcaggagttcgaggctgcagtgagctatgatggtgccactgcactcctacctgggtgacagagtgagactctgtctcaaaaaaatgattttaataaataaatacaaataaaaaggtatatgtggatgagaacttaacttcacttagaaacaaatagcaactattataattgccaaaaagtagaaa

SEQ ID NO: 269486 - DNA, 321 bp, Homo sapiens
gcaggattttgttaaagcagcccaggatggccaagacagctttggaaatgaaaatggccactgttcgctacggagaagagaccctcattctagacttgtgactctccaattctgcactcccatttaatttccccagtgctctatttagaacatatcctcagggcctgccgatgctagtcactctctggaagccttgcttctagaactcctgggaaatttcagctctggcacagacagctctggccttcacgtcaggaggcctggatttgtgcccgagctttgctgctttgccttcaaataagactctttccagctctggtc

SEQ ID NO: 269487 - DNA, 393 bp, Homo sapiens
cacgagggggtgccccaccatgcacagctaatttttgtattcctggccaacatggtgaaaccacttctctactaaaaattaaaaaattagccaggtgtggtggtgggcgcctgcaatctcagctactcgggagtctgaggcaggagaatcacttgaactcgggaggcagaagttgcagtgagccgagcttgcgccactgcactccagcctgggtgacagggcaacactccatcttaaaaaaaaaaaaaaaagataggagtagggtaaaggcatgggatacaggatggaccctgagaggataatatgctggaggtgctcagggcaaacaactcagatgtgtgtgggagtgtgcatgcgagggtttttacgcatatggtatagtctttttcctgc

SEQ ID NO: 269488 - DNA, 492 bp, Homo sapiens
ttcagttttctgcctcctccctccactataccacaaatctatataaatgattttatccagtcatcagcaaccatactgccaaaaaggtaaactctaatcctatctccaattaatgttttcttacaagtctgtactccaatcaaactcagccaataactccccttaaaggctgcccattctactcatcaagccactgttcatacacggctgtgggcatcctctcactgtcttgttattagttagctttacatttatttccggggcattctcctaaccaggaggtcaacttggagaacaggacagggctgtataattgttatattctgttacagaacatgactttattatataacatactgtttgaaaatcacaaccctataagtattttctccatgaatcgggtgatacattattaacaattttaaataataattgggagctagaaaaactaatctgggaaaatggatcgttattatggcagttgaccacatt

SEQ ID NO: 269489 - DNA, 521 bp, Homo sapiens
ccagtggcagacactgaaaataaggagaatgaagttgaagaggtaaaagaggagggtccaaaagagatgactttggatgagtggaaggctattcaaaataaggactgggcaaaagtagaatttaatatctgaaaaccaaatgaaggtgttgatgggcagtggaagaagggatttgttcttcataaatcaaagagtgaagaggctcatgctgaagattcggttatggaccatcatttccggaagccagcaaatgatataacgtctcagctggagatcaattttggagaccttggccgcccaggacgtggcggcaggggaggatgaggtggacgtgggcgtggtgggcgcccaaaccgtggcagcaggaccgacaagtcaagtgcttctgctcctgatgtggatgacccagaggcattcccagctctggcttaactggatgccataagacaaccctggttcctttgtgaacccttctgttcaaagcttttgcatgcttaaggattccaaacgactaagaaatt

SEQ ID NO: 269490 - DNA, 216 bp, Homo sapiens
gataatgcttaactcaaggggcttgcgtagagattcagcacagtgccggcgcccagcaagcgcccctgagtggctgtttgctggtgtacagtctccaggtaaccgccacgtgcctcccggtagttccctcagcatcgctactgggcgccctgtgtccttcctgtggcactctatcctctcattgttcttctgagtaaagaaaggtggccatcgaca

SEQ ID NO: 269491 - DNA, 152 bp, Homo sapiens
taaagcccgccactattattatgaatttgtttatttctcctttgagttttgttaatttttgttttatgcatttagagattgtgttattaggttcatacccatttaaaattgacgttttctggtagagtgaaccctttattatgtgaaatggc

SEQ ID NO: 269492 - DNA, 406 bp, Homo sapiens
ctggcttagttcaagcactgtttctcgtactcacctttgctgcagtgttctgagtctgtctataaaaaacagacacacagaccagtggaacagaatagagaaaccagaaataagcccacacatttatagcgagctgatttttgaaaaaggcaccaagaacacacattggggaaagaacattctcttcaataaatggtgctgggaaacctggatagctacatgcagaagaatggaactagattcctatctctcaccatatacaaaaatcaactcaaaatggattaaggacttaaatgtaagagccagaaatatgaaactatttgaataaagaatagacgaaacactttaggacattggtttgggcaaagatttttttggatggtacctcgaaaacacaggcaacaaa

SEQ ID NO: 269493 - DNA, 528 bp, Homo sapiens
aacagtttgtatggggttcccaccttgccaggcatcaacaaacacacactggggagagaccctacagctgcctcaagtgtgagaagacctttgggcgaagacatcacctcatcaggcaccagaaaacccacctacatgacaagaccagcaggtgctctgagtgtggtaagaatttccgatgcaactcccatctggccagccaccagagagtgcatgcagaaggcaaatcctgcaaaggccaagaggttggagagagccctggcacaaggaaacggcagcgtgccccaccagtgccaaagtgtcacgtgtgcactgaatgtgggaagagctttggccgaaggcaccaccttgtgagacactggctgacccacactggggagaagcccttccagtgccctcgctgtgagaagagctttggccgaaaacatcacctggacaggcacctgctcacccaccagggacaaagtccccggaacagctgggacagaggaacatctgtcttttgaaatctgtttccactacagctat

SEQ ID NO: 269494 - DNA, 111 bp, Homo sapiens
ccaccaggacacagagcagtaagaaaacacaaagtccacctccctcaccatgggcagctcagcccagagtcttccataagggccaaacacagaccagcactaaaaatagtt

SEQ ID NO: 269495 - DNA, 469 bp, Homo sapiens
tcttttttttaattggttgaagctggtgaggtggtattgatgtgtggcatgatcgaaaataagtatgttaaatcacttctcaaatgatttgggatgaaagactagttttttggctggtttatttctaattggttgtaaacagatacttaaaaaaaatgcaatcaacatgaatcgttagaaaagtgttggcagggcgcggtggctcacgcctgtaatcccagcactttgggaggccgaggtgggcggatcacgaggtcaggagatcgagaccatcctggctaacacagtgaaaccctgtctctactaaaaatacaaaaaattagccggaagtggtggcgggtgcctgtagtcccagctactcgggaggccgaggcaggagaatggcgtgaacccgggaggcggatcttgcagtgagccgagattgcgccactgcgctccagcctgggcgacaaagcgagactccgtctca

SEQ ID NO: 269496 - DNA, 358 bp, Homo sapiens
tccccatttaccaacccaagcaagtaagcccacctgagccacagaaccttctccctccctacaaaaggctcaggagtaggaggcaccagacagcttttatcgtctctaacactaactcagttttgaataaattgaagagcgaggaagagtcaaaggaaaaaatgctgggtcagtgattacccttgaaaatactttgcaattacaaaaacaaacatttaatgaactgatccagttagtcaccaacagaatacttaagtacgcctcttgattcctttattggaagaactatgacccatccaaatcattcttcaaagtcagtctgtctgtgaagaataaaacaatgattgctaataaaatg

SEQ ID NO: 269497 - DNA, 464 bp, Homo sapiens
atactatgtgattctatttatatgacattctgagaaaggcaaaactatagggatggagactaggtcagtggttatcaggggttattagtgtaggggaggttttgactacaaggggaaagcatggaggaagtttttgggagtaatggcctaactgttctgtgtccagattgcaagggcagttacatgaatctattaataaatatgtattaaaactcatggaactatgcgccaaaaagttaaatttcatcatatgttaatttttttaaagttcccagcatagtacctgacacgtaattcaagctcagtgaatactcgctactttcccttttctcttttcctctatatatccaggaaatcaactagcatctgacagttgtatttttcttagatagggtctcactatgttgcttgagcccaggagttcaagaccagcctggacaacatagggagactctatctctacc

SEQ ID NO: 269498 - DNA, 659 bp, Homo sapiens
catatatgtggtaaagtacttgtttctaaaatatgtaaagagctctcatgactcaattatttttgtaaaaactatccaattaaaaataagcaaaagctttgaacagacttcaccaaagaagatacatggatagcaaataagcaggtgaaaagacgctcaacatcattaatccttagggaaatataacttaaagccagaatgagatagcactacacacctatgagaatgactaaaaccaacaatactgagcataccaaatctcagcaaggatgtggaaaaactggtaaatttgtacgctgctggttttgaatggaaagtggtgcagccactttagaaaacaattcagcaagttcttcaaaattagacatgtacctagtgtacaatccagcaaattttactcctatttatttacttaagaaaaccgaaagcctttgcccatagcaaagcttgtacacagatgtttttagcattcttagtgagggctaaaaaactggaagcaacctaaatgcccatcacaggtaaacaggtaaacaaatggtggtagatacatacactggaatgctactcggctctcaatccaaaggagtgaattattgataacgtgcaacaacagtgatgattctcaaaataattacatgaagtgaaagaagtgagacaaa

SEQ ID NO: 269499 - DNA, 501 bp, Homo sapiens
  misc_feature (485)..(485): n is a, c, g, or t
ccactttatcaaggcttttattttgtcctaatgtgtctgcttcctagatcttctctgaggtggataactgagagagagttaatgagtaacttagccaggtgaaacattaatattatttggatataagtaacatttaatggaaaatatatttataacaatataaacaagttatatgacaggctttagcaaatattaataacaaaaagagtaacaacaacaaataacctacacttaccctatgccttttcttgagttctaaagcccatgtgggctgcttagtaatgatagctcaactctgcttctaatctgggttacaacactcatgttaaaacctcttagtacctttccttcttgtgacagaccgagttgtttagtcagtaaacttatcttgaactcctggggaacatagtgagaccccggtctctaccatgcctggctgagacccctgggattataggtgtgagccaccatgcctggctgagacnccatctctttaaaaaa

SEQ ID NO: 269500 - DNA, 336 bp, Homo sapiens
gaaagaaatttattattaaaatttaagtgacctgaacttggagtaaaagaagtctttattaataccagccaggcgctgtggctcacgcctgtaatcccagcactttgggaggccgaggtgggtgaatcacgaggtcaggagttcgagaccagcctggccaatatggtgaaaccccgtctctactaaaaatacaaaaattagctgagcgtggtggtgagcgcctgtagtcccagctactcgggagtctgaggcaggagaatcgcttgaactcgggaggccgaggttgtagtgagccaagatcatgccactgcactccagcctgggcgacagagcgag

SEQ ID NO: 269501 - DNA, 335 bp, Homo sapiens
gcaccattgtattccagcctgggtgacacagcaagatcctgtcccaaaaaaaaaaaaaaaaaagttggaaagctactgttgaatatgggctggctaaagacagcaccactgaggcatcctgctatttaaatacaaggctagagtggaatgcactgttacagcaatgaaacaatatttaaattatcaatcatgataatgttggggctcagaaattcataccccaagctagagtacaagtcatccttccacctcagcatcctgagtagctgggaccacaggcacaccatcacacccagctaattttttagtagagatcccacattacaaaaaaaaaa

SEQ ID NO: 269502 - DNA, 464 bp, Homo sapiens
agggggtgaggggtaaaagactgcacactgggtacagtgtacactgcacaggtgatgggtgcaccaacatctcagaaatcagcactaaagaacttattcaagcatataaggtaacacatatgttaattagctatattgagccattccacaatgtatagatatttcaaaatatgtcacacatgataaattatagtttttgatgtcattaaaaattatatttaagttttgttattttgaaagctttttcacagatctttttcagttttgtttgtttttgagcctgtcttgtacctggttgcactaaatatataatagttctctcttgtgaaaaccttaaaagcctagatttgaacacatgttcaatgataatgatgatataacagaaaaaagaacttatttcatgtaaccagacaccacctgttccccaaaaccctactgaaataaacaaaacaaaacaaaaacat

SEQ ID NO: 269503 - DNA, 1223 bp, Homo sapiens
atacctgtaattccagctacttgggaggctgaggcacaagaatcgcttgaacccaggaggcggaggttgcagtgagctgagatcgctccattgcactccaacctgggtgacaagagcgaaactccctctcaaaaaaaaacaaaaaaaaaagtccccagggcccatgtccacccagccgtctctctccctcccggccaatgttattctttcctcataagcccttccagagcacaaacacacaagcacgtatgtttgtcttcttttctcataaatggtaacaagctctgcttgctgttgtgcagcttctcttttcacataaaaatacaccttgaagattatttcttatgagtacgtaagatgggcacctgagtagtttgctgttacagaccacgtaggcaatggccgcctgcacagattatttgcacaggtgggagtatcattagatgtttctggaagtgggatggctgggtcaaggtgaatgtgtgtttggaattttgaaagataaagtcataaagataagtaaaaacacctggcatcttggctcacggctgtagtcccaacacattgggaggtcaaggtgggaggactgcttgaagctaggagcttgagactggcctgggcaaaatagtgaggccctgtttctacaaaaaaaaaaaaaattaactgggtgtggtggtgtgtgcccatagtctcagctactcaggagactgaggtgggaggatcacttgagcaccggaggtcaaggcttcagtgagtcatgatcacacactgcagcctgggtgacagagtgagagcctgtctcaaaaaataaataaataaaaaatagatagatagattgattgattgatatagagaggataagtaaaaacaaaaacatgtatgtactataaaacctgggatgggctgggcgtggtggcttatgcctatactcctaacactttgagaggccaaggcaggcgaatcacttgaggtcaggagtttgagaccaacctggccaacatagtgtgaaaccctgtctctactaaaaatacataaataaataaataaataaatagccaggtgtggtggtgcatgcctataatcctagctactcaggaggctgagttgggaggattgcttgaacccaggaggtggaggttgcagtgagccgagatcacaccactgcacactcctcataagtgcctggaagggcaacacagtgagactccatctcaaaaaaaaaa

SEQ ID NO: 269504 - DNA, 364 bp, Homo sapiens
ctcaaccgggagagccccagagaggaagcagatttgtctcctggactatcgaagtgtcccggtggcaagctaagcggaaagctagcactgtgttgggagtaagcaatgtggagtcatctcttcccccagagaaacgctgacaagtattagctcacagacatgtgtgcacaaagatggatgctcacagttgtccgttggagcactgtttgaagcagcaaaaggaaccaattcaactttccctgagtaggaaaatggctaaataaatggtaacttattcacagaagggaatataatacagctgttaaaatcatgaaaaaaggtacatattataccatgaataaatctcaaaaacatcagttctaaa

SEQ ID NO: 269505 - DNA, 6097 bp, Homo sapiens
catcttaaagcttccctttgagagtgttgctcttagaacttttcagatcttgttcagtgacctgctacagttatgtgggaggatccaggtgtaaatagaatctgatgacagattctgtaagcgtaaacaagcatcttaggggtgagagatgaaggccacaaagtatcgagagtcatgatcacaattatacctacccgtaaaatgtaatactggactagagtattttttctttccttttgcccaagagctagctaattaggacccgtaatctggagcttcactgtgacagttccactttctatttagaatcagcctgagtctctcctgcctgccttatccttgggccatcagcccagggtcactgggaactctctcacaatcacctaggcatctttgagatatttgaggatgtccagagcagaattgtgtcaggttgacaagagtggttaattctgcctatgtctcagtgacaagagaaatgagacatcctgtgtttgctcctcccctcatacaagagatgtctttggttggtatccggttgagagtttcccagtttcctgatagttggatgaaaaacaaggaggaggtctggagactcaagcagataaactaattgctaccatttcatatggcccttagaaaaatagataaagcagtcatggtccctaccatctaggaactgttagtctagactagcaactgaatacgtggttgaattaagcatcatatggttggcaaagtgaatagatgtgtgggaaaacgtgtgggctttatttgggccactttctttatatcgttgtgactactgaggtcatcatttgaatgaatgtttatgaccacaagagttttaaatatttttatttcttttactttgctaagaatacatatttatcttataataaaattaccctagaaaaccccaggagatttgtttaaatggctaattagtatatttacacagttgatgggttgagcagagtaatatatagggtttactcccagctgcagttctgttcagattcaccctttttggaggctttatttaggtctggccccaccctggagtcttgcctcacagaactgattagaagagatcagagttttggctggtgcctttccggagtggttgctaacaattcccgaattccacaaggagataaatgggaaaaaaaggaaccactgacatttaaagatgtcgccatagaattctctctggaggagtggcaatgcctggatactgcacagcgggatttatataggaatgtgttgttagagaactacagaaacctggtctttttgggtattgctgtctctaagccatatctgatcacctgtctggagcaaaaaaaagagccctggaatataaaaagacatgagatggtagccaaacccccagtaatgtcttttcattttgcccaagacctttggccagagcagaacataaaagattctttccagaaagtgacactgagaagatacggaaaatgtgaatatgagaatttacagttaagaaaaggctgtaaacatgtggatgagtgtacggggcacaaaggaggtcataatacagttaaccaatgtttgacagctaccccaagcaaaatattccagtgtaataaatatgtgaaagtctttgataaattttcaaattcaaatagatataagagaagacatacaggaaacaaacacttcaaatgtaaagaatgtagcaaatcattttgcgtgctttcacaactaactcagcatagaagaattcatactagagtgaattcctacaaatgtgaagaatgtggaaaagcctttaactggttctcaactcttactaaacataagagaattcatactggagaaaagccctacaaatgtgaagaatgtggcaaagcctttaaccagtcctcacaacttactaggcataagataattcatactgaagagaaacccaacaaatgtgaagaatgtggcaaggcctttaaacaggcctcacaccttactatacataaaataattcatactggagaaaaaccttacaaatatgaagaatgtggcaaagtctttagccagtcctcacaccttactacacaaaagatacttcacactggagagaacctctacaagtgtaaagaatgtggaaaagcttttaacctattctcaaatcttactaaccataagagaattcatgctggggagaaaccctacaaatgtaaagaatgtggcagagcttttaacatatcctcaaaccttaataaacaggagaaaattcatactggagggaaactcaacaaatgtgaagaatgtgacaaagcttttaaccgatccttaaaacttactgcacataagaaaattctaatggaagagaaaccctacaaatgtgaagaatgtggcaaagtctttaaccagttctcaactcttactagacataagataattcatactggagagaaaccctacaaatgtaaagaatgtggcaaagcttttaaccaatcttcaaaccttactgaacataagaaaattcatactgcagagaaatcctataaatgtgaagaatgtggcaaagcttttaaccaacactcaaacctaattaaccataggaaaatttattctggagagaaaccatacaaatgtgaagaatgtggaaaagcttttaatcgatcctcaacccttactagacataagaaaattcatactggagagaaaccctacaaatgtgaagaatgtgacagagcttttagccagtcttcaaaccttactgaacataagaaaattcatactggagagaaaccctataaatgtgaggaatgtggcaaagcttttaaccgattctcaacccttactaaacataagagaattcatactggagaaaaaccctataaatgtgaagaatgtggaaaagcctttaatcaatcctatcaacttactagacataagatagttcatactaaagagaaactcaacaaatgtgaagaatttggcaaggcctttaaacagtcctcacaccgtactatacataaaattattcatactggagagaaaccctacaaatgtgaagaacatggcaaagtttttaaccagtcctcaaaccttactacacaaaagataattcatactggagagaacctctacaaatttgaagaacatggaaaagcttttaacctattctcaaacattactaaccataagataatttatactggagagaaaccccacaaatgtgaagaatgtggaaaagcttataaccgattctcaaacctaactatacataagagaattcatacgggagagaaaccttaccaatgtgcagaatgtggcaaagcctttaactgctcctcaacccttaatagacataagataattcatactggagagaaaccttacaaatgtaaagaatgtggcaaagcttttaacctatcctcaacccttactgcacataagaaaattcatactggagagaaaccctataaatgtgaagaatgtggcaaagcttttaaccaatcctcaaaccttaccacacataagaaaattcatacttcagagaaaccctacaaatgtgaagaatgtggcaaatcctttaaccagttctcatctcttaatatacataagataattcatactggagagaaaccctacaaatgtggagattatggcagagctttcaacctatcctcaaatcttactacacataagaaaattcatactggagagaaaccctacaaatgtgaatatggcaaaacttaattgatcctacaagcttactacacataagaaaattcatactggagagaaactacaaatgtgaagaatgtgttaaagcctttaacaagtcttcaactttttctgcacacacgaggtattttatactggtgagaaaccttacaatgtaaagaatgtggcacagcttttaactaatcttcaaaccttactgaaagttgagaaaattcgtactggagagaatcctacaaatgtgaaaaatgtggcaaatcctttaactgatcctcaacttttactaaacataaggtaattcatactggagaaaagccatacaaatgagaagaatgtggcaatgcctttaatcagtcctcacacctttctacacataagataatttatactggagaggaactctatagttgtgaagaatgtggcaaagcttttaaccaatcctcataccttactatacagaaattcatactggagagaaagcctacaattgtgaagaatgtggcaaagcttttaaccttccttaacccttaactgtagataagaaaattcatactggaaagaaaccctacaaatgtgaagtctgtggcaaagcttttaactgattctcaactcttactacatgtaagagtatttatactggaaagaaaccctacaaatgtaaaaaacgtggcaatgcctttaactggtcctcacaccttgctacatataagacagtttatactttgagagaaaccctgcaaatgtgaataatgtggcaatactttaaaccaatcctcaaacctcactaaacataagataatactgaaaactttacaaacctgaatgatgtgacaataattttgacaacacctcgaactttctaacataaatcatactggtgaaaaatcctagaaatgtgaaaaatatcacaaagcctttaaatggttgtcacacttgattgtaggtaagaatccatactgaagaaaactcctggaagtgtaaaaaatgtggcaacacttttaataaatgctcaccccttattgcacaggaaagcatttatacttcagaaagattgtacaaatacaaggaatgtggaaaagccattattatctgctcagattttactcaacattagagagttagtacgtaataaaagcattataaatgcaatttttgtcaagagatctttcagaaaatataagcctttaaagtgaagaagaggagccagttgtgctggctcacatctgtaatgccagcactttgggaggccaaggtgggtggatcacctgagggcaggagtctgagaccagcctggccaacatagcaaaaccccatctctattaaaaattttacaaaaattagctgcgtgtggtggcaggcccctgtaatcccagctaattgggaggctgaagcaggagaattgctcaaacctgggaggcgaagattgcagtgagctgaaatcacaccactacactccagccaaagcaacaagagcaaaaacttcgtctcaaaaacaaaacaaaaaaagagtattcattgtgaggacaaacaatacaaatacgaagagggttgtagtacctttacttgtatcacagatacttttgtacccattttgcactagaggaaaaccatgaagcagttgctcaaatgttgttcaacaccagaaaatttatattggagaaaagcactgtaaatgtaatgcatttgtgaaaacattttttaaaaaactacagcttagaaaataccagaggcctcatactaaaatatatttttgcaagtgaagtaaatataaaaataatttaatccaaaattaagtctatataaatatcagagaattcacagtagaaatatctaaggtactgacacttcagacattgctgagtatagaatcagaatgctgagtatagaaaataatttaaaactaaagttggtaggtaaataatgtgtatataactttaaaagaagtagaatttttttgtagatgtataattacattcaaattatattttttcttgaaaaattagtttttgaaaagcaaataatgatgtaattcaactcaaattcatgctcttcattcctattgtattcacatgtgaaagcatgtgattaatttttcatgcatcaaagatatgagaaatcatttctgttaggtcggtattatttatgacactttctatgaaagaataaggacattaaaatgtaagatgcatgatgaaaacctgagtgaagaggctgtttgtgtttaacttataatattgagtgatccatgaagtaggttttcagagcaatattcttctgcattatagtaagagaaaaccatttttaatcttagttaaaattaaagtgaattagtagtatatcattttactatttgtacttttatgtaataaaatgcaatgtgttt

SEQ ID NO: 269506 - DNA, 1870 bp, Homo sapiens
ttcggggatttggcggggcctttgtctctggctgcagccggagctcctgctctcctcctcactgctcagtgtcctctgctcctagaggcccagcctctgtgtccctgtgacctgcagatattgggagatccacagctaagacgccgggactccctggaaacctagaaatgactgtgccataacacacatttgatgctgaaatccgggataggggaactcctttgggagtcgtgtcccttaaccccttcccccgacttcttgaagagacccacccgcgacctcggtacctcggaccagctctgtaaaagccccgcctctgccttcggatagatattgttacctgtttcggcctccctacttccatccaatctgacagtggtccagccttcattagccaaatcacccaggcagtttcccaggcccttggcatccagtggaatctccacaccccataccatcctcattcctcaggaaaggttgaaagagccaacggcctcttaaaaactcaccctccaactccgaaaggactggactgttctcctaccacttgtgcttctcaggatctgagccaccgcccatgaacctaccaggtatagcccattcgaactcttatatggtagtacttttctactggggcccaacctcatcccagacaccagtcctccaacaggctaggaatgaaatctgtcaggctgctaaccttcttttacccacctcagatacccagccatatgaggacactctggccagacagcccatcctgataaagagcttaaccccctgatctctacaacctcagtggacaggacccttcctggtcgtttatggtaccccaatggctgtctgcttacaagatcctcctcagtggattcacccttccagagtaaagctgtgtccatctgacactcagcctgacccttcttcctcctcttggaagtcgcaagtactctccccgacctcgttaaaactcaccgaaatccctgaagaaacttaaatgtcctgctcctgtccgccctgcttcttcaccctcttcctccactctatttgccaagacatctcctggtttcatccccaaactcccaccttagattctctcttaaactggatagatgatctcatcttttagggcactctgtataacttcttcccagatgagacgcctctgtttaccttcctactcactctttatctatccctcctgctcctttggctacctggcatggccgcactcccacttccagtaatgcctaattacctctacaaaactctcaacccactctctgttaaaccagtccaacccttctttggcaaaggacgctggctttgcatttctctatcagctaccacttacgttgccactctcattcccacaaaaaactgggtagttactagcttaacctaccaccctcgtaatgaaggaaaaagccccttctaactcctacatatgcagtcattggccaacttctccatcaatgaaatgaccgaaaatatcctgacaggtcgtgcagttcaacttttacgctcctacatgtccagcctcacccattacacaagtaatgaaaagcccatacacggccctgtgactacaacgctgtcttaactttccaagcccctttatgcatccaacacaacctgtcatcaggcctacctctaggtcacctactgttccatcagtgacaactacgccttgcagcttcaagccccaactgactgtattaacttccaggtctcccaaacagctacattcaaacagcctgtccgcttctcaaagcccccagaagtcatcagcacctctctgcttaacaaacaatccgggttttgtaatggcaggcatacgcactgcatgaccattcacccctggacctcctgc

SEQ ID NO: 269507 - DNA, 1481 bp, Homo sapiens
ttcggggatttggcggggcctttgtctctggctgcagccggagctcctgctctcctcctcactgctcagtgtcctctgctcctagaggcccagcctctgtgtccctgtgacctgcagatattgggagatccacagctaagacgccgggactccctggaaacctagaaatgactgtgccataacacacatttgatgctgaaatccgggataggggaactcctttgggagtcgtgtcccttaaccccttcccccgacttcttgaagagacccacccgcgacctcggtacctcggaccagctctgtaaaagccccgcctctgccttcggatagatacccagccatatgaggacactctggccagacagcccatcctgataaagagcttaaccccctgatctctacaacctcagtggacaggacccttcctggtcgtttatggtaccccaatggctgtctgcttacaagatcctcctcagtggattcacccttccagagtaaagctgtgtccatctgacactcagcctgacccttcttcctcctcttggaagtcgcaagtactctccccgacctcgttaaaactcaccgaaatccctgaagaaacttaaatgtcctgctcctgtccgccctgcttcttcaccctcttcctccactctatttgccaagacatctcctggtttcatccccaaactcccaccttagattctctcttaaactggatagatgatctcatcttttagggcactctgtataacttcttcccagatgagacgcctctgtttaccttcctactcactctttatctatccctcctgctcctttggctacctggcatggccgcactcccacttccagtaatgcctaattacctctacaaaactctcaacccactctctgttaaaccagtccaacccttctttggcaaaggacgctggctttgcatttctctatcagctaccacttacgttgccactctcattcccacaaaaaactgggtagttactagcttaacctaccaccctcgtaatgaaggaaaaagccccttctaactcctacatatgcagtcattggccaacttctccatcaatgaaatgaccgaaaatatcctgacaggtcgtgcagttcaacttttacgctcctacatgtccagcctcacccattacacaagtaatgaaaagcccatacacggccctgtgactacaacgctgtcttaactttccaagcccctttatgcatccaacacaacctgtcatcaggcctacctctaggtcacctactgttccatcagtgacaactacgccttgcagcttcaagccccaactgactgtattaacttccaggtctcccaaacagctacattcaaacagcctgtccgcttctcaaagcccccagaagtcatcagcacctctctgcttaacaaacaatccgggttttgtaatggcaggcatacgcactgcatgaccattcacccctggacctcctgc

SEQ ID NO: 269508 - DNA, 1600 bp, Homo sapiens
ttcggggatttggcggggcctttgtctctggctgcagccggagctcctgctctcctcctcactgctcagtgtcctctgctcctagaggcccagcctctgtgtccctgtgacctgcagatattgggagatccacagctaagacgccgggactccctggaaacctagaaatgactgtgccataacacacatttgatgctgaaatccgggataggggaactcctttgggagtcgtgtcccttaaccccttcccccgacttcttgaagagacccacccgcgacctcggtacctcggaccagctctgtaaaagccccgcctctgccttcggataggaaaggttgaaagagccaacggcctcttaaaaactcaccctccaactccgaaaggactggactgttctcctaccacttgtgcttctcaggatctgagccaccgcccatgaacctaccagatacccagccatatgaggacactctggccagacagcccatcctgataaagagcttaaccccctgatctctacaacctcagtggacaggacccttcctggtcgtttatggtaccccaatggctgtctgcttacaagatcctcctcagtggattcacccttccagagtaaagctgtgtccatctgacactcagcctgacccttcttcctcctcttggaagtcgcaagtactctccccgacctcgttaaaactcaccgaaatccctgaagaaacttaaatgtcctgctcctgtccgccctgcttcttcaccctcttcctccactctatttgccaagacatctcctggtttcatccccaaactcccaccttagattctctcttaaactggatagatgatctcatcttttagggcactctgtataacttcttcccagatgagacgcctctgtttaccttcctactcactctttatctatccctcctgctcctttggctacctggcatggccgcactcccacttccagtaatgcctaattacctctacaaaactctcaacccactctctgttaaaccagtccaacccttctttggcaaaggacgctggctttgcatttctctatcagctaccacttacgttgccactctcattcccacaaaaaactgggtagttactagcttaacctaccaccctcgtaatgaaggaaaaagccccttctaactcctacatatgcagtcattggccaacttctccatcaatgaaatgaccgaaaatatcctgacaggtcgtgcagttcaacttttacgctcctacatgtccagcctcacccattacacaagtaatgaaaagcccatacacggccctgtgactacaacgctgtcttaactttccaagcccctttatgcatccaacacaacctgtcatcaggcctacctctaggtcacctactgttccatcagtgacaactacgccttgcagcttcaagccccaactgactgtattaacttccaggtctcccaaacagctacattcaaacagcctgtccgcttctcaaagcccccagaagtcatcagcacctctctgcttaacaaacaatccgggttttgtaatggcaggcatacgcactgcatgaccattcacccctggacctcctgc

SEQ ID NO: 269509 - DNA, 1623 bp, Homo sapiens
ttcggggatttggcggggcctttgtctctggctgcagccggagctcctgctctcctcctcactgctcagtgtcctctgctcctagaggcccagcctctgtgtccctgtgacctgcagatattgggagatccacagctaagacgccgggactccctggaaacctagaaatgatggagtctcgctctgttgctcaggctgaagggcagtggtgcgatctcggctcactgaaacctccgccttccgggctcaagcaattctcctgcctcaacctcgcaagtagctgggattacaggcatgcaccaccatgcccagactgtgccataacacacatttgatgctgaaatccgggataggggaactcctttgggagtcgtgtcccttaaccccttcccccgacttcttgaagagacccacccgcgacctcggtacctcggaccagctctgtaaaagccccgcctctgccttcggatagatacccagccatatgaggacactctggccagacagcccatcctgataaagagcttaaccccctgatctctacaacctcagtggacaggacccttcctggtcgtttatggtaccccaatggctgtctgcttacaagatcctcctcagtggattcacccttccagagtaaagctgtgtccatctgacactcagcctgacccttcttcctcctcttggaagtcgcaagtactctccccgacctcgttaaaactcaccgaaatccctgaagaaacttaaatgtcctgctcctgtccgccctgcttcttcaccctcttcctccactctatttgccaagacatctcctggtttcatccccaaactcccaccttagattctctcttaaactggatagatgatctcatcttttagggcactctgtataacttcttcccagatgagacgcctctgtttaccttcctactcactctttatctatccctcctgctcctttggctacctggcatggccgcactcccacttccagtaatgcctaattacctctacaaaactctcaacccactctctgttaaaccagtccaacccttctttggcaaaggacgctggctttgcatttctctatcagctaccacttacgttgccactctcattcccacaaaaaactgggtagttactagcttaacctaccaccctcgtaatgaaggaaaaagccccttctaactcctacatatgcagtcattggccaacttctccatcaatgaaatgaccgaaaatatcctgacaggtcgtgcagttcaacttttacgctcctacatgtccagcctcacccattacacaagtaatgaaaagcccatacacggccctgtgactacaacgctgtcttaactttccaagcccctttatgcatccaacacaacctgtcatcaggcctacctctaggtcacctactgttccatcagtgacaactacgccttgcagcttcaagccccaactgactgtattaacttccaggtctcccaaacagctacattcaaacagcctgtccgcttctcaaagcccccagaagtcatcagcacctctctgcttaacaaacaatccgggttttgtaatggcaggcatacgcactgcatgaccattcacccctggacctcctgc

SEQ ID NO: 269510 - DNA, 5523 bp, Homo sapiens
ttcggggatttggcggggcctttgtctctggctgcagccggagctcctgctctcctcctcactgctcagtgtcctctgctcctagaggcccagcctctgtgtccctgtgacctgcagatattgggagatccacagctaagacgccgggactccctggaaacctagaaatgatggagtctcgctctgttgctcaggctgaagggcagtggtgcgatctcggctcactgaaacctccgccttccgggctcaagcaattctcctgcctcaacctcgcaagtagctgggattacaggcatgcaccaccatgcccagactgtgccataacacacatttgatgctgaaatccgggataggggaactcctttgggagtcgtgtcccttaaccccttcccccgacttcttgaagagacccacccgcgacctcggtacctcggaccagctctgtaaaagccccgcctctgccttcggataggtctggccccaccctggagtcttgcctcacagaactgattagaagagatcagagttttggctggtgcctttccggagtggttgctaacaattcccgaattccacaaggagataaatgggaaaaaaaggaaccactgacatttaaagatgtcgccatagaattctctctggaggagtggcaatgcctggatactgcacagcgggatttatataggaatgtgttgttagagaactacagaaacctggtctttttgggtattgctgtctctaagccatatctgatcacctgtctggagcaaaaaaaagagccctggaatataaaaagacatgagatggtagccaaacccccagtaatgtcttttcattttgcccaagacctttggccagagcagaacataaaagattctttccagaaagtgacactgagaagatacggaaaatgtgaatatgagaatttacagttaagaaaaggctgtaaacatgtggatgagtgtacggggcacaaaggaggtcataatacagttaaccaatgtttgacagctaccccaagcaaaatattccagtgtaataaatatgtgaaagtctttgataaattttcaaattcaaatagatataagagaagacatacaggaaacaaacacttcaaatgtaaagaatgtagcaaatcattttgcgtgctttcacaactaactcagcatagaagaattcatactagagtgaattcctacaaatgtgaagaatgtggaaaagcctttaactggttctcaactcttactaaacataagagaattcatactggagaaaagccctacaaatgtgaagaatgtggcaaagcctttaaccagtcctcacaacttactaggcataagataattcatactgaagagaaacccaacaaatgtgaagaatgtggcaaggcctttaaacaggcctcacaccttactatacataaaataattcatactggagaaaaaccttacaaatatgaagaatgtggcaaagtctttagccagtcctcacaccttactacacaaaagatacttcacactggagagaacctctacaagtgtaaagaatgtggaaaagcttttaacctattctcaaatcttactaaccataagagaattcatgctggggagaaaccctacaaatgtaaagaatgtggcagagcttttaacatatcctcaaaccttaataaacaggagaaaattcatactggagggaaactcaacaaatgtgaagaatgtgacaaagcttttaaccgatccttaaaacttactgcacataagaaaattctaatggaagagaaaccctacaaatgtgaagaatgtggcaaagtctttaaccagttctcaactcttactagacataagataattcatactggagagaaaccctacaaatgtaaagaatgtggcaaagcttttaaccaatcttcaaaccttactgaacataagaaaattcatactgcagagaaatcctataaatgtgaagaatgtggcaaagcttttaaccaacactcaaacctaattaaccataggaaaatttattctggagagaaaccatacaaatgtgaagaatgtggaaaagcttttaatcgatcctcaacccttactagacataagaaaattcatactggagagaaaccctacaaatgtgaagaatgtgacagagcttttagccagtcttcaaaccttactgaacataagaaaattcatactggagagaaaccctataaatgtgaggaatgtggcaaagcttttaaccgattctcaacccttactaaacataagagaattcatactggagaaaaaccctataaatgtgaagaatgtggaaaagcctttaatcaatcctatcaacttactagacataagatagttcatactaaagagaaactcaacaaatgtgaagaatttggcaaggcctttaaacagtcctcacaccgtactatacataaaattattcatactggagagaaaccctacaaatgtgaagaacatggcaaagtttttaaccagtcctcaaaccttactacacaaaagataattcatactggagagaacctctacaaatttgaagaacatggaaaagcttttaacctattctcaaacattactaaccataagataatttatactggagagaaaccccacaaatgtgaagaatgtggaaaagcttataaccgattctcaaacctaactatacataagagaattcatacgggagagaaaccttaccaatgtgcagaatgtggcaaagcctttaactgctcctcaacccttaatagacataagataattcatactggagagaaaccttacaaatgtaaagaatgtggcaaagcttttaacctatcctcaacccttactgcacataagaaaattcatactggagagaaaccctataaatgtgaagaatgtggcaaagcttttaaccaatcctcaaaccttaccacacataagaaaattcatacttcagagaaaccctacaaatgtgaagaatgtggcaaatcctttaaccagttctcatctcttaatatacataagataattcatactggagagaaaccctacaaatgtggagattatggcagagctttcaacctatcctcaaatcttactacacataagaaaattcatactggagagaaaccctacaaatgtgaatatggcaaaacttaattgatcctacaagcttactacacataagaaaattcatactggagagaaactacaaatgtgaagaatgtgttaaagcctttaacaagtcttcaactttttctgcacacacgaggtattttatactggtgagaaaccttacaatgtaaagaatgtggcacagcttttaactaatcttcaaaccttactgaaagttgagaaaattcgtactggagagaatcctacaaatgtgaaaaatgtggcaaatcctttaactgatcctcaacttttactaaacataaggtaattcatactggagaaaagccatacaaatgagaagaatgtggcaatgcctttaatcagtcctcacacctttctacacataagataatttatactggagaggaactctatagttgtgaagaatgtggcaaagcttttaaccaatcctcataccttactatacagaaattcatactggagagaaagcctacaattgtgaagaatgtggcaaagcttttaaccttccttaacccttaactgtagataagaaaattcatactggaaagaaaccctacaaatgtgaagtctgtggcaaagcttttaactgattctcaactcttactacatgtaagagtatttatactggaaagaaaccctacaaatgtaaaaaacgtggcaatgcctttaactggtcctcacaccttgctacatataagacagtttatactttgagagaaaccctgcaaatgtgaataatgtggcaatactttaaaccaatcctcaaacctcactaaacataagataatactgaaaactttacaaacctgaatgatgtgacaataattttgacaacacctcgaactttctaacataaatcatactggtgaaaaatcctagaaatgtgaaaaatatcacaaagcctttaaatggttgtcacacttgattgtaggtaagaatccatactgaagaaaactcctggaagtgtaaaaaatgtggcaacacttttaataaatgctcaccccttattgcacaggaaagcatttatacttcagaaagattgtacaaatacaaggaatgtggaaaagccattattatctgctcagattttactcaacattagagagttagtacgtaataaaagcattataaatgcaatttttgtcaagagatctttcagaaaatataagcctttaaagtgaagaagaggagccagttgtgctggctcacatctgtaatgccagcactttgggaggccaaggtgggtggatcacctgagggcaggagtctgagaccagcctggccaacatagcaaaaccccatctctattaaaaattttacaaaaattagctgcgtgtggtggcaggcccctgtaatcccagctaattgggaggctgaagcaggagaattgctcaaacctgggaggcgaagattgcagtgagctgaaatcacaccactacactccagccaaagcaacaagagcaaaaacttcgtctcaaaaacaaaacaaaaaaagagtattcattgtgaggacaaacaatacaaatacgaagagggttgtagtacctttacttgtatcacagatacttttgtacccattttgcactagaggaaaaccatgaagcagttgctcaaatgttgttcaacaccagaaaatttatattggagaaaagcactgtaaatgtaatgcatttgtgaaaacattttttaaaaaactacagcttagaaaataccagaggcctcatactaaaatatatttttgcaagtgaagtaaatataaaaataatttaatccaaaattaagtctatataaatatcagagaattcacagtagaaatatctaaggtactgacacttcagacattgctgagtatagaatcagaatgctgagtatagaaaataatttaaaactaaagttggtaggtaaataatgtgtatataactttaaaagaagtagaatttttttgtagatgtataattacattcaaattatattttttcttgaaaaattagtttttgaaaagcaaataatgatgtaattcaactcaaattcatgctcttcattcctattgtattcacatgtgaaagcatgtgattaatttttcatgcatcaaagatatgagaaatcatttctgttaggtcggtattatttatgacactttctatgaaagaataaggacattaaaatgtaagatgcatgatgaaaacctgagtgaagaggctgtttgtgtttaacttataatattgagtgatccatgaagtaggttttcagagcaatattcttctgcattatagtaagagaaaaccatttttaatcttagttaaaattaaagtgaattagtagtatatcattttactatttgtacttttatgtaataaaatgcaatgtgttt

SEQ ID NO: 269511 - DNA, 5381 bp, Homo sapiens
ttcggggatttggcggggcctttgtctctggctgcagccggagctcctgctctcctcctcactgctcagtgtcctctgctcctagaggcccagcctctgtgtccctgtgacctgcagatattgggagatccacagctaagacgccgggactccctggaaacctagaaatgactgtgccataacacacatttgatgctgaaatccgggataggggaactcctttgggagtcgtgtcccttaaccccttcccccgacttcttgaagagacccacccgcgacctcggtacctcggaccagctctgtaaaagccccgcctctgccttcggataggtctggccccaccctggagtcttgcctcacagaactgattagaagagatcagagttttggctggtgcctttccggagtggttgctaacaattcccgaattccacaaggagataaatgggaaaaaaaggaaccactgacatttaaagatgtcgccatagaattctctctggaggagtggcaatgcctggatactgcacagcgggatttatataggaatgtgttgttagagaactacagaaacctggtctttttgggtattgctgtctctaagccatatctgatcacctgtctggagcaaaaaaaagagccctggaatataaaaagacatgagatggtagccaaacccccagtaatgtcttttcattttgcccaagacctttggccagagcagaacataaaagattctttccagaaagtgacactgagaagatacggaaaatgtgaatatgagaatttacagttaagaaaaggctgtaaacatgtggatgagtgtacggggcacaaaggaggtcataatacagttaaccaatgtttgacagctaccccaagcaaaatattccagtgtaataaatatgtgaaagtctttgataaattttcaaattcaaatagatataagagaagacatacaggaaacaaacacttcaaatgtaaagaatgtagcaaatcattttgcgtgctttcacaactaactcagcatagaagaattcatactagagtgaattcctacaaatgtgaagaatgtggaaaagcctttaactggttctcaactcttactaaacataagagaattcatactggagaaaagccctacaaatgtgaagaatgtggcaaagcctttaaccagtcctcacaacttactaggcataagataattcatactgaagagaaacccaacaaatgtgaagaatgtggcaaggcctttaaacaggcctcacaccttactatacataaaataattcatactggagaaaaaccttacaaatatgaagaatgtggcaaagtctttagccagtcctcacaccttactacacaaaagatacttcacactggagagaacctctacaagtgtaaagaatgtggaaaagcttttaacctattctcaaatcttactaaccataagagaattcatgctggggagaaaccctacaaatgtaaagaatgtggcagagcttttaacatatcctcaaaccttaataaacaggagaaaattcatactggagggaaactcaacaaatgtgaagaatgtgacaaagcttttaaccgatccttaaaacttactgcacataagaaaattctaatggaagagaaaccctacaaatgtgaagaatgtggcaaagtctttaaccagttctcaactcttactagacataagataattcatactggagagaaaccctacaaatgtaaagaatgtggcaaagcttttaaccaatcttcaaaccttactgaacataagaaaattcatactgcagagaaatcctataaatgtgaagaatgtggcaaagcttttaaccaacactcaaacctaattaaccataggaaaatttattctggagagaaaccatacaaatgtgaagaatgtggaaaagcttttaatcgatcctcaacccttactagacataagaaaattcatactggagagaaaccctacaaatgtgaagaatgtgacagagcttttagccagtcttcaaaccttactgaacataagaaaattcatactggagagaaaccctataaatgtgaggaatgtggcaaagcttttaaccgattctcaacccttactaaacataagagaattcatactggagaaaaaccctataaatgtgaagaatgtggaaaagcctttaatcaatcctatcaacttactagacataagatagttcatactaaagagaaactcaacaaatgtgaagaatttggcaaggcctttaaacagtcctcacaccgtactatacataaaattattcatactggagagaaaccctacaaatgtgaagaacatggcaaagtttttaaccagtcctcaaaccttactacacaaaagataattcatactggagagaacctctacaaatttgaagaacatggaaaagcttttaacctattctcaaacattactaaccataagataatttatactggagagaaaccccacaaatgtgaagaatgtggaaaagcttataaccgattctcaaacctaactatacataagagaattcatacgggagagaaaccttaccaatgtgcagaatgtggcaaagcctttaactgctcctcaacccttaatagacataagataattcatactggagagaaaccttacaaatgtaaagaatgtggcaaagcttttaacctatcctcaacccttactgcacataagaaaattcatactggagagaaaccctataaatgtgaagaatgtggcaaagcttttaaccaatcctcaaaccttaccacacataagaaaattcatacttcagagaaaccctacaaatgtgaagaatgtggcaaatcctttaaccagttctcatctcttaatatacataagataattcatactggagagaaaccctacaaatgtggagattatggcagagctttcaacctatcctcaaatcttactacacataagaaaattcatactggagagaaaccctacaaatgtgaatatggcaaaacttaattgatcctacaagcttactacacataagaaaattcatactggagagaaactacaaatgtgaagaatgtgttaaagcctttaacaagtcttcaactttttctgcacacacgaggtattttatactggtgagaaaccttacaatgtaaagaatgtggcacagcttttaactaatcttcaaaccttactgaaagttgagaaaattcgtactggagagaatcctacaaatgtgaaaaatgtggcaaatcctttaactgatcctcaacttttactaaacataaggtaattcatactggagaaaagccatacaaatgagaagaatgtggcaatgcctttaatcagtcctcacacctttctacacataagataatttatactggagaggaactctatagttgtgaagaatgtggcaaagcttttaaccaatcctcataccttactatacagaaattcatactggagagaaagcctacaattgtgaagaatgtggcaaagcttttaaccttccttaacccttaactgtagataagaaaattcatactggaaagaaaccctacaaatgtgaagtctgtggcaaagcttttaactgattctcaactcttactacatgtaagagtatttatactggaaagaaaccctacaaatgtaaaaaacgtggcaatgcctttaactggtcctcacaccttgctacatataagacagtttatactttgagagaaaccctgcaaatgtgaataatgtggcaatactttaaaccaatcctcaaacctcactaaacataagataatactgaaaactttacaaacctgaatgatgtgacaataattttgacaacacctcgaactttctaacataaatcatactggtgaaaaatcctagaaatgtgaaaaatatcacaaagcctttaaatggttgtcacacttgattgtaggtaagaatccatactgaagaaaactcctggaagtgtaaaaaatgtggcaacacttttaataaatgctcaccccttattgcacaggaaagcatttatacttcagaaagattgtacaaatacaaggaatgtggaaaagccattattatctgctcagattttactcaacattagagagttagtacgtaataaaagcattataaatgcaatttttgtcaagagatctttcagaaaatataagcctttaaagtgaagaagaggagccagttgtgctggctcacatctgtaatgccagcactttgggaggccaaggtgggtggatcacctgagggcaggagtctgagaccagcctggccaacatagcaaaaccccatctctattaaaaattttacaaaaattagctgcgtgtggtggcaggcccctgtaatcccagctaattgggaggctgaagcaggagaattgctcaaacctgggaggcgaagattgcagtgagctgaaatcacaccactacactccagccaaagcaacaagagcaaaaacttcgtctcaaaaacaaaacaaaaaaagagtattcattgtgaggacaaacaatacaaatacgaagagggttgtagtacctttacttgtatcacagatacttttgtacccattttgcactagaggaaaaccatgaagcagttgctcaaatgttgttcaacaccagaaaatttatattggagaaaagcactgtaaatgtaatgcatttgtgaaaacattttttaaaaaactacagcttagaaaataccagaggcctcatactaaaatatatttttgcaagtgaagtaaatataaaaataatttaatccaaaattaagtctatataaatatcagagaattcacagtagaaatatctaaggtactgacacttcagacattgctgagtatagaatcagaatgctgagtatagaaaataatttaaaactaaagttggtaggtaaataatgtgtatataactttaaaagaagtagaatttttttgtagatgtataattacattcaaattatattttttcttgaaaaattagtttttgaaaagcaaataatgatgtaattcaactcaaattcatgctcttcattcctattgtattcacatgtgaaagcatgtgattaatttttcatgcatcaaagatatgagaaatcatttctgttaggtcggtattatttatgacactttctatgaaagaataaggacattaaaatgtaagatgcatgatgaaaacctgagtgaagaggctgtttgtgtttaacttataatattgagtgatccatgaagtaggttttcagagcaatattcttctgcattatagtaagagaaaaccatttttaatcttagttaaaattaaagtgaattagtagtatatcattttactatttgtacttttatgtaataaaatgcaatgtgttt

SEQ ID NO: 269512 - DNA, 421 bp, Homo sapiens
ttttttttctatgtagtgtttgccttttttaatcgttagtagtctttctatgtattttatgtgataaatatctatgtaaatatctatatccacatatacctacatataaaatatttcttacctactcattactttacggtttttcctttttgtgttttatttaaggctttctctaactccaagatcacaaacataggatcttagtgtgaggtaggaattttattttattttattttccaaatgactagacaattatcttgatgctatttattgaatacttcatcttttctctgctgttttgaaatacttttttagaatagtaaattcccatataaatggcaaatcttcagatccacttacatagaagtggatctgaaaccaagagaaggaggaagtccatgaggagagaattggaattggt

SEQ ID NO: 269513 - DNA, 526 bp, Homo sapiens
gtgatccttctgccttggcctcccaaagtgctgggattacagatgtgagccacttcgcccagcccaccgttttattttttcttactcaaaaggaagtgagtatgaggtgaactgcattaacctaaagtgctgcagagataaacttaaagcaggaagcaacataccatgaatgtactgcaagggaacacatttgtgtcatgtgaagagacatgacaaaaacagccctccttaaattatttgtggcaatagtgatcacattcattttaattttgccggaatatttcaagacaccgaaagaaacctggggctacaaaaaggaaagacaactcttcgatcaaggagttttcagtcgggaggacaactgactggcaaacaactaaataaaatacaggaattaactgaaacagggatgtaaacaagatgcaatggaaacataagtattgcttccacgtcagtctttgggaggacgttccttgtatttccatttgcaaagagaaataaataattgtcagagttcaaatgatca

SEQ ID NO: 269514 - DNA, 966 bp, Homo sapiens
ttatggccgggagagcattgaatttgcaggtgctttcagcagagaccacgcagaggctgcctttggatcaagtccaggaagtgcttcccccaattccagaactataagttacttccacagtgcatcagtgagatcaatatacacgaatatccccgggcaagttggaccgagccctttgaagaatactcagaagtttattttgtgaatgagtagactggaaaatgtttgtgtccagctgaggatgcacagttggaaagcaggaggaatgctgactggttgatgaaaactagcttaagagcattcattcgctccatgagatcaagggaacaagagtgtttgcaagaagccattatgagtcatggaaaaaaagatgatgaaacccatggaaacagcaagagaattcccactctctctcttcttaaaaaaaatctatcattatacagcacagagtggagccaagtttttaattttgaggaaccaaaaacaggatcaaatatgaaaaccctttcttttattgggccacattgtagatgctgatttgataattgtttcctatgcagatagattatttttatttcacagattatttaaaagggaagagggcctggttgtttatttatatgtttgtttgcatttatgaatcttgctgccttttagcaccaggatgtttttaaattgggattctgaggtgggaggatcatgaggtcaagggatcgagaccatcctggccaacatggtgaaaccctgtctctactaaaaacacaaaaattagctgggtgtggtggtgcgcgcctgtagtcccagctcctcaggaggctgaggcaggagaatcacttgaacctggcaggcagagtttgcagtgaaccaagatcacgccactgcattacagcctggtgcagagcaagactctgtctcaaaaaaaaaaaaaaaaaaaaatcaaagataccaataaaacgaatttaaata

SEQ ID NO: 269515 - DNA, 1727 bp, Homo sapiens
gtgatccttctgccttggcctcccaaagtgctgggattacagatgtgagccacttcgcccagcccaccgttttattttttcttactcaaaaggaagtgagtatgaggtgaactgcattaacctaaagtgctgcagagataaacttaaagcaggaagcaacataccatgaatgtactgcaagggaacacatttgtgtcatgtgaagagacatgacaaaaacagccctccttaaattatttgtggcaatagtgatcacattcattttaattttgccggaatatttcaagacaccgaaagaaagaacattggagctatcatgtctggaagtgtgtttgcaatctaattttacctattcactctcctccttaaatttttcttttgtgacttttctgcaaccagtaagggaaactcagattatcatgagaatctttctaaatccctccaattttcgtaacttcaccaggacttgccaagacatcacaggtgaatttaaaatgtgctcctcgtgtttggtttgtgagtctaaaggaaacatggattttatttctcaggaacaaacatcaaaagttcttatcaggagaggatcaatggaagtgaaagcaaatgattttcattcaccttgtcagcactttaacttcagtgtagctcctctggttgaccacttggaggaatataacactacctgtcatctaaaaaaccacactggaagatcaacaatcatggaggatgagccaagcaaggagaaatcgataaactacacttgtagaatcatggaatacccgaatgattgtatacacatttctttgcacctggagatggatataaaaaatatcacttgttccatgaagatcacttggtatattttagttctattagtttttatatttttgatcatcctcactatccgcaaaatacttgaaggccagagaagagtgcaaaagtggcagagtcatagagacaaacctacatctgttctcttaagaggaagtgattcggagaaactgagagcattgaatgtgcaggttctttcagcagagaccacgcagaggctgcctttggatcaagtccaggaagtgcttcccccaattccagaactataagttacttccacagtgcatcagtgagatcaatatacacgaatatccccgggcaagttggaccgagccctttgaagaatactcagaagtttattttgtgaatgagtagactggaaaatgtttgtgtccagctgaggatgcacagttggaaagcaggaggaatgctgactggttgatgaaaactagcttaagagcattcattcgctccatgagatcaagggaacaagagtgtttgcaagaagccattatgagtcatggaaaaaaagatgatgaaacccatggaaacagcaagagaattcccactctctctcttcttaaaaaaaatctatcattatacagttgggattctgaggtgggaggatcatgaggtcaagggatcgagaccatcctggccaacatggtgaaaccctgtctctactaaaaacacaaaaattagctgggtgtggtggtgcgcgcctgtagtcccagctcctcaggaggctgaggcaggagaatcacttgaacctggcaggcagagtttgcagtgaaccaagatcacgccactgcattacagcctggtgcagagcaagactctgtctcaaaaaaaaaaaaaaaaaaaaatcaaagataccaataaaacgaatttaaata

SEQ ID NO: 269516 - DNA, 2009 bp, Homo sapiens
gtgatccttctgccttggcctcccaaagtgctgggattacagatgtgagccacttcgcccagcccaccgttttattttttcttactcaaaaggaagtgagtatgaggtgaactgcattaacctaaagtgctgcagagataaacttaaagcaggaagcaacataccatgaatgtactgcaagggaacacatttgtgtcatgtgaagagacatgacaaaaacagccctccttaaattatttgtggcaatagtgatcacattcattttaattttgccggaatatttcaagacaccgaaagaaagaacattggagctatcatgtctggaagtgtgtttgcaatctaattttacctattcactctcctccttaaatttttcttttgtgacttttctgcaaccagtaagggaaactcagattatcatgagaatctttctaaatccctccaattttcgtaacttcaccaggacttgccaagacatcacaggtgaatttaaaatgtgctcctcgtgtttggtttgtgagtctaaaggaaacatggattttatttctcaggaacaaacatcaaaagttcttatcaggagaggatcaatggaagtgaaagcaaatgattttcattcaccttgtcagcactttaacttcagtgtagctcctctggttgaccacttggaggaatataacactacctgtcatctaaaaaaccacactggaagatcaacaatcatggaggatgagccaagcaaggagaaatcgataaactacacttgtagaatcatggaatacccgaatgattgtatacacatttctttgcacctggagatggatataaaaaatatcacttgttccatgaagatcacttggtatattttagttctattagtttttatatttttgatcatcctcactatccgcaaaatacttgaaggccagagaagagtgcaaaagtggcagagtcatagagacaaacctacatctgttctcttaagaggaagtgattcggagaaactgagagcattgaatgtgcaggttctttcagcagagaccacgcagaggctgcctttggatcaagtccaggaagtgcttcccccaattccagaactataagttacttccacagtgcatcagtgagatcaatatacacgaatatccccgggcaagttggaccgagccctttgaagaatactcagaagtttattttgtgaatgagtagactggaaaatgtttgtgtccagctgaggatgcacagttggaaagcaggaggaatgctgactggttgatgaaaactagcttaagagcattcattcgctccatgagatcaagggaacaagagtgtttgcaagaagccattatgagtcatggaaaaaaagatgatgaaacccatggaaacagcaagagaattcccactctctctcttcttaaaaaaaatctatcattatacagcacagagtggagccaagtttttaattttgaggaaccaaaaacaggatcaaatatgaaaaccctttcttttattgggccacattgtagatgctgatttgataattgtttcctatgcagatagattatttttatttcacagattatttaaaagggaagagggcctggttgtttatttatatgtttgtttgcatttatgaatcttgctgccttttagcaccaggatgtttttaaaaaaattcaaagaggccaggcgcagtggctcatgcctgtaatcccagcactttgggattctgaggtgggaggatcatgaggtcaagggatcgagaccatcctggccaacatggtgaaaccctgtctctactaaaaacacaaaaattagctgggtgtggtggtgcgcgcctgtagtcccagctcctcaggaggctgaggcaggagaatcacttgaacctggcaggcagagtttgcagtgaaccaagatcacgccactgcattacagcctggtgcagagcaagactctgtctcaaaaaaaaaaaaaaaaaaaaatcaaagataccaataaaacgaatttaaata

SEQ ID NO: 269517 - DNA, 1925 bp, Homo sapiens
gtgatccttctgccttggcctcccaaagtgctgggattacagatgtgagccacttcgcccagcccaccgttttattttttcttactcaaaaggaagtgagtatgaggtgaactgcattaacctaaagtgctgcagagataaacttaaagcaggaagcaacataccatgaatgtactgcaagggaacacatttgtgtcatgtgaagagacatgacaaaaacagccctccttaaattatttgtggcaatagtgatcacattcattttaattttgccggaatatttcaagacaccgaaagaaagaacattggagctatcatgtctggaagtgtgtttgcaatctaattttacctattcactctcctccttaaatttttcttttgtgacttttctgcaaccagtaagggaaactcagattatcatgagaatctttctaaatccctccaattttcgtaacttcaccaggacttgccaagacatcacagttcttatcaggagaggatcaatggaagtgaaagcaaatgattttcattcaccttgtcagcactttaacttcagtgtagctcctctggttgaccacttggaggaatataacactacctgtcatctaaaaaaccacactggaagatcaacaatcatggaggatgagccaagcaaggagaaatcgataaactacacttgtagaatcatggaatacccgaatgattgtatacacatttctttgcacctggagatggatataaaaaatatcacttgttccatgaagatcacttggtatattttagttctattagtttttatatttttgatcatcctcactatccgcaaaatacttgaaggccagagaagagtgcaaaagtggcagagtcatagagacaaacctacatctgttctcttaagaggaagtgattcggagaaactgagagcattgaatgtgcaggttctttcagcagagaccacgcagaggctgcctttggatcaagtccaggaagtgcttcccccaattccagaactataagttacttccacagtgcatcagtgagatcaatatacacgaatatccccgggcaagttggaccgagccctttgaagaatactcagaagtttattttgtgaatgagtagactggaaaatgtttgtgtccagctgaggatgcacagttggaaagcaggaggaatgctgactggttgatgaaaactagcttaagagcattcattcgctccatgagatcaagggaacaagagtgtttgcaagaagccattatgagtcatggaaaaaaagatgatgaaacccatggaaacagcaagagaattcccactctctctcttcttaaaaaaaatctatcattatacagcacagagtggagccaagtttttaattttgaggaaccaaaaacaggatcaaatatgaaaaccctttcttttattgggccacattgtagatgctgatttgataattgtttcctatgcagatagattatttttatttcacagattatttaaaagggaagagggcctggttgtttatttatatgtttgtttgcatttatgaatcttgctgccttttagcaccaggatgtttttaaaaaaattcaaagaggccaggcgcagtggctcatgcctgtaatcccagcactttgggattctgaggtgggaggatcatgaggtcaagggatcgagaccatcctggccaacatggtgaaaccctgtctctactaaaaacacaaaaattagctgggtgtggtggtgcgcgcctgtagtcccagctcctcaggaggctgaggcaggagaatcacttgaacctggcaggcagagtttgcagtgaaccaagatcacgccactgcattacagcctggtgcagagcaagactctgtctcaaaaaaaaaaaaaaaaaaaaatcaaagataccaataaaacgaatttaaata

SEQ ID NO: 269518 - DNA, 586 bp, Homo sapiens
gagggaatgctttctaacacatttgaagccagcattactctgttactaaaaaccttgcaaagacattacaagaaaggagaattatgagtcggtatccttcatgaagatagattcaaaaggtattaacaaaacattaacaaatcaaatccaacaatttagaaaacaattcatcatgaccaaatgtgttttctttcaggaatccaatacaatttaacattagaacagtaaacaatgtattttaccatattaacaagctaaaaatgaaaatcatataatcatttccatagatacagataaagtattggataaatttcatcattaattcctgatgagaaactttcaagtaactaataatagaagagaactctttcaagctgataaagggaatgtatgaaaaatctataggcaacatcataattgattatgaaacactgagtgttttcctcttacaatcaagaaagtcaaggatgtccactattaccatgtctatttaacatttcactggaaattctaactagcacaataagacaagaaaagcagatgacatgattgtcccatggaaaattcaagggaatccatgaaaaaa

SEQ ID NO: 269519 - DNA, 240 bp, Homo sapiens
agattcaccacttactatagctagacaccatgtctggcacacagtaggtgctcagtaactatctgttctactagccatgaggccttgggcaggtacttaccctcctaagcctcattttcttatacaaaagagaataatataacctacacctcagaaggctgctgggggattcaatgagaaaacataaataaaaatgcttcagcaccatacatggcatacagtcagttttaccagaatata

SEQ ID NO: 269520 - DNA, 1779 bp, Homo sapiens
aaagacctttcttcatggctcagagtttaatcgacatcagaaaattcatactggtgagagaaactatgaatgtaaggaatgtggaaagaccttttttcgtggttcagaacttaatcgacaccagaaaattcatactggaaagaggccatatgaatgtgaagaatgtggaaaagcctttctctggggttcacaacttactcgacatcagagaatgcatactggtgaggaaccttacgtatgtaaagaatgtgggaaatcttttatctggggttcacagcttacacgacataagaaaattcatactgatgcagaaccttatggatgcaagaaaagtagccacatctttagtcaccattcatattttactgaacaaaaaattcataatagtgcaaatctctgtgaatggacagactatgggaacacctttagtcatgagtcaaactttgctcaacaccagaatatttacacttttgagaaatcctatgaatttaaagattttgagaaagcattttcttcaagctctcacttcatttcactcttgtgaaatattatataaaagtgtaggaagggctttattcatgactcattaattgatgtcatttatttttttctcttgaggaacaccacaaatgtaagtaatattggaaggcattttaacagagcacacatccagcagcagcagcagcagcagcagcagagaattcatcatgcaatcaatataggaaagaaattactgatcagttatcaattgcagaatatcagggtaaaattttatgagatagcatgaattctttttgaatcattctcaaaacattctcatcagagatgttgcataaagaatttatatataatttggccaagcatggtggctcacacctgttatcctagcactttgggaaacagaggtgggtggatcacctgaggtcaggggttcgagaccagcctgaccaacatggtgaaaccctgtctctactaaatatacaaaaattagccgggcgtggtagcacacgcctgtagtcccagctactcgggaggccgaggcatgagaattccttgaacctgggaggtggaggttgcagtgagccaagatcacatcactgcactccagcctgggtgatagaacaagactccatctcaaaaacaaaaacccacaagaatttatatataattcattttggaaatctttcatcattagcaaaattctgttgtatttccacaaaaatcatgtaattaatctagaaaagccttgaactatgtcatacaatttatttggcatgtcttgtttcaatacatcctgcctctatttttttttttggaaagtatcttaaatctatgtctgtttaatcgtattcattagattataagggttgaatgatttgagatttacatgacttagtgactgtcatttgtattggtattaagccattttatgagaggaggacttttaagactataatgattatagacaaatatgtcatctctatttatgtcttactgaacatcagaatgttaattctgaaaaaaaatcagtaaaatacaatgaagaaagctttgaatattaatttcacatgctacatcaaaaaaacctataaaagaaagccttatgactttagtaaaagtggggttgttgagtgttcagcagttttttaaaagacattcagaaataacttctctctaacaaatttctaaagccaagtgttatataattctttaccacagttataactcagaaactagcaaatggatagccatatggattcttacctctttgaaatttac

SEQ ID NO: 269521 - DNA, 207 bp, Homo sapiens
ggccaggtggaaccaaacccattggacttgaacagaacctcgccttccccttcctgtccactcttctctgtgtcaggtgtgcagtgtgcacagcagcaggatctataatatccagactttccaaataagttgaatgtctatcaattagaacatcttttcgtacatcctgccatccctactgctggtaaacactaacatgttctctgt

SEQ ID NO: 269522 - DNA, 471 bp, Homo sapiens
caagatagggcaggaatgggatgaaaggggactggcctgttggctaggtcagcaaatttgtctgtgatttacagcactaagctcaggatttgacttgattagaatttgattgcctttcatttgattcaagttggagccactgctccgggctgttctatctagtggatggaccatagaagcagggatctcatgacttagcaatattaaaacctcaggcaggtggcttgttggtctgagcagcctctaaatttgtacaaaagcctggtggctggctgggttggtaaaaatggcagctgtcctgcatgctgacattgggagttactctgcactgctgcaggctgtcctggcacactgcaggccgggcatcatttcatggtggaggacgtcactcagttttgcatgaggctcttgcatcacatttgtatttaaggaattcacaccttattttagggaaaacatctgttccttggt

SEQ ID NO: 269523 - DNA, 305 bp, Homo sapiens
agcagaatgctttgaatgacaaagcaagaaagaattcaaagatgacttttcaaggtgttgatgaacctgaagaacctggattatcatgatgagaatgggaaaaaagggaagccacacagcaggtatggggttgagaatgaacttgtttgtgtgatgtgaagagtgaatgtgggagtgagaggcccatgagcagggaaaaggaaatgctgatgaaggtgaagtccagctgccatggttataaagggactgggaattagatccaaaacctgaaatcatgcaatgcctggagtatttttatactacaa

SEQ ID NO: 269524 - DNA, 538 bp, Homo sapiens
gcaatcaccagagaatatcactatttgctctgtgctccctcaacacttaaaccatgcctctttataacatttagatcaccgtccttataatgcgcctttctgtctctttttaaaccttgagcaccttgaaggcaaaaatttcaactttctttccctagtgtcttgcactccctggtatctagcacatagagagctcaataaatgttttttgaatgagtaaatcattgcacgaatttataacttcatgaacccatggaacccattgactggtctgccctcatctccgatccttggctgaaaagcctaacaagccattatctgtccgtactgaaacactcctcctgatgtcaagaaccttctaaacataaaaccacctggtgcacggatcatttcttcttccaagatgtatctgccattgagagaaagaacaaatactagcttcagctttgtttgtaatactcatttgcaggaaggcaaacatgattatatatgatttaaatggaataaatgtatagtaaggagaacaaatgagtttatt

SEQ ID NO: 269525 - DNA, 700 bp, Homo sapiens
aaaagaggcgtccctcaacacgtccctccctattcattgcagaaccaactcaaacaggggctgcttctgctcaggcacccgctgggcaccctctgcagccctgacttcagggccatgctcgctggggccgtgtggcagtgcctctaaatgggacccattgtctcacactggttctgcaggtgtgcctcctgccctctgggagcttgtgactttgagcaccgtgaagggcaggggatggcggcacagacgctcaggctcctaggggctctgaggccaaggctccttatgtctacatgtgtgaggtgccaggtaatttctgatgcccctggggtgtaaaaccagctaatccagaagccctgtgacctgccaggatcaggctgctgagaccaggccagaggataagcgggtcctccttcccggtgggtcctggaggaggagagagagtccacttctctcccactcctggctgcccaatccttagggtcaacagaagcttaaatggaaaggtcctgcctgccctctgctcagggtagaggaaaactaaataccctgggatcagagtaggggcctgtacctcctctcctcctcctcctcctcagggaggagactgatagttccggcaagaagtaaggtgggatgcagttggggtgggaggaatccacaagctggggagaatcatggctcactgagctaaaaaaaa

SEQ ID NO: 269526 - DNA, 268 bp, Homo sapiens
agtcaaatcgtatttgtaaaaggagtagagtgaaagacagagctttacttttttgtcatgcaacaggattccatctgagatgaaacttggagccatcacctttcccactcagacctgttccattttcacaatgtgacctcttcagagagcaaaatcaataatgtgtctgtctcaaaagctctggttgtgatacttacttttaaggcttatcatgactttcataaaaacagcaataaatgtcctaataaatgtgcaattctaaataaca

SEQ ID NO: 269527 - DNA, 503 bp, Homo sapiens
atcacacttcttggtatttatccaaatgatttgaaaatttatgcctacatgaaaactgcacataattatctagtagctttattcatagtttccaaaatttagaagcaaccaagatgtcttttagtaggtaaactgataaatatgtaccacatccggctagtagaatgttattcagcagtaagaagaaatgagcctaccagtcatgaaaatacatagaagagggccaggcgcggtggctcatgcctgtaatcccagcactttgggggctgaggcgggtggatcacgaggtcaggagatcaagaccatcgtggctaacacggtgaaaacctgtcttcactaaaaacacaaaaaaaattagccaggcgtggtggtgggtgcctgtagtcccagctatttgggaggctgaggcaggagaatggtgtgaacccgggaggcggagcttgcagtgagcctaggttgcgccactgcactcagcctgggagacagagccagactccatctca

SEQ ID NO: 269528 - DNA, 471 bp, Homo sapiens
cagtcttggcacacctggaaatattagtgtgcacccaccatcaaagggacatgcatttcattcattcatcaattcattcattcaagaaacatttattaaggatctaccatgaaccaggcactattagaggtgcttacaccagtttgatcacactaacttcatgtaaatcaatactgaaaaatatcgtccaggcgcagtggctcacacctgtaatctcagtactttgggaggctgaggtgggcagatcacttgagcccaagagtttgagaccagcctgggcagcattatgaaaccctatctctacaaaaaatacaaaaagtagccaggtgtggtggcacatgactatggtcccagctactcgggaggttgaagtcgggggattgcttgagcccaggaggttgaggctgcagtgagccgagatcacaccactgcactccagcctgggtgagacagtgagacccctgtctccag

SEQ ID NO: 269529 - DNA, 502 bp, Homo sapiens
aaagaccacagtcaggccttgggaggatttctcattagctgtatgctctggtgggtacccagatccccctttcagaaccgaggcactatttccccacctactggaagtgttgtctgctgatgactcacggctaagtccctctactggacttgactgctggtgcaggaagctgccctctccaaggagaagagatagactagaatcctcgaggacctgctcccagagaacatttggagatgtcctaagacaattggctatgtggatagggagatctggtttagggaccatatcatacagacagtagaagccatggatgatctcattccaggagcacatatacagtgggaagagaatgaagctgaagacaattccagctccaaagatagtgacaagagctgttcatcttcatcatcctctctgtaggcatcttgaattagaagatactatttagtgtggtctcttacccaagataaataatctaagtttccgtaatctttcctca

SEQ ID NO: 269530 - DNA, 399 bp, Homo sapiens
tgtttccatgaactcttgctcttttgaaggtgtaacttatgctcacatgaatagcacattatgctactaacttattagtagttttaaaagaaagcaagaggacaagaacatttatttcagagactctgttttcttttaaaccctaacggttgagtcaaacaaagtcttttttgtaaatactgtagctaaatcttggcatgcttttactttaagcaagggaggagttttactgacatttggatgtgctagatatttttgacatcaatccccaagatgatttcttcttgaaggttctctggctttttactatctttcctaacggtcacatttttagtttaccattagcaacaggaaaatatttaactgctggttttcagcatttattgggtagaccattat

SEQ ID NO: 269531 - DNA, 277 bp, Homo sapiens
acagttacatcaagtctgtcttcattattcatccctatgtttttcctcatcactggaacaatgtttccccacattgcttcatggcagcatcttactcattgaagatctgtttcaaatgatacctcatttctaaggcttccttcaaattcccttgttaaaataggcctgtcttccaggtacaaaatataccttagttacagattttatgacaggctgtcttgtgtttctgcccctcgtgtatttttctgccttctcgaacccacactagatctcctat

SEQ ID NO: 269532 - DNA, 204 bp, Homo sapiens
aaaagacttacccagggtcacacagcactggccacaggatgctctcctggttctacctagaagcctcatagtgagtgtctagaactaaagagacaggccaggtgtggtggctcatgcctgtactcccacatcttggaaggctgacgcaggtggatcacttgaggtcagcctggccaacatggcaaaaccccatctctgctaaat

SEQ ID NO: 269533 - DNA, 430 bp, Homo sapiens
gaaaaagaaaaaagaatccacagattcctcgacccacccaagaccaatcaagtcggaatcccgagggtgccccaggcatctctggctttttaaactgccccgctgattctaatgtgctcgcaaggctgaaatcactaatttagaagatccaggtgacatttccgcacagacctcctgcttcctgttctgaaacctctcactctggacgaagcacgagggtctgtttggaggaaggaatcctaagagggcagtggacaatccttgatgctggtattgctgtggacacacgggaaaggcacttcaatcaagcagctagaaaggacagcttgggatgcagcttggaagagtggccgagagggagcagccgaaagcaggcaggtggtgtaattcattggttctgctggtgtaattgatcatcagagcccacctc

SEQ ID NO: 269534 - DNA, 420 bp, Homo sapiens
gagcacatgtttgatcactttgacttttcataatgaccttagcatatatactgggtaaacagctctgaaaatgtgagaacagtaagagtataccattcattggtaattttttgaggaaaagttcattgtttaggagaactataggttaactcatgaactttaaccatccttgtcataaatactgttgacctcagagcaaaataccccagaattagcaccaacatctacatgcatatttactgtagacttcaaactgcagattttgttttttcatcttgatcacaaatgcatttttcaatctttacaatatgaaatttatttataactttagttccaaaatggactctgtaatgcatttgcccatatttttagtcgtaatggatgtgattatattttattgaattaaaaatctaacagaag

SEQ ID NO: 269535 - DNA, 676 bp, Homo sapiens
tttacttccagtagagactggctaggggagatcctgctggactcaccccaacccagaaaacaactgtaaagtctagacataatattttaaaaagctacctgaaagtactaacgagtgaagagaagcaggcagattttggaggaagaaagctgtaaagtgagtccccattttcaaggtgcaagggtcaggtactgtaagaatggtaagcaagggtacagaaatactggtagaaaaatagtttttctggcctgaggaactagaacactgaaggtcagaaaaccacagcctttggccaagggggaaggggattccagaaagaaaagaatcagaaaagaaagacccaaattctgtctactcacatctttggctaaccactgagtcacacatgtacggaacaaatttcaaagcagttcaacaaaacacaaaatatttgaactgagaccagagcttccacttaagaaacagagtttgcagttctagtctaaccaagataattacctgtcaaatatcaacaattgaaaactttctcaaaagaaaaaaaaaatcaactctagaaagtattcaaataaaccaataaatagcatgaaaagaatatcagagggacaaaaacagaaaggacaaattaaaaaggaataatacaatggtagacgcaaagttaaaagcaataattgcatta

SEQ ID NO: 269536 - DNA, 586 bp, Homo sapiens
gcccaggctggagtgcagtggcatgatctaggctcaccgcaacctctgcctcccggctttaagcaattgttgtgcctccatctcccaagaagctgggattacaggtgcgcaccaccatgcctaatttttgtatttttagtagagagtagggtttctccattttggccagactggtcttgaattcctggcctcaagcaatccaactgtcttggcctcccaaagtgctggaattacaggtgtgagctgcctcacctggcctggaaaaacagcattcaaacatgagataggaccttcaccagaaaatgacttttatgtcttcagaatattaatgttctttcccatcatcctatatccagacagattttttttgtttcaataagtattctgattccttccattaagttgatataattgtttagctagtatttatcgttgagtaactgttacaaccacagtgttggagctgggaggttaaacacaaaagcaagtagctgtcttatgatagaatgtgtctgaaaaagcacagtgggagccatcaaaagaagttaacagttctatctgggagaacagaggagtctttatcagg

SEQ ID NO: 269537 - DNA, 904 bp, Homo sapiens
ctgagattgtggcacggggtgtgtagtgggcaccaaggccaatcacctcactctccctgggtcagttggagttgtccacgtggatggaataggtgagagagtgtgtgcaaagacgggaaggtgagagagaacctggggccttaaggagagcttcgattctttggccgtgtttgtaggcttagggcctatgtgagagtgtcaaaagacagtgatgaagtaggaaggccccagatgttgaattttaaatgcagttgataggaagcctttgaaacaatatatatatatatatttttagtagagatggggtttcaccgggttagccaggatggtctcgatctcctgaccttgtgatccgcccgcctcggcctcccaaagtgctgggattacaggcaggagccaccgcacccggccgcctttgaaatattttaagcagagaagtagccagagcaatagttttcagagcttaatgtggtggatgctgtgtttactgtcaagattcgcttcaaagaaagactcggtgcccagcctcttgggagtgaccgctttagccattgcctcagctgcagtgaaccaccttactcaaaggatggagatggagggtcccacatccagggactaatgaggtgggaataggaagattgagccatctaggcccaacttaggacaactctgagagccatgttacctccagagctcaccatggggttagtagaggcgattattgagcctgctttgcaactcaactttctcctctgctcactcctgcttccttctctactctgcaatctgggcctttctcactgtctctctgtgaagttggcgaggctctatttggtgtcccttgatgtgcttaggtctggaaattgtttccaggtggggagcacaggcaatcatggggctcacg

SEQ ID NO: 269538 - DNA, 422 bp, Homo sapiens
gggaaggcaaaggaggagagagagacatattttcctttttctgagttttgtcagagagagatcttttttgcaattactcatttggaatttgaaaggtatcttttgtagatatcacctggtgggtagccctgtcaatatggttactcaacaacaaagtcaaaatgaggaagaccatatggttaaattttcctgagctactcttcgattcctatatgatgtagatggcaactcagaaacagctgggaagtttgtggcagggacagggtgatcactactctaggaatatatagctctacaataagggctggagagcaggtttccttggctagtactgaataaggaccacaacagacctcagagacatctatagaaattagtgggacctgatgtgagaccagttcagcaagggaaccctcttctcc

SEQ ID NO: 269539 - DNA, 347 bp, Homo sapiens
ttgtataattgaacaggaagctcatgtttatttccagtttgctctcaggaaagaaagcagtaatggggtgacagggaggatcctgttctttgaaggacatgctgagagggaatagtcggtgtgaggggccgtttagcctaatggtgaaatgcttagtcaactggaacctgactgcctggctccaaatgctggctttgccacatgtggcctgtggaaggtacgtagacatttgtgcctccgctgcctcatttataagttaatgacaggaagactacctacttctcagaggcatgatcagggataaataagtcaatgcccattaaaaaaaaaaataacagtacaggtgt

SEQ ID NO: 269540 - DNA, 587 bp, Homo sapiens
agagccttgtatccctgtccagggcattacatttcatgaaggcaagaacagaccaaatcctgtggacttttggcagtctctggggctttcatgtgaacctgtttcaactcctgaggccaaatatgctctatgtgtcacccggagagtcccagctaagaggccaaatgagtaaaatgcaagacatgaagctgggaggggtcggaatgctgatctgacctcaggctgctggagagaagttaactagctttttaaaatttttatttatttttttaagagatagtgtcttgctatattgcccaagctgaacttgacttcctgggctcaagtgagcctcctgcctcagccttctgagaagctgggactacagaaatgtgccactgcacttggctggaaccagcttttgaggcattctttgcctctgaagaacctaggatgaagttcctcttacctgaggaagcggagaagcttccagaggctttgactgtgctgctttctaacccatgagcctgctgtttccagaaggaacactctattagtctgttctcacactgctataaataaatgcctggcactggataatttaaaaa

SEQ ID NO: 269541 - DNA, 835 bp, Homo sapiens
tgttagcatatatttcatcttgtgtctgtgtatgagtgtgtgtgtttctgtggtccttcactttcactgaattatcataccataaaggagacctcagaacaggtcacagccagcgctggtggtcagaatttgcttcacccctgccctgggccctatccgctgtcagctgcctgagctgaagagagatgcgtccagctcagaccctccgcctgctgagtaggctgggtggaggaacaggatctcccatgtctaagccaaacctgttttaagccacaattacccagtttcaattccagccctgcttggtcagcatcatgtgttcctccacgttcctcctggtagccacagactgcgtggctagtcaggccagcagcaaaacaagatatctgggagtctgctgagggttgaaggaatgcccatcgtctattctgtgtacagtattgtttttatttttgttttgttttttgagacggagtcttgctttgcactccagccgggtgacagagcgagactgcctcaagaaaaaaaaaggaaagaaaatcaggctccaacaataagagaaatatattacctcatgtaacaagaagccccaaagtagagtggctgcaggttggtgtaaactctgccctcaggccagggcccccatggttgccaaagagcatcacctggatatggtaatgtcctgccgagagagcatcagttgctttctatgtggctctttttaggagtaagccaatctctcccagatgtcacatgccctgtcctaatccaagtccctcagggcactggaatgaccagaggctctcaaagtgtggttccccagaccagcaccatc

SEQ ID NO: 269542 - DNA, 417 bp, Homo sapiens
ggctgaggtaggagaatcgcttgaacccaggaggcagaggttgcaatgaaccaagatcacgccactgcactccagccgggtgacagagcgagactgcctcaagaaaaaaaaaggaaagaaaatcaggctccaacaataagagaaatatattacctcatgtaacaagaagccccaaagtagagtggctgcaggttggtgtaaactctgccctcaggccagggcccccatggttgccaaagagcatcacctggatatggtaatgtcctgccgagagagcatcagttgctttctatgtggctctttttaggagtaagccaatctctcccagatgtcacatgccctgtcctaatccaagtccctcagggcactggaatgaccagaggctctcaaagtgtggttccccagaccagcaccatc

SEQ ID NO: 269543 - DNA, 292 bp, Homo sapiens
cggccgcccgggctaagagcggccggctggagccgctgagcccccgctgcggccgggagctgcatgggggagcgccggcagcgcttgggaagatgccccggccggagctgcccctgccggagggctgggaggaggcgcgcgacttcgacggcaaggtctactacatagaccacacgaaccgcaccaccagctggatcgacccgcgggacaggtaggaccctggaaccctcctccgtgcccccacacccccgcctgggcccccacctgcccctggagccgccggccgggactg

SEQ ID NO: 269544 - DNA, 700 bp, Homo sapiens
gcggccgcccgggctaagagcggccggctggagccgctgagcccccgctgcggccgggagctgcatgggggagcgccggcagcgcttgggaagatgccccggccggagctgcccctgccggagggctgggaggaggcgcgcgacttcgacggcaaggtctactacatagaccacacgaaccgcaccaccagctggatcgacccgcgggacaggtacaccaaaccgctcacctttgctgactgcattagtgatgagttgccgctaggatgggaagaggcatatgacccacaggttggagattacttcatagaccacaacaccaaaaccactcagattgaggatcctcgagtacaatggcggcgggagcaggaacatatgctgaaggattacctggtggtggcccaggaggctctgagtgcacaaaaggagatctaccaggtgaagcagcagcgcctggagcttgcacagcaggagtaccagcaactgcatgccgtctgggagcataagctgggctcccaggtcagcttggtctctggttcatcatccagctccaagtatgaccctgagatcctgaaagctgaaattgccactgcaaaatcccgggtcaacaagctgaagagagagatggttcacctccagcacgagctgcagttcaaagagcgtggctttcagaccctgaagaagtaagtacaccctgcat

SEQ ID NO: 269545 - DNA, 534 bp, Homo sapiens
cggacaatatgttcccgagaagcaggcagggatagtgctctacctccttggccagaaagaaaatgactaagtgagcctcacaaaacaacaccttggagaaatcagaagtggctcgcagcagggaaatttggggcaagagaaattctcctctggacacacagggctcctggaagtgccccacttctcagatgcataagtgcaaatacctccacctcctccccccatgttaacccctggggtcttcccgctgttcacagcataatatctgaaacccttaacttcttttacagggtctttcacatgtgacttcctctacactgagtcttcaaagagagtcaggggttgtgtgtttgtgttttttgtgtgtgtttcttttgagacagggtctcgctctgttgcccaggctggagtgcagtggcatgatctcagctcactgcaacctctgcctcccgggttcaagtgattctcgtgcctcagtctccagagtagctgggatgcgccaccaccacacctggttaatttttgtatgtttag

SEQ ID NO: 269546 - DNA, 595 bp, Homo sapiens
tatttctttgagacagggtctccctctgacacctgggctggagtacagtggcgcaatcactgctcactgcagcctcaacctcccaggctcaagcagtcttcttgctcagcctcccaagtagctggggccacaggcatgcgccaccatgcccagctagcacgtctgtttctgtgcgcaaatctccccttttcataaggacaccagtcactggattagggcccaccctaatgacctcattttcacttcaggacctctgtaaacacccacctctaaatgaagtcacatgctgagggatgggggttcaggatcccaacctatccttgggggtggaggacacaatggaattcataatgctcccgaagtggttttcggcggggatcgtgaattaggtgtccagcgcgtaacacacagacaccatctggttctctgtgtgagaaggagggggttgcagcacacccgtcatgaataccagctctggagcaggacagacaggttcaaagcctggctccaccccgaccagctgcatgatcctggccaagtcacatcacttctctgtgactcagtttactccttgtaaaaaaaaaaaaaaaaaaag

SEQ ID NO: 269547 - DNA, 490 bp, Homo sapiens
tgacaccttgatgtgctgaatactttgaactgaagattggaaaggcctcaggagcaaagtctctccgaccttctcctgcccttctttctcccctgaagggagtcatagaaaccagaatttctccatcacaagccgggtcatagaaactagaactcctcttccccaaagcgagctgtaaaacctaaaaaggccacactctttcccttctccctttgcccttaaagaacctcaattcagagggcccctgacccacgggaggcggggaatgctttacagagacaccaaaaagcatctgaacagacaggcctcactggctttccccatgtcaattaccattcgatcacacccttttgtccaatcacatttctacatggctgtctatccctaactataaaatagacggttttccctggatctttgggtcttcatttctgcaggctcccatgtcacacagaattttgattaaataaatttgctactcttttatgtt

SEQ ID NO: 269548 - DNA, 904 bp, Homo sapiens
accacgcccggcccagaactggattttaaaaggaagtgcacagatgggcctaggagaggactcaggggcctgactgattaaagcttggccaagcacagaatctttcccactctccagaagctcaccctgacctctccttttcactcaggccctgtctctcattaacagccagtagcttattggtgatcctagatgcagcctgcaaccttttgtacaactcacagaagcactgatttgctgtcaaatggtggaaaagttcaagctgccaaactttttcttaaaggaccaaacagtgaatactgtaggccttaactgttgcaacaccatagcctctgttgcaacaactcaactctgtccttgtagtacaaaagcagccactgacaatatgtccataaatgaatgcgcatggttgtgttctaataaaactttatttacaaacgggcggcaggctcatttcagctccgtcagtttgctgacgcctgattttaagcatagggtgaccagtcgtcccagtttgcccggaactttcttgattttagcactgaaagtcccatattccgtgaaactcagccccagtaaaccaggttggccctgctatttaagcaacacttgcattatcccattcaaaactcacactaccttgtgggggtcaggtcaccgcccagtggatccaccttgcctgctgcctagacagagccgatttatcaagacaggggaattgcaagggagacagagtaattcatgcagagcaggctgtacaggagacggggatcagagtttttaacgacaatttggcgggtaaggacttgggaagttgggagtgctgattggtcaggttggagatacagtcatagggggttgcagtgaggttttcttcatgtcttctgttcccggctgcgatggc

SEQ ID NO: 269549 - DNA, 322 bp, Homo sapiens
cttctccttcctgttaccaaaccacctccctcccttctttacagctgtttgggagcaacatgttagaagcggagtgtgtgtgtgtgtgtgtgtgtgtgtgtgtgtacatcgggtcctcccatgtgtggtgttcttctggaggttgtctctttggtcaaggtgaacttttaatgtttattattttcttctccgcacaaagtaaagagcctaattttgtgtattctggtggctgctgtcatgagatgataaaatgtaaaacaaaactctagtcaacgtagaaagagttaactgtgctgaaaaactaataaagaacctaagaaga

SEQ ID NO: 269550 - DNA, 358 bp, Homo sapiens
tggtgctgttatttcatattaaaatgagaaaaagaacaagaacatgagaataaatgaattcttttcctctcaaaaacaacatccaatcaaaatacctaatgaaaaatgaagatgacacataatgcaatttttgtatgaatagttcttttgattaattatatagaagatctaagatgaccttctttcaatggttgagagatctgtcaagtgtttttacagtgataggatagagaatagtcactcagacacacatatacacacctcctatatctgcatgcattcatacacacacacacacacacacacacacacacacacacacattacagataagtatatatatggaaaaatatgtata

SEQ ID NO: 269551 - DNA, 488 bp, Homo sapiens
atcagtgtagactcatggatttttattttattcagtgagttataatccattactgtcctcaattattttgatcctcaaattgtcccagatttggccagcagaaggtcccttccgtgtcccgatcattttttgagcacatcctttctctctggcatcacaagatgttccaggttcatctcgtacgaaccgggaatcagccatttctccaaggagccctggtttcctggagcaggaaatgtttagaatccaagatctgggcaatagatgtgctccttggtactgaggtgtcattgcttttaagtccttccagcaaagagagctaaggaatgtgtctatgtggctgggcgcaggagctctcacctgtaatcccagcactttgggaggtcaaagccggaggatctcttgagcccaagagttcaaggctgcagtgagttatgattgcaacactacattccagcctggatgacagactgagaccctgtctctaa

SEQ ID NO: 269552 - DNA, 2912 bp, Homo sapiens
  misc_feature (1)..(2): n is a, c, g, or t
  misc_feature (6)..(7): n is a, c, g, or t
nncacnnggcgcgtgcatcagcctctctggcgggggattctccccggactccggccagcgccaatcaggtcgcgcggtacctgcccccagccctggccacctggaggggcgatgaggctccacgcccggagcagggcagtcctcggagcgccggggaggccgcggagcctcacgtgtgccgccccagccgctggcgcccggaaggacgcgctgcgaccccgtgggagccgaacgcgggagtcgctgcccgagcggagctgctcagccgcgggactgatgcccttggccagacgcacccccaactgctgtctgctcaggtgtagcccgcgtgactgagtcaccgctgctccagctgtttcacgtcgccgttccctttactgaatagtttgatggggcgccgggcggatgacagcgggaacggttgtgatcactggcggaatcctagctacggtgatcctcctctgcatcattgccgtcctgtgctactgcaggctccagtattactgctgcaagaagagcggaaccgaggttgcagacgaggaggaggagcgggagcacgaccttcccacgcatcccagaggccccacctgcaatgcctgcagctcccaagccctggacggcagaggcagcctggcgcctctcaccagcgagccctgcagccagccctgtggggtggccgcgagccactgcactacctgctccccatacagctcccccttttacatacggacggctgacatggtgcccaatgggggtggaggcgagaggctctcctttgctcccacatactacaaagaggggggacccccatccctcaaattggcagcaccccagagttacccggtgacctggccaggctctgggcgtgaggccttcaccaatccaagggctattagtacagacgtgtaaatccttccaccccgacccgcacacacacccacactgctgccctggcgggggccatgggggtgatgaatgaccctccaacagccccacatgggttgtttctgtttctttggcttttctcgctccgcagtggagggtttactaggatttaagcttttgagtgcattgagaaccaagacagggcctggctccaactctgtgggccagaggtgggggactgctaggtcgagtctgcagcttcgccagtttcttggttgggacactcctctggcagccccagcaccaccacaaccccttgcagtgtgccccagtcccctggattcgctggactgcaaaaaggagcaccagggaaagctcagcaaaggctcaggaggcctcccgggtcctcgggagatgaagcatccgtgcctaggaaaaggggacagagggcaaggagagaagtgagagctacaattccagcattggagaagcgaggggcggggcgtcaacggcactgcttcaggacgcgcttgctgaaacgactccaacagctagttcacagcccagctttgtacgttggttaccatagctactgctgtcactgtagctgctcccgtagggtcgttgattcctgaacgtatcacatctcacctgcccccttcctcgtgggacgtgtcaagttgactttaaagcctaaggtggcttgtggggactgcaccagaaagtgtctaaccttgtgttccccgaaatcctttctctgacttaggaaccagcgccccctgctggagaagttttttcattttgttagccgacttctggtagcttagcaaagagaccagctgactgtctctcggcccagcccaccacgccgagtagcttgtgtggatgcagtcctgtgagggtgtgcataaccgttcccaggtgtacgcacgcgcgcgcgcgcgcacagacacacacacacacacacacacacacacacacacacagtaaccacgggtaggcaccaggggctttgtacattcaggagctgcagagaggaaaggtctcccatgtaccagagaaggaaaagtctgatcccgaaacagcttgaacgaaaggtggttaacacgtgaccaatccccatggcagacagcgggctggtgaacaggaagagcacagaatctctgtggggcgatgctgcagcggctgaaaccacgtcaagtcccccagagcccggcattctatgtaagcatccacctgtgacgccgtggagcaggatcttcattcatctcaccagagcaacagcccagtcctgaggatgggagggacgtgacttagccttgggattccacgctcgccgccctcccttggccgccctactccccagtttcctggcgatgagccatttattgtgtctcacaccagcctcatttccaactccgacttcctacttagaatgtggcagtggctttgtgagtgagaatcctgatgagttttccagtggcctctgcagaagctggcccccttctaagggcatagctaacccccttcccactcctgagtcactgaattcgaggagggtggggcagggaaagggctggcccccctgctgaaatcttgattctgcatttgaggaaggtcagggtgccgctgggggagcagggagcggggagggaggaagaggggaatgcacatcttttgcgccactattaaggcacctgtcaccttacatctcaatctggaatcaaagtgccctgggttgagaagcagacctgggctctggtcacactttggtcactcattagctctaggaccagtcactaatctctgagactccattttctccagggaaacgaggcttgcccagatagactaacaaccctttagtgctccaagaagtgagaatttccgaaaaagatctgccggcccagagcactccctcttgccctaatcctggcagggtctggatgtatttacccaactctgatcttgcgtgcagggatgcttgctgatggatgaaagaccacaataaaacaagattagcagca

SEQ ID NO: 269553 - DNA, 3467 bp, Homo sapiens
  misc_feature (1)..(2): n is a, c, g, or t
  misc_feature (6)..(7): n is a, c, g, or t
nncacnnggcgcgtgcatcagcctctctggcgggggattctccccggactccggccagcgccaatcaggtcgcgcggtacctgcccccagccctggccacctggaggggcgatgaggctccacgcccggagcagggcagtcctcggagcgccggggaggccgcggagcctcacgtgtgccgccccagccgctggcgcccggaaggacgcgctgcgaccccgtgggagccgaacgcgggagtcgctgcccgagcggagctgctcagccgcgggactgatgcccttggccagacgcacccccaactgctgtctgctcaggtgtagcccgcgtgactgagtcaccgctgctccagctgtttcacgtcgccgttccctttactgaatagtttgatggggcgccgggcggatgacagcgggaacggttgtgatcactggcggaatcctagctacggtgatcctcctctgcatcattgccgtcctgtgctactgcaggctccagtattactgctgcaagaagagcggaaccgaggttgcagacgaggaggaggagcgggagcacgaccttcccacgcatcccagaggccccacctgcaatgcctgcagctcccaagccctggacggcagaggcagcctggcgcctctcaccagcgagccctgcagccagccctgtggggtggccgcgagccactgcactacctgctccccatacagctcccccttttacatacggacggctgacatggtgcccaatgggggtggaggcgagaggctctcctttgctcccacatactacaaagaggggggacccccatccctcaaattggcagcaccccagagttacccggtgacctggccaggctctgggcgtgaggccttcaccaatccaagggctattagtacagacgtgtaaatccttccaccccgacccgcacacacacccacactgctgccctggcgggggccatgggggtgatgaatgaccctccaacagccccacatgggttgtttctgtttctttggcttttctcgctccgcagtggagggtttactaggatttaagcttttgagtgcattgagaaccaagacagggcctggctccaactctgtgggccagaggtgggggactgctaggtcgagtctgcagcttcgccagtttcttggttgggacactcctctggcagccccagcaccaccacaaccccttgcagtgtgccccagtcccctggattcgctggactgcaaaaaggagcaccagggaaagctcagcaaaggctcaggaggcctcccgggtcctcgggagatgaagcatccgtgcctaggaaaaggggacagagggcaaggagagaagtgagagctacaattccagcattggagaagcgaggggcggggcgtcaacggcactgcttcaggacgcgcttgctgaaacgactccaacagctagttcacagcccagctttgtacgttggttaccatagctactgctgtcactgtagctgctcccgtagggtcgttgattcctgaacgtatcacatctcacctgcccccttcctcgtgggacgtgtcaagttgactttaaagcctaaggtggcttgtggggactgcaccagaaagtgtctaaccttgtgttccccgaaatcctttctctgacttaggaaccagcgccccctgctggagaagttttttcattttgttagccgacttctggtagcttagcaaagagaccagctgactgtctctcggcccagcccaccacgccgagtagcttgtgtggatgcagtcctgtgagggtgtgcataaccgttcccaggtgtacgcacgcgcgcgcgcgcgcacagacacacacacacacacacacacacacacacacacacagtaaccacgggtaggcaccaggggctttgtacattcaggagctgcagagaggaaaggtctcccatgtaccagagaaggaaaagtctgatcccgaaacagcttgaacgaaaggtggttaacacgtgaccaatccccatggcagacagcgggctggtgaacaggaagagcacagaatctctgtggggcgatgctgcagcggctgaaaccacgtcaagtcccccagagcccggcattctatgtaagcatccacctgtgacgccgtggagcaggatcttcattcatctcaccagagcaacagcccagtcctgaggatgggagggacgtgacttagccttgggattccacgctcgccgccctcccttggccgccctactccccagtttcctggcgatgagccatttattgtgtctcacaccagcctcatttccaactccgacttcctacttagaatgtggcagtggctttgtgagtgagaatcctgatgagttttccagtggcctctgcagaagctggcccccttctaagggcatagctaacccccttcccactcctgagtcactgaattcgaggagggtggggcagggaaagggctggcccccctgctgaaatcttgattctgcatttgaggaaggtcagggtgccgctgggggagcagggagcggggagggaggaagaggggaatgcacatcttttgcgccactattaaggcacctgtcaccttacatctcaatctggaatcaaagtgccctgggttgagaagcagacctgggctctggtcacactttggtcactcattagctctaggaccagtcactaatctctgagactccattttctccagggaaacgaggcttgcccagatagactaacaaccctttagtgctccaagaagtgagaatttccgaaaaagatctgccggcccagagcactccctcttgccctaatcctggcagggtctggatgtatttacccaactctgatcttgcgtgcagggatgcttgctgatggatgaaagaccacaataaaacaagattagcagcaaaacaattttaattgtcagtgaaaagcaaacatgtttgtcagactctcctgtggagtcatttcaaatggtaactcttctcttgtaccaggaagcagctgtaggtggggtaatgggatctgtctcctggtgcagaggggcagcttatggcggcagcagcttcaacaagcccgtcccacggccagccctaactgggccaagtgcaagctcctgatgagctgctgggcctggcagcgttccccacttcctagtgccttgctcccctggaattccacagccaatcaaccacagcagccgtgtcctccttgccagaaataacatcattcgtacgtcctgcccgtcacatctgcttggcctcatgcttgctggcaagtcatggccctgacccagctcttctccctggtggccctcaactgccttcagcctcagctccagctggggaggagggtggaagagcagcttgagtcagactgaggaatgcaagagaggtgctggccgtccttgtcactgttctttggaaaatgcctccatcagtgcctgaagttcaaggagtgtgg

SEQ ID NO: 269554 - DNA, 410 bp, Homo sapiens
ttgttccccttgtccagacataggtgcctgctgtggaagctgccgtgcagtacatctggtccagctgcagcctcacatggagccggcacctgtgtcagcacctggagctgcctgccctgccacagcagctggcatgcctggctgtatgcagtggctggaccctgcacttgctcggccacacaccactcatctctttgtgcctggcccacccttggtggatgtcggatccaggctggtagcatgagccaagtgcagcctgccagtctgagtgggcaaaatgagctcaacaggtgcaagcaatactcaggcagaaagcaccagtggacacagaggtttccagctgatgaagtgacacaccaaagatcctgtgacatttattactaaataaatagtattgcatagtttcttca

SEQ ID NO: 269555 - DNA, 945 bp, Homo sapiens
gctccgtgtgccccggggccgcgggaatgcggatcgcagccggcagggaggggccgcggcggagccttagacttgggggagccaaggaggccactcccaggaggctgcggagcaaatgactgcctccccgagcccctggctgcaaaagcagaggttgcccgtggcttttgcagctctggacacgcgggtgcagcccagggaacgtggacaagaggtgttgacggaccggaccgtgcatttgagttggggcatatcgaagtggtttaattaaaagccgcgagtgtggccccagatcctggcgttatcaaagcaaatcaaagcctttcttttccagccgagcgggccctgtggaaatgagatgtacatttacccttgacgcaccgcaagcctggccgaggctctcaggttaattgatatttaatggaaatcatgcccatgaatatagtttccatcatttcacccttgatagacgtcagccctgggcgcagggggaggctgaagaatgcaggagggggcattaggcttgctgagagagtaaatagaagagcggacagaaacgttctgaggcgggaaaaagggctcgcgctggggagggtgacatttcctcgggcaggacgcggctcccgggtctcagccccggcgcgcagcgaaccagggccggctgcggttcccggaggagtgcggagggcagacgaccgcaagttccccccaggagcctcccagccggcgttcagatcgcgccggttccaggcagctgcaggcggcccatcttatgctaacgatcctacttcctccgccaagcctgtgaaattactgccgagagagcgcgcaggcctcaaagttacgaatttttcccaaagcagagaaagagaaggctcagcctagtttgtgagcagagatgaagaaaagttgcccgagtcatgtggcccagtcgagtgtgaatcg

SEQ ID NO: 269556 - DNA, 590 bp, Homo sapiens
ttatgaactcacagttccacaaaggagaatctctatagtattgattacaatacagtgtgttcaattaataatgtataaagtattatatattataagtattgagatatagggtttttgccaaggagaagttagtgaagacttgaagatggggagatttttgatctaggtcaaaattaaggaattggttagaaaaagaagactagtccagccaaacttgtgaaaaaagaaacaaggatgtgtttagaaaacagcgagtgagtactttattatacttggaatataaattacatgggggtaattggcaagagatgagactctttgaggctagatgttgactggccttatatgccagtagaggagtgtagacttatatgtagaggagtgtagactttatgccaaaaagtgtggaatccaggaatcattgttaaataggagtttttattactagataatttttttaacagataagatacattataaagaatgaacaaaagaggagaccatcagtgaagagatgagtttggaatctactggaatagtcttatgagtgataatgaagctaaaggttgggccaaagaatgaaaaaggaa

SEQ ID NO: 269557 - DNA, 454 bp, Homo sapiens
tgggcctagcgactttaaaaagactggcaagccagtatggcaaatgttaacatttgttaaatctgaggagtatgcatgtgggtgttttattttttctctgtactttattttatgttttaatatttcataatttaacatttaaaatttttaaaaagatcctcagccgggcatggtggctcgcgcctgtaatcccagcactttgggaggctgagtcgggtagataacttgaggccaggagttcgagaccagcctggccagcatggtgaaagcccatctctacagaaaatacaaaaattagctgggtatggtggcacacgcctgtaatcccagctattctgctccagaggctgagacacaggaatggcttgaacccaggaggtggaagttgctgtgagctgagattgtgccactgcactccagcctgtgtgacagagcaagactgtctcaaaaaaaa

SEQ ID NO: 269558 - DNA, 478 bp, Homo sapiens
acacaacttacctcactttcccctttttgttgacctttattatgactttcaccaaaagttgaaaatgtatgtttctggttaatttttactttatatttttcatttgtaattcttttgaattattttgacctatttattggccaattataattactgctgtaagaattccctatttcatttggtagggaatgtacaatgatctactgtctaatatcttaagggcttagtatttttctcagtgactttgtgggttctttgtactgtaagattattaacactttattgatatttgattcagcattttctccagtttgtggtttgtatgtggattttgaaaagtattttccatgttaagaatttgaacatttttatttaataaaatatattgcgaaatttgtattaatgatttacaatcatcttaaatccaccattttgtggtattattgtctccaggtttctccttacttctaaaaaaaaa

SEQ ID NO: 269559 - DNA, 363 bp, Homo sapiens
ggttaaagtgggaggatcccttgagcccagaagttgagaccagactgagcaatagagcgagactcccatctcaaaacaaaaacgaaagcaaacaaaacagcttcattttgccccattttgagtttgaaaaatacaacaaaaacaacagagaataaaaccagaatagggaggcaatttcattttttcacattttctcatttaaatgtagtgattttggctctggatcccttaacagaaactgatttgtgaaatagtattgctgtcacagaaaagcaaacaaacagcaaaacatatctaacataaggatgcatcgttgttcagtaataagatggtaaataatgcacagaggcagtgaagggaaaa

SEQ ID NO: 269560 - DNA, 648 bp, Homo sapiens
tattttcttgaattcataacagccagtgtgtcctttcttcccatttcaccctatttctgccaaaccagagctttcaacatttctcttgtcccctttttaaatttttttttttagttttgtattagagacagggtctcactgttgtctaggctagagtgcaatggcgcaatcgtatttagctcactgcagccttgaactcatggtaccaagtgatcctcctgccttggcttccccaaatactgggcttacaggcatgagctaccatgtaagccctcgcttgctacctctgcacctgttttaccgtgtgtctgaaatacctttcttgtgttactttacctaataaattacagacatttttcaagacaaagtcaagtgtcacttctttggtgatgtttttttctaatgctcccagagttagcctgctctgcccttatacccccagcactctgtttgtaactctacaatagtatctgtatgttgtctggtagtcatgtgtatatttgtctcctgtagccgactggaaactccttgaggacagtaagaatatctccgtcagttttgcccccaccatgcatggcagcacttttttttaaattgagacagtatctcactacgttacccagtctggccttgaactcctgggcccaa

SEQ ID NO: 269561 - DNA, 420 bp, Homo sapiens
gagaaatgctccattatttgattaattgtcttggataaaagccttaactgatgttccagttgacctacaaatcttgtgaagtgagttttaaaagtatttgtaaatagtatgtatccttatagctcatgaatgtcagaattctacactggggccagcacagtggctcatacctgtaatcccagcaatttgaggggctgaggaggaagattgcttgaggctaggagttcaagaccagcctgggcaacataatgagaccccatctctaccaaaataaaaattatctgggtgtcatggtgtgagcctatactcccagctacttgggaagctgagctcagaggatcatctgagtcctggaggttgagtctgcaatgagcaatgattgtgccactgcactctagcttgggtggtgatgaagtgaga

SEQ ID NO: 269562 - DNA, 403 bp, Homo sapiens
gccaccattcagaagttcaggctgaacaccaaatcataaaccagtatacataaattcagaaaattagtttgaaaggtgatatggttaggtgttgtgtcctcacccaaatctcaccttgaattataatctccataatccccacctgtcaaaggagagaccaagtggacgtaatcgaatcatggtggtggcttcccacatggtgttctcatgatagtgagtgagttctcacaagatctgatggttttgccaagtgttcgatagttacttctgcatccattctctttcctgctgccttgtgaagaaggtgccttgcttctccttcaccttctaccatgattgtaaatttcttgaggcttccccagccatgctaaactgtgagtccattaaacctctttcctttata

SEQ ID NO: 269563 - DNA, 673 bp, Homo sapiens
tccccatcatgaacacatgcttctttttttcctcgccttcaccctcaattttttttgtggaaattcaatggttgactgtaccaagccagctctctgggtgagaggttccttctaacaaggattagaaacccctctcatgtaggaagaggtggatttgggggattatatgatccaaccctctacctttggacagaatacaatcgagatgtctccccagtacacagaactgcttttccagcaagttctctttgttaagccattctggtatccctcaaatcccttgttatgactatccacaattctccatgccccatgaccctttcttagctaaaatgaaaaataattgcctagttccctcatgtagagaagttgagctattaccttgacttcccccttctcttccaaaaaagattacaattcctttaattttctttcccatcctagggtgtcctctttgctctctccatattctccaaataaaaattcaaaactgagcagcaaatcctgtgcctcttcatccaacccctcctcatcatgaatcattatcactcaggaagtaaggacctggtttactatctgagaactttagtcctaataatttctctacaccaacttctagtcctaataatttatccgtataatgctcagaaacactccgagattctcagtaaaa

SEQ ID NO: 269564 - DNA, 423 bp, Homo sapiens
gccagccccccgcagatgctaggagggaagcttggaaggaattctccccacagccttcagaaggagccaatcctattgttacaggaaaggggtcccgatccagatcccaagagagggttgtaggatctatcgcaagaagaattcagggcaagtagtctgtaatgtgagagtaagtttattaggaaagtaaaggattaaaagaatggctactccatagacagcagcctcaagggctgctggttgcctatttttatggttatttcttgatgatatgctaaacaaggggtagatgattcaggcctcccatttttagagcatatacggtaactttctaacgttgccatggcattcgtaaactgtcatggccctggtgggagtacagcaagaacgaccagaggtcatcctctggtggccatctaggtt

SEQ ID NO: 269565 - DNA, 817 bp, Homo sapiens
taagtgggtacttacttcacaatataaataaataatgtcaaccttagtattgtgattacatattactgctttccctgctataatactgtattttattgtacgtgagttacggccagttgactctaaactgtgtcccagtgtagcaaataccatataccaagcaagtacaattttgtttctttcaaaaaaagggaactaagacttagctactaagagcctataccaaaactttgtcccacaaagcagcttcaggaaagagaggacttttattcctttgcagatatatagttctatagttttattttatgaaagcataaatacagggagttttttcttattagcatcttaactcctgagacctcttaaaaaagagcattgatttcttagctgtactgggtaggtaatacgctgagagtcttttagcagcgagaagggcaggtgggttagttaaaggatcaggaaaactggctggttttccttctaaatttgttgagtcaatactaggtaagctttaaatatggatcatcaatgttcttctacatgagtcagaaagaaagactgtgtttcatcacgcctgtgatcttcccaggctcttccaaagctggtaaaccagttaacttgaagggacagaagctgatagaaaaaccatgccaggagaattaaactaaattataaataaaacaactcctataatttcctaattctaaaaacagagtctcatttagcttagtgtaaggaactttgtcataaccaggcctcttaaaaccaaaataatcatccattttgtagagttacaaaattataaagtaaacagtta

SEQ ID NO: 269566 - DNA, 335 bp, Homo sapiens
actttttaaagttatgtctatgtaataaagctgttggacctatactgaatttttggtaccacagtttccctcttgaatgtactaaaacacaaaaaactgacagctctgagctgtggccttaccttggaattaaacatttccacctttgtaaaacatcctatttttgtttctacctttggctttccaggtcaggacctctacctgatcagtaacctattattttgtaatgatttttaagctgcagaatctctaccttgtctttgaaactggcacattagttgtggcacccatgtgattagatagttcctgacaaaataaatgtatgtccttccatg

SEQ ID NO: 269567 - DNA, 334 bp, Homo sapiens
aatcaaggccccaagagaggaaatggggtggcaggttgtggtgggggattgcctgcctatgtcctctgactcttgaacagcactaggcaaagggctggccacacagcaggtgctcaatctgtgggtgagaaaacactgaatgaacacaggggtcatctgagcctctgaacctccaaggcagcctcccggcaaaatgtccccgcaaatgttccctctgaccccagctcattccaacctctttcctaagttagtgggaaagggcttgatcccatcccctcacaccccatcagcacccactgctgcccagcacccacagggcgccagacgcttcacc

SEQ ID NO: 269568 - DNA, 538 bp, Homo sapiens
actgcttcaagggagggtctgggagaggagtgaatgggaagatgcccctaaacacctggaggtgattcagcctcaccctccccgaacatctggcacctacctccccttcccaagcacctcacacctctgctgaggcggttcccttggtctggaatgccactctccactctgcccagatgacgaacacctgtgcctctttcaggacttggcttgggatctttcctcggaagattttccagaactgtcctgagatagtgtttccatttctccccatgctcccactggaccctctatgtatttccatcatagcacatataccttctgctccaggattgcaaattccccaaggcaaagatggccttgtctttctttttagactcagtacctggaatggcaaatgagatagatactacccaggtagagcttatgatcaggtgggatttttataaagatatctgaataaggaattaagccttcagtgaggagctttaaatgcatgatattttaccaattacactaccaggactttagcacctaa

SEQ ID NO: 269569 - DNA, 529 bp, Homo sapiens
acagtggcgtgatctcggctcactgcaacctctgtctccgggttcaaatgattcttctgcctcagcctcagcctcctgagtagctgggactacaggcacgcacaaccacacccggctaatttttgtatttttagtagagatgggatgtctgagtttattttttaagagacagggtcttgctctgtcacctatggtggagtgcagaggtgccactgtaacctcaaattcctgggctcatgtgattctcctgcctcagcctcccaaagcactgagattatacgcacgagccaactcacccatcttgttttttaaaatgaaatcattttctaaaatggcaaatagactaaaaaaggaaaaaataagcaatcacaatagaatgttgtggaaaaaaacaagtgacagctctgggccagcacagtggttcccacctgtaatcccagcactttgggaggccaaagcaggcggatcacctgaggtcagaagtccgagaccagcctggccaacacggtgaaaccccgtctactaaaaa

SEQ ID NO: 269570 - DNA, 385 bp, Homo sapiens
gacattcacgggaattatgtcctagaagcttggcaatttttttttccaaaagcattctttgtttttctaaaaatatcaatttggtattaggaaatgaaagacctgtaggtcctggctgggcgtggtggttcacgcctgtaatcccagcactttgggaggctgagttttttcagacttggctctgggtaggtcctcctaagcactcagttttgagctgcatatgtgaaggcagagcaggaataaaaggagaaaatactgagaagagtccaaaatatgactaaagagatgaaaaaaacaaaatgaatggttgctcacacctctttcctatccctacatagaaacaaacaggaaaatcagagcaacagggagttttagtgataaaaca

SEQ ID NO: 269571 - DNA, 387 bp, Homo sapiens
tctgtgtcagtcacactgaggcaaatgcacacgaatagcatggcacctggcccagggggaaggcagggcagggtggagtgtcaccagcaggcccatgacagtatgtggataggacagaggtcagggagggcacaggtcagcatttcaggaactcgcagtattctttttccctcccttggaggtggggacctgacttgtaagttaatttggtaatttttaactaggaagtaaatttaaaatttacagaaaagttgcaaagaagatagaattcctgcttagcttttgccccaatttcccacttgccacccttccctctttgtgtttgtatctttttttttctgagccacatgaaagtaaagctgccttttgtgtctgtgtcaaaaaaaa

SEQ ID NO: 269572 - DNA, 419 bp, Homo sapiens
ggagaggcaggatgaatggatctctttgatactcaaagttttttaagccattgatgtgttatgtgtctaaaataatattcttttttgaaaaattattgtttcatgatatgattaataaattattttctttgttaaatatcgattaaaaattatattaataattatgttaataattaagaattatagataaggataaaattccttttgactgttacagcagtccactcccaagagaataaactgttaccttccagaccttttcaaaattgacaggatctatttaaagtcctgtattttatttgaccagaaaattctatttttcagatgttacatttaagaaaacttcttgaatgtacatgacaaagaatgaacaagcatatttattgcaacattgtttataatagcaataaaggtaagca

SEQ ID NO: 269573 - DNA, 430 bp, Homo sapiens
catcgtgctgatgagcaaggactagggaagaagatgctcaagaaacatccatgaaaacaaccaggagggctttgagagaatgcggagctggagctcggatcttcctttctgaaaagcatgagaaaacccagaaggctctgtcttaagataaaaagaccagggactttctaggggtcataagatgttgacatttaattgccattgtaacagctgtgagaggtaggaacttggagtggtgattaggccatgagggctccaccctgatgagtgggactggtgctgttataaaagggcaagttagtcccctcttaccttctgccttccaccatgcaacgtcacagcaagaaggccctcacaagatgctggccccttgatctacaatttccctttttcctgaactgtgagccaatacatttctgtttattataaa

SEQ ID NO: 269574 - DNA, 470 bp, Homo sapiens
tgggttcaagtgatcctactgcctcatcctctcaaagtgctgggattacaggtgtgagccaccacagccagccacaaatagagattttatctactaccaccagaaatcttctgacatactgttttaccgcatgaactattgttttctttataaattccttaacaaatctctgttgtatagaatactgttggttaaaatatatcagcagctaatagctcattttaaatagattctgaaagttcaagaatttcaggttgccagacactaatatactctacaaaatcagaaaaggctcattactgcttacttacacaacaaaaaatttcctaaaaatcatttttaaatatgtttgagttcaaaacataaaaatgccatgttacgatatttttaaacttaatgaaactggatatatttgctgattcttgtaagaaacacaatcacaaataaagctcatctgtttgtccaaacca

SEQ ID NO: 269575 - DNA, 461 bp, Homo sapiens
tcttcggggaaggggcggggagagatagcaagccacgaacctgcacagcgtgtagatcagggacggttcctgcagactctagaggagacgggactggaacgcaaagagaggggctagaacctaggaggcgggttgcaacccgcggaggacgagattctcaggtgctgggggcagggttaggtcgggagttgagcaggattagaaccactgacagggcatagttaaagccagcagagaagggattagaatgtgggggttttgcttagaccttgagttgaggctgtattttgggagcatttttgataaaaagagactcctagggcaggctcagtggcttccgcctgcaatcccaacactttgggggtggaggctgcaggatcgcttgagcccaggagttccagaccagcttgggcaacatggcgaaacccccgtctctactcaaaatacaaaatacaaaaagt

SEQ ID NO: 269576 - DNA, 697 bp, Homo sapiens
aaaactagaagagtggtgaggacctgagggagtgagaattcagagggtaaggttgtgcagagtttggcctgaccttaaattttcttttccccttgagttaattactcagttcaaaaaaatccagctgagaggttgaaaagctgagaagcttctggcagtctgcagagctgggaagacaaaaagggaatttaggggtcattaaatgctatagaagtttatttaggaccctgaaggctacagaggggtggatggaggtgtcagcaaatgacagcctgtggggtcacattcggtcctccagctgtgtttatgtgggacatgagctaaaaatgttttttaccttttaaaatgtctgaaaaaaatttaaaagggaataatattttatgacacaggaaatcataacgacattcaggtatgagtgtttaaaactaatgttttatgggaacaaaaccacacccatttatttgggcattatatatgacttctgttgcactacagtgtcagagttggttgctgcagagagcacatatatttcaaattgctgctctgcatgctacgaatcacaatgacatagttacagtttgtcagtatgtgtgtgtgtgtgtgcgcgccacacatattgccctggcatcttatttatttctctcattaccagtgcatacccacctatatggttcaagatttttcttaaccttagtct

SEQ ID NO: 269577 - DNA, 875 bp, Homo sapiens
aaaactagaagagtggtgaggacctgagggagtgagaattcagagggtaaggttgtgcagagtttggcctgaccttaaattttcttttccccttgagttaattactcagttcaaaaaaatccagctgagaggttgaaaagctgagaagcttctggcagtctgcagagctgggaagacaaaaagggaatttaggggtcattaaatgctatagaagtttatttaggaccctgaaggctacagaggggtggatggaggtgtcagcaaatgacagcctgtggggtcacattcggtcctccagctgtgtttatgtgggacatgagctaaaaatgttttttaccttttaaaatgtctgaaaaaaatttaaaagggaataatattttatgacacaggaaatcataacgacattcaggtatgagtgtttaaaactaatgttttatgggaacaaaaccacacccatttatttgggcattatatatgacttctgttgcactacagtgtcagagttggttgctgcagagagcacatatatttcaaattgctgctctgcatgctacgaatcacaatgacatagttacagtttgtcagtatgtgtgtgtgtgtgtgcgcgccacacatattgccctggcatcttatttatttctctcattaccagtgcatacccacctatcatgttaaaacaagaaaaggagaaaagtggactttatatgtaacactttagaggtatagtggaatgtatattattattaacaaattagatagcaaagcattatatttattatgctagaagactatggctgtgctaaaagaatataatatatgtcagcattaccagacttggcacttctcacaatattcccagccaacaggaataaaac

SEQ ID NO: 269578 - DNA, 616 bp, Homo sapiens
caaaaggtgttgaacatgggaagcattgatactggaattagaggccagtaaggggttgaatccctagtcaagtcatcagagtttcattattttctgttacctaccaggtcatcggatcaaaaggatctcatttctcagcactcctctagtaatcttatggggctcgagaaatagtgaccataaaagctttcagaaatatggtggaaggataggaatttggggactagaagccagaaaacagaatctaaaaaatactggcagttaaaaaagtaaataaatagaaagctaagaaatatcaaacgtcagaaggaccgagacagaaaatacagtcatgtgttacttaatgatggggatatgttccaagaaatgtgtcattaggtggtttagttgttgtgcaaacgtcatggagtatacttctacaaacctagatggtatagcctaccggacacctggtctatatagtgtagcctattgctcctaggctacaaacctgtatagcaggttactgtactgaatactgtaggcaattgtaacacaatggtaagaatttgtatatccaaacatatctaaacatagaaaaggtacagtaaaaatacagtataaaagagaaaaaaaa

SEQ ID NO: 269579 - DNA, 526 bp, Homo sapiens
gtgcctgggaaagcctctgatcacacatttcctcagggattttttaggcctgatgtccctttgaatttactttaacaatccttttgtaattttattttttacatcaattgtaacttagtattattatatatataggcatttgggtgtgtcttgaaggcatgtcctggtttcaaactgatttgtggtatattattgaattaggcccatttactggaattataaactgctatccaactacacaaagagctgaggattctggggaggtcaggatggagatgaaatagaagtgaggagaaaatagctctctctctcacatgcagattctttatggataaaatgcataattacctaaaatttaaaatactcaaaaaattatctaatcagtatgtaatggaaattatagagcaaagaacaaaacaaacaccaaaataattttcttttttctacataaaaattaaataatttacataatgaaatattccatgatcccagtgtaaaatgccaatagaatatatgtaaaaaaaaa

SEQ ID NO: 269580 - DNA, 378 bp, Homo sapiens
tcaaattcttatattacatctgttccctaaactttacccttttattcatacatctgattgttagtgttatgatatatatctttcattctgagcactcacaaagccagtgattaagtaattcagcttgataattagttttaacttttcagtggttttaaagccccactcatataattttttgttggatatagtataaaattatttagtcagtggagaatcctttcaggagttttcagggaatacaagattgttgacatctaaatctgcagctgcattctaataaattgccactttatttacttgaattatattttctcaggaaacccaaacttgcaaatttagtcttttaaatttaagtgtaccagcttaataaactta

SEQ ID NO: 269581 - DNA, 447 bp, Homo sapiens
cagcgagctcccaatccactgatcctacatcaaagttaccagtcattgcctggcccattgcagcaacaaattccagtaagaaaaaaaagagatctattacgaaaacaatcttacacaaaagtggaaacatctactccgtcagctcagtccactcttcttaataagagtcagaaatcactagcatgtaaagagaactagcaacataaaaagagaaataacaaattttacaaagtagaaaaataactttggagtaagatgaaattatttaggtaacacaaaagaagttaaaaatcattcttataaatgttttccaaaagattcaaggaggccaggcgtggtagctcatgcctgtaatcccagcactttgggagccaaggcaggaagattgcttgaggccaggagtttgagaccagcctgggcaacatggtgagacacctccatctctac

SEQ ID NO: 269582 - DNA, 402 bp, Homo sapiens
ttgtccaatgtaaacttgttctatagagttgttattttcccaccttttagagtttgtagaatcctgtgttttcatcttcaggaactgtaacttatcttatctttcagggatagggagtacatagtggaggtggccagataggccatgagaagatgaagcatttgtcatgaccacacattgtttccaggacctcctgagaagcctgatagaatcctagggcttccagaaacacttttggaaaaacacagagctttctaacttcataaataaaatgtgaatggtgtgtgataggtgtaacaaacaaaatgtcagaactggctttttaaatatctttagatttttgcatctctatagaaattatcactaataataaataattacatgtgaatgattttgcagaca

SEQ ID NO: 269583 - DNA, 810 bp, Homo sapiens
catcctaaaaatgcctgggaacccaagactttttttgttactaatctcccaagctcgggggcgggggtttgtcataagaagtcctgtccataaggagcttttgttttctcagccgttgttgcctggttaatgccgggaaagtccaatcccaggaggggacacctggtgtcacagattactggcacccccctcacaactgtgactggcacccccctcagaaatttgtgggttccttaatatctgtggcaacaagagtcttttgctctcttagcctgtttccgggagtgagatttttggtgggggaatctttggcattgtttttgtctatgccctaaaattacattctggctttacaggaagaggcttttggattgagttgttactggaataagtacaccactggaaaccctaattgtcggtggccagaagacggatcctttaagttagactaaaattcctaaattaaaaaaaaaaaattagagatatcttacaccaaacaattgatgcgaagattaaattaaaaggatacacaggctgggcactgtggctctcccctgtaatcccagcactttgggagggtgaggtggcggatcatgaggtcaagagatcgagaccatcctggcctacatggtgaaaccccatctctactaaaaatacaaaagttagccgggcatggtgtgtgcctgtagtcccagctaccccggaggctgaggcaggagaatcacttgaaccggggaggtggaggttgcagtaagtcgagattgtaccactgcgctccagcctggtgacagagtgagactctgtctcaag

SEQ ID NO: 269584 - DNA, 346 bp, Homo sapiens
gaaattgtaaacattataagtcagaccttgtgattatatatcaaactctgtaacccagtaccaaaaaatgtacttcttaagtgtttctagaatgttttaaatgtctcccatgcactaatttgtagaaatttttaatgaagcagaaattactagagatgtaatgagaattagaaacacatccaaacaggagattttacatcattctcaatccaagaccaatcaagtgatcagaaataagtgaaattatggaaattgtaaacattataagtcagaccttgtgattatatatcaaactctgtaacccagtaccaaaaaatatacttcttaagtgtttctagaatgtttt

SEQ ID NO: 269585 - DNA, 695 bp, Homo sapiens
ttctccttctcaggagtcccattttcttcagattagatgaaataaaagggctctgactagtgcaaagcactgttacagctgaggtgacaaatgacaccagattttcaagtgacgcttccctaaactacctccacgacactctacagcacagagcctggataccatttgtccagagtaaagcacttctccactccagtggcaaacacacagaccaaggaggtggcctggcacacgcagcttttgtggcactaacctaagtctctgcgaaagtttaacgcacagaaaccttccccctgcttcctgcctgccctgactgatcctttatcagcacaacatcaggtagtcaaggttagtaaaggtggcggagcgggcaggagctttacaatgtaaaactttcgcggggaattgtgtttcaaacgtcccgcctttttggccagcctgtgaggggcacaagcaaggatctctaacagcccagccccactgacaaggaccacacgcagtggaatgccagtggcttcactctaatcctgttttacagtctccttggtttccaaccccactaccagcaacactaataagtagcccaaggtcacccagttagcaagtggtagaaacaagattgaaactcgagtcatctgatgccaggtccgcgttctcaatctccgcaccctgctcccagcttcggtggcaacatg

SEQ ID NO: 269586 - DNA, 506 bp, Homo sapiens
  misc_feature (57)..(57): n is a, c, g, or t
  misc_feature (66)..(66): n is a, c, g, or t
cagctacagaggaaattaatggtttccttcagaggcttttatttatacaaatggcanaaactcccntattataccttccccagatttgtagacctcttgctgttgttttttcctcctgttgcttggagtaaagaagtgggaatgatgcaaaaatgaaaccactttagtaatacaggagagtgaccgtttggtgtcaaattgtggactatgtggcttcctgattgtggcagtaatggcaggccagttctggaacacagctgtgggaatcatcctggaggtccatgctgaagcctcctccagcccttccagccatgttgatgttgagctatacagatcatgaaggcttgaataaagccaggcagaggtaaacagagttgaaaaatggagggcgagggatagagctgataacatcacctgaattcctgactcagccatgtttgaagccataatcacccacttggatttctcatttgtatgagtcaataaattcccctttgtggcttaaa

SEQ ID NO: 269587 - DNA, 410 bp, Homo sapiens
ggatatttaacatagtaagtaaaagatataacataaaaaaaaaacaagaatagcttagtgtaatacataatgaatatgttatacttataaacagatatataagatgtaataatagtagattactatatagttctgagctatcactatctcttagaagtatggtccatgtcagggccaggtgcagtggctcaggcctataagatcccagccctttgggaggctgaggcaggcggatcacctgaggtcaggagttcaagaccagcctggccaacgtggcaaaaccccgtctctaaaaaaaaaaatatatatatatgtatatatatatatatatatgtgtgtgtgtgtgtgtgtgtgtatatatatgtatgtatgtatatatatacacactgtacacacacacacaaaataaa

SEQ ID NO: 269588 - DNA, 130 bp, Homo sapiens
tatatataagtgtatatatttttttcttttcattgtgaggcatctggaatgtagcaggaaattttgaagccatgggatgttatattttttgtttttttccctttttaggttgaaagccaaattatgacaa

SEQ ID NO: 269589 - DNA, 411 bp, Homo sapiens
agtggtaccccgtattcatcattcttggggaggactgatgcttgagcagaggccgtgaggtgccctcttcaatggcacccatcttcaattcttcctttttatcttttgcttttgacctttcctgaagtggctgaagattgtagcaatacacaagcatactccgatttcccctaagatgttgtgcctcccatctgcttcttgtttcatattgttctgttttcatgtgccctaagggacagttatgttgtataaagagcaagtcccccaagtgtcctccccacttcgggtctgcagaaaaatgattgattatgaggaatgtgatttcagtaatgcaggcaggattaaatgcttgccatctatcgacactttgcagtgccttaaagagagcttttaaaattttgggctatcact

SEQ ID NO: 269590 - DNA, 240 bp, Homo sapiens
cagggtgatgtgataagagcccagtgacactagcagatgaagtaggttatgttacaggagaggagtccttagtttagggaacctgaatctttcatagtgggctgcaaataaagctgtctgatctttgccagagagggagacattatctttattttcccacatggtaaacaaacctgccctctgtaccagagggagacatctctttatctgccaaggctatttgctatataaacaccactg

SEQ ID NO: 269591 - DNA, 728 bp, Homo sapiens
attatgtaaagtagttgaagatgggggatagcctatgggtcttcagaaagcctctgggtttctagagatctttctggaagaggttaggaggatgagtcaagtttagaatggaagaggatagatgaagcttgcatttggtagtaaaaaccaaggatgaatgtgtgaggcatgattatttgtcacaagtttccaggtgacactctggcactcagtccttgttgaattaagcaagctttcttactgttttacttggctgtgttaaagtagagtaacaggaaattagacttcccataatgtctcaatagagctgtttaagtttctagccataattggtatgggaatatagctctaaaccttcaaggctgctaccatttctcacattcctatatctagaaactgtagccaggcagcactttcagtgaggtgagtgggtccaggtttgttcaattacttttgtaccaacctaataccttaatagtatttgtcctaatttacaaaaataggtaatgaaggattcttggttttacctcagagctaactgtccattaatggcaacatcccacatttgttgaagcatgattttgttgtttgtactttgacatgcatttgatattttaagtaacgccttgaatgcatcttaaataataatttatatacagttaacactcctgtttgtttttaggaattcttagtgttgccaatttcctaggatgtagaagagcatagta

SEQ ID NO: 269592 - DNA, 272 bp, Homo sapiens
gataatcccagcactttgggaggccgaggtgggtggatcacctgaagtcaggagttcgagaccagcctgaccaacatggtgaaaccccgtctctactggggttttaattttgtaaaaatacaaaattagccaggcatggtggtgcatgcctgtaatcccagctacccaggaggctgagacagaggattgcttaaacccgggaggcagaggttgcagtgagccgagatcatgccactgcactccaccccaggtgacagagtgaactccatctc

SEQ ID NO: 269593 - DNA, 561 bp, Homo sapiens
tagaaaaaggggtatgtcatgaatccataaaatatatgtaggtactagtctattttgtgatttgctaccataaaatatacacaaatctattatagaaagcaaatttattaaaacttatgcaaagagaccatacatggcaccatttacagtagaaatatttaaaagtaatgatgcagtgttaaatcatagctgcataaaattaactgtagtacatactgttctattataataattttgtagccacctacagttgctattgcagtgagttcccctgctgtgagtattcgcttaaatgctgtgtgatgctaaggaattgtgtatcaaagtaaaaagtgatctctttgggttctcctgtacatttcatcatgtttggtacaatacagtaaaccttgaatcacaccatagtgatgctggaagtgctcccaagaagcagagaaaagtaatgacagtacaagaaaaagttgaattgcctgacacataccatagattgaggtctgcagctgcagttgcccaccatttcaagataagtaaaccccatgtaagggccatagtaaaaaaaga

SEQ ID NO: 269594 - DNA, 467 bp, Homo sapiens
gtggactttgaaaatcacacacatcacatcaccagtgccaaaatggctgtttctgtggctgactttggcagtctctctgccaacgagaccaatggtttcatcagtgcccatgctctgcatcagcacgcggccctacactctgagtgacctgagtgaggatcccggaactgcgtgtgcagcaccagtaaacttgaggggagctatcaggtttgcatagtctttcactggaagtttgaacctttctcactatgacatcagtgatgtcagtatgtatagaactatatcttgatttatcaagagtattttcatttttcaatccataaatgtggaaatgaactatgatcagcagagttgggaactaagattgaactctgtggtgcagctttaagctctgcttctctcttcctcatctcccaatacctcttccccactcccttctttttctattcttttgtgttccccactgc

SEQ ID NO: 269595 - DNA, 407 bp, Homo sapiens
ctcccacctcaccctccctggtagctgggactatgggcatgtgctaccacacctggctgatttttgtattttttgtagagggtgttgccatgttgccggggctggtcttgaactcttgggctcaagcaatccccccacctcagcctcccaaagtgctgggattacagacatgagccaccatgccctactgaaagaattttaaaaagtaaccccagggttatatgtatccattgattacgagcatttctaatgaccccataactgatttcttgtgaatgaagattttggccaggcgtggtggcttgtgcttgtaatcctagcactttgggaggctgaggcgggaggattgcttgaggccaggtgttcaagaccagcctgggcaacacagtgagacccccaccttcgtc

SEQ ID NO: 269596 - DNA, 280 bp, Homo sapiens
tttaattaattataatctaactacctgaagtagaagaggaagcagtgggctccacatgggccaggtcctttaacacatgaactttgatcccagcccccgaggtcagccatcagctcctcatcctgcagcctgcccaatgcttcattacccaattaacccgtcattttagagccaggtggtttaagggactgtgtaagaagaacctgggactccagggccgcagcctttggttatggtcctgttgtggttctaatgcacgaattaaatatctgtctcttct

SEQ ID NO: 269597 - DNA, 629 bp, Homo sapiens
tcttcgcccaggtctatggaaaggcaaatgaccgaacactcgctcaggatccagggacccctccaacactgctccaggtcagcttctccacaaacaagcagagggacacaggccgctcctcttccagcccctcctagggcgcagcaaagggctgagctccgggtaattctacagctgttcagcgagcacaagtcaggcactgcagggatggtgcagacgacaccacgccgtcgtccactggacaagatgaccccaaagcgcaaagctagagagcctcacgggacacagcggaagggcgcggggaaagccaggcaatgtcggacccaggcggcaccgggtctgggaggtgggcaggcaggagtggtcaccacttcagggtcatccaggaaatacagaacattttccagaaaacttctgggcatcatgaaaaacaaaagctgggctgggctgggcgagggccagggcctgtccctccctgctggctcacatggactggcagccagacctgaaaggggcccagggaatcagaggtgacccccagggctcagccagggaaacctggggccccattgagcaaaacactggccaaggccactgaggaagtcactggcacaggaggggctaccatc

SEQ ID NO: 269598 - DNA, 430 bp, Homo sapiens
actgcaccattggctcccctggggctccagcctgccagcctccataattgtgtgaagcaattccttatactaaatctccatatgtgtgtgtgcatgtgtgtgtatacgcatatacatacacattctattggttctgtttctctggagaaccctgactcattcaggaaaaatgatagattctgaactcatttgacataaacagcttggtttcatctaaatatgctctaacacacaatggacatttcatttgagatgttcctgaacctggacctgaaccttagttgaaagtgtgatttcctgcctgttttcaactgttctgtttagtttcacatatatttaattgaattcaccatagggagatgactctgatttaaattgcctaggttcatcctaatttgttgtaagtcacaaaaaaataaggaaatttaga

SEQ ID NO: 269599 - DNA, 239 bp, Homo sapiens
  misc_feature (1)..(3): n is a, c, g, or t
nnngcttccttcccatctcgctcttgggtcatgcctggccagcagaaagcagctccataggggaggagagccacgcaggatctcacagctgcagtctaatagtaacacagaggaatgtcttccaggaggcccctgatcttctctgctcagggaccactcttatctgacccagagacagcacatatctttcgttaaagatcagatcaataaaatattttatttattcattaatttaacaa

SEQ ID NO: 269600 - DNA, 1923 bp, Homo sapiens
  misc_feature (1)..(3): n is a, c, g, or t
nnngcttccttcccatctcgctcttgggtcatgcctggccagcagaaagcagctccataggggaggagagccacgcaggatctcacagctgcagtctaatagtaacacagaggattcagcagtggccaccatgggttctgtgaattccagaggtcacaaggcggaagcccaggtggtgatgatgggcctggactcggcgggcaagaccacgctcctttacaagctgaagggccaccagctggtggagaccctgcccactgttggtttcaacgtggagcctctgaaagctcctgggcacgtgtcactgactctctgggacgttggggggcaggccccgctcagagccagctggaaggactatctggaaggcacagatatcctcgtgtacgtgctggacagcacagatgaagcccgcttacccgagtcggcggctgagctcacagaagtcctgaacgaccccaacatggctggcgtccccttcttggtgctggccaacaagcaggaggcacctgatgcacttccgctgcttaagatcagaaacaggctgagtctagagagattccaggaccactgctgggagctccggggctgcagtgccctcactggggaggggctgcccgaggccctgcagagcctgtggagcctcctgaaatctcgcagctgcatgtgtctgcaggcgagagcccatggggctgagcgcggagacagcaagagatcttgatccagacagagcagcatatctttgctcatacaaactagaagaaccagctgatccttgagaaatttacgcttagtctatcaaacaagaaatgctggcttggcccggtggctcatgcctgtaatcccagcactgtgggagaccacggtgggggaatcccttgagcccaggagttggagagcaacatcacaacaccccatttctactaataatcaaaaaattggccgggcatggtggcatgtgcctgtagtcccagctacttgggaggctgaggcaggagaatcgcttgagcccaagaggtagaggttgcagtgagccaagatcgcgccactgcactccagtctgggcaacagagtgagaccctgtctcaataataataataataataatgatgatactctaagaaaaaaatctcaacatacttcatttaatagctcgttaccaagtgtgaatgaagcaatatgtcataatagagtagccactggttgcataataatagagacctaaattctcaaatagggaaagaggttttaaaatcaaatttgaggccaggtgcagtggctcatgggcggaggagggcagattacttgaggctaggagttcaagaccagcctggccaacatggtgaaaccccatctctactgaaaatacaaaaattaggcatagtggtgcacgcctgcagtcccagctactcaggaggttgaggcagaagaatcgcttgaacccaggaagtggaggttgcagtgagccgagattgtgctgctgcactccagcctgggtgaaaaagacaggctgtgtctccaaaaagaaaaaaaaaagtcaaattcaaatatcatctggacatgtcacaatggatcgcggatccttatgagtgattttccccagtggcccctggggatgtgccactgtcactcagaagggcaagctaggcagggcccatacaacagcaggggtctgcaggttagacgttccctgccctgggacgctcacccctgggcaagaggctggaagttcacaccatccaaaatttatccttgttttttttctgatgctaattagcctctcccgattttatgacatcttgtgttgatctttttcaaaaactcattttcttttttttccttctcttttctccttcttgtagcacatatctttcgttaaagatcagatcaataaaatattttatttattcattaatttaacaa

SEQ ID NO: 269601 - DNA, 1621 bp, Homo sapiens
  misc_feature (1)..(3): n is a, c, g, or t
nnngcttccttcccatctcgctcttgggtcatgcctggccagcagaaagcagctccataggggaggagagccacgcaggatctcacagctgcagtctaatagtaacacagaggattcagcagtggccaccatgggttctgtgaattccagaggtcacaaggcggaagcccaggtggtgatgatgggcctggactcggcgggcaagaccacgctcctttacaagctgaagggccaccagctggtggagaccctgcccactgttggtttcaacgtggagcctctgaaagctcctgggcacgtgtcactgactctctgggacgttggggggcaggccccgctcagagccagctggaaggactatctggaaggcacagatatcctcgtgtacgtgctggacagcacagatgaagcccgcttacccgagtcggcggctgagctcacagaagtcctgaacgaccccaacatggctggcgtccccttcttggtgctggccaacaagcaggaggcacctgatgcacttccgctgcttaagatcagaaacaggctgagtctagagagattccaggaccactgctgggagctccggggctgcagtgccctcactggggaggggctgcccgaggccctgcagagcctgtggagcctcctgaaatctcgcagctgcatgtgtctgcaggcgagagcccatggggctgagcgcggagacagcaagagatcttgatccagacagagcagcatatctttgctcatacaaactagaagaaccagctgatccttgagaaatttacgcttagtctatcaaacaagaaatgctggcttggcccggtggctcatgcctgtaatcccagcactgtgggagaccacggtgggggaatcccttgagcccaggagttggagagcaacatcacaacaccccatttctactaataatcaaaaaattggccgggcatggtggcatgtgcctgtagtcccagctacttgggaggctgaggcaggagaatcgcttgagcccaagaggtagaggttgcagtgagccaagatcgcgccactgcactccagtctgggcaacagagtgagaccctgtctcaataataataaaaaaagataaacatggtgttaccatttgacccagcagtttcatacccaggagaattgaacgcatatgtccacatagaaactcgtacacagaagccaaaatgtggaaacccacgtgtccatcaacagatgaacggttaaacaaaatgtccatccatagaacggaatattattcagtcataaacagaatgaagtactgtaagtgaaaagccagttactacatattgtgtgattccatttatacggaatttctagaataggcacatccatagagacggattagtggttgcttaagactgggagggagggggaaataggaggtgacagctaatgggcagttttatttttgatgtaatgaaaatgtgcttacataagccgagcaggcataaacagaaaaagtgccctaagattgtgataatggtacaattctgtcaattgcataattggtggatgatgtgtgaattatgtctcttaggataacagctttactggcgttaccagaaaaagataaaataattacattccg

SEQ ID NO: 269602 - DNA, 478 bp, Homo sapiens
cttaacaggtggggattacaatttgagatgagatttcggtgggaacacagagccaaaccacatcaaccagtaaatcttgggctgatttgttacacagcgatagataacttactacgtcaggatcatggttactggaagactggtttatgtcctgctggtcctccccaccttgccttgcttgctctatggaaggggcttccattatgggaactgcctggggagaggctcatggggcaaggaactgatgcctccagccaacagccagcaaggacctgagggctgcccactgccatgagtgagtctggaggcagattttccaccctgagatgcctgcagctccagccagccccttgactctagccttgaggaacctacagccaaagccacccagttaccctcacccagattcctgactgctggaaattgtgacatcgtaaatgtttcttgttttaagccaatacatgttggtgtaattttt

SEQ ID NO: 269603 - DNA, 380 bp, Homo sapiens
aaagcaactcatgacatataatggagctcccataagattatcagtgacttattcagcagaaattctataggccagaagggagcacccaaatatatgaagcaaatattgaatggaagggaaaataggcagcagcacattaacagtaggtgatttcaatacctcgcttacaacaataggtcaaacaaccaggcagaagatcaataaagaaacagagaacttgaacaacactacagacttaatggacctaacaaacatatagagaatattctacccaacaacagtgaatgaactattccaagagttcacagaacattctccaggataggtaagatgttaggtcacaaagcaagtcttaacacacttgaaaagattgaaatcat

SEQ ID NO: 269604 - DNA, 595 bp, Homo sapiens
tcagtgcccttagcaagcacagcaatatttataaataaatatttattaatgaagatcctaataataagttccttataggattaagtaatgtgctatgcgttatttaggaataattcatttaagaatgtattctgatactggaatcctacttgctcaagaaattaacacatacttgttttacctgtggaaatacacatttcctcaaagccaactcactaataaagcaagaaaatttatatcaaaacaacaatgattaggtttgactatgcaattgtgagttgatttctaaataacaaaggtatggtgtttttcttccttttggttaaacatatatcctttatatatatgacatttcatgccacatatgcaaacacacatataaataacgtcgtgaataatatattctggaaatgaacctctggtcattctagtttagtcggtgttctcacaaaggaaagaaaaaaattagacacctacccaaggcaagtaaaattatttttttacatatactaataatgattttactttttcacatgctttttctaaacattttgtcactttattgcctttttgcatgtatataaaatgtttgtgg

SEQ ID NO: 269605 - DNA, 541 bp, Homo sapiens
tcagtgcccttagcaagcacagcaatatttataaataaatatttattaatgaagatcctaataataagttccttataggattaagtaatgtgctatgcgttatttaggaataattcatttaagaatgtattctgatactggaatcctacttgctcaagaaattaacacatacttgttttacctgtggaaatacacatttcctcaaagccaactcactaataaagcaagaaaatttatatcaaaggtatggtgtttttcttccttttggttaaacatatatcctttatatatatgacatttcatgccacatatgcaaacacacatataaataacgtcgtgaataatatattctggaaatgaacctctggtcattctagtttagtcggtgttctcacaaaggaaagaaaaaaattagacacctacccaaggcaagtaaaattatttttttacatatactaataatgattttactttttcacatgctttttctaaacattttgtcactttattgcctttttgcatgtatataaaatgtttgtgg

SEQ ID NO: 269606 - DNA, 371 bp, Homo sapiens
cagcgggctaggaggcagggaacgcccttccacctgactgtggcctgagggtgccttccctggggcccagccggttccgcgggccagagcggtggctggcgcagtgctggggcgaggctggaggctgggtacttggccaggtctgaggccacgggaacagagggcttggtcccacccggctcagttaggagcagggagctgaagtgtggcctctttgctgctgaactgaggactttttttcagaagggattaggcaggaggaccatgtgaccaatgaggaaactgttttgttttgtttgatttttataagtgtaggaagctcttttgacttagttgcttttacaacaactttaccaagtctcatcacaatt

SEQ ID NO: 269607 - DNA, 533 bp, Homo sapiens
aggcatgagaatcacttaaacctgggaggaggaggttgcagtaagctgagatcttgccactaaacttcggcctgggtgacagattaagactgtctcagaaacaaaacaaaacaacaaaaaagcttttagagcaagttcatgggagatgcagcaggaggcgcaggaaccacacatgtgctagtgaggagtgtggggagactgggagggcccacaggtattgtgctgcttctggctgagggcaggggaatagggtggctgcttctgaaagcaaatatcctgaaaaacctgttgctggtactccaaattctggttcccatgtagatcatgaaacctgaaaaacttccaggcaagtagctttcagaatctttcctgctgtgattagctttcactgcaggtagtgattacctgtgagataacatctgggaattattgattgaaaagaccttcactatcggttgggggcggtggctgatgcctgtaatcccagcactttgtgaggctgaggcgggtggatcacctgaggtcaggggttc

SEQ ID NO: 269608 - DNA, 1132 bp, Homo sapiens
aggcatgagaatcacttaaacctgggaggaggaggttgcagtaagctgagatcttgccactaaacttcggcctgggtgacagattaagactgtctcagaaacaaaacaaaacaacaaaaaagcttttagagcaagttcatgggagatgcagcaggaggcgcaggaaccacacatgtgctagtgaggagtgtggggagactgggagggcccacaggtattgtgctgcttctggctgagggcaggggaatagggtggctgcttctgaaagcaaatatcctgaaaaacctgttgctggtactccaaattctggttcccatgtagatcatgaaacctgaaaaacttccaggcaagtagctttcagaatctttcctgctgtgattagctttcactgcaggtagtgattacctgtgagataacatctgggaattattgattgaaaagaccttcactatcggttgggggcggagattacaggtgtgagccaccacacccagccagaatttcttgaataatctgtctccatttctctatatagcctcattgatctatctaaactcccatatctattttggttgctagactgttcatcccaattacatgtgccagtgtcactgctacactaattgaattactataaatgtataatgttttcctatatgttcgtggtacattttttttgcaacgttctcccaaggtctgaggaacactatgtcaaggcatggcatgaaaggaatacaggtctcccaaggctttagagaagaatgatttgttcatggtgtcacaaagcaaggggtgaggggcacaattgggatgaaaacccagggatctacgtaattcctccatctttccactgccccagagtgggaaggtaggggtagctgagaggttttgaggaccagaggatagcggggagtagtctggatagacttttctgtctctaagtcctgttaactccactctcctattgcttttgcatgggtccctccccagctatcagcatcctgaggcctcctctctcacccagagtattgcaacagttgtgcaaaccttcctgacgaagaccaggtcagcactcctttgggtgagagaggaggcctcaggatgctgatagctggggagggacccatgcaaa

SEQ ID NO: 269609 - DNA, 924 bp, Homo sapiens
cacgtgccaccacaacatgctaattttttgtatttttagtagagacagggtttcaccatgttagccaggatggtctcgatctcctgacctcgtgatctgcccgcctcagcctcccaaagtgctgggattacaggcttcagccaccgcgcccggcccagtttttaagtgttgtagagatggagtcttgctttgttgcccaggctggtcttgaactctgggctgaagcgatctgcccaccttggcctctcaaagtgcggagattacaggtgtgagccaccacacccagccagaatttcttgaataatctgtctccatttctctatatagcctcattgatctatctaaactcccatatctattttggttgctagactgttcatcccaattacatgtgccagtgtcactgctacactaattgaattactataaatgtataatgttttcctatatgttcgtggtacattttttttgcaacgttctcccaaggtctgaggaacactatgtcaaggcatggcatgaaaggaatacaggtctcccaaggctttagagaagaatgatttgttcatggtgtcacaaagcaaggggtgaggggcacaattgggatgaaaacccagggatctacgtaattcctccatctttccactgccccagagtgggaaggtaggggtagctgagaggttttgaggaccagaggatagcggggagtagtctggatagacttttctgtctctaagtcctgttaactccactctcctattgcttttgcatgggtccctccccagctatcagcatcctgaggcctcctctctcacccagagtattgcaacagttgtgcaaaccttcctgacgaagaccaggtcagcactcctttgggtgagagaggaggcctcaggatgctgatagctggggagggacccatgcaaa

SEQ ID NO: 269610 - DNA, 724 bp, Homo sapiens
gcactgcctctgagctcggaggccccggtcgcctgggcccggacgccggcccggacgccagcccgggaagcagcaggtcaggagcgggagccggagccaaagctggacccaggccggaagtgcggcgccctccgtgggcctctctaggagcggaggcgaccgcgtctcagtgggaataaccccttcagctccgggaggccgtcgccgcgtgaggtgttcgctcgctttcctcctgagaagggccgaatgatggccgctagtcactctggggacatttggaggattgaatgcctgtaaccgcgcagggcccacggcctgggtttccatccccgatccgcctcatggctgagctcctcggacaagttattcaacctctctgagtcacagctttcttccttgcaaggggttgctgtaaggattccatgaattaatgcatgtgcagcactcagaagagaggctggaccccgcgtggtggcgcgcgcctgtgatcccagcactgggaggccaaggcgggaggatagcgtgagcccagaggcttgaggctgcagtgagctatgatcacgccactgcattgcagcctgggtgacagtgagacactgtctggaggggaaacaaaaaagctatatatcatttttttccattatttatactctgctataaaagaacttttggtggagggtcacgtttgagacatgagaataagaaacatgataaaaatgatagt

SEQ ID NO: 269611 - DNA, 496 bp, Homo sapiens
ccgagatggactgtgagctccagagctcgctgcagtggcccttgttcttcccggtggatgccagctgcagcggagtgttccggccccggcccgtgtccccaagcagcctgctggacacagccatcagtgaggaggccaggcaggggccgggcctagaggaggagcaggacacgcaggagtccctgcccagcagcacgggccggaggcacaccctggccgaggtctccacccgcctctccccactcaccgcgccatgtatagtcgtctccccctccaccacggcaagtcctgcagagggaaccagctctgacagttgtctgaccttctctgcgagcaaaagccccgcggggctcagtggcaccccggccactcaggggctgctgggcgcctgctccccggtcaggctggcctcgcccttcctggggtcgcagtccgccaccccagtgctgcaggctcaggggggcttgggaggagctgttctgctccctgtcagctt

SEQ ID NO: 269612 - DNA, 562 bp, Homo sapiens
agagaacaaagtaataagagtacatttgtatgaagataaacattccatactaacttttaaaaatgcaattttgttttccaaatggcttaagaccaggaagcgtactttaacatttacagcagagactgtccaagttcagggttccaagcatgaaatgaaaaggggatattgagttgtttgtatctattcaataagtaaaaatatgtttcctgaggttttagaactgaggttttagaagaaggtggagacaagaggggtaaaagaagggattcaatgggaaacttcaaagtattaattaactcatccaactgtgtagagatctcagcttaatgtatgaaaattcagtgtcaaacttagtttaaaaggcagactacagaacgagtgcttggcaagccaggaatcaacgcacttttgtcagctagaatggtttggctccaagggagtgtgagcagtgaagagcatttcaagtggaggaataggaggagaatctccttcaccctactcactgtaagcattgtaaggcacatggaaatacaggaatgtttgaaagccactggatccg

SEQ ID NO: 269613 - DNA, 604 bp, Homo sapiens
aatcaaccagaaagctttgctcctactaaatatcaagaaaaagcaatgtattcgtttcaccgcttggtaggattttattatgaaaatatgaagactgccttgtgctatttgataagcacccttaccatctgtgccttaatggaaaattcattacattttacatgaacctgatctatatccagacctcagagtaaaccatagctttttattttaactggttacttgctaatttcattttctctgagcgatttcatttctgcagtttggtctgtcttaacaaaggatttttcttaaagaaaaacccagatcaaaagcgaattccagactaaagctttctgattctatgtgcaaatgatattggctgctaaaaaatagttacttataagaaagtttgttatattttttagaatatgagaaaatagttcaaaattatttttattttgctttgaatgtagatgcagagaatgccaagaaattatcacaattttaatttttatataaaagatcataaaaggtatcactatatgggctgcattatactacactgaacagataatttatacagcttcagacttccttaacatttaattaaagtatttcttca

SEQ ID NO: 269614 - DNA, 480 bp, Homo sapiens
caggagagaataaccagaggaagggctgaaaatcctggagaacaccaacattaacaagcttcagtttgtcagaaccagttgggatgcaacaggattttcagttttgctgtcttccatgcatgaatggcttctgttaggttggaatgaccaagatgatttttccacccattcttgggacctggactatgatagccacagcagctaaagatgccagcaggtccaaaggactccactgactcaactgatctgagggaccccatgagaagcctactcatcaaagaatgcagtttctaaatcctgatgagttcaccccccttgccctgaccaatcaacaatcctaattctccagtcccttgccctccatgatcctcttaaaaaccctagcccagaattcctcaggaagatggatttgagggtctccttccaactcctcactcagcgccctgtggtcattaaactttctctgctgcaaacctgctg

SEQ ID NO: 269615 - DNA, 510 bp, Homo sapiens
caggagagaataaccagaggaagggctgaaaatcctggagaacaccaacattaacaagcttcagtttgtcagaaccagttgggatgcaacaggattttcagttttgctgtcttccatgcatgaatggcttctgttaggttggaatgaccaagatgatttttccacccattcttgggacctggactatgatagccacagcagctaaagatgccaggttctgcatactatgaaactactacatcagcaggtccaaaggactccactgactcaactgatctgagggaccccatgagaagcctactcatcaaagaatgcagtttctaaatcctgatgagttcaccccccttgccctgaccaatcaacaatcctaattctccagtcccttgccctccatgatcctcttaaaaaccctagcccagaattcctcaggaagatggatttgagggtctccttccaactcctcactcagcgccctgtggtcattaaactttctctgctgcaaacctgctg

SEQ ID NO: 269616 - DNA, 395 bp, Homo sapiens
agtgtcatttgctctctgcaaatttgtgaattttcaagttttcctaacctcttgtgatcagggaagatattttatatgatatatatcttttaaaatctattgacccttaatttatggcctgacatggtctattttggagaatatcccatgtgcaagtgtattctattgttatcgtgtattctatatattttctgttagatctaattggcttattgtattgttcaagtgctctatttccttattggtcttctgattgttttatttattattgagaatgggttattgaagtctctaactattgttgtagaactgtctatttcttctgttaattctgtgtatttttccttcatatattctgatggtctgttattaggtatataaatgcttataattgt

SEQ ID NO: 269617 - DNA, 404 bp, Homo sapiens
catccagaagccacgagatggtaacagtgcttcctctgcaggggctctgatcgaccttgggtctgcaaggggtagcagtcaggggtcacctgagcctagctcagtgggtgtgctcctcacactgcatgaccgcatgctgtgggtgggcctgtgcacatgtgtgtttgtgcacacagaggaaacgagtgtaggcggggatcaaggtcatttttacaaacagaaaagctgcagcatctccataactcagcttgtgggctagacagtcaccacagaaaaaaggaagccagaccaaaactgaaccactggactactgcaagcccgccccagcagggagccagtgcaggacccctgtgagaaatgggaactctgtactatctttatagcttttctataaatctaaaact

SEQ ID NO: 269618 - DNA, 417 bp, Homo sapiens
agttggattcttacagatgaaagatagaagtagaccttgttttaaggatcagacgcggtcttgaaaagttgtgtatatgatgaaatttcgttaatcagatcacacttcccaatagacaaataatgatatcaaagattctttatttcattgttccaacacttaagctttttattttttcaacccttcaaaggattagatttctgtgcattccccattcctatacagttgttaatttatttactaagatgctgtgcaaaacatgtaagttttttagtggatatcaggaacatatgagacagggcgcggtggctcacgcctgtaatcctaacactttgggaggccgaggtgggcagatcatttgaggtcaggagtttgagaccagcctgaccaacatggtgaaaccccatctctattaaa

SEQ ID NO: 269619 - DNA, 720 bp, Homo sapiens
cttgtaaaatttctgacaatatgtctgctgatagttgttactgtgttcctctgtatgtgtttgtatgtatgtgtttttaattttctttctgctggttaattttaagattttctctttacaatcgttttccagaaatttggtaataatgtcctttaatatgtctatgtatgctgtcagtgtgtttatcctacgtgggattcgtagagtttcatcgatctgtgggatatagttttaatgaaagtgtgaaagaaatattaaacattatttcttcaactgctattcccaatttgttctttatgagactctatcccatgtatattagccctcttgatattgtaccacaggtcactaaagtttcattcatttttttggtcaatcttttattccactctgtacttcattttggataactattaagtgtttggattttgttgtcttcctttaaaaaatgttgaagttgaaaaaactggaacatttgtacactgttgatgggaatgtaaaatggcacaccattgtggaaaacagtaggacaatccatcaaaaaattaaaaatggaattaccatataatcgaggaattccacttctgggtatataccagaaagaactgaaagcagggtctggaagaggtatctgttcaccattgctcatagcagtattattcacaaatggccaaggttggtagcaacccaagtaaccatttataaacaaataacaataaa

SEQ ID NO: 269620 - DNA, 443 bp, Homo sapiens
gggtgtgtagaactccactcagcctcatggatacatctacaagtctctcaacccatcctgttacagttctccatgagagtcacctcacacttggaaaagaaggaggttaaagcagagtattgttggcagccagctatgcccatcctcttgtaaataactttccaacacacccatttccttgccttaaggtgcaggttcctacttctacaaaatttcaaatgattgcaggtcaaaaacctttggagttactcacaaataataataaaatttcaaataactagggtctacttgtccatcaagatgacattaccagtggaacccacctgttaattttaaagtagcttcagaacccaacaaaaattatgtaagcctggttaaatgtccttttttcttcttgcctctaataaaatcaggatcttcggccttgatactaaatatgtgta

SEQ ID NO: 269621 - DNA, 607 bp, Homo sapiens
  misc_feature (8)..(8): n is a, c, g, or t
  misc_feature (14)..(14): n is a, c, g, or t
  misc_feature (33)..(33): n is a, c, g, or t
  misc_feature (37)..(37): n is a, c, g, or t
tttggttnggtttnggatttggggaaagccagnattncaggcatgagccaccatgcctggcctttaatatctttaatatgaatctttaacagagaaggattttttaaacaattacaataccttatattatcttatgatctgatatccagtttgtacttattttctgtcttgtaaatgtcttttaaaaatagattttttttcacattagaatccagaaaggttcacaaattgcagttggctgaaatgccttatctcttacgctaatagttcctccactaattaaaaaaaaaattgagtagttttagatttttagaaaaattgcaaagatgctataaagaattcccagttttctcatattactaacaccttacattagtatgataccgtggtaagaaaatgaaaagacaagctacaattgagattagttgcaaaatcatctgtctgataaaggacttgtatccagaatatataaagaactcttacaactcactaagacaagcaatccaatgtaaaagcaggagtacaaaattagtgtaaaaaattctaggtttattctcagggctaaaccatgggcaagagatttaaagagtgattttacaaaaaaaaa

SEQ ID NO: 269622 - DNA, 1070 bp, Homo sapiens
ccacggtctctaaggtgaaggtcaaggtggatgcgacaatggatttaatataatgagtaatgtatgtatttaatttaatttttggtaagggattctttttcagctttaatcttagatccaggggtacatgtaccggtttgttacgtgggtgtgttgcatgatgctgaggttaagtgtacaattgatcttgtcacctgggtagtgagcatgatacccagcaggtagtttttcacctcttgcccctccctcccttctccctcttctagtagtccccagtatctgttgttcccatctttatgttcatatgtacccagtgttcagctcccacatataagtgagaacatgcagtattgagtgttctgttactttaatttacttaggataatggcctccagctgcatccatattgctgcaaagaatgtgattttgttcttttttatggttatgtagtattccatggtgtatgtgtggaaatctttaaacatttatgaaatgaaacagtagaatgagccaccatgcctggcctttaatatctttaatatgaatctttaacagagaaggattttttaaacaattacaataccttatattatcttatgatctgatatccagtttgtacttattttctgtcttgtaaatgtcttttaaaaatagattttttttcacattagaatccagaaaggttcacaaattgcagttggctgaaatgccttatctcttacgctaatagttcctccactaattaaaaaaaaaattgagtagttttagatttttagaaaaattgcaaagatgctataaagaattcccagttttctcatattactaacaccttacattagtatgataccgtggtaagaaaatgaaaagacaagctacaattgagattagttgcaaaatcatctgtctgataaaggacttgtatccagaatatataaagaactcttacaactcactaagacaagcaatccaatgtaaaagcaggagtacaaaattagtgtaaaaaattctaggtttattctcagggctaaaccatgggcaagagatttaaagagtgattttacaaaaaaaaa

SEQ ID NO: 269623 - DNA, 604 bp, Homo sapiens
tcacctgcctcagccgcccaaagtgctgggattacaggcatgagccaccatgcctggcctttaatatctttaatatgaatctttaacagagaaggattttttaaacaattacaataccttatattatcttatgatctgatatccagtttgtacttattttctgtcttgtaaatgtcttttaaaaatagattttttttcacattagaatccagaaaggttcacaaattgcagttggctgaaatgccttatctcttacgctaatagttcctccactaattaaaaaaaaaattgagtagttttagatttttagaaaaattgcaaagatgctataaagaattcccagttttctcatattactaacaccttacattagtatgataccgtggtaagaaaatgaaaagacaagctacaattgagattagttgcaaaatcatctgtctgataaaggacttgtatccagaatatataaagaactcttacaactcactaagacaagcaatccaatgtaaaagcaggagtacaaaattagtgtaaaaaattctaggtttattctcagggctaaaccatgggcaagagatttaaagagtgattttacaaaaaaaaa

SEQ ID NO: 269624 - DNA, 581 bp, Homo sapiens
ccacggtctctaaggtgaaggtcaaggtggatgcgacaatggatttaatataatgagtaatgtatgtatttaatttaatttttggtaagggattctttttcagctttaatcttagatccaggggtacatgtaccggtttgttacgtgggtgtgttgcatgatgctgaggttaagtgtacaattgatcttgtcacctgggtagtgagcatgatacccagcaggtagtttttcacctcttgcccctccctcccttctccctcttctagtagtccccagtatctgttgttcccatctttatgttcatatgtacccagtgttcagctcccacatataagtgagaacatgcagtattgagtgttctgttactttaatttacttaggataatggcctccagctgcatccatattgctgcaaagaatgtgattttgttcttttttatggttatgtagtattccatggtgtatgtgtggaaatctttaaacatttatgaaatgaaacagtagaatgagccccatcaatcaactacagtaagtaggatcgattcccattttatttcatctttgtttgacctatacttttc

SEQ ID NO: 269625 - DNA, 160 bp, Homo sapiens
gcgaatgagattttaatcacctgtcactgccgcccgcactttctctatatttatgataatttttgggtctttttattgaaatcagtgttgactgaatcaagtaatcctgattagcaatctcactgtacccagtcaagagtgaaatgcatcccagccccgc

SEQ ID NO: 269626 - DNA, 876 bp, Homo sapiens
gagctatggatagtgccactgtactccactctgggtgacactgcaagaactgtctcaaaaaaaggcagggagattatttaatgcggttcattcaggatgagcttgtaaagtgttacatagctaactagacctagttgggtttcagaggtcaaatcaagtaattaggttttgggctgcatgcagaggtggttagtagttttgatgtccgcacactgggcttgaactgtgactcctgagtagctgggattacaggggcctgccaccacattgggctaatttttgtatttttagtggagatggcgttcaccatgttggctaggctggtcttgaactcctgacctcaggtgatccgcccgcctcggcctcccaaagtgctgggattacaggcgtgggccaccgcacctggccctcgtgttgggttttaaaacccactcttttttttcccccccaaactctgacttcacctttctctttatgaaaccgttctctttttggggcgggggtggtggtgaagaagctgctttggatggtggtgtgtggtacttgtgtcatcttcactcctgatgatccctttcctcataaactctgcactgcttttagcctgttttgttcgtgttataagttcttccatccagtccctgcactccaccttttaacccttttcaaaagctgcttcgcaaagggtcttgactaaagttgcttgcttaatgaatatgaagcagcctaaggatgagagaaaacgaggcagcagctggaccctctggagaatgttactttgtattttgtttacagctggttgtgactaagctctgtcctctaaagtcggttctaggggattaaaacagctctggctgatggcgcccaataaaataaaac

SEQ ID NO: 269627 - DNA, 939 bp, Homo sapiens
gagctatggatagtgccactgtactccactctgggtgacactgcaagaactgtctcaaaaaaaggcagggagattatttaatgcggttcattcaggatgagcttgtaaagtgttacatagctaactagacctagttgggtttcagaggtcaaatcaagtaattaggttttgggctgcatgcagaggtggttagtagttttgatgtccgcacactgggcttgaactgtgatcctgagatttatgttcccagtctccttcaatctggagagattattacttacaatgagttgatccttgttatactttggtattttggaagaaagttttatccccagacatgttgagacaagagatctaactgaaggagatgagaggatttctataccatatgcgttaccttctaatgctggccacctctgaagggcacgtggcagctgagacgaaattgattttcttcatcactgatcccgtggcctttacacaggctcagaggtgcatcagaatccacaatgaagtggacaagattagtgaccaacacatctgtaaatgttatattttctttttttagttccttagctttttctaccctaggataaattattgaccagttttctgcagtcagattcctgaatcatgttgggttttttttttttttagtttcactcttgtcgtccaggccactcttgtcttgcctcactgcaacctctgcctcccgggttcaagcgattctcctgcctcagctacttgggaggcagagacaggaggaacacttgagcccaggagatcaaggctttagtgacctgtgattgtgacaccgcactccagtctgggtgaccgcatgacctggtctcttaaaaaggcaggaaatttattggctattatccagccttttctaaattaaaccaccccaagtactattctcatatccatgctgttccg

SEQ ID NO: 269628 - DNA, 461 bp, Homo sapiens
ccctctctcaagggctttctgggaacccaggggactatctgcagaagaacgttctttggggcgcggtgggaagccaagcaggcctcctcttttgggcgctggtgaacgcaggatccgcatggaagcgactccgaccccacggcgtttccacgcctctgcggcttgggagggagctaggggcttcaggaactcaggctgtgggttttcgagttgctttcctgataaatgaaaatcctcctgataacatttagattttgtctctccaatagaaacggcagcacgtctcgctgaggcccgcgcctgcccccgggtactcgaggctcggtggctgctcctctagcccctcccgcgacgccttcgtccggtcactccggccttgcaccctgtggcgctcaggcctctccgctctcgtttgctctcgtacagacggtttccctaaaaaaaatctttacacgtttaaa

SEQ ID NO: 269629 - DNA, 1318 bp, Homo sapiens
ggcaatcagatctggatctgccctgggtgtaacaagcctgacgatgggagtcccatgattgggtgtgacgactgcgatgactggtaccactggccctgtgttggaatcatgactgcacccccagaagagatgcagtggttctgccccaagtgtgcgaacaagaagaaggacaaaaagcacaagaagaggaagcatcgagcccactgacgactcccgaggggctggaccaagcggggtcagcccgggcttcttccctggcgcctctggaagggagctggtgcaagtctgccgtcacatccacccccagatgcctgtggataaagaacccaggaggactgaggctggaacacaccgcgcacctggattgttcactcccgagccgccttggcctgtggctccgtggcagtgcgacagaaggaaactcaagcagaggcgtggcctgggggctgcccctcctccacttctctaataccagtgacaagtattattaataaagagcgtacatcttcccttttgatttcctttattctctccagggccttttcattgaggtattagatgagaagataatgtacaaactgcctcaactgtaatttaaggatgatagagtctgtatacagttttcagcccctttccctctatagtaagataatcagaataacataaaagaaaactccagttggagtaccggtaaatatttttgtgataagaatatatgaagcttccctccttcccccgtttttagtactaacatgtaaaatgttcaggcttttgtgaaataccttatattttttaagaaaaaggtttctatcatgtcctgtttgcttttgtgcaaattatttttgtttaatgtattttatatcttcgttgcattctaattttgcccttctttaaactgctggagtctcttctcactgcttgtacatttcatcaacttgtataaaaactcttcagactaaaagattgcccctaatgtaaataataaatatttatgaagtagttattttttaaatttttatcgtgtttaattctggctttctctgaaatccactgtgatttcagccaggtctgtaatgacgctggacagaaacaaggctagagaaaaagccatcgttcaaagaaatttcccttgagctcagcctgcgcagtgcccggaaacatggtggggaaagggcccgagcagttggaaggaaaacaaggcaatttaaatttagagtttatgacttgaagttgttttgtttgttgtctattttgtttttgtaaatttctttgacagacttttactaaaaggacatgtagtttccatgaaagtaaaaaa

SEQ ID NO: 269630 - DNA, 509 bp, Homo sapiens
ggcaatcagatctggatctgccctgggtgtaacaagcctgacgatgggagtcccatgattgggtgtgacgactgcgatgactggtaccactggccctgtgttggaatcatgactgcacccccagaagagatgcagtggttctgccccaagtgtgcgaacaagaagaaggacaaaaagcacaagaagaggaagcatcgagcccactgacgactcccgaggggctggaccaagcggggtcagcccgggcttcttccctggcgcctctggaagggagctggtgcaagtctgccgtcacatccacccccagatgcctgtggataaagaacccaggaggactgaggctggaacacaccgcgcacctggattgttcactcccgagccgccttggcctgtggctccgtggcagtgcgacagaaggaaactcaagcagaggcgtggcctgggggctgcccctcctccacttctctaataccagtgacaagtattattaataaagagcgtacatcttc

SEQ ID NO: 269631 - DNA, 1078 bp, Homo sapiens
ggcaatcagatctggatctgccctgggtgtaacaagcctgacgatgggagtcccatgattgggtgtgacgactgcgatgactggtaccactggccctgtgttggaatcatgactgcacccccagaagagatgcagtggttctgccccaagtgtgcgaacaagaagaaggacaaaaagcacaagaagaggaagcatcgagcccactgacgactcccgaggggctggaccaagcggggtcagcccgggcttcttccctggcgcctctggaagggagctggtgcaagtctgccgtcacatccacccccagatgcctgtggataaagaacccaggaggactgaggctggaacacaccgcgcacctggattgttcactcccgagccgccttggcctgtggctccgtggcagtgcgacagaaggaaactcaagcagaggcgtggcctgggggctgcccctcctccacttctctaataccagtgacaagtattattaataaagagcgtacatcttcccttttgatttcctttattctctccagggccttttcattgaggtattagatgagaagataatgtacaaactgcctcaactgtaatttaaggatgatagagtctgtatacagttttcagcccctttccctctatagtaagataatcagaataacataaaagaaaactccagttggagtaccggtaaatatttttgtgataagaatatatgaagcttccctccttcccccgtttttagtactaacatgtaaaatgttcaggcttttgtgaaataccttatattttttaagaaaaaggtttctatcatgtcctgtttgcttttgtgcaaattatttttgtttaatgtattttatatcttcgttgcattctaattttgcccttctttaaactgctggagtctcttctcactgcttgtacatttcatcaacttgtataaaaactcttcagactaaaagattgcccctaatgtaaataataaatattttggaagcggcgctttaatttatcggggtaacggggtctctgaaaccaggggtacgcggggaaaccgcgaaaagggggaaacccctca

SEQ ID NO: 269632 - DNA, 400 bp, Homo sapiens
tctccaccagctgccaggtcacagaggcaggaacaaattcttctggttcatcggcctcaacaatgatcacttggctgcttggagggatcatttcagaattctttgcaacagtaatggccgtttgaaggttatcacctagaagacaaagaaactttgcttgctgtatgtacaaacctcccctcagcaacaagaactgaggtctcccttttccactctgcttggtgttctttgagagcatttaccgctttctgccttattttatcttcctctctgctgtagactgcccctactgggcaaacactatgttcccatctccctctccatattctgcatcatatcctggtccatgtgtatttcaaaacatgtgtgaattaataaagaaatacttaagcatttaaaa

SEQ ID NO: 269633 - DNA, 498 bp, Homo sapiens
agccttggtcgcccctagtcggtcgtgagcctctttgccgcttgtctcccccagaagctgctgttccgcccacctagctttacccgccgttttacccccactataagggactcccatatttcttggcccctcccagctaatgggcacataggccttttgaacttttctttttaaagttggtatccatccactgggattgtcgacatctcgagtcttcttaaagaggtctcctggccgggctcagtggcttacgcctgtaatcccagcactttgggaggctgaggagagcggatcacttgaggtcaggagttcgagatcagcctgaccaacatggtgaaaccccgtctctactaaaaatacaaaaattagccgggtgtggtgatgcgcgcctgtaatcccagctactctggaggcagaggcagaagaatcgcttgaaccctggaggcggatgttgcagtgaccgagatcgcgccactgcactccagcctgggtgacaga

SEQ ID NO: 269634 - DNA, 507 bp, Homo sapiens
ttctgtataccagccgtgaacaagtagaatttgaaattaaaaagacattaagtatgaacaggttttttaatgaggcagactataaaactgtgatgaaatgtatcaactaaatagatattccatgttcacagatagaacaactcaataatgtcaagatataatttcttcctagcttatctatggagtcaatgcaatcccaatccaaatcccagcaagtcattttatggatattgacaaactgattataaagtttatgtggaaaggcaaaagaccaagaataaccaactcaatattgtgggagaaacaagttagaggactgacgctacctgactccaagacttagtataaagctacattaatcaggacagtgatattggtgaaacaacaagtagatcaatggaacagaatagagagcccagaaatagactcacataaatagagccaactgatgtttgacaatggagaaaagatagtcttttcagcagattgaaacactatctgcatgca

SEQ ID NO: 269635 - DNA, 413 bp, Homo sapiens
agcgtccagcagcagcgaggggcacggagagcaggcagtgcagaagtcaaacccctaacagccacaggaaactcagggcaaacggaagcgtttccattctccagcccttctttcaatattcttaacatgagcaatccatgagccctcattttgcagcccacagaacctcagccagcgtgtgaggaagaagctccaggcggcggcagccagcgtgtgaggaagaagctccacgcggcggccagtgtgtgaggaagaagctccacgcggcggcggccagtgtgtaagaaagaagctccacgcagcggccagcgtgtgaggaagaagctccacgcagcggccagcgtgtgaggaagaagctccaggcggcggcggccagcgtgtgaggaagaagctccacgcggcggccagtgtgt

SEQ ID NO: 269636 - DNA, 464 bp, Homo sapiens
aggcggcgccttcctcttggcccaggggctctcttggggacagtgtgcagtactccccaagggggctttgctgtgcaaaagcagcccctgccgatgctgcggctcccgtggatggagcactgccgtgggaacagagttggaactcatccaaaagaataaaagacaactgtgttggaagattgccaaggtttgtagctgtgccaccgcagacttcagagatgaacactgccttggagacgaggaggattcaagttgcagaagcatttaggtgctgcgtgaaccccagcagggccattccagatgctccacaggacagcgctgaacgcaccgcagtgagcctgggaggccctgggctactgctgcctccccttctctgggctgaacatcaaggtagtgcttctgtgttcttctcccaacttgtgcaagaaaggacattaaagttatttttatgaaattgcctaaca

SEQ ID NO: 269637 - DNA, 426 bp, Homo sapiens
actttgggagggccgaggcaggtggatcacttgaggccaggaggatatatatatatatatatatatagtattaaatacattatatgtattttatcatcatccaacaggggaagtccaaccagcaaacccttctgttggagatgtggcaacatgtggcaaaagccttgaaccaacacccactcttagcaccaccaaatccacttctgggtttttatctgaaggcaattaccaaggatacacagtcagcactgtttttatagcaaaaccctggaaataactgaagagcctgacaatggatagagccatacaatggaattccatggaagctatggaaaatgaaggcataccctatatttacgcataaagatataaagacttgtccaagatattttctgtaccaaatcaatatttgcatgcatatataga

SEQ ID NO: 269638 - DNA, 364 bp, Homo sapiens
  misc_feature (37)..(37): n is a, c, g, or t
gagtgaaagtgagcggcggcccgggcgggccaggggnggcgtgaggggaagtccaaccagcaaacccttctgttggagatgtggcaacatgtggcaaaagccttgaaccaacacccactcttagcaccaccaaatccacttctgggtttttatctgaaggcaattaccaaggatacacagtcagcactgtttttatagcaaaaccctggaaataactgaagagcctgacaatggatagagccatacaatggaattccatggaagctatggaaaatgaaggcataccctatatttacgcataaagatataaagacttgtccaagatattttctgtaccaaatcaatatttgcatgcatatataga

SEQ ID NO: 269639 - DNA, 2480 bp, Homo sapiens
gtcgacccacgcgtccgcggacgcgtgggcgcgcgtccggctgcgcttgcagcccagggcgtgaggtgctctttctggatcgccagcctcgaagttgaggcgtggactctggccaggtggctgttccagagcaacatgggagatgctgaagcaggcaagaagacctttattcagaaatgtgctcagtgccacacagtggaaaaaggtgaaaatcacaagactggtccaaatctctggggcctctttggctgaaaaacaggaaaagcaccaggattttcttatacagaggcaaacaaaaacaaaggatcgacgattcaatgatgaaatcgacaagctaactggatacaagacaaaatcattattgtgcatgcctatccgaagcagtgatggtgagattattggtgtggcccaagcgataaataagattcctgaaggagctccatttactgaagatgatgaaaaagttatgcagatgtatcttccattttgtggaatcgccatatctaacgctcagctctttgctgcctcaaggaaagaatatgaaagaagcagagctttgctagaggtggttaatgacctctttgaagaacagactgacctggagaaaattgtcaagaaaataatgcatcgggcccaaactctgctgaaatgtgaacgctgttctgttttactcctagaggacatcgaatcaccagtggtgaaatttaccaaatcctttgaattgatgtccccaaagtgcagtgctgatgctgagaacagtttcaaagaaagcatggagaaatcatcatactccgactggctaataaataacagcattgctgagctggttgcttcaacaggccttccagtgaacatcagtgatgcctaccaggatccgcgctttgatgcagaggcagaccagatatctggttttcacataagatctgttctttgtgtccctatttggaatagcaaccaccaaataattggagtggctcaagtgttaaacagacttgatgggaaaccttttgatgatgcagatcaacgactttttgaggcttttgtcatcttttgtggacttggcatcaacaacacaattatgtatgatcaagtgaagaagtcctgggccaagcagtctgtggctcttgatgtgctatcataccatgcaacatgttcaaaagctgaagttgacaagtttaaggcagccaacatccctctggtgtcagaacttgccatcgatgacattcattttgatgacttttctctcgacgttgatgccatgatcacagctgctctccggatgttcatggagctggggatggtacagaaatttaaaattgactatgagacactgtgtaggtggcttttgacagtgaggaaaaactatcggatggttctataccacaactggagacatgccttcaacgtgtgtcagctgatgttcgcgatgttaaccactgctgggtttcaagacattctgaccgaggtggaaattttagcggtgattgtgggatgcctgtgtcatgacctcgaccacaggggaaccaacaatgccttccaagctaagagtggctctgccctggcccaactctatggaacctctgctaccttggagcatcaccatttcaaccacgccgtgatgatccttcaaagtgagggtcacaatatctttgctaacctgtcctccaaggaatatagtgaccttatgcagcttttgaagcagtcaatattggcaacagacctcacgctgtactttgagaggagaactgaattctttgaacttgtcagtaaaggagaatacgattggaacatcaaaaaccatcgtgatatatttcgatcaatgttaatgacagcctgtgaccttggagccgtgaccaaaccgtgggagatctccagacaggtggcagaacttgtaaccagtgagttcttcgaacaaggagatcgggagagattagagctcaaactcactccttcagcaatttttgatcggaaccggaaggatgaactgcctcggttgcaactggagtggattgatagcatctgcatgcctttgtatcaggcactggtgaaggtcaacgtgaaactgaagccgatgctagattcagtagctacaaacagaagtaagtgggaagagctacaccaaaaacgactgctggcctcaactgcctcatcctcctcccctgccagtgttatggtagccaaggaagacaggaactaaacctccagctcagaaagacctaacatctcaaggatgcactgggaaccatgcctgggctttcaccttgaagcatggtcagcagcagagagagcaacgggaaggacaaagaaagaggtggggcagggagcacaccccaggaccctcacttttccctaatgaacacgcatgggctgaaatgaaggctctgggtaggggactgttttggatccaaggacctgtggacagtcggcctacttactctgagctgagggaacactgaacagtaaaagcgtcattagcgctg

SEQ ID NO: 269640 - DNA, 3255 bp, Homo sapiens
tggaaagatgttacttcatctcccaggtttgctcactgcaaatacaatcctgagaactgaactagggccttaaagtcctgacatgcatggcttggttttgtggattgcctctctcaacaggtggtgaaatttaccaaatcctttgaattgatgtccccaaagtgcagtgctgatgctgagaacagtttcaaagaaagcatggagaaatcatcatactccgactggctaataaataacagcattgctgagctggttgcttcaacaggccttccagtgaacatcagtgatgcctaccaggatccgcgctttgatgcagaggcagaccagatatctggttttcacataagatctgttctttgtgtccctatttggaatagcaaccaccaaataattggagtggctcaagtgttaaacagacttgatgggaaaccttttgatgatgcagatcaacgactttttgaggcttttgtcatcttttgtggacttggcatcaacaacacaattatgtatgatcaagtgaagaagtcctgggccaagcagtctgtggctcttgatgtgctatcataccatgcaacatgttcaaaagctgaagttgacaagtttaaggcagccaacatccctctggtgtcagaacttgccatcgatgacattcattttgatgacttttctctcgacgttgatgccatgatcacagctgctctccggatgttcatggagctggggatggtacagaaatttaaaattgactatgagacactgtgtaggtggcttttgacagtgaggaaaaactatcggatggttctataccacaactggagacatgccttcaacgtgtgtcagctgatgttcgcgatgttaaccactgctgggtttcaagacattctgaccgaggtggaaattttagcggtgattgtgggatgcctgtgtcatgacctcgaccacaggggaaccaacaatgccttccaagctaagagtggctctgccctggcccaactctatggaacctctgctaccttggagcatcaccatttcaaccacgccgtgatgatccttcaaagtgagggtcacaatatctttgctaacctgtcctccaaggaatatagtgaccttatgcagcttttgaagcagtcaatattggcaacagacctcacgctgtactttgagaggagaactgaattctttgaacttgtcagtaaaggagaatacgattggaacatcaaaaaccatcgtgatatatttcgatcaatgttaatgacagcctgtgaccttggagccgtgaccaaaccgtgggagatctccagacaggtggcagaacttgtaaccagtgagttcttcgaacaaggagatcgggagagattagagctcaaactcactccttcagcaatttttgatcggaaccggaaggatgaactgcctcggttgcaactggagtggattgatagcatctgcatgcctttgtatcaggcactggtgaaggtcaacgtgaaactgaagccgatgctagattcagtagctacaaacagaagtaagtgggaagagctacaccaaaaacgactgctggcctcaactgcctcatcctcctcccctgccagtgttatggtagccaaggaagacaggaactaaacctccaggtcagctgcagctgcaaaatgactacagcctgaagggccattttcagtccagcaatgtcatccttttgttcttttagctcagaaagacctaacatctcaaggatgcactgggaaccatgcctgggctttcaccttgaagcatggtcagcagcagagagagcaacgggaaggacaaagaaagaggtggggcagggagcacaccccaggaccctcacttttccctaatgaacacgcatgggctgaaatgaaggctctgggtaggggactgttttggatccaaggacctgtggacagtcggcctacttactctgagctgagggaacactgaacagtaaaagcgtcattagcgctgcttcattttgtatagggcttttctgtttgttacaagccaaacattgcctgtctttgcttcccgtccctgaatgcctttttgtgccagactgtcccaagaatcctaatttgtattccatagaggtattttatttttaatcctagagcttcttattgatggatcctttagaattgcctacctaaaaggtaaactatactatccttataaatactgatcaatcccagttctccccctaaaaatgaatacatagtaggactatagcaaatgtgtttgatgggtaattctagactgggactatggtacccttttccagagttttaaaattcaaccttcattacagacaaagttttctcccagaaggaatggattgatagattttgattaaagtaagggtggaaggaaatctgtagctggatttaccacaagtgacatctagaaactatagttcacaggacagagcagagccatggagaataagcattgactaccttgagttctcctagtgaggagttctggtataaaatttaagattactaccagtaaccaacttaaagcaaactataggggtccctaattttggatttttccttaagtgtaagaaacaatgcttcaaatgttaagaaataacagtctgggcaaagaacgcatattctataggaagccaggtttacaataggtaagaataaactgtattaagtagatgtaatgactagaaagctgctttgctccctatattgagaaattgtggacatggtatgtgttatccaaagaacattgggctagaagatagatttctatccttagctttggcattattgactggattgacttgaacaagtcgcttaacttctacaagcttgtttccttatttgtcaaattagattacactaggaaacgattctcgaacatgttttaaccttacaactctttgttcaaataaatctttcaatgaatccccaacatataaaacgtcaaaaagctgaattcctatgtgaattataagcagggtttggacatccagagcacctacaaaccttcatctctttgattacgtacatgggggtccacagggactctgaagagtttgaaaatccctggcctagattaaacctgagagccattctagctcttaaaaaaatctgaaatttacaaaccatttttcttgttattgtttttgtttctttgtttgttttcgagatcacgtcactgccctccagcctgggcgaccagcgagactccgtctcaaaaaaaaaaaaaaaaaaaaaaaaaaaa

SEQ ID NO: 269641 - DNA, 3520 bp, Homo sapiens
gtcgacccacgcgtccgcggacgcgtgggcgcgcgtccggctgcgcttgcagcccagggcgtgaggtgctctttctggatcgccagcctcgaagttgaggcgtggactctggccaggtggctgttccagagcaacatgggagatgctgaagcaggcaagaagacctttattcagaaatgtgctcagtgccacacagtggaaaaaggtgaaaatcacaagactggtccaaatctctggggcctctttggctgaaaaacaggaaaagcaccaggattttcttatacagaggcaaacaaaaacaaaggatcgacgattcaatgatgaaatcgacaagctaactggatacaagacaaaatcattattgtgcatgcctatccgaagcagtgatggtgagattattggtgtggcccaagcgataaataagattcctgaaggagctccatttactgaagatgatgaaaaagttatgcagatgtatcttccattttgtggaatcgccatatctaacgctcagctctttgctgcctcaaggaaagaatatgaaagaagcagagctttgctagaggtggttaatgacctctttgaagaacagactgacctggagaaaattgtcaagaaaataatgcatcgggcccaaactctgctgaaatgtgaacgctgttctgttttactcctagaggacatcgaatcaccagtggtgaaatttaccaaatcctttgaattgatgtccccaaagtgcagtgctgatgctgagaacagtttcaaagaaagcatggagaaatcatcatactccgactggctaataaataacagcattgctgagctggttgcttcaacaggccttccagtgaacatcagtgatgcctaccaggatccgcgctttgatgcagaggcagaccagatatctggttttcacataagatctgttctttgtgtccctatttggaatagcaaccaccaaataattggagtggctcaagtgttaaacagacttgatgggaaaccttttgatgatgcagatcaacgactttttgaggcttttgtcatcttttgtggacttggcatcaacaacacaattatgtatgatcaagtgaagaagtcctgggccaagcagtctgtggctcttgatgtgctatcataccatgcaacatgttcaaaagctgaagttgacaagtttaaggcagccaacatccctctggtgtcagaacttgccatcgatgacattcattttgatgacttttctctcgacgttgatgccatgatcacagctgctctccggatgttcatggagctggggatggtacagaaatttaaaattgactatgagacactgtgtaggtggcttttgacagtgaggaaaaactatcggatggttctataccacaactggagacatgccttcaacgtgtgtcagctgatgttcgcgatgttaaccactgctgggtttcaagacattctgaccgaggtggaaattttagcggtgattgtgggatgcctgtgtcatgacctcgaccacaggggaaccaacaatgccttccaagctaagagtggctctgccctggcccaactctatggaacctctgctaccttggagcatcaccatttcaaccacgccgtgatgatccttcaaagtgagggtcacaatatctttgctaacctgtcctccaaggaatatagtgaccttatgcagcttttgaagcagtcaatattggcaacagacctcacgctgtactttgagaggagaactgaattctttgaacttgtcagtaaaggagaatacgattggaacatcaaaaaccatcgtgatatatttcgatcaatgttaatgacagcctgtgaccttggagccgtgaccaaaccgtgggagatctccagacaggtggcagaacttgtaaccagtgagttcttcgaacaaggagatcgggagagattagagctcaaactcactccttcagcaatttttgatcggaaccggaaggatgaactgcctcggttgcaactggagtggattgatagcatctgcatgcctttgtatcaggcactggtgaaggtcaacgtgaaactgaagccgatgctagattcagtagctacaaacagaagtaagtgggaagagctacaccaaaaacgactgctggcctcaactgcctcatcctcctcccctgccagtgttatggtagccaaggaagacaggaactaaacctccaggtcagctgcagctgcaaaatgactacagcctgaagggccattttcagtccagcaatgtcatccttttgttcttttagctcagaaagacctaacatctcaaggatgcactgggaaccatgcctgggctttcaccttgaagcatggtcagcagcagagagagcaacgggaaggacaaagaaagaggtggggcagggagcacaccccaggaccctcacttttccctaatgaacacgcatgggctgaaatgaaggctctgggtaggggactgttttggatccaaggacctgtggacagtcggcctacttactctgagctgagggaacactgaacagtaaaagcgtcattagcgctgcttcattttgtatagggcttttctgtttgttacaagccaaacattgcctgtctttgcttcccgtccctgaatgcctttttgtgccagactgtcccaagaatcctaatttgtattccatagaggtattttatttttaatcctagagcttcttattgatggatcctttagaattgcctacctaaaaggtaaactatactatccttataaatactgatcaatcccagttctccccctaaaaatgaatacatagtaggactatagcaaatgtgtttgatgggtaattctagactgggactatggtacccttttccagagttttaaaattcaaccttcattacagacaaagttttctcccagaaggaatggattgatagattttgattaaagtaagggtggaaggaaatctgtagctggatttaccacaagtgacatctagaaactatagttcacaggacagagcagagccatggagaataagcattgactaccttgagttctcctagtgaggagttctggtataaaatttaagattactaccagtaaccaacttaaagcaaactataggggtccctaattttggatttttccttaagtgtaagaaacaatgcttcaaatgttaagaaataacagtctgggcaaagaacgcatattctataggaagccaggtttacaataggtaagaataaactgtattaagtagatgtaatgactagaaagctgctttgctccctatattgagaaattgtggacatggtatgtgttatccaaagaacattgggctagaagatagatttctatccttagctttggcattattgactggattgacttgaacaagtcgcttaacttctacaagcttgtttccttatttgtcaaattagattacactaggaaacgattctcgaacatgttttaaccttacaactctttgttcaaataaatctttcaatgaatccccaacat

SEQ ID NO: 269642 - DNA, 4446 bp, Homo sapiens
  misc_feature (869)..(869): n is a, c, g, or t
  misc_feature (1110)..(1110): n is a, c, g, or t
gcagcggcggcagccagaacaggagcagcgatagctcgggtttccggaacaggagccggggcagcggcggcagctcagtgctgggcacctgtgcggagcaggagtagcaggaccacggggtggggtcggcgccagccactctgagccagagaaggaaggggcatctcccagattccactgctgggaataatctccaggggaggtggcgctgaactgggaatactggtgggggtgaacatgtgcaggaacagctagaggcctcggggcaggaaaacatttggttcacgtgtaaacaggcaaggaaagctgtctgggaccatggcagcctcccgcctggactttggggaggtggaaactttcctggacaggcacccagagttgtttgaagattacttgatgcggaaggggaagcaggagatggttgaaaagtggctgcagaggcacagtcagggtcagggggctttaggtccaaggccctctttggctggtaccagcagcttggctcacagcacctgcagaggtggcagcagcgttggtggtggcactggaccaaatggctctgcccacagccagccccttcccggtggcggggactgtggtggggttcccttgagtcccagctgggccggtggcagcaggggcgatgggaacctgcagcggagagcttctcagaaagagctaaggaagagttttgcccgctccaaggccatccacgtgaacaggacctacgatgaacaggtgacctcccgggctcaggaacccctgagtagtgtacgacggagggcacttctccggaaggcaagctccctgccccccaccacagcccatattctcagtgcgctgctggaatcgagagtgaatctgcctcngtatccccctacagccatcgactacaagtgccatctgaaaaagcataatgagcgtcagttctttctggaattggtcaaagatatctccaatgaccttgacctcaccagcctgagctacaagattctcatctttgtctgccttatggtggatgctgaccgctgctctcttttcctggtggaaggggcagctgctggcaagaagaccttggtctccaaattctttgatgtgcatgcaggaacncctctgctgccttgcagcagcacagagaactcaaatgaggtgcaggtcccctggggcaaaggtatcattggctatgtcggggagcatggagaaacggtcaacattcctgatgcctaccaggatcgacgattcaatgatgaaatcgacaagctaactggatacaagacaaaatcattattgtgcatgcctatccgaagcagtgatggtgagattattggtgtggcccaagcgataaataagattcctgaaggagctccatttactgaagatgatgaaaaagttatgcagatgtatcttccattttgtggaatcgccatatctaacgctcagctctttgctgcctcaaggaaagaatatgaaagaagcagagctttgctagaggtggttaatgacctctttgaagaacagactgacctggagaaaattgtcaagaaaataatgcatcgggcccaaactctgctgaaatgtgaacgctgttctgttttactcctagaggacatcgaatcaccagtggtgaaatttaccaaatcctttgaattgatgtccccaaagtgcagtgctgatgctgagaacagtttcaaagaaagcatggagaaatcatcatactccgactggctaataaataacagcattgctgagctggttgcttcaacaggccttccagtgaacatcagtgatgcctaccaggatccgcgctttgatgcagaggcagaccagatatctggttttcacataagatctgttctttgtgtccctatttggaatagcaaccaccaaataattggagtggctcaagtgttaaacagacttgatgggaaaccttttgatgatgcagatcaacgactttttgaggcttttgtcatcttttgtggacttggcatcaacaacacaattatgtatgatcaagtgaagaagtcctgggccaagcagtctgtggctcttgatgtgctatcataccatgcaacatgttcaaaagctgaagttgacaagtttaaggcagccaacatccctctggtgtcagaacttgccatcgatgacattcattttgatgacttttctctcgacgttgatgccatgatcacagctgctctccggatgttcatggagctggggatggtacagaaatttaaaattgactatgagacactgtgtaggtggcttttgacagtgaggaaaaactatcggatggttctataccacaactggagacatgccttcaacgtgtgtcagctgatgttcgcgatgttaaccactgctgggtttcaagacattctgaccgaggtggaaattttagcggtgattgtgggatgcctgtgtcatgacctcgaccacaggggaaccaacaatgccttccaagctaagagtggctctgccctggcccaactctatggaacctctgctaccttggagcatcaccatttcaaccacgccgtgatgatccttcaaagtgagggtcacaatatctttgctaacctgtcctccaaggaatatagtgaccttatgcagcttttgaagcagtcaatattggcaacagacctcacgctgtactttgagaggagaactgaattctttgaacttgtcagtaaaggagaatacgattggaacatcaaaaaccatcgtgatatatttcgatcaatgttaatgacagcctgtgaccttggagccgtgaccaaaccgtgggagatctccagacaggtggcagaacttgtaaccagtgagttcttcgaacaaggagatcgggagagattagagctcaaactcactccttcagcaatttttgatcggaaccggaaggatgaactgcctcggttgcaactggagtggattgatagcatctgcatgcctttgtatcaggcactggtgaaggtcaacgtgaaactgaagccgatgctagattcagtagctacaaacagaagtaagtgggaagagctacaccaaaaacgactgctggcctcaactgcctcatcctcctcccctgccagtgttatggtagccaaggaagacaggaactaaacctccaggtcagctgcagctgcaaaatgactacagcctgaagggccattttcagtccagcaatgtcatccttttgttcttttagctcagaaagacctaacatctcaaggatgcactgggaaccatgcctgggctttcaccttgaagcatggtcagcagcagagagagcaacgggaaggacaaagaaagaggtggggcagggagcacaccccaggaccctcacttttccctaatgaacacgcatgggctgaaatgaaggctctgggtaggggactgttttggatccaaggacctgtggacagtcggcctacttactctgagctgagggaacactgaacagtaaaagcgtcattagcgctgcttcattttgtatagggcttttctgtttgttacaagccaaacattgcctgtctttgcttcccgtccctgaatgcctttttgtgccagactgtcccaagaatcctaatttgtattccatagaggtattttatttttaatcctagagcttcttattgatggatcctttagaattgcctacctaaaaggtaaactatactatccttataaatactgatcaatcccagttctccccctaaaaatgaatacatagtaggactatagcaaatgtgtttgatgggtaattctagactgggactatggtacccttttccagagttttaaaattcaaccttcattacagacaaagttttctcccagaaggaatggattgatagattttgattaaagtaagggtggaaggaaatctgtagctggatttaccacaagtgacatctagaaactatagttcacaggacagagcagagccatggagaataagcattgactaccttgagttctcctagtgaggagttctggtataaaatttaagattactaccagtaaccaacttaaagcaaactataggggtccctaattttggatttttccttaagtgtaagaaacaatgcttcaaatgttaagaaataacagtctgggcaaagaacgcatattctataggaagccaggtttacaataggtaagaataaactgtattaagtagatgtaatgactagaaagctgctttgctccctatattgagaaattgtggacatggtatgtgttatccaaagaacattgggctagaagatagatttctatccttagctttggcattattgactggattgacttgaacaagtcgcttaacttctacaagcttgtttccttatttgtcaaattagattacactaggaaacgattctcgaacatgttttaaccttacaactctttgttcaaataaatctttcaatgaatccccaacat

SEQ ID NO: 269643 - DNA, 2117 bp, Homo sapiens
  misc_feature (1)..(1): n is a, c, g, or t
  misc_feature (3)..(6): n is a, c, g, or t
  misc_feature (8)..(8): n is a, c, g, or t
  misc_feature (11)..(11): n is a, c, g, or t
ngnnnngncangaaaagtccactgtgtgttgggaatagattatgaagggctttgagtgtaggccctgtaagcaataggaagccatggaacagccagaaaggttatgcagatgtatcttccattttgtggaatcgccatatctaacgctcagctctttgctgcctcaaggaaagaatatgaaagaagcagagctttgctagaggtggttaatgacctctttgaagaacagactgacctggagaaaattgtcaagaaaataatgcatcgggcccaaactctgctgaaatgtgaacgctgttctgttttactcctagaggacatcgaatcaccagtggtgaaatttaccaaatcctttgaattgatgtccccaaagtgcagtgctgatgctgagaacagtttcaaagaaagcatggagaaatcatcatactccgactggctaataaataacagcattgctgagctggttgcttcaacaggccttccagtgaacatcagtgatgcctaccaggatccgcgctttgatgcagaggcagaccagatatctggttttcacataagatctgttctttgtgtccctatttggaatagcaaccaccaaataattggagtggctcaagtgttaaacagacttgatgggaaaccttttgatgatgcagatcaacgactttttgaggcttttgtcatcttttgtggacttggcatcaacaacacaattatgtatgatcaagtgaagaagtcctgggccaagcagtctgtggctcttgatgtgctatcataccatgcaacatgttcaaaagctgaagttgacaagtttaaggcagccaacatccctctggtgtcagaacttgccatcgatgacattcattttgatgacttttctctcgacgttgatgccatgatcacagctgctctccggatgttcatggagctggggatggtacagaaatttaaaattgactatgagacactgtgtaggtggcttttgacagtgaggaaaaactatcggatggttctataccacaactggagacatgccttcaacgtgtgtcagctgatgttcgcgatgttaaccactgctgggtttcaagacattctgaccgaggtggaaattttagcggtgattgtgggatgcctgtgtcatgacctcgaccacaggggaaccaacaatgccttccaagctaagagtggctctgccctggcccaactctatggaacctctgctaccttggagcatcaccatttcaaccacgccgtgatgatccttcaaagtgagggtcacaatatctttgctaacctgtcctccaaggaatatagtgaccttatgcagcttttgaagcagtcaatattggcaacagacctcacgctgtactttgagaggagaactgaattctttgaacttgtcagtaaaggagaatacgattggaacatcaaaaaccatcgtgatatatttcgatcaatgttaatgacagcctgtgaccttggagccgtgaccaaaccgtgggagatctccagacaggtggcagaacttgtaaccagtgagttcttcgaacaaggagatcgggagagattagagctcaaactcactccttcagcaatttttgatcggaaccggaaggatgaactgcctcggttgcaactggagtggattgatagcatctgcatgcctttgtatcaggcactggtgaaggtcaacgtgaaactgaagccgatgctagattcagtagctacaaacagaagtaagtgggaagagctacaccaaaaacgactgctggcctcaactgcctcatcctcctcccctgccagtgttatggtagccaaggaagacaggaactaaacctccagctcagaaagacctaacatctcaaggatgcactgggaaccatgcctgggctttcaccttgaagcatggtcagcagcagagagagcaacgggaaggacaaagaaagaggtggggcagggagcacaccccaggaccctcacttttccctaatgaacacgcatgggctgaaatgaaggctctgggtaggggactgttttggatccaaggacctgtggacagtcggcctacttactctgagctgagggaacactgaacagtaaaagcgtcattagcgctg

SEQ ID NO: 269644 - DNA, 851 bp, Homo sapiens
gtcgacccacgcgtccgcggacgcgtgggcgcgcgtccggctgcgcttgcagcccagggcgtgaggtgctctttctggatcgccagcctcgaagttgaggcgtggactctggccaggtggctgttccagagcaacatgggagatgctgaagcaggcaagaagacctttattcagaaatgtgctcagtgccacacagtggaaaaaggtgaaaatcacaagactggtccaaatctctggggcctctttggctgaaaaacaggaaaagcaccaggattttcttatacagaggcaaacaaaaacaaaggatcgacgattcaatgatgaaatcgacaagctaactggatacaagacaaaatcattattgtgcatgcctatccgaagcagtgatggtgagattattggtgtggcccaagcgataaataagattcctgaaggagctccatttactgaagatgatgaaaaagttatgcagatgtatcttccattttgtggaatcgccatatctaacgctcagctctttgctgcctcaaggaaagaatatgaaagaagcagaagttatgtaagggatgtgtattagtgaaaatgtctcaagtttgaccaagaacctgtttcttcctgatagtgaggaaaagctgctttgctttgctagaggtggttaatgacctctttgaagaacagactgacctggagaaaattgtcaagaaaataatgcatcgggcccaaactctgctgaaatgtgaacgctgttctgttttactcctagaggacatcgaatcaccagtaagttatcttttatcttttaaagttgaagactgtgtgaatggaataaagttgagtttatttataattaa

SEQ ID NO: 269645 - DNA, 435 bp, Homo sapiens
acacatcttaatttttaccctcttctcttttttttttcaggaaccttattacccggttttctttaaatcaaataattaggggttgaaataatcaaataattagaggttgaaagtgcaccaacatattaggtgcattttatggcccaggaagtgcattggcattttatatacaatgcagttcaatttcaaaaatcctatttattaggtgttactaggtgatatgatcgtcttagagatgaagaatccagcccaagaagatgaaattgcccaagtcacagatttgtaaggcacagaggtgtcatgtaaaccttggctattttgaattcaatcctttctttctccttccctttctgccattaccctgggccattttccctagactgagttttaaaatttttggttggattgtaggttttttgtgtttggaagggtttc

SEQ ID NO: 269646 - DNA, 349 bp, Homo sapiens
ggagacagagtctcactctgttgccaggctggagtacagtggcgtgatctcagctcactgcaacctccacttcccgggttgaagtgattctcctgcctcagcctcccgagtagctgggatcacagacacatgccaccatgtctagctcattttttgtattttttttttttttagtggagatggggtttcaccttggccaggctagtctcaaattcctgacctcaggtgatccacctgcctcagcctcccaaagtgccgagaatacaggcatgagccaccatgcccagccttaatcttttattaacatatcccatgagaaaattggatatacttcttataaatcaagggc

SEQ ID NO: 269647 - DNA, 3267 bp, Homo sapiens
taatgaggaatcaaaggaagaagaagaaagagagaggaaggaaggttggaaggaaggaaggagggaaaattagaaggggaaaccatgattgctggtgaggttttgagcacattttcctgcaggctggtatgggtgagaggtttggtcttgtttgcaaatcttctgaaggccattccagaggagcagttgccactgccccatcccctgagctctgagcatgggggttcccctggggagactcctggtgagaggatgccgatttctgctgatctgtcactgggtaccgaggactgggtgtgtttaaggcagacagccaggtgaggatcccagctactggggcctgctgtcatctcctgggagtacccgggggtcaggagcctaggggactcttgcacttcacatccagccatgctaattacactttttggcaaaggaaacagctaggagcagtttctttcactcctacagccccgttttctcagtgtttagacctcgaattattactgggctagagggaaggcagcctctgaagtgtggcaggaggaggggaagtctgcctgcatcttggtgtgtctgtcagatgccagcactaataacctggcttctgtgaggcctgtcagtgctctcaggaatgaaaggggacccctgagaggtgctcagtaccagcaggctgtgaatgctctctacccaccaccctcacctcctcgttaaagatggtgctacctgccacacagcagacatctggtcgctgcacacccgaaagaccccaaggcagtctgccccttgtccagccacacgccagcacccaccctcctggcccctgcctcggcctccccagaccagctgcacccagcccccaacacgcaccccttctccagatgtgtgcagggcctcattttgcagagcaaagacagatgtttcagccacacgctttattaacttctaaaacctgtgctcaggacactcttcaacagtcatgaaaagtttgatcacttgccacagtcaggacctttgtgtggggctctgatctgatgttcggtctcatcatctcccaaaccagcagtcgtttgtaccccaaccctctgctcaggggctcatacccccaaatgattttcctgatttatgtatttccctacaaagggctttctatacctagcatctgcctccagcatgagaagggggaataggtgagacccatttgccagtagcagacggggaccctggggagaaaatggcagagcctgttggagactccctgtctccagctgaccagccaatgggattcctcttccctccactgtctcccacaaagtagaagaatcctggtacatttagcccatgagcctggcacagatccctatctagacatgaggccctttagacatgactttggcattgaccagcctgttggcaatgggtcggggaggcagaggggatgctcacaccagtaattctcatcccctgaatgcttgggatcacctggggagagttcacaaaatactggtgcaggggtcccacctctgatgatgctgagtggtgggtctggggtgtggcccaggcatcatgatgtttcaggcccccaggtgacttcttaggcagcccagctaagcccctagagccttgcaatttcccccaaatgacctcagagggcccgatttgagggaaatgcctaacttcaggggccgtaagaatcccccagggagcatgtgaaatgcagataccaggcccacccccagagatgagctgaggtgggtcaggggtgaagtgcagggatcagtgtttttcacaagctccatacctccaggaaatggtgttgtggttgggcccgtagaaaacattctgagagtcctgttgcctgtgccttggtgcacgtggggtggaatcccagtggccctgccttgaggaggatgtgcattaacgtggtaggggagacagagacagctccacctgccccctgtcccaccggggacctccaaaaacttcatggatgttagagcaagcagccatgctgcagcagaggatgaggctggcggatttagtaagagccctctgtgtttgggctgagttctttctctagttgccctgtcatctggcctctggataacccacctctcctccctcatcctaaaattacagatggcgaaagacggccacatttagtgagacccctaaggtcctccaactagggtgggtccacagtggcccctggtgcatggaccacacactctcttccctcctctggctcaggactacggtctgaaattagggagatatgaatgtctttcttgaaaacttctcttcccagtcttcccactttgcttgggggtccttggtcaaggccagctttggggactagggcttgttgcgactaccagctgtctcattttgctgtactgcaaactcaggcttggttccaagcttatgggggccctgtccttcccctagtagggtttgttttggggtcacatctggtcatacccttcagagagctcttccccagcctctacatcagggagagaggtaggtagggaggagcattcaaggattagaagaaggactaaagtacaacagccttggaggaactgccaggaactaagggcgagcactggagaaggcaacctgggaccccctgcgcttctgagcaggaagaccaagaccttcaggggccctaagcactgaaaacatcattcctcatccccaagccctggcatccccctgttcttctaaaataattcttttctaggtatttctgattgcaaaattctggatgggttcatccaagctgacctttgctgttttttcccttcccaacaaggcctcactttttggagccaccttagctggtgcctaggcagaggggcagtcagcagtggttatcaggatcctggctctatgggttgccttcctcctggtctgtaaagcccctgcaggcagggacttcttagatagctgcttccttagggcatggcatgtagtgggtggttaatgaatggaagagagggaatgagtgatcaagggagggaggagggagtggagtggagatttctcatcctttcctgttaatttatgacatcctcctgcctatgagtccttgactctggagttttacaaagcagtcacatttcaaataaaagtctgggaaagcaacacatcatcgccaacttttaattttgctaaataaggatattagaaaaagaatagaaaattgcagtcccttactgtttaaagaaaaaccaaaagaagttaaaaaaaaaaaaaaacaacctc

SEQ ID NO: 269648 - DNA, 374 bp, Homo sapiens
cgccatggccatctcctgctcgaagtccagggcaacatagcacagcttctctttgatgtcacgcacgatttcccgctcggccatggtggtgaacctatagccacgctcggtgaggatcttcatgaggtagtcagtcagttcccgcccagccaggtctaggcgcagggtggcatgggggagggcattcccatcatagatgggcacagtgtgggtgaccccgtcaccagagtccatcacgatgccagtagtacggccagaggtgtacagggacagcatggcctggatggccacgtacatggctggggtgttgaaggtctcaaacatgatctgggtcatcttctcgcggttggccttggggttcaggggggcctcgg

SEQ ID NO: 269649 - DNA, 151 bp, Homo sapiens
  misc_feature (40)..(40): n is a, c, g, or t
atccataccgaggcaacagagagaagatgactcagattantgtttgagaccttcaacaccccggccacgtacatggctggggtgttgaaggtctcaaacatgatctgggtcatcttctcgcggttggccttggggttcaggggggcctcgg

SEQ ID NO: 269650 - DNA, 441 bp, Homo sapiens
tagtgaaagagaattaactataggtgtatgcagtaagactgaagaaagtaatataatgtcaagtgaagaaggcaaattgcagaagtctatatgaagtatgccttttttttgtatgaaactcacaagtgagcgaaactaaatgataaatagtttaagggtgctgccaagtgtgcaaactattcaaaaacaagggaacggtaaaagcaaatttcagaatgtcggttatctcttgtgggacagtagagaggaaacaggtagtttcagtgggttcataagtcagatggtgtgtttacaagtgttcattttattatgcttcataacacagtatgtatgttagatattcttcataagaaaaaagaatacagaccaagcatggtggctcatgagctcatgctcatggtggttcttatattgagaaccctgtctttacaaaaacaacta

SEQ ID NO: 269651 - DNA, 374 bp, Homo sapiens
cttgaggtcctaaatgcagaagggaaaaagcaacttttgtcagatgcctacttcactttcattcatctctaatattttggatggggaatcatccaaagcttctgagtgcatgaaggtcaagtgtgccagtgtgcagctgggcttcttttccagaattaaaagtattttgggtggtgctgaaggtcagcggaagaagtaaagattgcaagaaaggagaaacatgggcttggggagatcccagaattggggacagaagacctggcactaggctacagcacttagcacctctgatcttgtttttcctcacctgtaaaaggagattaacaatgcttttctgcccgcctcttggggagaagggaagaatataattggta

SEQ ID NO: 269652 - DNA, 1174 bp, Homo sapiens
  misc_feature (381)..(381): n is a, c, g, or t
  misc_feature (399)..(399): n is a, c, g, or t
  misc_feature (440)..(440): n is a, c, g, or t
  misc_feature (443)..(443): n is a, c, g, or t
  misc_feature (459)..(459): n is a, c, g, or t
  misc_feature (472)..(472): n is a, c, g, or t
aaaaaatgaagacaagattatataaaagtcatggaaaaagcaacaagactaaaaaatgtattatggaagtaagcagaaatacttgcctaaatggaaaaccaaactgggaagtcaaataatttgtctctaagacttgcctaaacttgctttggtaaaacttacagtcctatggccaaagctaagtcagatctgccctagagcctttgaaggtaaaaataagatactggttaccactgaaatcgtcaaatttattaggactaaccacattctaacaataaacttaaatgagagttcaaggtatttaaactctcattaatttagaagttaatcaaattaatgaatccgattgatctgattcagacctatactttgatccaaggnctgcacagatatctatcnatctatgctgaggagcaagagaaaggatttggaaggcaggnagnctgatggtcaaactgnaggccagctactntgttaactatgggatcatgaggcaattaatcagctctaatccatagttgtttatttaacagtaggttataggaacacagatgttatgatggctttatgagatgataaatgcatagaacatattaggatgtctagcccagaatacaacactcaacagatattagtttcttccatctatattttcttagttaacataattttttaaatctatgaaatcttacctgactgcagattcatcaggaattccaacatctattaaagaaaaaggtaaaatgcattttaaatcaataataaatgtacagaatattaaaatcataagaatgcacagtgatgcatgcctctaatccaaactacttgagaggatgaggcaggaggatcactttagtagcccagaagtttgagaccagcttgggaaacatagtaagactctaccttcataaaaaaattgtgcacacttgtgtgtatgctttagatcctgtttgttgttgttgttgttgttgttgttgttgttgttgttttggtttggtttggttttttaaagcataagactgacgctttgttacaaagcattcctttgggagcatgcctgggatcttattagaattaacattcattatacgtattggtaggtaattaatgcagtaagaactcttccctctgtgtttattagatgcaaagaagaataaatttattaaaatttggt

SEQ ID NO: 269653 - DNA, 1259 bp, Homo sapiens
  misc_feature (381)..(381): n is a, c, g, or t
  misc_feature (399)..(399): n is a, c, g, or t
  misc_feature (440)..(440): n is a, c, g, or t
  misc_feature (443)..(443): n is a, c, g, or t
  misc_feature (459)..(459): n is a, c, g, or t
  misc_feature (472)..(472): n is a, c, g, or t
aaaaaatgaagacaagattatataaaagtcatggaaaaagcaacaagactaaaaaatgtattatggaagtaagcagaaatacttgcctaaatggaaaaccaaactgggaagtcaaataatttgtctctaagacttgcctaaacttgctttggtaaaacttacagtcctatggccaaagctaagtcagatctgccctagagcctttgaaggtaaaaataagatactggttaccactgaaatcgtcaaatttattaggactaaccacattctaacaataaacttaaatgagagttcaaggtatttaaactctcattaatttagaagttaatcaaattaatgaatccgattgatctgattcagacctatactttgatccaaggnctgcacagatatctatcnatctatgctgaggagcaagagaaaggatttggaaggcaggnagnctgatggtcaaactgnaggccagctactntgttaactatgggatcatgaggcaattaatcagctctaatccatagttgtttatttaacagtaggttataggaacacagatgttatgatggctttatgagatgataaatgcatagaacatattaggatgtctagcccagaatacaacactcaacagatattagtttcttccatctatattttcttagttaacataattttttaaatctatgaaatcttacctgactgcagattcatcaggaattccaacatctattaaagaaaaaggtaaaatgcattttaaatcaataataaatgtacagaatattaaaatcataagaatgcacagtgatgcatgcctctaatccaaactacttgagaggatgaggcaggaggatcactttagtagcccagaagtttgagaccagcttgggaaacatagtaagactctaccttcataaaaaaattgtgcacacttgtgtgtatgctttagatcctgtttgttgttgttgttgttgttgttgttgttgttgttgttttggtttggtttggttttttaaagcataagactgacgctttgttacaaagcattcctttgggagcatgcctgggatcttattagaattaacattcattatacgtattggtaggtaattaatgcagtaagaactcttccctctgtgtttattagatgcaaagaagaataaatttattaaaatttggtatctacaagtgaactgcagtatacaagtcatcctagccaaagcctatgagattgagtaaaaatggtattgttagcagaacaggtg

SEQ ID NO: 269654 - DNA, 401 bp, Homo sapiens
agccactgtgcctggccccaaaattgattgtttagaagtaattttatgctagttcaatttcgctataattgattttctttataatgccttgtattttatgcatttaaaacattctgagaagagatgtatggggagaagaggtatctggttttgagaatacatctgtgtataatgaatggcaaatagctgttaagaatggcatatacaaatatgaatgtataggaaaattgaaaggattttagagaaaagggaacagagtagctgaaactttttttttttgtttatgtgttctttttttttttttgagacagagtctcgctttgtcatccaggctggagtgcaatggcgagatctcagctcatggcaacctctgctgcctgggttcaagcaattctcctgtc

SEQ ID NO: 269655 - DNA, 341 bp, Homo sapiens
tggaaagcataaagtggatgaaaatgaaaatagatgttgaaagcagaatcctaagaatgaactgaagtggaaacccattatatcttccctccttcaataacatcttttttctgaatgagagaatataagtagaaaaggagaaataagctatcacaaatgaatgtccgtcagtataaagtcatagcacctttcaaccaaggaagaaccccctataagtagcttctgcattggacaattgctactccaatatacaaatacaattattgtgccatagtcccctagcagttgaataatctctttgaattcatctaagaaacctaacctaatttcttctttttata

SEQ ID NO: 269656 - DNA, 239 bp, Homo sapiens
atctgggccttcgcagcccggctagggagcgtggacgagtctccgggacatcctgcgcgaagggtccttctgtgcgtgctgcgcgggcgctaacgaggccagccagagtcaccagggatgaaggctatagggcccggttttaactcattcggttcctggccattgactgtccttttttcagttctggggcctcatcccttcccaaactgagaaaataaaatacagcccaacacccaaaa

SEQ ID NO: 269657 - DNA, 618 bp, Homo sapiens
cgcttgttagtttgtggctatggaataaacacctctgagccaggtagccaaaaccaagtttgattccaagttctatccagtgatcttaggctatcatttaacctctctgaagctccatttccccatctgtaaaatagaactgactatagcagctacctcacaggattgttgtaaaacccaaatgagataacatgttcaagcattttgtgaactgtaaagtagtatataagtatacaatattattatttatgataataaatctgtacaataatagaaagattatagatttctcctattatctattatagattaaagattatatggtgaactaattttaaaatttataaagagctaccgaattaactttaaaatttagaaaacttgttgagtatgtataatgaccctttgaaggggaggggctaatactaggttcataacttaacgtaaattacaatgaacaatccaaggaattagattatttcccgtcccagccagctttgtaaaggcacaacacgtgttgcagtgatcacttaaatttgtacctaacttgtgcaagctacccctggtggtggaatgctgcccttctcagagtgaggctgaatgtgggcctaaagtatc

SEQ ID NO: 269658 - DNA, 430 bp, Homo sapiens
gagcccagcaactctgtccctgggtttctccttttctaggtggccaacagtttgttggggcagatttgagtccctgatgtatccctagctgcaccatggaaaacagcacatccattttgtaagagtatccaccacaggcatttaatggaaataaaccattctgacagcccaaaagggtgcttcagtcgattgtggaagcttgaaacaaagcaggaagaattgtttaggcacagcacacccaatgagaatggaaccaaccaacacttctagttctttttcaacctgcgtaccagtgtctagggctaaagaagatgaggacagccaaccattccaaggatagaagcctgaattaaccaagataattggcaaagggtcacagaaaatgtccttttaaaaataataatgcttactctttttcttaactgtccca

SEQ ID NO: 269659 - DNA, 779 bp, Homo sapiens
catcctggtggcattttgctaatgccccattgtcagcgttggcactcccacccaggcttccaggctcatctgctctcccatatttggggtgaaaggaaagtaggtggggcaggcccgggagacaggcacgaaatgggggtcgcaggaggtggcacacacctccgtcaacagtcagctccttctgcccaggctggaaatggttttaacaggcggtaaaatttcatcttgcggtgtcaaattggggtcattttggggttagagttctcagtgtccgagaggagctgtccagctgcgtggggactcattaactgcaaaagatctgtttcagtaaaaacaattcaaagacaatcagaaggctaaagaccctctacaaatcgcattttacaagtgccccagaacaaatatggatggtgaaacctatttcttcagaatcccaaatcagctacttagctctggagtgggggtgggggtactgcataaaaaagaggtgaaaaggaggggaccaagcgggtggggaccagtggaagggggaatcgggcctctcaaatttaagagtctgtttttaatcacctctttcttattgaagcagccccaagagttctgaaaactgctacttttctatttttcattttctttttttgagccaacatggaatgctattataggtaacatttaagatttaaaaggaataattgaattccactatagtcccttaatttgaagggcattggctttatggggagtgtttaatttgaaccaagaatttatgaacccagact

SEQ ID NO: 269660 - DNA, 398 bp, Homo sapiens
acaaaaacgtcaacattattacttagctttttactgatagaagctgggttagagaacacagcttaggcttgtgggaaagtgggtttattatttcacccttaaatgagagactcccggacagtcatggtggctcacacctgtaatcccagcactttgggaagacaaggtgggcagatcacttgaggtcaggagtttgagaccagcctggccaacatggtgaaaccctgtcactagtaaaaacacaaaaactagccaggcatggtggtgtgtgcctgtactcccagctacttgggaggctgaggcaggataatcgcttgaacctgggaggcagaggttgcagtgagccaagatcacaccactgcacttcagcctgggccacagagtgagactctgtctca

SEQ ID NO: 269661 - DNA, 345 bp, Homo sapiens
aattcccctctcgacattgacattggcaaaaacaaaaaatttggtcaagtttccaaaaataattgtaagaaaaacaaaaattgacaagattgacctaaaatggacaaaaaaatgacctaaaattgacccaattaaactaaagagcttctgcactgcacagtaaaagaaacagagtaaacagacgacctacagaatgggaaaaaacattggcaaactatgtatccaacaaaggcccaatatccagaatctattaagaacttaacaagcaaaatccaaaacaccccattaaaaatgggcaaatgacatgaacagacatttctcaaaaaaagacatataagtggccaa

SEQ ID NO: 269662 - DNA, 389 bp, Homo sapiens
agtgatgtctactcctgtgcacatgtacacaacacaatcttgctctttctctcatacacacacacacacacacacccccaaagaacacacacattgggctaacttctaccctccttcagctactagcttaaatgttgattctatgaagagacctcccctggtcacctgagaaagccttaccctctattcatgttgccttcacactctgcacatctcctattgcctttactgcaactctaattgaaaagacaaagatgaaattcaagttacccccattcaatttgcaaaaattaagaagtctggcaacagcaagtattggagagaatgtgggtcaaccattctaccatacattgttggtgggagtgtaatttgtcacaaccgttctgaaa

SEQ ID NO: 269663 - DNA, 317 bp, Homo sapiens
gcttaaaaaataacagagtttgaagacttacattataatcaaataaacacaaatgaaactccaaaaataaatccatttagatatattgttcaagcaatccaatgggagaaaagagtctttcagcaaatagttctgcaataactagatatccataagtaaaaattggatttggcttcaactcatacaataaatggattttaatttgaccagattaatagaactaaatacaaaaaccaaagagataaagcttctagaagaaaacacaggacaatatcatcatgacatgggagtagccaaaggtttcttaggacacaggc

SEQ ID NO: 269664 - DNA, 704 bp, Homo sapiens
aattgactccgtcaccaaagaaagcaccagaaaacgtgagtcccgtttgacagacttctttccttttcagaactgtgtcctacaaaccaaacaaatctcccccaattgttaaagccatatgcattttgaaggaaatgtaatccatatgttcctgagtcacttatgcctaagtcattaaaaagttattttttaaatgtgatttcatgtttgaagtcattttagagtatttttagtagactctcattcttcataatgctaaatttttcttggtttgttttcttgttttatttaaacacactgtatatcatcttaacacatcctgtggcgaggcacaaagggaatcttgaactcagaaggagggtctggtgtactggaataacacatttgaggcagtttctattttcagaagtttacaactgtccccccccccttaattttttattttatgtcctgggctgcttttaacctggtcacatcgtcatcccagccctctccccccgcattccttaaatggttgtccatgaagaagaaaagggaaaagagaaaaatgacaaagaataaaatcacatggcctcctaggatatacttctgcactgtgctatgtgatcctttcttcccagaattgaatgtattttccccttttacctactattgttgctagctgggagaattaaggtgtttcttaaagtgccaacaaaagagag

SEQ ID NO: 269665 - DNA, 567 bp, Homo sapiens
agggcaggctagaaagaagtagacaattgaatcgatgttgaaaatatagaatgtacaggctctggtgattggttggatggtgagtgggagagaggaaggggaccaaggtgcttccctggggtctagtttagatgggttgagggcggggcaatcagagaaagactagttgtagagagagggagcaggaaaagggaaatagagctagaaagttaattagaaccatgctgtgaggatactgaatgccaaggtcaagactgtattgaaaaacctgagccgaggctgggcacagtggctcacgcctgtaatcccaggactttgggaggccaaggtgggtggatcacaaggtcaaagagatcgagaccagcttggccaacaatggtgaaaccctgtctctactaaaaatacaaaaattagctgggcgtggtggcatgcgcctatagtcccagctacttgggaggctgaggcaggagaatctcttgaacccagaaggtagaggttgcagtggcctgagatcgtgctactgtactccagcctgtcaacagagcgagacaccctctcaaaaaaaaa

SEQ ID NO: 269666 - DNA, 378 bp, Homo sapiens
tttctctgtgcattgtttatgaatcttttctgttctccaagttttgtatcaactagaaaagccttcctcattgttcctcattgctcagctgtatttgggaaaaaaacccttacattttctgtttaatacttaattgtttttattttttacttttactgctgcaactagctggattctttttgctattgttgtaaagccttagccagagatctgtcttaatttttcttcaagatgcctacacatttgtcccaataccatttattgaataatctatattttccccactaacatgcaatactacattagcatatacaggcataccttggagatattgcgggttcgattccagaccactgcaataaagcgagtatctcagta

SEQ ID NO: 269667 - DNA, 424 bp, Homo sapiens
ctgagacttaggttcaagtgcatgagtcacaatctcaacagtggattgcatcctgccatgagagccccaatcccttctccaagctgtgttccagtagaggagtcgcaacatcaatggtgtgctgaatcctggttggagagttcccacttcacctgtggactggatctgtatataagaggagagatgtcgactctcatgcctgggcttagggcaatgggcatgatcctacatttgggattgtagcaacaactcttgactgcccctgggtgtgagattcagaacctcaattgtgacctgtgtacacttgggcatgtgacaatttctacttttggctgtgtgttcatacaagactctcaatctcacctgtgttctgggccctgttattaaactctctgtaccacccacggggtttattcaatatgca

SEQ ID NO: 269668 - DNA, 401 bp, Homo sapiens
ccataaaaaaatgatgagttcatgtcctttgcagggatatggatgaagctggaaaccagcattctcagcaaactatcgcaaggacaaaaaaccaaacaccgcatgttctcactcataggtgggaattgaacaatgagaacacatggacacgggaaggggaacatcacacaccggggcctgttgtggggtggggggaggggggagggatggcattaggagatataactaatgttaaatgacgagttaatgggtgcagcataccaacatggcacatgtatatatatgtaacaaacctgcacgttgtgtacatgtaccctaaaacttaaagtataaaaaaaaattgggggttgtgattttaacttacatttctttgtaaccataaagatgctttaaagattgga

SEQ ID NO: 269669 - DNA, 100 bp, Homo sapiens
cagaaaggtagactagatgacttctggtcatcctcccaggtctgtttccatgaatcttgattctggggtttcttctaagtcctcatgctaaactcctctg

SEQ ID NO: 269670 - DNA, 380 bp, Homo sapiens
cggggccagtgcttagaggaccctcaggctctggcttgttgagggtcccagggagaaggccagcggaagagggcgtcttcatgcgatgggttgaggagtgacttttcctttctgattttttacatttttcagattttctctaatgaactggtttgactgtctttttttttttttttttttttttaatttttttattgatcattcttgggtgttgtcttaaaagagccatttatttcatagcaaaacagttcttgtgcactcagggcatggtgaggggcctcatttgtcttttttttttttataatttgaaaaaaagtcatccacagctctatcacccacctacaatagtcctttcctaatttcttgctataagcacactt

SEQ ID NO: 269671 - DNA, 526 bp, Homo sapiens
agattttgagcaggttgagaactttaagctggcagtttttaatagttgtaggtctttgcttgaatagaaggtaaccctggtttaatgtttttttgtatgtctgcagtcgtcattaattgcagtggttatcaaagtgtggtctgcagacctcaggtcattcctaagaccctttcacagagttgcaaggtgaaaactattttcataataatactgagatggctattctcatgatttatctgcccttaaataggaacagtagcatacccagtgccctagcatagtaatttattctcctccttctcttcttctcttcttccttttctctgtacttctaccttcctcctttctcttctccaacatgcccatgcacttgtttcttcatttatacaatgaggtttctaatacagtgaggtcattggattgttttgaagattaaatgtgttaacatcataagtaacgcataaagtccttaaaatggcacttgacacatagtaaatgctcaataaatgctactaatgttaaccat

SEQ ID NO: 269672 - DNA, 473 bp, Homo sapiens
ggcctggggaagaggaggtgctgcccatcctccttctcaggaggatctgagcactttggaagcctctgactgtcaccaatgtgcccggtgaggtccagatcattaacagctgtccccaatatcccagcttttaagtcactgctctggaactgcattctttacattgattaaaggaggcttaatgaatcttggccaggcacggtggctcatgcctgtaagcccagaagtttgggaggccgaggcgggcagatcacctgaggtcaggagttcgagaccagcctggccaacatggtaaaatcccgtctctactaaaaatccaaaaattagccgggtatgctggcaggcacctgtaatcccagctacttgggaggctgaggcaaaagaatcacgtgaatctgggaggtggaggttgcagtgagctgaggttgtacccctgcactccaacctggtgacagagcaagactctgtcttta

SEQ ID NO: 269673 - DNA, 433 bp, Homo sapiens
tctgagatggagtctcactctgttgcccaggctggagtgcaatataccacgatctccactcactgcaacctttgcctcctgggttcaagcaatcctctcaccacagactcctgagtagctggaattacaggtgtgtgccaccatgcccagctattttttgtatttttactagagatggaatttcaccatgttggccaggctggtctcgaaatcctgacctcaagtgatctgcccgcctcgtcctcccaaaatgctgagattacaggcaggagccaccgcgcccagcccagttttcttatttaattcaatgaattctctctattcaaagaacaatatccagttgctgctgttgtggttacttaaatttccacgtgcaaaacaaaacaaatgaacacccaactagtctgcactgcagccagtgaatcaaagcatg

SEQ ID NO: 269674 - DNA, 267 bp, Homo sapiens
ggaaaacaagctttttgtttgtttgtttattttttatttttgtggagacagggtctcgccatgttgcccaggcgggtctcaccatgttgcccaggctggtctccgactcctgggctcaagagatccatccgcctcggtctccccaggtgctgggttacaggcgtgagccaatgctcccagccaaaaacaagcattttgtgtcacactaggcactttcacctattttccacttaatgcttacaacaatcttgtgagtagttattacca

SEQ ID NO: 269675 - DNA, 510 bp, Homo sapiens
tagtttttaagacttggagacaaactgacgaacatacaaatattttgctgtttatcaagatctcttagaattttgtatgtattttatttttagacactacataaataagtaaggcacatttccctctttacatcttccatagcaccgagtttttgtgtcttgctttagccctggaaacctggcgtccagcccagtgctggtggggccctcaccatggccttccatcagcagaggcagtttctccaagtgagtccaggtctcaaccagtgacttgttcccatccacatcacctagcacagcccttctctgtggcagagaactgaaggaactcaagtgtccttaatttccaatccctcacagattggtacttctgagaatataaataatattcattattaaaaaaaacatgaagagatatacagtacaacattttaaaacctcaatttttattgttagatttaacagacgtaaacttccatttctttaaatataatcacaataaacatagga

SEQ ID NO: 269676 - DNA, 430 bp, Homo sapiens
gaaagtagctctatcaggttttcaaatcttttttaatctgcaaagattaagaatatgcaaggattgccatacagattacaattaaggaagtatcacaggtcagttgagggaaaaaaaatttatttaactgatcataggggaaaattgactagctccttgtgaaaaacaaaacaaaataaagtttcctgtatgttttcaattcacactgaacacagaaataaattcttcatagattttaaagataaggtaaaagataaaaccattacaacctggaagagaatgtatttaacatatgtaagtgaatgctaaccagtctcagaacttactaagcataaaagcaaaggaatacttcaaaaagaaaaacactcagtagattagactatataaaagttaaagacacgctcaccgtaagtaccataaacaaacaata

SEQ ID NO: 269677 - DNA, 294 bp, Homo sapiens
aataatgatgaccaaactctatgaactgtctggattcctctctcagcacagcagtagttgtttgttgaagccagttttttatgtatttctgagaaagaaaattgagtaatttatctggttgctctcaatagagggataagagagggtttcatatgcagtatttatatacttgtcagtaacctcagaaacttttttttttttacagtagctttggctacttctgtctcccacctggggctgcagcttagcttcccaacttatgggagaaaaaatggcctaagttcacagcgctcc

SEQ ID NO: 269678 - DNA, 454 bp, Homo sapiens
atcgggtagcccgtccatagttggccagagcacaaattcacaaaagctttcatcatgggtttgtgctgcaaggatgttctctctctcctcgcctcatatgcagttttcaaaggcactgtgaggctgccttcaattatgcttgagaggaagacgcgctgttgggagcccgaaagagccaagaggcacacaatagagctctctggcgcctcgtttgggagatttaccagcgatcccttgaaaagggaaaagggattacagatgtgaaattagacacaaagattgaagaggggaccagctgtatttttggatattagagttactttggcacttttgggtggtttcctcgggaagtacagtggcagagtgtagctgaattattaatatttctgagactatatacaaggcttcttttaaaaaaacttttattatggaaaatctaaaacatatacaaaag

SEQ ID NO: 269679 - DNA, 230 bp, Homo sapiens
tataactagtttcatgagaacacttactaataaaaataaattcgtagacaacattgagtcaaatatagtaagaacaaaacaaccaaacttaaggaaagcatatcatttctttttgtaaatggatttgagacatcatttattgaaaaataacatagtaggaaggctttctttttcaatatcttcaaagttaattttttgaatctcatgatacagggctgactaatttctgg

SEQ ID NO: 269680 - DNA, 1029 bp, Homo sapiens
cagagactagagctgtgttctcacagggcccaccacccttccacctccttggccattgacacctgcgtccctggcccagctgctcccaggtaacccccaaagcagctggcacatcccacctctggtgtggccggggctgctgtgtgtccgcagggcctgccccgtctattctagcttgtttgtcctgtctgaaccagcgcctactccaagaagcctctgctcagcccagcggggatgcttctaagctccggacgagcctctcggaagccttggtgattggtggtgtagtcatcttgggatgcagatgtcttaccaacctgcaagaacaaaaaccctgtggcttcctctggtgcagggtatttagtcaatgtttgctgaggtcccgtctggttctggctaattggcaggggtcgtccacccattctttccctgctctgctgtctgtgccaggagagacgggggccagtcggccaaggggccagctcctgctgcctgctcctcttgggcacgtgcgggggccccctttctctgagcagggatagggatcagtctgccggagggatgtggtggacaggcctaaagcatttggggcggggcatgccacttgagctccctaaatctgtctcctcataggtgacaccgctccagggccccccagtggcctctcctttcagagctacctaaattctggtcacttcagagaaatggagcacccccttctccctggtccaggtgtggacagcctggcacactgagcacacctggcatggctggtaatttcagaaagaagaggggccggggtccagtgggaagcagcggtgaacccctcgtgagtgggctttgcagtccctccccatgccacggcagagctgccctcaacacagccttcctcttcctcatcggagagcacaccctgtccccttgccgagctgtgccctgtgccttcggtggtatttgattttggctgctactggctttgttgggatctggaagtcgcttcccctgcgtggtgcgtggagcactgtaagt

SEQ ID NO: 269681 - DNA, 752 bp, Homo sapiens
cagagactagagctgtgttctcacagggcccaccacccttccacctccttggccattgacacctgcgtccctggcccagctgctcccaggtaacccccaaagcagctggcacatcccacctctggtgtggccggggctgctgtgtgtccgcagggcctgccccgtctattctagcttgtttgtcctgtctgaaccagcgcctactccaagaagcctctgctcagcccagcggggatgcttctaagctccggacgagcctctcggaagccttggtgattggtggtgtagtcatcttgggatgcagatgtcttaccaacctgcaagaacaaaaaccctgtggcttcctctggtgcagggtgacaccgctccagggccccccagtggcctctcctttcagagctacctaaattctggtcacttcagagaaatggagcacccccttctccctggtccaggtgtggacagcctggcacactgagcacacctggcatggctggtaatttcagaaagaagaggggccggggtccagtgggaagcagcggtgaacccctcgtgagtgggctttgcagtccctccccatgccacggcagagctgccctcaacacagccttcctcttcctcatcggagagcacaccctgtccccttgccgagctgtgccctgtgccttcggtggtatttgattttggctgctactggctttgttgggatctggaagtcgcttcccctgcgtggtgcgtggagcactgtaagt

SEQ ID NO: 269682 - DNA, 721 bp, Homo sapiens
cagcgtgtgtgtgttggcctgcagctgtttctgccatttttaaatggctccagtcgggcaccgggcaccctgtgtaccaggggagctcccgagacaccgacgacttggatctcaactttggaaagcctccccttctcacggttctgaaaattctttgtcccactggagccaaacccagcccacggccgggcatccggccatcgcagccagccctttccataggaggccggggagcacgtggactttattgattttcctcttgccttttttgttgggtttgactcagaaaggacagctaacttgtgacaccgccacaccggaggctcgcccccagtggcttttagagaccgaggcgctactcgagaaacgacacccccaaacgtaaacatcccctgccacagggcctgcccagcttccaggctcgaaataaagggtcgagacgagcccgcgggcgctgacactcagagccagcgttgcggcggctcctctccctccgggaccccagtgaaggcgtgggaaaaaaataataaagttgaaatcaggcagcggggagttttcaacaactctgacccaacctggcgatctgcttgcgcctcgggcctggcccaggggccgattccgagcagaccccgacgaggccgcggaaaggttcgatccccttaatgtcgaccgggccacgccgggcggacgctaatgtgatcccgaaaaccacgcgcggccg

SEQ ID NO: 269683 - DNA, 459 bp, Homo sapiens
gccagtgctatctgtgaggctgctgacaaggaagagcctccctcacagaagaagcgagtggacacatggccagctggtcagccagggacaaatccgtgtcacaggacgacatggacgagattgaagtgtacggcagcgacgcccagtcgggcacacagctggccacctacctttgaggtgtgtgacagcatccttaacattggaccctgcaccaatgctgccatgggtgagcctgccttcctgtctgaagagtttcagaacaaccctgagccggacctggagattgtggtttgctccagccacaggaagaatggggctctgtcggtgctgcagaagagcatccagccccaggtggtgacaacctttgagcttcccggctgctacgacatgtggacagtcatcgccctggtgcctaaggaggagaaagagaatcccaagggggagggcacggagcaggaa

SEQ ID NO: 269684 - DNA, 679 bp, Homo sapiens
cccagctaactttgtatttttggtagagacagggtttcaccatgttggtcaggctggtctcgaactcctgacctcaggtgatccacctgcctcaacctcccaaagtgctgggattgcaggcatgagctactgcacccagccaccttgaactttcttttaccttaatcatgtgatgccaagagtttgtgttaaaggcattttttaaagatagataactctaaagtaggcacattatttatatcagaaaaagacttttttccagaataacattaattcattatgtttaccattttactcttgatagaactctagacataaaaatttttacaaaatgcatttaaatagttacaaaatgcattttaatgttatttttaaagtatggattagagtattaatatattagttattagggatttttttccctctattgctgtattcccagtacctagaagagtgcctagtatatttaatacttttttaaataaaagaatagaatcatgtttccagcctaggtttgaacctctccatcaccattttctagtctctgatcctcagttttctcatctgtataatggggttagtagtagaccacatttcataggttgttgtaatgttttcttgaaaaaactctttaataaccgttgggctcatttgacttgcctttagggggccggttcct

SEQ ID NO: 269685 - DNA, 888 bp, Homo sapiens
agtatatgcttaaacatcacacgattttataaagcaagaaaaatgaaatgatctccctattcccccacggtgtaggcctccagatccttttctggcttttaggcaggacaattaacaatgtggattctgcagtcagactgatggggtttccatgcatggcctcaccattaactcctcactggggagaccttgggcctcggttttttattcatagaatgcatgttgaataaaccatgtgggaaaaagcagagccagcaccagcccctgctgactcactgatccctcggaaaggtctgggatgagtcaagtcttcagggaataagcagcaaggacttggaattcctgagcaagccttgggttccccacgccctaggaagtccctctggaaggggagcaggacctctcccaccagatgacggagtttgctttctcgcccagcgcagctcccaccaggcgtgagctggcagtccagaagcggccccagatgtggctatccaccgcccagtctgcttccctgcctcaaaccccagggagacagaaattacctaaaaatgcatatcattgccttatgccaagatgattcaaataagcctgagaaagagaggccagcgctaaatacagacttggcagaactacttcacccagtaaacatctaatcagcacctgcaggatcctcattctgcccttctgggcagagcaccacgaactttccctgagttattttctaccaacaatttagaatgaattgctcgtgaagtagaaatgaggggaaaagcaactaatggtggtagaacaaagtaatttttacaattaaaagaagtagctgccagatgacagaacaaagtagaggacgagaaaataaatcattttcagggaaaaaataaaaaa

SEQ ID NO: 269686 - DNA, 392 bp, Homo sapiens
accataccctcaccccatgcctcctctagctgctctagttcacaatattctctctcttctctgaacttttacttcctgtagcaccgacagagccttgatatacttcctcctctcatgagttaatttccttgtgtgcctgtttgcctcaaaaccagataataggcccttggcccctctccctgtgtcatgcacagagtgggcattcagtgaatggttcttgatttgattatacattcatgacgtcaccgtaaagttagtctccctgggctacatatcaacatggaagaaaactgcagccccctgacctattagaaggatgtgacatctcacgggagtgctcagttgcccttcaaagacaggaaaataaatgtcagatttggttttgtttatct

SEQ ID NO: 269687 - DNA, 332 bp, Homo sapiens
acaaaagaaaataacagtaagattgaagacaaatcaatagaaatgatctaatctgatgaataaacaacaaaaaaagacaataaaaatgaacagagtcagggacctatggaacaatgtcaaaaggcacgatgtatgtgtaactgcattcccacaaagagaccaagagaaatttggacaaaaagcatttgaagaaacacaatgactgaaaactccccaaatctggtgacaaaaaggtacagattcaagaaggtaagtgaacttcagatgggataaattcaaagagaaccaggcctagacacatcataatcaaactgctgataaccaatgataaa

SEQ ID NO: 269688 - DNA, 463 bp, Homo sapiens
tggtatattatacaatgtatttggcaataaaaaggaagaagtactgatacatggcatagcatggatgaaccttgaaaacattatgctaagtgaaagtaggcagtcacaaaagaccacatagtttattatccaatttataataaatggacatatcaacaaatctatagagaaagtagattcgtggttgcatggggcttgcagaagggcaggaatgaaaaatggtaataggaaggttttctttaggggtgatgaaaatgtaaaattggatagtggtgatggttgcccacctccataaatattctaaaaaccattgaattgtgcactttacatgggtgaattataaggcatatgaattatatctcaataaagctgttaaagagaaataattatctacaataaaaataagaacaatgtgttacatggcttgtaacatatgtagaagtaaaatgtacaatgtggtggt

SEQ ID NO: 269689 - DNA, 413 bp, Homo sapiens
tttttcgtttaactgcaaggtacaggggatgaacatcaaggagccaccagagctgccattagcaagatgcttgcattgggccctaagtttcctcatctataagtagaggagattggaaagttatatttacggtgctgtctggctccagcatttcataagttcactggttttccaggctctggattcttaattattcatgctaatggagaaaagaagtgggagggtaattgaaattcacagataatccctcaaattgtctctgaatccttgcccaccaggccttcatcctttcatttcagttactgacaagtagatgtaattgactgatttgagcttgatcttccttctgatcttactcattctctggaggaaatgactaatgagcagaaaaattgccaaatgggggagggaga

SEQ ID NO: 269690 - DNA, 354 bp, Homo sapiens
ctcaaagacctatggtgttttgctgatttggggccattgcctcagtggatttctgttaccatccataactagagtttactggtgtttcctttctttctttgcggttgtctaggcctttgtgagtagcagtggcctgttgagtgcctaagagaatcagcacactacctgaccccctgtttgggagtatgtggcagaggctgtttatttcaggctttggcagtgataacccagtggccctgtgtgttctgggcagtggcagaaaggtagccctctaattccaggtcacatccccattctgcatttagtgacaaccttcctttcacatatccgtcttagaagtcttgtgttctcagc

SEQ ID NO: 269691 - DNA, 388 bp, Homo sapiens
aaaagtagtcgtaagaagttgtattattagacccaagtgacagatcaactcactgagaagtagattaagttgcccaatgtcccagggggaataaagagagttggcagttgagctcttgtccctcaattccaaattcagagtctttttcataccactctgccatcatgtcggtttcattttttcaggatgggttatgaaggacatgatacccattttcttggcagggagagagtgtggtttaagaaagtctttggtggcaggtgcctgtagtcccagctacttgggaggctgaggcaggagaatggtgtgaacccaggagggagagcttgcagtgagccaagatcatgccactgcactccagcctgggtgacagagcgagactccatct

SEQ ID NO: 269692 - DNA, 354 bp, Homo sapiens
gtcacacctctgcactccatccagcctgggcaacagaacgagattctatgtcaaaaaaaaaaaaaaaagctacattgagccaggcacagtggcccatgcctataatctcaacactttatcagtctaaggcaggagaatcccttcagtccaggaattcgagaccagcttggacaacatagtgagacccccatgactacaaaaaaattaaaaaatcagccagacatggtggcctacacctgtggtcccagctacttgcagccgtgcacggcaaggctgcagtgtgccatgtttgcaccactgcacttcagcctgggcaacagagcaagaccgttgctcaaaatttaaaaagacaaa

SEQ ID NO: 269693 - DNA, 470 bp, Homo sapiens
tctctattttgcacatcctactttgcagattattcatctgaataatgaggccacagatcacctaaagaatcttttcataatattgaatctatgaattgaactggaattctgctctaagaaatgacaactttgtatctcgtctcaggaaaagactattataacatcttataaaaatatttcatagcggctgggcgcggtggctcacgcctgcaatcccagcactttgggaggtcgaggagggctgatcacaagttcaggagatcaagaccatcctggctaacatggtgaaatcccatctctactaaaaatacaaaaaattagccaggcgtggtggcaggcacctgtagtcccagctacttgggaggctgaggcaggagaatggcgtgaacccaggaggtggagcttgcagtgagctgagactgtgccattgcactccagcctggttaacagtgcgagactctgtctcaaaa

SEQ ID NO: 269694 - DNA, 675 bp, Homo sapiens
tagctgggtgtggtggcacacacctgtggtcccagctacttgggaggctgaggtgggaggatgacttgagcccaggaggcagaggtgagtcatgcagtgagccgagaattgtaccactgtcctccagcctgggcgacagagccagaccctgtctcataacaaaacaaaacaaaaagaagtggttaaacttactgcttatagtagcaatattttatctcttactctaaaagcagcttgatgcccacgagggtctggaaatctgtatggtagagtacaaaatgatgactttgctatagagccaccagatcagaggaagtgagactatgtaaatgaaatccctaagtaggactcttcactgtaggtggatagcactgttttaccattttaagtcatataaatggccagaaatctgtgtcttctcttgggaagatgtttctggctgatgtctattaattataggtattttagttcctgaaattttgctttaataaattaatttccttcagtatagaaattgaaattctctagttgtaaaaggctatatctaatagcctcagaggtcacaattctgcacatgagaaactccaagacatgtgaagtaatttggtgggtgaagtagctgaacactaacaacactactaggttttatgggaagagacaaacctaaaggcattt

SEQ ID NO: 269695 - DNA, 362 bp, Homo sapiens
catgctggaaacgcagcaatggacaagacagccaggctctgcccccacaggactcagagtccagtggtggagtcagatccatcccaagataatgatgacagagggggcagcactgggatgggggaccccagagggctgtgggagcacaaaggaggaagcccgactcagcctgggagtcagggagggcttcctggaggagggggcacctgacctgagatccaaaggatgagtaggagtgagccagatggcacattagggagttgcatcccaggctaagggaccagcctctgcaaagaacctgagttgagagagaactttcattcgttcaataataaactcaatttcaggcacacctcatttta

SEQ ID NO: 269696 - DNA, 398 bp, Homo sapiens
gataacataagtagataacatgcaagaacagatggacagtgcaagcagagagatggaaatttttagaaagaatcaaaacgaaacactagagataaaaaaaactagcagaaacgaaaaatgtttttgatggactcaacctctgagcttgaggatatgccaacagaaacatccaaaactgaaggcacagagagaaagatgacctaaaaaatggaacagaatatacaagaagtgggcaactacagaagattaacatacttgtaaatgataataccagaaacagaagatgagaacaaaaatatttgaagcaattatgactgagaatttccccaaattaatgccagacactaaaccacagatccatgaagctcagaaaacaccaaacaggataaatgccaaaa

SEQ ID NO: 269697 - DNA, 346 bp, Homo sapiens
tataggatgtgggcacctagcttcaatctagccagacaatttttataaagtagtctactctttcgggctctttgtattagtatgttataatatagatatgttatacactatacaaattgcacttttggacggctatatacaacagaaaaaaaaaatttacttctcaaaatatcctttaaagtctaaatatttcttgtgttttttatgttattaaaaagtgcccttgggaaaaaaatattataaatttttaagtatagtatgctttattctatgttccttgagatcaattcctccttccttttcctcttttgccaattctaatgacatggactatacaaaggtgatg

SEQ ID NO: 269698 - DNA, 459 bp, Homo sapiens
tgagatgcagtcttgctctgttgccaggctggagtgcagtggcatgatctcagctcactgcaacctctgattcccgggttcaagtgattctcctgcctcagcctcccaagtagctgggattacaggcgcatgccgccacgcctggttaatttttgtatttttagtagagatggggtttcaccatgttggccaggatggcctcgatctcctgacctcgtgatccacccgcctctgcctcccaaagtgctgggattacaggcatgagccactgcgcccggcctaaaatctttaattttttaatatgatatgactaagacatgagctgtatttgaatcgagcattgtgtctagcacaaaataggtatgtgagagtgtttatcaactgaatgaaccttttagggtctgggtgaagtttaaatatatctgttcatcaaacaaaaggaaccagtttttaaaacat

SEQ ID NO: 269699 - DNA, 344 bp, Homo sapiens
aggattttctagatacacaatcatgcttcttgggagtaattatagttgttctaatctttatgcttttagttctttttattgtcttaatgcactggctaagacctctagtacatatagtacatctagaccatataagagcattgctttgttcctaattttagaggtgaaagtatttagtctttcaccatcacatgtgatgttagctgtaggttgaagtttttgctttgtggggtttttttgttttgagactgagttctactcttgttgcccaggctggagtgcagtgagccaagatcacatcactgcactccaacctgggtgacagagtgtctgaaaaaaaaaaa

SEQ ID NO: 269700 - DNA, 442 bp, Homo sapiens
cggcctgaggaacaggtgttgcactcagaaacactgaatatggggtcacaggatctgactttgagccttggctctgctatttatcagcaggatttgaagaaaatctctctgggcattggcatctcatctataaaagtggtttaagaatgattaccttggccaggagcagtggctcacacctgtaatcccagcactttgggaagccaaagccggcatatcacttgaggccaggagtttgagaccagcctggccaagatggcaaaaacccatctctactaaaaatataaaaattagcctggtgtggtgacgcatgcctgtaatcccagctatttgggaagctgaggcacgagaatagcttgcgcccagaaggcggaggttgcagtgagccgagaaagcgccactgcattgcagcctgggggacagagcgagactctgtcttaaa

SEQ ID NO: 269701 - DNA, 326 bp, Homo sapiens
ccacttagccatacatattactgggtttacggggagagtaagcagaggaaatgctgatagaaattaaaaatatgcagctgacatactggaacatacattatgttttttgttttgttttgttttgttctgagactgagtcttactctgtcacccagtaaatcataaacaaattcattaattgcagatttaaaagatgtattagccgggcacggtggctcacacctataatccagcactttgggaggccaaagcaggcaaatcacgtgaggccaggagtttgagaccagcctggtcaacatggcaaaaccctgtctctactaaaaaca

SEQ ID NO: 269702 - DNA, 517 bp, Homo sapiens
acagaaaaggaataaagcttgcctctttttttgaaaaacccagctggacaatgggcatattcaatggccaaggcctcctctaattgctggcttgggaagaactggagataactcagcaatggagagacaaggagggctcctagggaacaacttggagaccgaggaatcttgctgaatgccagcagaaaatctggaagcagagccagtataattcagcattactgagcccactgagctctccagggaagtataaattgagcacagaagctctgaaatggattgtaaccacaacatcagaggttataagaccctcattccagagtggtactgccctgcgtctgggaagaaggaaggccacacagagagaccaagaagaatcctaacagacagggcttgcttggtttccccctcagtctcttaccgttagatcagacctctttggtcctaccacgtttctacatggctgtccattcttcatcgaatctaagaataaaaattggttggtttcccctgaaaa

SEQ ID NO: 269703 - DNA, 482 bp, Homo sapiens
attcctgagaaaggggtctcaataaaatcttttccgcatatcatgcaaaaatcacaggagccctttgcacaatttattgcacagttacaacagtcagtgaggcatcagattcctcatactgctcctgcgaaaatgcttactttgaccctagcttttgaaaatgcaaatgcagattgtaaatgtgcattagcacccgtgagatgtacaaacagcttgggaaattttctcaaagcctgtcaggatgtgggaactgaactccatcgttcaactgtgttagctcaagtaatagctaatttagtagtgaacaaatctgaaaagggccaagggttgagccctaaagtgggaaaatgttataattgtggaaaaattggacatttcaaaaaagaataccatcagacctctgggcagaagggatcttacaatgcaataccgcccccccctccccgccccgctccccccaacacacacacacagaaaaaaaa

SEQ ID NO: 269704 - DNA, 679 bp, Homo sapiens
ctaagattaaaggcacagagtgggaggtgaggaggctaggaagttctagagggttcaaatcagaaatgctttgtcctgtaaatcgtgtggagctgtggaaaggctttaagcaggtgagtgatgtgattaggtttacgttcccgagaaatcattccatcacactgtggagaacggactggaaaaagatcttcgtggatgcagaagatgagcatagacactgttgctgtggcccgagcaggagagaatgaggcccagacccagggcagtagaggtggaggtgtagaggagggacacagtgagagagagagatggaggagactgaagaacactgagtgagtaaactggaagtggtggatgcaggagaccaggaggagccagggttgtccaggatttctggcagagctgacttggtgagtgagggcattattgactctgacagataaatgagaagaaaaccagcttctgaggggtagtggaagcagataggggcatgcggggcatgttgagatgtgttgggacatgctgcgattgaaggggcctgcggccatcaggtgaagtgtgtagccgacatttggaagtactggcctagagcttaggtgaaagcctggctgaataggtaaggtgccactggtgtcataggacgagaagcggcgaaggacgagaagcagcgaagggttac

SEQ ID NO: 269705 - DNA, 548 bp, Homo sapiens
  misc_feature (45)..(45): n is a, c, g, or t
agaccaactgtgttcaccctagagagaagcagagatgggggaganaatgaaaggagaatgtgaggttacagtcaccttcttaagaaccttttcatagacacatttctgttattgccaacaatgtccttaattacctagcattgctttgatcaagaaaaaaagtgatgtaaaactttatttatttatttacatatatatatatatattgagatggtgtctcaaaaagaaaaagaaaatgtggtatactttgcctcaaaaataaacacataaaataaaataataaataaataaataaaacagttgggatccacccaaatggagatttgcaaagtgggaaacataccctgtgataagcacgtaactagagataattccagaacttatgagaagagacaggaggctcttgggaataagaccatgaaacctgcaagcatcgagccaaaactctgaaaagttttcgacacagttccaagctaatagtgcatgcagagaaccgggctggaacatttaggaggggggtggagagtggagaagagaaagaaatgtta

SEQ ID NO: 269706 - DNA, 634 bp, Homo sapiens
tacaagataatatatgtgcttgctttcttcttgattttgaaggaagaggttgcatgttccatcatcaagtataaacataaggtgagggtttttttcttctaaagtcctaattatttttcttattttaaaatatagaaatagcatccaatttttatcaaggagtattgcattttttgagatgagcattttggttttgcttactgtgttaatattagaaaacattcattcatcatttggatatatccattttaatcatcaaaatatgcaacacatatacagatgtcatacattatcaggtatacaactatttttaaattatacaattttaaaatagtacaatttaaaaatagttgtgtacttgattatcagagttaagaacacttttcattagaaggaccaagtagtcaaagtgaatagacgttttttggccctcccacctcacccctaacatacacacatattttatgtcagagttctcaacaaaaataaataacaaaataagaaattctaatgaatacatatatttgaggcttatttttcacaatacttttttcagtgctgttataataacaaaatataaactgcatggctttgttctttaacatgttcaagtttaggtgtatattgaattatg

SEQ ID NO: 269707 - DNA, 465 bp, Homo sapiens
ggccctgggacccgccccacccgaagcccggggagatccaaccgcaggctgcctccggccagcggactcattcacactccgcaaacaggctggggccagacgccgccctgccctaggtgcccagcaaacacgcgggccagccagacccctggaccttcacagggaggaggagatggagatgggttcaccccccacaaaggagggaggggaggggatggccgccatgcccaggtgccgggacaggagccgagggccgcgtgcaccccttgggcccttggaggggccggcatgtgcctctctgtccctgtgccacttccactggccgtacagggccaccaccgcggaaaccgcatgtgtaacccctggaaacagggtcctccttgatgagtcatgttctaagttgggaggaaaattcactggatagtggaggcagtagaaagaaataaaaaaagtctttgttccaca

SEQ ID NO: 269708 - DNA, 499 bp, Homo sapiens
aacaaaaaaaaaagtaataggcaactgtaaaacagcctcacagtggtccttcacgaggcatttcagagggcattgttatcatagatgtcgacagatccatatgcattattggcctagaggagcttccagtgggacaagatctggaggtagaaaacagtgatgttgatcatactgaccctgtgtaggcctacgctagtatgtgcatttgtgtctttgtttttaacaacaacaacaaaaaaattaaaaattaaaagatgtaaaattacaaaaaaatcttagagaataaggatataaggaaataaagtatttctgtgtacaatatgcgttttaagctaagtgttgttacaaaagagtcaaaaagttaaaaataagttaaaaagtttataaagtaaaaaagttactgtaggataagtttaatgtattttgaaagaaataagtttctttataaattttataaattcagtgtttataaagtctacagttttgtacaatgatgccc

SEQ ID NO: 269709 - DNA, 439 bp, Homo sapiens
aggcacagtaaaaaaaaatatcactttatctgttatttcctttagccattaagatctgtagtcttttttgtctgcttactgatgaaattcttttttactttgacacttagaagttcagaattctgttattcaatggggagtaaatatgaaagtcatcatgtagtcagaactggatcaagtgttccccaaaataaaaggaaaaggtaagactgtcagtaactactaaggacagaatccttctgtatactaatgtttaaagaacaaaaagaggaagatacgctcttgtgtgggaaatgcagcaaaaaataaatggtgaaaggtgaaccaggagagtatgaagctatgactatcgagggtatttagagtttcaaggagaaagtgagggaccatgttaaatgtagtagatatgtaaaaaaaacaacaacaaccaaaaaaaaaa

SEQ ID NO: 269710 - DNA, 462 bp, Homo sapiens
atttatccccattttataagtgaggatgctgaagctcagaaagggtaagaccatgtagcgaattagggaggttacgtatcaaacccaggtcttctgacaaaacctgatgtactttaatctcccttcatgctgtaacgttggcaggttaatgatgaaagaaattgacttttcccccttttcctggcaatggtaaatagtgatccttctttgccaggctggattatacacagtgaggtagtggcaaggggacagtgaaccagggatgctggtatggctagtggagtgtaatttgtataaactttctggaaggcaggttcaatacgtatttgtaacttaagtttatacccattgacccatatcagttccctttctaataactaattctaaggcagtaataagcattcatgcagattgttgtacggaatgttgtttagaggactttttataatagccaaaaaaaaa

SEQ ID NO: 269711 - DNA, 376 bp, Homo sapiens
acttcaacctgggtgacagagcaagacatgtcttaaaaataaataaatattagatagttcaaatgttaagtagatcagacaaaaatcatgctggtctcagccgggcgcagtggctcacgcctgtaatcccagcactttgggaaaccaaggcgggcagatcacctgaggtcaggaattcaagactaacctggccaacatggcaagtccctgtctctactaaaaatagaaaaattagccgggcctggtggtgcatgcctgtaatcccagctacttgggaggctaaggcaagaatcgcttgaacccgggaggcagaggttgcagtgagccgatcgtaccaccgcactccagcctgggtgacagagcaagactccgtctc

SEQ ID NO: 269712 - DNA, 590 bp, Homo sapiens
aattcgcgcccgcgtcgaccgcggccgcgtcgacgacgacagaagggggcagtttctcaaaacttaaacataccacctatcctatgaaacagcagtgtcactcctaaatatttgtccaagaggactgaaaacacaaggttcacaaaaagactagtacacaaatgtttacatcaactttattcttagtaaactacttgaatgttaaatgaagggtagatacaccaatcatgttacatttatacaatgcaatactactcagtaataaaaagaaatgaattatcaatacacagaacaacttggaacaacctcaaaaactttacggtgagtgaaagaagccataaacaaaaggatacatgatgtacgattccatgtgtatcatgcgtagattaggcaaaactaatcagagatgaaagaaatgagaacagtgaatgtttacaggagatgttgacagtgaagagatgtgagcaacctttctgggatgatggaaatattatattataataggatggtgattacataggtgtctgaatttattagaagtcatcaagttccacacctgttatctttgtattttaccaagtattttctat

SEQ ID NO: 269713 - DNA, 459 bp, Homo sapiens
taactttattttattttgtttttaaaaaaatgctgtatctatcttttctgaaggcgaatctccaaataaaaggaatctttattctgttaagttttaaataataaacaaaactccaacttgatttaattttatactcagttccctttagcaaacgagcaagccagcagtcatattttcatgtggttacttgttttcataacttttcaccaagagcttaagataggagtttgaaattattcttatctttgacattaccttaacaattcacccatgtaataattttaaacatatatgtgggtgtcttactctatcttcttgtcttaaactaacacttaaatgtttaaccatttccttattatatgtaactgtaatatatgagagaatactgttaatttctataagttgtttcatgccatgtttttcaaataaataaataaataaataaattcactttaaaaa

SEQ ID NO: 269714 - DNA, 1080 bp, Homo sapiens
gagccagtgtccagtagtccctgaaatgtctgatcatctccctttccccagtgcacagttaccctgataaaaggccagaggtctctttggggaaggatgggagaaagattcactgcatacattgtcggtaatgtagtggggtccttcctcaaggggacccgacctccccttcattcaaggggttctgggtctgtaaactagctcaagtctggaaattgattgaagagccatgattctctgtttttataattcaaattagtgttttggccatttgacctagaagttttctgcttgtataaattaagtaggaatgcagtgggcttcctatcaatttcacttctaggaacaccatgattaattaaccaatgccggagctctacacgagccagactgttctgattgctgctttgcctctgctgtccattagggtagctgtgcccacctgaccttatcatatctagtttttgaaacatggcagggaaaatgattccacgtaacctgaccatatcagctgggtgactgaataaaacaccttctcagctcgctttcctctggcctgaagctttttgctgtagctgcttttgcaacaaaggacacagttgtaggcagtggatcctaaatggaggtttcctgggggactttagggaaagcttatattttcctgataaaactgtcaagtgtggccaagataatacttccccgttttctgactttaatgaaaatacaaggccctcaacagagatagctgacttctgactttgggagagaggtcagggaacagcagtgatgctgtcgctgatgtttttgagctattggtctgatatcactagaggcttcctttacatatttgagccatcctaaatctataattttctgtttacttgtagccaaaaatattctaaatgtttcaccctcatactttttgagaaaaaaaaatagcttaataataataaagtaccttaaggcaatttgccattcttttcctttcttcaaaatcagcaaagcatggcaggacacatctgaaagtctgtttactgttgtttttgttgatgttattggcaggcagggcacttatttcca

SEQ ID NO: 269715 - DNA, 460 bp, Homo sapiens
gatttatttaggtttggaaggaatacagtcttgacctacagcaaggtttctcagcattagcactgttggtattttgaggcagataattctttgttgagggtgctcggagtgtcctgtgcatagtaaaatatttagcaacattcctggcctctacccactgtatgccagtaacatcgcatcactcgccacatccccatttgtgacagattgtttccagacattgccaaatgtccggggaggtagggatgggggataaaatctcccttggttgaaaaccattcatttaaaatactggagtatgcagggcacagtttcgtgttcctgtagtcccagctactctggaagctgaggctgaggtaggaggcttgagttcaggaggtcaagggtgcagtgtgagatgattatgcctgtgcatagccactgcactccagtctgggcagcacaacaagatcccattgct

SEQ ID NO: 269716 - DNA, 626 bp, Homo sapiens
atctcctgaccttgtgatccacccgcttcggcctcccaaagtgctgggattacaggcgtgagccacagcgcccggcgaaaagatgtggaaaattcttaaagctgatcagcagctactttgctactctggatctttcttcatttcctttaagctgaggaattgcatgttactgaaaaatggcattggactgagacccttgaaggcctatttgtcttctagtgggtcagctctttttagtattatcgaaggcaatgtttcaaaattcgcagttttcttttggattagtatgggtttctttaaagtgccacactattctaataaagcttaacatgaataatgtgactttgttccattaaaaataacagggctttgtttcacaaacttttgaatcaattttatgtaaacatacataaacatacatgtagttgtaatcataatgtagacctaagtttgttgtttgcccttttttcttgacttatacacattcccgcatgttactctttagtcttcattgtaaaatttaagatgatgttccataatttacccgaaactattgtgtcagtcaatgttctactggagaaacagaaccagtagaataattctttcttagagaaacttcagttttg

SEQ ID NO: 269717 - DNA, 854 bp, Homo sapiens
ccatgttgtgggtattttattattaataagtgcaagctattatctcactttgtatatctcaactcattatcacttctttctagcttgctccttctaacaccccaataacaatccttctgggactttcaatccattgatcctaccatttttcacttttttcactcagcttttgatttactgtcttcctctctcacctagcctgaattccattgttctataaatacaacgttctcttgaatacaccatcaactctctggcccctctctcacttctctgtacttactccaattctcctgaccattccttctgtccatttccaactctcttacagggtctttctccccttaaatctctgacacttgctcccacatcctcacactcagctgatgacttcactttctccttaattataaaattagaagaaatcaaaagagcatttctataaatgctcaccaacatagtggctcacttactagcatctgtatcatatgttctacattccctcctgttatcagagatccactctgtccaacagagtaaccactaaccacataggggtattaaacatttgtaatataactagtgcaactggggaatgtaattctttattttaattaaaattcaaaaccaaagcattgtaaacattaaacaactttattattttggtagaactatatttcccattttaatgatgggaaatttagcacccaaactgagatatgctttaagtgtttgaaaatctagtatgaaaaaaaagaatgtaactatttcataagtcattgttatattgattctatgttaaaaccacagtattttggatatacctggttaaataaaatattatattaaactta

SEQ ID NO: 269718 - DNA, 366 bp, Homo sapiens
tatttttccccacccattattgcattgatccatgcaaaaaccctatcagaaggtaatgcttattatagcaccattttatggatgagaaaattgattcaggctccctgagggctggaaccatgcctttgttgttctgagtggcaggcacattgattcattacatgaagttgttccttgataaatattacttgtgtgaatgatcagtgtagagtcaaaggcacatagctagtgaacagtagagccagaatttcaccgcatcttctgccccaaacccagtgtgttctttcagtatgccatttcacattacatatatctgtctttctaattctgtgaaatgagtttaccatttattaaaataaacaaagt

SEQ ID NO: 269719 - DNA, 483 bp, Homo sapiens
caggatctaggtctaattcatagtgaaatgttggtgcacacagtccctgattgcttcttctgaatttcgttactctggaaatcaaaatcaaccaaatgagtcacataagatcaagagaaactcagagaaaactgaactggtattagtgctaggcaatttcctttaattatgtttatttcttataatacagaaccaaatatcataagactttcatgattgatctaactacagaatattaaaattgccacctaggtttttgtgtttgaaaaacctaaatttgtaggtagaacagaatcaaatgtgaacattttaatagaaaaaatagtctgaaatcctggtctgcctactctgtattcagatctgtattcagaggtaagtttctatgacatttagtttacaaatcatgaaaaatattcttaaatgcaatggtatacattagttttgttctgtaagatttttatgccttacatttttgtttattac

SEQ ID NO: 269720 - DNA, 507 bp, Homo sapiens
cattgctccactcccttcctcagcaacaccctcagctcctttgcatctcctttggtccacaccaggagactcccagcagatccgtagccctcgatcagccacatggggtttaccacccctgctggagaaaatcacctgtcatcagactgcggtccccttcatggtccccagctgtgggaggccctcggagccacaccacagccttatttttctttctctctgtcccctcacacgctcattccatcctgtgtcctctttgctctctgcgggcacttcactgagaaagtagactcagcattcctgagtcggtctacagttttctgtcctcttaccccaagcctgacctcctcagagcccacctcctcctgtgctcagagtgtagtgtccttcctctgcctctcgtctgctctgcgtctaccctgcccctcttgtccctttgtcccatcggctggcctcttgcctggtatgttccatctcactctcagcctgtaaacccaaacccactca

SEQ ID NO: 269721 - DNA, 345 bp, Homo sapiens
aatgcatgcttatgtagaatcctctcacatgtaggaaagtggatactggaaataataccattcatcacagccattgagcacgaaagcatccctttcagaaattatcctcattaagagactcagtagagaaaaccacctgatagatagtgattgaataaggtgaactggacccttgacctcctacacctcatggctggtggtatctcagcactcagtgattcaggcaggtgcgagatgtcctttctcttcctgccctccacagagcaaacaagcaaaaggaatcagaaagaagtctgaacatactttagattcatgttgatctctctaaagtcatatagtaaaaaa

SEQ ID NO: 269722 - DNA, 421 bp, Homo sapiens
taggccttggcattggccctcattttgtctttggcctccccagctcccaatttagtaaagaacttactaaatttagttttagtaaagaatcctactaaatcataatcatcccccccaattcttaatatctgatcacccttgatatctgataaagttccttatcctccacctctgacatataattgcttagcctgcctttagtaagaatcctattaggtctttttatcaagaatcccccctacccttaatgtcttctattaagttttctatgcactgaccccctcattattcttcttggctataaatccccacttgtccctgttgtgtccagagttgagcccaatctctctttcctattataataattctattatattagaattaaaggaatcaccctgcaaaggtgatgataatagcaata

SEQ ID NO: 269723 - DNA, 1009 bp, Homo sapiens
agcctttatccttcagtgatatgtatagaatatgcccaagtggggaaacttgacaccagaacacatgtttttagttccttaggtacaaagcaaagaaacacacctgtccttaagactgaatctatgtcatgaccatctaaatgatgatagagagctttcctccaaatacagctggctattctccagggtcttagcctaatgattcctactctttgctattgatatttgcatggttcaagagctggtctgcttttagttatgcactcaacaaatattgagtgcccataatatgtacagcacgatgctagtgcttatgagaacaaatactccataaacccttattcatgtggttgcgagaacaggttacacacattggaacccaattaagagatactgtacaattggggtgattcggtggcacaggcagaaggtgccgcagatgctgaggagagtgtcacagtggactttggtctgtgccatcaaagaagcgacaaaatgtggataagaaaggatggcattttggaagttacacatgaaggtccaatgttacttcaagcatctatcttcaatgtgtgtttattttgcatgtatttatgtttcaggcatagataaggccactcttgctaggagatacacatcttcatcctagaatgtttactaaatcgcctttttttctagagttgacatctgcttcattaagattatttttcattcagcatttatggaatattcatcaagtgttattgatatgccagtatacctagtgacaagaatattttgggggcactagtaaatactcgtgagccgccttttgcgtagtaagccaccttttcgagtttttgctccggggagtatgtgtccgtttttcttcatactgtcttgagtgtctacgtttttttttcttggtagttgtaaacctgttacggatagcaacatagctagccagcttttggcctgtattgatttgagagggaatgagaaaagacttcaatactacagtgagtgaggc

SEQ ID NO: 269724 - DNA, 383 bp, Homo sapiens
gcttgtatatatgcttgtatgtatgttctgaaacttaaaatacagtaaatatagtattggtagtactttaatttgagtctatgaaataatttcccttttctgattccgatatgagaaaaattagaaaatttcaagattatttttatggtttaaatgccattgttcaaatattaacaagtatcacagtgaatgcttggttgtatgaaaataatgagacctcagtttcacttatttggcagactaagcaaaagtgtaaaattactaactagtgcctcttagctttctatttaaaatgataattttaggacgccaatgtgggtggatcacttgagttcaggagttccagaccagcctgggcaacacggcaaagccccatctctacc

SEQ ID NO: 269725 - DNA, 387 bp, Homo sapiens
aaaaatctctacttctttatttaccaaaaaattatccaaaatctaaatgcaagaggtctgaggtcattgtgcctgggcttacactatattgctctgccattatttagctgtgtaaccttaggcaatttacctaaccactctgagttttgttttcctcatttctgaaagtgaggcatgccagtttctttcattaaatattaacttccactaaaagaagttaactttaattaaaaatctgtactcataggaaaggaaagctgttggtgaattgagaaccctgccacaaaagctgttgatgcatgagaactagaacattacacagtcaacaaatagcatagggaagggcatggagctctgtaaagccgataggccaggattctggcattc

SEQ ID NO: 269726 - DNA, 389 bp, Homo sapiens
gatctgtgtttagttgatgaactgatccatgctattcttgcatcatgactttttcatcttcccttgattcttttccctatatgcatttaagcctgtctggttcttttctcaagcctttgctctctactcccctttcactcaaagcatttcatgtttcgcctttataaccctagtataagtatcaaacttctcacctgtgacttttgcctctctctacatctctcttctacttttaactttcatgtttacaataagctacctttctcttattttcagttcttaccttctcaaacttcagagaatccccactgcttagtgttcttgggagatgctagaggttacacaaaatgccacctcccagaaggtcgaggcattttttttctttaaaa

SEQ ID NO: 269727 - DNA, 417 bp, Homo sapiens
tgatgctcacatttcatgtagtcagaggaggccatctggtttgaatcaacatccggaagttacagggtgatgcttagagagggcttgtgcttccccagccacacatctccataaagatgtaagaggtaattatttcagctgggtgcggtggctcatacctgtaatcccagcactttgggaggccaaggcaggcagatcacctggtcgggagttcgagaccagcctgaccaacatggagaaacgccatctctactaaaaatacaatattagccgggcgtggtggtgaacgcctgtaatcccagctactcaggaggccgaggcaggagaattgtttgaacctgggaggcagaggctgcagtgagccaagatcgcaccattgcactctagcctgggcaacaagagtgaaacttcaactca

SEQ ID NO: 269728 - DNA, 475 bp, Homo sapiens
acaaattctttcttgtgtgagatccaagaacccactctttggatgtggatccagacccctttccggtaacatcttcctggtgaaccatgaagggatgatactgaggaggccatgacccgaaggaaatagaccgcaacactaattggctgactttgggtggatttgttttcctagttcttgaatctgtgctggctctgtgacttgttttgaccaaggaatatgatagaagtgactctgcccttcaaggctaagcatgagactgccatgtacaaacgttggtctagtctatggagggcaagatgccacataaaggggaactgaggcaccccagacaacaactagtatcaactgctagacatgaggccatcttggaccttctaccacagttcactgcagttgtatgagtgaaaccagcagaacttcccaaccaattcacagaacatacgaaataataataattgttgttttaaaaaaa

SEQ ID NO: 269729 - DNA, 468 bp, Homo sapiens
tgttttgttttggagagcctctaggaacttgaaaaatacatatgccacactcttaagacccggtggttcttaatcagggatgttcattaaaatgctggaaaactgtaaagacttccaggtcccatccaaggagattttgcttctgattgactggctagtggcctggccattggtattttgaaaaatccctccaagtgattcttttacatcccagctagaaaaccctaaattaaaggtgaaaaaccagacaccaagtggcatttaaataaatgtcaactttaactccacaaagcatctggttgcatgtggacagaaagagaaggaaagagggccctatatctggataacttggaaatgtgctccccctagcaagatatctaccaaaattaaaaccatatttgaggatgctggcactgtgagcaatatataaatgatgcatgtaacatcatttaatatgatcttattttt

SEQ ID NO: 269730 - DNA, 305 bp, Homo sapiens
ggaaataacatttaaaaagcggcagggtggaaataatttctgctgatgaggttgcatttctccagataaccggcagagtaaattaaagcaatatagtaaaacaatgcacatattgatggaatctcaggatcacaaggttgtggtgaaggaaatttgaagatgtccaggaaagaaagacaaatgagatgaatcttgcagctgcccttcaagggggcatgggccgggtggccatgattctccgtgatgttgcaggaattctggctgggtcctcaggagccttttttttcttgtccacattcaccttc

SEQ ID NO: 269731 - DNA, 310 bp, Homo sapiens
  misc_feature (215)..(215): n is a, c, g, or t
  misc_feature (226)..(226): n is a, c, g, or t
  misc_feature (231)..(231): n is a, c, g, or t
catcccagggagcctgggagtcagcgggcctggatgcacctcccagttctgcctcttattagccagctgtgtgttaacccctcatctggtttgctcaaggtaacatgaccatcacaaaagcaacagaaacagattatttactttcagattaacttgtgaaaatgacaagttgaatattgtcatttcagtattcaagttgaatactatcaattccntattcaagttngaatnattgtcacaagttgaaagattaacttgtgaaaatgacagttggttgaatattggtattttctgcctccaattgttgcat

SEQ ID NO: 269732 - DNA, 454 bp, Homo sapiens
tctcacagccctccctgcccagctcagtctccccagttccatttctctgacaagaggcaaccgcaactcacagtttagcatatttccttctggtctcgcccacccatcctagccccacacaaattttttaactacaaaaatttcaaacttaaagggaaagtacaagcataacacaatgaatacccttaaactctgcacctggatttgcatgattgttaacctttttctctgtttgcctctctctctctgtctctctgacacacacacacacacacacagagatagacacacatctatgtacatactttttttccgaaccattttgagtaaattacagccattgtacacttcacctctaaatactttagcaggtgtctcttaagaaccaggatgcttttttccataaccacaatacaattgtcattctcagaaaaattttaacattagtgtgaca

SEQ ID NO: 269733 - DNA, 469 bp, Homo sapiens
actaaatatcatagcctatgggtcagatggtctctgtcaactattcagctcagctgtttagtgcataagcatctataggcaatatgtgagtgaatggatgtagctgttttccaccaaaatttaattacaaagacaaatgcctggctctcaggccatagtttgctgaccccagatctcaggcccctcatcatacacatagtgaaaccaacactagaaagcttaagtcacttaatcaaggagaaataacaaaataacaaacctagatagtgccagaacctctaccaggcatttagttttgccatatgacaagtcttccaatatgcatgctaatgctctaagaacaacagcatgtttatcattatagtatttagccaaagaattctaactagttggttttccacatctattaatttcacttaaagttgttatttcccagaaaaccatattgtttttattttctatgcaaaaa

SEQ ID NO: 269734 - DNA, 647 bp, Homo sapiens
gtccctctgaaatctagcctaactcccttgtgctgtagcccagccccttttttgggattagtcctccatggaagcacagggtagtgcaattggcttgaaaatgcctccagaggctgggcacagtggctcacgcctgtgatcccaacactctgggaggctgaggcgggcggatcacgaggtcaggagttcgaaaccagcctggccaatatggtgaaaccccgtctctactgaaaatacaaaaattagctgggagtggtagcgtgtgcctgtagtcccagctacttgggaggctgaggcaggagaatcgcttgaacccaggaggcggaggttgcaatgagccgagattgtgccacagcactccagcctgggcgacagagcgagactccatctcaaaacaaaaagaaaagaaaattcctccagacgtgggagggagacttttaggcaacaacccttggccttcgcgcttctggctccatgttctgtcccctctaccctttgccatcttgtctctcctgttgtccttctgcttgtccatctctatatctgtctctctccgaggcttcgtcagtctcttatctctgtcttggactcttatctccttggctctttgattctctgtccctgtcttggtctgtcttggtcactct

SEQ ID NO: 269735 - DNA, 755 bp, Homo sapiens
actcatgttattaagtaaatgtttatttatttatttattttttatgatggaggctcgctctgtcgcccaggctggagtgcagtggcacgttctcggctcactgcaacctccgcctcccagcttcacgtcattctcctgcctcagcctcccgaatagcagggactacaggcgcccgccaccatgcccggctaattttttgtatttttagtagacacagattttcactgtgttagccaggatggtctcgatctcctgacctcgtgatccgcccgcctcagcctcctaaagtgctgggattacaggcgtgagacacggcgcccagccccagtaaatgtttatttcttaactttcatcttaacctatcgacaacacttgatacaattgatcactctattccttgagaaactttcttcatttgacttatggaatgccacactctcctggttttcttcttatttctatggcctctctttttctggttcctttcctggtttctcctcattttcctgacctctaaaccttggagtaccccaggactcagtccttgagcctcttttctgtctatacttctctcttcatagttttatccaggtcttggacgggtgcagtagctcatgcctgtaacctcagcactttgggaggctgaggtgagcagattgcttgagctcaggagtttgagaccagctggggcaacatggtgaaaccctgtctctaccaaaaatgcagaggtggaaggatcacttgccccggaggcg

SEQ ID NO: 269736 - DNA, 472 bp, Homo sapiens
ttccggatgccaaagaggcaaatgtggaatgatgttaggatatcacctgtcataatattatacggattcagctcaaagcagaacctttctgcaaacacgtagggatatgaggaccaaccttagtttgtgaaagagaattaagcttttccaaccttgaaagccttcagattactggatccccagatgctatggatggccagctccataaaaagaatttttatctcatttaaaaaaacttcattaagctttacctcaagttacagaaacatgataaagcacaatgcagtggaaacagcgtggagctggaggatgccagacgacattccagccctgattccactgctcatcaccaatgtcaccctgggcaaggtactccagccctgctgctcagtttgctccactgtaaaatatgaagataatatcttccatgtaagatagttgtgggattaaatgagatcatgtatggaaatta

SEQ ID NO: 269737 - DNA, 1555 bp, Homo sapiens
ttttttgattacggccattcttacaggagtaaggtggtatcatattgtgcttttgatttgcatttcccagatcacagctatttaaaacaaaacaaaaacctaaatttaaaggcctggaataaatcttaggcctaccattatcttcctcaaactagttcaagttctttagttcatttctatttcacaaagatgtttaccaacattactgactcaaacagactatggtcaatccagtcattttctcactctgccatctgtcaaaacaagttgatttttgctcactagagaacatattcataatgcagcaaaataaacttgtatgcagcttattttcggaagtttaaattttattactactttttaaacacagggctgcatttgacatgtttacactcattcccagtgatttccagcagtggacagtaaagtcatttagaaatttgactgcaagcaaattattaccatgccaaactattaaaacacattattgactgattgactgacaaggtctctgtcacccaagctggagcacagcagcacaatcatggctcactgcagccttgacctctcgggttcaggtgatcctcccacctcaacctcccaagtagctaggactataggtgcatgccatcacgtccagctaatttttgtatttttcggagagacagggtttcaccatgttgccccactagtcttggaactcctggactcaagtgatccacctaccttggcctcccagagtggtgggaacaggcatgagccaccacacagggccctaaaacacatttttttaaaacacatttggctatttagtttttattttcaccaaaatggacatgaggaaactatggatcagatataagaggactgccttaccaataggtcattattctttttgcatcaactgccttcccaaccactgaccaatataataaagactacagaactacctctcaataagaagcaggaacataaccttaaaccagtatcttccttgttacgttcttcctaactacttataaaatctccagttctcttcctactacataaccttcccacaatcaaaccaacagctcaaagacatctaaaattacaagatcatttcattacgtgctcctaaaagctgctcctacaacttagacaactacttagggaagaaagaataaaatgttaactaatctgatgctcccatttgctataaggaaacagcctattttgatgctaaaaaggaacttaatttaaaataattccaatcactttgtgctcaaattgagctagacaaaaaatctaatcatactaaagctcctcagaaacctaacaaaaagtatcagaaactatgctgattactctggaggaggatgccttctacctctcctcatcctcttatcccacctttttgcctcctacaagttatccacaaaatattaagtaactaatcttgtacttgcaaagtggcagagttccatatggacttaagaatgtctgatggaaattactttcattatattcaaattagtagcctagaaacaaaagctaaatattgtattaatttcct

SEQ ID NO: 269738 - DNA, 479 bp, Homo sapiens
ggaaatatagcttgtttatttcagctggactttatgcatgaatgtatgtaagaatgtataaaagtgctatgtattcacactacagtgtgatgtaaactatgtgaattactgtcggtcattgtcagaagagtttgtaagtcactggttaaattttcttctgaagaaagccctttttcttctttgaatcagtttttggcaattctttatagtgctaccctttgtccctctttgggcaaattttacactgcctagcttaagtaaattggctgattcatggttgtttacagccctagcatccacaggcccagtctgaacagtgtgtaggccactcactttgccatcaccgcattacatggttgtactccacttatgacagcagggaagtggaggctgtggccaggaatctcctaccgtgggaatagcatggcctatatccaaggctgctcccgctgggaaaacagtgaaagcacctgaggctc

SEQ ID NO: 269739 - DNA, 288 bp, Homo sapiens
tgaacatagatgcaaaattcctcaatgaaatactagccaaccaaattcgacaacacatcaaaaagagtatataccatgaccaagtgggatctttcatgggatgcaaaattgttttaacatgtgcaaaacaatcaatgtgatataccacgttaacagaatgaaagataatggctgggtgtggcatctcacacgtgtaatcccagaactttgcgaggctgaggtggaaggattgcttgagtccagaagtttgagaccagcttgggtaacacagtgagaccccatctctac

SEQ ID NO: 269740 - DNA, 480 bp, Homo sapiens
taattacacttttcattgtctgtatctttgctatacattgaacaaatggagcaggcagagtgttgttttgcacatgggtctgacagatttcctcccaatgggtcctgttctgattgggctgtgatgctcactgctttgggaagagtctgaactcttttcatagtagtgggtggtaggaaaggtcggttgttatctataaagattattattgactcctggctgggtgcggtggccacgcctgtaatcccagcactttgggaggccgaggtgggcagatcacgaggtcaggagatcaagaccatcctggccaacatggtgaaaccccatcactacttaaaacaaaaattagccagctactggggaggctgaggcaggagaattgcttgaacctgggaggcggaggctgcagtgagccgagatggcgccactgcactccagcctgggtgacagagtgagactccatctcaaaaaaaaataaac

SEQ ID NO: 269741 - DNA, 474 bp, Homo sapiens
actacatttgatattattttttcttattaatatgtcttttgttataggagtctcactcgttaaccttgtaatgggtgatgaaaatatattactttttcgttcctacagtttcaaataaatcacctttgtgtctgttgctgggtgggcccctcaggaagttcaccagaacactggatgtaatcaccaaagacatacaaactgtaaactaggaaaactcattagactgtcactaccttcctaacttcaccatctaaagataagctcaagtctaaacaatcttgactggctgatctctggactcagaagctgagtttacagtttattccaaatattaatctttgtttttcttttattttcgctaaactaagctcctctcattaaaagcctggcagctacaaccacctagcagttatcttctaccaagtcccaacaaatgttacagctgattcttaatgaacaaaacgcaactcatcg

SEQ ID NO: 269742 - DNA, 144 bp, Homo sapiens
gcctcatagagttaaccaaaataatgaataagctgagtctaaagagtcacagtaattatttcatgttaaagatgttagaagaaaaaaaaacactgaaaaaagttttgcattagaattaaatttaaaaggctaaattataactct

SEQ ID NO: 269743 - DNA, 725 bp, Homo sapiens
aatcacttccatttttccaagctgttcaaagtaatctcttaggtgatgttcttccgtgtcttctttaatgccaccaacaaatatctttttcacagttaagtgggcacctggtctttgagaatcttctcttgagacagttctctttggttccacaacttttccatccaccttgtgtggccttgcgttcgtggctgcatccacctcctccacagtggcgtatgtgacaaacccacagcccctggagcgcttggtgtttggatctctcattaccacacagtctgtgagcattccccatcactcataatggctcctcaggctctcgtcagttgtttcaaagctcaaatctccaatgaagagcttcctcagctgtttgagctctttaggagactctgacttagacaagatggaagggagaagagagactttaacgatgcttcttcagtggcgtacacgggcggaaaggcaatagctccctatctttaaggtcctcttgtctactagtccgctaatacagatccctggttatgatcttataatttcctctgactttagaaatgaaatgtgctattaacatatcccaggtatgtccttccaaaattactttttttctttctttctttctctctctttctctttctttctttctttctttctttctttctttcttttcttccttccttctttcttgctttcttcctgcgtctccttctttcttcctttttttg

SEQ ID NO: 269744 - DNA, 387 bp, Homo sapiens
tgaaaagctgtgcacagaccccatgaccttcttctgaagtggtgggtcatttagttttcccagagaggcaaagaagtttggtgatttggagcctagtaaatgaaaacaagagaaagaccatgatgttgcttttgtattaagaagagttgaaatttcaaggccagttctgaagaggcctataccccacttctagtaacttccatgagttctcaaatatgcctcaggttgggtccagcttttaattagagggacgtgttgaaatcacaagttagattcaaatcccagttctgccacctattaattgtgtgaacttggacaggtccctcagcccatctatacctcagtttcctcatctgttaaacagtgataataaaaacatttacctca

SEQ ID NO: 269745 - DNA, 510 bp, Homo sapiens
aaggcttgctgggtaagttaagggggtgcaaggtgggttggggctgagctaagtatgccaagttatttccccacaaatgccctttggacaagtcactcttcctccaaggtagggagagagttaagggtcagagagagactggaaaaatgtgtgccactggtacttggtcctctggagcatggactgggaattcattcccctctgtggagacaagagtaggatgaacatgttctctcctaacactgcatggtgaatctggacctgagctggttggcaccgcctgcagctggaggtaactgggacaggcaggacctgtcccacccaatcaagaggaatggtaggagccccacccaccttggactcagctgtagataccagacagccttggaggtttctcaaagctgttatccagactgagaggagatgttgactaagacattgatcatctggcccgcttatctctgtggcatatttaaataagaaaataaattgttaatttttctctaaaaa

SEQ ID NO: 269746 - DNA, 858 bp, Homo sapiens
ttcatttttttaaatactgacttaacaagtataaccccagataattgtatgactgactacaggtaaaagtccaaagctggagctctggacaatgtctttgagccaagtggggttttaaaaaattatttctttaaaaagtatgtttcatcaagactttggtgaggacctcaagctcatgttagaatggtgctatgataaactcatatcagaatgtcaatgctatttaattagaagctttttgcttcctaccatttaagaaaaaaatttcattttaaatctgtaccctaattatattaagcaattttaaaatgataaaattttaaagttgaaacaaaaacaaaacaaaacaaaaaaatcccttatgtatctaataagtcttcctgctaaaagtatctaaatgttttggtaatggcaacagcagaatcatttcagtgctttgttaaactaatggctcaggccttagaataaaatcagtattcatggagttttactaatcaaacatttcatcaggcagagtaactgatttgtgcttaacaacttatattcaaatattaagttattgtgccctgaagacacagctatcagttaaaatatgaacaaattcctaataggaatatagcaaaccaggcagtatccctggtgagcttttttgtgttttttaaaatttttatggatacataatagttgtacatattttccctggtgagcttttaagatcagaatctgtttctataaatgccaaaaaacattttaaaataactcctcaccgcaaatgaatgggtgctccataaatatttgataaccgtagcaaactcaacaaatacagctatcaaatagcagccattatagaaatcttta

SEQ ID NO: 269747 - DNA, 802 bp, Homo sapiens
atacccccaggaagtcatcagcagaagagagacgggtctttaggaacacctgtaagccaaggtgttatacaagactagagatgtgtggagcagaggtagaaatacccacagataggaaagaggacccttctgggatatggagagaaggaaaggtcagcctactcaaaagtatcctcgatcacttgacacaccctccacagggtcatcatcaaggagctgtaattcatccatgacaagaagcttccagctcaaatgcaaacattcctgagacagttcccacaggagctcagaaacgtcctccacgtacccctcatggggacatcttgctcctacagcagtaaacgtcttgcttccctccaacggtgcttccttacctgtccctacctgtgccacgaccacaggatgcctacaaaaaaaaaaagaaggacacctcactggcacctctctcctgattctcatctgcactttgttacctgggctctgaagcagccctgctcctgctcttgggccacacaaagtgctcacggatgtggcctttttatcttttgcctactctctccctagggttcaagcatcatccctgtgtcctaaccagggaacaagtggcatgttcccttttctcccaggaacctacacacaattgcttctccgatgaaagccacttccactgtgcacatcaatcaaggcagatgcatagcaggggccgggggaccctgggctgctcttccagcacttagccaaacactgaatctgtttatgctccactgggacacaaaggaatgtcacaggcactaaaatattc

SEQ ID NO: 269748 - DNA, 389 bp, Homo sapiens
ctggaaacattaatctggacatgctggaggatgcaggtggatttagagccagaataacatctgtaataacaagtccttgaacctctcgtcaaacctccttgatgaagattatacagaagcacttctgttgtttgatagggctgttgattggaaagaccttgcttctaaacagtagaagtctccttccctgcaactatcatccatggatccaagatctgctttgggaatcctacaacttgaatttttgctcccttccattatgaagccctaaggcaagtggcttggagtaacccaccagagaaccagggccctattcattcattttggtatacccatgcttggcatgatggctggtcaatggtggaagcttaataaatgtctgctaaaca

SEQ ID NO: 269749 - DNA, 443 bp, Homo sapiens
ttccaccccaatacctggtcttccttcccggcttaaggagtaccatgtacttagccacaggcagaatagctttcgatgaccccatagcactttgtttcttcaccttgatttgcactttacaatgtccccagcccctctgcagcccgtggctggcagggcgttcgatgtgcggttggcccccagcgcgccctccagagctgcggtgtctccctgcctcattccccacatcccactgagcatgggaccattgggagcagagctgatattaaagcatgtttagcttcgaagttttacttttttaaagctgagtagttaagaattccctgtaaaaacaaaaccctgtaaattgagcctcatgtctggtatatattttaccaaacagccttaaaatatatttggaagcaaaaatcagtacgaatgtatctccttgaaaaatgcaaaaa

SEQ ID NO: 269750 - DNA, 322 bp, Homo sapiens
acacacatacacacacacacacacacacacacacacacacacatattattctgcagggaacaggatgggaataatttatcagttccaatggctgggataaaccatcctctgactgaaaaaaaattagagggaatatcggaaaactatatttcttttttacattatgaaagaaaacacctaaagtgtcttaaacataaaagagtagtatgttggataagtataagtgaagactcacataaccaccacatgggacaagaaatagaacattgcaaatctcctgtatgttccttttcatacaccctaaaaataaatactacccaga

SEQ ID NO: 269751 - DNA, 432 bp, Homo sapiens
tcgatacgactttttttgaggacagagaccatgttttaatgacttcgatatctccagcagcgatcaccggccagggcacattgtagactgtccagaaacactgatggaatgcatttgaatgcattttcctctggttctatgttctgtccttctgttgttccccagcaggagagttctcatctgacatccagaagaggacggccccaccagcaggatggtggtgggactgggagatgctggcctgtttctgggaagtatgttagttgccaacgaaactaaataaccatgggaacagacgttaagctaattggttactacaaagcaggggtgaagggacgtggctgatgtcagggctgtgcagttagggtgaaaactccatgggatggctgggagaccggaggctggcaggaatgggcggtggtgggagggagc

SEQ ID NO: 269752 - DNA, 504 bp, Homo sapiens
gaggaaatgtagagcaactggtgaatgggtacaaaaagagttagataaaagacaagctgtattgcttgatagcacattacagtgactataattagcaacaatatattgtatatttcaatgtagctagaagagaggacaggaaatgttaccaacccatagaaatgatgaatactcaagaggatggataccccaaatactctgacattattatacattttatacgtgtaacaaatacatgtacccataaatatgtaaaatatcatgtatcagtaaaagaaaaaggctggatagagagaggtaaaaataggagaaatgagagcagtcagtgcacataagagtaatatgcttgttatactgtgtggctacactggttaaggaaattcctgctgcatataacccaaatttgccattagaggttaagaaaactttccacttaacaatttaaaaattatacaactaaaacatccattatttaaaaatcaacataaagaagcaaaaaaaaaa

SEQ ID NO: 269753 - DNA, 246 bp, Homo sapiens
agaaattttatgaggaatagtattttttaaagagcacatagtaaactttgtagctgtttataagggctgaagggagatggggatctggggagtttacctgtgagtggctttaacatcagctatttgaactcaagagattggtatttgctttttaggaacagcagtacctcttttgttaagagattgattgattgagagtttcgctgtctcccccaggctggagtgaagtggcacaatctcagctca

SEQ ID NO: 269754 - DNA, 443 bp, Homo sapiens
actgctttggaatattgattgctttgagccgaaagcatttgaaaaataacaaatgcagggaggggctttttgggactcctttgtctgcctaaagacaggtcctccaaagaaattcagctatcatccatgccttctcccacgccatcatcttaatgttatttaatttttcttgacaaatcaggcaggtatcacagttttttacttccatgactgacgtgcatcaagatcaagcaattcatttttactgcacattttcctcttaggttggatttatggttttatgatcttaaacatctagcagagccaacaccaatctgtctaaccagcaacccaggaaaaacttgagaattctgagaaactcccattttattttaccgacaatttaaaaactagctttatttaccacagacttatgtaaatcatgtgaacttattaaaaaaaaa

SEQ ID NO: 269755 - DNA, 282 bp, Homo sapiens
gggtacatgtacaatttattacttgggtatattgcatgatgctgaggtttggggtatgattgatactgtcacccaggtaatgagcatagtacccaataattactttttcaacccttattcccctcccccctctatcttctactagtccccagtgtctattgttgacatctttctgtcatttttttctttatcatatgtttttggtgctatatctaaaaccttattgccaaacccaaggtcaggtagacttttttttagacagagtctcactctgtcgcccta

SEQ ID NO: 269756 - DNA, 358 bp, Homo sapiens
acagagcccaaactccagataatagaggaagtgagacttgttgacattgtccttcatgcatagaaattccctccaaggctgggcatcgtggctcacacttgtaatcccagcactttgggaggccaaggtgggcagatcccttgagctcaagagttcaggaccaccctggccaacatgacaaaatcctgtctctacaaaaattagccaggtgcagtggtgtgtgcctgtagtcccagctacttgggaggctgacgtgggagaatcacttgagtttgggaggcagaggttgcagtgagctgagattgcgcccactgcagcctgcctgggctgtgggagtgaaaacctgtctcaaaaaaaa

SEQ ID NO: 269757 - DNA, 355 bp, Homo sapiens
ctccatctgacgtgcattcctccatctgacaatgtgtactcctccatctgacgtgcactactccatctgacgaaatgcactcctccatcagatgatgtgtactcctccatctgacatgcactcctccatctgacaacatgcactcctccatctgatgatgtgtactcctccatctgacatgcactcctccatctgacaacgtgcactcctccatttgacgtgaactcctccatctaacgacgtgtacccctccatctgacaacgtgcactcctccatctgacaacatgcactcctccatctgacaacgtgcactcctccatctgacatgtactcctccatctgacgatgtgcact

SEQ ID NO: 269758 - DNA, 473 bp, Homo sapiens
tttttgtattttttgtagagatgggtgtctccccatgttgctcaggctgttcttgaacttctgagctcaggtgatctatctgcctcggccttccaaagtgctgggattacaggcatgatgagccactgcacctggccaaaagtggcagaaattttgatatggtttataatcagttttattgtggggaagatgggccattttaatgaatgattatttctattggctaaactaccgagtcacgacatgacaaatacacatgaagctttaatcacatgcagttatatacttctcacaaatcatcaaattatttatctggtcttcacactaagggatttacttagataagccatcgatgatttcagttgttaaaagtgtggctttttaaacagcatttattcagtgcatcctgatttatttcaaaatgaaaaattgttacctttttttctgaataaataaagcttacttttagtggc

SEQ ID NO: 269759 - DNA, 593 bp, Homo sapiens
cggctcactgcaagctccgcctgccgggttcatgccattctcctgcctcagcctctcaagtaggtgggattacaggcgccggccaccacgcccggctaattttttgtatttttagtagagacgggatttcaccgtgttagccaggatggtctcgatctcctgacctcgtgatccgcccgcctcggcctcccaaagtgctggaattacaagcgtgagccaccacgcctggcccagaaaaatattattttattttggcaggcagtctcttagctgaatcaaacttctagtcctgtagcagtgccctctgtggtgtgtcacagctgcaatctctgctcagttattttgtctttagctgggtgacttggagtgtacgctacatgggcatattacaagggtgaaccagagatttgagcagaaatcattttcagaagttgaggctccacctctgtagctgtctcctttctagaatttttccttcactttctagctgctgtggtgaaccctcttttctctggttcttcaagcctgtaagattgcaaacgtctctcctagttttagttaactggcatggtgctgagcagagactgcactcc

SEQ ID NO: 269760 - DNA, 791 bp, Homo sapiens
gctcacgcctgtaatcccagcactttgggagtctgaggcagccagatcacctgaggtcaagagttcgagaccagcctggccaacatggtgaaatcctgtctctactaaaaatacaaaaattagccggccatggtggcatgtgcctgtaatcccagctacttgggaggctgaggcatgagcatcacttgaaccaaggaggcggaggttgcagtgtgctgagattgcaccactgcactccagcctgggtgacacagcaagactccgtctcaaaataaaataaaagtttggatcacttaccctgtaaaatgtcctactttctggatttatcagattatttcctcatgatattgtttagcttgttcctcgtgcctctgtatatcctataaactaatagttaaatcataaggtttgaatagactctgcttaaatatttttggtcagaatacttcatgggtgattctgcatacttacatcatatgacatcacatcagaaggtattcagtctctggtcatctcactactagtgatgtcaagactgaccagcgttcaaaatagtgacacctagataaagagtaacttttaaaaagaggccgtgaacctgggcaatatagtaagacaccatctttaccaaaacgtaaaaaaattagttgggcatggtggcgtgctcctgacgtcccagctactctagaggctgaggtgggaggatttcttgagcccgaggtcaaggctgcagtgagctatgatcgcaccactgcactgcagcctgggcaacagagtgagaccctgtgtca

SEQ ID NO: 269761 - DNA, 240 bp, Homo sapiens
aggttggggagtcagcttgcggggacgggactccgggaatctccgtctagacacaagcatcagcaagaggagggtcgcgggatttaggggagagctcgaagatcagaatgcaggaccaaggacctggggcgatggctcacgcctgtaatcccagcgcttttggagaccaaggcgggaggatggcttgagcccaggagtttgagaccggcctcggcaacaaattaagacccctcctctgcc

SEQ ID NO: 269762 - DNA, 395 bp, Homo sapiens
cactggcccatccaccatccggggaggctttccacgtgcaggatgcgccaccgagggcacggccgcctctcccacccgaggccttcactctgccctgtcttcccccggtacccctttctcccgtctctgcccagccaaatcctgtcatggtcagcggccggctgcagcgccacctcagtgaagccttgggggagaccatgccgtcccagcgaggggtacagtaaggatgccacagtcaccccaccctcggggccacctcatcccggcactggcactggcactgtcctctgtggctcccagcacttcacacatttgtatgctttgcttcagaacaacaaacactaaagttgcagaactttatttaaaaatgaaaataaaactgcctgatttataaa

SEQ ID NO: 269763 - DNA, 479 bp, Homo sapiens
ggactccgcttcctccaatgccaaaggaaaatgtctataatctcactcttcagcgggaagcgttggactccgcggtggtccttgactacacacaccgcagtgcccaccgggaacgtattccatatctctgagcgcctggtggggaatgtggactgtgaccctgactgaatgaaatgtatcatcagcatggattctgtgataaattacaagatacaaactcaaaaggaactgctttctatgtgcctcatattttaatgtttctcccctttgtgaatgcttaggtgagactgtagtcatgaaaactgagtaaagactttattacacacattactgaggcttctctccaatgtggacattctgaagttgaagacttgaggcctgaatgaagcacataccaccctcctcatacttccgtagtttctctcccgtgtggagcttctgaagcataataaaattcaagtgatccagaaaaaaaaaaa

SEQ ID NO: 269764 - DNA, 319 bp, Homo sapiens
ctctgaagctggagaggtgtttgtcagggctcaaatgtaagctgcttattaataatgaagtttcaatgggtatgtgctgtagggattcaagggtgtatttgtctacaaaaaagtcttgttttcattttatggaatgacttttttctccccgttctctctcctccttcttctctttccccttccctacctcccttgtttctttcatgcagcatttctaccaatgttgtttatgggtgtcctttggtttcattctaaccatgcatccttttgagttcttaaaataggactaagtccatatatcaatcttcattgttttctt

SEQ ID NO: 269765 - DNA, 428 bp, Homo sapiens
acattaaaaccccagtgggtttcttcttttggtgcattttatttttgttgtttgctgattcacgcagtgtcgcatgactccctggggtgtagttggggggaaggcttttcagtaaacactcaaatctaaacaggtatcccaagaatcaccagtgccactggaacccctgaatcttcagattagggccagtctgtcaccaatcctgggcacacactaactggtttgttgaccctatgcttttagttccacagtaaataccagaactgtgatcaatgtacaaaagaaataatggtcaacagaagtcattaacaacttgaactgccaggagaatcgcttgacctgggaggtggaggttgcggtgagccgagatcacatcactgcactccagcctggcgccaaatcaagaccccgtctccaaaaaaaaaaaa

SEQ ID NO: 269766 - DNA, 420 bp, Homo sapiens
acattaaaaccccagtgggtttcttcttttggtgcattttatttttgttgtttgctgattcacgcagtgtcgcatgactccctggggtgtagttggggggaaggcttttcagtaaacactcaaatctaaacaggtatcccaagaatcaccagtgccactggaacccctgaatcttcagattagggccagtctgtcaccaatcctgggcacacactaactggtttgttgaccctatgcttttagttccacagtaaataccagaactgtgatcaatgtacaaaagaaataatggtcaacagaagtcattaacaacttgaactgccgggttcaaatgattctcctgcctcaccctcctgagtagctgggattacaggtgcccgccaccacgcttaatttttgtatttttagtagagaccagtc

SEQ ID NO: 269767 - DNA, 387 bp, Homo sapiens
cattgtactccggtccgggcaacaagatttgaaactctgtctccaaaaaaaaaaaaaaaaggaaaaaaaattaaaaaaggaaaacaacaatgaagcaccagcaaatacctggtggagtagctaaaatccaaaacactgacacttccaaatgctggagacagtgaactctccttcactagggatgtgaatggaaaattctacagccaatttggaagacagtctgcggagctctgaagaaaataggcatggtcttactgattcagtagtctcattcctacatattgactcaaatgaactaaaaactgatgtccacacgaaagtcctcccacaaacgtttttagcagccttactcataactgccaaaaactagaatcaaacaaggtgagt

SEQ ID NO: 269768 - DNA, 265 bp, Homo sapiens
  misc_feature (1)..(1): n is a, c, g, or t
  misc_feature (12)..(12): n is a, c, g, or t
  misc_feature (28)..(28): n is a, c, g, or t
naggagaggggngagaagggggggaggnagagttgaaaaccgtggcaccctggactagatggcctggattctgccatgtaaatcaaagaagagagggcctaactcagctgcctagcctggatcacctggaacccattaggatacaggatcataaacacctctattttcccttcagagagagaccagaaccactggagttaagctacctgcataagagcttgggtcccagctccaaaatgtctcattatctgtatttgaatatccc

SEQ ID NO: 269769 - DNA, 529 bp, Homo sapiens
  misc_feature (475)..(477): n is a, c, g, or t
ggtccaagtaggctaaatccagtccagagtttgtggacgttcttagggaatataaagctaaggggcagcaaaattagtagcaccaaatctgtggagccagaagatgtggattcaaactcctgctgcacatcttgtatgctttttgattttgaaagagttttttttttcctttttgagccttggcttccatatatacaaaatgaagttactaataatatcaaccttataggagatggcctggattctgccatgtaaatcaaagaagagagggcctaactcagctgcctagcctggatcacctggaacccattaggatacaggatcataaacacctctattttcccttcagagagagaccagaaccactggagttaagctacctgcataagagttgagtgcgatcagctgtacttaatctttaaatgtccaacccactgataacctttggtttgctttgataactatgaaataaatnnngatgcggccggggatgcgttttttataaaatatataaaaaatagatttgcac

SEQ ID NO: 269770 - DNA, 354 bp, Homo sapiens
  misc_feature (300)..(302): n is a, c, g, or t
aaatatatacttccttcactataatgcgcccccgggcactacacgttattagaggagatggcctggattctgccatgtaaatcaaagaagagagggcctaactcagctgcctagcctggatcacctggaacccattaggatacaggatcataaacacctctattttcccttcagagagagaccagaaccactggagttaagctacctgcataagagttgagtgcgatcagctgtacttaatctttaaatgtccaacccactgataacctttggtttgctttgataactatgaaataaatnnngatgcggccggggatgcgttttttataaaatatataaaaaatagatttgcac

SEQ ID NO: 269771 - DNA, 387 bp, Homo sapiens
  misc_feature (333)..(335): n is a, c, g, or t
gagaaaaaaaaaaacaatgctaaaaagcctagagatgaccacatatgaaacgaccatgtgtgtaaaggattgctggaaaataaatcagagatggcctggattctgccatgtaaatcaaagaagagagggcctaactcagctgcctagcctggatcacctggaacccattaggatacaggatcataaacacctctattttcccttcagagagagaccagaaccactggagttaagctacctgcataagagttgagtgcgatcagctgtacttaatctttaaatgtccaacccactgataacctttggtttgctttgataactatgaaataaatnnngatgcggccggggatgcgttttttataaaatatataaaaaatagatttgcac

SEQ ID NO: 269772 - DNA, 1042 bp, Homo sapiens
gaagctcctagctggtgcagtgaggcaagacaaagaaaggaaatataggtgcactgggaaggaagaagaaacactgcctttattctttaggtgacatgattgtgtgcttttaaaataataaaggaatcaacagaaaagttgcttaacctaatgaatgagtttatcaaagtcacaagatacaaggtcagtatacaaaaatcagttggatttctacatggtagaaacaactgtacatggaaaaatgtttaatagtgtaagatatgtacattggaaactatgaaagagtgtaaaaaataaagaagtgaaataaatggagaagataccaccttgatggatggaagccttaaggtaaagatgctcattctccccacactgacctgtacattccccacaggcctaatcaaaacccccacaggcttctgtgtagaaattgacatgctgatcctgaaatttatatgaaaatgcaaagagtctggaataaccaaaataattttgtaaaagaacaaagaagacttctactacctggttataagacttctctgaagcacagaagtcaaggcagtgtggtggtggcataagtaatgtaaatcatccaggtgtggtggctcaagccagtcatccagcactttgggaggctgaggcaggagaatcgctagagcccaggagttggaaaccagcctgggcagcatagcaagactcatctctacaaaaaatacgaaacaattagctgggtgtctgtagcacatgcctgtagtcccagctgcgcgggaggctgagctgggaagatcactttagcctgggaagtcaggggagctgtgatcacaccactgcactccagcctgggcaacagagcaagaccccatctcaaaaacaaaacaaaacaaaaaacaaatcagatggaacagaatacagtgtccagaaattgatccatgtgtatataatcacctggtactcaacagaaaggccaaggtaatttaagagggaaggattgtattttcaaaaaatgatgcaagaacatttgaagagtcatgtggagaaaaaa

SEQ ID NO: 269773 - DNA, 514 bp, Homo sapiens
gagccctggcaggccctacagctcctgttggccattctattgactctgatggccctcccctaccaagcaaggaagaaaacctttctaagcgtccatgaagtgatggcagtagaaaactatgcgaaggacagcttgcagtggatcaccgaccagtataacaaggaaagtgatgacaagtaccacttcaggatcttccgagtccttaaagtccagaggcaggtcactgaccacctggagtatcacctgaatgtggaaatgcagtggaccacctgccaaaagccagagaccacgaactgtgtcccccaggaaagggagcttcacaagcaagtcaactgcttcttctcagtgtttgctgtaccctggtttgaacagtacaaaattttgaacaaaagctgcagcagtgactaggtgtcctggagtgtacaactgcggccactgcatgtgagagaatcctgcaatgggcaataatccttaatataggcaataaatgtttgtcaacatattctcttaaaat

SEQ ID NO: 269774 - DNA, 409 bp, Homo sapiens
gagccctggcaggccctacagctcctgttggccattctattgactctgatggccctcccctaccaagcaaggaagaaaacctttctaagcgtccatgaagtgatggcagtagaaaactatgcgaaggacagcttgcagtggatcaccgaccagtataacaaggaaagtgatgacaagtaccacttcaggatcttccgagtccttaaagtccagaggcagcaagtcaactgcttcttctcagtgtttgctgtaccctggtttgaacagtacaaaattttgaacaaaagctgcagcagtgactaggtgtcctggagtgtacaactgcggccactgcatgtgagagaatcctgcaatgggcaataatccttaatataggcaataaatgtttgtcaacatattctcttaaaat

SEQ ID NO: 269775 - DNA, 1605 bp, Homo sapiens
agtcgcacggccacctgagtcgccccttcctgctggagccagcgaggggtgcctgcagccgggacaccttcctctccgcgtctcctcgtctcccgcgcccgcgtcaggccgccagccttgcccaccgccccgagaagagcgcgccgggcgccgactgcccctcggggcgccgagcggcggccctggacgtgcgggggcctctctgggccggccgcggcgcctcggccctgccctctagctcccgcgttcgctcctaccctcttggctctcggggcacagcgcgcggcccggtccggagcagggcggacaggagcgccaggcagagcggcctggccgccgctaacggcgcacgcgcgcgtactcggctcggatctaccttccagtagcagcggagtggccaatgggaccgggaccagggctgggggccggggggccgccgccgcggggaggttcccggctcaggtgcccagcgctcaccagcccagcgcctcgggcggcgccgcggtggccccggcagccccgcgcagctgtttcctggggggcgtggcgtcgggggcccgcgcggcgcagtcctccttcagcatcccgaacagcagcagcggtccgcaggactcgcaggactcggtgcacagcagccctgaggatggcggcgacggcggccagcaccggccggtgggcgggagccccggcgggccgcgcctggtgatcggctccttaccagctcacctctcaccgcgcatgtttggagatgcgagtaaaatttggtgccatgactcggactgggggacctcccttaggagatcaatccctatcctcctgctctttgctccatgagaaagatcgacctacgacctcaggtcctcagactgaccagcccaaggaacatttcaccaattttaaatcggagacaaaggtgaagcgttttatctgtgaacccaaaactccggcgccggtcacagaatcaggaagagtcttcccttggtgtttaaccacatggggatgcctacatgattattcacccatgtttcagaggtgtctgaccacggagggatgcctgtcttggtccttcacccttagcggaccccactgaaaatcggactgttcaactcccctggcagccacttccagagcccctggaactctggcccaaggctctctgacaccttcccagaccttcttggcttagcagctgaagactgacactgcccgatcgcctcagaagcctataggaccttcacagatgctctgggtaaccctcacagtggagggcctggttgcagtatgcctgaaatttgggatgtagaagatcctgccaatgctgggaaaactcccttatgtaacctcttggtgaaggattccaaacctcacttcaccactgtattccagaacagtgtttacaaagtcctagaagttgtaaaagaatgactgctacatgacctgctgcctacggagaactacatctctaatggttttaatgttttgctaagtcatgtgttgttcatatcccaaaaacttttataggtaactgttttcaaatagaaaatgttttatttggtcaatttgaatgtcattctaattataaaaatgactcatacctttcatgcg

SEQ ID NO: 269776 - DNA, 208 bp, Homo sapiens
gactccatctcttctcattccagatttccagcgtgaagcaggcccaagctagggaaggtgagaagctttaaccttaaattttcgagttttggccaggcgcggtggctcacggctgtaatcccaacactttgggagtctgaggcgggcggatcatgaggtcaggagattaagaccagcttggccaacatggtgaaaccccgtctctact

SEQ ID NO: 269777 - DNA, 481 bp, Homo sapiens
ggtggccaggaggcatctgggaacacataggggactgaggctcagtggtgttagttcattactacctgactgcaaacctccgccgactcatgaaactcccctcgtgtcatgtcattttgccttttgtagcagggccgtggatttgtgatgatggacactgtggccctgtggctagaaaataggggcttagaccaggcacggtggctcacgcctgtaatcccagcactttgggaggccgaggcgggcagatcacaaagtcaagagatcgagaccatcctggccaacatggtgaaatcccatctctactaaaaatacaaaaataaattagccaggcctggtggcgtgcacctgtaattgcagctacccgggaggctgaggcaggagtgtcgcttgaatctgggaggcagaggttgcagtgagctgagattgcgtcactgcactctagcctggcgacagagcgagactccatctcaaaaaaaaa

SEQ ID NO: 269778 - DNA, 375 bp, Homo sapiens
tggcaggtgaaagggctttaaagtgcccacattgactcagtgcactatgttagaactttctgtatagacactggccttctcaggcctccctgcatccccaccaagagcaccaggcagtagtcacttgaatgagttgagaggatgttccagactctgaaggagaagagaaaaatggctagggtttttgcctcaagaaagggcatctgtctacagcataggaagatacctgtagatacaaaaatgactcccgggcagggccaagcgtggtggctcacacctgtaatcatagcactttgggagggcaaaacaggtgagaactgattaagctcaggagttcaaaaccagcctgggtaacacagtgagtgcttgtctcta

SEQ ID NO: 269779 - DNA, 1401 bp, Homo sapiens
caacacgatggataagtgagagggattcgggttgcgtgttcactgcccccaattcctaaagcaagttagaagtttttagcatttaaggtgtgaaatgctcctcaacacgatggataagtgagagagagtcaggttgcatgttcactgcccctaattcctaaagcaagttagaaatttttagcattttctttgaaacaattaagttcatgacaatggatgacacaagtttgaggtagtgtctagaattgttctcctgtttgtagctggatatttcaaagaaacattgcaggtattttataaaagttttaaaccttgaatgagagggtaacacctcaaacctatggattcattcacttgatattggcaaggtggcccacaatgagtgagtagtgatttttggatatttcaaaatagtctagaccagctagtgcttccacagtcaaagctggacatttttatgttgcattatatacacccatgatatttctaataatatatggttttaaacattaaagacaaatgtttttatacaaatgaattttctacaaaatttaaagctaccataatgcttttaattagttctaaattcaaccaaaaaatgttttactcttataaaaaggaaaactgagtaggaaatgaaatactagattagactagaaaataaggaataaatcgattttactttggtataggagcaaggttcacctttagattttgtattctcttttaattatgctccttggcaggtatgaaattgccctggttacattccattattgcttattagtatttcactccataacccttttttctgctaaaactactctttttatatttgtaaaataattggcagagtgagaagaaacataaaatcagataaggcaaatgtgtacctgtaaggaatttgtactttttcataatgcccagtgattagtgagtatttcccttttgccagttgacaagatttttccaccctcgagcagcgtgagagatgcctctttaacacttgaaattcatttctatctggatacagaggcagatttttcttcattgcttagttgagcagtttgttttgctgccaacctgtctccacccctgtatttcaagatcattgataagccctaaattcaaattcttaagatatggaccttttattgaaaatatcacaagttcagaatccctatacaatgtgaatatgtggaaataatttcccagcaggaagagcattatattctctttgtaccagcaaattaatttaactcaactcacatgagatttaaattctgtgggctgtagtatgccatcattgtgactgaatttgtgcaatggtttcttaatttttttactgttatttaaagatgttttacataattcaataaaatgaaatgacttaaaaaaaaa

SEQ ID NO: 269780 - DNA, 468 bp, Homo sapiens
ggaaagaataactccagatgggaggaaggaacaactccagacgtgccacctttatgaactttatgactgaataatattcaattgtatgtgtatgccacattttctttattcattcatccatcaatggacattaagattgcttcaagattatgttgtctaatttcgactttccaggtgtgcagcttcactcctgaagccagtgaggccatgaacctaccgggggggaacgaacaattccagacacgccacctttaagaactgtaacaccacaagggttcaagaacccaccaattccggacacaattatatattcaatattgagtgttatatacatgattcattttcaactttcatatcaggaatcatgtgggctcccacaggcttcctttgaagtggaaagatagaaactcttcaaagtaaccatttgttactactaaatattaaatagtaattggctgttaatccaaa

SEQ ID NO: 269781 - DNA, 493 bp, Homo sapiens
cagtaagccaagatcacaccactgaactctagcctgggggtgacagagcaagactctgtcccaaaaaaaaccaagaaaggtaactctattcagcattatactggagtttccagccagaggaattaggcaagaaaaaaataaaaaacatccatattgaaacagaagtaaaactatatttgcagatgagatgatcttgtatatatagaaaatcctaaagaaacaaacaaaaatctattggaataaatgagttcagcaaagttgcaagatacaacattaatatacaaaaatcaattgtatttctatacactagcaatgaataatctgaaaatgatagccaggtatggtggctcatgcctgtaagtcccagcgacctgggaggctgaggcaggagaattgcttgagcccaggaggcggaggttgcagtgagccaagatcctgccactgcacttcagcctgggtgacagagtgagactctgtctcggggaaaaaaaaa

SEQ ID NO: 269782 - DNA, 431 bp, Homo sapiens
gaatgccttgggaagatatggattaaatagaaaccaaatgtaattatcagatattctctcaagctcagtgcaaagctgaattccaaatctatggattttaaaagctgatattatctttctacactgtgtagaacaagtgtcacagcttaaaaaaaaaatagtggtgttgaaatttgggaagtgagcagttctctttcctgtgtttaattcaggaagtttaattttttttttctttaaattcatgccactcttgttaaatgtggtagcagaaacgcagaaattttcatttggaagtgatctttagcaggatcatgatcctttgtcagatgcttcaattttgcacagatttaatgcagaatttttgttttagtactgtaagacatacatgacagctgggcatttttataaagtgtttctttattttatgttca

SEQ ID NO: 269783 - DNA, 386 bp, Homo sapiens
cagggcaagaggtggccctccctgtttggggcctgcactggagggagacagaagcctgctgagacagcaaggatggagggaactgagaggactctgttctcagtgaaaggtgctggggagagataagggatgcccgaggaagatacacggttactggggcttaaaatagtgttggaggcatggaaaatgagattgccaagggacaaaaaggagaacacaggaaagcgatcaggcctcagagggagggaagggatgccgagaacacgattttaaagcagctgggacaatgagggggaggcacttggctgattcagctgtacagtcagccccaaagcgctcagcctgcatttttgtggatcaaatatgctaattaggcacaggtccct

SEQ ID NO: 269784 - DNA, 265 bp, Homo sapiens
aaacaaggttactccacataaagctcctaggacctggcatatcataagtgggtgctcaagaaaaggcaatgatggccgggtgtggtgacgcatacctgtaatcccagcactttgggaggctgaggcaggtggatcacttgaggccaggagtttgagaccagcctggccaacatggtgaaacaccgtctctactaaaaatacaaaaattagtcaggtgttgtggggcgtgcctgtaatcccagctactcagaaggctgaggcatga

SEQ ID NO: 269785 - DNA, 501 bp, Homo sapiens
aaacaaagctccaacctagctttccatccttctttctcttccccattgggtaccccttactctagtcacaccagtccccaattcactttatccgtctccttttctttctcaagctattctctatacctcaccttttctcccctgcctccattgttgcttattcaaccctagcagtgctttcaggctcagctcaaaccttatcacccatgttaaatgaaagaagccagacacaagaaggggacattctgaatgattccatttatatgaaggttaagaacaggcaaaactattgtggggaaaaaacagaactgtggttgcctttggggagtgaggattgattagaaggggttttgggggtatgaaaatgttcttgatcttcattccagtggtaatttcatgggtgaatacatttgccaaaattcactgaattgtacactaaagatctgcatttctctgtattgtcaatttaatctaaaaataaaaatcttaccacccagatct

SEQ ID NO: 269786 - DNA, 396 bp, Homo sapiens
gccccccacgagtgagtttgaggggcctctttagctcagtccagttgaggcagcagagcctttccataggggtgtggtgtgacctgaatgttgggcacgtggtcgtaactgagctttaaaagtgaatgagaggagccatgcgtgatggctcgagcctgtaatcccagcactttgggagatcaaagctgggggatcacctgaggtcaggagttcgagaccaacctgggcaacatggtgaaaccctgtctgtactaaaaatacaaaaatcagttgggtgtggtggtgggtgcctgtaatcccagctactcaggaggctgaggcaggagaatcgctccaacctgggaggcagagactgtaatgagccaagattgtgctgctctactctagcctgtctca

SEQ ID NO: 269787 - DNA, 363 bp, Homo sapiens
ataagggacttgagcatcctaggattttggtatctgccaggggctctggaaccaatcccctgaggatactgagcgatgactacatttgtttatgatttttttagctactattctttgtctacccacacatcagtttttcttaatttttcacacatttcaaataaataggagatcaggttatcacatttcatgtcaatgtgcatatcattaacactagttcaaaacttgtttcactttttttttttttctgagacagagtctccctatgctgcccagcttgtcttgaacttctgggctcaagcaatcatccctcctcagcctcctaagtagctgggactatagcaaaatttgtgaatatttaaa

SEQ ID NO: 269788 - DNA, 402 bp, Homo sapiens
agacggggtttcgccatattggccaggctggtctccacctccggtgatccgcctgcttctgcctcccaaagtgctgggattacaggcctgaggcaccgcgcctggcctgaagaatcttttcaaatgcaacagggagagggatagttgtatcagaatgttttcaactaaaaccaccacctggagtgccaaactgcaacggggacctagacagattcagattgtgccactggagccctggaattggattgctggatagactcactgtgttaatttatttaatcttggatcaagatgcccagcatggaagaagactgaaccatcacttagaggagagctgcttacccctcactgggttgtggcatgaacaataaatacacttttaagatactgaaatttgggagt

SEQ ID NO: 269789 - DNA, 421 bp, Homo sapiens
gggtccaaatatatgccattcacttcccatatttagtcctgttatctctctgaagactggcccaagagaggcctttctgatgagacatttagcacagcgattaatcactagataaacatgtgaatgggtccatttgcaaagtgaaagctccctaaacagaggcttgtcctttacaaaaagagcaggtccaattttccttaaaagttcatggttgcctatgtggtgtgatttgagaaatcctgaaccttctgttcccattactttccctgttgagctctacatttcatagtgtatcactcctgtggatgaaacctggcctctccagggcagtttctctaataaatggccatagtcctgggaaaggtcctgatgccttagtgtgcagtgtgcttgacaccataagatcctttcttctttgata

SEQ ID NO: 269790 - DNA, 660 bp, Homo sapiens
ggacgcttagccggcccttatattccagatttggaacttcgaaaagagtacgtactgattttccaaagggttttttttttttcatgtttaaacgttaataaggacttcggggatgattttgtgagcagaaaagtgggtgatttatcaaataggaatgtgaaatgggcatgtttcaagtaggtcgtctgggcccagtgaactataattgttgctttttgaactttgggggtgggggtgggtgatgtagcaattgttttgcgtagtttggcgtatatatgttagaatttgtttttaagttttacttttgggaaacagttaaaacaacccagtgatggtagatgtgtgtgtattgaaattgagctttcgatgttaaatcttccaagagttgtattttgtgcagttttttttccgatggcattaaggctctagaagtaaaatacttcaaaatacggttatggtttattttcttttggtagctaggcatgttttttctttagtgtaggagtatagtacactgtaatcgtattttaaacaagggaataagcctactaaacataaaaacaaattgtaaacccagtcacgtggtggtggtgtgattcggatgagggtcctgagaactggatccgtaattttcattgaagacagtacaaaagggaggag

SEQ ID NO: 269791 - DNA, 446 bp, Homo sapiens
gacaactgtgactctagcaccgagtggggctaggggaaccttctcctctgttgggaataaccaccacattcatcccctcccctgacccctggacaagagtggaggacacttggagtggagacaagcaggggtacctgtttaaatcaacagctgaggccagatgcagatgctcatgcctgcaatcccagcactttgggaggctgaggtgggaggatcacttgagccccaagagttgaagaccagcctgggcaacatggcaaaaccccatctctacaaacaataaaaaaaaaaacagctggacatggttgcatgcgcctgtagtggcagataactcaggaggctgaggtggggggatctgcttgagcccaggaggtgaaggctgcattgagctgtgattgcaccactgcactccagcctgggtgacagagcaagaccctgccaaaaaa

SEQ ID NO: 269792 - DNA, 348 bp, Homo sapiens
cagtaggtcaatgaagaaattaagaagaaaatttaaaaatttattgaaacaaataataatggaaacataacataccaaaacctgtaggatataggaaaagcagtactaagtggaaagttggtagctataagtgcctacatcaaaaaagtaggaaaacttcaaataaaaaaatgatttatcttaaagaactagaaaagcaagagcaaacgaaacccaaaattagtagggaaaatattaaaaaagataaaaacagaactaaataaaattgaaacaaagaatacaaaagatccacaaaatgtaaagttggtgttttgaaaagagaaagtcaaacctttagtcagacttaaa

SEQ ID NO: 269793 - DNA, 154 bp, Homo sapiens
aggaggggttcaggggccagaccctgcagggccaagggccatggccagggcactggccttgacctcaagggccatggggaaccaaggacaattgatcacaggagtggtgacatcagatttgtactttatttcattttgagatggagtctcactc

SEQ ID NO: 269794 - DNA, 372 bp, Homo sapiens
ttctagcaggacttccccagtatgtggatgggggcacagggactcttgggggggcctcaaggcatctgtgagctaggcctaaccaccgctactgaatgactgcgagatgagtcccagagctgggacgagagtgggcctggtaccctgccccagccctcccctgacaggagttagtaagggacaggttagcatgctaaagagatagcaagctggtcacagcctagggccaccacccttctgtcttacaagtcagaaacatgtcctgactttgggggagagggtatatgttaaacgggcccaccctgggagctgtagtggtcactgtggagctgagcactgggctgcactcctcgctgccccagagtgaccagg

SEQ ID NO: 269795 - DNA, 339 bp, Homo sapiens
agcactttaaccagattcacaaagtaattagtatgaccctaggaataatgctgtaagataaagcccagaactaataaaacatacccctttggggcccgaaggccagtccaattcgaggaagtacccatgccagcataggacacacctgttccaactcataattaaaatgaataagcaaaaagcaaaggatttcaacctcttctaggagcctcctgaactcagtagccttttagggttcctgctgcagccctcaggccttggggcttctgtctgagcctctgcctctagccagctgcttaaccaccctcgaattctttctcccaagctctggaccaagta

SEQ ID NO: 269796 - DNA, 452 bp, Homo sapiens
agtgtgtgaaggctccaatttctttacatccttgccaacatttattttatttctttcttcatttttttattttttaaagccttgctgtcttgcctagtctggtcttgaactcctgagctcaagcaatcctcttgcttcagcctctcaagtagctggaactttgattgattgattgattgattgattgagatagagtctcactctgtcacccaggctagagtgcactggcgctatctcagctcattggaacttttgcctcccgggttcaagtgattctcccacctcagcctcctgagtagctgagatcacaggcatggtggcgggcgcctatagtcccagctactcgagaggctgaggcaggagaatggtgtgaacctgggaggcggagcttgcattgagccgagatcgcaccactgcactccagcctgggagacagcccaagactctgtctc

SEQ ID NO: 269797 - DNA, 759 bp, Homo sapiens
tttatctaataataaaagatagaggaaataagatagtgggattcgaaataacgtaacacaaattaattattcatatcagtttctctactagaggaaatgcaatagttgattaaggatcagaggaaggaaaatccttcaatgaaacattgaaagaaagctgaagaatttgtagtgagagaaaacaattatcttaacaaacatttttatattataattctttttcccttctggacatcagatgcagataattgagttcgtgattcaattcgtgggtcattatcatcactggccgcagcaaggctttatttgtaaaaatttttttccattttatttccgttcctcattcccattccacctccccacaggtagctcttctaatatattaaatgtgtacctttctgtttgcatgtgttcttgcaaaatgcatatttttgtgtacatcaaatttacataaataatatcacatcataaaattcaatccattttagattttattttccttggaccatattttaagagccatgcatgttgctgtgtgtacatataatcccttgcctctaaccactacacaatgtgcacattttccctacatactctcccagtgatgttgaccaatattacctccagttatcgcaccccaaatgatgctgaaaccaatatacatgtacatgacccttatggaactgtgtgagaattactttgaactctatgtgcaagagcaaaattgctgttaataaagttaaaatacacttaaactat

SEQ ID NO: 269798 - DNA, 556 bp, Homo sapiens
tgcagtggcgcaatcatagcttactgcaaccttgaactcttgggctctagcgatcttcttgcatcaacctcccaagtagctaggaccacaggcatgagccactgcaacacaccaatcctcagaatttagacatcaatattacttatagactctatttagattttagttatctacatgtttaccaattaatttgctcatgattcctcctttcatcctcccacctgttgggattgctttccttctttctaaagtccaccatttaggagctccctgggtgttgtcctgctgttccataaattctctccatttgtttgaatgacagcaccttcattttgcgctcatttttgaactttagctttgctgagagcatgattttagatcgacattttcttttggcagatgttttattgtcttctggcttctactgttgctattgagaggtttactgccagtgtaatggtgccctcttgcttctaaaaagcaagactgctttgtaatggctgctctatcttagctctgcttttaagatctctttgtcttaagtattctccaattt

SEQ ID NO: 269799 - DNA, 92 bp, Homo sapiens
ggacaacttgatatcatcccccccacccccggtgtactgcaataagagggcacaatatcatttaagtagtattatagccagaaacacataaa

SEQ ID NO: 269800 - DNA, 455 bp, Homo sapiens
ctttgaattttaagtcttttttcttaaagatagagcagggtaaatgcgcctatgtcttccatgcatttccagggcagcatgccactcctcgttttaatgatttgctgtcttttgcaggagaggaagtggtagaattagggagactttgcaggaatgttctcacatgtgtgtctgcacatgcctacccacaagtccacccacaaacactcagctgccacctatgcaggcatgttacagtttgtcggtctaccaaatgaaagattcattttcatgtttacatctgcaaatcctggacaattaaacatgcatatgaggaaggccaatccatttgtatgtaaaatgttgaccatctaagaaatactcaggtatcttaactataaagcacattttgggctcaccttgtaagggtgaatctggattctttctgcaaataacaaccaaattgaagtgactca

SEQ ID NO: 269801 - DNA, 389 bp, Homo sapiens
agtttccacttaacatctgggcatttttcatttgtctatttgtcccatgatgcttttgagcaatggccagactcagacgagttttggtaattgtggtggacatctgttttggtctgaccaacatccctttccctgccattggaaaacagcagccagcttttcctttcggggaactaccctgactccactgcctgcagtcttgagggaactgtcaatcaaggagccttgggtaggtgagatctgagacccatggcaagccagtcagactcttcagggaatttgatcatgagtggaatgacatcagattggaaaaataattcaggtccaacaaagcatcattaattcctgttacgtcaagtagcacagtgatgagactgcaatgaactgaa

SEQ ID NO: 269802 - DNA, 462 bp, Homo sapiens
tgagaaagagcccagcacagccccgcagcagatcccgggcactcacgctcatttctatggggacaggtgccaggtagaacacaggatgcccaattccatttgaatttcagataaactgccaagaactgctgtgtaagtatgtcccatgcaatatttgaaacaaatttctatgggccgggcgcagtggctcacacctgcaatcccaccagtttgggaggccgaggtgggtggatcacttgaggtcaggagttggagaccagcctggccaacatggtgaaaccccgtctctactaaaaatacaaatattaatcgggcgtggtggtgggtgcctgtaatcccagctactcgggaggctgaggcaggagaaccgcttgaagctgggaggtggagattgcggtgagctgagatcacgctactgcactccagcctgggtgacagggcgagactctgtctcaaaaaata

SEQ ID NO: 269803 - DNA, 405 bp, Homo sapiens
tttttttaacttttgtagagacagggtcttgctatgttatattgcccagactgacctcaaatgataccccaccacagcctcccaaagtgttgggattacaggcataagccaccatgcccagcctccattcctgaagttaacctctttcttggtatcaacttcataagcaagatacatttattaaacatataattatatagggcccaaaagaggagtctgtaattacagaaaaaaaaaataccttgaagaaaggtatatatgcagtagcatcaaaatatgaaataaataataaggttataaacagatcagagataaatacagtaaaggactaactggctacgcgcctacttcaactcagaaaaatactgtgagaaaaattgataaagtaacttttttcaaaaaata

SEQ ID NO: 269804 - DNA, 469 bp, Homo sapiens
  misc_feature (263)..(263): n is a, c, g, or t
  misc_feature (331)..(331): n is a, c, g, or t
  misc_feature (457)..(457): n is a, c, g, or t
agaaatgcgattgcagctttcagaagagactctggaatagaggacccaacaaacggatgcctggactcctgacccaaacccacagtaatggaatcaggacgtgcttgcccctgaaggttaaagctgatgtttgccccccaaggaaacctctttccatcaaagcatctctcaccatcatccctggcctacagagggcatccgcttttcaagaatgccaactcctctctcaccaatgtgtgttttttctgaagtttgcttcccanggaatggccttactgttcaaattcagatgcactaggcaagttcagaagacaagagtgaagatgagacnccaacagcctcacactgaggacgattctttctccagctccccactgcacaagcaagcttggtattcatcaatatgacatggtctggaagttttcctgtatattcatcagcttgggttactaaacanagtacaaaataa

SEQ ID NO: 269805 - DNA, 582 bp, Homo sapiens
  misc_feature (376)..(376): n is a, c, g, or t
  misc_feature (444)..(444): n is a, c, g, or t
  misc_feature (570)..(570): n is a, c, g, or t
agaaatgcgattgcagctttcagaagagactctggaatagaggacccaacaaacggatgcctggactcctgacccaaacccacagtaatggaatcaggacgtgcttgcccctgaaggttaaagctgatgtttgccccccaaggaaacctctttccatcaaagcatctctcaccatcatccctggcctacagagggcatccgcttttcaagaatgccaactcctctctcaccaatgtgtgttttttctgaagggttccagaagcaacactttgttaggagatgctgcagaagccagaggattgcctgatgcctcccagctgaatcagcaaagctttcctctaatagcgttgcttgattaaggggttttgcttcccanggaatggccttactgttcaaattcagatgcactaggcaagttcagaagacaagagtgaagatgagacnccaacagcctcacactgaggacgattctttctccagctccccactgcacaagcaagcttggtattcatcaatatgacatggtctggaagttttcctgtatattcatcagcttgggttactaaacanagtacaaaataa

SEQ ID NO: 269806 - DNA, 603 bp, Homo sapiens
accaacctttgagaacaaattcccaccctctacaactacctcaaagaatagaagagagaaagctactcaactaatttttaagcataatcttgctattaatgtcactaacacacactaaataatgttagcaaatcaatttctcagtgcattttaaaagaattatataccagagtcagtgatttatcctggaatatttgatgatctaacgacagaaaaactgattgataaaatttattacattgatgaggaaaaaatgatcatcttactagatgtaataaaaaaatttacagtaaagtttaatatccattcatagtgtaaattcctagcaaattaggaatagaaagaaataatagtatcaagaaaaaggctacttatacaaattcacagtatatctaatacttgatgaaactttagatacatttgcattaaagtcagaaacatgattaagattccttctattgcccatattattcaacattgttctgaagatctcaacattaagacaaacaatgataatgaacacaagagaagagaaaatctgcagaaaaaactcacaaaaattggcatttggagaagatatgactacacagaaaatagcccaga

SEQ ID NO: 269807 - DNA, 396 bp, Homo sapiens
cctaaagattaaagaagcttaaggaatgccaaatagaataaactcaaagaagtctatactcttgacacattataatcaaaaattctaaacactgaaacaaagaaaaaatcttaaacaacacacgactaaagaacaatgggattcagaaaactgaatttttcattataaaccatgggggccagaaggaagtgaaataacatctttaaagttgtgagagaaatgagctgccaactgaggattctatatccagcaaaaatatactttaagaatgaaagtgaaataaggatattctcagatgaagaaaaactaagataattaattgctagtagaaacatcaggaatgaagaagaggaacagaaatgacaagtgtctgaataaatatcatagactattctt

SEQ ID NO: 269808 - DNA, 304 bp, Homo sapiens
tataggagattattttttggtggaaatcttgaatgaaaattcactagctacctgaagtttccactgagtcaaaattttagagcttttctttcttgcagcagtatttctttttaaattttctttcttctatgcagagtaacagtataataccaatgtaagtgatattttatcacaggtgttagtagtttgcttgtttttgtctttaatcttgtttttgaggtaggtggtgtggaagaggattaaaatacacgttcatataagtacataaaacttaaaggtagagtttaacaaataattttaaagc

SEQ ID NO: 269809 - DNA, 689 bp, Homo sapiens
ccatgcctagcctccagctccttatttttagtggattaccttaatttgtagtattcctttcatacatttttctcactttaataatcacagttttaaaatatgaatactttagtagcattgctaatactactttatataataatactttagtagtatcgctaataccactattacaaggataactactattgggaagcatttattgtgcaactactatatgtaaactctgttccaggtgtttcatgtgtattatttttcatccccacagcagccctgtgaggtgggtattgttcttcacattttagaagtgaggaaacaggcttagagtcgtagtgatgtgcctaagatgacacagctgataagcagtggagcaagaaaggagcctgagatgtggctcaacattcatcttttttccattgcccctttcacagacccatttatagacggggctgagggcctccctaaagaacctatagctagtcaaaggcagagctagacctaagcctagcttttctgacccttctcgtattagacctgcattgtatgtatttttttttaaagactggtcaagtgcagtagtgagaagggggaaggagcagaacaaggagtttgatctgtaaccgactgggacattaattgggtagggactactttggacccccactttttccgaggacccggcttttcgg

SEQ ID NO: 269810 - DNA, 423 bp, Homo sapiens
aggctcatggatcatgatgcgctgtccccaaaccaacttttcagcttcctttaacagcaggcagtggcagcaactgcccttacacaaggagccagcctttggccacagcatccagaagagaagcagacatagtatacaggttagctacagtggaatgtatgtcctctacaacatcccagtttgggtccgtgcggggaattgctccagtcgggatctggagtgtcgtctggattttcatcatgaaggtgctgtgcctcttcctttgcttcatttaaaaccagccatagctcatctgcagtgagcataatgtcccagagagcctgctcgtctgcccaggcctcccgagaagccaagcagatgccagcactgtgcttcctgtacagcctgcaataccaagagccaattaaacctcttctttgtaaa

SEQ ID NO: 269811 - DNA, 357 bp, Homo sapiens
tgcaaggagggggaagggatggggagagtaaggagcttcaccacatgcgtttctgcggttttgtttggtttcttaataagcaagcaatgcgggtgtaatgttcaaactgaacagagctgcctggtgggcgcatgatgtttgtgatttcccattctctgctgtgggcttcgaatatttgttttaaaaaatcgaggccgtgccaggggctggggggcggggcctcccgcggggcggggctgcgagcccacccctgcggtccccggcccgccccggcgcccgggaaactgtgtggcgctgcgggccgcgcgagagggacggcagggggcgggcgcggcgcggctgctgactcaccggcta

SEQ ID NO: 269812 - DNA, 997 bp, Homo sapiens
ctgttctttttttttaaggcaatggcactctttccatctcttcctcctgaccattccaccaaacatctcccacagatacaaaccatagagaatatcaggtattttcaactttgctaatcaactctttaaaatgatagtccattttagaacttgaacaaatatttactataccatttatcgaccccaagttgggctttcctcctcttaaagaagttcagtgaactacaagaatttgtggattaaaaaaaaaaaaatttaacccaaagactcctagtgacctttgctggagctaacacagcatctcttaatccagctctaaaggatgtgaagagctccaggcctgaggcaccatgctgtgcagcaatttacttcttcattgcaccaggctcatccctcatggcccacagcatccaggggtaaactcggaacaaaagattgcttacactttcataacttcaaaaattacatcacacatgcatgtccagtgttaaactacaactgattacatgtactgtctaacgaaattgttgaatacttgctctgcttttctccctgttggccttacaatccctgtttctaatttccttccatcctcgggtcataaaactttatacccagtggcctggcacaaaagtttcttttcttgtttccctagatatcgcttaaagcaggcattgcagtccactgtacttcttccttctatacaagctggaacaccctgagtcctaagctttactgtgcttaagaatgacccgtgggaggctgaggtgtgtggttcacgaggtcaggagttcaagaccagcctggccagtatggtgaaaccccatctctactaaaaatacaaaaacattagccaggcgtagtggcgggcgcctgcaaccccagctacttaggaggctgaggcagagaactgcctgaacctgggaggcggaggttgtagtgagccaagatcatgccactgcactccagcctgggcaacagagtaagactccatctc

SEQ ID NO: 269813 - DNA, 462 bp, Homo sapiens
caggaatttgagaccagcctgggcaacatgttgaaaccctatctctacaaaaatacaaaaagtaactgggtgtggtggcttgcacctgtagccccagctacatgggaagctgaggtgtgaagatcacttgggcctgggagttggaggctgcagtgagccatgattgcgccactgcacttcagcctggatgatagagtgagtccgtgtctcaaaaataaaacaaaacaaaaaaacaaaaaccaaaatagtataaactctatcttaaaatacagtgtaagaattattttagaattggaactatttgtttttttcaaacaaaatcttttgaggggctgggcatgatggctcacacctgtaatttcagcactttgggagcctgaggtgggaggactgctttggttcaggagttcaaaaccagcctagatgacatagcaagatcctcatcttgttaaaaaaaaaaaa

SEQ ID NO: 269814 - DNA, 315 bp, Homo sapiens
cctccgcacagctcccccagggctaaaggcaacccccactgccgccctgcactgacccttccagtaactgtttgtccagaagacttcagctgaactggcaaacagttccaggatgcggtcagaacacctgctaaccaaagctggcaaaaacatcaccaggatgcagtcaagacacctgcacccccaactcggttcacacaccccgacccagttcctcgccctgtaaagccctgctgcagtctgtaagcaaggctgcctcctctgcctgtcaaggaacagcctggcaggacaaataaaaattgcttgcctgtcatt

SEQ ID NO: 269815 - DNA, 435 bp, Homo sapiens
tctttgcctcaaggtctactgtctactttctggaggaattcaggctaagacacagaattacaagtaagtgaaatgtcaccgtacttattacaagggaaattatgcaatttgaagagggaggagactagtggctaaatgggaatacttgaatgtattcagttttcattatccaggctgcatctactttatgtggattcggagttgatgcatatgctttatgtaatctacctgatagggaaatggcactgagtcaacatacaaggtgaaggaatctgagcaggtgtttggacttcagcatcaggttaacacctcagaggccaggattgagtttgttggcacttgcagctgttagaaataaacgtgacattgcctgaataaatcattggttagctcttgtcaatgatacaggagaattttcacttcttccttccctca

SEQ ID NO: 269816 - DNA, 478 bp, Homo sapiens
tggagctgaagttaaaatctctctctcctctacaggctgttgaattgtatgtaaaggcttgggactctggtgtggcacttaagtactttttatcaaccttcaggctttagacagtctcattgccttagcccacaattcctggaatctgtgaaggcaatttattctgaaaattccacttaccgaaaagtaacttcatttttccattaaacgaattgaagtttcaaactccttgtttattgctggtctaacaaggccattaatacgtcctgtcctctctgctttagtgatagcaggcagcttgcggactcccagctgcactggccagataaccagtgacagagtgtgtcatggcaggtgctagagtttcagagttgaacccaactaatttttgaaactttaatgattataatgaggcagtttccatgttttccaatcattgtttactcaaaggcctcctacagactatagaaacataacc

SEQ ID NO: 269817 - DNA, 499 bp, Homo sapiens
tttttttagataccacttttcatagatatcttattttttttaatagtgcttgtcttttgtattacttatttacttgtctgccacccaaacctaactgtgagctccttgtagtatgggaatatgactttgtaaccctaggacctaacagggtatttaaaattgttaaaattcttagattttattttttaacgtggccacggtgtcttctacttttggtatagaaatgcttggtattttcttccctcactcaaccttttccaattaattccatctcatcctcttaagattcatctgaaatgttgtctccaggaagcttccctgaccttgccttctccctttccccttaaagtcttcttttaatgttcttgtcagtagcctatgtggtatctgttttatactttccacattgtatatatatttttatgaatatggaattcataaatgcattacttgtgcaccccggccagactcgctatcccttttcctctttatttttcca

SEQ ID NO: 269818 - DNA, 238 bp, Homo sapiens
gctcatcacaaacttgaaacaggcaaaatgtacctgtcagagcctaagtagaactggattgcatgatgtatggcagtgatcttccagagcgctctcaagtgtgtttgacacgagtgaactgtgttcgagttgattctccctatggcagtcccaaagcctaattatgaaaacacgataagatcattgcacagttagaccattgcaccattggcattcctaataaacagatcagcttagc

SEQ ID NO: 269819 - DNA, 451 bp, Homo sapiens
gcacttcccatgcaaggctctagttccagacatgcttccagaattctcgggaaaccccctcctctcccctgaaaaccccgcccttgcacattagatatcctggttttcctgttggggtcccattatggcatcatcagcagatggggcacagtctcctgaggcctggggggaatctgtcccagaaaccagggtgtggggacttctgactaaatcaagggaaggttttcatggagaaagtcaacaaaaagtgaacattctaatttcaaaaatagtctcctcattgcacttcaaattaagggacttggaaaaaggggagcagggagctgggtgtttaatgggttcagagtctgatactgggatgatgagaaagttcttgagatgaattggcggtgatggtgagaaaacaatgtgaataaacttaacgccaataaaccctgcactcaaaaatgat

SEQ ID NO: 269820 - DNA, 283 bp, Homo sapiens
gtttacagttaattaatgctactttgtcaacttggttccattatttgatcttcagattcaacaaagtagccgaattctcaactaatgacttaaaacttcaaattttaggattaaacagaatggatatccactccacctggaattctctttgctaaaacaatgaggtagttcagtgaggtaatacaatgacactacattgatttcccccctgtggcgccaaagacagttcttgatctctacacccagtgacaacagggtactcaaaagggaactagtggtaaga

SEQ ID NO: 269821 - DNA, 119 bp, Homo sapiens
cttgtaagggtttttcagatggtagtgaaacaacttggaagtcagcaattcctaaggattttccaaatcttctcagactaaaattctcccactttcctgctgccttgttcaaaccatgg

SEQ ID NO: 269822 - DNA, 387 bp, Homo sapiens
aaactaaattagctaatttatataaaatactttctagctgacattggtatcatttttattaacttcagtaaaattgataataaatatttttacatcccagattcagtcagaagactaaacatacctcagatttcaagtataatataatagattaagtcaacctaaattgaaaaaacttgggtaagtcatctttactaaaattagaggacttaaactgaccactttgaggcacaaaagtatcttcagggaacacagttcagtcagtagtagaaaataattcacaactacttcccagtcttttaagaagtgaacattttaactgaagtttgactgcgatgtgcaggtacaatgaatgcataaatagtaaaaatttttcaaggaaggttg

SEQ ID NO: 269823 - DNA, 470 bp, Homo sapiens
aaattgctaatttaagtactgtgagaatcagtgtactaagctaatcttgtgaaaagatggttttggatggagactcttcccagtaattattacggagttaaggcaccctttttaccatcttctctgtcaacctaactgacatgaatttctaacctggtaaagtgagaagagtgatcaggagaagataatttgcatagtatatatagatttctattccatttatataaaacccttgaatggtaccttagtagaaacaatataaaataaagctaatatgggttagatgataatgtggttaagtggatttttttttcctgtctgaacaaaagaactgacaatttaatcaatagacccctgtcagtctggagagatgcttctagtggtcagcacggcactctggtctttgtgtgtgcatatgggtgggggcagggcagggtgttgcattttcccattaatcatggtaaacatta

SEQ ID NO: 269824 - DNA, 445 bp, Homo sapiens
cagcacagacctcatgctatcactaattagccagagcattcccagccaaaaatcccagtgcctgtccttgacaaaaaagtctgttttttccacagtaagggtgaaaagcctgcctctctgtctagggacatctccataagacaagcaaaaatagggtggtggtgagctctcagatcagccagcgcaatgaaacagactgcagcctcttaggagacttactgtttgctgcctccctttctctgcaaagtgggatctccattagacgatgcctttgtactctgacaaaatacctaaccaccatgagacaagccacttctgcattattctgtacattgttcctatccattccccatttttggcttcagaagtcatcccctagccaacttccagccacttgcattaatgatgaatgcgattagcagcctatgctagtccattagggaaa

SEQ ID NO: 269825 - DNA, 790 bp, Homo sapiens
gaaactatagctaccaagcccattctttgtcctagattcaaatgaaaacactgtaatgtgacctcccacgggttttcctctataataaatttacagaacttctgaaaagattactaataattaattatttccttgtcccctcccaccccttgtcaaatgactctgaaatctaatttcttttccttctgacaaacagaaaaaggaaagctacgaaagctccctgtacaattccctcacctgtttacagcccattcttatttcaacaatcctaggaactggcagaaagagagggtgcagggaagaaagggtgttacttgtcacccagtgcaagcaaacaagatgttgtgaaagaaattatgtccttccaaaatttgtatgtcaaagggcctttaaagaggtaattaggtggccgggcacggtggctcacacctgtgatcccagcactttgggaggccgaggtgggaggatcacttgggcccaggaattcaagactgacttggacagcatagtgaaaccccacctctatttgtttttaattttttaaaaagaggtaattaggttgaatgaggtcattgggtggggccctaatgtaatctgactgatttccttgtaagaagagggagaggcaccaggggtccacacccgaagagggataactgtgtgaagaggcagcaggagagcagccatgtgcaagccaaggaaagagacctgaggggaatccaactctgctggcaccttgatcttggatgtccaccctccaggaccgcaagaaaatacatttctgttgttt

SEQ ID NO: 269826 - DNA, 373 bp, Homo sapiens
tggagtggggtcaggagcaggcaccctgatgtccttgttggcttatcttcatggatgtctttgaggccacctctctttctgtggccaccagcccttccttctcaaccttctcctgctcaaggccaaccccactttctctcttccaagaaatgcacctgttgaatcttcacattgatcggattggcacataaaatacaagacaccctatagaatctaaaataatttttggtatgagtgtgtcccatgtaataattgaggcatactgtatgaaaatattattcattgtttatctgagattcaactatggctgggcatcctataattttatttgctgaatctgacaaataaaattcagctaaattatttgctaaat

SEQ ID NO: 269827 - DNA, 423 bp, Homo sapiens
ataagctgatgtcacagggttggacggacctgttgccacaagatgctaatgctctggaaacctgccaaatgtattgcctgtttaaaatgtactccatagaactaccatttgatccagcaatcccactactgggtatctacccagaggaaaagaagtcattatacgaaaaagatacttgcagctgggagtggtggctcacacctgtaatcccaaagtgctgggattacatgtgtgagccactgtgcctggccgattactcagtctatggacgttttcagctcttctagaagcttccacgttcttcaacatctgcctctataactccagcctccaatttctctacttcacactaggggttcaccatacttatctgcccatctttcactgatttgccaagaaaaaaaacaaaaaacattcaaaaaa

SEQ ID NO: 269828 - DNA, 567 bp, Homo sapiens
gtcattcacacttcatgtatagcttcttattataagggcaaagttgagttgtaactgagatggaatgcctccctggagcctagtatgtttagtctcaccctttataggaagtttgccaacctatgggctagaatactgaggctgatgtacactcacatgtaaagggaataccttccataccacatgtagtgatatggaaaaaatctccatgacattgttactaagaggataaagcatggaagagtaccacacaatacctttctaattttagaaatagcaaatatgggccagacacagaggcttatacctgtaatcccagtactgtgggaggccaaggtggttgggtcacctgaggtcgagtgtgagaccagcctagccaacaagaggaaaacccatctctactaaaaatccaaaaattagccaggcatggtggtgcacgcctgtactcccacctacttgggaggctgaggcaggagaatcacttaaacccgggaggtggaggttggagtgagctgacattgtgtcattacattccagtctgggagacacagtctcaatctacaaaaa

SEQ ID NO: 269829 - DNA, 177 bp, Homo sapiens
tttttttgagatgaagtctcgttctgtcgcccaaactggagtccagtggcatgatctcggctcactgtaagtctgcctcccaggagaatcacttaaacccgggaggtggaggttggagtgagctgacattgtgtcattacattccagtctgggagacacagtctcaatctacaaaaa

SEQ ID NO: 269830 - DNA, 282 bp, Homo sapiens
ccaccagatggcaaagttgaggagtgagttgtgaacaatttctttacattattgactgtggcgggttgttgtaactatgcccatgtctcttctataggcaagatgaagacagcacatctaacaaggatccaaattaatggcattgtctcagcctaactagtgatgaaaggaaaataatagcagcttgtaattttttttaaaaaaaggttctcactcttgaccatttcttttacctcccaggaggacacctgaatagtttagagacagaaaaaagcatcaacc

SEQ ID NO: 269831 - DNA, 461 bp, Homo sapiens
ccttgctagtccagggccttggacgtatcacccaaggcctttctgtgaaagacactcaaatatttgttcaatgatttctaattgtatccattacttatttgtagcttcaaaaacaacgtttgaatcttaacttgtttcaccttgagttaattttgtttctatacctcttcaaagaaaaggaagattgaaggggtctttaacgcctccattaactcctgcaacgtgaatttgatatactctcttttgcatgaattcagctttgtgatttctgaaatggtatcacctgaaagccacttaaggccagaccaatgaaatgttacaggcaatatttgaacctaggactgactgtttttttttggctctgctcatgtctcttccaattctaaaattttatgatttaatgattttggaaatgtgtcaaagagagacttagtgtaattcaaaataaatttcaaatctga

SEQ ID NO: 269832 - DNA, 431 bp, Homo sapiens
tgctgagactagtagttgaaggagttgatttttctggcagctttgctcaactgggactctgcgtgggttacgccctgacaccctagtgttcggaaactaacttctctcctgtgcatctagaatggtatacatgaaataagacatgaaatccttgggaaaactgagaaaatggtctcttaaatcatttccataattcatatgaggaaccagggaggtcacggaactgtacaaaagggctgtcttcgactttgaaattgcagaggaccctgtagggtaccaaaaattggctacgcttagtatattctaatcctgcattggtgtgactctctgagaaaccaatttcttctgagaagagtgggcaaaatcaggagattactcgtgtattaaatgcactgttttattttcaaaacatttttttcagtctcccttac

SEQ ID NO: 269833 - DNA, 597 bp, Homo sapiens
ttcaggcaggacccctacttttaatttgtcttccctccaggtccagctgtcaccttcttgagagactctaaatatacaacccttactacgaacctttttctccctttcttgcatttttttttctcagttgccacaaaaaattcttctggtctttgttccagttttgagctgaaaatgatcccagctgtggttgagaagcataagaatgcctgtaattattccttctaacaaggaaaaggaaactcaatatatttagagtcaaatttaaatgatgtaacatcaattacaaaaacctttaaggggcctaaaagtcccctttggcatactttttcttgataaaacctgattttcctcaagctctactctttgggcagtaacttgctgaaaattatatcaatagtagtctttctctgtcttcttcatgtgataaggaagtaggagagagggttggaggcacgtacaggaaataggaggggaaaagccagaaaaacccttacttattgacaataccacaatttcctatatgtgccaaacaatattgcactatattcctaacacagaatatccggcaatatcagagtatctatatttctcttt

SEQ ID NO: 269834 - DNA, 668 bp, Homo sapiens
gattaacctttaactgttcaagcctaatacctaatatctccaggtattattttccctgtgctaggtttattgcattatctggcttggaaggaacagtcacttgcttttgtaggaggttccagccaccagatttctatgatgaaataaattcttccccagattcatagcataggtgcaaatcctttgagaaagggacagaggacatactgcatgacatacctgaacttaatgaatttgattgaattaatgtctttatcaagatgaaatgtatataacatgaatttaaccattttgaagtgtaaaagtcagtggcaattcatacattcatgatgttgtgcaaccaccagctccatttaattccaaaatttttccatcaccttgtacctattaagaggttgctccctcttctccaccccatgcaaacatcaatctgtgttctgcctccatggattttccaactctggatttgtcatgtaaatggactcatgcaatatgtatccttttatgaagcctcgtgtctggcttctttcacttagcataatttttccaagtttcatccacattcattccttttgagactggattaatttgtaaatgattacctaatctcaaacactttgacaactctaaaaatggactggcaatgccatttcgtgaaaggctgcaga

SEQ ID NO: 269835 - DNA, 395 bp, Homo sapiens
gtgatgggtatggaatggtgagctcaaaggaatcccagggaggatcctgcccagccttccccaactggattctacagaaccccagcactatgagatccctgcaggaaaaaagatccctgtcaaataagatcggaaactctgctctctctgactctcttttggagtttcacaaggcacagtaccagaagccctggaaacctcatttcctcatttgtaaaatagagatgatgatgatgaggaggaggaggaggatacctatttcagagggttgcttcaagtgataaatgtaatggtgcttgtaaaaggtttatcacacctggcaaatagcactcaaacagcattattattattattatataatgttatttttatatagtatttgttactataatttt

SEQ ID NO: 269836 - DNA, 638 bp, Homo sapiens
caaaggcatctgagtggtaagagcatccggagcccaggactgctgagtcaaccctctggaatgcccacaactccccacaggccagccggccttgggactcccgcacagccacgtgagccggtggagccgggtctgtttgctagtggaggctgttaacagcacgggaagtggtcaagggttcaacaagagatgagccatctggtcctccagaggtggaggaggcacgtgacccacatggtctggccactgatgactgaacaagctatggacaccggaccccggagagaccattcactcactggccacgaacatgagttcagatacatgccccaaaaggatgagcctgggtactggattccctccctcagaaacgtgaatcaagagacacaggatgttcctgttggtccagatacttgagctaaaaggtgatggatacctggatgtggggtggtcattctggggagtacgtccatatagaaagaggagcaggtgctgtgggattctggatcccagtgatagagctaagtggctggatcaagcttcacctgaaacccactctacttgtcttagtccattttgtgttgctataaaagaatacctgcaactgggtaatgtataaagaaaagagacttatttca

SEQ ID NO: 269837 - DNA, 455 bp, Homo sapiens
cagcactgccactcactagctggggggctttggccaactaccaaactctgatctccgtttcctcacctatagagtggagatgataaaactatattttattgattctaagatgcacagtttttcaattttaatctcttggaaatcagaatgtatcttaccgttggtgggtcccatataattgacagctgtttttctttctgagaggtatgtgcaataatgatacatcttataatcagtggtgtcttagagttgatgaattatggtatttgcctaaagaatttttataaggattaaaatgtattattcaagtgcttctctttcactatggcatataaagaggccagggcctggaaaatgctcaggtgcatttcagttttgagcttataaaactgggtagataacatgactagtgagcaaaaatggctttcactggtcaaccaaagtgactagctgta

SEQ ID NO: 269838 - DNA, 556 bp, Homo sapiens
gggaaccatacttgttttttactaacttctgaattaaataacatgccataaacatgtttaagaacagatctggtgaatggatagttaattagtgctgggtgtggagaacaaatgctggtttcatctaagtaaagcatttcagaaatacaaaatgtagaaagtctctcaattttaataatataaacctgctaagccttcatttggtccttgtgtattgtctgtgtactcagttgacttctcattaaaaacaaaactgctgtgctcctgacccagtggaagaagcactgttgggagttcaaagagctaaccaggttttagtcctagctctaaatggcattgagattttgggcaggtcatgaaacatctggaggactgcaaccactagagacagacaaccacccagtagctagacagctagcccctattctggctagaagcttgacttgcaaacaaatgtcctattggtatctaaagcactgtcatttgtggttgaacttgtaccaagtgggtagataggatcgcctgggagtttgttaaaactcgtgggccctacctc

SEQ ID NO: 269839 - DNA, 366 bp, Homo sapiens
tcattcacagtcatgatccttgttgtctctttggatggctgaaggtcccaagtgttgcagtgctataaaaatggatattgctggctgggcgcagtggctcatgcctgtaatcctagcacttggggaggctgaggccggcaggtcacctgaagtcaggagttcgagactagcctggccaacgtagcgaaattccttctctgctaaaaatacaaaaattagccgggtgtggtggcgggcgcctgtaatcctagctactcaggaggctgaggcaggagaaccacttgaacccgggaagtggaggctgcagtgagccgagatcactccattgcactccagcctgggcaacagagtgagactctgtctcaa

SEQ ID NO: 269840 - DNA, 835 bp, Homo sapiens
caaagctgggctgtctctgaaccctccttctgcacaccctcattttgcgagccagtaacatctcaactctcatgtaaaccaccctctgcgaggctgtgcatttgtactttaggctagtcgaattttcttgtcagatttttctttcttgtcagacttttaaagaaaatcagtttctagattttggtatgtctcttcttcagtgaagctgttttgaccagcaatagagggcaaatttccctttggaaatttttgtgcatttcctttgataagtccagtgtggatcaataggcttttcaagagctttagaaaagtgcatgatgaataaattaatgttaattaatcagctcctcccagtcaggaagctttaaggattaatttggaaatgagtgtgagctttgacctagctagttaaccaacttatctgcacttcagtaaaacagagataatacttactcatggggctattgggagcattaagtgggaactccacgtctagtccctattacaggcgtggttcatcttggtttccttccctttattctcttcatacaaaatgaagggtaattgttgcaaccagaaaacgtatgaataccaccttatgtatattggatgtttatggttactgaacacattcatatgtatgctaatgttatagggctgaaaaactaagtgtgtttttcataatactttacaaatctcccatccaagcaagatcaggggtcatatttggcttagaactaagtcaagaaagagtttgttgctgaataccaagatcttaatagaaaagctcttatgatgttgcataataaatatgggtattgcatataaatgtgat

SEQ ID NO: 269841 - DNA, 400 bp, Homo sapiens
gctgctctcctaactttggcgatggcttttaggcttcgccttcggaatgcaagacaaggactgtggagacgcagctcagcagccaccaaaagcagctcttgacatttcagacagtgacatgacctgctgctggatttggcaacagtgaaagagtcactcttagatacctgtgcctgaggccagccaaagggtacatgatggggtggcaagacagggtgagtcacccacagaagtgttctaggctggaagtcaagagattttggttctggtcttgcttcatttgttgttgttggtggtggtggtggtggtggtgtgtgtgtgtgtgtgtgtgctcttttatttcagcattttttttttgagacagtctcattctgtcaccaggctggagtgcagtggagat

SEQ ID NO: 269842 - DNA, 392 bp, Homo sapiens
caattatttcaagatcatcttctaagtgttcactaaaatggatgacatacatttcagagaagaattttttgtttgtggaacgaatgcatgaatgaggacaaggagaggcctggatcacaactttgtactggaatatcaggagttgtgtaaagcaaggaagcggagactctgcagaacaaagccccttcaagacaaggaaatgccgtttggagtagctactttgaggacaagagacaaaaagcctgaggagaaagtcaccatgaaggaaacagaaagactaaacagcatgcgtgatctttgattcagagtccccatctcaccctggactgccttcctttggaattcccttgtggaaaaaaaaattaaactcttatttggttaaatcattgtaa

SEQ ID NO: 269843 - DNA, 452 bp, Homo sapiens
gaagagaagaggcatgtccttgagggccagaagggagaaggaaggagcatattcctcaaaactagaaaagaggaacaaaatgattaggtctttctattaatggagacatatgtcctgttgggtggcagatcttctgtgaggtagcggaacctgaaaggtgatgaccacatgggggcaccaaaagaggctgaaccttggaccctgcaactccaagccccagcaaaggtgcctgtgccctaattgtgacacagaagcagcagagccatgggaacttgaagggactttgtgggctgcacacaaagggctgcagagctaaccagtatagatcagcaccttgagggcctctttgatgcactaggatcccgtaggggagccccaataatcacgactgggaatacatttcctgtggcccaatgtgatggtggcttcaatgccatacatacattcacttt

SEQ ID NO: 269844 - DNA, 425 bp, Homo sapiens
agctcagattttttttagtacatataaattggggtacccttatcacagctcaggggccacatactttttgagaactgttcctcttttcttcattgcaggccacctccttactacagtgatgttttaaaggtgaggtacctacccaagtgggccaatcacaatattccagctagtggacactgattaattctgatggaaactcttaaccctagtttggccaaactgtatcccattcctttgctcctacagtacttaagcagttatttcctttctttcctacataatcagcttttatttttccctctatgctgtttatttttttttccaataggaatggaaacatctatcatcctaagaaaatttgacctgtggcctctaatttcctctttagttataatacatttatctcctctttgctaaaaaaa

SEQ ID NO: 269845 - DNA, 320 bp, Homo sapiens
gctgggctaaataaatatgcacatggaaaaaaataaatcttaagccttatctcgtaccaaatgtaaaaattatttccaaatgggttgtagatataaatgttaaagattttaaaaagtgcttctgtaagataagatctttgagatcttgggggtaggcaaagatttctcaaacagaacacaaaatgtactaacagtaaagattgatacattgaactacattgcaataaagaacttattttcatgattaagaaagaaaaatacaataaagagagtagaagacatttgttaagaaataaagagctcctgtaaatcaatatgaa

SEQ ID NO: 269846 - DNA, 478 bp, Homo sapiens
tgagcccaggagtttattatacaaaataatgtgtatatacattttgtatttgtacaaaataatgtgtacatgtatacaaatataaatgatatatatacccaaatataagtgaaatatttacacacacacacaaatacaaatgaagttgttttatagtcaaaaccctgccctctagtgtttatggaaaatatgccgttatttcagaaatgtcagattaagtatattctctatgtcaccagtagagtgagtccttgtacagggaaacaacttctccacattttgagaaagttgaaatcttcagacttttattttcttcaaaatcaaattgatatattttatcaatatgcgacatcatacttttataaaaatatctttgtgacaggttatgtattttatcacctaaaataagcaataatattaatgtaagcatttttcctaattatataaaagtaattcagattctttattgaaaattcca

SEQ ID NO: 269847 - DNA, 819 bp, Homo sapiens
tgctgaggcgatctagaggatcccgacgctctctctgtgggacgaatctggtcatctccatatgttctcatagtgaaattcttctcgttttcctttcatttttcaggcctcgtctaatttaaaacaaaccacacagacacactggccaaagcagcgactgcctctgagaggaaggtgggcctgcagtactggctgggaccacctccacatctgaagatgctgtttgcctgtatttgcttcccagcgtccttcctccctgcctggttgcctgttgggcctaacatggagctctgcccacagtagtgtcgttactatggccactagcccataccaaggcatggcctttgcagtccccagcatacagctcccgacctcacaggcaagtccatctctattgctgtcaggaagtaaaagttcacacggggcgggcacaaagtcctgctcatcccaaggcaccaacgcacccccaccaggctttccccagaaggcaactcaaccactctaggattttttttttttttaaataaactgtattaggagcttgtcagaaatcccgaagttggagaccactgtgaaactcctgggtcccaccggggctgagctcgtaccagtagccctaaattcaaaaagaaccagggaaggttctatttacaagtgaactggactcatgatgctccaccaaggaggcaatccctgaaaacaggcaaggttcatcagcaactctaaccgctcagggtgtgctattactactttttgaaaacaatcgtctgattatacaaacatgtatatagtgcttaacagtttactctgtattctttc

SEQ ID NO: 269848 - DNA, 237 bp, Homo sapiens
aggcaaggatcagatcctgagtcccttggagaagcaggaaggcatcatgatgactaatgtcagaggcaggggaggacaggtagggatagacagggaagcagtgctgggaagatgctaaaatgctgcagtttgtgcttggaaagatcatggcctggttcttccattgtcatgatgggttgttctctttcttattgtttttctaatttgtcttgactaatggagaagatcaggagctca

SEQ ID NO: 269849 - DNA, 445 bp, Homo sapiens
aggcgtgagccactgcacttagcccccaagttatgcttttttaatcccaaagcactcagtttatttttccagctgatgaaatttttttttctaatccacctatttgctgatttgctaccttttagagcccagggtggttcaacaaccactcatctccttttaaagctctaggttcctgttatcggcagttgacacctcatggtacccagagcatctgcatgaacttctcattctggttttaatctctgaggatttcccttattttcttgtaagcttagctatgcaattagaatcgccctgccccaccccagcatttattttgttttatacaaaaagaatttcagactacctggttatctctattgctagaaatgaaaatcctatagattcgtttatgattttgaacatccgttagctgccccaccccccatggtaaaaaagaaaa

SEQ ID NO: 269850 - DNA, 271 bp, Homo sapiens
gccaggccctcaaacttttcggcctgcagaactgacagctgaaaaaaacgccttttcttcatgtggagcgttgtgggtgatctggtttgccatgctatcagagccccttgcttatggattgttagtttaaattactgagccaattcctgtccactcaactggtcagcaaacgctctctctttatttaaacccttttctgattatataatctatattccttgcacaaaaatggaatataggcaagtataaagacaaattctaaaaaattact

SEQ ID NO: 269851 - DNA, 471 bp, Homo sapiens
caggaaatgaaagtggtttatgccttataattgcagaccgtggtgctgtactactgcagggagcatttttcacattgggaagcaattatgtaacctatgcctatatatatatatttgtcattttggtaactattttgaacttccttgttgagatataacatacatacagaaaagtgcacatgtaacatattacacagatcagtaaactttcactaactgaacacgcccatgtaaccagcgcctatatcaagaagcaggattactagcatcccagaagcttcccttgcatctttagtcactaaccatttcccccaaggattaccactattctagcttctaacactatggactcatttatcctgtttctgaactttatacacatggaatggaacaacgtgctctcttttgtatttggcttcttccatcctatattgagataataagacttacgtatgttgcttcagcatgtag

SEQ ID NO: 269852 - DNA, 385 bp, Homo sapiens
aaacctttctttatgccacacatcttaagtacctgaacaccactctcccctggcctacagtataaaactggttagaaggtgaagaaatttaagggaaggcttacatatggaagagtaaaacattttacattcgttttgctttcagtgcccaatactggcagccaagtttatacccttcagaaagacaggtgagaaatccttctttggtagtatctaagcagtcctagaaggcttctccacaccagttccttctccacaaccagggccaactctccaggggaaaagactgccagaggcttatcccagtgaaggaagcacattatttctactctgagccaggctaactttccctagccttcccatttcctgactccaacagattcag

SEQ ID NO: 269853 - DNA, 471 bp, Homo sapiens
tgtccccttccccttagcatcgtgctctagaatttcccttatcccaccagtttgtcacaggctgaattcctgctctctggtagactgacaccctttttccatgaagaagtggtctgtcttccagatccctgttttgaatttttgtaaggaactccaaatggagttaaaagaaatccatagtatgtgtgagattgttgtgtcctctgcagtggagctgctgatgtagaggcttactctggttgtaatcagacagaaaaggcttcttacccctgaggacttagctggtgttatgccagaaatatgggaaaggggacaggctgaatgaccacagacaaggaatgtcagtagtctttcagttgcatgtaatgtccagtttctctcaaaatgcagaattttttcataatgtgggttttgttttttggttttgcatgctgattatgaagtaatatatgttcattgttaaaaaaaaaa

SEQ ID NO: 269854 - DNA, 470 bp, Homo sapiens
cagctaacgtttgttaaaagcccatatcctttggatgatctacatgacccgtcatgtaggagtccatcagttcctcttccttccctcatctcaccttttctactggagtccattctctaaggccactccctcagcacatgcctggttgctttgcttcaaacatgccaggtgtcttccccatggcctttgaactttctctgttacttttccctacacattagtgggctacctctctcagttacttcaggtgtctgttaaagtgctcttactggccaggcgtggtgtctcacacctgtaatcccagcactttgggaggccaaggcaggtggattacctgaggtcaggagttcaagaccagcctgaccaatatgaaaccgggtgttcactaatacaacttagcctagtgtggaggcgtgcacctgtaatcccagctacttgggaggccgagacaggagaattgcttgcctggg

SEQ ID NO: 269855 - DNA, 458 bp, Homo sapiens
gcaatcctcctgccacagccacctgagtagctggaactataggcatgtgccatcatgcccaactaattttatttttatttcagttgtagagatggagccttaccctgttgcccaggctggtctctgactcctggtctctagtgatcctcctgccttggcctcccaaagtgctaggattataggtgtgagccaacatgctgtccccattattgactgttaccctaaagtgtgtgttgcctttctagtttgagtagaaagtccagcattatctttttggataatatccaggttttgctgtttctttctttatttttcataatgagaacatttgctctcttgctgacattggagggcgtctgtttacctctcctgtaggcacacaaaattcccaacgtttatttgaagaaaaagacaattatttgagtaatttgaataaataaacattttaagtgattccc

SEQ ID NO: 269856 - DNA, 367 bp, Homo sapiens
gaaataaaacacatgaccatggtgaccagctcaaggatcacaaatgaagtgaactttattatttcttccccttatagggctcatttgattgaaaagcaatcagaaatcaacttttcttcctttttaagaaaacgagacaaatataaaaaaggagaagatagaagatgatggttttcataactaccatgcacacagatctatattggaaagcctaactgtgtgataaatgatcattcacatctgcctattccgttattaggaaaccaattcaaaacagcattcagtcagcttcccagagccttggggggtatttagaattgtgtttgatagatgagttcaataaataaagacttgtgaagtgctcata

SEQ ID NO: 269857 - DNA, 716 bp, Homo sapiens
gattttttttctttttttttttttttgctgtgttagttaggaaattatttattaatttacaagacaggttttatctcagccaaggagggaaatggcgtccctgtccctcccaaagcacagagcagagaaatgaggctgtttacatcgcaagtctctgcactggtgtttaagtcattaaaaagatatttgaaaaaaaaagtctctaaatacaggtttatggaataattcataacagctttaaggaactatcatggtacactgggaaagtcactcatattgcaggatagatttcttctgttggctggtgagcatttgttaatagtcggccttgactctaccacaattttagaagtagttcttttatttctttaaaagcaacattttgggacaaaatattgtgaacaaataaggaatacgactatatttgtgaaaccccttgttaatttccaagtgatattttaaatcttgaataagacatgtacgctcataaataaagagggaaaagaaataattaaatcaatgttcctaagagcttctcagaaaataagaaagagataagtgatagaactataatctacaatctaccctaacagtatatttgcatcacttcttaaactttgtttagtattttaacacgctgtttcttattatatgtgaagaatgctgtgaggtagcatgtcaatgttttgcagattaataaactgatgttaaaagag

SEQ ID NO: 269858 - DNA, 424 bp, Homo sapiens
ttgtttgttttaagttagggtctctgtcgcccaggctggagtgcagtggcacaaacatggctcacagcagcttcgacctcctgtgctcaagccatcctcccacctcagccttctgagtagcttggactacaggtgtaagccaccacgcccggctaattttttatttctttttggagatgggatctcactgtgttgcccaggccagtcttgaactcctggcctcaagcgatcctcccgcctcagcttcccaaagtgttgagatttcaggcgtgagccaccacgcccagccccagaccacactttgagaaccactattataggttcaaggagttcataaatgtggctacttataacagggcccggcacagatggaatggagtaagtattcaataaatgttacacttattgcataaaaatagaggga

SEQ ID NO: 269859 - DNA, 294 bp, Homo sapiens
gtctctcagggttgttagaaggcagtggttctcaaacttgagctgcattcgaatctcctggagagcttgatgaaaaacagactgtgggcccctccctccaaatttctgctcagcttcccaaagtgttgagatttcaggcgtgagccaccacgcccagccccagaccacactttgagaaccactattataggttcaaggagttcataaatgtggctacttataacagggcccggcacagatggaatggagtaagtattcaataaatgttacacttattgcataaaaatagaggga

SEQ ID NO: 269860 - DNA, 258 bp, Homo sapiens
gtgtaaaggaagaagcatgtgggttgctactggtgacagtatattgccatcataaaagaattcacggcacagctaatgcaaatgagagtgaggtagagaccctctcaaagtgggaactggaggcctgaagctcaatctagcttacaacttttcatttctatgactagtacaattttacattgtttatgcctttcgggttttgttaactgcaaatgaaagccttcaagctaatacatgaaattttatttttaatttaat

SEQ ID NO: 269861 - DNA, 425 bp, Homo sapiens
gaacaaccttattgtaggaaatgtacacacgtttcttcctttactcacttagcctatgtttattgatgtgatgacatttctctttcttcttcactgtcaccattcatgtttgattcgaaggcttcttggagttttatgattcctctgagctgattttgatccttgacaattgtgtactgcagtgctcagataggctgtttgcagtaatctgcctcttctggcctttttagtaatttagaattgactataacattacatattcctttaaacttctcttgaaggtctgctggaaatagagatagtcctttaagatgctcttttcattttttttttttatcatactttaagttctagggtaaatgtgcacaacgtgcaggtttgttacatatgtatacctgtgccatgttggtgtgctgcaaccatta

SEQ ID NO: 269862 - DNA, 302 bp, Homo sapiens
cgcggccgcgcgacacggctgcgagagacgacagagggagttaagcaattaacctatccattgccttccataattaactgtgtgtgtagtgagagtatctaaaatgtactttcttggcaaattttcaatatactatgcaaaattattaacacaaagtatacgttactttttgtttgtttgttttggctggctgcggtggcttatgcctaaaaacatgccctttgaggaggctgaggtgggaggatcacttgaggccaggagctagagaccagcctaggcaacatgtcaaaacccagtctctc

SEQ ID NO: 269863 - DNA, 387 bp, Homo sapiens
gtccccactctgtggattattcacaaagtggatagatgaatggatgaatgaataactgtaaacatattaattgtagttacacaggttgcaagcatttcagttttatttttagttttctttcgtataaataattaaaatctaacatttatgtatcttcagttctttgatgcattattaaagataaggagagccattgcatgcaaagtttgttaaaattttaaagtaaagcttaccataaaactctaagtcagcttgagggttgtgtgtaacacggtgctactgaagctttttgccacttcaggatttatatttgtattttcatcagtggcataaatatgtcagtcacagttggtagcagctgtccctttcttgggcatgtacaaagac

SEQ ID NO: 269864 - DNA, 200 bp, Homo sapiens
ctgctcattttgggaacctttgctcatttctttattataagtttaccattttataatataccattgaacatctgtaaaggtcttcacatttttaggtagctaaaattggatgttaatatttttttggaaacttgttgcctggtagtaataaggagaaagtgggactagaaactggaaatagctatttttaaattgttagc

SEQ ID NO: 269865 - DNA, 495 bp, Homo sapiens
ttactcatgcacctttctgataagaaaagtgaaaatgtgaagttgaaaactgaagacgcccagcaacttcctgaatccagccctccacgtcctgccctacgggacggacgactcccaaagaggaatcgttggtggaagtcccatgtttcgttgccgttggaagggggaactggtcaaggcaggttcggtttcaggatctcacctcacctgggagcggggaggtgacggtccccagcggggcagtcacgccgccctggccttgaggccggactccacactgcgcttggctagggtggtccgtccctctcttggccacctgtgtcgggcagcctgacgccgcatcttcctgagcagctgtcgcgttgccgtgtggcagccacgctgttgcaacatgagcggctgaggtttctgaggcccctccggccagaagctggcccaggtgctgtgggcaagacatgtgcgagagactgaattagacccccttggaaaaaaaaa

SEQ ID NO: 269866 - DNA, 249 bp, Homo sapiens
gcaaacaatatatgaggataccttctgcaccctcagccacactgaatatcatcagattttttcatctccggcaatctggtagatcagggatggtgaacattttctacaaagggccaagtaagaaacatactcagctttctgggccataagatatctgttgcagctcctcaactctgccattgtgcaaaagcagttgtagaggatatgtaagtgagtgtgattgtgtcccaataaaacttcagttacaaa

SEQ ID NO: 269867 - DNA, 546 bp, Homo sapiens
ggaattttctagaaacaaagaaagatatgaatcttcccatcaacaatgtatttcaaagaggagctatggataaaacaacatacttaagcatatcatagaaatgtgtttagaatatcaagtatggcaaaataaaacaaatattaacatgtcacagttataatatgcaaggctctgttctaagtgctttaaaacttaatcctcattacaaccctatgacacagatacaattttatatccattttgaacttgcccaaggtcacacagtaagtagtggtgacagaataaagaaaagaaatcttttaaaaaactaccagatccaagtttgccaagtttcacaagacaatgaaataatatactgaggttgctgatgggaggaaacctatcaaccaagaattccctatctagctgaaaaacaaagtaatgcataaaatatactttcacacaaaaactaaggacatttacaagccagcctcttactaaaaggattactaaaggatgtacttcagcaagaagaaaagtggactcagagaagatgcaaggaacaat

SEQ ID NO: 269868 - DNA, 411 bp, Homo sapiens
ctaggctgactctttttgaaacatacattaagttagtttctagctaagaatccctagtagctccgttcatacttagagcacgattcagactccttactctacctgctaggctctgcatgcctgcctgcaacagtatctctggccttctctgagggatctaccctcctactgtattctgtttctactgtgtgcggtcttcccactatatggaatgctctctccccgaggaccccatttctgctcctccttcagaactaagttcaagtgtcttttccttaaagaagccttccctgacccaggctaatgtcagaccacccaatcttacagggcctcatagtaccttgtacttctcttatgtacctcttcctgcaattgtaattaatgaattacgagactagttattagcccccc

SEQ ID NO: 269869 - DNA, 358 bp, Homo sapiens
ggaaacttaggttgttttcatattttggctgttgtgagtaaagctgcaatgaatatggaagtgcagagatctcttcaagatactgatttcatttcctttggatcgatatccggcagtgggactgctgaatcaaatgaaaacaggactgagaggggaaggcaatgtgaaaatggaggctgagactgaagtgctgccagtataagccaagggaggctaaggattgccaacagccagaagcttggagaaatgcatgaagcgaattctctcttggagccttcactaggagtcaaccctgctaatgccttgagaaacatttggcctccaggactctgagaaaataaattactgttgttttaag

SEQ ID NO: 269870 - DNA, 716 bp, Homo sapiens
aactattaggggtgaaaatatcaaagtgagagaactataaagggtttttaaaaaggaattaggtatgttgggttagtcgcattggagagtgcaaattcaccatcgacctgatacctgaaatttcctccttaccatctagaggcaagttgggaatgctgccaggctcctgtggtaaaggaagctcctctcttgactggtgctttatggctacacgttcctgctcagaatggatctcatttagtcttcaccaaaaaaaaaaatctcatgagatgatttaagtgttttatggacaagatgtctaaaactcagaaaaatttcacagtgtgcctagcttttatgtttatgttgaagttgggcattagaagttagaatgaatgggtttacttcagagaaaattaaatccatcacccactccttgtactatgaattccaaatacatattaaatacatataataaaatatttaatatatatgtaagtgccagaaggaaacataaatatgaatattttgtaatatcaagttgaagaaaagccaaaatctgacatcataaaagaaaactttcaagtaaaatatgttaatggctaccaggaaaatattgtgcaatgtctgattgccatgaagagggttaatatccttgctatatcactctgtgaagtcatctttaaaagactaagaaaaagatgaatctcttaataaaaacctggcccagaacatga

SEQ ID NO: 269871 - DNA, 609 bp, Homo sapiens
aaggattactttaaggacctcaaaaggagacaaaacagcagactgttaaaagcagccgtcaatatttatctaaacacaatgaagcaactgcttgtgctacgacaagcagtaataaaatgatgggactaccactgttggtcctattagtggaaacaattaatagaaaaatgggccaacatgaaactgttggtaactttgtaagggaaaatcacttccctaaaaaagggaacggcatcagcatcaccactcatgagagcaatgattgacacttcacatgcaccagcaaacctcatccagcccgcagccctctgaggaaagcactgctgacagctccatggtgcccaccagaaaatgcaggtgcagctgcttcaggagcttactcaagtcccacagctggtaagtgggacagctgggatttgcaccacattcctctgactctgatgaacgtgcttttgtccgtgatataatgccacaaatagagctctaaaatccaccttgagtaggcagtatactccaaagttgtgcagagtacagactagtaataggtacaattgctagtaatagctacaacgcttaaactgatgttgcatacatttaaaattaagtttg

SEQ ID NO: 269872 - DNA, 475 bp, Homo sapiens
accaaatattctggaccccttcaactcttaaaaaatgtcatgaaatacaaaaacaggctgggggaatgctgttctagattaaagaaattaaaagataggcccaccttactgtaatgtgtgaccttaattggttagccgggcatggtgacaggtgcctctaatcccagctacttgggaggctgagacaggagaactgcctgacccgggaggtggaggttgcagtgagccgagccgagatcatgccactgtactgcagtcttggcgacagagcgagactctgcctgaaaaaagaaaaaaaaaaaaaaagaaaagaaaagaaagaaagaaaaaggaaaaaaaagaaatacctgtgtcaaaaagtaaggaagtgctcaaagacaaatggggacacgggcaccagcgtcaggggttcttacaggccaatttggaacaatttgagcaacacagaggatgataacaggctaaagtactttgg

SEQ ID NO: 269873 - DNA, 554 bp, Homo sapiens
gcaaaaagtttttttttaattacaaagctaacggcattaattactagtactgtaaatgcatcagcgcacaaaagccgagtgggttccaaggagctgaggcagcaattggtgaacatttcaacaactggaaaaggcttagtcacaaaggagagacctttctatggtaacattatgaaagctgtcttcacactgattgagccactgtttaattgaaggtgacatagcctatggactagagacagcactattgcattacaggaaaaaggttattcacagagagtctctctggacttcttgctgagtctactgtcatatgggaaccaagaaatcgaattttgaaatatatgaaaacagctacaatagcatagcagtatgataggtataagtataatgtcaaacatccttctttttaccatccattcactttttgctgtactaatttagaagcaatctcatgtgctaaaaagctaaaactcaatactgaagccctaactaggaaggactgcccaacgttgagtatttctgagatcagaaaatttctgtactaatctatc

SEQ ID NO: 269874 - DNA, 470 bp, Homo sapiens
gggtttactaaaacaccaggaatattcctttcaaaaaggagtaaaacacagaggagctccagactatgcacaaggatataagtagggagagaagccaggctagtttattcctgtttctattcccaatacctcttccaaaggaagaggcagcagtgatcgaggtgtctgtctccaagcagaaacagtgctttgggcagagtcaaggtatggtagtaaaacccagaagacaggtggctgaggtacctttcctagctgttcatcttacctatttccctgcctaacgaaacagggagcagtaccactgtctttgcacctttcccatgtaagaatcagtgggcagttaagcagaaaatccccattataaaaatgcacttatagtaacccgccccccaaatcttttaggattactagaatcacaaaataagagagacaaattcgaaagacaacagcaaaataaaaacaaaaaccag

SEQ ID NO: 269875 - DNA, 413 bp, Homo sapiens
ttcaagaatgaatagaagtgctgctgttcttcttcagcaggtgctgttgatttctacagaaagggaaactactgagtgcttattatgagcatttcacctgggggctggcaatcaaaagaaatgatcaatgggagagccttggtcaaacactgttggtcttgctttgtggctgggcatctagaccagtatgtatgctgtgagggtggctacttttgaaagacaaactagaaccctccattaagactcccactgttggcaatttaagtttttcagtaaaacatgaagtctctggattttgttgttgttatctaaaaatctcagaaccttgacaaggcctcattgcatcaccagaactagaattgggacagcaacatttctctaacattcctgtgattaaagaagccatcatcaaa

SEQ ID NO: 269876 - DNA, 503 bp, Homo sapiens
gcactcaagcattataaacagtttatattgaccaatttccatgtctcagccactgttcttagcaccttacatccttgttccaactctacctgttttgcaatggaagaaactgtagtgcttataatttgcttagtcgtagagctagttggtgttagagccaggttttgaacgcaggcagtgtggctccagaatccgtactcttaaccacagtataattctgtgacttcaaattatctaacttctctttcctgtttacttcttcgtaaaatgaggataatagtacctaacatatagggttgttctgaaaagtcagtgagttaaaatatgtactatgctgcttagaatcatacatgaaaaatagtaagtactcaataaatgtcagctgttattatgttagcattattaaggcatcgaactcatgcatatctctgaattttaaccaaataggtggactaaaccttaagtatgaatttatatattaaaaggtagaaatactgtggtct

SEQ ID NO: 269877 - DNA, 1277 bp, Homo sapiens
acgacgatgcgctgcggcagctggaggccgagctgggcgccgggcggtctgacttgcgcgtcgtgcgggtgcccgcagacctgggcgccgaggctggcttgcagcccgctgcttggggccttgcgtcagctccccaggaccgaggagctgcagcaactgctcttcatcaacaacgcgggctctcctggggatgtgtccaaaggcttcgtggacctgggtgactccactcaagtgaacaaagactgggcgctgaacttgacctccatgctctctctgccggacttgcagcgtctcgaaggccttaccaaccagtcctggcctcaacagaactgtggttaacatctcaaccctctgtgccctgcagcccttcaaaggctgagcgctgtgctgtgcgggaaaggctgctggtaacattctgttgaggtcctggcgtcggaggaacctaatgtgagggtgccgaattaggccccaggtcctgtggacacagacgtgtcccggaggttagcccggtagacctccatggacccagacatgcgaaaaggctgcaggagctgaaggcaaagggagagctggtggattgcagggtgtcagccagaaacggctgagctcgctgcaaaagggggtgttcaagcctggagcccacgtggacttctactataaataagcccatgtctttggcttcctgaacctttctgcccccactttcagacacacccccagagccccgtggctccccacaccctgccatggtggcagtcctgccttacacagataaacactcatgtctactgtcctaccttcacacatagcctgctgtgatgagcttccaggtcgctggccttaccagttgtcgagagtctggatgtggcaccctggattatgaggaggcttaggagagaggttatgggtattcatgtctctatccccaggaatagaatttaagggatgggaagagcaggaaaagaagctgaaacacacaagagaagaggttgtgtctcctgctcatagctagtccatggggagagggaagagtgacctgagtcaaataggagaacgcatgcagattcgcagatggcctggtagggaggaagagcagagggtacaagtccccgctcacacagatgccccttgctgaggggagcagcagcttctgttgaactttgtgtcctcactctgatgtctacttcctccagaatccaccaccccttccccaggctgggagaaggggccgttgggtgtctatgtacatggccaaggcagatacaaataaaattaaa

SEQ ID NO: 269878 - DNA, 315 bp, Homo sapiens
ccctcgttatcaaaatagctaacaatccagtttaggggtacaatgagaaagaagtattggcactcactaatcctgactgtcttctgataaggttaaataatggtaatagcagagattttgttctagagagcattgggtgaataagtctgtacacatttgcagtaatagccagagggagaattcaattgttttgtgtaacctaggaagaagaacttcagatatactctggaattagaagagaagaaggcaagaaagataaactgtcagtgacattttagaaggaaaaataataaaacatgtgctatgaattttaaa

SEQ ID NO: 269879 - DNA, 829 bp, Homo sapiens
gccggacaagatggttcccgatcgtcagaattcctgtccgcgccttgcgtcagccccgccgaaaggatcgccccccctagtcaaaccgctcgcgccccagaggcctcatggagtcccgcctcaggctcgggccttggcccccaaagaaagccactccgacgtgtttgagatgggcttagttcccggacccgtcctactgcccccaggcgctggacagcctcagaaagaggacaagtctgcatggaaagataatcgcacaactgagccttctgggagatgtagttcggagctgggaaggcggttggaccctccgaaagtcatcttaattgctctcacagataagccggtgctgggctgccggcctgagtactgtgcgcccagagtgcgcaggcgcaaacatcctgggttgctgttttggcctctttgttcgggcgtgaattttgtttattgctccttagtgcagaggggttatgggaccagaggttgtgagactcagaagtggttggggacgcagaaggggtgtagaccaggaacctgcgacctgatggggggaggtcgaagggaaaggaatcgccaaacgtgggacaggtttggagaggcagaaagagaggagtctgaaattgcaaagggcaggtgttattctgacttctgtgtgctttgtgataaatgagtgggacaggaagtaagaggagtttcactttctccttctgcaattatttgtgtacttggactaagtgtatctcatggccagtatttgactgcttttgacctataaaggtattgtatacacagtcatgcatagtttaataataaggatatatgctctccc

SEQ ID NO: 269880 - DNA, 441 bp, Homo sapiens
tttttctagacagggtctcactctgtcgcccaggctggagtgcagtggcatgatcatggttcactgcaacctcaacctcctgacctcaagtgatccgcccatctcagcctcctgagtagctgggactacaagcatacatcaccacacccagctaatttttttttttttgtagacatgcggttttaccatgttgcccaggctggtctcaaacgcctgagctcaagtgatccacccacctcagcctctcaaagtgctgggattataggtgtgagccaccacacccagcctcttcttcttggatttattgatctgtcttcctcactagcctgtgagatcctaggaggtaaggaccaagtcttactcaagtttgtatcttgagaccaagcactatatcaggcacatgcattcaaaactcagagttctctctctcattcattcaca

SEQ ID NO: 269881 - DNA, 436 bp, Homo sapiens
caggaaatttacaagggaatagaacttgtcagttaatctgccaagtgggttaagtagagggcaattaagaaagcaactagatgtatacctaatacgttgtgttttaactattatatgtctataacttacggtgtttataagctaatagccctcctttcccatcacatctcttaaggcagatttctggtaagatctaaatattaatcctaaggatctgtttcatgcaaatctaagtactagtttttcttactaaacctttatttggtctctaaaactttaaggctgttatgtttcattctttgtcttctggtgtcagttcacttgcatgtgcccgaaaatgtattcttactcctctgtttctgttctccccatggctctatctttcataattattagccccttagaacactataaccattaaaaatggcaagcatga

SEQ ID NO: 269882 - DNA, 465 bp, Homo sapiens
caggaaatttacaagggaatagaacttgtcagttaatctgccaagtgggttaagtagagggcaattaagaaagcaactagatgtatacctaatacgttgtgttttaactattatatgtctataacttacggtgtttataagctaatagccctcctttcccatcacatctcttaaggcagatttctggtaagatctaaatattaatcctaaggatctgtttcatgcaaatctaagtactagtttttcttactaaacctttatttggtctctaaaactttaaggctgttatgtttcattctttgtcttctggtgtcagttcacttgcatgtgcccgaaaatgtattctagctccctcggctagcttccgccaagcttttataaactcaaagggatttttaaagtgtgcggaggcccaaaagcccaggaagagagccatgaaatgagtttctgagaaagactgtgaag

SEQ ID NO: 269883 - DNA, 464 bp, Homo sapiens
ttgtcctttcagtttcatccctcacaacagaagctagtgaaaggggataaaaagcttctcagtgtcctttgctataaagatttttgtttgtgattactttcctctggaaaggaaaaatcctacttggaagacatagagtactagcaaatgttaagcagagggcaacactcctgcagtcagaggaaggttctcttctggggagaggacctgctgttgcttggccacatggcagcatggagttacagcactggaagtggaatcccgaaaaactaggaaagctccagtgggcactcatctctcatcatttttggctgagccataggctcttttttcaaactcaggcctgagacaggcttacacaccaacctaaatgcatcttctccaaatccctttcaaaaactgccagtcatcaagttgaggttgatctctagtataaaaacaaaaacaaaaacaaaaaaaaaagg

SEQ ID NO: 269884 - DNA, 417 bp, Homo sapiens
caatgtttgtaagatgcagtgttcttattgaaacattactaagtaatgaaaaattaatcaaaggaaagaataattttaagatggatcaatgtcaagaaatagttttttgaaaagttttaagattcacaaaccattattatgaatctattcaagttcttaaatgatgttattaaaaagtatggatagtaagaaacatatcaactaactcctcactaaacttgagaaaatataaaataactaaggtaaaaatccataaattacgcaacaaaattgaaattgaggggggaaactgctatgcaatatttatattcatttaaccaaataatatatacatttagctttgacaaattttcaagttctggtacaagtgtttgttttgttgatttaagaaaggataattatcactaagaatttcta

SEQ ID NO: 269885 - DNA, 543 bp, Homo sapiens
agccagatagtctcaatctcctgtcctcgtgatccgcctgcctcggcttcccaaagtgctgggattacaggcgtgagccaccgtgcccagcctaagttaagcattttttaactccctgatttgcatttctgaaaattttatcagaaggtaaagagattgaagagttctgcccctgggtgtaataaagttattgacttttagaggctgttaggatcccaagagagaaagattgggtatagtcagatttaggaaatcattcattcatcacacacttgaaatattttacgagtgctggtaggagtcagaattgtgctaagtatcagggtggatacagagccgtgtaagacagacatgctctctatctttatggagtaaacaaggattgaattaggataataagtgctgtaaaggagtgaattagggtgtttaacagtggttctcaacctaccttgttaagaaattgggaggcaaggggttgtgaataggaagactcagaagaatgacatttaagctgaagcctgaagaataggtagaagttttcta

SEQ ID NO: 269886 - DNA, 461 bp, Homo sapiens
cctcattgctaatgaagatgtggtttaaggattttatgcacccagttcatttattaacaacttgtttaagctttattagctgggtctctactttataactgtgttctttaatttacaagacaataaaaattaaaatggtaaatgggaaacctatcttgcttttcaataaataatttattttaataacttcgtgggcatggtggccaaaacattttagctgtgaaaataatttcaattcatatttttttggaatcaatattaaaaggtgatatattctcaaatgaaaagtggacaaatgatcagttataggacatgattaagaaactaaccatgagccacgtgcagtggctcatgcctgtaatcccagcactctgggaggccgcggtgagcggattgcttgagcccaggagttcaagaccaggctgggcaacatggcaaaaacccggctctactaaaaatgc

SEQ ID NO: 269887 - DNA, 513 bp, Homo sapiens
caaagtgctttcctcccccacagactcatctaatggtgctacccacacttctaggctggtgtcatcactgatcacccagctgtgattttacagctgtgagattgcagtgcagggaggtgaagcacttggctgtgtttatccaatcattggtgagacttggattggactcccaaccacctttcccacttcctcgacctcatttcagcaaatgccagcctctgcggtaaggttttaccccagcagagtgaaacaaagtcagggttaggaacttgggctttcaagtcgacagggctgtgttgaaatcctggtctgtggggcggtgcagaggggtgggtgcattttaatacagccacatagaagcaacagtgtctgctttgtcactggccttggttccacaccagccctagcactccagtctcagccccacttccaggcaaggaggaattacttcctatatcatattatttgaagtgtttataaaactttctcaggaaaagtctcaaaaaaaaaaaa

SEQ ID NO: 269888 - DNA, 541 bp, Homo sapiens
ttccctggcacaattctcgtgaaaattgtgtagggatattaccttacatttatccagtcaaaattagcatctgtcaatcagatcctttccaagaaagggaatcagttatatcataaatacacaaatatataacatgtgttttttaccctccagggaaactttaagcaagtagtacaccatcattttttaatgaatggtcaagaaattgaaaacatatataagttgagttaagcagttaaagggaaagacaattagcaatgcctggtaagctaagtggtactccaaaggtttattttatagctacagaaattatctacatgtagagggggtggatacaaactagcttagactggggtgagaatcctggtttgacatttaacattttagaataagagatatagaaagattcctctgtagttgaaggatcctgttttgtcctactcataagcaaatccatggggtagcaaggtgctttctggtaagcctttgatatgatatgaagctcaagttgataaaacagattaattgaaggaaaaaaaaa

SEQ ID NO: 269889 - DNA, 377 bp, Homo sapiens
gtgaaacattttaaaaatctctactaaggaaaaaccatcttgggaattctgcaatttattatttattaatggaaactttcataagactaaataaatgtttttatctttcaagtaagcatttaatggattactttaaaagaaagacatgtttttatttctcataagtgagtttagaacaataactctagatttcaattacattctcagagttatctggcacaaactgatgtctcacaaaagcaatgaaacaaacaaacaacaaaaccatgtttttctgactggattgttggctagctgtcacggctatgttccaaccacaataattatagtccatctacatatttctttcctatgatccagctggattagcctgtaat

SEQ ID NO: 269890 - DNA, 619 bp, Homo sapiens
cgtgtggaagcggatggggggcagaggttgtggtgagtgagagatgaggtcagaggaaacagtgtagagaaaggctgtgcagagcatacagagccttgaaggtctctctaaggactttggctgagtaaaatgggaagccactaggtgattatgaggagaggaatgccatgatcttatactttaaagaattgatcactcaggctgctatgttgagcactgaataggtaagatcatattataaagaaaatgagagtccagacctgagccctaaggaactctaacattttgaggtgtggtagagaaagagcagtaggaaggaaaaaaaggatggagaggtaggaggaccaggagagtgtagtgtcacaaaagaaagtgaggaatgtttcggggaggagggtgtaatggacagtgttgaacgctgtcaaagtgtagacgaggttagaagtgtcatttgaccttggcgatgccgatgtcatgggtggttttggcaagccattttagaggagtgggggcagaagttagagtgtagtaagttggagaggaaaaatgggatgtgaagaagtggagagaatatgtgtagatgaatactcttgaaagtgaaataggatagaagctggga

SEQ ID NO: 269891 - DNA, 287 bp, Homo sapiens
tctaaatctgacaaccctgagatggtaaaggcaataataaccaggagttaaaatacccacgcccactgcccgaactcctccccacaactgcgagatgtcaagcaggtgacctcacctcttggttcttctgttccattctctatgaaatgggacatcacctgccataccttgcagggttgacatgtggagcacttccatgtgctccgtaccattctaagtgctgcagataagtaatgtaactctatcttcaccgctttgagatatttacgtcgatcattgctcccatt

SEQ ID NO: 269892 - DNA, 641 bp, Homo sapiens
cctgggagggagcgaggcaacctggggagacaatgtggggaatcatcacgttccattacagcgcccttctcttgctctcttggagcttctcaggccacgggtgtcggtcatattggttttagagattattagtaactacccaaacccaacaattttgttttcctgaaactagaaatgtcctgtttccaactttatattttcatcaacttctttttctatgatgtgtgagaaactagaatattcagtgtgctttcttgaataccagccttgtttcaactctttaatgagtggactattctctgaagctggccctcagtcttactctgggttcatcaaccaaggtcaagatctgtccacatgcacgtaacaggagcacttttccgagaattgtaaaggagccacggtgcaaagccttctggacctgggtctcatgtgaaaactcagcaatgagcctcctggcctgagatgagcctgcggagcaccttgttacagcacgcatatgatgtatataaaaaatgaacacatgtattccaattacactgatttgatctttacaaactatatggatgtattaaattgtcacatgtaccctcaaaatatgtacatctattatgtatcaataaaataattaacatattttt

SEQ ID NO: 269893 - DNA, 965 bp, Homo sapiens
ggaggcagaggttgcagtgagccgagactgtgccattgcactccagcctgggtggcaagagtgagactgtttaaaaaaaataataataacttctatttctaaagctgtgatacatagaaaacaagttatctgtttctgagatgcaatggtgggacaggtgaagaagcattcccattccaaaagagataaattggaaggagaaaaggggtttaaagcaggtttgtaagtctgcaggacaaattccattcagttctgagacttgaaaatagttctctgtggcttgatattccgttctctaggtgcattgacacggccttaccccttggtcctggattggcagcctgcccattttttttttttcttatgactgcttagttcctattttttgttttttttatttctacctttttaatcttaagtacagatgcttcttgagttatgatgagcttacattctgataaggcaggagtattatttgagtccaggagtttgaggctttagagtgtgattattgcacctgtgaacagccacttcactgcagcctaggcaacatagtgagaccccatctctttaaaaaaaaaaaaaaaagaaagaaatataccttatttatttaacatcttggcttagcctagtctaccttaaacatgcttagaacacttacatagcctacagttgggaaaaatcatctgtctacacagttcactggacaagcaagcattggttgtttagtctcatgatggcgtggctgactgggagttgtggcttgctgccgctgcccagcatcacaagagaatattgtactgatgtgtatcaggtttgcatcatggtggtaaagttgaaaaactgtaagtagaatgattttaagttggataccatctatagatactttctagtatgccattttcatttcttttatttttcattgttattttattttatatatttttttgagatagggtcttgct

SEQ ID NO: 269894 - DNA, 527 bp, Homo sapiens
tgttagaattaggcatctggagtccagggaatgagtatagagatgtttcagttgttcgaaggggcacatgtaggtaaggtaagagcaccaagatgaggtgggggtggggggcagcaagaggaaacttgaatcagggctacgatagctgccttgctgactgttacaccaactcttgcacctcttaggagcattcactggaaaaattttccagatctcttgacgtcacagcgttgccatttgcctactgctgcttggatacagaatgcagcacttaacccttgtcctgcggggagggagtgattgagttgggtgctgtagttctggattacacaaccttttctttcttccttatctttgcttctgtctttgcttttttccttgttatttgcttttgatagaggagaaaaaggattatgattaagcattttgctgtggttttgtgtgttttgcttgttttaacagctctgtagcctgatttcctttaactgtttagtgcctgataggaaagttgggcttttaaatgtatg

SEQ ID NO: 269895 - DNA, 185 bp, Homo sapiens
taggaaacagttgctagtctagtccatacagtggcaactcattagaaaggagtgagccagcattgaaattctcataagaacagaaaagtggaattgagatggtctgagtactctaaatgaggatgggaaaggtaagtcaggtgatgtattaaggggcatgtagttctttggggataaaaaaagaa

SEQ ID NO: 269896 - DNA, 487 bp, Homo sapiens
gaaatttcttttttctcctcttccataaataggaggaaagtcatgattctcaagccattacagattctctgacacttgttaacggaaaattctgatgaggcatgatgagaacttctgcctataaaaatctcactaaagttctgagtcacaaattgttcacatacttcacagtaagcaggcaatccaatgtcaggacagttgtacacctttcttaggttgcctcccctaattggggctgtatttgacatgaggggccagttttgacactttttaaaaccatacacaaggatgcagcactaagtttttgcacataggcaagaatttatcttgtgattagaagttagttatatgttcattaagaaacatgacgaaatctgcagcaaaaattgaatttcataggccattcagtgttctctgcgataattctaattcagaaaaaaattgaatcttggtttaaaaaaattgtaataaaactttaccactggta

SEQ ID NO: 269897 - DNA, 500 bp, Homo sapiens
gctcccactaaatttattgaagcagtcccctgttggtagacatgttgtttccattttcagcataactaataatgtagcaatgaacttgtgcacgcagcctggctcactcagcaaggaaatctgtagtaaattcctagcggtcaaagtgctgagccaaagagtatgtgcattttcttttaggctattgctaaattgccctccaaaaaggtgtacacgaagcttcgctgtcccaacagcatgaggaggtttgatttatttcagggcatctgctgactgcaggagtttagctgggaacagacgtgccctcagaaccacaaccaacataaacgcatttccttcccaattttagcctttcccagggccaaaagatgggctgggataccttgtcacagtgtcaacttcgccccaaagagctctgagaggtaaatggctgtggtctaaatgttgcctttccgctatttgtttgggaataaaggctgtttttgttttgctctacaatc

SEQ ID NO: 269898 - DNA, 360 bp, Homo sapiens
gggctagtcattcttccaacattctgtgacagattcattagtttgtcttctgaactacatgccagcagggagtctgtaaaagaggttttgtaacaatggtacacttccaaaccagtcagtttggaagctcttggccctctgaagtttccctgaaaatcagtgatatgaggcagattgattaccaggaaaaaaggcatacaatttgatttaacgtgtatacacaggagtcttcagaatgaagacccagctccccaactccccaataaggtacagaagcttcttttttttttttttagatggagtttcgctttgaacccgggaggtggaggttgcagtgagcagagaccgtgccgtctcaaa

SEQ ID NO: 269899 - DNA, 489 bp, Homo sapiens
tgtgtggctctgggaaagctgtaagataaatgaagagaagagaatttgtgcatgaataaaattgaagacataaggaaatcatataattttttagcttgctgactatgcagtaggagattggattaagttgatttattacaatttttgttgttggagtttttttaaagattcacatcttcttttgttatatctctataagacatttgaatgtactgttatgtgttttaaactatctgagaatttataacagtaatagatttaaagctgttgatccaagaacttacaaaagttttggactacatatttgcttagagtaagctcagtaagtgttgcttataaatgatgttaatttatatgcatagaaccaagctatagtttgtataaagtttataattcaggtgttaaaggaaacaaagtgagtacaatagctgtgcttgaaacaccagaaaattattactgaaagtaaaaaaaatcttgtatttgaagcat

SEQ ID NO: 269900 - DNA, 323 bp, Homo sapiens
gaaaggtgtttctctgattattgcacaaggtccctgaatttaaagtagttttcctcttttttaaaaaccactttgttgaggtatgattgatatatttaaaaactgtacatattcagtctatacaacttgataaatttggggataaatatacacccatgaaaccatcaccaccatcaaggccataaacatatctatcacctcccaaagttttctttttatttgcccaaattaatttaactaatattcataagatatcttttgtattacgtaggaatttgggatggcatataagaccatgttgatttatgattttatgtgttaac

SEQ ID NO: 269901 - DNA, 387 bp, Homo sapiens
agccaattgcctgtgtccatccctctgtgcctgccatccctagtgcacctcttccagacacgacacccagagttaggcagcagagcctggcatacttcaagattcacccagaggtgtgctgatctcttgaaagcctccctcttctcatgataccacaggtaggggactgggtcagtggtaaattatagaatgagtatccacctgagactctcagctaactgtctcctctactttaaggattttcctccctttgacaagccctgcacttggatttctcccgagtgaaatacttggtgagggtttcactgacaggcttcttcccaggccccaggatgatcttaagattcctggaaataaactaagaagtaaatttaaggcagcatcttg

SEQ ID NO: 269902 - DNA, 360 bp, Homo sapiens
tgtggtgatgcaagtacctttatggccatcaccacggaactgtgctgggtcaagcctgaagccaacatggcactgggccttgcccaaggccctttccttcatggtggcgagttcccccagatcctgggtgtgtccagagatggtgtctagaagccagggaatggagtaaaaaaccctagcaatttacctgatgttcagttttactgtggctaagctgacactcaaatcacaatacaaaagccttcctgctcttcactcctctttccacaggcagaggaccctctccctgtggccattactaccaccatctctggtccacatggggttctgccagccactgctgatatttactgaaagccc

SEQ ID NO: 269903 - DNA, 181 bp, Homo sapiens
cttgaagtcagtcctgtccttctcctcctgatgtcccccagctgcctcctctggcccccagcttcataagggtggccccaggttgcttctctctcacacacacaggcgcatgtatgtacacgagcactggaccatgaagtctcagcgtgtgctcacagcctctcacacaggagtgggctgt

SEQ ID NO: 269904 - DNA, 251 bp, Homo sapiens
  misc_feature (16)..(16): n is a, c, g, or t
  misc_feature (25)..(25): n is a, c, g, or t
  misc_feature (45)..(45): n is a, c, g, or t
  misc_feature (51)..(51): n is a, c, g, or t
  misc_feature (144)..(144): n is a, c, g, or t
  misc_feature (232)..(232): n is a, c, g, or t
tattccagtgttaggntgagaacanaaattgtatggatcttaacntcaccntgttccagttttagctgggagagaatctatgtgcccactggtgtcagaactgtcatcttctgtttgaatgaagaaccttacagtgagaaattntcaaatggagtgctactgacatctgccacaggacaattctttgtcatgtgcaactgccccactttgaagagtgttaatgtctctgttncccataaccagtaacagcc

SEQ ID NO: 269905 - DNA, 383 bp, Homo sapiens
aaagtactgttatgtatactctgaaggccccaaagttagtggtatttgctataagggggatggggtgtgacaaagtttggccattgcagaaaatggcttctgcgagtcatagggaggaatttataatatgtcagttatgtcagagaagctatcccaaacagtatctttagttcataggctgcggatttattatgtgattatctcttgtattagtaaaatggaatatttattaaataccttgagcacactggatttttaaacatgacaagtttaaaagagatcactactcttaaggaaccttatcaacaaaagtgaatatgtaaaaggaggttcgggagtccgttttatttgtagggggaggaataggaagtggaaaaggaaat

SEQ ID NO: 269906 - DNA, 468 bp, Homo sapiens
aaggcaccgggcaccagctgttcatgctgaacatgcccctcgacccagcgacgccatcctgggcagatcccacaaagaagggcacagtcaggttcaccagcagaaacgcgctcactagaacatccggcagctctgttctgctggcgtctggaaaaggcattccatggtgctggccgtgtgctgcttcttgacctgaggggtgatttcttgggtatgttcgctttgtaaaaactgtcataccatacacacatatacgtgcttttctgcaggcatgttatactccaataacacgtttgcttttaaaacatggctggcagggggatgcagggtgatgagaagtttggtctgagtaaccctgaacccctagctctaatttgtttctctgtgactctacaattctacctgctcccctcagtaaataaacacagatctggattaaacatccaaaataaattttaaaatgagaaa

SEQ ID NO: 269907 - DNA, 295 bp, Homo sapiens
gcttgagcaagccagtgtaaaaattacaacagcttactgagccctgtgcagaagctgatattgagagcatggaggcttcctgctaaaggccagcatcagcttgtcagccacacaggtgaggctgggagaggatcctcagtcctgatcaagacttcagatgagatcacagccctggctgacatctgactgcaacttcatgagagaccctgagccacagcccccagcccagccactcctgaatttctggtccacagaaactgtaagagatgtaaataaattattattgctgctttta

SEQ ID NO: 269908 - DNA, 615 bp, Homo sapiens
agataaagcagtgcctgggtacaaagcaatgtctttgcccttgtagtacttacagtctattggggacaacagataaaaataagttaatgtataaaatatcaggtaggaatgagtgttgtaagaaaaggtagagagagagtgatggggttggaggagactattttagatagggtgattggaaaagcccctataatgaggtggcgactgaacagagacctgaatgaagtggaggagtgagctatatagctctctagggaaagagtgttccaggtggcgggaacaagaagtacaaaggtcctggggtgggaatatgttacattttattttatttttattttgagacatgatcttgctctgtcacccaagctggagtgcagtggtacgatcttggctcactacaacctctgtctcctgggttcaagtgattctccagcctcagcctcccaagtagtcgggattacaggtgcctgccaccatgcccagctaatttttgtatttttagtagaaatggggtttcaccctgttggccaggctagtctctaatcctgaccttgggtgatccgcccaccttagcctcccaaagtgctgggattacaggtgtgagccactgcaccc

SEQ ID NO: 269909 - DNA, 254 bp, Homo sapiens
gacacgagtttacttatataacacacctgcacatgtacccttcaatctaaaatcaaaaaaattaaaaagtgacaatatgacttactatgtaagaaggtcaactagcagtctgccataatctgctgcatgttttataatatatccgtgtatcatccatctttacgtagaatacagtcaactctcctcaagggaggtagattagttttctagggatgtcataataaactagcataagctggatggctaaaacaaca

SEQ ID NO: 269910 - DNA, 453 bp, Homo sapiens
ttcattcaataatcgttttatcagctgcatgttattctaatgttaaaaaaacataattactcaggaatggaaaaccaaacatcgtatgttctccctcataagtgggagctaaactatgaggatgcaaaggcataagaatgactttggcgactcagggaaggggtgagaagggggcgagggatgaaagactacaaattaggttcagtgtatactgcttgggtggtaggtacaccaaaacctcacaaatcaccactaaagaacttacttgtgtgaccaaataccacctgttacccaaaaacctatgaaactaaaaagaaattttaataaaaatttttaaaaaccaaacttagccagtctcttattgattttaatttttttgatgttagactatgatatgatgaatcctcttgcatggtcattaaaatacggtttttttctctgcattttatggtt

SEQ ID NO: 269911 - DNA, 457 bp, Homo sapiens
ggagggtgtgccgctgagtcactgcctgggcatctgggcctggaacctcggccacagatccatgatgtgcagttctctggagcaggcgctggctgtgctggtcactaccttccacaagtactcctgccaagagggcgacaagttcaagctgagtaagggggaaatgaaggaacttctgcacaaggagctgcccagctttgtgggggagaaagtggatgaggaggggctgaagaagctgatgggcagcctggatgagaacagtgaccagcaggtggacttccaggagtatgctgttttcctggcactcatcactgtcatgtgcaatgacttcttccagggctgcccagaccgaccctgaagcagaactcttgacttcctgccatggatctcttgggcccaggactgttgatgcctttgagttttgtattcaataaactttttttgtctgttgataata

SEQ ID NO: 269912 - DNA, 1488 bp, Homo sapiens
acacattccccaccctctgggagctcctagtctgagagaggaaacactcctgcccaagggagcttccagttagatggcagagagagatgcctctggcttcaggagtcccgagtctaaggagggaaacgactccttcagggagcttcttgctcttaggctgtagccatggctcctgccagactgcacaggagcccccatctgccagccggtgcatgtggccttgctccccagagcttgcgcagatgccatcaaaatgggactctggtcaccctgtcatttcccttctggcagacactaaaatggggagccctgccctcaggggggtgtcccaagtgccatcagaggaggcttggtgactcccagacacaagggaagctttagcgtctgccctcagggtgagatggaggtatcgcctccggcctcagggaaccacagtctgagggggagatgcagcccctgccttcccattcagagaggggttttgtgaggtggcttgggggcatagggcagaagtggatcctacaggctgagctaaggccccaagagcctcagcagtgtacccatcacctaggcacctctgcagccacagatccatgatgtgcagttctctggagcaggcgctggctgtgctggtcactaccttccacaagtactcctgccaagagggcgacaagttcaagctgagtaagggggaaatgaaggaacttctgcacaaggagctgcccagctttgtgggggagaaagtggatgaggaggggctgaagaagctgatgggcagcctggatgagaacagtgaccagcaggtggacttccaggagtatgctgttttcctggcactcatcactgtcatgtgcaatgacttcttccagggctgcccagaccgaccctgaagcagaactcttgacttcctgccatggatctcttgggcccaggactgttgatgcctttgagttttgtattcaataaactttttttgtctgttgataataaaaaaaaaaaaaaaaaaaaaaaaaaaaaaaaaaaaaaaaaaaaaaaaaaaaaaaaaaaaaagaggggggggggcgcggccgcaaaaatgttcccgcggggagggacaacaacaagagaggcacacgccccagtgtgttagtatgaacaaagaggggcggcacccaataaggaggggggggtataataaacaggatgaaggaggagggaggggcgaaataaaacagaacagaggagaggggagaaaaaaggagacaggggggacacttgggagagagaaaccaaaaatagggggggggagagacaaaatgaggggacacacgctctcagagagagtatatagaaaggggcgggggggaaatataaaaaattggagaggtgtatagagggggtgtgtaaaaaaaagaggaagaattagagtgggaggtggaaaaagtgtgatggaagaggaggggatgaatgtagacagaatatatgaagggaggggagtataaataaagg

SEQ ID NO: 269913 - DNA, 765 bp, Homo sapiens
  misc_feature (465)..(465): n is a, c, g, or t
  misc_feature (469)..(470): n is a, c, g, or t
  misc_feature (472)..(472): n is a, c, g, or t
  misc_feature (474)..(474): n is a, c, g, or t
  misc_feature (479)..(479): n is a, c, g, or t
ggacgcgtgggtcgacccacgcgtccggggtctgtctctgccacctggtctgccacagatccatgatgtgcagttctctggagcaggcgctggctgtgctggtcactaccttccacaagtactcctgccaagagggcgacaagttcaagctgagtaagggggaaatgaaggaacttctgcacaaggagctgcccagctttgtgggggagaaagtggatgaggaggggctgaagaagctgatgggcagcctggatgagaacagtgaccagcaggtggacttccaggagtatgctgttttcctggcactcatcactgtcatgtgcaatgacttcttccagggctgcccagaccgaccctgaagcagaactcttgacttcctgccatggatctcttgggcccaggactgttgatgcctttgagttttgtattcaataaactttttttgtctgttgataataaaacaanacannananaacanacccaaaaatttttggggcgcctcctggcccctagaaaagatttttaaacccattggttggggggccggcccccgattgtatacgtcaccgtggcccaaggcggcgcccaagaggaaaacgtgccaagacacaggcgggttcccccaataaaaacgccggggaccagcaggctcgtgcacacaccgaaggcgtgcgagccgaggcactaacaggcgccagagctgataatagcggccccgtgcataacccacaccctgtgacacgaccatcgacacaacaacacac

SEQ ID NO: 269914 - DNA, 448 bp, Homo sapiens
accgttaccgcaggtgaagcttggagatgatattgaccttattgtccgttgtgagcacgatggcgtcatgactggagccaacggggaagtgtccttcatcaacatcaagacactcatgagtggattccggcacgttggcgttgactggcgtcagaagctggaacttctgcacaaggagctgcccagctttgtgggggagaaagtggatgaggaggggctgaagaagctgatgggcagcctggatgagaacagtgaccagcaggtggacttccaggagtatgctgttttcctggcactcatcactgtcatgtgcaatgacttcttccagggctgcccagaccgaccctgaagcagaactcttgacttcctgccatggatctcttgggcccaggactgttgatgcctttgagttttgtattcaataaactttttttgtctgttgataata

SEQ ID NO: 269915 - DNA, 1044 bp, Homo sapiens
  misc_feature (5)..(5): n is a, c, g, or t
  misc_feature (7)..(7): n is a, c, g, or t
ggcangnggctcccctcaccccggtccaggatgcccagtccccacgacacctcccacttcccactgtggcctgggtgggctcaggggctgcccttgacctggcctagagccctcccccagctggtggtggagctggcactctctgggagggagggggctgggagggaatgagtgggaatggcaagaggccagggtttggtgggatcaggttgaggcaggtttggtttccttaaaatgccaagttgggggccagtggggcccacatataaatcctcaccctgggagcctggctgccttgctctccttcctgggtctgtctctgccacctggtctggcgctggctgtgctggtcactaccttccacaagtactcctgccaagagggcgacaagttcaagctgagtaagggggaaatgaaggaacttctgcacaaggagctgcccagctttgtgggggagaaagtggatgaggaggggctgaagaagctgatgggcagcctggatgagaacagtgaccagcaggtggacttccaggagtatgctgttttcctggcactcatcactgtcatgtgcaatgacttcttccagggctgcccagaccgaccctgaagcagaactcttgacttcctgccatggatctcttgggcccaggactgttgatgcctttgagttttgtattcaataaactttttttgtctgttgataatagtaaaaaaaaaacacacaaagaaaaaaaaaaaaaattttgtggggggccctgggccccgaaaaaaggttttgcagaaaccattgctgttgggggcgcccgcgggccccagtatgggttaggtgggaaaacggtggctcaatcgagcggggctccccaaaggaaaaacccgtggcacgagacaaaggggtctggggttctccccacaatgaaaaaaaaggcccgggggagaaccggaggctcttgggaaacaatccagaagggtcgtccgggggcccatgagggggctccaccaccggggctccaagggagctaaaaaaaagcgccgcgggggtgggac

SEQ ID NO: 269916 - DNA, 351 bp, Homo sapiens
ctcctgccaaagcgtagtacccaactgcccagtggggagggagagctgggaaccaacctgaatgtgtgagggtctgggtgtttggtggagctggggttggggctggcttggtgatgagtgtatttcctgtcactttcaggagaaagtggatgaggaggggctgaagaagctgatgggcagcctggatgagaacagtgaccagcaggtggacttccaggagtatgctgttttcctggcactcatcactgtcatgtgcaatgacttcttccagggctgcccagaccgaccctgaagcagaactcttgacttcctgccatggatctcttgggtactacgttggtagcgggatcc

SEQ ID NO: 269917 - DNA, 469 bp, Homo sapiens
ccgcctactactactaaatgcgcggtcttgtcgaccctgggtctgtctctgccacctggtctgccacagatccatgatgtgcagttctctggagcaggcgctggctgtgctggtcactaccttccacaagtactcctgccaagagggcgacaagttcaagctgagtaagggggaaatgaaggaacttctgcacaaggagctgcccagctttgtgggggagaaagtggatgaggaggggctgaagaagctgatgggcagcctggatgagaacagtgaccagcaggtggacttccaggagtatgctgttttcctggcactcatcactgtcatgtgcaatgacttcttccagggctgcccagaccgaccctgaagcagaactcttgacttcctgccatggatctcttgggcccaggactgttgatgcctttgagttttgtattcaataaactttttttgtctgttgataata

SEQ ID NO: 269918 - DNA, 984 bp, Homo sapiens
  misc_feature (5)..(5): n is a, c, g, or t
  misc_feature (7)..(7): n is a, c, g, or t
ggcangnggctcccctcaccccggtccaggatgcccagtccccacgacacctcccacttcccactgtggcctgggtgggctcaggggctgcccttgacctggcctagagccctcccccagctggtggtggagctggcactctctgggagggagggggctgggagggaatgagtgggaatggcaagaggccagggtttggtgggatcaggttgaggcaggtttggtttccttaaaatgccaagttgggggccagtggggcccacatataaatcctcaccctgggagcctggctgccttgctctccttcctgggtctgtctctgccacctggtctgccacagatccatgatgtgcagttctctggagcaggcgctggctgtgctggtcactaccttccacaagtactcctgccaagagggcgacaagttcaagctgagtaagggggaaatgaaggaacttctgcacaaggagctgcccagctttgtgggggagaaagtggatgaggaggggctgaagaagctgatgggcagcctggatgagaacagtgaccagcaggtggacttccaggagtatgctgttttcctggcactcatcactgtcatgtgcaatgacttcttccagggctgcccagaccgaccctgaagcagaactcttgacttcctgccatggatctcttgggcccaggactgttgatgcctttgagttttgtattcaataaactttttttgtctgttgataataatattttaattgctcagtgatgttccataacccggctggctcagctggagtgctgggagatgagggcctcctggatcctgctcccttctgggctctgactctcctggaaatctctccaaggccagagctatgctttaggtctcaattttggaatttcaaacaccagcaaaaaattggaaatcgagataggttgctgacttttattttgtcaaataaagatattaaaaaaggcaaataccatcca

SEQ ID NO: 269919 - DNA, 1111 bp, Homo sapiens
acacattccccaccctctgggagctcctagtctgagagaggaaacactcctgcccaagggagcttccagttagatggcagagagagatgcctctggcttcaggagtcccgagtctaaggagggaaacgactccttcagggagcttcttgctcttaggctgtagccatggctcctgccagactgcacaggagcccccatctgccagccggtgcatgtggccttgctccccagagcttgcgcagatgccatcaaaatgggactctggtcaccctgtcatttcccttctggcagacactaaaatggggagccctgccctcaggggggtgtcccaagtgccatcagaggaggcttggtgactcccagacacaagggaagctttagcgtctgccctcagggtgagatggaggtatcgcctccggcctcagggaaccacagtctgagggggagatgcagcccctgccttcccattcagagaggggttttgtgaggtggcttgggggcatagggcagaagtggatcctacaggctgagctaaggccccaagagcctcagcagtgtacccatcacctaggcacctctgcagccacagatccatgatgtgcagttctctggagcaggcgctggctgtgctggtcactaccttccacaagtactcctgccaagagggcgacaagttcaagctgagtaagggggaaatgaaggaacttctgcacaaggagctgcccagctttgtggggcattccagagaaccatgtgctgtgagggccttccgagtccatctgtttaatcctgtcattggagacttgagaaaccagagcccagaagggaaaagtgattgtcccaagatcacacagcactggagaaagtggatgaggaggggctgaagaagctgatgggcagcctggatgagaacagtgaccagcaggtggacttccaggagtatgctgttttcctggcactcatcactgtcatgtgcaatgacttcttccagggctgcccagaccgaccctgaagcagaactcttgacttcctgccatggatctcttgggcccaggactgttgatgcctttgagttttgtattcaataaactttttttgtctgttgataata

SEQ ID NO: 269920 - DNA, 580 bp, Homo sapiens
  misc_feature (5)..(5): n is a, c, g, or t
  misc_feature (7)..(7): n is a, c, g, or t
ggcangnggctcccctcaccccggtccaggatgcccagtccccacgacacctcccacttcccactgtggcctgggtgggctcaggggctgcccttgacctggcctagagccctcccccagctggtggtggagctggcactctctgggagggagggggctgggagggaatgagtgggaatggcaagaggccagggtttggtgggatcaggttgaggcaggtttggtttccttaaaatgccaagttgggggccagtggggcccacatataaatcctcaccctgggagcctggctgccttgctctccttcctgggtctgtctctgccacctggtctgccacagatccatgatgtgcagttctctggagcaggcgctggctgtgctggtcactaccttccacaagtactcctgccaagagggcgacaagttcaagctgagtaagggggaaatgaaggaacttctgcacaaggagctgcccagctttgtgggggagaaagtggatgaggaggggctgaagaagctgatgggcagcctggatgagaacagtgaccagcagtgggtggtatagccgatcctctagga

SEQ ID NO: 269921 - DNA, 453 bp, Homo sapiens
gtgagctcaccatgtgggggtgaggctgagagaaaacaagtacacagccacagatccatgatgtgcagttctctggagcaggcgctggctgtgctggtcactaccttccacaagtactcctgccaagagggcgacaagttcaagctgagtaagggggaaatgaaggaacttctgcacaaggagctgcccagctttgtgggggagaaagtggatgaggaggggctgaagaagctgatgggcagcctggatgagaacagtgaccagcaggtggacttccaggagtatgctgttttcctggcactcatcactgtcatgtgcaatgacttcttccagggctgcccagaccgaccctgaagcagaactcttgacttcctgccatggatctcttgggcccaggactgttgatgcctttgagttttgtattcaataaactttttttgtctgttgataata

SEQ ID NO: 269922 - DNA, 650 bp, Homo sapiens
  misc_feature (460)..(460): n is a, c, g, or t
  misc_feature (467)..(467): n is a, c, g, or t
ggagggtgtgccgctgagtcactgcctgggcatctgggcctggaacctcggccacagatccatgatgtgcagttctctggagcaggcgctggctgtgctggtcactaccttccacaagtactcctgccaagagggcgacaagttcaagctgagtaagggggaaatgaaggaacttctgcacaaggagctgcccagctttgtgggggagaaagtggatgaggaggggctgaagaagctgatgggcagcctggatgagaacagtgaccagcaggtggacttccaggagtatgctgttttcctggcactcatcactgtcatgtgcaatgacttcttccagggctgcccagaccgaccctgaagcagaactcttgacttcctgccatggatctcttgggcccaggactgttgatgcctttgagttttgtattcaataaactttttttgtctgttgataataaanaaaaaanaaaaaactcgcagggccagagctcctagaactgagctgcctctaccacagcctcctgcccaccagctggcctcacctcctgaaggcccgggtcaggaccctgctctcctggcgcagttcccagctatctcccctgctcctctgctggtggtgggctaataaagctgactttctggttgatgca

SEQ ID NO: 269923 - DNA, 989 bp, Homo sapiens
acacattccccaccctctgggagctcctagtctgagagaggaaacactcctgcccaagggagcttccagttagatggcagagagagatgcctctggcttcaggagtcccgagtctaaggagggaaacgactccttcagggagcttcttgctcttaggctgtagccatggctcctgccagactgcacaggagcccccatctgccagccggtgcatgtggccttgctccccagagcttgcgcagatgccatcaaaatgggactctggtcaccctgtcatttcccttctggcagacactaaaatggggagccctgccctcaggggggtgtcccaagtgccatcagaggaggcttggtgactcccagacacaagggaagctttagcgtctgccctcagggtgagatggaggtatcgcctccggcctcagggaaccacagtctgagggggagatgcagcccctgccttcccattcagagaggggttttgtgaggtggcttgggggcatagggcagaagtggatcctacaggctgagctaaggccccaagagcctcagcagtgtacccatcacctaggcacctctgcagccacagatccatgatgtgcagttctctggagcaggcgctggctgtgctggtcactaccttccacaagtactcctgccaagagggcgacaagttcaagctgagtaagggggaaatgaaggaacttctgcacaaggagctgcccagctttgtgggggagaaagtggatgaggaggggctgaagaagctgatgggcagcctggatgagaacagtgaccagcaggtggacttccaggagtatgctgttttcctggcactcatcactgtcatgtgcaatgacttcttccagggctgcccagaccgaccctgaagcagaactcttgacttcctgccatggatctcttgggcccaggactgttgatgcctttgagttttgtattcaataaactttttttgtctgttgataata

SEQ ID NO: 269924 - DNA, 456 bp, Homo sapiens
gtcgacagcgcctgctccagagaactgcacatcatggatctgtggcagaccaggtggcagagacagacccaggaaggagagcaagcgctggctgtgctggtcactaccttccacaagtactcctgccaagagggcgacaagttcaagctgagtaagggggaaatgaaggaacttctgcacaaggagctgcccagctttgtgggggagaaagtggatgaggaggggctgaagaagctgatgggcagcctggatgagaacagtgaccagcaggtggacttccaggagtatgctgttttcctggcactcatcactgtcatgtgcaatgacttcttccagggctgcccagaccgaccctgaagcagaactcttgacttcctgccatggatctcttgggcccaggactgttgatgcctttgagttttgtattcaataaactttttttgtctgttgataata

SEQ ID NO: 269925 - DNA, 1133 bp, Homo sapiens
acacattccccaccctctgggagctcctagtctgagagaggaaacactcctgcccaagggagcttccagttagatggcagagagagatgcctctggcttcaggagtcccgagtctaaggagggaaacgactccttcagggagcttcttgctcttaggctgtagccatggctcctgccagactgcacaggagcccccatctgccagccggtgcatgtggccttgctccccagagcttgcgcagatgccatcaaaatgggactctggtcaccctgtcatttcccttctggcagacactaaaatggggagccctgccctcaggggggtgtcccaagtgccatcagaggaggcttggtgactcccagacacaagggaagctttagcgtctgccctcagggtgagatggaggtatcgcctccggcctcagggaaccacagtctgagggggagatgcagcccctgccttcccattcagagaggggttttgtgaggtggcttgggggcatagggcagaagtggatcctacaggctgagctaaggccccaagagcctcagcagtgtacccatcacctaggcacctctgcagccacagatccatgatgtgcagttctctggagcaggcgctggctgtgctggtcactaccttccacaagtactcgggctgaagaagctgatgggcagcctggatgagaacagtgaccagcaggtggacttccaggagtatgctgttttcctggcactcatcactgtcatgtgcaatgacttcttccagggctgcccagaccgaccctgaagcagaactcttgacttcctgccatggatctcttgggcccaggactgttgatgcctttgagttttgtattcaataaactttttttgtctgttgataataatattttaattgctcagtgatgttccataacccggctggctcagctggagtgctgggagatgagggcctcctggatcctgctcccttctgggctctgactctcctggaaatctctccaaggccagagctatgctttaggtctcaattttggaatttcaaacaccagcaaaaaattggaaatcgagataggttgctgacttttattttgtcaaataaagatattaaaaaaggcaaataccatcca

SEQ ID NO: 269926 - DNA, 933 bp, Homo sapiens
  misc_feature (5)..(5): n is a, c, g, or t
  misc_feature (7)..(7): n is a, c, g, or t
  misc_feature (743)..(743): n is a, c, g, or t
  misc_feature (750)..(750): n is a, c, g, or t
ggcangnggctcccctcaccccggtccaggatgcccagtccccacgacacctcccacttcccactgtggcctgggtgggctcaggggctgcccttgacctggcctagagccctcccccagctggtggtggagctggcactctctgggagggagggggctgggagggaatgagtgggaatggcaagaggccagggtttggtgggatcaggttgaggcaggtttggtttccttaaaatgccaagttgggggccagtggggcccacatataaatcctcaccctgggagcctggctgccttgctctccttcctgggtctgtctctgccacctggtctgccacagatccatgatgtgcagttctctggagcaggcgctggctgtgctggtcactaccttccacaagtactcctgccaagagggcgacaagttcaagctgagtaagggggaaatgaaggaacttctgcacaaggagctgcccagctttgtgggggagaaagtggatgaggaggggctgaagaagctgatgggcagcctggatgagaacagtgaccagcaggtggacttccaggagtatgctgttttcctggcactcatcactgtcatgtgcaatgacttcttccagggctgcccagaccgaccctgaagcagaactcttgacttcctgccatggatctcttgggcccaggactgttgatgcctttgagttttgtattcaataaactttttttgtctgttgataataaanaaaaaanaaaaaactcgcagggccagagctcctagaactgagctgcctctaccacagcctcctgcccaccagctggcctcacctcctgaaggcccgggtcaggaccctgctctcctggcgcagttcccagctatctcccctgctcctctgctggtggtgggctaataaagctgactttctggttgatgca

SEQ ID NO: 269927 - DNA, 1239 bp, Homo sapiens
  misc_feature (5)..(5): n is a, c, g, or t
  misc_feature (7)..(7): n is a, c, g, or t
ggcangnggctcccctcaccccggtccaggatgcccagtccccacgacacctcccacttcccactgtggcctgggtgggctcaggggctgcccttgacctggcctagagccctcccccagctggtggtggagctggcactctctgggagggagggggctgggagggaatgagtgggaatggcaagaggccagggtttggtgggatcaggttgaggcaggtttggtttccttaaaatgccaagttgggggccagtggggcccacatataaatcctcaccctgggagcctggctgccttgctctccttcctgggtctgtctctgccacctggtctgccacagatccatgatgtgcagttctctggagcaggcgctggctgtgctggtcactaccttccacaagtactcctgccaagagggcgacaagttcaagctgagtaagggggaaatgaaggaacttctgcacaaggagctgcccagctttgtgggggagaaagtggatgaggaggggctgaagaagctgatgggcagcctggatgagaacagtgaccagcaggtggacttccaggagtatgctgttttcctggcactcatcactgtcatgtgcaatgacttcttccagggctgcccagaccgaccctgaagcagaactcttgacttcctgccatggatctcttgggcccaggactgttgatgcctttgagttttgtattcaataaactttttttgtctgttgataataaaaaaaaaaaaaaaaaaaaaaaaaaaaaaaaaaaaaaaaaaaaaaaaaaaaaaaaaaaaaagaggggggggggcgcggccgcaaaaatgttcccgcggggagggacaacaacaagagaggcacacgccccagtgtgttagtatgaacaaagaggggcggcacccaataaggaggggggggtataataaacaggatgaaggaggagggaggggcgaaataaaacagaacagaggagaggggagaaaaaaggagacaggggggacacttgggagagagaaaccaaaaatagggggggggagagacaaaatgaggggacacacgctctcagagagagtatatagaaaggggcgggggggaaatataaaaaattggagaggtgtatagagggggtgtgtaaaaaaaagaggaagaattagagtgggaggtggaaaaagtgtgatggaagaggaggggatgaatgtagacagaatatatgaagggaggggagtataaataaagg

SEQ ID NO: 269928 - DNA, 740 bp, Homo sapiens
  misc_feature (5)..(5): n is a, c, g, or t
  misc_feature (7)..(7): n is a, c, g, or t
ggcangnggctcccctcaccccggtccaggatgcccagtccccacgacacctcccacttcccactgtggcctgggtgggctcaggggctgcccttgacctggcctagagccctcccccagctggtggtggagctggcactctctgggagggagggggctgggagggaatgagtgggaatggcaagaggccagggtttggtgggatcaggttgaggcaggtttggtttccttaaaatgccaagttgggggccagtggggcccacatataaatcctcaccctgggagcctggctgccttgctctccttcctgggtctgtctctgccacctggtctgccacagatccatgatgtgcagttctctggagcaggcgctggctgtgctggtcactaccttccacaagtactcctgccaagagggcgacaagttcaagctgagtaagggggaaatgaaggaacttctgcacaaggagctgcccagctttgtgggggagaaagtggatgaggaggggctgaagaagctgatgggcagcctggatgagaacagtgaccagcaggtggacttccaggagtatgctgttttcctggcactcatcactgtcatgtgcaatgacttcttccagggctgcccagaccgaccctgaagcagaactcttgacttcctgccatggatctcttgggcccaggactgttgatgcctttgagttttgtattcaataaactttttttgtctgttgataata

SEQ ID NO: 269929 - DNA, 470 bp, Homo sapiens
agtaaaaaggcctagataggggatgtgccgtgtgtgatgctagggtagaatccgagtatgtaggagaaataaaatgtgcatagtggggattttattataagtatgtagagttaggtagatatagaggtctagggctgttagaacgtcctaggcaagtgacagcgagggctgtgagttataggtagacgggggacttgtggtggggaagtggggatggttaattggtacaaaaaatagaaagaatgaacaaggtctggtatttgatagaacagcagagtgactaaataatagtttaattctatgtttttaaacacctgaaagagtataattgggttttaacacaaaagataatgcttgaggtgatggatgccccatttaccctggtgtgattattacacgttgtatgcctgtatcagaatatctcctgtacctcataaatatatacacctaccatgtacccacaaaaatta

SEQ ID NO: 269930 - DNA, 328 bp, Homo sapiens
aataaagtatagcagtatagccagagtgagattgcccacattttgtaacactgggaattctgacctccaaaaagaagtctctcacctctgcattaaatctgaattaggcagagacataccacaaaggctatatatttatagctctttacctctgtcaggactcagcaaggatcttcggatgtttttaaggtttctgcactccagttattaccacatacagacagaatatcaaaatgcaggcttcctagagggacatttagtaagcagaaatttcttggtctcttccctcaaaaattctcttgcttatagcccactgatgttttggcag

SEQ ID NO: 269931 - DNA, 333 bp, Homo sapiens
ggtaaagcaacctgcccaagatcataaaattgtttagtggcaagaaaaatcggagtccaagtctccctgacttaaagaaccgtgctcctaacatctcagggcaatgacacatcctcatccaactccacccttccccattttggctttacatgccctctcttggacaattcaaattttatggacaaaacccatgtcttcttgggtgactgtggcctggttgccttccgagcttttctatatatacctggtaactatggcaggttctaacattttcctaagatacgttacccaaccagttatttcaaatcaaaaataaattcaaatatctctaga

SEQ ID NO: 269932 - DNA, 561 bp, Homo sapiens
tgagactccatctcaaaaaaaaaaaaaaaaaaagaaaaaaaaaaagaaacttcagcatccccaagatacacagtatagtgaaaacacaaatggattggcagtcaatgagaaaagaatcccagttctaatcatgctaccatctgtgaatgcttattaacctgggtttttttgttttgtattattttcaaatgaagcatttggattacagcagcatttcctaatctaaactatcctgcatatcaagcaaagtatttcaatttctccaccatgagccaggcacagtggcttacacctataatcctagcactttgggaggctgagggaggaggacagcttgagcccaagagtttgagaccagcctgggcaacatggagagagccctgtctctacaaaaaataaaaaatgacaaaatcagttgggcatggtgacatgcacctgtagtcctagctacttgggaggctgaggcaggagcatctcttgagcccaggaggtcgaggctgcagtgagccatgattgcgccactgtactccagcctgggcaatggagcaaaaccttgtctct

SEQ ID NO: 269933 - DNA, 473 bp, Homo sapiens
aaggaaatgacatgggaagaatgtcgatgcacatgttcgtccactgttcctcccacctccggtcctcatcacgcagagcggaccctgtggtccacgactggcatctgggctctgctttcccattgcagagacccctgtgagcacccgccacgcccaggccctgtgcagcactctgatgtgtaacaggaaaggcaggcagagtccctgctctcaaggactcacctttaaggactgcatgggagacagacaacaaaattaaaaatagagaacaaaatagatggcagagtgcaacgtgctgtgatgtccatgagcagagggaaggagaggcacagagagaaagggacagccgcttcgtcacaggcgaccagaagcattcgtgtgatgttccacagtttcttcaatcccatttcattttctttttcttccatcatatttaagcaaaattaaatttattatgttgtagttgaaaatgt

SEQ ID NO: 269934 - DNA, 356 bp, Homo sapiens
tgctttaacagacaaagagaacttttctaaaatctatttgaagcatgtgactggtgaaatgctgggttgctattactctcttttgaaaagtctactacaatgctattttagttggctatatatgaaattgattattaaaaatatccttggcccgggtgcccaaggatatatgaatatggtcagactcagatgttagacattttgtcaataaggagcttaccaattcataaacagatctttaagactacaagtgacaccatacttaaaaagaacacattttaaagcaaacatttcacaaaaatcatataacttgcttttatttctagacaattataaaaatatagcagtcatataaa

SEQ ID NO: 269935 - DNA, 146 bp, Homo sapiens
aagactgcatggcctctttatattataactgaaatttaaatataagcaatttgaatataggaaatttaaatataggagatctgtggtttgaaatcaggttatacatttatttatatgattactcaaatgcaaaaaaaaattgttct

SEQ ID NO: 269936 - DNA, 189 bp, Homo sapiens
tggcaaagggcaacatagatagggtttgggaattacatagtttgttttagtttcttacatacccaagagtactgatagctgctgctttgaacacaaagtgatcagtgtttttcagtgacctgagtaaatgggaaactatctttgtcattgtgtaattggcctgtatactttatccagaaattgaaaata

SEQ ID NO: 269937 - DNA, 473 bp, Homo sapiens
ctgctgttgagccctgagtggctaggggaaataggaagaggattgccatggcctggccatcttgttgctgcttggagagatcatatagctaatgaattaggcaggggagctattttttgaagatgatgaactaaatgttgaagacaagtttgagatctgtaaaatgtgattttttacttctgcttataatactcatgattggggaggattgtggaaatttaattatgatgaaaaacctctatcttttttgtaatgttggcatacttggggaatttagtggaaaatacattccccagcaggccttttgttggttgcactaactgcaaggttgctgggaagtagagtccatttggttgatgagctttgactgcggttttggaaccttacctctcctccttagcccaatatgctgtctcgggtcctattcttgttctccagctctcagtccaaataaagttatttctcctggttaa

SEQ ID NO: 269938 - DNA, 452 bp, Homo sapiens
ctgctgttgagccctgagtggctaggggaaataggaagaggattgccatggcctggccatcttgttgctgcttggagagatcatatagctaatgaattaggcaggggagctattttttgaagatgatgaactaaatgttgaagacaagtttgagatctgtaaaatgtgattttttacttctgcttataatactcatgattggggaggattgtggaaatttaattatgatgaaaaacctctatcttttttgtaatgttggcatacttggggaatttagtggaaaatacattccccagcaggccttttgttggttgcactaactgcaaggttgctgggaagtagagtccatttggttgatgagctttgactgcggttttggaaccttacctctcctccttagcccaatatgctgtctcgggtcctattcaaataaagttatttctcctggtcta

SEQ ID NO: 269939 - DNA, 313 bp, Homo sapiens
gtccatatacacacatgtagacataggcacagaccagggacaagatccaccaaatcgagttccagacagttcatgacctgcccctgtgcatctcaccaggcgtccagcagggccgtctaaagacagaccccaggagacccatggccaccatgccctgccccaaatggccatttaagcttcacaacaaaaagccaagttacaaaaggaactggcattaacactgctgttgtagtgagactctgaacccatccagtctgtaacttccagaatttctggtctacgttaagacaagtaatgtaagttgtttcaagct

SEQ ID NO: 269940 - DNA, 438 bp, Homo sapiens
cataaaagcataaacatctctttgatatcttatgattaataaaataattattgtcaagtataggtctaagtgttaatgatcaccggagattattattattaatttttgagacagagtctagctctgtcgcccaggctggagtgcagtggcccaacctcggcccactgcaacctccccctcttgggttgaaacgattctcctgcctcagcctcccgaacagctgggactagaggcgcccaccaccaggcccagctaattttttttgtatttttagtagaaatgaggtttcgccacgctggccatggtggcgcatgcctgtagtcccagctcgggaggctgaagcaggagaatggcgtgaacccgggaggtggaggctgcagtgagccgagatcgcaccaccgcactccagcctaggcgacagagcaagactctgtccca

SEQ ID NO: 269941 - DNA, 470 bp, Homo sapiens
cataaaagcataaacatctctttgatatcttatgattaataaaataattattgtcaagtataggtctaagtgttaatgatcaccggagattattattattaatttttgagacagagtctagctctgtcgcccaggctggagtgcagtggcccaacctcggcccactgcaacctccccctcttgggttgaaacgattctcctgcctcagcctcccgaacagctgggactagaggcgcccaccaccaggcccagctaattttttttgtatttttagtagaaatgaggtttcgccacgctggccaggctggtcctcaatgcctggcctcaactgttagtcaggatggtctcgatctcctgacctcgtgatccgcccgctttggcctccgaaagtgctaggattacaggaatgagccaccacgaccgaccgagactatgcatttaaaagattaatgttataaaaacattttgat

SEQ ID NO: 269942 - DNA, 519 bp, Homo sapiens
atactgtcagttgtccttgaagtaactggccctctttgttcatttctgagaaaatgtctgacatataaccagagcttagtaactatagcttatctctcagtcattcctgaaagttttaatgtgctccacgagggcaagcagctacttcagctgtaaattccaacacttgcccaagtactgcctcctgatgtggccactgtgcctatgcctgcctcggcctcccagtgctgggattacaggcgtgagccaccgcgcctggccaaaatatataaccttaagtgtaagtttactaactttggaaagtacatacaccagcataaaccaaccccctttcaagatctacattattttatttatttatttatttttttgagacagtttctcccttgttgctgaggctggagtgcaatggggcaatatcagtcaccgcaacctctgcttcccaggcaggagaatggcatgaacccaggaggcggagcttgcagtgagccgagattgcgccactgcactccatcctgg

SEQ ID NO: 269943 - DNA, 996 bp, Homo sapiens
aacatagactgtcatgatattgtggctttcttggggactttactgggggaaaaagacacatgaaacagttatatattgttctacttggagtgcttaagtgacttagaaaaatacatccctatacaatttcaggaatagcaaagattaggccagagtaattagggaaggcatcttggagaaggtaaaatctgagactgcccctaaaggatgtataggctttagataggtagaaaggtgactgtaggtattcagggtcatgagaaatagtatgaacaaagacaagaaggcagaaatgagaatggtgtgctgaggacacagataaggacattgacctgagaggaatgtaggcattgtattgcaagtagtagatgagattacctgtatggaattggatggagtggaaaactgtgaaatccaagccaagttattaaacctgtttatataaatattgaaagatttctagtaaaatgggtggtagtaatttttctaacattttattatgaaaaattttaacatacagcaaaactgagaattttacaatgaacacccataaacccaccacctagatatgtattcatctattcatatctattcatttatgtgttcatttatcattcatctatcagttcatttttttgtatgaattttgaagtacactccttaaatacttcaacttgtatgtcattaacagttcagtgtttgtttttcttttgttctaaaatgtgcatataattaaatacatttttttcttgctgccactgaagacagaagatacacacatcttaagtgtacttttgttgagttttaacaaatacatgtatctccataatccaaacgcctttcaagatatcaaatgttactacaccccagaaagttcccttatgttccttctcatcagtttttgttcccactgcccaaaggcagtgttccaatttctccctccatagattagttttacctgttttagagtcttaataaatgcattcttaaaaactc

SEQ ID NO: 269944 - DNA, 412 bp, Homo sapiens
ttctgtctagtgtcctaggcttcacacctagcctatgcttgttgtcctgttttgatcctcttcaaaaggtggtttataatcaactgtaagactttgacagttgctctcaacattcttctaaatgaaggaaggaaaagaaaggaaggaaggaaaagaatgaaaggaagaaagaaagaaagaaagaagaaagaaagaaaggaaggaagaaagaaagaaagaaagaggagcctggaaaatccagtttgtatgaccagggagaagaatggattagagcagccactagtcagtctcttccaagcaagaaggaccacccctgagctgttttccagctggacatgcctggacctgtattccactcctctctaaaatgcaccttatttttcttcattaaattctgttacttaacccttgc

SEQ ID NO: 269945 - DNA, 474 bp, Homo sapiens
ttctgtctagtgtcctaggcttcacacctagcctatgcttgttgtcctgttttgatcctcttcaaaaggtggtttataatcaactgtaagactttgacagttgctctcaacattcttctaaatgaaggaaggaaaagaaaggaaggaaggaaaagaatgaaaggaagaaagaaagaaagaaagaagaaagaaagaaaggaaggaagaaagaaagaaagaaagaggcaatgtcattcctgttctccccagaattggtgaaatcagcaacagaactattcatttcattgagcctggaaaatccagtttgtatgaccagggagaagaatggattagagcagccactagtcagtctcttccaagcaagaaggaccacccctgagctgttttccagctggacatgcctggacctgtattccactcctctctaaaatgcaccttatttttcttcattaaattctgttacttaacccttgc

SEQ ID NO: 269946 - DNA, 279 bp, Homo sapiens
atatcggtaaagtctaggagagacccagtcctagagagaggatctctcaaataaagcagaagatttccaagcccatttaaaagttcacaaaaaatgtcacatgcaaaagcataaacctaaacatcctgaaaggaggggaaatccggtgtttccactacctactacttcccaggtgaatatctctatagttttccattacaagaaagaattgcggtcaaaatgacccccttgcagtagatctattcaaataaaagagcatttaatttttgtatttacagc

SEQ ID NO: 269947 - DNA, 270 bp, Homo sapiens
caaaatgagtgaactgtggaccctgcctttaactagctcatgatcttgtgagagatgcacataaaatgcagatagattatgcacaatgacataaagataaacactaataagccagacttgtaaggaagcaggaggccaactatagaagaaggttcaaggaatatcctagggaaaggtcacacctaagctgactcttaaaaacaagtaagctttgacaaaaagaagttggttggccgtatgaggaaggagaattttaaaggagaccataaa

SEQ ID NO: 269948 - DNA, 464 bp, Homo sapiens
catctatacactgtgttctagaagtatgttaatttggcttaaagaaaaactataaattctttgtcttcattcagaaatcagtaattctcaaaagggaaggtagtttataacccctaggaagatcagtgattctcaaaaggtggtacggtttataacctctaggggtcacatccgaatctcctgaggaaaatgctgaactatgcaatcccttctcaactttcccctagagacagattctaacaacattgtctcctatgaaagatttcatgattactgtcatgaatcactattattgatgggagaaaaagtttatatcaggtatattgagatgcaaaaggaaaagaatcactgttataagctgaaattgttgatggaagtgcacaggaaacaaaacagcagcaagatattacacaattagctgacatgtatagtgacatttttgccagattacacacaaaaaaata

SEQ ID NO: 269949 - DNA, 485 bp, Homo sapiens
agaaaaagtagaaactgtaccaagaacaggaaggacggattggcaccagtgaattcaaacaataaccaggtctcaagcagtagccacctccagtctgatacaaaggattactccctccccagtgccagctggagccccatcatggtgaggctctacaatgagttcatggagaagactgtggatgggtcatggacaagacttccaggttgttggtgctctgtgcaattccttaaagaagcagaccttactaagattgctaaagctgtccctgccatcttcttacaaatgaagtgacgcagatgcaaggtgctgcaaggcccacctcctcctgctctgacaggcagacaggaaaccaaagcccctatctgagcagcctctgtctctcccattcacctccagcttcccatgtggacctttgccttttccttcttggatggtggaaactcctccagatgtcaagacttgctgtgaataaagttttaaga

SEQ ID NO: 269950 - DNA, 368 bp, Homo sapiens
gaggatgtaggggtgcagggggcagggatgaggcctgagctctgggagtagctatagggatgggttcaaggagatagtcaagacaaactgtagggctgaagagtcggggctgcttccctcaggcagttgggtggctcagaagagttcacagcagagttaggggcagaggaaggcacaggtgaggcttctggtacctgtgttactggtggagggtcttgactaggaattttccaggtccttggcgttttgaacaaagtagcagaggggcagacgtggtaatccccacactttgggaggcctggatgggcagatcacttgaggtcagtccgagaccggcctggccaacgtggtgaaacccgtctctacta

SEQ ID NO: 269951 - DNA, 388 bp, Homo sapiens
ccttcaggtcgccaacactcctcctaatttcaaagaaattaccagcaggtaatttcaaagaaaagggaatagaggccctgaaaggtgaggagacttaaataatactatgtcagattcaggacagagcaagagttggatacgaagaaatgggcttcctctattgcgggaaagataagagagttcagttacacagcaggaaatctgaccccagagactgaccagaatagagaactaagggcatgacaccctcagccctgtaaagttgtagaaataagatgataatgatgatgataatggttattaccaaatgttgagcaactgttcaataacagcactaattgtgtgttcattggctaattgttaattaaactgtgttaactgttttgca

SEQ ID NO: 269952 - DNA, 448 bp, Homo sapiens
ctcatgcctgtaatcccagcactttgggaggccaaggtgggcggatcactggaggtccggagttagagaccagcctggcccacatagtggaaccccgtctctacttaaaatatcaaaaattagcccggcatggtggcgtgtgcctgtagtcccagctacttgggaggctgaggcaggagaatctcttgaacctgggaggcagaggttgcagtgagccaaaattgcaccactgcactccagcctgggcaacagagtgagactctgtctccaaaaaaaaaaaaaagaaaaaaaatggttttattttggcttacagttcaacaggttatatacgaaacatagtactgatatctgcttctggtgagggcctcaggaagcttacaatcatggcagaaagcaaggggagctgtatatcacatgacaagaggagaagcaagatacagaaggggga

SEQ ID NO: 269953 - DNA, 467 bp, Homo sapiens
ctcacagagtgtacttacactaacctagatagtagcatccagtaaacacctgggctatatggtctagcctattgctcctaggctacaaacctgtatagcatgttactgtactgaatatgtaggcacttgtaacacaatggtaagtgtttttgtatctaaacatatctaaacataggagaggtaatgcattgtgctacagcattacaatggctatgacagacactaggcaataggaattttccagctccattataatcttaagggaccaccatggcacatgcagtccattgttgaccaaaagttgttatgtggtgaatgactataattggcttttcagagcaaccactcacaagggggtgtagtatagcttactagacaaaactgcagccgctgctctgttttttgctcttagaaaactgagtacctgatttggacaaaatcataataaaatttagatagagccaaca

SEQ ID NO: 269954 - DNA, 345 bp, Homo sapiens
gagtttggtaacatttttgtgggtgattgatgtggcttgggggaccatgtcttgcttagattggtggggcttgtggggaccatgtcttgcttaaatacatttagaatcatatctctttgaaagcactgtgctttcaaaggttaaaggtatgttgacacacttccgagaatgcttaggactgtctaggttttatgcctggtaccctcatgtaattactatagcattccttttcattctcaaaagtattctcttttagataaagaaaatggtcaatgtatttatggatgaaataaattggctatgcattgaaaattattaacgttcaaaaataaatatgaggatgta

SEQ ID NO: 269955 - DNA, 232 bp, Homo sapiens
tgaaggccggactacaaggccctcaagaacaggagactttgggtcctcgctaacggccttgggagaccacgcaagactggtcagaaaagccaggtagaaaggcttttcatgggccgcgcgcggtggctcacgcctgtaatcccagcactttgagagggcgaggcgagcggatcacttgaggtcaggaagttcgagaccaacctgggcaacatggtgaaacccccgtctctac

SEQ ID NO: 269956 - DNA, 554 bp, Homo sapiens
cttccttgtgtgtatcatttaatttgttcctctatctcatgtgtttcttgtaaactgaaagttaggtgtagagattgagtctaaatatttttggcaagtatatgtcgtaggtaacatttgtgctttatactgcatcatattgggagataaataatattatattgccatctctgttagtgcagccattagaaagacattgtgcctatgtctgtctctttgctgtgtttggtatctgttgagagccatatttttataaaaatcttaaagcattgtcctctgtgaagaaaatatattagaaaaattacacttgacagtataagaattgttgatttgaataaatacatgatttttagaagacatatgtatgaccagcaggaatagtagcctaataggcctttgtttgggacagaatacacttcagatcatccagaaatctaaaatcaggcctgtgtgcctttgactggtatcttccatgtggtgttgaagagtttgagaatttaaaagaaaatgaattaatactaagcaagacacacttttttctttgttccttaaaa

SEQ ID NO: 269957 - DNA, 417 bp, Homo sapiens
gatgtgggaacagtctgatcaggggtcagcaaactctcgctcgccgcctgtttttcacggacccccagctgaaaatttaaatatatatatattttttacatggttaaaagaaactatcggccgggcgcggtggctcacgcctgtaatcccagcactttgggaggctaaggcgggtggatcacggagtcaggagatcgagaccatcctgactaacacggtgaaaccccgtctctactaaaaatacaaaaattagccgggcgtggtggcaggcgcctgtagtcccagctacttgggaggctgaggcaggagaatggtgcgaacctgggaggcggacttgcagtgagccgagatcgcaccactgcactccagcctgggcgacagagcgagactccgtcccaaaaaaaaaaaaaagaaaga

SEQ ID NO: 269958 - DNA, 371 bp, Homo sapiens
gaattctttctggcaactagattgtcctgagatcagaacaatctaatccatacatgtcctaactttgccttctgctgtatcagtatctgcaactaggaaggacagagaggagacctggcctcccctggatgtttatgagctgcagatcttcagggaacaaaggctgtggacatgccattgatttgggaccagtgtttttgagtatccttaatttttggtatcatctgtggcagataggctgctctccttaagtcatggcttcccggttgaaacaagacatgagattaacccacttttttcatttctaaccaaagagaaggaaactttgtaaagtcttaatagattaataaaaacaaaagcttctgtggaaa

SEQ ID NO: 269959 - DNA, 809 bp, Homo sapiens
gagtggtgactgaaaccacacgccatgttgggagacttccaaacaagtctagagagttggcacttagggatgaagaaatcatcttctgggtacacttggtctttcctgatgacgcttttaagagaaaggcagagttgaccctgggctttcaaaaaactgttctttcaggcaaaacctcagagagaactggctgctagtgatcctctgcagagaccttgaagagcacggcaattatgaaacttcaacaagaaaagatttaagctgatcttttaaaaaaatatatactgtcaggaattttgtagaaatgactttaatgtaataactgcttctttgacttatgttttgtcttgtggtgaaaagaaaaatatttataaaagcatgcctgtgtcctaaaattggggacacaaacttaaatgactgaaggcacttgaggagtggaggcaaggatggtgaaaccaggccctgtaccaagcaggagagcgtgaacctgctaaagagagtgactgcttctcatttccagtcaatgcgactggtgtcgcattccagtcaaatggagttgcgacaccatttcagccacagcgattgatctggattttctgtaaaattccctgatttttacatattgccaattaattaattaattaaaaagaaatgtagatgttcaaaaaaaataaaaaaaaaaaaattgtggggggggggccaaaagtttacacaaattggggggggcgcaaggagtgaagtggtaggggcaaaaacgggtaaagggggtcacaaaaaacggggcgggtgaacaggggggaagggaaggg

SEQ ID NO: 269960 - DNA, 453 bp, Homo sapiens
gaaaatttattatcttactggaccttttcatttttgaagcagattaatttggaaacttttacaaattgatgagcaaaattatttgtttccatttgaattgatttaataactgaaaaagttatttttcatgtttttatcacttataaaccttctataaatttatctttaatttctcttttccacttttctgtttcagcctcctggtatttttaaggaaatgtaagagtgtgaatcaggtactgatggttttgacttcattatgatcagcatctttggcttccatcagagtagacactgaacgttttcatccaaccggatgatgagtgcattagtgagtatttatttagttcataatacatgttcctgccacactccactgtaatttgtttcagactgactaatgtaatgagaaatcttaccaaatataaatggcactgcagatcaaaacccact

SEQ ID NO: 269961 - DNA, 473 bp, Homo sapiens
cagttcatcattatctccactcgtattacagctttctaactggtctccaattgtatacccaattttgtccccttcaggccattcttctcatttaggcagtagtgatctttgtcaaatacaaagatgactgggtgtggaagattgggaagaagaaggaattggggggcagctcgcagatttttttcttagatacctgaatgaattcatatcagagaaaacaggagaggaatccggtttttaggagaagattttttttttttcctactgggctagcaggactagatgaagaccttcagaaaccctgggcactgagaagatcataaggtctcttcccaaatataattaaaaataaaatactaaggtgaaatatattttaattattatttttgaacttattttttccaaatgttttccctcgagtctgtgcatgtgtgccctaaatacatgtttcatcggctagttggataatcctg

SEQ ID NO: 269962 - DNA, 416 bp, Homo sapiens
ggtctgcaaatggagagctccctcaagagtgccctttccagagagaagccctcacctctgccctgtgtgatgtctcagaagccactaccagatagccacggtttctgcagtcaaagacgtgctggaggggacagaggtgggcctctggagccagaccccctggggctgactcctgcttccactttagtcggcccttgaacaacaggggtttggactgcatgagtctacttacatgtggatttttttcaacaaaagttacactaaatttgcctgcctctcctgcctccccttcaacttctgctacccttgaaacaacaagatcaacccctcttcttcctccacctcctcctcttcctcagcctactcaatatggagacaaggctgaagacctttacaatgatccacttcaacttagt

SEQ ID NO: 269963 - DNA, 501 bp, Homo sapiens
tgagacggagtctccctctgtcgcccaggctggagtgcagtggcgtgatctcggctcactgcaagctctgcctccctggttcacgccattctcctgcctcagcctccccagtagctgggactacaggcgcctgccacaaggcccggctaatttttttgttatttttagtagagacgcagtttcaccgtatttgccaggatggtcttgatctcctgacctcatgatctgcctgcctcggcctcccaaagtgctgggattacaggcgggagccactaggcccggccatagcagcatttttaaagatgtaccagaaaaactcaaatgtccatcaactgactaaagaataaacaaaatgtagtaaccataaaatgaaagaagtactgatacatggtacaacacggatgaaccatgaaaatattctaagcagacaaagccagtcacaagacacacattgtacgattccatttatatgaatgcctaaaataggcaaatccgtacagg

SEQ ID NO: 269964 - DNA, 402 bp, Homo sapiens
tggctgcaattgatactcctttttcttgaaagcctcttctactttgattttctggatacttcagtgttctaattttctcctttctgtgtcctcttttcctcttatgtacgtatagatagatgttttacatgttttagtcagtgtccctcctttttctctagggtacctcttcaaatgctttcatggattcctataactcatcagctctctagtcatagtctgacctcacatcctagtatccattttatttctcaactacctactaacatctactcagatgtcctgccagcttctcaaacccagtatgtcttagcacagactttctctccctcccttcttatagttccttttagtttttctatttctattatgagcatcacagttctactagtggcctaagtt

SEQ ID NO: 269965 - DNA, 296 bp, Homo sapiens
ccccagtgagcacccagaccacatgcacctgggggttctcagaagcaggccttgtggaacaaggcagctcactcaagtcattagaagtgacatttgaagatggtcaagattcaaaacaacacacacacacgcatccacccatgcatgcctgtatgcacacagcacacacgtgatactgctgttaataactagaagcccaggatccaccctggataatgaagatcaaccactgagccaaggatgaaaagggagagactggcaaatcaagaaaagcagatcaatacagagggaaacat

SEQ ID NO: 269966 - DNA, 280 bp, Homo sapiens
tctagggtcaagttttataggaagttatccattgaggcatgctgggctagagttcattgttcctcagcaaggctcttctgttttgtttttgtttttgttttacggggagatggagtcttactctgtcactcagggtgaggtgcagtggtctcagctcactgcagccactgcctcccaggagaatcacttgaacccgggaggcagaggttgcagtgagccaagatcgcgccactgcactccaacctgggtaacagcgagattccgtctcaaaaaaaaaaga

SEQ ID NO: 269967 - DNA, 499 bp, Homo sapiens
ccacttccttgctatgtgacatcattggcaggtcaatttatctgagccttaatttcttcatctgtaacataagagggttatacaaaatcactgctaagggctatggtatatgtgcctataatcatcattttttttttaactatatgggtatgttcaacctttttgtacttctgctttactttctaccaccctgaaaccaagaaaatggtagagatagaggaaggattcagtgtggttagaaatcttaacaaaatggtatacacccccttccccccagtgctttgattttaatacagttcttcagagcaaatatttgctgatttacctaatggcagtgttagtattgctttttgtttactacctttctttgaatgacatcaggcttttggtagccaaatgttgtgctgggctaagaatgcatccacacgagcactgagctcccttatatgtttgctcttttttctttgtaagtcttcttccataaagaaatataatatca

SEQ ID NO: 269968 - DNA, 431 bp, Homo sapiens
aaaggggccagatgaacagagcaggggaggtgcaagagggagcagggctgtcctgttggccatccagaacattcccttgccctggctccagtgactggctcaggcctaggtgctggacctcagtcatgtgaatgagccatcattggacttccagaatgattgggaaagagctgccatctttctgaaagaatgtaaaggaacaggcctaagagcgaagccagcacagaaggaagtggcccagaagacagaaaggttccgaaaacaaacatcatttagctgctgtgtccagctgtgcccaaagctaatccacacttagcttttcgctgcgtaaactaatacattttcttttttctcaagccaaggcaaactgatttcctttgacttgcaacctaaaagtcttcaccaaatatagcaatattgaaaatttttta

SEQ ID NO: 269969 - DNA, 379 bp, Homo sapiens
gaaacccaagtgtttgattccactctactaagcagcctccaccccgagagattacagttgtaggttgctgccctttctcccttttgcaatccttggagcatgaccagtttccatgatataaatctaggaaagttacatcttaggcagctttcttgtttatccaggccaggattgagaatttcctttatttaggtataataaacatgtatctgtgatatgtattgagatgaatagctttatttttccttagatattaaaacctatactaaagtttattacaacccattttgaagatattaaaacagatcctaatcccttacacaacaaacttttacagttttttttttttaattaaaaggagtgctttttcttgctctta

SEQ ID NO: 269970 - DNA, 551 bp, Homo sapiens
aaaaaagttaccagcttatgtcattttaaagaacactcgccctgaaaacttctgagaggttggccatttgaaaccctggttttagtgtctgtattattagtgaactaccgtgttcccatgtggctacacaaccacaattatgtactatctggctctttaccaaagtttgcagacctctaatctagagtgcgacatttcccctcattaactcttaggtcccttggctctaaaagggtatattcatcttggccctatacagggaaagggggaatgggattaatgatgtgctttgtaagaagaaccaattttaattttcacaaaggcttgacgtagctgtgagagaaagggtaagaagaagcaggcttcttcttagaagtctgagatggcctaaagtggtgggggaagaagggagagtggggagaaagagaaacaagaaaagctgagagtgaattccccagagaggtagccactgattctgccctactctttgctggaattctggaaaacacctgggcttctaaaagatagggagctcatgcatcatggtaggg

SEQ ID NO: 269971 - DNA, 479 bp, Homo sapiens
tgtgttatatgtagacgtgcttaatgaggcaaaagataatggattccttttaggcacagaaaagctgctaaaggaaatgtaattgggctggaaagttgggatttattggacttttctccttcccaaatcagaactatatcatccttatgaaaatattagcaatgtggctaagaaaaatgagacaaagtaattactgcattatttaataaccttgctctatttagagaaaattctcctatgaaacctgtagaactctacacatgaatctatcacagcatctgtaatcctgggacctcaaaagtacaatggctgaattatgaggccttgtcttgtctgtgaaatgaaaggatggttttattgtattttatgtatcataaatcctaaaactactttaaaaaagtaattgtatagggaaatctgtcatttcctcctctctgttgtctattcccctttattctggtaataaaatcttgatattc

SEQ ID NO: 269972 - DNA, 471 bp, Homo sapiens
tgaaggtagttcaaactagggggcaggcttttctagttttggctagaatactccctccccaagtgcagcagaggttgttctatacccctgaggacagacggggtctggggagaggggatgtgttgctgtggagcctggtgaactaatgtggtggtgttactcccaatctaaggataaattgccagcgccatggctcacgcctagagccccagcactttgggaagctgaggtgggaggattgctttaggccaggagtttgagaccaggctgggcaacatagtgagaccctgtctctaaaaaaatatattttttgattagttgggcctggtggcaggcacctataatcccagctacttgagagtctgaggcgggaggattgcctgagcctaggagtctgaggctgcagtgagctatgattgtgccactgcactccagcctgagtgacagagcaaacaagaccctgttcttaaa

SEQ ID NO: 269973 - DNA, 272 bp, Homo sapiens
tgaaggtagttcaaactagggggcaggcttttctagttttggctagaatactccctccccaagtgcagcagaggttgttctataccccctgtctctaaaaaaatatattttttgattagttgggcctggtggcaggcacctataatcccagctacttgagagtctgaggcgggaggattgcctgagcctaggagtctgaggctgcagtgagctatgattgtgccactgcactccagcctgagtgacagagcaaacaagaccctgttcttaaa

SEQ ID NO: 269974 - DNA, 623 bp, Homo sapiens
gcggccgctaagaggagaccaagaggcgggggctgcacttgacaaccagcatgccgagatgtcagaagaggcagaagtggatgtgagagaaagagagacacagagagacagagagccaaagagggcaagagacttgactttaagagactcctgtactgacaactccatgcagttcggaaccagaacgactacggctgaaccagggttcatggggacatggcaaaacgctgatactaacctcttattcagaatgtcccaacaggccatccgttgcacactggtaaactgcacatgtgaatgttttcagccagggaagattaacctgaggacttgtgatcagtgtaaacatggctgggtggcacatgccttggataagctcagcacgcagcacctgtaccaccccacccaagtggagattgtgcagtccaacgtcgtgtttgacatcagcagcctgatgctctatgggacacaagcagtgcctgtgcggctaaagatcctgctggaccgtctcttcagcgtcctgaagcaagaggaggtactgcacatactgcacggccttggctggactctgcgggactatgtccgaggatacatccttcaggatgctgctggcaaggtgctgg

SEQ ID NO: 269975 - DNA, 435 bp, Homo sapiens
tcaaaaaatccaccttcacttttcagtcagaagaggcagaagtggatgtgagagaaagagagacacagagagacagagagccaaagagggcaagagacttgactttaagagactcctgtactgacaactccatgcagttcggaaccagaacgactacggctgaaccagggttcatggggacatggcaaaacgctgatactaacctcttattcagaatgtcccaacaggtaagttactttctttcttgattttttttttcttttttttaagaaaccttgaattgttatgggcacttttgtttctggtgtttttctttctaaatactttttaaaatgtggtcacttcctagttaggctcttgttttgtcataactgtgttactggaatgtgcagggttacttcatggtttccctaagggcgtcttaaaagaaaaagg

SEQ ID NO: 269976 - DNA, 452 bp, Homo sapiens
cctctagccttggagttggcagtgggatgacagcacccactctttttgcccctagcattacaactaattgcttcattccctctctctgcacagaaaccctgaaatcgtgtctccaatgacttctgctcagaggtgaaacacagcattctttccggctgccttatactgtgcagtgtcctgggtgtggggcaatgaggaagtgacttgggttttctagtgtgtaattttcctctgaaatgcatggaacagcaacaaaactaccaagatacattgcccagaatggtttcatggtagcactgaatgcattctacctgtcattatgtcaataaaaaaatttttaatatctgctgctaaaaaataaccaaatgccaaaatcatgtattctctctaaaacagatttttagaaatttgttgacctcctttcttgaataaattatccttgttaacagcaa

SEQ ID NO: 269977 - DNA, 852 bp, Homo sapiens
gcggccgctaagaggagaccaagaggcgggggctgcacttgacaaccagcatgccgagatggcacaccttgggcccaccccacctccacatagccttaattacaaatcagaggacaggcttagtgagcaagactggccagcatatttcaaggtcccatgttgtggggttgatacatctcaaattgagtcagaagaggcagaagtggatgtgagagaaagagagacacagagagacagagagccaaagagggcaagagacttgactttaagagactcctgtactgacaactccatgcagttcggaaccagaacgactacggctgaaccagggttcatggggacatggcaaaacgctgatactaacctcttattcagaatgtcccaacaggccatccgttgcacactggtaaactgcacatgtgaatgttttcagccagggaagattaacctgaggacttgtgatcagtgtaaacatggctgggtggcacatgaaaccctgaaatcgtgtctccaatgacttctgctcagaggtgaaacacagcattctttccggctgccttatactgtgcagtgtcctgggtgtggggcaatgaggaagtgacttgggttttctagtgtgtaattttcctctgaaatgcatggaacagcaacaaaactaccaagatacattgcccagaatggtttcatggtagcactgaatgcattctacctgtcattatgtcaataaaaaaatttttaatatctgctgctaaaaaataaccaaatgccaaaatcatgtattctctctaaaacagatttttagaaatttgttgacctcctttcttgaataaattatccttgttaacagcaatt

SEQ ID NO: 269978 - DNA, 467 bp, Homo sapiens
ctgtggctgcttgaggggcgagctggtagttgtgttttcagggatcttttttagagaagggagttttaacagggaaacgcggtggaaggcgtggcatataaactcttaattatagggacgtgaagttttcaacatgtgggaccaaaacaaatccttgctttcagtaagaactgcggagagcaatagaaaaagaacttgatttcaaagtccaagtttggtattttgagaaagcaattgcgggaggaaaaagatacttttaagaagtgaaagaatagaattctgatttttgtttatttcctatttcaaaccctgtctttttcctatgtggagattttgtgtgcccaggtcactaactgggtgtgattgactttctcgagggggcggggaaattgactccatacaccgattcaggaccctctcatcagtgctttaaggctctcttctggagcaggaaggaaaaaaaaaaa

SEQ ID NO: 269979 - DNA, 1249 bp, Homo sapiens
gccttcagtctgtgtcggaacctgccttcttcctggttctgcacattatcaccactgccctccccatttctctggccaggccccatgtatttacaggtaacttgggtagcctccatggtgcttggagaaggctgtgactttctgagtgataccccatttcagccatttagcccctcttcatcagagaaccttgttcatgattggatgcagagatcaagatcatctgcctcctcaagtggtccagcctccctgcagtaggcccagagcaaagaagcaggtaagccaaggaactgcttatccagcttcttgaccaacttgctggttttcacagtgatgctgtgaagatgggggcctgcccaagcatttccaccagggtccactgtacagagctggtcccaagtgtccaaagtccatttggcctcaatactgcagccaatatttcccccagaatcagcaaccctttgacccttccctttgtcagagcactggggctccaggcaacagtcctgtgaccatagattacttcctggatcctgatgaacttgtttggttagaagggatttctccaagttccctctgtgagctggagggatttctgccccaaagcgcgacaggttcagaatggtccccagcttgaggcctgcctcttcctccagcctttccaggcactgcatgcattaactgatttcagaattcactctttgtttacttccatcccattgcgaggccaggtctcgccagcctgttgtgagaggacatgttaggtgaggccattacaccttctggaaaccttgaccaagaggcggggtatcacatctatctattcatttatttatttaactgatatttattgagtacccactatgtagcactcagtgtactgggtgttgaaaataaagcatgagcaaaacaaagattcctgcccccatggaatttatgttccagtgagaaaggtagactagacacaacaaatataaaaacatatatatcaggctgggcacggtggctcacacctgtaatcccagcactttgggaggtggaggtgggaggatcacttgaggccaggaatttgagagcagccttggcaacatcacgaaaccccatctaattttttttaaaaagctggatgtggtggtgtgcacctgtagtcccagctattcagaagcctggggtggaaggatcatgtgagtccaggagtttaaggcacaccagcctgcgtgagagagtgagacccaatcttgttaaaaaa

SEQ ID NO: 269980 - DNA, 666 bp, Homo sapiens
actttcactttaataaatcttgccactgcacactctttgggtctgtgtgtttctctaatcgagctgtaacactcatcactgcagtccacagcttcatttcttgaagcctgtgagaccacgaacccttcaatcgagaaaaaccttcgataaggagaagacttctcatctcatttctggggtctggtccgggatttctccaaagcgaatagaatccatgaagctgcaaatggttctacaaatggagccccaagtgaccaccactagcacctactatcaagcacccctagacccacccaccaacctgttctcacaccacgacaccaaagactcccctcctgaggaaacctcaactgcagtgccccttctaccccccagttcagcaggaagtagctagaacaatcgtcatccaacttcccaacagcacttgggctttcctgttgaaaggggggactgagggactaagtggctaaattggctggacttcctgggtcaatagggacttccctaaagtgactttcccctaagccaaaatgagtcatagctgcaagctaagagattaaaacttcaaccaatcaaaggggattttcccctaagccaaaattagtcatagctgcaagctaaagggattgaaacttcaaccaatcaaaggggactttcccctaagcc

SEQ ID NO: 269981 - DNA, 493 bp, Homo sapiens
gttagccctctttcttttatttctggccacagcacacttgaacatacccacaccaagatttagattcagaaaagggatgtaggtggcctcatctggctcatagcctcagccacttggtccaactcaacttcttaacatagactctatgttagaatatcatatttgtacagctgttaataaagctgcaatttggtactaatatttcctctgaataacagccctcaaggaaacccccaaaagaagatgaactgattgaccaggcagaatttaagctttgccagggctatctgaacatcaaaatacagtcataagcctatctttgccctaaaagtatattctggggttgctgcctgcaggtattaaatgagttactgcatgtaaaatgcttagctttgtgcctgtggcactcataaaatgttagcttaaatattgctaaggagagttcggtagccttgataggcagaagtcatcacgagcttaacccaaggggagt

SEQ ID NO: 269982 - DNA, 188 bp, Homo sapiens
gaaaattttcaggtctctgtctggcttagaaggatcactgcaatgcgatgccactgtcttccttcaggatgcacccatgtgctgagggatgtgtgcattcacccacttaggaggctataatcaaagctggcggtcagagctggtgttggaccttcctactgccaagtatgagttgattaatagcgtga

SEQ ID NO: 269983 - DNA, 579 bp, Homo sapiens
cacagaacacagcaccatgctagtacaatacgctgtagattctccctccctccccctctctctcatatactcatatattttatgttgaaccaatatgaggcattgctcaaatttaagtcatattaaagttctaggctagttttgaaaacagaaactgattggaagcagaggttttcaaatagcccacatacgctactagaaggctgtacatttaagagagggccatctaggaagcaataataggcattaaaacaacaacaaaacaacaaaacaaaacagaaacaaaaacaacttgggaaacggccctcctttcacgttttttctatcccatcgacaaaggcgcgctgtccttagctgcgatgattttgtctcgcctccaaaaagacgcccacgcactatgttgagcacccaagtgaggctacggttcctgcggtcacagagggcagggaggctcaagcacctccaaaaccccgagccctggacagctccccaggcccttcccgcggcgcgaggacaagaggtctccggggccctcgggggagcggcgcctcctcctggttccagcagctctgcggccgc

SEQ ID NO: 269984 - DNA, 473 bp, Homo sapiens
gtttaaatatgaagatgcatatagatttagaataagtgagtacagaaaggtataccatactaacacttatcaaaagaaagagacgtagctaaattaatttcagacacagcagacttcagagcaaggttaaagaagagcattgcataatgataaaggagtcaatactccaagaaagaaatcataaaaatccttagtgtgcatgtgcctaacaacaaaccatcaaaatacattaggcagagcctgataaaacagcaaggagaaacagatgaatgcactattacacttggggacttcaacacccctctttcagaactggacagatccagcaggcagaaaatcgttaagaacacagctgaacttaacagcaccatcaatcaactgatatcagtagactacttcattcaacagattacacattcatctccaattcccaagacattcacgaagatagacgcaattcttagtcataacac

SEQ ID NO: 269985 - DNA, 252 bp, Homo sapiens
ctctatagggttttaaaactgatttaataataaataaaaatttccaagaaaacagcactgaaggaaagccacaggaccttgtgaaatttaaaaaagtagacagagacaatgcagtgtccatagaagctgtgaagttgacagattgggtttgaatcctgcatctgtcacatacggagtttcggttgcctcatttataaaatgggcctgataatagtaccatataggatggctgtgaaaaagcaaaagaagaaa

SEQ ID NO: 269986 - DNA, 350 bp, Homo sapiens
tctttcagttatgcccgctgacttatgaggatttttagaaatcctctctgtaccggaaaaaacttgagcggtgctggtgttcccagcaggggggacaaaggttgtttttaaagatttactaaatttgcattgaccccgcccacttctaggacttaactttggagcttaattatcccctagctctggttgcctcagccaaaaccaatgtttgaaccactttgacctctgatttcctttctagcttcaaaattgtataaaatgtacacaccgtcagtctcctacatttgcctgccttcttcctaccactcccttattatccaaaccaggaaaacaagttcagactccaaaga

SEQ ID NO: 269987 - DNA, 209 bp, Homo sapiens
gcacatcgtgtgtgtgtgtgtgttgtgtgtgtgtgtgtgtgtgtgtgtatcttactaatgttcacagagacacattcttcctgagttcttgggaagcatgtcaatcttacccccaaaaacatcctacaattatcaactaataattcgttttctagaacttgacaggtagccaagtgctttgtcatattttatttatttgcgtacccatt

SEQ ID NO: 269988 - DNA, 478 bp, Homo sapiens
agctgctacccatgactttaaaaaataaacagatactgattatttatggtttttgagcagcgttctgcgtacaaaggcagaatagctgtggctaaataaggggacatggttgtggcttcccacttctagttattacataaaatgtaaatctgacataatcattatcaaacagcataattgagtaactgttaagtcagactaagtaaaagctaagatgacacagtctttcattttagggaaaacataaaggtattttatttttgccctagaagatgcaaacttttttaagagttcttgtttttgttttttgttttgagacagggtttcactctgttgccagtggctcaatcatggctcactgcatccttgaccttcctgggaggagcacttgagcctgggcagtggaggttgcagtgagccgcaatggtacgactgcactccagcctggaggacagaatgagaccctctttcagaaaaa

SEQ ID NO: 269989 - DNA, 482 bp, Homo sapiens
acactttctcccaggcctgtgtttcaaacttctcaattaaagaggctgttgagatgtgcgtggggacatgggtgtgagttcttccctctctggcttgttgagcttctggagaactggtgtcctgggctcagctcggagcccttcctgtcccctccttcggcctgccacaccccctccccacgagcccttcactcctttgtggccaactgaggctacccctcagacagcatttgcattttaataagacccaaagtcaaaagataaaacagctattcccaaacacagggaacactaacaattgtctcttccagcaggagtttcatctttgtccaaaaaatgaggagaacacaggaaacttgaaagtattatccttgattatattatccttttatgattcaatgtttgcggcaggtggtagtacttgctatttttaatgtcctatttgacaaaataaaatattggcaaccctgaaaaaaaaaaaa

SEQ ID NO: 269990 - DNA, 411 bp, Homo sapiens
tgaatctggagactgtgaaggcaggagtaagtgcacagcccgtgacttggctcagtgtgtgctgagagaatccgtccccggcaccatggacatgctagaggtgtgaggctgcagaacaccgctggaggacggacttgtgcctatttatgtgaaagaagatgcttggcaggcaatgcgctactcactcgtgacctttatttctcacattgtgcattttcaaggatatgtttgtgtggatatctgcttagtgttaccacatggtattctcagcatgttaccttcacactgttgtgcgatgaaactgcttttagctgaggatatgctctggaaattcctgctcagtttcactgcagccctaatatgtacatatactgcaggagctacatataaagctcttatttactgtatatt

SEQ ID NO: 269991 - DNA, 511 bp, Homo sapiens
tgagattttaagatgaatatgctctcaaaaagctctgtgctggtcttcttaaattaattacggaaatttatagaggaaatcaagcaaataattctaatgaaaagaatcaaaagagtattttctaattttgcgatctatattcctggaatttttttttcaaagttctgaaacccatttcttaagcatgaacaaccacttttttaaaaaggttaggctgggcgcggtggctcacacctgaaatcccagcacttcaggaggccgagccgggcagatcatgagatcgagagatagagaccatcctggccaacatgatgaaacccgtgtctctactaaaaatacaaaaattagctgtgtgtggtggcatgcgcctgtagtcccagctactcgggaggctgaggcaggagaatcgcttgaacccgggaggcggaggttgcagtgaaccaggattgcgccactgcactccagcctggcaacagagcaagactccatctcaaataaataaataaaaatt

SEQ ID NO: 269992 - DNA, 337 bp, Homo sapiens
attaaaaatcaaaacctcttacaatgtcattaagagcgaatcaatactttaagaaaaccttgttccaacataggggaccaatctttagaaagacttataaataatttccttttaattatagccaacttaaacacacacaaaatttctttcttaaattctcttttcatgaacctgatacagaccatttatgacatgcttactttatcctacacttcctttttcttaaataccaagtcattttactttaggacaaaaaattattattcaagattttttctcacacaaaattattttttctttaaccttacttaataaaaatatatatttatgtccacaa

SEQ ID NO: 269993 - DNA, 777 bp, Homo sapiens
gtatagtccctatcttcatgtcctgtacattccctatcttcatatgctatacagtcgctattttcatatcctatatggctcctatattcatatcccatacattccctatcctatacattccctaccttcatgtcatatatggtcctatcttcagaccttttatggtccccatcttcataccctatacattccttatcttcatgtcctgaacagtctccatcttcatatcctatacattccctatcttcatttcttaacagtccccatcttcatatcctatatagtccccatcttcatgtcctgtacattccctatcttcatatcttcctatcctatacattccctatcatcatgtcctaaatggtcgctgtcttcatatgctgtacattgtctatcttcatgtccaatacattccctatcttcatgtcctatacggtccctatcttcatgtcataaacggtccctatcttcgcatcatatgcattccctatcttcgtgtcctatacattttttccctttatattctattcatttctgtgtgttaggaggtgaaggcattttataggagtctggaaagaagcctgagaagttgtattttcccctcacacctgcctttaccagacccctgttggagaatgacagtagagcttaatcagagtgtgacctctgacttttcaaactgaagacctcaaatctccaatttttatctgaaaaaatattagaatagtttcactctctttatgaacatggagacgtttttggattgctacggaagta

SEQ ID NO: 269994 - DNA, 225 bp, Homo sapiens
ccgctgatgaaggctccttagagtgccctgttccttagagatataggcgctactccatgaatttcaagctgtctaaacaactataatataatccttctcacaacaggaatctccattgccccaactcttgtcttcctcctcccataatgctgtcacctctctacccctccccaggacaaaggggcatctcatttggccagccacagaaataccccaacgtaccta

SEQ ID NO: 269995 - DNA, 399 bp, Homo sapiens
taataatttaaatgcctatcaatggaaaacaaatgaaattggttacagtaaaattgctactatgggaggcagctgagatctagaattgttttcaaaatataattttaagtgtaaaagtcaatgtcctgcaacacacacatacacatacatatatgcagaatgtgttgatatcgtatacagtatcctagaaaaatacagaaaatgctggcaatgctggttgcctctggagtaagagatgggaatgttaagaaatcccacttttcattgtaaactctgttgtatctttttaaatttgaacctgttaagaaattttaatcaatttttttaaaacagaaaattaaatagtagagagtaattaatctgattaatattgtgaaaatacctttctggcaaaaaaaa

SEQ ID NO: 269996 - DNA, 452 bp, Homo sapiens
taaaagaggcagcattgaaatatacatttagactttaaaaattataatggggttccagctgaagactgttatgagccaatgcctttacttccaaatgaccatggaaatgactggatcagagcagggacttgacggagccagcatcgacaacctgaatttcaaagctcttctgggaagtacatggaagtgctaacagaataccctaatatttccaacttcaagtgtctaaagtagccccagagaagggacttctagttctagcatccagagctgtgtccagcctgcttctggtgatgacatcctggtgtgcggagcaagctaaggaacccaaggcataggctctgagtcataggggactcgcccaaccagatagtaaaatagattatacagttgtaaaggtaatgatactataattaaagaaaaaataaataaacagagtataaagtccagaa

SEQ ID NO: 269997 - DNA, 387 bp, Homo sapiens
ttcactgttatgaagctctgggagttatttaaatctctcagcatgcttcctctgacggtgctgggatggggcactgcctcgttactgcctggtgaggatggagatccaggtttcctcctgtcgctgtcctcgggacctctgctgaggcctttctgctggaagtaggaggagcaccctaatggcaccgtgggatagggagcaggccatgttaggctggatggtgaaagttttcagcctgtgacgttgtctggtgtgggtgggtcccctttttttgtgtgtggtattttgctagagtaaggtagttatttcctaaaacttatctgtcctgttagttttccttcttaagtacctaacaaatataaagacaatgaactttaagcaataaaa

SEQ ID NO: 269998 - DNA, 211 bp, Homo sapiens
taaactactgatatttcctacttgggaaaaacaaaacaaaacagaacaaaaacctgtatttcaaaattagctacttcaatcattgaaggctggattgaggctgctttatagtccatgaaaaccacctctctttataaattctaaacatttaaaaaatctttgctcgtgctggaatgtcattttctagtattttggccacttcaccatgact

SEQ ID NO: 269999 - DNA, 517 bp, Homo sapiens
ctagaatggacagagatgacattcatgccaaagaccatgttgacttgctatctctacatttgctctaagtttagaaaaaaaaaatcccttcaatttatcctccaacagtcttcttagaaccttaccatggatgccttgtataacacatttcacctttctggtaaaaaaaaaaaaaaaaaaaaaaaaaaaaaagtacccctcttcctttcattaaatcttgcttttcccaaagccagtgattttaatctcttcaaaatactgccttctaatttattagaatataggctctgttaaggaaaaggccttgcctatatctgttaataatttttaccttgtaatcacagtgaagagcattgaatttgccacatggtaagtattcagtaaataaatagatataaggtgaaataaagtagtccacccatcccttttttattcggttgtttactgtgttcttggatatttttaaaaatgtgtcttcacagatgtaatttagagacattgtatctagtccaccaaa

SEQ ID NO: 270000 - DNA, 686 bp, Homo sapiens
tgggttgagtatatagttcatctcttaagctattacgcaaagtgcacattagatctgctgtagtcagtctgatatttttgtttaattttctgaagttttctgggaaagcagtctatatttgcattcattaatctacttgtttaaactttttgaattaaaatttattttcgcaattcattttatcctagaggacaaatacaattaaatatagtgggtgttttcatctctcattttttgcattttaccaaatgcccaaaagtcaacaggaagagatacctctttggtcaggaatgtaaaaacaggaaggaggaagtctattgcaaatctgtgctggctgattatgaattcaggtttcaccatggaggatgttcattaatgatcatcagtgtgctgtgctgttattcaaaattacagtgagtattaatgtcagtaatacagaatgtcaacactagttataggaggcaatgttaactaacacacgacactagacttttttctgtgcgtggaaacaggatactatttgtgagaacaagtcaagtaaaattcaacatcagaaatatacagtaatcctttaagatatgaatgtatcttttaagaaacatattaaagtatatcaattctgtcattacaaattctttgacagaatctcttcaaataaattagaggaagcatctgggcattatttt

SEQ ID NO: 270001 - DNA, 569 bp, Homo sapiens
gtggcgggcacctgtaatcccagctacttgggaggctgaggtgagaggatcgcttgaacctaggaggcagaggttgcagtgagccaagatcacaccactgcattccagcctaggcgacagaggaacagtctgtctcaaaaaaaaaaaatgtggataactgtttaatctgggtgaggtgtatgtagtgtcattatagtttccctttttgtgtgtatatttgaaatatttttataataataatttctaaaactcataattacataaaaaatgcttatgaaaaatattaagtgaaaaggcagaatataagcttgtccattcaacattactatgaccattaactagtgatgcattaacgtgttgatgccgagttgcaagtcatctgttaagatgttcaaatttgcaatgattttacttatattttagtgaagagctaaaatacagtttgatgctagaaaatgtttatgggactattttaagcatgtttaagtgtgacaggaaaaagaaagtgtgagaatcactgtaacaaacacatacacctatccatacacacccatataccattaaaaaaa

SEQ ID NO: 270002 - DNA, 253 bp, Homo sapiens
cgagactctgtctcagtataacaaagtatacctatcaaattattttgaccttttctaaatgtctccctttaatagaagtttcaataaagctataaagtggcaaaagacaaaatacctaacaaaatgtagattggattgtacattttaaaataactaaatgagtataattggattgtaacacaaaggataaaagcttaaggggatggataccccatcatccatgtgatcattacgcactacacgcctgtatcaa

SEQ ID NO: 270003 - DNA, 402 bp, Homo sapiens
ctgtatttgtcaaaaaatgtcaaagtcatgagacacagaagctgaggagacattccacatttgaggaggctgaaacagctggacagggcccagctgatcctgtgccgggaaggatgctgccaggctcgttgacaaaatgaagtgtggggacatcaaggccactgtcctgaagcagtagctgcacagcagccgcgtgagagctgctgtccccgggaggcaggcggctgtggagaagggaagacatcatgtgtgcgcctgtgtgtgtagggggcaaagcagattgggggagtgttgtcggctaggagctgggatggaaggcaggttggtttccctggtgatgttctagtcttgcaactgttcaagtctgaaattatttccaaatgaagagtttgttgtgtgttt

SEQ ID NO: 270004 - DNA, 413 bp, Homo sapiens
tctcaaaaaccctcacctctcagattctgccttcactcacgtatgcattttactatttcaccatcaacttaaaatttgcctcttttctatcaacttaaatttctttttaacttgtttcagatgtggagaatccatttaaagccaaagggttaactcctaagctgcatgtttttcgaaaagaacaatctagaaatatgaaaatggtaagactaacatgggtgattcctggtttttttcatggtagaatgccctacatgagaaaagccacaaggactggccttgttggccaggcacagtggctcatgcctttaatcccagcaccttgggaagctgaggcagttggatcatgaggtcaggagttggagaccagcctggccaatacggtgaaaccccatctctactaaaaatacaaa

SEQ ID NO: 270005 - DNA, 295 bp, Homo sapiens
gcatttcagttttaagtggttgaaaaatcttataaattgacagttcacttctcacaaaagttaagtccattttataacagactttctgaactgaggctaattttatacaaaagcagtaatacattctgtattatattctgagaaccttttattgggggatctcaaattatttacacaaggccagtgcagtggctcatacctgtaatcccagaactttgggaggcagaggtggggggatagcttgaggccaggagttagagaccagcctagccaacatggcaaaaccctgtctcta

SEQ ID NO: 270006 - DNA, 366 bp, Homo sapiens
gtgagcaggtagcctgtaagtgtatttcagtttgtgccagcattcccaaagtgtgtcccatacactgttccctggaaccttaataggtatttctattttaaaaaaaaagtatttcttggtcaaacaaacagaagaactactgagttaaagttaaataggtcaatctacaacagaatatttcacagcatttaatatgctattatttattatctgtttccagaaaaggtatatgaaagtgtttttgggccaggcacagtggtgcacacttataatcccagcactttgggaggccgaggcaggaggatcacttgaacccaggagttcaagaccaccctgggcaacagcgagtcctcgtctcctaaaaaa

SEQ ID NO: 270007 - DNA, 420 bp, Homo sapiens
gctcactgcaaactcagcttccctcaaacaatcctcccacctcagcatcccaagttagctgggaccacagccatgctccaccatgcccagccatccttgcttctttactacatttcttttttcaacaaatatttatcaagtaatattgtcaagtaatatttatgagcttcccctcagataggcatttagcatcatgatggcaccatcctctaacaataatgggaaggctattttccactgttattaatcattaattctccaaatcattttagtattattattaattctaataagtacagagattaataaatgcattcaaaccacatgtgaatatttgctataggtttatctgtgcctactgtatgttcagatttttctttatatctgaactttgttataaataaatgacagtaaaaatgg

SEQ ID NO: 270008 - DNA, 403 bp, Homo sapiens
aggttcagactgccattcagaagaggagaaaaaaggcagtggtcccaccttcccctttctagacgcctgtgaacactcctgggaatgaatgcgattgttctggagagcaagggagagagctggttagcagaattttattagagcaactggctcgtgactgtcacattaaaatgattcaagctgaatggtatttaatgatttatggggtgaggccacctgtccctgtgaaagcttcatattaaccatggcctggagtcatgggatttttacatgggaaaatgtaaaaggttgatattactagggttgagtctctggggattacatggggaagttaggagaaccaaggaggaggagggagggaagacgaattagtgagtcaaatattattcttcagaaaaccagc

SEQ ID NO: 270009 - DNA, 384 bp, Homo sapiens
gaaagaagaccatctacaagccagagagcagccttcacgagacactggatttctagagccttgattttgaacctcccagctttcagaactgcttcttcttcagttgacctcttgaagtctcggaggaatggccatttgtcggggtatgtggggaagcaggcttattcttttggacctgtgaggaatggttcctgctgacaactccatgcaaaggaagattggtagcaagtcactgatagacagtttttcacatggcctggctcctttcaatctgccaggtgtaccaggatcattcctatgaacttgtcaacagatacattcacgtattgatttacgatgtcaccaatacctaaaacaacattccttaaaacatttgaagtaagt

SEQ ID NO: 270010 - DNA, 352 bp, Homo sapiens
accaaagcctcccaggagcttattgtcctgcaggagtgcgtgcagaccaacatcaaagaagatggttctaactcctcccacctcccaccttctcctctcattaagaaatgtagccccaccgcgacagtcttggagaagaagccgggaacgggacgcggcaaggatctctgtgacttaaatctggcctttctggcccagtctcccatttggcacttcttcctggatgcgcatggtagtggcattgtgctgtatcctgcctgggctgtggcctctgctctgtactccctcttgctctatctgccataggagcctagaggcttggtctggcttaaagtcttcaacaaagaacact

SEQ ID NO: 270011 - DNA, 356 bp, Homo sapiens
ttaatagattttgtacagctggcccccacagtctgttctagaactgtttgaaaacttcttggaacaacagaaaaaaaatatgaaaaaataattgctgatgttaagcaactctctccctgtaggatgttttttagtgtcggagcttgagactaaagtcttggagtcttggtcacaaaactgcatggagtgttgtttatttcttggagaaccgtgattgagtcagtaagtagttaagtgcttcctaggcagtagctagtgccaggtgctgaggacgccaaggcagtggtgtttggaaatgcctttggaagagctctggatgcgagaggagctgggctggctttatcatgcagtcgagg

SEQ ID NO: 270012 - DNA, 540 bp, Homo sapiens
tttcttcctactgcagctcgttattttacccccactttgaccacaacattgctaggacgttggggaaacagaagtgtgtaagacaccacctctgccctcagaaaaatgtatcatctttcaggagagaaaggcacccccttgcgttgcagagctgagtagagcagggcactttacgctgcgtgtaaaatgaatggtgtagaagttaagttctggaagaaggagtggagacactgctgggaagaactagtcagggaacactgaagagaaacctggacttgaccttctctgtcttaaagggatggtaaggtttccataaagctgggatgaaagagaaatccagatggggaaatctgtgtgtgagtacaagagaaggcccaaggcaagttcagcttagtgtccaactggaacaataggactcccctatttctctctgctgtattaatgtggcttgtattatttaatggtacagtaaagtaattagtggctttcaaactctttagactgccacccacagcaaaaaatacattttacatcatgata

SEQ ID NO: 270013 - DNA, 509 bp, Homo sapiens
tcagatccagagcccagagcgtccaggctggagtttaggacgttcatcagagtcccgagacgcgcgagtgggtggaaccgcgtggggcgggagaagagggggagattaggcagcaagaaaatggtccccgtgggcagttcagcctaaacctggagctggggaagggcctctggagagaagccttaaatcgttactcatctttcacagtcttttataatcgtgaatgagccctccgttgtagactgttaatgcgtgtccaggatgcccgagagtgggggtaaaacaataaaagactcctcctgttgtgattaaaattatatttgctttttgtatcctcctaagttccatgatattgaaaatgtgtcttgttatatttcataaatgagcttttaaaaaacttctgagatatcttccaaaaagtatcactcaccagggaagaaaagaagaggaaacctagtggcttttctgttgacgccaaaggttactccctctgcctcaccataaaaaaa

SEQ ID NO: 270014 - DNA, 1076 bp, Homo sapiens
tgagcatggccatgtttcaataaaactttatttataaaaataggaagtgggccacatttgccaacccctgtgttaaactgtcacccagagtagattattaggatctgcacagctgttgcctgccgcataacaacctagaagccagattattgtcatcttcatcattgagacattcaatgtgctttttcctgttctctcgatcaacatcaaaagcaatcaacacagacagaagatgctgtgaccacatgtggagggagacttctctccaccactaagcaaacaatgagctctgcagcagacaccagccaggtgcccgccaattcaattccattgctatctatgtggagatagcatcagatcccacaggctaggggctcagtccccaagacttgcccacttcagacaccagtcacaagtccaggactctggaacttctgacggacaggcttcaagttggggttcccatgacccttctgtggatttgattaatttgctagagcagctcacagaagtcagagtaacacatttactgattggttgtttataaaagatattataaaggatacaggccgggcactgtggctcacgcctgtaatctcagcactttgggaggctgaggtgggtggatcacctgaggtcaggagttcaagactaacctggccaacatggtgaaaccccatctctactaaaaatacaaaaattagccagggatggtggcgggtgcctgtaatcccagctactcgggaggctcaggcaagagaatctcttgaactcgggaggcggaggttgcagtgcgccaagatcgcgcaccactgcattccagcctggacgacaagagcaagactccgtctcaaaaaaaaataaaataaaatgaaggatgcagataaaggaatgcataggacaaggtatgggggaaggggcagagcttccacaccctccctggcacaccaccctccaggaacctccacctgctcagctgtccggaagctcctgaaccctgtcctctcaggcctgttatggaaacttcattggataagcatgattggagcatggacaactgtgtcaaaatgggattg

SEQ ID NO: 270015 - DNA, 357 bp, Homo sapiens
gcagtcctcccacctcagccccctgagtagctgggactacaggcatgactacgcccggctaatttttttttcttcagtattgttaagtgaggtagggtctcactattttgtccaggctggtctcaaactcctgggttcaaaggatcctcctttctcagccacccaaagtgctggttttacaggcgtcagccaccatgcccggctggaactatcttttcaaataactcctgctaaggattgtagcttagtgtgggtgctttagtactgaacctccttggaacttttgcattatttatctaaagcattatagcagtgagtctagagccagaaagagtgcctcttttatgatatgcataa

SEQ ID NO: 270016 - DNA, 397 bp, Homo sapiens
tgctgctctccacacactgcctagagggtggccttgctcggtaggagcagtcatggggctgtaaaactgcatcctcaataaagctgtatcttctaccacatgctcaggaaagaaccatgagccttattgggctaatcgccaatttgggtgttcacctgccctgcatcagttgtgcctgtgaaaaactactgcactccagctgtgaccggttgagggtaattgtccaggttcttggtgttttgcacaaagaattcgacaaaacacacaaacaaagcaaggcaatgaaagcagagattttttttgtttgtttttttaattaccgtgcccgcgagacggagtcttgctgtgtcgcccaggctggagtgcagtggcacgatctcggctcctgggttcaagc

SEQ ID NO: 270017 - DNA, 456 bp, Homo sapiens
acactttcttacaacaacagccactgtgttggctggagagggatggggtgggcccaacggagacacaaggaggtagaggagctaacccctctactccactttcaaaactacattttaaagggaatgtgtatgtgaagagcactaccaacatcgcttttgttttaagttttcctttttgcttgtttttaaagccaaaacaaaaaacaaccaagcactcttccatatataaatctggctgtattcagtagcaatacaaaagatatgtagaaagactctttggttcacattccaatattaaaatagtgacacgaactggcaaagtggttttaaaagctttcacatgggataaatgattttctttctttcttttctttcttcgtatggtcttgtcagaataaactactatcttgaataaaacaacatccaacccaggtcattgaaatgaaattggccagt

SEQ ID NO: 270018 - DNA, 303 bp, Homo sapiens
ctgttgctatttgccgtgtggtcttgggcaagttacatagcctctctgggcctaaatttggctcttgtaaaaagacccagtcccccagtccccctgtcttccctcactcttgtgcgatcttggccattttggccacttgcccttaccaactgtaattttatttactatttgccttccaattaactcacttattaatttaatttgatttagaaaggagttttatatcacactgtaagtggaaaattagacttgccaggaccacattaccataaaaatgaatataattaaaattataatgttgtt

SEQ ID NO: 270019 - DNA, 490 bp, Homo sapiens
ctagaattctagttctatctcgattttactacaaaagtagttattttgtatagtcagtgtttatgtagatttacctagaagtttgctattttattatccttgaaagttagctaggtatacgattataggttgacagctgttttctcaaataatattctactgtcttcttgcttccattgctgcttctgaaatgacagttgtcagtctgatcagtatttgtagctaatctgccttctttctcaggtcatatttaagatctttatctttggtgttctacagtcaaatgtggccatgctacagtatgtttagctgtatatttcttttcattgtcctgttgggattgattgagattcctgaatctgagaattggtacttttcataaattctgaaaaattcccagctactgtctctttgaatattgtatctccctcattctctctattctctcctttaggaaataaaattaagacttctgttttatgatctcact

SEQ ID NO: 270020 - DNA, 469 bp, Homo sapiens
tggtctcaaactcctgacctcaggtgatccacccgcctcggcctcccgaagtgctgggattacaggcgtgagcacctggcctagtttttgcttttatgctgtgaacatttataacaagtcttgggtggacttacattttcatttttcttggataagtaccaatgggtggaattgctgggtcaatagatgcatggttaatttaatttaatttttttaattaattttttttttttgagatggagtttcgcctttgttgcccaggctggagtgcagtggcaccatctcggctcactacaacctccacctcccgggttcaagcagttctcctgcctcagcctcttgagtagctgggattacaggcatgcgccaccactcccagctaggtttgtatttttagtagagacagggtttcgccatgttggtcaggcgggtttccacctccggacctcaggtgatccgcccacctcgg

SEQ ID NO: 270021 - DNA, 225 bp, Homo sapiens
gtgtattttgtcatttcttaggacaagagcatgggaacaaccatctcctggaatggcccttccacaggaagagaggaggacacatggcacagaggaaggatggggcacctggattcaaaatctgcttacaccatccatggagcctgggatgttgaagaattagttttttctcttggaacttgctttccttacttgcaaaataaagttaatcctacaaacacaaaa

SEQ ID NO: 270022 - DNA, 475 bp, Homo sapiens
gagatggagtcttgctcttgttgcccaggctggagtacaatggcatgatctcggctcactgcaacctctgcctcccaagttcaagcagttctcctgcctcaccattccaagtagctgggattacaggcatgagccactgtgcccggcctaagtatcaatttttgaaatgcatgctctagctggagcttaaatagtttgtgaaaacattggtaagtactttatttatgattaaactagaaactcaacaattctatgtaacttacaatccttagattttggaaaacttccaatttcaatgtacaatcaatatgttataaaaatatatttcaatatatctgtttgtcaattgaggtataaaagcatgtctaataatagaggcagcattgataaggtcctgataagttcttggttcagaaaaaaaaaagccactagaataaacttttgttacgaaaattaagataacaattaggcttaa

SEQ ID NO: 270023 - DNA, 379 bp, Homo sapiens
agccctatggactaatttgactggtatatggtttatacctgatgacatacgaataggaactggctttatttttttcccatccttgactttagccctgccatattggatcttcctttcttgactcttggcaagattttacacttaactataagaacaagcttgttttagtctgagaccagcctgaccaacatggagaaaccctgtctctacaaaaaaaatacaaaattagctgggcttggtggcacatgcctgtaatcccagctactcgggaggctgaggcaggagaattgcttgaacccaggaggtagaggtcgcggtgagctgagatcctgccattgcattccagcctgggcaacaaaagcgaaactcttgtctccag

SEQ ID NO: 270024 - DNA, 338 bp, Homo sapiens
agaactgctcgcttgcttgctgtgtgaggatagacccacacacatttggtcacagaagacttctgtggtcacacagacttctgttcatcacagaagtcttctgcgatgattgttgtggtgtgaaagcagaggagaaacacagtttgaatttttctactttcacactgtgtttactgaaggttgctcaatgtaggcttgggatggttggtccggggtatgtaatagaaggtgcttaaaagtgctcctcaacagttttgaagcgtgtgggacaaaaaaaaaagtgctcctcaaagggtaggcaggatagtgtaatgcttaaatatatggaatctggatcc

SEQ ID NO: 270025 - DNA, 1266 bp, Homo sapiens
gtaggaaaaccaaatggcctttgaaggggaagtgggcttggactgctgccttggcattttatttcaaccatatccagaagctggctgaactctaaatgtggttcactcaaaagcaagataaagaatttttatcctgcttggctaatccctgtcaaggccctgtcaagggatcttaaaatttagtcaaaaaagtattttgaaaacattagtcatttgctatatcactaattcgtaaaaggctgttaggctgtgctataaattctgattttgtaagtgaaaaatataatttgtacttattattacgggctgaggtaatgttaattttcaccatgctataaatgcaatgaggtaatttgtatgtctccaggaatcttcttctttgttttaaatcttgtgtttatttggtgtcagttgaaagatataaaccttgttctgtggtctttagacattgtactttagtcttaaaggactcaccagtgaactagaagatctcattgcctctctccaggataacagtatgacccttttgatgaaaggctgaaacagtttcttaaaatcgtaacttcccagagcaattcagatttataaacctgatggacacttaaaaggattttgcttaaaggataattcagggttgtgagagcttgatggctttgcctacagcctgtttttctttcaagctccatcggcctttctggaatcagtgtttgattcatgattgagtcaggcctccaaccctctaagccacaggtgaaacaatctttgatgtctggaaagttttaatttattagagtgttggtgtttcagagatcctccttagctgtagacagaaagccgtagttaaacagaacagcttggccccaaagttgggtactcactgggcaggggaaaagagcatttaccatggaaaaactatcttgttctgggtaaaaacaaaaattaacactccttgagagaaggttgagggccacctgtggctgacaggttaaatgagagatttgtcatcacatgatccagagccttgttttgttttgtttttattaccttcctctttctctatttaatcacatagctgtctttttacctctttacaaccaagtatttaggcaaatactaacagaaaacgactcagagtcatttataccctggagctgcactgtggaattcagtagtgactggccacagtgagcacttggaaagtggctactgaaactgacaagctaaattttaagtttttaaaaaatatttagttgtgttaaaaaaaaa

SEQ ID NO: 270026 - DNA, 640 bp, Homo sapiens
ggggaatagataatgagtggagcggcaaactacagaggacagaaaatgattcgtaaaggactttcaggaaaagatggctgcctccacacacatatcagatactcctctctctgaaatgcactaccagatgtctcacgtacttttttgccaaaatcagaacttgcaagatagggcagttctcgtgccgaattcggcacgagacagaaagccgtagttaaacagaacagcttggccccaaagttgggtactcactgggcaggggaaaagagcatttaccatggaaaaactatcttgttctgggtaaaaacaaaaattaacactccttgagagaaggttgagggccacctgtggctgacaggttaaatgagagatttgtcatcacatgatccagagccttgttttgttttgtttttattaccttcctctttctctatttaatcacatagctgtctttttacctctttacaaccaagtatttaggcaaatactaacagaaaacgactcagagtcatttataccctggagctgcactgtggaattcagtagtgactggccacagtgagcacttggaaagtggctactgaaactgacaagctaaattttaagtttttaaaaaatatttagttgtgttaaaaaaaaa

SEQ ID NO: 270027 - DNA, 409 bp, Homo sapiens
tcctaagagtcatgtattcccgtggtatgctcataaccttgaacacactcttcctgtgtctgattaaattccagtactttttcatcaaacttgacttccaggttatctaagtgggcttctcataaggagaagcagtcactgcagatttttctttgcttttttggtaactggcttaagagacaagattttataattctcatgctgtctttattaggtttttgattgcaaaatctgaaatgtaaaagggtcaaggtttttacatccgtattaccttctgtattgcctttaaagtcttttgattatcacttttgttaagtaagtaactattattttacaatgacctgtgcttctgtttggatcagatgttttgagccttttaacatctttaataaacgtcctcaaaatcaaa

SEQ ID NO: 270028 - DNA, 326 bp, Homo sapiens
gaaagaactgacatacctgttcctcaaaatagaaattatcagtaatcgttcagtatgcttcaacacagtaacctttagaactttgtcaagaaaagtatgaacatacagatgttcatacatgaaccattattaaaaaaaaaaaagcagaccgttaaatactatgtacacagtggttaaaacacacctgtaggcaaactgaataaaatttcaaattatatatagtagacttttaaacctaatttaagtaggttttagaaaaagtaaataattgcaagaaactaaaatatgaaatattaaaacattaaatataaaactttactcattgg

SEQ ID NO: 270029 - DNA, 508 bp, Homo sapiens
aatcaaggaccagataaaacaaattaaaataaaataaaatgcaaagttccctctaaacacctgtcatgtttaaccataagctttctgatgtgaaggagaaaggaggttcctgggaatgtatccacaattagtaacaggatgacccttaaacccccaagtgtgaatgaacccacatgtatacattactgtgtacacacacacacacacacacacacctgtcaatgtccctccatttgcaatatagacagcatttaatacgcatgaagagatttttaaaaagggcattctttaacgtatttcaactggcagcaggtgatcagaaaaaaataagataaataaaatattgtttagctatcaaagaacaactctgcactgttagatacttaaggtcctgatttgcacctgagtttagaaagctacctcatacatatgcacttaaaatggaaatttctcatcagattccacatctaatgcaatgcagaacccaactctagctgtgccccatctt

SEQ ID NO: 270030 - DNA, 591 bp, Homo sapiens
ttttaaagactacagtattttaaatatttagacaaagaaggatgttttgagatttttttctttgctgactgataaaacgaaattattctattagactcatagacgattattatctccaaagacagaaaatgtaaatttttatgttttttctttacaagtaaacctaatgcttatagaagtataaatgttgaagatattatttcataaatactgcattgccttgatactaaaataatactgatttaaagacaaacgtagatcatgacatgatatttgggaaaaacaaaaacaaaataactcccccaaacattgccttaataaatgtatgcatcaattataagatatatcccagattcatatatgttgagatgtaagaaaatgtgctttttcagattgaagaaatacggttatagtaacaacaataatagtaagttaacattgaacacttactgtgtgctagcaaatgtgctagcaaatttttttacatgtatactctcatttaatcttctttttctttctttctttttttttttttttttttgagacagtcttgctctgtcatcaggctggagtgcagtggcgccatctcgg

SEQ ID NO: 270031 - DNA, 466 bp, Homo sapiens
tctcagagtggctactttccagacaccagacacacaaatgctttaaagacaaaagcaggttgttacatttgtcagggtgaataaaaagcctagagcaggactctcaagtctctctttctgtgctaaggaatgtcttcccaattttttgcagccttgaggaccgggagatgactgggaaattgctgacagggcagggaaagggctatactctacatgctggcattcacagacaaacaccgaggggcagcaacagcaaagaggagtcttggtgctcttcctggagttcccaggctttactggccatggatcctgttattcaatcaaatacttattgtgtgcctactacatattgggcactattctaggccctgtggatgtattagtgaactaagcaggaaaaaaaatcacctactcatgtgaaggttatgttgcaatagactttggggacagagacagacaataaatt

SEQ ID NO: 270032 - DNA, 571 bp, Homo sapiens
ggggtgctactagtatccactaggtagaggccagggatgctgctgaacatcctacagtgcacagaacacgtctcacagcaaggaattatctggcccaaaatgtcattaacaccaagattgagaaacccgggactggagcattgcagcacagaatcacagcacattagaggtgggagtgattttagaagtactctcatccaattctcccatttcacagccgagggcactgagatccagagaggagagggaagcagccaggatcacactgcaagcaagtgacagagctggtctgcaattcagatctgctctctcctgagaccgttttacccagattcccccagagttgttgtgaaaattaaatgtgagctgtgaaaacaaaaataaatagaaaattatagagactatattaatatttctattattaagaattgggagtttgtatagttgtatttctggctatgccactgactcattgtgcaatattggacaaatcattctcccacccccatgcctctctatgagtgtgtgtgtgtgtgtgtgtgtgtgtggtggagaggtggtcttagagcaa

SEQ ID NO: 270033 - DNA, 560 bp, Homo sapiens
accgagatgttgatgcctaagaaccggattgccatttatgaactcctttttaaggagggagtcatggtggccaagaaggatgtccacatgcctaagcaccgggagctggcagacaaggatgtgcccaatcttcatgtcatgaaggccatgcagcctctcaagtcccgaggctacgtgaaggaacagtttgcctggagacatttccactggtacgttaccaatgagggcatccagtatctccgtgattaccttcatctgccccggagattgtgcctgccactctatgctgcagccgtccagagactggaagtcctcagcctaaaggtctgaagggtgagcgacctgcaagactcacaagagggaaagcggacagagataacctacagacggagtgctgtgccgcctggtgccgacagcaaagctgaggctggggctgggtcagcaaccgaattccagtttagaggtggatttggttgaggatgtggtcagccacctcagtaaaattggagaggattattttgcattgaataaacttacagcaaaaaaacttaaaaaaaaaa

SEQ ID NO: 270034 - DNA, 523 bp, Homo sapiens
atgtaactgggagcataaactggtaaagcctttttggtagacatcttggcaatatctatcaacataccaaatatatataatgtttgacccagtaattctacctctaagaatctcttccatagaaatattcagatataagtacaaaaatatactattaaatgttcatggtagcattgcttagaatagcaagaaactaagaatgatcatcattaccacataacaccattcaggtgtttaaaaatactgactttgaaaggcatattgctaactgaattaaaggcaagtcacagaaaaatattaaatcatgcccctgccaatctctacgctgacacacattttatctatgcaaatacatggagggaaatctgggaagactgtaccaaatagtcaacaatcattaaatgtagtcaaaagactaaaactcctaagttctattccatatacttttactaggaaaatatatactcctatacactttcttaaagagaaaaacatattgaagaatacacattaattaccagca

SEQ ID NO: 270035 - DNA, 395 bp, Homo sapiens
tcaagtagctgggaccacaggcgcacatcatcacactcggctactttttgtattttttgtagagatgaggtttcatcatattggcaaggctggtcttgaactcgtgagctcaagcgatttacctgcctcagcctcccaaagtgctgggattataaatgtaagccatcatgcttggcctgaaccaattttaacttttaaaaatcaccttttctttgttatacattcaagaagacactgagatgggcattagactaacatcaagctaagttgcatataatttcataaactctgagctttcttgaatatattttttaatttgtgggaattccttgtacacctgagccccaaagacacagcaaactccagtcatagcttggcaattaaatgaagcaatg

SEQ ID NO: 270036 - DNA, 480 bp, Homo sapiens
attttaaaacaaacattatatgtctgaatctttgcctggagtttcatattttgtgaaaagcattttgtaagtagaggactcataagtgctataagtcacctagtacactacaatggcatagatgtgacagatactcaatgaaatgattataacttctgatgtatgttatttttgttgttcatttattaatctagtgaaagccagccaatagatggaatgacattcacctgtaaaacttccaagatcccatccaagcttagtgtcctctgaagttctccataattgattgtctgttcccaccaacatttagcataagctctagaagcttatattgttaatcatccttctatgtttatgtgctgacttgcaaataaatgcgcctatgtggcctttatcttcacagccctaataatatctacataatgtaataaatttgttataaacctgatgtttcataaaattatgtcttatcacctaaaa

SEQ ID NO: 270037 - DNA, 543 bp, Homo sapiens
tcactctccctctgccctagagattggctgaactcaagcagcagccagatggcaagataaccagagtaacagagtcgctaaagctcagcctcctgggagcagaaaccagagtggagaagggcagaaagcggttctagacaggcaaaacaaaaatatccagcacaccggccaaaccaccagccggttctgagtatgaaggaaaaacatttcagaaatatgaaagctcacctctcatgtaccaagaacttcagcagaattagttaatatgataaagaatacatggaatccaaccaaggggctcaaactaagaaagcaagtgagggaaccttcaggacgacaactgtgtctcttgcctagagagcaattcatccagattttagaagaaggatggaaggtgagaaagcaaagctccaagttgaataaatgaactgacagatgatcatatgcactgaagtactggtaaaatttggtaggcatttgacaaatattttgcagtatttggaaagaaatagcaatgaatacatagaaaactaaaatgagaaa

SEQ ID NO: 270038 - DNA, 850 bp, Homo sapiens
  misc_feature (430)..(430): n is a, c, g, or t
attccaaggattgagaagttttgcagtggtcaactggtatagacatcccattaccactacttccttcattggactgcaaggtatttctgtttggaaaagtaatggagtccagtcaacttcattgatcgccaaggactgtcaaaattataaaacttgctgtggagctctgacatgccagaagccgctagaaaaagaagtttgacattcagaaacttatcaagaggttctactctttggatagagaccaaaatcatactttgaaaaagcctgacaggtttcttcggaaaagtggccatccatggaatgaatgaaatgttctctttctattccagggattgcagtggcaaagctaggctaggtcttggaggctggtgtaaggcgatgtgggtgaaggcaggaggctgatggaaagactggggggaagaaaagncgaaatggattcacggtgccttggatgaaggacgagaggggaactgcaagctccttcaactggttctgtccggtgagaagtgatcaagcttgggctgacagaggctcagggagccctcacgttctttcgcttttttacctgccaatcaaactgtacaagacaacacctgatctggcatggacatcgcgggtccaagcctgtaggcccaaatcggataatctctggagctgataaacaagcaaaaagagaaagccaggacaacagacaatattaaagaagaagacaatccaactctgagattccaacttagaaactaactggttccttcaagataaaggtcggggttagagaatgtgaaccgggttgcttcattctaagacttctcatacgggctggtttcaaaaacccagggggactcct

SEQ ID NO: 270039 - DNA, 997 bp, Homo sapiens
  misc_feature (577)..(577): n is a, c, g, or t
cgcagagagaagaagctgcccaagaatggaaaggaagaaatatatcacatcatctgtctgtccacaggctttccttggggcttatgaagtgaatgaaggagggaagaaaggagagacagagaaaatatggatttcctcatggttgtgattcctcttcactcttttgaatttggaaggatggcatacacatctgaaaaataccactacttccttcattggactgcaaggtatttctgtttggaaaagtaatggagtccagtcaacttcattgatcgccaaggactgtcaaaattataaaacttgctgtggagctctgacatgccagaagccgctagaaaaagaagtttgacattcagaaacttatcaagaggttctactctttggatagagaccaaaatcatactttgaaaaagcctgacaggtttcttcggaaaagtggccatccatggaatgaatgaaatgttctctttctattccagggattgcagtggcaaagctaggctaggtcttggaggctggtgtaaggcgatgtgggtgaaggcaggaggctgatggaaagactggggggaagaaaagncgaaatggattcacggtgccttggatgaaggacgagaggggaactgcaagctccttcaactggttctgtccggtgagaagtgatcaagcttgggctgacagaggctcagggagccctcacgttctttcgcttttttacctgccaatcaaactgtacaagacaacacctgatctggcatggacatcgcgggtccaagcctgtaggcccaaatcggataatctctggagctgataaacaagcaaaaagagaaagccaggacaacagacaatattaaagaagaagacaatccaactctgagattccaacttagaaactaactggttccttcaagataaaggtcggggttagagaatgtgaaccgggttgcttcattctaagacttctcatacgggctggtttcaaaaacccagggggactcct

SEQ ID NO: 270040 - DNA, 782 bp, Homo sapiens
ggacgcggaggagaaggaaagtcgctcaagcagtggacagagcggagaaagcgacttcgggtctgctggagtttgctggaggtgcactccagactctgtttgcctgcctatcaccaacagaggctgcagaacagcaaagattgctgtctgtaacttcctctggaagcttcatcccagaggggcacctgccagatgccagccggagctctcctctatgagtgaatgaaggagggaagaaaggagagacagagaaaatatggatttcctcatggttgtgattcctcttcactcttttgaatttggaaggatggcatacacatctgaaaaataccactacttccttcattggactgcaaggtatttctgtttggaaaagtaatggagtccagtcaacttcattgatcgccaaggactgtcaaaattataaaacttgctgtggagctctgacatgccagaagccgctagaaaaagaagtttgacattcagaaacttatcaagaggttctactctttggatagagaccaaaatcatactttgaaaaaatgagaagagatggaagccaaggaagggtgtgtggaatcaagtagcagttctcaaaacagcatatatcaagacctcagcacatatcaagacctcagcacatatcaagacagtggcacaaaagcatcgtagtgttgtcattcaccactatgcaggagggaaagccaatttcatttcagaatgtcctcaattaatctgtagaaattattaattttattaaatcccaacccttgaaaaaaaaa

SEQ ID NO: 270041 - DNA, 503 bp, Homo sapiens
ggacgcggaggagaaggaaagtcgctcaagcagtggacagagcggagaaagcgacttcgggtctgctggagtttgctggaggtgcactccagactctgtttgcctgcctatcaccaacagaggctgcagaacagcaaagattgctgtctgtaacttcctctggaagcttcatcccagaggggcacctgccagatgccagccggagctctcctctatgagtgaatgaaggagggaagaaaggagagacagagaaaatatggatttcctcatggttgtgattcctcttcactcttttgaatttggaaggatggcatacacatctgaaaaatagtaagtaatgtgtgatttatttttcaattactgttactaattgtaataaagctgaaatttgattactggaggagtttgaaatcatcatgcatgccttgaaggaaaatgggttttgtgaaacatttgcattatttggtgtgaattacctttggtgtgatttaactgtttatcac

SEQ ID NO: 270042 - DNA, 402 bp, Homo sapiens
ttcaagtcaaggactcacaatgtcagctgcagcactgtctgcctgagcaaaatgaagaggcttgctgagagccaactgcccgacaacgactcattcccaggctctctgtagtttggtagaaagaacctgctaaagtagtaatattgatcatattgatcatgacaatggcagctaacatttatcatgtgcttactatgtgccacccactgttctaagggctttatccttcaatgcaggcactaatatcatgatccccattttacaggtgaagaaaccgaggcaatgaacaaagtaatatacccaagatcacattgccagtgaatgggagagctgacgtttcaatctacacagaacctgtgctcttagctatctaaccgctttacttggaagtgatgtgagatt

SEQ ID NO: 270043 - DNA, 372 bp, Homo sapiens
ctgctcactccagaaatattgaatcaaaacgtggagcaggagacaggcaaggccagtgaaggagtgtggctccgataggattgacaactactaccttagatgatgaatcaagctcagaagggatccctctggatttccctgcgccatgtaagaagtgcctgctttccctttgccttctgctatgattgtttcctgaggcctccccagtcatgttacctgtacagcctgcagaactgtgaagaaaccgaggcaatgaacaaagtaatatacccaagatcacattgccagtgaatgggagagctgacgtttcaatctacacagaacctgtgctcttagctatctaaccgctttacttggaagtgatgtgagatt

SEQ ID NO: 270044 - DNA, 229 bp, Homo sapiens
tgctgtcaagtggctgggggccaggatgcctgggttggccgtgagaggacattgctgaggagagtggaggccaggctggggtggggtgtggcaggaggacaggaatgcagtggaaccagtgggtcaggctcctgagggccccaggctccagcctcagggctggcctgttccctcctaagctgccatcttcatatcttcaggacccacccctctactcctcaccctcagc

SEQ ID NO: 270045 - DNA, 525 bp, Homo sapiens
tgagacagagtcccgctctgattcccagggtggagtgcagtggtcattttgtcagctctgtcagcttgtccttcttggagactgtgccaggtaccaggcccccacacagtcaacagggctgtttctcctcaggctcaccagcccctggtttccacctattttgatttttgtccatctgaaaggcaaaaactaaacaaaacaaaggaatttgggtgtagttagagtttgcgtttctcttacgatgcgtgaggctggtcaccttttcatttgcttaagagccacatgtgtttctttttggtgaatgaactgcagaatttctgcagaggtggtgccgggcagctttggagaggggggcctggagggaggccagactagaggcagaggccacttctggggacagttagcgtagaagggagagaaaatttggtcctgaagagtggtgtgagagctggagatggagatgatgaagttgaaaggctgagattaggtgataggttagcccccatggagggccatggaggaaga

SEQ ID NO: 270046 - DNA, 938 bp, Homo sapiens
aagtagagttccaaagtactgcaggccctggtggtagctggcggagggccgtcctgctcgggactgtgagaagccctttcattgagcctctgctgttcatgctgtttgacaccttgcgttttccagttaacgttatattttggagaccactctacatcaatacatagagtgtgtcctcattttcacagctgcacggtattccagcacaaggatgtatggtaatttacagatgcacttcttggcagagggaccttcaggttgcttccagccctttctcaagacaggccgtgccgcaagacagggtcctgctctgtcacccaggctggagtacaatgtacaatggtgtcatcatagctgactgcagcctcgacctcctgggcttaagccatcctcccgccttggcctcctgcgtggctgggactacaggcacgcaccaccgtgcccagcttgcagtggtcattttgtcagctctgtcagcttgtccttcttggagactgtgccaggtaccaggcccccacacagtcaacagggctgtttctcctcaggctcaccagcccctggtttccacctattttgatttttgtccatctgaaaggcaaaaactaaacaaaacaaaggaatttgggtgtagttagagtttgcgtttctcttacgatgcgtgaggctggtcaccttttcatttgcttaagagccacatgtgtttctttttggtgaatgaactgcagaatttctgcagaggtggtgccgggcagctttggagaggggggcctggagggaggccagactagaggcagaggccacttctggggacagttagcgtagaagggagagaaaatttggtcctgaagagtggtgtgagagctggagatggagatgatgaagttgaaaggctgagattaggtgataggttagcccccatggagggccatggaggaaga

SEQ ID NO: 270047 - DNA, 397 bp, Homo sapiens
agagaaaagggaagatttgtttactatccaatataataaagataatgtctccctccatagcaaaatcagacaagtttgctgcccggtataaaagatttgggttccctttgctggacacggtggctcacacctgtaatcccaggacgttgggaggccaaggcaggtggatcacgaggtcaggagttcaagaccagcctggccaacatagtgaaaccctgtctctactaaaaatacaaaaaattagccggacatggtggcaggcgcctgtaatcccagctacttgggaggctgaggcaggagaatcgcttgaacccaggaggtggaggttgccgtgagccgagatcaagccattgcaccccaacccgggcaacagtgtgagactccatctcaaaaaaaa

SEQ ID NO: 270048 - DNA, 485 bp, Homo sapiens
ataaaccatacttgtcaataatggtttgttcttttaatatgagactggattttatttgctaaaattttatttaatatttttgcatcaaaaaatgaaaagatatcttggattagcttcggaataatccataatccattgctggagagggactgaatggtggtatagataaaacaaaattagatgtgagttcgtcattcttgaagtcacatgatgaatatgtggaatttgagtatactgttcttttgcttgaaatttttcatagtagaaagttaaaaaatttttttgcctatacatttataagagaaattggtctcttaagtttttttcaagtgattatacttgaaaatcaccaggttaaaaaaatagaataatgtagcatcccagaagccctcatcttctctctcctctccaaaggtaattattatcttaaaaacatcatagatgtgcttggttgtcatctttatataaatgaaatcctaaggtac

SEQ ID NO: 270049 - DNA, 430 bp, Homo sapiens
gtcttctcttatgaagccaatgaatatttactgacaagcagtatagtaggacatgcccttgaatagcatagaatctaaagagaggagcagatgtgtaaactaaaaataccaattcagtgaagcaagttcagcaaaaatgtctgtgcagggtgctagagatttgcagaagagttacatcacactgctatgagaaactacgggtggttttaaaggaaaatggtaatatcagagctaagtaaaggagcatacataggagttaactagttaaaaaaataatgaggaactgctatgaggaattatggatggcttcaaaggaaaaaggtaatatcagagctgagtaaagaagcatacatacgagttaaccaattaaaaaaataatgaaagtcagtgggagaatgtttaaggcaaaggacagaacaccaggaaagac

SEQ ID NO: 270050 - DNA, 397 bp, Homo sapiens
  misc_feature (342)..(342): n is a, c, g, or t
ccgaatctataaaatgttttacatatttgccagggaaacagaaaagatatttgtacagctgtaagaattggaattaatttcattttactgacttttccttaacctaattctgaacacttttgccataggtttgagaataagttgttataaaatgactactattcttcactaatagtattggcatttcaattcctaaattctgttttttgattcttgaacatttctgaatttactttttttgtcttagttcttctacagaatcattttcttcttttttctttttttatttttattttttatttttgagacagagtcttgctctgttgcccaggctggagtganccgagattgtgccacatcactccagcttgggcgacagagtgactccatctcaaaa

SEQ ID NO: 270051 - DNA, 803 bp, Homo sapiens
ggctgcttggcgtggcagtgatcgcttggcttggcatttctggcttagcggtcctcctttcgcagattggaaaccgcgggctatcctgctgggaggttgtggccgaggcagtagctcgctactgatggcctcctggggtggagaaaagcggggaggggctggggggtctccgaagccggcagtctacgccacgaggaagacccctagtgttgggagccaggaggaccagtggtacttggactacccgggggaccagtggtccttgggcttctcctacagctggtggaagaacagcgtcggcagcgagagcaagcacggtgagggcgccttagaccagctccagcacgatgtccgcctggaagatcttggcgagctccacagagctgcccggtcgggcgacgtccctggggtggagcacgtcttggctcctggagacactggcgtggacaagagggataggaagaagagcattcagcaactagttcctgaatataaggaaaaacagacacctgaaagtcttcctcaaaataacaatccagctgctccaagccaggctgaaggaggagaaggaggagtcgcctgtggtacggtggagcagatgacgtggctctgcagcttgcctcatgcagttggtggtggagatggagaccacagctcgactggagcggtaggagggcacccacgggggcctggagagtattgtcatctgcatgagcaaagggttcatcaccacatctttgcaagaggaaaaagaaaggggaagaatcatgtgtctaatgttgtaaggtaaacattcacaacca

SEQ ID NO: 270052 - DNA, 515 bp, Homo sapiens
gtggcttgcctaagctttattttaaaggctgttttcaatattatttgaagattgggcagtacatgatgcaatcaaacaaaacacaggtttcaggtatgtataaatacttatgctttatttcatatataatgctgtgtgttccttgacacacacagttctatgtattccaagtggtcactgtagtttatcacaggaaaatgttaatgccctagaaattttcatctgaggtatctaagcccataataggtcatcattaaatagtctctgaattattgttgtgtattatatattgtgtgtattttgtgtattatatattgtgtattataagttacaccacaaatactacaatatgttcgctcactctggaaattaaaaagtgggagatacactttaataagtataatggattgacccatagatgactttatattacataaactacttaagacatattctttgtgctgctttttctaaaatagaatatgttaatataaacatatttgaaattcaaaaag

SEQ ID NO: 270053 - DNA, 213 bp, Homo sapiens
acacagagtactccatttaaaaattaactatgacataatatttcacgatttagacattccttagtttgaatttcacaattaataagcacttaggttttccttaatattttgcttttacaaatcaaactattcataatcatgccccttgtatacatgagagtgttcctctagagtggacactgagcaggaaattactgggtaatgtataggtga

SEQ ID NO: 270054 - DNA, 524 bp, Homo sapiens
agaccagatcagtctctttacacttatctgacagtgacttacaatgatgcattttatgtgagcattcagaacctgtctgtaggtatccactccgatatctgcacacagacattcacacacatctgtagctgaaacaaacgtttcataaaacagtatttatcctcctacttaaaatgtactctggtattttctgttcaagtctggtctgttctcaccaaaaagctggtcctggcccattaaatcgatttcacaactctcggccgcacaccgtctgaaaaatatcagactagacagtgtctgaaattcctaccaacttggaacttctcttattctcttctgatgtgtgagatgaaaaggaagcaaagagagcgagagttttggaaagaaaaactgatgggccatgacaggccggcctgagtctgtgaggacactttgaggaaggacttctgattcctggttcaacagagatgcttaaaagttaagaatgggtactaaagataccagcctaaccattttaaaggaaa

SEQ ID NO: 270055 - DNA, 596 bp, Homo sapiens
tcaccatgttgcccaggctggtcttgaactcctgggatcaaggaatcctcctgcctcagcctcccaaagtgctagaattagagacgtgaggcaccacaccacctacctttatatttaagcaacagtttgactgcatacaaaattcctgggtcacatctctttgctggaggattttattgtgattgccttcttgtgtgtttggtaatccagtttgtgagttgatggcttcatcataatctgtgggagtcctctgtaccaaacttggaaagttctcctccagacaagactttgccttcaggtgaatcaactgacaccagcttgaacagtgaccgtgactgcaacaaaggaactgactcaaccggtcctctgaccactcccctgcaggaaatgactcagcacatgaagacagtttcaacactcctatgatttcatcccccaaccaatccacaacatctgtttcctaatgccctacctgccaaatcatccttaaaaaccttagcctctgaattcttggtgaggtggatctgggaaatgtatcccgtcctcctcactctatgccttgcaataatcaaactctttctctgctgcaaaaaaaa

SEQ ID NO: 270056 - DNA, 923 bp, Homo sapiens
ttctacttctaggaaattccactcattgataaagctcggcttcgacgcccctgctcacaatgaaataccttccttgccaaccacattgctttatgatcgtgcccctttaccacattgtacttgaaatgccttgtcatttaagaaaccataaaaacgacgtctttaaaaatgggttcatcatttagctggagatggcttctgtgcctggaaccagaagcctgtcctctcggtggtatgcctccacaaaaggaagcgagctaccacaaaggacagcatcatgtgttgccttcattgctattgaatcgggaagttggtgcccagtttcaacatggatgacaaagtagtgggaatctgaaatgcctacagtagaagctatttttgaacgagaaggactttggctcaaatcaacagtttggtttcttactgtttacatctatgagtcaaagtagcttgctcccaggatcccccaccaaaccgaatgaaaataaattcaatgtgtgcccactgagcctggcctgggagttcttgagatcaactcagaatcatggtctttctgtcactcccaaaacaatcctacctaattctacttgttcctaagtattgccttaggatactgacagtcttttctcctacttacagcttttgaatgaaattaaagctaatcctctctggcttggtcgggtcttgtgtaagaattcccacaccccacaatcaaggccttgcaatgtggtgttagaagagatagccaagttaccacacctgtatcacgattcggataaggatagtattttttgccttccatgagacagctttgaaaacctgagtcacagaagctgcttcatgcaaatccttccactttcctcctcactgccagtacattggcacctccttcttaaaatgagaagagaagcataaacaagacc

SEQ ID NO: 270057 - DNA, 1003 bp, Homo sapiens
ttctacttctaggaaattccactcattgataaagctcggcttcgacgcccctgctcacaatgaaataccttccttgccaaccacattgctttatgatcgtgcccctttaccacattgtacttgaaatgccttgtcatttaagaaaccataaaaacgacgtctttaaaaatgggttcatcatttagctggagatggcttctgtgcctggaaccagaagcctgtcctctcggtggtatgcctccacaaaaggaagcgagctaccacaaaggacagcatcatgtgttgccttcattgctattgaatcgggaagttggtgcccagtttcaacatggatgacaaagtagtgggaatctgaaatgcctacagtagaagtaagggtgtctttatattgggaatatcctcgatcccagggcccatttctaattcccccttctctctttccctgatacaggctatttttgaacgagaaggactttggctcaaatcaacagtttggtttcttactgtttacatctatgagtcaaagtagcttgctcccaggatcccccaccaaaccgaatgaaaataaattcaatgtgtgcccactgagcctggcctgggagttcttgagatcaactcagaatcatggtctttctgtcactcccaaaacaatcctacctaattctacttgttcctaagtattgccttaggatactgacagtcttttctcctacttacagcttttgaatgaaattaaagctaatcctctctggcttggtcgggtcttgtgtaagaattcccacaccccacaatcaaggccttgcaatgtggtgttagaagagatagccaagttaccacacctgtatcacgattcggataaggatagtattttttgccttccatgagacagctttgaaaacctgagtcacagaagctgcttcatgcaaatccttccactttcctcctcactgccagtacattggcacctccttcttaaaatgagaagagaagcataaacaagacc

SEQ ID NO: 270058 - DNA, 857 bp, Homo sapiens
ttctacttctaggaaattccactcattgataaagctcggcttcgacgcccctgctcacaatgaaataccttccttgccaaccacattgctttatgatcgtgcccctttaccacattgtacttgaaatgccttgtcatttaagaaaccataaaaacgacgtctttaaaaatgggttcatcatttagctggagatggcttctgtgcctggaaccagaagcctgtcctctcggtggtatgcctccacaaaaggaagcgagctaccacaaaggacagcatcatgtgttgccttcattgctattgaatcggctatttttgaacgagaaggactttggctcaaatcaacagtttggtttcttactgtttacatctatgagtcaaagtagcttgctcccaggatcccccaccaaaccgaatgaaaataaattcaatgtgtgcccactgagcctggcctgggagttcttgagatcaactcagaatcatggtctttctgtcactcccaaaacaatcctacctaattctacttgttcctaagtattgccttaggatactgacagtcttttctcctacttacagcttttgaatgaaattaaagctaatcctctctggcttggtcgggtcttgtgtaagaattcccacaccccacaatcaaggccttgcaatgtggtgttagaagagatagccaagttaccacacctgtatcacgattcggataaggatagtattttttgccttccatgagacagctttgaaaacctgagtcacagaagctgcttcatgcaaatccttccactttcctcctcactgccagtacattggcacctccttcttaaaatgagaagagaagcataaacaagacc

SEQ ID NO: 270059 - DNA, 389 bp, Homo sapiens
cccactttggtcaaggccctcttcaacacaagttgggactctcgggacactttcccaacaactttcctgcttgcatggtatctctaattctaatatgatgctctcaggttcccattcccaaagcacactttacagagcaaacaggccctactcagaattcttatgtggttcttcagctctcccaggaaaacgcccctggaatagggtggtagtggtggtgggtaacgcctaaccttcccaaacttaatgttcatgccttccctgtgagctccagctaccacgggcagctgatctttctccaaaagatgctacacataccaccagaaaaccaataccttgacatttaccccatccttcccacgctcttctccagctgagggtctactttc

SEQ ID NO: 270060 - DNA, 437 bp, Homo sapiens
gcccatccggcaggggctgggccgaccacagcttcccggggttgcggccctgcctcctaggcttctgcggagattttgttgttgtttggggttttgtttccttccagaggctccaggcgctgggagttaggaaagaggctgccaagctgagaaagcgacgctcgtcctcacacagcaaaacaaaactaaaagtaaccttgtattgtttacaaagcgcccagtaatatgtaaacagtgaacttgaatctgtcttgctaggcggacgaacgggcaaagcccacattataagtacctgttgtaatgtgaatgtttactcttcatttctggccaggtttagaaagggagggaagtggggatgggaaagttaattgggatgttaactttccgatgacttagagacctttttagctatttattttattgttgggaaaaaaaaa

SEQ ID NO: 270061 - DNA, 312 bp, Homo sapiens
atgataagtcccacagcctggacggcttcaacagctggaatgtattgtcttaaggatctgggggctggaggtccaaggtggaggtgtggcgggttcaggttagtgtcttggaggcctgtctccttggctcataggtgaccgtcttctctctacatgtctgtgtcctaatctcttattataacggcaacagtcacgttggattcgggccactatggcttcattttaactcatttgtgtctttgaaggctctgtctccaaatacagttccgtcctgagctactgggggctgggacctcagcgtatggattcgga

SEQ ID NO: 270062 - DNA, 423 bp, Homo sapiens
ggtaggtatacaagaatctttttttctttgctgttctatttgtattgaaagtgggacagaagatatggcacctatttcattaagattcagaatttcagactggaactggaagaaagtataattgattatgtaatacttattggtgtctacaagaccaaaagtgaaatggacattagttaatcactaggtatttgttgatccttcatttttgttggagaattgctcaagcagaagacgttctctcccttgaaaagtttaccctgtgcagaacaggggccaattctaggaagttgtttttctccccacattatcttgtggtaatccatgatgcttaagtgcatttttataatgttattaatatgagtaaggtttcagtgggcatatattgattactaagcaactaagtgtagaagaatccagaat

SEQ ID NO: 270063 - DNA, 460 bp, Homo sapiens
cgtctgaaatcttgcatttcagaatggatgctttcttaagtcacagcacttaacaatccctggattgttttggccattcaaaaccaaagtgaatggatccaggttttattactctttgaaaggaaacctgtcaagcacaatgcctgctgtgggagccaccttctccaactgacaccgcctgaccccagcttccagctcactccccgctctgtgaaggaagcagctccagcatttgtccctggagggtctctgaaagtccaggtcagcccctgggctggtccccacagtaagaagagaactgtgatgggcaacaccccagaaaagaagacttgcagcctcacttcaggtcaatttgcaagaactgacatcacacagcagcttggtttcttcagaccgtccagcttgctgcgtcttgcccagtcacgtggagctaataaagatacgctgttccacacctctg

SEQ ID NO: 270064 - DNA, 688 bp, Homo sapiens
cttatctgttgtgtgcaccctctttgctgggcacagttagacagccggcttgctacccgaatcaacatgagctaaggagctaggattcactggcttcccattccagctccagttcccattgccctccttacccttccaagtccttaccctccagctgtgccaaatcccctgccttggattcttcatgtccttcaataagtccagacacttgcaccagcagccccttcaacctggagtgtcctcctcatcccttcacttcttctgcagcccattcccagcgttctctgctcattttaaatgacccattttgagcatcacctcccacgagaaggcctctctaatcccttagcatcactatccgcttttgatgtcacagagtcccccaaatgcactgctgtgacagcatgtatcacactgggtcatcagagttaacacacaagcccatttcccccaggtagaccctgcacttttccagggcaggacagtaaatttaccacacaacctcttacatctaaaagaaacgttgttactcattgttgaatgaaagagaatgaatgacaactttcagtacttagatctacagagagaataaaagaattttccctctggtggggagatcttttgggaacgggagaccttcccacagccgtgttgtgatgaaggtatctccttacttcgtcgaagcacg

SEQ ID NO: 270065 - DNA, 242 bp, Homo sapiens
aattacatcccaatatccctgataaacacagactcaaaaatcttcaataaaatactatcaaataaaattcaacagcccattaaaaagttcatatatcctaaccaagtgggatttatccctgggatgcaagtatggttctgtatacacagatcaatcaatgtgatacaccatgtgttttctatttattatcaaaatgaatagaaaaaaacacatgaacacctcaatagatacagaaaaaacat

SEQ ID NO: 270066 - DNA, 828 bp, Homo sapiens
cccttctgttgggcgtttctgcggagaggcgggaggcgctgagagtctgcgcggaggtccgtgcacagactgctttgcctgttgttgctcttcggaggcggcgatccccgaaggcgagctgaaatacggctgcaggctacaatttgcagccgacgattaaggaagacgacgagcgggagaggtggcccaccctcatggagcgcttgtgctcggatggcttcgcatttccccattactacattaaaccgtatcatctgaagaggatccacagagctgtcttacgtggtaatctggagaaactgaagtaccttctgctcacgtattatgacgccaataagagagacaggaaggaaaggactgccctacatttggcctgtgccactggccaaccggaaatggtacatctcctggtgtccagaagatgtgagcttaacctctgcgaccgtgaagacaggacacctctgatcaaggctgtacaactgaggcaggaggcttgtgcaactcttctgctgcaaaatggcgccgatccaaatattacggatgtctttggaaggactgctctgcactacgctgtgtataatgaagatacatccatgatagaaaaacttctttcacatggtacaaatattgaagaatgcagcaagtgtctccctcagaaacaacgagctggagaaggctacaagtgaccgacacaagatcttgtttcaaatatagccacagaacttaacggagggacctatatcttgggaacaaggtgtccttctccagaaaagccacccagttgagaaggctaccaacgaggactggaggaaaggatcctgtttcaaa

SEQ ID NO: 270067 - DNA, 1078 bp, Homo sapiens
cccttctgttgggcgtttctgcggagaggcgggaggcgctgagagtctgcgcggaggtccgtgcacagactgctttgcctgttgttgctcttcggaggcggcgatccccgaaggcgagctgaaatacggctgcaggctacaatttgcagccgacgattaaggaagacgacgagcgggagaggtggcccaccctcatggagcgcttgtgctcggatggcttcgcatttccccattactacattaaaccgtatcatctgaagaggatccacagagctgtcttacgtggtaatctggagaaactgaagtaccttctgctcacgtattatgacgccaataagagagacaggaaggaaaggactgccctacatttggcctgtgccactggccaaccggaaatggtacatctcctggtgtccagaagatgtgagcttaacctctgcgaccgtgaagacaggacacctctgatcaaggctgtacaactgaggcaggaggcttgtgcaactcttctgctgcaaaatggcgccgatccaaatattacggatgtctttggaaggactgctctgcactacgctgtgtataatgaagatacatccatgatagaaaaacttctttcacatggtacaaatattgaagaatgcagcaaggtataggtcaaccaatgttattttcaaactatctgaaatgcatttattttaacattgacacatgtaagggtcaatttttcatatttggaagctcaaacattccttgaatgaaaatattttgaaatgccttaactgtctaagattttactttaaatattggaacttttaaagaagcattatagggaacagccttttttcatgcacttatggtaaataactataaaaacaaatgaattacaataaatttataattcatgacaactgaatttgggaaaggtaatagttaagtgtttttccactaaattactttttttctaatcagtgtgaagtgacacaggaaagtaaaattgtcccttataaataggctttattttaaatgtcaaagaaaattaaagaatttcacaataaatgtacatgttgttgctgttgaaaag

SEQ ID NO: 270068 - DNA, 751 bp, Homo sapiens
cccttctgttgggcgtttctgcggagaggcgggaggcgctgagagtctgcgcggaggtccgtgcacagactgctttgcctgttgttgctcttcggaggcggcgatccccgaaggcgagctgaaatacggctgcaggctacaatttgcagccgacgattaaggaagacgacgagcgggagaggtggcccaccctcatggagcgcttgtgctcggatggcttcgcatttccccattactacattaaaccgtatcatctgaagaggatccacagagctgtcttacgtggtaatctggagaaactgaagtaccttctgctcacgtattatgacgccaataagagagacaggaaggaaaggactgccctacatttggcctgtgccactggccaaccggaaatggtacatctcctggtgtccagaagatgtgagcttaacctctgcgaccgtgaagacaggacacctctgatcaaggctgtacaactgaggcaggaggcttgtgcaactcttctgctgcaaaatggcgccgatccaaatattacggatgtctttggaaggactgctctgcactacgctgtgtataatgaagatacatccatgatagaaaaacttctttcacatggtacaaatattgaagaatgcagcaagaatgaatatcagccactgttacttgctgtgagtcgaagaaaagtgaaaatggtggaatttttattaaagaaaaaagcaaatgtaaatgccattgattatcttggcag

SEQ ID NO: 270069 - DNA, 405 bp, Homo sapiens
cttatgtttagaaagggttccttattcaatccatggtactgggagaactggcaggacgtgtgcagaaactggacccctttcttccaccatatgccaaaattaattcaagatgcattgaagactttaaaacccaaaactataaaaatcccagaagaaaacctaggcagtaccattctggacatgggaactggcaaagatttcatgacagagacaccaaaagcaatggcaacaaaagcaaaaattgacaaatgggatttaattaaactaaggagcttctgcacaacaaaagaaactagcatcagagcaaacaggcaacctacagaatgggagaaaatttttgcaaattatgcatcccacaaaggtctaatatctggcatctatgaggaatttaaacacatttgtaag

SEQ ID NO: 270070 - DNA, 406 bp, Homo sapiens
  misc_feature (14)..(15): n is a, c, g, or t
ctggccaaggtttnnattattgtaattcctgtggcagaagaggatcagagctgtgaataagtcataagtccctatagatgaggtcatacagctaaggtgatgaggccaatattcaaactcaagcatctggattgcaggctgcacttttgatcgccatgtctagcctcctctatacacctgctctgaccgatttggtattcaccacgcccaagaggctactgaacacctgaaatatggctggctggagttgtgatgtactctaagtataaactacacaccctatttggaagacagtatgcaaaaaagaatataaaaagtctctttggcaattctttatatcaattacatgttgaaatgataatttggatatattgggattaaaaattattaaatttaatttcactat

SEQ ID NO: 270071 - DNA, 452 bp, Homo sapiens
gctaacatttattaagcacaatatttgccagaattcttgcaaaaagccttacaaggactattttattttatcctcataccaacggcttaaggatggtattacttaagtattcttgttttacagatgaggtcatacagctaaggtgatgaggccaatattcaaactcaagcatctggattgcaggctgcacttttgatcgccatgtctagcctcctctatacacctgctctgaccgatttggtattcaccacgcccaagaggctactgaacacctgaaatatggctggctggagttgtgatgtactctaagtataaactacacaccctatttggaagacagtatgcaaaaaagaatataaaaagtctctttggcaattctttatatcaattacatgttgaaatgataatttggatatattgggattaaaaattattaaatttaatttcactat

SEQ ID NO: 270072 - DNA, 493 bp, Homo sapiens
ttttctggtttggggtttttttttttatttgtttgtttaagtctcgtttctgacactttctgaaagatgcaacatggagataggccaggagggaaactagttttagggtgttctcattacattcattttatgtcattttttattattaggtttacattattgtaattcctgtggcagaagaggatcagagctgtgaataagtcataagtccctataggtaaaatcaagtactatttgtctctgatcaaaattgccctttccattgataggagaaatgactgggcctccttgtcatccagagttcattttgtttttcgtggcagtttcactgtctttgggaattgagctttttgaaatgttaaagcacgagaagcatgaacaccttggcagggtttgcagtatctccttctagtgcaggatggagggctccagagctggcaatttgaggaatggctggtggcttctgatgtcacctgccactcatgtgtccctc

SEQ ID NO: 270073 - DNA, 330 bp, Homo sapiens
attgaagtgattctcctgcctcagcctcccgagtagctgtgattacaggcgtccgccaccacgcctggctaatttttgtatttttagtagagatggggttttaccgtgttggccaggctggtcttgaactcccacccttcagtgatccgcccacctcggcttcccaaagtgctgggattacaggactgagcttctgtgcctggactgaactagtaacttttacacccaggaattccaaagcagtttaaaaatactttgcttagcccccaggcagaggcttaacctccaggtggaggctccatgaaggagcctgtagggcttgtggctttt

SEQ ID NO: 270074 - DNA, 1153 bp, Homo sapiens
gtatcacctcccacttcttgctcttcctcctactccagctatgcaggatgtgcctgcttccccttctctttctgccatgattgtaagtttcctgaggcctccccagtgatgcttcttgtacagcctgtggaacttgccttgaacagtacctgccactcaataggatgtctgatttgaaagtgatcttggcttgggaaaagtccatcaggtgtgacacaaggctcaaggaaagtatgagaaaaggtgactattctccatcttcttgggtgtccagagagtgttggagtggctccagcatagctacaagggcaggctcggaggtggtatctgcccccaaaaatcatttctgtgttgcatgagcatcatttgagaagacctgctgcatcatccctatcaataaggctgtctccatttattgaagctcagataccattgcttcaaggtgcgagctggtataactgaaagcaaagaagacattgctaagttgaacattttaactagttttaaaaaaattgttaaaacagcattgcagaaacaatagtctggtaagcaaggctttcatttgcaagaactttacaagagaaaaaggatatgcatgacttaaatagcccaaacttgaagtacagagtctttagtataagccagtacttctgaaggtatactctgtggacctctggatactggcatcaaatgccctcgtagtcattgtattcttcatcaccaaggaattacgttttttttaaaaaaatagcttcagaatgtccttgctgaagcagtaaaaaattaattttattaaattttgatccttgagcgcacatatttttcaatattctgcgtggtgaaatgggaaatatatagagagcacttctgctatgtacaaaagttccgtagttgaacaactgtatggcaataaactaggtaacttagataaaatgaaaaatttctagaaagacccaaactacctgaactgattcaagaaagaccaaaaaatccgaatagacttataacatgtaaagcgattcaaattgtaataccaacattcccatgaaggaaagcccaggaccaggtgacttcactggtaaatgctgtcaaatatttatgtaattaataccaattattcacaaactcctccaataaataaagatcagagaac

SEQ ID NO: 270075 - DNA, 1083 bp, Homo sapiens
ttgtattgaatcttcaggtgactattctccatcttcttgggtgtccagagagtgttggagtggctccagcatagctacaagggcaggctcggaggtggtatctgcccccaaaaatcatttctgtgttgcatgagcatcatttgagaagacctgctgcatcatccctatcaataaggcttagagacgggttttcaccgtgttagccaggatggtctcgatctcctgacctcgtgatctgcccagtcggcctcccaaagtgctgggattacaggcgtgagccaccgcacctggccactcttgcgtatcttaagatgacacaccatccatcagaaacgtctccatttattgaagctcagataccattgcttcaaggtgcgagctggtataactgaaagcaaagaagacattgctaagttgaacattttaactagttttaaaaaaattgttaaaacagcattgcagaaacaatagtctggtaagcaaggctttcatttgcaagaactttacaagagaaaaaggatatgcatgacttaaatagcccaaacttgaagtacagagtctttagtataagccagtacttctgaaggtatactctgtggacctctggatactggcatcaaatgccctcgtagtcattgtattcttcatcaccaaggaattacgttttttttaaaaaaatagcttcagaatgtccttgctgaagcagtaaaaaattaattttattaaattttgatccttgagcgcacatatttttcaatattctgcgtggtgaaatgggaaatatatagagagcacttctgctatgtacaaaagttccgtagttgaacaactgtatggcaataaactaggtaacttagataaaatgaaaaatttctagaaagacccaaactacctgaactgattcaagaaagaccaaaaaatccgaatagacttataacatgtaaagcgattcaaattgtaataccaacattcccatgaaggaaagcccaggaccaggtgacttcactggtaaatgctgtcaaatatttatgtaattaataccaattattcacaaactcctccaataaataaagatcagagaac

SEQ ID NO: 270076 - DNA, 547 bp, Homo sapiens
gtatcacctcccacttcttgctcttcctcctactccagctatgcaggatgtgcctgcttccccttctctttctgccatgattgtaagtttcctgaggcctccccagtgatgcttcttgtacagcctgtggaacttgccttgaacagtacctgccactcaataggatgtctgatttgaaagtgatcttggcttgggaaaagtccatcaggtgtgacacaaggctcaaggaaagtatgagaaaaggtgactattctccatcttcttgggtgtccagagagtgttggagtggctccagcatagctacaagggcaggctcggaggtggtatctgcccccaaaaatcatttctgtgttgcatgagcatcatttgagaagacctgctgcatcatccctatcaataaggctgtaagcacctgatttcctgtatcatgtcttttctagcttaaaatatagtgctttttccttctcagaatcttgactaaaaaaacagaaaggaaaggtgagaaaaagaaaaaaatggaataaagatgtctatgtcacaacaggaa

SEQ ID NO: 270077 - DNA, 491 bp, Homo sapiens
  misc_feature (176)..(176): n is a, c, g, or t
  misc_feature (203)..(203): n is a, c, g, or t
  misc_feature (221)..(221): n is a, c, g, or t
  misc_feature (238)..(238): n is a, c, g, or t
tgctcctttgtctgcttaacatctgccttcccctccccctccttcttcccaccacatgcctggggtatcccccacccaaacaaaaataaaaacacaactgtcaatgaaataagcagttctttccttccttgcacttgctctggacaggacctcaccaccctcccttcaggaagcanggtgggggaggaggggaggagtaggangtggagaggtggtattcntttcccccaggggaagngggctctgtttcttttttcttttctttttttttgagacggagtcttgctctgtcgcccaggctggagtgctgtggcgccatctcggctcactgcaagctccgcctcccgggttcacgccattctcctgcctcagcctcctgagtagctgggattacaggcgcccgccaccacgcccggctaatttttgtatttttagtggagatggggtttcactgtgttagccaggatggtctcgatctcctgacctcgtga

SEQ ID NO: 270078 - DNA, 439 bp, Homo sapiens
acctgaggactcagcctagcaagctcttgtgatagactttgaatagcagtatctgcgaagaacctgaggcctcagcctagcaaactcttctgatagactttgaataggaatgtctgggaagaacctgaggactcagcctagcaaactcttctgatagactttgaataggagtatctgggaagaacctgaggactcagcctagcaaactcttctgatagactttgaataggaatgtctgggaagaacctgaggactcagcctagcaaactcttctgatagactttgaataggagtatctgggaagaacctgaggactcagcctagcaaactcttctgatagactttgcactgcagatgcttcatttaaggctatagagtagatgttggcaatatataaaattcaaacttgagtgtccataaataactgttgttggaacat

SEQ ID NO: 270079 - DNA, 438 bp, Homo sapiens
atactcctataattttaaactaatataggtagtttctctccttaaatttttcatgttcaagacaaagatgctataaataaaagttgtagaagtatagtatcttatttaaaagtaatgatgagcctcttaaatgattccaaggccatttaattttgacattacattgtatttatgttgatggtttgagtgatcatttgatataaatttgttctgagaatcaataaaggaaatagaggaactaattattcaaacttaatagtatcattgcaaattatagtatgtacaaaattcttatttacctcttaatagtctgcttattttttctacaataaatgatgcggtaaaggaaaactataatcaattcactggataacatgaactcttctcttctttacagagtattttggggagaataaaatctacttaaaatatataatt

SEQ ID NO: 270080 - DNA, 788 bp, Homo sapiens
agttgattaggtcgacggtgcagtggctcacacctgtaatcccagctctttgggaggccaaggcatggatcacctgaggtcaggagttcaagaccagcctggccagcgtggcaaaaccccgtctctacaaaaaatataaaaatgagtcggttgtggcattgtgtgtctgtaatcctagctactcgggaggctgaggcaggagaatcgcttgaacccgggaggcggaggttgcagttaactgagattgcaccactgcactccagcctgggtgacagaatgagattccatctcaggaaattaaaaaaaaaaaaaaaaccagttgattaattagcatgaaccagaaatcacctctacagtcctggacatacaggtcaccttgccaccttcctgatggctggttctagattcagtgtggacgagagatagtgacagaggtgacctgcttgggcctagacacacccacccaggcaccacatgaattcaactgaatgtaattccaagagctcctggagaggcaaggcaggcggccaccagcaccgccctgggcggacggaactgccattagaaatatcctaaattggctgggcgcggtggctcatgcctgtaatcccagcactttgggaggccgaggcaggcagatcatctgaggtcaggagttcgataccagcctggccaacatgtgaaaccccatctctactcaaaacacaaaaattagccaggcatggtgggcacctgtaattccagctactcaggaggctgaggcaggagaatcgcttgaacccaggagg

SEQ ID NO: 270081 - DNA, 489 bp, Homo sapiens
tgatttaggggctggcatgataattgctaagtaaagatgtgctttctgtgataatctctttctgggttacatgggcgacacttggtagcacttgaacagacttgggccttcacaaagtgaaatttgagaccatttcagccttctgtagttgccttggctagcatttttgctagctggttagtaagacatttccaagtgcagttattttgagctcccagattattttagaatttgaaccaattgcaattttaaatagtacattatgtttagagttcccttgaggtgtatgtgattgccgttactcccagaattactgtcatattgaattttatctttttttattgcataatggagtattccagttttatatttcatcatattttctgatggactgaaagtttgtataaatgtgttatccataatgctaaaagcccaataaaagaagatgtgtgccattcatagcatacagtactcgtgtgtaaaaatgca

SEQ ID NO: 270082 - DNA, 431 bp, Homo sapiens
tggtcacagctcccaggggtggagagtgtgcagttcctggtggggcaggccattctgttctctccaccatctgctgatgctggagttaggcttgcacagttggggacatttaagggattgtcagagttgcaagaaaataagaacctcaaatggattgaatccacaggatctggggtaccagctgacttgcctggtcaagatggcaggagaacctagtctgtgtgcgagctggggctggcagcaagtttctgaacaagtagcacatggcatggggctaattcaaggtctgtgctattctaggacagcagattggcctagggtctaaatagaaaagaaagctttgtctcagaaagtctggagagccctacaggacgctgcatgtccttttcctgggtctggtgggaaaaacagggcagttgagtcttgcaaag

SEQ ID NO: 270083 - DNA, 421 bp, Homo sapiens
ggggagggaagagagtgaaaggcagaagcccaggactggctaggggtggggtgggctgcacagcattcggggagaaagggacggtgtgaggctgaaataggaactcactgacaatgtgaaatgcctggcactgggtctgtttgttcatataggcaccccgtaaaggtagggctctgcccacatctcatggtttaaaaccttatcaaaggggaagtttttcaaattacaaatgtgtggtcttattatgtaaaatactaagtattacttattcacaatactgatatgtataaaagttaaattctggccgggtgcggtggctcatgcctgtaatcccagcactttgggaggccaaggtgggtggattatatgaggtcaggagttcgaaaccacctggccaacatagtgaaaccccgtccctgcc

SEQ ID NO: 270084 - DNA, 471 bp, Homo sapiens
aaatgagtgtttttccaaacctcagtttgcccatctgttaaacagggattatagtacttgtctcacaaagtttctgtgagaattaaacaaggggatgtatcccaagcgctcagcatgtcgtgcacaccctgaacatggctgctggtattagagttttttctttgactgaatttggaaggaatgtctacatctgtttgctaatcgaggtcccatggtgacacggctgactttaagattcttttaacaccgggattctgccatcctattaaggatatacagaagcaaaaaagctgttagcacatgtccagcctctgagtcaaggagcagagaaatgtgagttggttgttgaagaaatgcaaagactgaatttgcttcatgaccccattttttggtttatcatttgagcagactgagactttccattaattttaaaaagtcatgaccaaaataaaaataaaattattcatgaaa

SEQ ID NO: 270085 - DNA, 433 bp, Homo sapiens
tttgcttttcagtgtgtaagctggtcagcttacagcagtacaaattggcagcgtggcaagaaagaaaactgaaattcaatccaacactgggattggaagctcttgagactcaaatgtcaccaacaccgggggcttctcctctaattatcctgtcaaacgagggttgaaaatgtcagcacagacttcagtctcagctcctccagcaaccaatgagagtgggcttgggtctggtttaaatgatgaagaacaaatttgaaaaacccttcagttgatttcaagacttcctgggacggcgatgtttaaaccacaatgttcttcttttggggcaaagttaagagccaatcacagttaaggtttctctgcatgttctgcccatatttggctgtaatcttgcttcatccaactaaatttataatatatgtgagtgaaaagc

SEQ ID NO: 270086 - DNA, 637 bp, Homo sapiens
tgaggtcacccaggaaagagtatgtgaggagagaaagggagcaagccctagcccccaccagcaaccagaggttgctcatttcagaagcagaggccctaactcagccccaaggggaagcctacatttctgtagactcgtatttgatggctatagcatatgcttgctaaccactgctcttctagggatccctggagaagcaggcaagtaagagcggggagtggagaagcccccataacctgtggggaaagaaaggagaggcttccagtgccaacatcagaaggcctctgacctctttgacttgcagctgtagccgtttggctccctctcctcaccccctaaagctgggtcggagacagccttgtccccagagtccccagcggctctttagcatgatgctgcattttgaatgcggttaccacagccccaagtgactgagccagctcacgtgctacctcttgtgtgggtaccagtgtatgcacacacagggcttggagccaggaacggaaagaaagtgctcactgcaataatgccacaggagccccacgagggtgggcactggatggcatcacaacccaggcccaggacactcccctcgctccagactagaggagacacagatgtctctctgccctgccct

SEQ ID NO: 270087 - DNA, 382 bp, Homo sapiens
gtgagagggataagaggctttatctagtctttttttgcatatgaatgttcagttgttttggcaccttctgtcagaaaggctgtcttttctccatggtattgcttttgttcctttgtcagatatcagttggctctatttgtatgagtctgggccctctattctgttccattgatctatttttctattcttttactaacaccacaccatcttgattactgtagctttatagtagccttccaactttgttcttttctttccatttttttttttttttggctattctgggtctttaggctctccacataaactttagaatcaggttttttgtttgtttgtttgtttgtttgtttgttgtttttgagacaagatctcactatgttgt

SEQ ID NO: 270088 - DNA, 207 bp, Homo sapiens
tgaaggactatacaaccaaaggatttgttttcttcaaagtgatcacatggaggcgcagtccaatgatgtcaaccttgctgagatgtttgaaatttcttttacaagtttccatgagaacctttgaagaaagccttctccaactatcctcaatgatggaaatgtactcattctttaaggatgggtttgattctgggagcaatctaaaat

SEQ ID NO: 270089 - DNA, 483 bp, Homo sapiens
gactatactcaaaattgctttaaaagttttttgtgaagactatgataacattattcctgtcaggaatttttaaaaattatgtacaattcatgacactgcagcctaaaatcgttctgtaatttcatgtagccttgaagattaagttctcagaagatgcttcttaatctgatccctgttgtctctccaacttcatcaccatccattccctaccacatactgtatgctctattcatgctgaaatgaagactatatttgtagtttcattactatatgtggtttgccaaatctctttgtctttgcacttgtgtttccttttacttaatagcactctccatccctcctcaccctcacgtcccacctccatccatttagctaaataaccagttacatagatgagttaatctaaacattccttctgggtagatccaccctatttaaccttgggcacattactgaacttttctgagctttggtttcttgatt

SEQ ID NO: 270090 - DNA, 400 bp, Homo sapiens
  misc_feature (399)..(399): n is a, c, g, or t
tcagctcctcccattaataggtggagtttcttttcctactactgggatctggactagtcttgtgacttgccttggctaatggaatgctacagaaacaatacctgccagtttcaagcctgaacttcaagagccttgcacatgtcccctagctctttcgtaaacttgatgagtgacaatgtacacagcctgctagagatcagaaacaacatggaagagtgccaagacactttagccaacaacgagccattcctagtcaacccagaaactgatcacagtcatgtaaattagcccagctgagaccagaagaaccacccagctcagcctagcccacattactgacccacagaatcatgaattaaataaatggttattattttgggtgaagtgaggaaaaagaana

SEQ ID NO: 270091 - DNA, 416 bp, Homo sapiens
tgaaaactttataaaaatatcctctcaaatgaaatggacaattataacagaaggaaaaattatggtgaggacttcaaaatccaggggtacggcagactaagataccgtaaatgacacacttatgataaaatttttttttgtggctaagacagggtcttgctctgttgcccaggctggagtgcagtggtgtggtctcagctcactgcaacctccgcctcctgggatcaagtgatcctcctacctcagcctccaaagtagctgggactacaggcatgtgacaccatgcctggctaatttttgtaaattttggtagccacagggtttcaccatgttgtccgggatggtctcgaacttctgagctcaagcaatccacctgcctcaaagctttgggattactggcgtgagccactgtgccc

SEQ ID NO: 270092 - DNA, 411 bp, Homo sapiens
gagataattgctttggtgacttcccgtaacctaaagcaacaagaaagtgacatagctgagaatagagtttagttctttgacttccaattcatgtttcctacaaagcataacttaacaatttggaaagaaattccatatgaattaaacatctttctttgaattgaaataagtttattttcaacatcaacaccttcactacagggtattctgtgaactgaaaagaaaggctctgtgctgaaactgtgtctcgctaacacttcagctgacatattaacttcttgttgaagagctatttaatttgaatagaatctgagccgttacagtggtaggaagattttatgtaacctcatttttctattgatgaaaactccactacctttaagatctaaaaagataagacatctgccatta

SEQ ID NO: 270093 - DNA, 322 bp, Homo sapiens
tcacttcaaaacaggcaaaatttataatagagtcaaatcaggactgaatgcatcaacaaaaactggagttcagcttatcaaatacagatcaaaagcaagaaatagactagagagcacacgggatatttcttccttaaatttctctattttttattgacactggaggaaaaaatagcacattaaaacctccttgctgaattactgtcctaaaccaatagatccgtggggcttgttcagctaaaagccacaacagactttgtaatgcaatgatgtaatcttggcatcttggctttgtgtcatttatattcaacctaaaaaaaaa

SEQ ID NO: 270094 - DNA, 409 bp, Homo sapiens
agaaatttattatgtaatgctatagtaaataagatttttttctctattttatcagatagtttgttttaagtgtatgaaactgtagctgggcgcagtttaagtgtatggaaccatagctgggggtggtctcccaaagtactagatcacgcctgtaatcctagcactttgggagaccaaagtgcatggatcacctgagatcaggagttcgagaccagcctgaccaacatagagaaaccctgtctctgctgaaattacaaaaattcactgggcatggtggcgcatgcctgtaatcccagcaactcgttaggctgagatgggagaatcgcttaaacctggaaggcagaggtttcagtgagccgagatcaccccattgcacttcaggctgggcaaaagagctagactcctactc

SEQ ID NO: 270095 - DNA, 335 bp, Homo sapiens
tgaatttgccttggggagaagactacgtaactgaaaaccagcatccaggccctcaagaagaaatataatctccaacagtctccttttcaatttctgtcaaatgtctggcttctcttgaagggatgttcacgagaagggacagccgccctcctccgagcctcctgtttcagctgatgcaccttcaagtacaaggtcctgttcttgggctctgttaaagtttccctcaagaaaaaaaccttacatttgccaatgcacttgatgtaaagttgttgaggatgttgactctcctttaaacatttattgaagctaggaataaacttaactggacctgtgta

SEQ ID NO: 270096 - DNA, 477 bp, Homo sapiens
tatactaaaaattatttatctgaaattcagatttaactagtgtcctgtattatttgtaaccctgtattatctggcaactctgtgatggggacccaacagctgggtgcagtttaaggtttagcatcaaatgttagcttagaaggaagatgagggccaaggcagtgagtttaggactgacacagcagatggccccagtatatcctgcttctgggtttgaatccaaactccaccacttaataaccatgtgaacttgagcaagttcctgaattttatttaacttatctttgttttggtttcttcttctctaaaatgggaataataataattatagcaataacttccctcaaagtgttgttaaaaagatgagttatttgtgaagtgcttaaaacagtagctcggttagttattatttttgttattccaataacatctaaaaataatgttattccaacaataaattcctgatatccccacccc

SEQ ID NO: 270097 - DNA, 495 bp, Homo sapiens
tgatgattttaatcaagagtaaagggaacatttattacatgaaatctgacttcagttgtgcaaaggtatgttaagacattaagacaattgctggaaggtttcaaatatgtgtacacacacatagagctacttttgtgtgtttatttatatgtatatttcacaaaggctaatgcccacagaggaaaatgattattttaacttctgggttatcatctgctggcagggtctgatcaggtctagagtatttaaggaaaagtctcctgtcttctatctccactagaagtactgcagcttgagagctgaaaggaacttgaaaaatgttatccagtcttcacttagcccatttttatcggcattaggaaatagggttcagcaatggttattgatttagcagtctggtcttatatgatctgctttctaattatctatctagtattcctatattatactggaacttcaataaattataacctatgtgaatatcataaaaaaatg

SEQ ID NO: 270098 - DNA, 446 bp, Homo sapiens
atctgagaagcagttttgtctagtgtcgtttcagtaaatgggactcatttagtcagtttgctttgctgtcagaatcatattccagatatcagaatgtgctatggcaggtacttgtttaaaacaagtaataatatccttgtaatgtttagcaatacagctgactggtctgtgttccattacttgtgtaaaaggaaatatgtaaagcttttaaaaataagtttaaatgatcaaaagagatgcctgaaaatatattttggcacaggaaattacaggaatttataaatgtgtcatgtggaaagataattacaaagtttattttaatcttttatctctgactgaatcttaagttaaaatattcttcccggcatcctgtctggtttttgccactgtccctgctttacgtgttacctttccatgttgatctgagttgcatttagttgaggaga

SEQ ID NO: 270099 - DNA, 1391 bp, Homo sapiens
atgatttggggtcctctgagactccctatgaactttaggatgtgtttttctatttctgcaaaaactgtcattggggttttgatggggttgcattgaatctgcagatcactctgggtggtattgtcatcttaaaaatattgaatccatcaggctgggcgctggggctcacgcctgtaatcccagtactttaggaggctgaggcaggtggatcacctgaggtcaggagtttgagaccatcctggccaacatggagaaaccccgtctctacaaaaatacaaaaattagccagccgtgatggcgggcaccggtagtcctagctactggggagactgaggcgggaaaatcggttgaacccagtggtggagattgtagtgagccaagatcgtgccactgcaatccagcctggcgacaatgctagactccgtctcaaaaaaaaaaaaagtggcgtatggatgtctcatgtcagctttatgtagtgggtggcactgtttgtgcgtggataattgtggtgtcttggcacattgacccttttatcaatgtataacatctttgtctcttaaaatagtttcagccacttcagctctcttttgcctgtttatatgaatacttttccataccttcactttcaacctgtttatgtctttaaatctgaagttagtctttcaggccgggcatagtggctcacgcctgtaatcccagcacttgggaggccaaggtggacggatcacttcaggtccacagttgcagaccagcctggccaacacagtgaaaccccgcctctgctgaagatacaaaaattagctgggcgtggtggcgggcacgtgggatcccggctgctcgggaggctggggcaggggaatcacttgaacccaggaggcggaggttgcagtgagccgagatcgcgccactgcatttcaccttgggtgacagagtgagactgtctccaaaagaaaaaaaagaatctaatgcctgatgagctgaggtggaacagtttcatccccaaaccacccatccccacccccggctggtagaaaaactgccttccatgaaaccagtccctggtgccaaaaagattggggaccactggtttaagtcctgtagctttacagaccatagctagaaaggcaactggtattaattcaccctgcacgaggacctccgtctgcctccgctgagctgctgtctgctcacttccccgggtggcacaccggcctgcatgtaaccaactcctgaagcttttatctgggaatgtcctcttttttggggggtggggaagacagggtcttgctctgtcacgcaggggaatcacttgaacccaggaggcggaggttgcagtgagccgggatcgcgccactgcatttcaccttgggtgacagagtgagactgtctcc

SEQ ID NO: 270100 - DNA, 1221 bp, Homo sapiens
ctgcctcggcctcccgaagtgctgggattcccggcttctctgcccatttttaacttgagtttattgttgggctgtagttctgtgttctggatgtgagtctcttacatacgtggtttgccagtgtttattttctcccattctgtgggttgtcttttcactcccttgatgggtttgtttttttttccatatagagtctaactctgtagcccagatcgtgccactgcaatccagcctggcgacaatgctagactccgtctcaaaaaaaaaaaaagtggcgtatggatgtctcatgtcagctttatgtagtgggtggcactgtttgtgcgtggataattgtggtgtcttggcacattgacccttttatcaatgtataacatctttgtctcttaaaatagtttcagccacttcagctctcttttgcctgtttatatgaatacttttccataccttcactttcaacctgtttatgtctttaaatctgaagttagtctttcaggccgggcatagtggctcacgcctgtaatcccagcacttgggaggccaaggtggacggatcacttcaggtccacagttgcagaccagcctggccaacacagtgaaaccccgcctctgctgaagatacaaaaattagctgggcgtggtggcgggcacgtgggatcccggctgctcgggaggctggggcaggggaatcacttgaacccaggaggcggaggttgcagtgagccgagatcgcgccactgcatttcaccttgggtgacagagtgagactgtctccaaaagaaaaaaaagaatctaatgcctgatgagctgaggtggaacagtttcatccccaaaccacccatccccacccccggctggtagaaaaactgccttccatgaaaccagtccctggtgccaaaaagattggggaccactggtttaagtcctgtagctttacagaccatagctagaaaggcaactggtattaattcaccctgcacgaggacctccgtctgcctccgctgagctgctgtctgctcacttccccgggtggcacaccggcctgcatgtaaccaactcctgaagcttttatctgggaatgtcctcttttttggggggtggggaagacagggtcttgctctgtcacgcaggggaatcacttgaacccaggaggcggaggttgcagtgagccgggatcgcgccactgcatttcaccttgggtgacagagtgagactgtctcc

SEQ ID NO: 270101 - DNA, 306 bp, Homo sapiens
tggtgccaaaaagattggggaccactggtttaagtcctgtagctttacagaccatagctagaaaggcaactggtattaattcaccctgcacgaggacctccgtctgcctccgctgagctgctgtctgctcacttccccgggtggcacaccggcctgcatgtaaccaactcctgaagcttttatctgggaatgtcctcttttttggggggtggggaagacagggtcttgctctgtcacgcaggctggagtgcagtggtacgatctcagctcactgcactctccacctcctgggttcaagagattctc

SEQ ID NO: 270102 - DNA, 405 bp, Homo sapiens
acttatttatattattcgatttattcaacattctcaaaatgataaaattatggagatggagaacatattagtggtttcctggggttgtagagaggaaagggagtgggtataactgtaaaaaggggtagcataagggatctttgtggcaatagaacagttctgtttcttgactgtggtagtgttaacacaaacctacacatatgataaaattgcatagaactaccacatacactcacatgcacaaatgaatgcatgtaaaactggtaaaatctcaatttctttatataagatgatataagattttattatgtaagatgttactattgggagaaactgggggaggggtgtacaggatctgtctctactaattttcatgacttcctatgaatctataattatttcaaa

SEQ ID NO: 270103 - DNA, 415 bp, Homo sapiens
gtaagacacttagtagaacagctggtgctctgtgggtgctagtttctttccctcctcaagaatgttgtcggttaaagtatctactataataattttgtgagtgccaaagaaacactattaaaagttgaaaatctcgtgaaaataagaatgggatagcagaaaagtctcagactctggagctagaaggcagaagttagatataactgcctgtttccagttgtgcctcatgtaaatgcaggtgacaaaattcattttattagctggttgtgagagttaagtgttagagacaggaaatagaattggcttagttttctaagcttcagacaaaaagtaagccaaacatttacaatagtgtttagtatacttctcttttataataacttttattgataaaaaaatttttgtaaactgcaaa

SEQ ID NO: 270104 - DNA, 351 bp, Homo sapiens
caaaggagtctcttcttttccctctgctccaggttccctaacatgccagggcagaaattcctgggtccagccaggcacggtggctcacgcttgtaatcccagtaacttgggaggccgaggcgggtggatcacctgaggtcaggagttcgacatcagcctggccaatatggcgaaaccccatctctagtacaaatacaaaaattagctgggcgtggtggtgcatgcctgtaatcccagctacttgggaggctgagtcaggagaatcacttgcacccgggaggcggaggtggcagtgagccgaggttgtgccactgcactccagcctgggtgacagagcaagaccctgtctca

SEQ ID NO: 270105 - DNA, 1292 bp, Homo sapiens
cgacctgccaaagtgctgggattataggtgtgaggcaccatgcccaacatataacaataaattatatcactatataaaataaattcctcacagcaaaaaaccaccataagcatagtctaaagaaaaatgacaaatttggaaaaaatattttcaaatcatatcatgcattgcttaatttataaagaacacctagaaatgaaaaagtccaatgatccaaaaagaaaaaggtacaaaattgtaaacagttttcacagaaaagaataaaatgattcaagccggaaaaaaagttcaactttattactaagagaagtataagacaaaactatactgagataccagttttttaacctattaatcaagaaagactttttagttttataaaacattgtaatattctagatattattggtaagaatggagggaacaagtatttttgctgatagaggggtaaactggaacaaccgctaaggatgacagtgaattctgaatttatttacccaatgtactcttcaagttgcagaggctgagaaattattaaactgttacccagaactttttatgcagatgggggggcagtctgaatgctaattaagttttctcaactatatgctctctcctcatgatttgaaaggcaaaagtgaagcagaggccaagttttgaagttcttgaatgttacgaggtagtgaaaaacgtttccatgcagcagtgatcaagtgtctatcgttcagcttcctgaatatggataggctgtggtggtggcagcagcttcttaatctgacattccaacccctagattgtggtgttacatcttctttctccagcttcccaggagtgaaaggttgtagtggctggcctctggttcccagcagggctccatggtgaccagaggttgtagttcccccagtgaatcatgtttgtgtcactgtgggattcattcccataggctcaacttagattcctaaaccctgctccttcaacccttccagtaactttataagcaccaaattccatttaaaaagtgccttcctgtttaaaatatctataatggcttctgtttcctgcattgaaagctgactgatctggagggcaattgggcaacagcaatcaaaattgtcttttcttttgacctagcagtttcacttcttggaatatatcctgtaaatatgcttatgtatgaaggaaatgagtttgtacaacgtttttcaatgcagtattgtttgtaaattgacaccagtaggggaatagtaaaatcaattactatgcatgcatataataaaattttaggtagctat

SEQ ID NO: 270106 - DNA, 391 bp, Homo sapiens
  misc_feature (390)..(391): n is a, c, g, or t
ttgcttgaggccaggagtttcagggtgccgtgagccacagtcacactgttgcactgtggcctgggcaacagagcaagacctacctctaaaaaagaaaggaatgaaagaaagaaagaaggaaagaaaaaaaaaaaaaaaagcggccgctcgaattcgcggccgcgttcgacacggctgcgagaagacgacagaaggggcggagagcttgctgtagcagacctgcagaggcttgcttgtggggttaacgaggccctcctgtctcctcctctttcccaccacgccacttcaccaggttctattcctggccatttcaggctcaagtcatccctggagggagtgggatctgggcagaatcacattctgctgtcacctcagcatcttgtagagaann

SEQ ID NO: 270107 - DNA, 481 bp, Homo sapiens
agaattaaaaattaacctgcacaatgtatttagactttaacctatctccatagtcatagttaataaatttcctcatgatattataggtttgtacctaaatcaaccggtagagaaagttattctcaataataatataagctaaatgtacattcataaattaggttcttacctttcatagagagtgacggcaagataaaacaattcatttattttttgttttatttttctcattcatttactttgaagtatttatttggtttgctttctttcatttgattctgtaggcattttagaataggaatgaaaaaagggtcgcgatgccaatagagcataggatcagcaacaaataagccaaagagagatgaggtggaaagacaaccagtatttttcgacaacattccattgggctttgcttgtcaagtgaaatgaatgcccgttgatgaggaagctgctgcctcatcaggagttccgctattcctgg

SEQ ID NO: 270108 - DNA, 535 bp, Homo sapiens
agaattaaaaattaacctgcacaatgtatttagactttaacctatctccatagtcatagttaataaatttcctcatgatattataggtttgtacctaaatcaaccggtagagaaagttattctcaataataatataagctaaatgtacattcataaattaggttcttacctttcatagagagtgacggcaagataaaacaattcatttattttttgttttatttttctcattcatttactttgaagtatttatttggtttgctttctttcatttgattctgtaggcattttagaataggaatgaaaaaagggtcgcgatgccaaaattgaatgttaatttaagcatgaaaggacaagtgagattcatataaggggaactagagcataggatcagcaacaaataagccaaagagagatgaggtggaaagacaaccagtatttttcgacaacattccattgggctttgcttgtcaagtgaaatgaatgcccgttgatgaggaagctgctgcctcatcaggagttccgctattcctgg

SEQ ID NO: 270109 - DNA, 414 bp, Homo sapiens
ccatttcgtagataagttttctaaaaaggccgaattcagagctagttctcggcaggggagaggtcgcgccccgggttcgtgcacgatgccactagcatctctcccctcactgcactgatgccatgaagccttagaggccagacggcccaggaaccctgttgacagtggccaaaccttaaacacgtacaactgcttattgttttcaaaagtgtgtctacttcgacaaacctcattctagtctcacattcctgatgggaggtaggtaggactgggatcattaaaaccagtggacaccttttctgagccaaagaagcaaaaagaatctattgagcaaaagcaaattacaaggagagttctcaccatccctcatttccaaacccagccaaaaatcctattgctttcagtgattcaaaa

SEQ ID NO: 270110 - DNA, 577 bp, Homo sapiens
tcaagagcgtctcccactccttcaggatggagacaaaaacccaactggtggccaagagtggtggcttacgcctggaatcccagcacattgggaggccaaagcaggaggatcacttgaggccaggagtttgagacgagcctgggcaacatagcaagaccctcgtctctattaaaaatataagaaatatgccagacacggtggctcatgcctgtaatcccagcactttagaaggctgaagcaggtggatcgcttgagaccaggagttggagaccagcctggtcaacacggagaaaccccatctctactaaaaatacaaaaatcagcctggtgcgatggcacacctgttaggcctagctactcaggaggctgaagcataagaattgtgtgaacccaggaggcggaggttgcagtgagttgagattgggccactccattccagcctgagaggcggagcaagactctgtctcaataaacaaacaaacaaacaaactgtccaggtgtggtggcacagccctgtagtcggagctaataaagaagctgaggtgggaggatcgcttgagcccaggatatggaggct

SEQ ID NO: 270111 - DNA, 292 bp, Homo sapiens
tgccccctctcttagagccttccactctggcccccacaatgccttacagagcaaatctgggtcagactggatgcaacctgtgattcccaacagagacaaacaaagcaaggttcaggatgctcagtactgcgatgaaatgccaagacacagaaaagccatgtgtcaagaaggcgggagttattctttagacacatcctggtatatgtttatcattaaagatcagtggcttttgtgagtctaaaaaattaagccttaaatgttttcatcaaattccagttaactacctatctag

SEQ ID NO: 270112 - DNA, 496 bp, Homo sapiens
gattacaggcatgagccaccacacccagcctacagtcttaaatttagaaggaatcattgaaataatctaatctattccaacctagagaccagtttaaggattccctacacgaatgtttctaactgatgacaaattgtttgtcttgaatattgtagatgaagtgaaggtcactattctatgttctattttcgaatctttaatttgtttttaatactttctacttattagccctagttctgtgctctggaacagtggaggagaaacctacttacttctttctgtgacagtctatcaactctttggaagaaacaattgtctcccatcctggtcttgtcttcacaaagttatcaaccctcaaggcttcatctatggctcttttagcttgaagatcctctctcatcaaggacaaactccttcagatacctcccctaagaggcttgacacccaccgttagaaactgcggaccaagtcagaataggaaaaaaggtaaatgaaa

SEQ ID NO: 270113 - DNA, 977 bp, Homo sapiens
gactcggctcccgctgcgagcggccgccctgcccgcgcaccgcgctcagcgcccaccgccgggcttcccgcgccggacccagtacctcggctccccggggccggaccgaggccgcaagcagcgccgcggggtgtggggcggacccaggagatgaaatgacaacgtcaaccctccagaaagccattgatctggtgacgaaagccacagaggaggacaaagccaagaactacgaggaggcgctgcggctgtaccagcatgcggtggagtacttcctccacgctatcaagtatgaggcccacagcgacaaggccaaggagagcattcgagccaagtgcgtgcagtacctagaccgggccgagaagctgaaggattatttacgaagcaaagagaaacacggcaagaagccagtcaaagagaaccagagtgagggcaagggcagtgacagtgacagtgaaggggataatccggagaaaaagaaactgcaagaacagctgatgggtgccgtcgtgatggagaagcccaacatacggtggaacgacgtggccgggctggagggggccaaggaggccctcaaagaagctgtcattttgccaatcaaattcccacacttgttcacaggcaagcgcaccccctggcgggggattcttgctgttcggaccccctggcacagggaaatcctacctggccaaagccgtggcaacagaggcaacaatccacctttcttctctgtgtcctcctcagatctgatgtccaagtggctggggggagagtgaaaaagctggtcaagaacctgtttgagctggccaggcagcacaagccctccatcatcttcatcgatgacggtggattccctctgcgggtccgaaatgaaaatgagagtgaggccgccggaggatcaaaacggagttcttggtccagatgcagggtggggaataacaatgatgggactctggttcttggagccacaaacatcccat

SEQ ID NO: 270114 - DNA, 637 bp, Homo sapiens
gactcggctcccgctgcgagcggccgccctgcccgcgcaccgcgctcagcgcccaccgccgggcttcccgcgccggacccagtacctcggctccccggggccggaccgaggccgcaagcagcgccgcggggtgtggggcggacccaggagatgaaatgacaacgtcaaccctccagaaagccattgatctggtgacgaaagccacagaggaggacaaagccaagaactacgaggaggcgctgcggctgtaccagcatgcggtggagtacttcctccacgctatcaagtatgaggcccacagcgacaaggccaaggagagcattcgagccaagtgcgtgcagtacctagaccgggccgagaagctgaaggattatttacgaagcaaagagaaacacggcaagctctgcctcaaagaccgagtgacataagccattcccaccctcctaggttcacatccagggctgtgtcttccttgggggaggagatggtgtcgtttagatcagggtaaggcagtcaggcgggtgttcaccactgccttttcttcctctgagcgtgagaacactgaacccagccactgcccctgggtccctgtcctggaaatggtctaataaatccttttcccttcttgagctaaaaa

SEQ ID NO: 270115 - DNA, 506 bp, Homo sapiens
cagttggcagaggtgtgacctgcctcctccgccaactgccgtgcggccctgggaagagctgctggcagccctgttgggcagttgttttcatcctgggaagccagtcgcagtcattctgcctacctgaggcaggatctgctgatgaaacccttttcttccttgattgactggatctcgggcaggacagacctggctggcccaggccccagagcccggtgcacagtcaggtgaaagtgacgagcggggccgcctggctccactgccgtgggtggggaagctgagggccagagccacgcagcccagaagctgccaggagcctcggctgcagcctccagggctggggtttgtgtgtctctaccatagcacagttaacaggaatttctggaacatcatggggggttccagtgtttgggctggactcaagctcagcttaattccattttggtcaaagggtctgatttgcccttgaaaccataataaagaagctctagaaaaacaaatcactt

SEQ ID NO: 270116 - DNA, 253 bp, Homo sapiens
aggcaaaaatttctgccctcgtgaaggccgtattccagtgttcctcatctacgtttttaaatcatttataaccattcatctgtatatgagtatatttttaaggggtgtaaaaagagttgacactcaggccgggtgtggtggctcatgcctgtaaccccagcactttgggaggccaaggcgggtggatcacgaggtcaggagttcaagaccagcttggccaacatggtgaaactccgtctccactaaaaataca

SEQ ID NO: 270117 - DNA, 189 bp, Homo sapiens
ccacaggtgtgctgaatcacggttcaaatgttaccaaaccacctgtgaatcagatccatgcaagagagtaattatttcaaccttcaactgctttttatgtgtgagatttagtaccaaattcctagaccctgttcatgtgtgagaatggtaatcatatcagcttggtgtacataaaagaatcacattctc

SEQ ID NO: 270118 - DNA, 693 bp, Homo sapiens
tggaagacttagaagccacacacttaagacagcaccatcacttttatggaaggagtccagttcctgaatgctaccatggagctaagcccaaacactgtatggaacatctacattttcggtcataaagcacgataaatgtcctgaaactcaaggaacttataatgtagaacatagctgaagcagtgcatctgtgttatagtactgtcttcttggaggaaacatctttagagtgagtcaggaagccctcaaagtgatgatggaatttgcggttgcaatcaagttcactgtttaaaaacctctcctagaaagccaagaaactaggatcaaatccttgctattccactaattaacttgtggagttgagagtaaacaattagacatttctaagtctagttttcctcatctgtgaacagccaattgttcattaagtaaaaggggctggccaatttaggtattcaatacatgtttgctttcaaccacccacccacccacctactggcacaaaggctccaaactctacttgtaaaatctaccaaaaagaaagttactgcattatatttgtgtataaatggtttttacaacatctatatgttggatttttttttttctgctctctctggaaaaaaattagtttaagccttgcttaagaaaaaagaagctaaagtaaataaatcctgaccaagaacgcatata

SEQ ID NO: 270119 - DNA, 353 bp, Homo sapiens
aatcacaattttgagcccttttccttcaaaggaattaacaaataggtaattgtcttttttagtactcattattcaggtttattggtcttatggttttataaattgagagtattctctccacttgagaaatgattttgtaaagtctgtttttaatttcattaggttacacttgagacttctttgtgaagagcttaacatttagctgttaaaacttgaggaggtggccgggcgcggtggctcacgccttgtaatcccagcactttgggaggccgaggtgggcggatcacgaggtcaggaggtcgagaccatcctggctagcacggtgaaaccacgtctctactgaaaataaaaaa

SEQ ID NO: 270120 - DNA, 1407 bp, Homo sapiens
gatagagacacgaaaaacccttcagaaaaatcaatgaatccaggagctggttttttgaaaagatcaacaaaatagatagaccactagctagactaataaagaagagaacagagaagaatcaaatagatgcaatagaaaatgataaaggggatatcaccactgatcccacagaaatacaaattaccttcaggggatactacaaacacctctatgcaaataaactaaagaatctagaagaaatgggtaagttcctggacacatacaccctcccaagactaaaccaggaagaagttgaatccctgaatagaccaataacaagttctgaaattgaggtagcaattattagcctaccaaccaaaaatgtccaggaccagatggattcacagctgaatcctaccagaggcataaagaggagctggtaccatttttgaaagaaaataaagtgggagaagaaagacaacataaaaagaatagggtataattaaattcattttctctctgaaaacatatttatatcttcatgcagcttttcaaccagccatgcgccgaaataagcaaatcgaaagctgcaaaagctgcagcagtggaagtgttatgtgttaggccgaaaggctgtgggtgtgaatttactagtatagccaaaagaaaaaaaggtattcagcagctgttgttcagttctggggggattatctgcttagtgccatgacaagagcaaattctgattgagaagcacaagtcataacagcagctttacctctggcccaccaacctttctttccgagggtaggacagaagttttcttcacctggtcatacacaaattatataaaattcagttgccttgcaatgcaacaacaataccgtcaaaggtggaagaggtatccccagagaatggaaatagtatcccaattgttaaagaaaaagtaagatatgccagaaagtagaattacccaatattaaaggtcaccataatacagtgcttatttattccactattcatttacaggggtaatagcatagagctaaaattgttcaagtactcccatggatattgtttagtttataaaaagttatttctttaaagtacacagaatgacatcaccattcccaaaaccaaccctgagaagatttctgaaaggtttctattaaaagatgtaagatatttcctggaaatggagactaattcaaatttacccagcctcatccaagagaggaccaagttactttttcaaagtagtcgagtatcttttattacttgcacagagtcaaaaagaaaacttctagaaaatacgcagttatagtttgcagatagggttaactgggtgaaatagcgacaaggcattttcttatggagttacagacttacagaattttagagttaacagggaccttaaagatcatctactcc

SEQ ID NO: 270121 - DNA, 431 bp, Homo sapiens
gcggaggttgcagtgagctgagatgctgctactgcactccagcccaggcgacagagtgagaccctatctcaaaaataaaaacaaaacaacaaaaaaagcaaagctgaagtgaactgctgatttagggcaaaataattctttctctttaaaaaacaaaagtatatactcagttgtttctttgacactgttgcccctagtttagtcttaaacactcatagtattataattacaacttttaatctaagtaactaatgtcttacaggaaaacaacaacaacaacaacacttgaggggtagatgattgagaactttcagtcatacacaagcattttaacagactgccagagctgcccatatctcttttatgttttagtaaaataggaaaagtgaacacatttgttaacataactcaattgccttttgatggcatac

SEQ ID NO: 270122 - DNA, 366 bp, Homo sapiens
tctctgacaccagctactttagacaactcacacggctatcaactggagagtggtccaattaagtttgcagcctttaaaagcatgttgccaaggaatttttaccaccttgctcacaaaacaagttactgagaatgtcgatacatatgtatatgcacacgcatcctctgtataatgttgatatatataggtatatacatatatataccatataatctcaattccttgtttaaaaatatagatatatctatgtccatatataaaatgataggatatctaccaaaataataacagtgatgatctctgagtaatttctattttcttctttataattctattttctaaattagaaaaagttaaaaaattaaa

SEQ ID NO: 270123 - DNA, 275 bp, Homo sapiens
gcatcacagatcactagggaatcggtattgtagggaactagctaaccattttggggaggaggaatttgaatcattcttatatactgtatatcagaatgaattccaaacacacataaatttaaatgcaaaaaaatcataagagagactggaattgatttatataatattgaggggagaaaggacttgaagtttatgtgtagaaaatcaaaagcacaaattattttctttaaaaagtggatatttgactacataaaaattaaaacttttatactaaa

SEQ ID NO: 270124 - DNA, 673 bp, Homo sapiens
caaagattgagtcctcactgtgtgccaggcaccatgctaaattttgtgctaggcacttgggatactctttcagacaagactttgtccctgctcacagagaaatctgataggttggcctatagtcactcttttctaaacttgacctatctacctgaattaaccgaaggagctggttagaaatacagattcctgggccaagaagaagaacctaaagtccaacttcctgtaaccatcaacacatttaaccctgtaagtttagagtttattgtaaccttctcatgccctttgctatactcagtgtgcaaatcatgaagactaaggtggatcctgttttggtggagattctgatgtgttaagtctgtgatgaaacctgggaatgtgagttcttgaaagctcccattattggaaatcactgagctagatagtttttagaattttttttctgaccggagaatcagtgctttttatagttgtctgacttgtagtcacttgtgactttctgaaagtttttctgtgtattttgccacatagaaaatattgctcaatttaactccatctgctagaaaagtaccttcagagaggctagatatcagggctggcttctctcttggtagcggcagtctcctgtctgttctccccaccatcagtgtcccctaaaccattgtactgtttt

SEQ ID NO: 270125 - DNA, 483 bp, Homo sapiens
ctactcatccttacagttatttcatactctctcaaatatgatattctgtaattacctttacctaaaaataactcagtattgttgtgttgtttggctttgtttttcactgtttctggatgcctcatcattctcagacgcctactgcatcaatacacaacttctttaggaaaaccacggatacttcattgttcctaggatatcactaatctaggtaagaaaaatgagttgatatgaagacttgttacccactattgcaaattcaactcccatgactcaggaactgggaagcagaaagtagtttttcccttgattatttgtactctggccagtacgtgggaagccatttctatcactagaaagttgctccaagtcatagtgtcacaataagaacaagtttgctaaattactgacaagtgtaatagcaaaagactaaaataaccttatgcattaacagcatttattttcactgttaacctttctaaa

SEQ ID NO: 270126 - DNA, 517 bp, Homo sapiens
caagttagctgatagtgtctttcaggtcttctgtattcttcctgatttctacttgttctgtcaattactgagagaggaatgttgaactctccacctgtatgtcttctgtcacctctgtcacttttttgctccacatgttttgaagcactgatactaggtttagtattgttatatcctcttgatgaattaagacgctttaccattatgtaatgtctctctttatctctagtaatattccttatattgaagtctacttcgtccaatacaaatgtattcactccaactttctttttattaaagtctgcatgctatatcttttttaaatcttttacttttaacctgtttgtttctttatgtttaaagtggatttcttatggatagcatgtggttggatctgacaatatgtgttttaactgggatgctgaaactattacatttaatgtaattattggtatggacaaaatttatatctcctcgcttgctattttttctctatgtatcccacctattttttgtt

SEQ ID NO: 270127 - DNA, 639 bp, Homo sapiens
gcatgcggggctaccctgagactcctgagcctcctcagcctgccctgccctgtcctgtccagacacagagaacacttgggctctgctgggcttgtggcccatgcccgctacactcacccaggaccatgcgatccgcaaccctgggtactgcttggtgacctccagcaaagactgcactgaatgaggccggccagcacgcacaacgcggcccgacctctgagctacccaaagggagagcagcaagttgcctgtgcgtggctggttcctgtgcgcccataggagcatgaaacgcccccaaagggcccactggccagatggtcactggggcaggcgggcagctgccattcactggactcctaattgtgttgattggatttttacctgggacatgtatttccttttcaaacacaatgtcaaagtcaggaaagcggctggatgcagtaggaggcccaggcgggtggatcacttgaagtcaggagttggagaccagcctggccaacacgatgaaacctgtctctactaaaaatacaaaaaattagctgggcgtggtggtgtgtgcttgtagtcccagctacttgggaggctgaggcgggagaatcacctgaacccggtaggtggaggttgcagtgagccgagatc

SEQ ID NO: 270128 - DNA, 426 bp, Homo sapiens
gcacagaggagttaactagagaactatccagccaataaagcagaatcaacacaaatggggatgtaatatccacttaatggatttactaaaaagtagaaacaacaaaattgggctaatgaacattgtcgtggcacttaatttgtttatgtaaaccatgaagcaatattttaaaaagctcaagtgtaaacatatgcccaagggtaacaactatgattatggtcctctggaactgtgctggacgaggctgagtaagcatggaagactgaagtgtgatctgtcagggtggtgggattgagcggattttccctttgtgaggacactggaggtggctggtctgaatgcagtttacaactaattgctcacaaccagttaccgatttctttgtcccttctccactcccgctgcttcacctgactagccttaatg

SEQ ID NO: 270129 - DNA, 509 bp, Homo sapiens
aaaacttatgaattgtttatttctggaactttccacttaatattttcagatcatggttgactgggtaactggcaccatggaaagccaaaccacacataaggggagactgctatactccgcatcctgagctctctccactttggctttactaaattcccagtttcatctcctctgttcagggaggtcaccatcatgtgcctgggtttcttctccctatgtcataacctaaaaactttcttcatacagtatgttgtaggagtttgtttgtttcccatcccccagggatcactgtccttcatgagtgatgcccagtgtcttgaaaactgttctttcatatattttgaacagtttttcagttgtttctgacaggaggttaaatctgatccctgatactccatcttgcctggaagcacaaatccattttcctgatatttttagcatcatctttttcttaacttttattttaagttcagggatataattgcaggtttgttacataggtaaacttg

SEQ ID NO: 270130 - DNA, 340 bp, Homo sapiens
caaaagtcaactcaaaaggtataaaagacttaaatgtaagacctgaaactatgaaactgctagaagaaaacataggagaaaagcttcttgacattggtcttggcaaagatttttttggccatgacaccaaagcacaggcaacacagcaaaaatagacaagtgggattccatcaaactaaaaagcttctgcacagcaaaaaaataaaaaataaaaaaataaactaaaaataaataaataacagagttaaaggcaacttaatgggagaaagtatttgcagaccatatatctgacaagagttaatactcaaaatatataaggaattcatacaactcaatagca

SEQ ID NO: 270131 - DNA, 394 bp, Homo sapiens
attggaaggcacaaagtaaagaaaatgaaaattagaaacttgtgaaaaggagcattacccattgcagttcttcaaacttcagacttccttctgtcttggaattacttgaaaactatcatgatttccactttgctctttgatgtttgtgttttcatattctccctttttaaagcaaattcccaaaatataaaagcatcatttgccagtttcctcctcgactattttagaacagctaaatttcatgtgttagaagtgcagaaatgaaaatgaaagaagaaaagagagacactttcaatgtttctagcacacaacacctgcctctcacatatctttgggtttctgtctatcatgaacctgcagaatcagaacctcataaaaagtctgaccaagcaaa

SEQ ID NO: 270132 - DNA, 379 bp, Homo sapiens
tcacaacacagtgcatggtacgtgcatggtagtccttttaagatggcttttatataccttatcacttctacctcagaccttttgaagtggtctttgctttcttgaaacctggtgttgcaggtccctcttgatttttccctgcccgaagacttggaatcagccactctacaaggagccctgttaaggtctaacctaaatctgggcaccagaatgttgacttgctgctgatggattggagggctgtccttgttgagccacttgtgtgacagagctggaaagagttgttttgtttgtttgtttttaatatcatgaagttacatagatattttcagtttaactctcactttcctgatcatttattttgttctttaaaaaaaaa

SEQ ID NO: 270133 - DNA, 375 bp, Homo sapiens
gagagggagccagggctgctaacacattgtcacctctcactgggattacagtgaagttctgcaacaacagaaaatgtgtgacaaaaatgccagaattattatagtctccctttagttcctgaatatcattaagaaaagaaaattaatctgctactcttagaagagttccagggctatgaataactattctatgaaaaaataatatcacagtgaatttacttcatttccctaaaacatctaagtatatagtaaaaagagagagtattccctccagacaaaggctttcaagcaaccacaggagaaaatgccctgtgtagggataatgaatattaatctaaaataattttttctaatatatggtttaattccatcgca

SEQ ID NO: 270134 - DNA, 500 bp, Homo sapiens
ttcctgccagtatcttaaacttaccaaaaacagaatccattgcctttatccccatatttctgtatttgtattctgtctgttggttagtggagacaccatatatctggtttctcaaatagaaatcttattgataatgccagcttccctcattccttgaggatgtttgctcctggcccacccacactctcagcaaaatgaccttgcttgtcatttcaccaccaagaaatataaacaaccagtaaagaactacaagtcagccacatctacccaactaccagcatctgtgcctatatgactgccttccttcctttgctgtggacacattttttctgttcctgttttgtgcctctttcctccacttgtactctggatcttgtctcctttcacctgcccagtcacaacttcagtggtctctctgtgctgcatcaacagttattttctttactgagtcatttccatcaatatggaaatgctgttatttctcccatccgaaaaaaaaa

SEQ ID NO: 270135 - DNA, 523 bp, Homo sapiens
gctcgacggaaataggaaatttaaaaataaaagaaatagagggggctgtgggagaacaggcattgcagaatacatctctgctttccttctgtattctaagcttcaatatttcatgactttctaatctacactcatttctcttcagaggttttgctttgcatcttctagctaactgtggaattaacatatccacctggttgtctctctgtcacctcaaagttagcgagtttaaaaatgaggccaggcgcagtgccttatgccggtaatcccaacactttgggaagccaaggctggcggatcacttgaggtcaggagttcaagaccagcctggcaaacaaggtaaaaccccatctttactaaaaatataaaaactagccaggtgtggtgtcgtgtgcctgtaatcccaactgcttgggaggctgaggcaggagaattgcttgaacctgggaagtggaggttgcagttagccgagatcgtgccacagcactccagccttggcgacagagcaaggcatcatctcaaa

SEQ ID NO: 270136 - DNA, 227 bp, Homo sapiens
aaacaaataaaatatgacagtagccaatacaagtgggccctgtttccagtttttaaaaatgaactcttgaaatgaaggtgggctggacatggtggctcatgcctgtaatcccagcactttgggaggccgaggcgggtggatcacctgcaatcgggagttcgagaccagcctgaccaacatgagaaaccccgtctctactaaaaaatacaaaattagccaggcgtagt

SEQ ID NO: 270137 - DNA, 415 bp, Homo sapiens
aatgtggcggggcggagggatcgagctttaattttcagcactataataatagctgactcttaattgtcaggcaccttacatcatctcatttaattctcacaacagactgatgaaatattttccccatgttgcagatgagaagacagaattcatttgacctaggtcgtacagctagtaaacggccaaggtggaatttgaagcctggtaacccaacgatatattgcatatgagtttaaccaaaatgctgcacggcccagcggggtgggcccaaggccgcttgggctctgcagcaggaaacgggctggaaaagctcagagagccagcaaagacgttttccgggaaggcatggtatctgagccaaaccctaggtgttgtgcagaagttgaccgagtaaagaagtgagcaaagtgaaaaa

SEQ ID NO: 270138 - DNA, 750 bp, Homo sapiens
aggcttccaattatacttcacatggtgaactgtgtaattagtttggaagacttatgcttagtcattggtttatcctaatcggctttggctttccccaacaacaaagtgagcttattttgctaagctgaaacgactctgcaccctttgttcctgccttttattgtctcattcctttcattctgtgttactgccaaagttctgtttcattaggcctacaagtcatttccaattcagtgggctgctacaatccggcctttatcacgggctgctctggttcccatgtcccttctgggccagtgcctgagtttgtggtttgacatgagggctttaaccccttcctgtgccagcccctcactgtggtggccgggaagaaaaggccttccaggaaccggcgtggaaagttacagctcttgaggtctcgtcaaagtgggagatcgctgtggaaaccaggtgaaagggtccttggagccctttgtgtcggattggggttgtgtgggggcccataaaagttaacttgagctctggagaatggtgtgtgaaagctttttaggggaagaaaaaaagaaaacaagagtgaattgttttttttaatgtaatgagaccttcccgtttatccggccagcgtgggcgattgtgggtgagtgaggcccgaagaagcgctgggtgcctgcgatctcccaacttcgggggttttctgtgcaggtgcgaagctgcattcatggcccccactcaaacaccccttttgatact

SEQ ID NO: 270139 - DNA, 498 bp, Homo sapiens
ctggatcccgggggagggaggcacagggaggcgtgaaggatgggaaccagcctcccctgggctgcttgggccggcttcccccttgccagttctgctgcccttaactgcggccttgggcagggggcgtaacctttgcaggtgacgcttgggtctccctgttggaagaccggcaagatgccgtgtacttactttaagaagcaaatgaaggttgggcgcggtggctcacgcctgtaatcctagcactttgggaggccgaggtgggcggattacttgaggtcaggagttcaagacctgcccaaccaacatggtgaaaccctgtctccactaaaaacacgaaaattagctggatgtggtagtaggctcctgtagtcgcagctactcgggaggctgaggcaggagaatcacttgaacccgtgggggcagaggttgcagtgagccaagatcgtgccactgcactccagcctggatgacagagtgatactccatctcaaaaaaaaa

SEQ ID NO: 270140 - DNA, 435 bp, Homo sapiens
caaatatttaagataatggatagcccagttacacagatttgatctttacaaattatatgaatgtattaaattatcatggctgggtgcagtggctcacacttgtaatcccagcacttttggaggctgaggtgggtggatcatctgcggtcaggagttccagaccagcctggcaaacacggcaaacatgtactaaaaatacaaaaaattagccaagtgtggtggcaggcacctgtaatcccagcaactcaggaggccgaggcgggagaattgcttgaacctgggaggcagagtgcttgcagtgagccgagaccgcaccactgctttgtagcctgggcaacagagtgagatgccatttcaataataataataaactatcacatgtaacccccaaatatgtacatcattgtgtatcaataaaaataaataaatgtgaaa

SEQ ID NO: 270141 - DNA, 290 bp, Homo sapiens
aatactgcactggcagcgagctgcactttccttcctaaatggaaaatgggttaaaaaagaaagagaagagtcgacagagaccaacaggagccccaaacatgtattcctcttcactattggcctggacatctccacataggcagtcatatagagacttgaaatatcattcaagggatttgggtatccagtagacttttagttacatatactacaaaactgactttgtactctcaagtagacctttcgtagaaagaaaatgtttctaataaaaatgtattagaactaatgac

SEQ ID NO: 270142 - DNA, 611 bp, Homo sapiens
ccactgcctggcctgggttttcatggtaagacgggagccactgggggcttgggtgacatgatctgaaggattaagaacagatgatggggtgattgtgtgagagtgtgtgtgtgattgtgtgaatgtgtacacaaatatttgtgtgtgtttattttgagtctctacagaaaaattaaaagaatggcataatactgtcctatatatccacctgctgaacttggcaattgttggcttttgggtttcttttgctttgtattttttctgggaccatttgaaagtaagttatagatctcaggacatttcatccctaaacatgtcagcacgtgtcttttaaaaataaagacattctgggctgggcacagtagcttatgcttataatctcagcactttgggaggctgaggcaggaggatcttttgagcccaggagttcaagaccaccctaggcaagaagacgaaaccccgtctctacaaaacatataaaaatgagcccggcatggtggcatgcgcctgtagtcccaggaggatcgactgaacctgagaggtcgaggctgcagtgagccatgattgcaccactccagcctgggtaacagggtgagaccttgctaaaaaaa

SEQ ID NO: 270143 - DNA, 410 bp, Homo sapiens
ccactgcctggcctgggttttcatggtaagacgggagccactgggggcttgggtgacatgatctgaaggattaagaacagatgatggggtgattgtgtgagagtgtgtgtgtgattgtgtgaatgtgtacacaaatatttgtgtgtgtttattttgagtctctacagaaaaattaaaagaatggcataatactgtcctatatatccacctgctgaacttggcaattgttggcttttgggtttcttttgctttgtattttttctgggaccatttgaaagtaagttatagatctcaggacatttcatccctaaacatgtcagcacgtgtcttttaaaaataaagacattctgggctgggattacaggcctgagccaccgtgcccggccaaatacccatattattaagagaaa

SEQ ID NO: 270144 - DNA, 456 bp, Homo sapiens
aaacactcctctccataaggatttgtttctgagttctatccatccatctttgaatgagcctttcctgtggaaactaacatttgggtatcctttctgaaaccctaattcctgacacacgccaaatgcctggagacgttcctgtttcattgttgattctcactttttaaaaaaaattctgggccaggctcatgcctgtaatcccagcactttgggaggctgcggcgtgtggatcacttgagctcaggagttcgagaccagcctgggcaacatggcgaaaccgcatctctacaaagaatacaaaaattagctgggtgtggtggtgggtgcctgtaatcccagctatttgggaggctgaggcgggagaatcgcttgaaccccggagtcggaggttgcagtgaaccaagattgtgccactgcactccagcctgggcaacagagcaagactctgccaaaaaa

SEQ ID NO: 270145 - DNA, 439 bp, Homo sapiens
gaggtcagggggcagaggatggagctaaaagttccaatcctctaatcacatggttggttcccctggcaaccagcccccatcctgaggctatctaggagcccaccaagagttgcctcattagaacaaaagatgcccctgtcactcaggaaattccaagggatttagaagctttttctcaggaaccagggcagagaccaaatatacattcctattctatcacaatgtcacaggcttcttttcctttacaatatagtgacatatggctgttgagtacttgcaatatggctattttaagttgagatatacattggatttgcagacagtgcaaaaacatgtaaagaatggaaatatcttaatttttaaaatattgatcacatgttgaaataatattctgtatattttcggttcatgcaacatattattaaagttattttttaaa

SEQ ID NO: 270146 - DNA, 359 bp, Homo sapiens
gtgatcactaacattgtacaccaaaggaacttaaagatcgtggccttgaagttttagactataaaacagcttttaggctgtagtgctctgtagtataaataaggcagtgaggcagcaactccaaagaaaattccctttcaagacttacattgtaacctacttgagtttatagttgtggagttttaattcatttgcattctaggccatgaccaagtgaccagaggactaaaatagtataaaagcatcctgtattgagtttccatagccaagggggtgtaagatcatgaaatttggagctgtttctcgtttttaaaaaatgagttgtaaaatacatattaaataaaatttaccaacttaaa

SEQ ID NO: 270147 - DNA, 589 bp, Homo sapiens
actctgtgctttgtgattgtgatgacgtctggtcaaatgtggacttatataagaggagaaccatatgtccaaagggaccctcacacaggacataaacattatatcagtaaatttagtcaggctcagtttgcagcagaaacattcattatttccctgtttaatatgtgtgttagcctgggaatggtgctgttagacaaggctgccacctctacgatgaacatcagaaagagaaagatgatgtgtctggctggtatgtgtcttgttgccatattcttcagtcggctgctttccctctttagatttaaagtacctgactatccatacagctttgtctgggattaaaaaggatcctacagacatagacaatgaagcaagaaatttgaaaaaaaaaatgtgaagcagaaaaatgcaaactcatagctttttaaagtaattgagatttcaccaaaagagaccataagtgctttaagtgctttcaaaatctgtcaagtattatggtatgtatcttctctgttcttaatttttctccccgagtgttatagattacctcaagtccaattattaaaatctttagagagtacaactttca

SEQ ID NO: 270148 - DNA, 503 bp, Homo sapiens
atgaagataccaaagttcagagatgattaggaattttccaagatctcacagctcagaagtgacggagccagactttaaacccaggcaaactgcttccgggtccctgctcttcctgctccggtactcccatgaacagtgctccttatctcattatgtgctggcttagaaattccaggggctaattttgaaacaaaccaggcttgcagatccagctatgaaatcagcttgcttagtgggcttacaaacaaggagaccaccaccaataggcagaagtcaagatgatgccaactggacctccaggtgcttgactactcaagaaagcctttggagcaagacctgcagacctgcaccttcctgcacccctcccacctgtttcctgtaccatgtctcccttctgaaaccatctcactcagcccagaaagttggactggtcttttaaaagcatgagtctggccattccccaattgctagcttccaattaataaaactgttttcctttcgct

SEQ ID NO: 270149 - DNA, 291 bp, Homo sapiens
  misc_feature (285)..(285): n is a, c, g, or t
gcagggacaggtggcccaagggagagcaattcaggcaatttgtgtgatccaggaaggccatgcctctggtctcccgagagcctgttcatcacccccatggggagtcaggcccctttcacagtggctggggaagacagagactgagcagtgagaaggttctgtctggttttctttttttcttttaatttaattatttttttccgagacagagtcttgctctgtcacctaggctagagtgcagtgagccaaggtcacgcctccagcctgggcaacagagtgagaccntgtctc

SEQ ID NO: 270150 - DNA, 311 bp, Homo sapiens
gaggaagaaggcaaaccgggcagccttcccagaagtggaggagtttgcgtaggccttcggtgcgttctcgcctgggtggaaggcggggacgtgcatttgttggagagcggtgtcctgcgccctaggctggaagcctggcctcgggcaggggcctggagcctcggggttggaggtggggggcggggcggggggcggcccctactgggcgggcttctgtctgcgcgcccgcgcccccgacaggcggcttatttgcatggagagcggcggcggccaatgggcgcgcgcggccgggcatgctgggatcgggctgg

SEQ ID NO: 270151 - DNA, 393 bp, Homo sapiens
gctccaccgtgtgtgtgtgtgtgtgtgtgtgtgtgtgtgtgtgtgtgtgtgtgtgtgtgtgtgtgtgtgtgagagacagacagacagtctcgccctgtcacccagtctggagtgtagtgccacaatcttagctcactgcagcctggacctcctgggctcaagtgatcctcttgcctcggccttccaaagtgcaggaattgcaggtgtgagtgaccacgcccggccttcttttttgttagcttttgcttgtaacaaaactgccgcctctgtccttctctgagataattgccctcttaaggtcccgagtatagacatctccccttccttctcctcagcccgcttgtgcaaggtctttgagtgagagattcatgatcagccccaggcccttgtcct

SEQ ID NO: 270152 - DNA, 343 bp, Homo sapiens
gaagctgcctgtgcattcaccaatctagcccccttaatgaccctttgaggcagacactttatccccatttcacagaggtggaaactaagcctcgtagaaggtgagtaactcaacccaggtcacacagctcgagctaaggttcaggccactcagctgactccagtactgtgtgccaccctgctcctcactgctttcctctgaaacctcagggattgtctggctcaatgtgtacctggggaagatgagaaaactgaggcctagagaggtgaaatggcttgcccaagaccactccaaatatcccacctatccttggcccctttccactccaccatgcagcatagcg

SEQ ID NO: 270153 - DNA, 294 bp, Homo sapiens
atcaccgtgctccagcctaggtgacagagccagaccctgtctcaaaaaaaaaaaaaaaaaaaaaaaaaaggaaggaaggaagaaaaggagggagacaggaaaggagcacaagcaagtttctggacatatggatgcaagtaagtttataggtgagcgccactccagcctgactggcagacggagaccctgtccgcccctcccctctaaaaacagtagagctctggtgagctgaacagtggtccttcaaagctaccaggccctaatctctgaaacctgtgaatgggccctctttgg

SEQ ID NO: 270154 - DNA, 456 bp, Homo sapiens
agaaaatccatgatcctgagactgcaggaggcttttcacaaagttctttgtcactcttaggagaagactgagtcagggaaaaggtgaaccctgcagactgtactagaagacaacgcgggagcacagaggagaccaggacccaattcccaggctgtgtgaccttggacacgttacagctcctctctgcatttcagggttttgttttttttttttttgatttttggtttgtttgtttgttttttgtctcgctctttcacccaggatgaagtgcagtggcatgatctcgactcactgcaacctctacctcctgggttcaagtgattctcctgcttcagcctcccagctactcgggaggctgagtcaggagaatggcgtgaacccaggaggcagagcttgcaatgagccgagatagcaccactgcaccccagcctgggccacagagtgagactccatctc

SEQ ID NO: 270155 - DNA, 457 bp, Homo sapiens
gagtaagaagcttcctgctggtgctaagctgtgttcctcactatcccgttcagcctttcatccttccattatctatgtaagcaattccttgtgttaaactcccactgttgaaagacctagagtagtttcttaattctgacacagagaagcagcaagacagcagtgagctaaccaagggtttacaaagtcatcaatgagaagttctgcatcaaccaatccattgctaaggtcatgtggctatgaaagtcacccaaggccaagacctcaacttttcccgcttgaaaacccttgaatatagaaggagctggaggaggaggagtaataaactattcctccaaaaatccaaatgtgttaatagtcccagccttggccctgcacctccccttctccctcctctcggcaattcctgacttgattagttaccaggactaatgcctttctgctggtttatcagaaa

SEQ ID NO: 270156 - DNA, 290 bp, Homo sapiens
gtaggtaaaataaagatagtggcccctaactttacttccttcttggctggtttttatcataaaatcaaacgatatgaacataggaaatacttgattcctaacaatatttgcttttggacagtccaagactcaaccagctctcctatgctttcaactcttgccctgttagaattgtgttcccttgtataggaagaatctccagagcctcccttctttccagagacttttgaatatgaatgttagagtacatctcagtagatcataagcagtggaatcacataactaaattt

SEQ ID NO: 270157 - DNA, 163 bp, Homo sapiens
aaattttttttctggtactataaaacttgcacagatattagcttcaatattgatgaaggaatggaataatcctaacatctgcaaataggattatttggcactccaaatcccaatttggatcatcaagatctgtggatgcttccttccctacccccctttattt

SEQ ID NO: 270158 - DNA, 126 bp, Homo sapiens
cggtcgtggggtaggttggaagagcacgtgagggaagccagattttcaccccaaagctgcattgctcccttaccattatgctaaatgtctgaggtaaaatctcagagggtaatttacactcgaatt

SEQ ID NO: 270159 - DNA, 561 bp, Homo sapiens
ctggaaactttttctgaaaatcaccagttatctcttaaatgaccaaattctttgactttttttttcttgcctcttctgctgttcgaattctctgcaggatctgatagtttttttaaaaaaacaatttcttgattttagtgatactccacttttctggtcattttcccacctgtttgtcctatctgcccactcatttagtcaaggcctttctcttcttttttgtattcttaattggcacttttgtgtgatccttgaagctccgggacaggtccttttaaacagtagtagaatcatacagtgctagagctaagagaaagcataatcatcatctaagttacccctccactttacagttaagggagttaggcccagaagattgaaagtgacttgttcagggtcaaataatgagtaaatggcagacctagtgctagaactcacttcctttgctactattcccttgattataccctattttacagagccctacatgtaatttagaggctctgtaagaatagtttgtaactctctaagtacatatatatgtgaaaataaatggcaaat

SEQ ID NO: 270160 - DNA, 484 bp, Homo sapiens
ctcaccctaatgtccacattgaaccttaattacttccttaacggacctgcctccaaatacagccacactgggggtcagaacctcaatcgatgaattgtcaggggacacagttcagcccactgcaccaggtaaactagaccctgccaattcttcgtccataaacctttaatataataaaatttatgttgttttaagccactacatttatggtaatgtcatgaagcaataaaaacctaacacaaaaatccaaagcaaatatgtgcttagacaggaaattaggaaatgatagagacgactgaaaacactaaggcacttcctttaaaactggggccactaaacaccgttattcagcaccactttggaggctccagctaacacaagaaagcaaataatagttagtataaatattggggaatcagaaaaaaggcatccttttagccaatgggctgattgtgcagctaagaaaccaaagagatatttttac

SEQ ID NO: 270161 - DNA, 453 bp, Homo sapiens
tttaaaaatctttaaagctaaagttgaacatttgtgacaactaggaatatttggatactttgtgtttctctccctctttttatgtctctctatctctctctgataaaagtatgtttgtggataatttattttaaaactagacttttggttatgccagattaatagttccagagatctcttataaagcacatttcttgtagttaacaatatggtgttgtgcacttcaaaatttgttaaataatagatttcatgttaagtattctaaaaacacacacacatacacactcggacacaaggcaactttggttgatattgaacacatccattaccttgattgtggtgatgatggtattacgggtgtttgcatatgtccaaactcattaaattgtacacattgaacatgtgaagttctttgcatatcaactatatctcaataaagctgttaaaattaaa

SEQ ID NO: 270162 - DNA, 468 bp, Homo sapiens
ccttctttcagaataatgtgaaatttcttttaaggacaagaaactttagtgtctagttggtaaatgacataggtttgaatctctttctaagagttgtaattgatgataagaatattctgtggttctttacagggataaattgtttagtttaatcagagtggtggctctcactatccataagtccatgggcaaaagtgttgactaatacgatcatacagtgtacaccagccaccttacaccatgcattgttgagagttcttgctctatatttgataacacttttcaaatatgccattttccgtgattataaaattgcttaaatatctatataatctttcaaaataattttcctacaaatgtctaaatttctctagaagtacaacatatacaatcagatttacttggaatggtcttccttagtcagtcgtgttttcctgcaaattaaaatggtttggacaacacaaaatt

SEQ ID NO: 270163 - DNA, 483 bp, Homo sapiens
gaacttgtgcattcatggattttggtatctgtggggttcctggaaccagttcgccatggatattgagggatgactgtgtatagaattgctgggttctgatacaacctgcaagtccatatactggcttagtcaaaattcttaggcatatggctgaattaaaactttctgcattgcttaaaatttatatacaggtataccttactctgttgtacttcttcactttgcagatgctgcattttttttttttaattgaaggtttgtggcaactgtactgagcaaatcaagtccgtcagcaccatttttccaatagtttgtgcttgcttcatgtctctatgtcatgttttggtaatccttcccatatttcagacgttttcattattattatatctgttatggtgatctgtgatcagtgatctttgatgttactgttgtaattgttttgaggtgccacgaactgcacctttgtaagatggtgaactaaat

SEQ ID NO: 270164 - DNA, 425 bp, Homo sapiens
aattttttttctagctcaaattttctgattttgagcattaaaataaacttttttgtacttaatgtaagcacttaatatgtgcttcaattaattgaaatacttttgttccaagttgtaaaaatattttaaatgaagggaataggccgggcgcagtggctcacaccagtaatctcagcactttgggagggcgaggcaggcggaccacgacgtcaggagattgagaccatcctggctaacacggtgaaaccccgtctctactaaaagtacaaaaaaattagctgggcgtggtggtgggcgcctgtagttccagctactcaggaggctgaggcaggagaatggcgtgaacctgggaggcagagcttgcagtgagcctgagattgtgccactgcactccagcctgggcgacagagcgaaactctgtctca

SEQ ID NO: 270165 - DNA, 515 bp, Homo sapiens
ctgctatgtcaaattgtagaaatatttctgtgatcatgtgttttatagttaggctattttcagcagagctattcctatcattgttaaacactcaattaaatcatctggctcaaatatgaagaagtctgttcttcattggaacaaatttttgacctgtagaaatattctgttttaaaaataagcttaagcataaatagacatgtttaaacatagctttctcaaaaactgcgattataggagactggacttatttatgtacattgagattcacttatggtgatagttgtcagtgtgttgctggaatgactgacatgcatctaaatcttacatttttcaggtcattcaggtgcttatatatgtaagcttgggattgccattatcaaacgcgactagaatatgaatagcttggattttctggtagaccaaagtactattagttattatttgtcctttgtttttccataatgaagagaaatgcatgtgattttgcagaattgttgcatcctttgagctct

SEQ ID NO: 270166 - DNA, 401 bp, Homo sapiens
gaggctgccaggaccccaattcattattcagaaaatggatcaataacagaaaataatgacaaatggatcttgctttttcttttcaaactatatttcaagatatcaaatacataatgatgaaaaattgatccctactaaagaattccaactactaaatgcagaaagaatgatggaattaaaaaatttccagtttgtgacttctagagaagtccattgcaaaaaccattacttaaggtaatgtatggctgatgaggaaccttataaatggtggaccaggtatacagctaaatcttctgaccaatcttaactcactgaagttgggacagacagatactatgtctctcccaatgagatatactggaaagtacatagcaccaactatacagcaatcttgcctagaa

SEQ ID NO: 270167 - DNA, 653 bp, Homo sapiens
acaaggcagcatatttgatgtgtgatgtgccatgtgaacaggacaaacacccactttagaaattcagcttctaatgaccagtgcagatctttagggactgttcacacgtacattgtaatatgtgtggatctctttgtgtccatgggtatcagcatagaggtaaatgtaggagatcaaggtagggacacaaggactagattgtcaaccaattatattcaaatccagagtcatctaaataaagaaagagattgggaagcccaccacaaaccagagaaatggttatatctacctatgttaaaatgcaaaacaggagtcactagtttgtattgacatatgctgtaaatgaaaaacacaccctgaatttcccagatttaatatgaaaaaaatgcaaaatatctcaatcatttctatactgactacatgttgaaatgatactattttggatatactgaactaaataaaacataattaaagttacttattttttaatgtggcttccagaacatttaaaattacatatatggcttatatgatatggctattggatggcactgggtttcctgctttggaactgtgcaaatcatttaactgctctgatattcatttttatcatctgtaaaatggggatgaaagtagtgctgttctcacagatt

SEQ ID NO: 270168 - DNA, 482 bp, Homo sapiens
cagagtgaaaggaagtacggtgacaaggggtgaatgccatgtttcaagtctgagatgtctgggttgaaaggagatgggatgattaggaaggaggcactgagttaggaatctggaaagcccagctctgttatgaaacgctcccttatcccatggctccgagaagttagtgccattccagagatgggacgctggaagaggtgcttgaagacccgtgagcttcctgccatggaggtgtgtggtagagcatctgcaacctcttgctggcagccatggggacaaagattcaagcttcaggctgtaacggtgtcatgtacctgtggtcccagctactcaggaggttgaggtgggagcatcacttgagcccaggagtttgaggttgcagtgagctgtgatggtgttactgcactccagcctgggcagcagagaaagaccctgtctctaaaataaaatgataaaataaaataaaaataaaattcaaaaat

SEQ ID NO: 270169 - DNA, 517 bp, Homo sapiens
agacacaactgtggcattccatattatcatacaggaatttgaaaatgaatagtggatggtgtatataatctactgacactttattaacctttttaaaccaccaaggtttgagacagctgtgcttcctagctcttccctgttaagagcagtccatgttctgtctttttatcttaggcagtgccttgtgttgccttaatgccttagtacaggaaaagctccagttggatgtcagactttttaaaaagtacatgaatcagtgctgcataatttctatatggcaagtttggaggcatctgctaaagaatcagtacacgtgctgcatttggtccagagagttagcagagtgcatgatggacagtgttttgtctcaaataccatgtggatgcttggatttgatatttgtaactggaaagaagtaaatggatgagccattgatagacattctggcaactattaggaacatgaatatcaagtgatagaatcccagggaaagaaaggaagcaaactgaatgtgggg

SEQ ID NO: 270170 - DNA, 647 bp, Homo sapiens
  misc_feature (6)..(6): n is a, c, g, or t
  misc_feature (14)..(14): n is a, c, g, or t
tattcnggcacganggctccgactgtccgtcagtgatgaatgaaggggattcaagccttgccaccgacttacaggaagatgtagaggaaaatcctagtccaactgtggaagagaataatgtggtagttaaaaaacaggggccaaatttacataattggagtggtgactggagcttttggaatgcactgttgtctggttcgatgaaatggaattaatctgcttcagtttccttgtgtgaaaactacaccacagaagtggattccacttacactgtagctcactgtattgtcaagagactaatgttatatagaaaccatatttctgaatgttactgagaagccagctattttatataattttgatttaaaaaattcattcctgtacgtaaagaaagtttagcagtgttcaacctatagtgtataatgactataagatggttttaaagttagaagctacatattctgtttccattgtgttcattcggttgtgtaatctggatgtgcttcaggtttccccactgtaaaatgagactactgcttgttgattaggcacattaagatcttagagtctttttggaagaaaaacacttctgtatgttacaaatgctaacatttattatattaaaggactcattctaaatctagcaa

SEQ ID NO: 270171 - DNA, 501 bp, Homo sapiens
gaatacacagctttctgggccagaaattgagcttctgactcttgagccttatatgagtactgcgttggtcatatttattttgtgaaactactctgtgggctgaaagggagagactctccttggtttgcagagcctgactagacaggaattctggcaactgctccagcagaactatggcactgagctaggtttaaatgctgaggagatggaaaacttgtcactgtcgattgaggatgtgcagccaagaagtccaggaagaagcagcttggatgactctggggagagagatgaaaaattatccaagtcaatcagttttaccagtgaatcaattagtcgggtttcagaaacagagtcattcgatggaaattcatcaaaaggaggattaggcaaagaggagtcccaaaatgagaaacagaccaaaaagagtctcttaccaactttggaaaagaagttaactagagtgccatcgtcactggacttgaatatgtatctttctctggc

SEQ ID NO: 270172 - DNA, 736 bp, Homo sapiens
agcctgtaactcgcgagcgcgcgctggaggtgggcgcggggcggtgcggtgcggtgcgcgcggggcggtgccgcggcggcggagggagccgcgatggagggcgctccgactgtccgtcaggtgatgaatgaaggggattcaagccttgccaccgacttacaggaagatgtagaggaaaatcctagtccaactgtggaagagaataatgtggtagttaaaaaacaggggccaaatttacataattggagtggtgactggagcttttggatttcaagttccacctataaagacaggaatgaggaatacagaagacagttcacacatctacctgatacagagaggctgatagcagattatgcttgtgctcttcagagggacattttgcttcagggacgactatacctttcagaaaactggctatgtttctatagcaacatcttcagatgggaaactacagtaagacattttgcatttgatttgttgatacaaataattgcatagagatatatacagttcttccaaaaactctactttagatgattccaaagtaaatttatatatatttgtgcatctaaattagtgtgcatgtaaatacaaacgtgttgtatatataagtgtataatatatttttctgatttaatacattgagctccagtatagttagagaaagatattttaattgaaaaaaagcttgaacatatatcttaatggctgccaaaaccatgtcttaagtgac

SEQ ID NO: 270173 - DNA, 1004 bp, Homo sapiens
agcctgtaactcgcgagcgcgcgctggaggtgggcgcggggcggtgcggtgcggtgcgcgcggggcggtgccgcggcggcggagggagccgcgatggagggcgctccgactgtccgtcaggtgatgaatgaaggggattcaagccttgccaccgacttacaggaagatgtagaggaaaatcctagtccaactgtggaagagaataatgtggtagttaaaaaacaggggccaaatttacataattggagtggtgactggagcttttggatttcaagttccacctataaagacaggaatgaggaatacagaagacagttcacacatctacctgatacagagaggctgatagcagattatgcttgtgctcttcagagggacattttgcttcagggacgactatacctttcagaaaactggctatgtttctatagcaacatcttcagatgggaaactacaatttctattgctttaaagaatataaccttcatgaccaaggaaaaaactgctcgactcatcccaaacgctatccagatagttacagaaagtgaaaagtttttcttcacatcttttggtgccagggatagaagttacctcagtatctttaggttgtggcagaatgtattattagataagagcctgactagacaggaattctggcaactgctccagcagaactatggcactgagctaggtttaaatgctgaggagatggaaaacttgtcactgtcgattgaggatgtgcagccaagaagtccaggaagaagcagcttggatgactctggggagagagatgaaaaattatccaagtcaatcagttttaccagtgaatcaattagtcgggtttcagaaacagagtcattcgatggaaattcatcaaaaggaggattaggcaaagaggagtcccaaaatgagaaacagaccaaaaagagtctcttaccaactttggaaaagaagttaactagagtgccatcgtcactggacttgaatatgtatctttctctggc

SEQ ID NO: 270174 - DNA, 440 bp, Homo sapiens
gcactgagctaggtttaaatgctgaggagatggaaaacttgtcactgtcgattgaggatgtgcagccaaggtacagcaaaatgttttgaaatgtcaaaatttatcaattattaatcaaagcagaattattttacattcgactaattctgaatttctagtaatttatctttggctgccatttgcccctttgttctttgtggtggaatggggtgaaaggtggggacagagaatagtttgctaaataggtaagcacatatgagatatataaggaaatgttggctatgtcacttagggtagacttaaagtctggttttagtaagcctgtttattaaggatctggagaagtacctagtgaaatctctgagtttatagatgacagtaaagtaaattatatggtaggtgttttgaaggatacaataatatgatttttcctcaggaat

SEQ ID NO: 270175 - DNA, 523 bp, Homo sapiens
ccattcaactagattatttggactgagcagaagatagatggatcttctagaatgacaatagagtactgtaaatttagccagatggtgactccaagtgcagtttctgtacccgatatcatttcattattgtggcaaattaatatgcctcctggtacctggttgctatgatttcaatgtcccctccagaactcatgttgaaacataacccagaagtggcagtgttgattcgtggtgcctttgggaggtgattagactatgaagggttttgcccccattaatatattaatccattcctggattaatgggctgtcatggaaactggtgactttataagaagaggaagagagacctgagctagcacacgcaatcacactcagcccctcgccatgtgatgtcctgcgccaccctgggacccttcagagagtctccaccagcaataagactctcaccagattcacctcgaactgacagcttcttagaccccataactgtgaaaaataaatttctttttctttacaaatta

SEQ ID NO: 270176 - DNA, 387 bp, Homo sapiens
ggatcattatgacacttaggagataggtatgtaatgctcacattatcctagtaacatataagcagtaagcactatgtatatgattgtgtaatttatttttctttagtaatacaactgatattaatccagactttaaagtgatattgccatgccccttccgtaatggaacacatgatttgaattgtttttcagtatgtgtgcttgtcttgattttgagttgctagggttgctaaggaaacccaactcaatctactgttaagcaaaattggaatttattggtttatgtagggatgaagtctgaggtcagggttgactggatccttaaggctcaaatgatgttgttaagatgctgtttctgagttactcagttctccacaccttgacttg

SEQ ID NO: 270177 - DNA, 302 bp, Homo sapiens
tacttcagaaagaccatagaactaaatgtgaaatattaaacaataaaaattccagaacattgcataacacacctcaaggtggactttaggatagcaatatacccttaagtaggacataaagagagcactgaatataaaagaaaaaaaatatatttccttaaaattaaaaacttgttttcatcaaaagaaaccattaacagataaaaagctatcaaacaaaacatttccacatgagattacagagatatctgtaatacatacatctgacaaaggagtcaaatttggaacgtataaagagatag

SEQ ID NO: 270178 - DNA, 805 bp, Homo sapiens
gtagcaacaaagcaatgaaaatgacctcattttgcttatgaagatacaccctatgttggactctatgatagagggattgggttatttccctgctgtgcccccagatctctaatggcccatccagacatctatttggctgcagcaaaggttcaagctaaggcatagatgacatcttcaaaagtcaaaaagtcaggtgtgatctggattttcataggaaattatcttcaaataatactgtcattctctgttttaagcaaattcttactctgtgtccttctcaaaaggacttgaactggtttttattaagttccaccattaaaaaaatgaaaacagacataaaattataaagcccattgggaaaatttaggttggaggtgtagggtggaaaagactaaggaaattaaggagaaatatagcaaatgagtatgtagttacaagctgagcttctagtaaggcaaagcaataaggaatatgggatcattttcatagcttatatctgtgtatcaagcacacttgaaggaaattattgcatgatactcacatttgtcattttttctagaccttttgcttaaaccattgccatggtttgaatatttgtgccccccaaaactcatgatgaaacttgtaaaccaaaaataaaatcctaaggccccatcccgccagccatctgaatggacttcctccttagccagggttcttttaaaatttaacctgagagactgtttcaggccatgataggaagtgggagtgggacatgcctcattatacctctctggtattaacatcaatacagactttaagtctg

SEQ ID NO: 270179 - DNA, 453 bp, Homo sapiens
cccctcaatgtcacatgggatttggccagtaaagaagcaagctcagaccttccccatcccgcagcatttcctgcagcggaggcttgctggctgccattagcgggcagctgaccctaatcctcccgctgacacaactccgacttgacacctggaacccaccactgtggagtctggacttccagaaccttaagtttaacatcaggctactacagtttctctccaaattccttagaaacatagtaacaccagtgaaatacattaagaaacaccttactacattttaatacattgtactttttattttatcctggactgtccgcttttgaatgactttatcacagcctcatttataaatttcttgtaacttttagacaaatgtgtgttcaatggctgcttttatttccagtactgtcctcaatcattttgccattagtgaaaatcacttactgagca

SEQ ID NO: 270180 - DNA, 303 bp, Homo sapiens
aaagactactcatttcagtccttgaaaatgggataccgtgagctttggaagtaaggtacgtgttggtgaacactgttgtcattgaacaggaaaaattaaattattaggtgagaagtttccacctagagattagtaacaagtagcctgaacaaattattttacctgtatagatgctaagacagatgtgttcttttaatttaagacctgagagcatgtttagagttgcacgtaatggcaataattctatgttgtagaaatagagaaatagtttttatttttcacttttggtgattgcatggatag

SEQ ID NO: 270181 - DNA, 399 bp, Homo sapiens
ggggaactttcatactgttttccacactggctgtactaatttaattcccaccaacagtgcacaagtgtttccctttctacacatcctctccaataaaagccacttcattttgagccattagtgaactgagagaaaacagcactatggagggagaaagtggattgtttccaagaagtaggtgggcaaggagcaatgaaggaaagataataccaaggcaaatacctggaggatgttaagccaagagcatcagaggagaaaaggaatcatcaagaggttggttagtgggtacaaacgtgcagttagaaggaataagtaatagtgttccacagcacagtagggtgactatagttaacaatatatgttttttttgagacagggtctcactctgtcacctaggtg

SEQ ID NO: 270182 - DNA, 338 bp, Homo sapiens
tttgttttcaggcctcaatcttttcctgactatggttagtaaaggggtaaggttgttttttcctgataagtggcttttttcattttgcctgcactaaaagcaagatatatcatgtctgacctttatcccattgaattgactgcctcctccacatatccaaagctgaattcatgatcttgcttcccaaatttggatcttcacaaatattctttcttacagggaaaggaagctccatccacaaagttcaagctagaaatctgggaattgaccttacaacttctcttttcccaacaccccataaccagcttattattaaatctggccaattttacttttat

SEQ ID NO: 270183 - DNA, 497 bp, Homo sapiens
tcagccaatctggagagggggccctggccaggtgttgggggagtagacaggtggcatggccttcagcttctccctcttctaaaagtataaacaggcatggttcaagttcccagaaaagtctcccatcttctgacagtcacattgtgtcaaagggccaggccccagatgagctgagaaaccatggctctatggccactcccaaccctgaagacaggggaggccatttgctggcctctaatttgctcaagagccagcccctagttatccctagcttgggtttcaccaagactgcctgactcagatggacccctcatgggtgactgccttttaggagatggtggtccctaccaggctgtttggcctgatctgtgtggtagcacccctcttttccaatccccccatctcctttctgctttggtctcttccaggtactcctaatgattggttgcatgtgctccagtgggcccagataaagtgttttttattccccttggaaa

SEQ ID NO: 270184 - DNA, 201 bp, Homo sapiens
atttttttcctattcccacagcatctgaggtaatttcctccactaaaatcttgaatacctcaaagttattcataagagttgaaatcaacttcttccaaattcttgttaatcttgatatttggacctcctcccataaatcacaagtgtttttattggtatctagaacagcaaattatttccagaaagtttttcatctttttc

SEQ ID NO: 270185 - DNA, 306 bp, Homo sapiens
cttcctgcctcctgcccagcccctgctgtcagagatacttggtgcttccagttctggagacttccttgagttctgtgactcaaaacaacttccttcccctgtgggcatcaacaatgagagatcttcagatgcgatcaggcactccagtccttccatctcccacaatgttggagacctgtgttccctgctgtagaaacctctgccattccctttatctctgaagacagatggacttgactgtcagcttagcttggtttcaggaggaaaggaagataaacccctgtgtttaagctgccgtgttaaatg

SEQ ID NO: 270186 - DNA, 433 bp, Homo sapiens
ggaagccagcagacacctgcagggatgggaactcctccagcaactccaggaacgtggggctgttggtgaacttccacttgctgtactctgaggactgaaagccaagggtgatgtgagcgactcagggcgcctgccctgctttggggaaaaggctgtcacaacccagtattcattcatttcttcactcactcaacaaacaagtccatgtgccaggcactgtccggggtgctgagactaccaagcttaagaagaaatagttcctgtcctggaggaactcagtccggtacacttatctaacttatgtgacttccactgtcagcaactcatgggctggggtcaaatctttgttgaatggcactttccccagctgtcgtgtcctaggcagtttgggtggtaggtgggcaaatcattaaaaacaaatcaaaatctcaaa

SEQ ID NO: 270187 - DNA, 380 bp, Homo sapiens
tttctttttttatcatctgcttcatttttcatttatctattttctctgtttagtaccagaagtcaacacttttgtcagcttctcggttagcactccccacccactgattccttgaatgctctgaagaccaatgaattccttattctatgagcctgacctttataggccaaaaaatagagagagaaataacaatgaaagtgaatttctactactgttatgtttaagtcacagtgcaggctgcttttgctttcctgagaaagtatgtcaagtgttttttaaattcttttttttaaaattcttttctttaaaaccttatttttttcttgttctttcttttctcttttttttttccttgccagcagaaagtgaaggaggcacac

SEQ ID NO: 270188 - DNA, 303 bp, Homo sapiens
gaccatgaactcagctaggagagcaatagaaagtcatttatggcttgttggaccaaaaggatcaaccttgtctcttgaacatctcttgtctttggatggacttttaagaggtacgagaaagggcagacggctggggaagcaccctctctgcttccctgctttgatttcactatgaagaggagccctttgtgggagcctgtgaaggctgattgcaccaggaggaagcctccttcccataggaaggatttagttttggcttagtgctccctgtgagtgcagcaacatcgggaagagtctctgggg

SEQ ID NO: 270189 - DNA, 253 bp, Homo sapiens
tggaaaagtatcttcagccatctcaaactccctgagaaggtgacgaaagttatccggagaatccagaagtgcgacgagaaacagatcacaagcttgattcagacgggtgtttaggaactaggaacacagtttaattgaattttctggtgagtgcatgattaacaggaaaccccttttttctgttgtattttgttgaaaaagatcttgctgaaattatacctattgtccttcttagtaagtagataaaaacaaa

SEQ ID NO: 270190 - DNA, 280 bp, Homo sapiens
gagaaagggaagaagggagaaaggaagggaagaggggagggaagagtctaaacctgggggtgctgaaccagtagaaggagatggtctctagggtctgctataagctaatagcttcagagctgtttgtgggaaggaaagcctcttgtcagtcaatatttactcaaggggagtcttgacctctgtgctgttcctcacgctgctttattatgagccacctttagccttcattttaaaacactcaaaatcaaacacactgctggccccagggctcctgcaaaca

SEQ ID NO: 270191 - DNA, 384 bp, Homo sapiens
cacggaccatgggctaaggatggggggaatttaagctttctgttgagatggctctcatttcagctgagggcagcgctctgaaaaaaaaaagatacagctgtgatcttattagcagccaacagtcattgcagctgggggagaggcacatgacctactaaagtggatttgaccagggcagcaatatttcctaccatctccaaatatatctcaccttgttgcccccaactccagtcattcaatttattagtctgttttcacactgctgtaaagaacctcctgagactatgtaatttataaacttacaattgtggtggaaggtgaaggagaagcaagcaccttcttcacaaggtggcaggagagagggaaaggggaagtggcactttt

SEQ ID NO: 270192 - DNA, 401 bp, Homo sapiens
cacccatatgaccccattttaacttcattacttctgtaaagacccgatcttcaaatacagccatttctgggtttctggggtgtaggctttaacatatcatcttttggggggaattcaggccataacactcatcttccataacttggtataagtaacattctcgggcttgggaggtggtgtgtgtgttgtgggggggtgtctacgttacattgtttagaaaacactatccagagggggctctcgcctttcagcctagacaataaactcacaaggctgggtcttctgcccccatgaagggccaggaacacatgtgatttccacattttctctcttttggtttccactcatccattttcttttcaatctcagaataaaagaattccacacagaacaaatctgta

SEQ ID NO: 270193 - DNA, 479 bp, Homo sapiens
agcgcatgtcctgggatcagatttaagaactatttagaaaaaatgtctgtattaacacttagctaaaatacgccactgatttgtaaagatattattattagcatttatacctttcttgtcctcagagtgatttgatgggatatgggcaatattctaaacaatattaaatcaggaaggctttagttttctaacatacaaactctcagagagctaaagactaaaaatttatttttctttgtataaccagtacctggcacaatactaggctattcatgctttgttgaactgagggctaaaactcagaaagttgatatcagagaattaggatgattggggcaagggctggcacacgccatctgcttgaggggttgtgttagtggctgtgcagaactttccattgcatcattacttttgttttttgtcaagaacgaaaggtatataataaaagttggctcaagagaagtgaaactaaagagaaa

SEQ ID NO: 270194 - DNA, 222 bp, Homo sapiens
gccgaaccacagcagagtgatgtcacctcactttcaggtctgctttcaaagcacatattaaagtttctgattctaccacagccacacattttctcagtcttcatcttccatccctgccttaagcatttcagtctatccagccaatctctctctgtctgtctttctctctctcgctcatacacacatgctcatatatacactcatactctcattcatcttata

SEQ ID NO: 270195 - DNA, 420 bp, Homo sapiens
agagagctaggatgctgttggaggagtaagtatgcatgaaacaatcataatttaactaatttgcccacaaatgttagcaggaaaatataccaaaaattagattttgttttccattcgttatttttcttaatttctaacataatttttaaacaaaactgagagatgtttgtcaaaacacctcccaagtgatgatttccattagaatatgaactagacacttttcctccagtgggataagagccagattttcctaatcacaaaaattagggcatggtcaggcaaaggagtttacatgaaaagttttgcaaaattagtattactttgaaaatttcaggctatttggccactgcaaccagggagtcacttaattcttggcataaactccagcacttttggaaattgacctaactctataaggca

SEQ ID NO: 270196 - DNA, 411 bp, Homo sapiens
tttttgagacggagtctcactctgtcgcccaggctggagtgcagtggcgcaatctcggctcactgcaagctccacctcccgggttcacgccattctcctgcctcagcctcccaagtagctgggactacaggcgcctgccaccacgcccggctaattttttgtatttttagtagagacggggttttaccgtgttagccaggatggtcttgatctcctgacctcatgatccgcccaccttggcctcccaaagtgctgagattacaggcgtgagccaccgcgcctggccttgttccaagtcttaagaggaatgccatttggtatcatgttggctgtgggtttgtcacagacagctcttattttgaggtatgttcctttgatgcttagtttgtggatggttttttactatgaagg

SEQ ID NO: 270197 - DNA, 1175 bp, Homo sapiens
ggtttccctaattattttggggaattgcgtgagggttgctttcaaacacaaggaatttgcacaaccacatggagtacatggttctctctggctctggctctgtctcccagcagaaatatctgctgccggtagctatggaaggcacctaagggctgctactgccacaggtgccgcctgcagctgacgctcactattgaagctatacttctttgggttgttggagtggtgacagtgctcttattctctctggaggtagaaaaatccttctcctcttgttgagatacagggatcccaaattagtgtgactggtgatcacaacatctcatcaatatttggtgaaacaggcctcacagctgttcatcagacaagtgaattaactgaccgattgttgtacttagaacctttgtccctctccaggactcaagcattatctgagtcccaagctcacttttcccagagaatgggcttcttgaaggggctgctttgtttctcagtacacatacaccattggccaacttgcctgtcaatcctacaggccactctagattctagagcaaacacactttaagtcccagcttggcttactcttctaagggaagaactcatgtccatcagatttatttgatgttattttctgaacaataaaagtgttcaaatagattataggaacattgcctaggataatatggtatagctgtggtttgtgatttatggtatatccatatgatcaggtacaatgtacaattttcaaatgatgattatgaaaattatgtagcaagatagtaacatggtcattacatacttttaagtagaaaaatcaggattcaaaattatgtgtgtattatgattaaaactagtattacttgtgattacaactattattacttatgattttacttacaaaggagtaattagagaacatagccatgttagggtgaggatcataagttatatcataatgaaagaatttatttttcagaatgtttattacacaaagtaataaaatatttactatgtgctaaaaattgttaccaaatattaagtattgcataatctttctgttttgtaaaacactgtccaagcaccagtattaaaggatcttttatctgtctgattactgcaagaacctggaatcaataaaatatggtattttttcttcatctcaaactttctct

SEQ ID NO: 270198 - DNA, 564 bp, Homo sapiens
gattagcctgtggtcaaggtttccagctctgtcactaggacaacttacctaactctctgtgcctcatttcttcaacaaccaaagggaacaatagtacatgcctcatggttgtttgtaggatttaatgagtttgcaacgtatttggaacaatgcttggcacataataaatgctgaataaatgtttgctgttattactccctgaagacagtcttggcaccctcaaggagccccagatgccagggaagccttcctaccagggggcctttcaaatgtccaggagtacctgctcatgtctcctcaaactcccagcttcacctgggctggatgagcaaactgtgagatgaggatcccacccggccctgcctcccaccaccatcaggcaaatgaccctgattcaagccttggtcaacctccacctgcccactgcccacctggacagccactggctgcagtttcaggaagctgcctcttcccctcaccctccccacggcccaggaatcaatgcaatcccctaaaagctcataacttggaggtaattataagaagcatcaattacccagcaat

SEQ ID NO: 270199 - DNA, 463 bp, Homo sapiens
taaaccaccccgaacttaatggcttgtaacagcaagcatatattccctgccatgtttccgcaggttgactaggctcagctgggcagttcttggctggtctcacttggggtctcttgggaggttgcaggcagaatgcgcctgggctggagtcctctggtcgctctcccagggtcccagaacagctgcctgtctacgtggtctcaaggccttcgctccctatatggcctttctatgcagtgtctccatgcagactttctggtgaagggagctgggggcttctcacatggaggctcggggctcctcaaagtgcagaaccagaagccttcttaacacttagccagaagctggcccagtgtcacttcttcctccttcctttggttgagctgttgtggccagctcaggtccagggtagggaagtaaattcttgatgggagaatgacaaggaattgtggccatcattaat

SEQ ID NO: 270200 - DNA, 492 bp, Homo sapiens
gcatgtactagtcaagtaatatctcatttttctgtaatctctataaaatattgtagtaacaagctaaccttaattgagcttttgttgctcaattatttttctaaacagctttacatgtattatctcacttgatctttaaaataaccatctgatgcaaatgtcattatcttcatgcacagataaaggaaccattgggggcaggtatcatagaatcacagtggtcaggtatagattgaagtagcagtttactgaactgattgtggctttaaaaggtggagttatcagcctagagatatgtggtccagggctgtgcaggagctctgcagggccatcatggacagacacctcaccctcctctactatgtagggcatgttcattttcttcctgatgtgttttgcctcatgcaaaatataagatggctgctgtagtttatttacttttcctggtcagctgtggaaggaagtgaagagcaagaaggcctttctttagtt

SEQ ID NO: 270201 - DNA, 1542 bp, Homo sapiens
agggtaaaatggaaaactggaatctatatttgaatgtgagattctcatctttttagctttaagattttttaagttttaccagttttcctcaaagagaagatgaagttacttcaagagaactgatttctgtcatgtgagtgtaggtaagaaaattcttaactactttgagatatttttcttcagattattaatgagttttttgcaccactagatagaatttccaagattttcctgcttacttttggaaacattgtctctaccattactgaatattaaataatagccatgtacccctccctcacaccatatacgaaaataaaattatttgtggcctaaatgtaagcgaaaaatctataaccttgtttaggtaatggtttattgatgacaccaaaagctcaagcagcaaaaccaaaaattgacaaattgggcatcattaaaatgaaaaatctttgtgcttcaaaaaatgccatcaagaaaataaaaagacggcccacagaacaggagaaattttttataaatcatatatctgataaaggatttgtatccaggatgtatacataacccttaaaacccaaccacaaaaagagcccaattagaaaataggcaaaggataaatatctatccaacgtggatacgcaaatggccaataagcatgtggaaagatgctcagcatcattagtccttagggaaatgcaaatcaaaaccacaagatactacttaacatctcctagaatgactgtaattcaaagatggacaataagatgtgttgggtaagatctgaagaaattagaatcctcattcactgctgagggaatgtaaaatagtacagtcactttggaaaaattttggcattttctcaaaaagttaaatacagaattatcatgtgacccagaaattctacttctagctacaaacccaagagaaatgaaaacatagatccacacaaaattttgtatgtgaatgttcatagcagcgttattcgtaataaccaaaaagtggaaacaatacaggtatccaagaaatgatgaatggataaacaaaatgtggcatattcatgaaatggaatactattcagctatcaaaagtaatgaagtatgaatacatattacatcatggatgagccttgaaaacatgctagagaaaggaaaccagatgcaataggccacatatagatgattcctataaattttcccatttatatgaaatgtccagaataggtaaatctgcagggacagaaagaagataaatcgttgccactggctatggagaagaaagaatggggagtgactgctaatggttttggggtgttttggtggggaggggaggttgaaaacgttttgaaattaggtattactagttatactaccttgtaaatatactaaaaagccactgaattgtacactttttacattacactatgtaaattgtacatcaataaagctgtaattttttaaaagtatggatagtgtcatgtacacccatgttaataatatggtactctgttattcctagatttctcttttgacagtaataaatttgatt

SEQ ID NO: 270202 - DNA, 324 bp, Homo sapiens
tccctgagacagtttggaagtggagggcaggagggttcaatgcgcctcacacccacccagtcagaaaaggttaaaaaggagcagcagcagcaacagagaaaactgagaaccaacaccctctccaagaagaatataggctttaaaaaatcatgacacctgcaaaacacgcaagcagctcttcctcacaggttccctctctgtggacctttttttgcgggggaagatggaatggagggcgaggaaagcagactagcacttaggggaggccggcctgtggatgcctggttggcggtgaaatgaatgctttattccacaaaggaaatg

SEQ ID NO: 270203 - DNA, 666 bp, Homo sapiens
cctgccaagctatcttttgccggggagattggcatctgtagagaatctgcattgaggcggccaggctttccctgaagctttctcttgtccttatctagaaaagattaacagagagcctgacaccttaaatatctgaaagatacatttaccatctattctccctgcaggctgctaaatgtgaggtttcatccatgtaacaagaccacttttgctagccaggtctcctcttggctctctctcccacaacctgtcttgccaccataacccgatttaccaccatcatctgtttttgtctatactctgagcccccattcttctgtaatcccaagatggtgtgtaagattctgtaccccactggggcatgggggcaatcactctgtggttctcacccatgcatgttaataaatttgtgtgccatttctcctcaaaaaaaaaaaaaaaaaaaaaaaaaaaaaccttgtttggggcccgccttgggcgcgtcgaaaaagttttctaaacaccacctgcgtggggccgccggggccccagacgggcaacggtgtaccacggggccacagcgtgccccacaggaacccccgggcccaagacgaaggcgcgggacttcccacccaataaaaaagccgccggggggcacccgcgcgttctggaccaccccagagggag

SEQ ID NO: 270204 - DNA, 583 bp, Homo sapiens
agatggcaggctgcgtgaacatgcgaacagacccagacggtaggaaacacctcccaaagtacccaaagtgatgggaatgatatgcactattaaaattacatcaacctgtgattccaagacctttcattatggaaccgaaacacagctgtaaacttcacacctcagttttcattctgcccttgaaaaggaacagaaagaaacaaatctcttttccaatttttccagctatttcctcaatagcttgaagatttagcattaacttctgcaggatgataccaggaaagctgagataaaccacaggccatttgaaggaactggattgccgctgcaggctccctgagatgctgaaaaactgtattgtattattttacaaattaaacatatgtggcaaccagcatcaagcaaactattggcaccgttttccaacagcgttggtatctccgtgtcacattttgtattgaagacatgctagaaactgtgcaactccctgtccacaaggaattcactgtcaagtaataagcacataattattccactacttgccatgtcttaaataaaactgtgttccagagtctgcccgtga

SEQ ID NO: 270205 - DNA, 366 bp, Homo sapiens
actctgttgcctgtcaggtaatgccattaggggttttaagtaagattgaggatgcactcttctaaggctatggaactgtccaacacagtagccactggccccagtgagatgtctaaatttaaattgtttgaaataaaacaaaatccataattcagttgttctattcccagctcagtgacttatttcggccggtcttatccatctgtggacctcaaaatcccaagtggtaaagaaggggctgacagaaggtctgcaagatctcttccagctcgggggtgttcttgattctgtggccagtcttggaaaaccgctcagaaggaatcatcttaaaatgatcaataaagcttgcatacctaaaaattcaaa

SEQ ID NO: 270206 - DNA, 802 bp, Homo sapiens
cgtgacatctccgccttacaatcttcgcttcaagagtcagtcttaaatcatgtaggttttgcttgaggtttgctcgagcaagatgaccttaggtttggtcttatttgcatttttaccataactaggcctacattctaaataagtaactaaatgccacctatgagtttcattaactgtggctgcttgccactttttagttctggttagggtggtgctattgttttcctcaggttcattagaaacatcttccgtgacagctctgacgcggcaccgatttctgagtgtccagtgttttccctaccattattttctttggtctgaagttgacacttaaactgtccagttttaaacctccgatccgtgttcccaaatgaaaacatgactttcattacgaattacacgtcaagggagcaaaccaaggcgctcggggcggcgagaaccgcgacacagcgcttcgcctggactggtaaacaaaccgccgcgcaggcgcaatggcaacaggacggtaacctgggtagccgccaatgggctttttcgtagagtgaaaagcggaaaagccaaacaaaacgctggttccaaggtgataaactggctgacttcctctatttttacttttttaaaaaattttgtttctgaagaagtagttgtgcggccttctgggcctcgcagagatcttcttcgtggaattcctcggccccagagaaatgccgctagcctgtcggctagttatattagcctaattttttgtcttgatctttttcatttgactgcagcactaatcctaatccactggggcagcaaa

SEQ ID NO: 270207 - DNA, 235 bp, Homo sapiens
tttccattaaaacagttcttttattatttctggcttcttactccataaggaattactaggtcttagattttattagtctttttgtgatgagtgcccatgaacttttgttgtttcccttgtgtataccagaggttatgcttgaaattactgtaactgttgaattatctgggagatagacacagccctgtccttgtggtctacgaacattgggaaacacaagtaacaatttcagtcg

SEQ ID NO: 270208 - DNA, 504 bp, Homo sapiens
gggctctgaaaagcccagactctaaaagctacatgtctaagattaaaaatcttagcttttcaaatctcaagctgtgtgatttaggtcaggttaacctctctgtgcttcaatttcttgaaaaaattgtgagaattaaataagtatagaaaaatgcttagaccagaaccaggcatggaataaccactatattaaaatgggtatataccatcatcatcattactgtctgtaatgggatgtaagggcggggtacagttcatcttcaagtgtagggtaacatgggtctgcacagagcagttaaggcaaagaaaagcagatgatgcttactgcatgtgcccagcctgcacccctcactcctctgaaaattctccccagttagtctctgttgggcacgtcatatgaattgtgggagaggggccatcttctaaaaatgcaagaagtaaagacagctgatttacaggaaaagaggatgaagctgatccacaaaccaaaacagagaggaaggca

SEQ ID NO: 270209 - DNA, 463 bp, Homo sapiens
aggtgtgatcatggaagatgccaccattgagttgggtcccctggttttactggagatgatgaggccaagtggcagcacttaattattaaagcaacactgagcagtgctggtttgaaggtctgcttcctcagggtgtgaatgcttacacaaggactatgtctggaaccaaaaggattttctcaggtgcctcttggtactttgtgtccagtaaaaaaaaaacataaagaaaactacaaaagcagcaacaacaaaacagcagaatgatgaataacttggattaagaatgaagatttgtgttgtaccgtcaggtaaagaagtcagtgaactgaggttctggctaagggcaagggaaatatggaagaagccacctgtgatgttataaccaataacagaaacaaagactgtatgagctttgtatgttttctctttgctagctatatgtatgtgttttgtacatgaaaat

SEQ ID NO: 270210 - DNA, 494 bp, Homo sapiens
agaagaaagaagtctacctatttgctagagtgttaaaattgttttgataaagctcaaaacttatctaaataagctctctctccctaagcatgttttcatttttataaaacagttacatatactttgcttaaaaatttaaaatacttttcacctcctctgacttcatttaaaattaaaataattaaagtgccaattttaagagatgttagctcccattattggttctttgccatattcttttgacaatctgctgtaattttctgccccctttaaagcctcaggctatagggcttctccaccaaaggaatgttaagaagtgataaggaccttctgtgagcagaagtggcttgtttgcaaagggactgcttatcttggccactcttgaacacaagatgggaccctctactgcaaagctctggcatgtttttttttcccctaagttatcctccatactactgacagtgattttccctaaataaaaaactgcttcaaac

SEQ ID NO: 270211 - DNA, 425 bp, Homo sapiens
cttgaaagctagataatcctagcttaaatgataaaatttgagtagagtttgaaaacactaaaatcagtttgccaaataaccagctctaatttctttataccaaagccaaacttcacctaaatcttacctaagaattgagttccttattgtaaccagataggagacacttttgtatattattccaaatattgcaaacctacaaggagtaaaaggtgttattattttaaagaagaaggaatgaggcctgagaggtattgattcacttggttgagggcttcaagtagcacaaggcaaaagcaggatttgttgacttccaaacctgttttcttccttcaccatgtggcctttgcatctttcccacacaaatattattccacaaatatttattgtcaccaactataataaaagaacagaactatgtatca

SEQ ID NO: 270212 - DNA, 283 bp, Homo sapiens
gtacgaaaaaatctagctatatgtgaaatgactgatgtgaaacagcttggaatagaaggaaaatactaatgaaatctgggatagttagagtcgagcctcatatttcttgagctataatttgatacacacatatacatgtatacataaacacacatacacacattcatttttttcctctaaggtattcttacagagaacacacatactttttggctggctgggattagacatgagtatgtcacttgatcttttcaaatataccaccactattgaaaaaattcga

SEQ ID NO: 270213 - DNA, 423 bp, Homo sapiens
ggcctcctccctgatgtggctttgttctgtcttctgcttaatgccacaggctttggttcctgccaccaaatgagccctcctattgttaaactctgagtctttttttaggctatgcctgcctcctctgcaccctttactcttattttcattttattgattgcctatgtggtttttctcccaaaaatctgaaagtggtatgggagtcagtctgcctagttctctcttcttccttgttttccccaagataaccgcaaagtcccttttggttttaagggtttactgttaataactacaaaaaagcccaaacctagcagtgacaataaatacagtgaagtcacaaacttaaaaaatccttcaaagtttctgtagcattggtctctaggctataattatggctccccttcaagatggtaactgaaaact

SEQ ID NO: 270214 - DNA, 986 bp, Homo sapiens
accatccttctgcctccaaaatctcctgaacttttttcctaggtgaataaccctgttattccccaagttgcccaaaccaaaaatccaagagtctctgttatttctactcccttaaatccacaaagtcgctatcatttctaggtcctaaataccttgtatctgtctcctcctccccagcctcctgctctgccctttaggcatgtattgtctctgtctggtagtattacagtcacttcccaactctttctcctgctccatttctgcctctgtcttctcttcaaaaacaaaaacaaaaaaacatggcttccagagtgagctttaaaaaatgtgcttctcctcacatcactcccctgatgaaaaccctcatcaaacaaggaaatacattgcagcttgagcctcttctaccttcctgggccaaagcagacattgctaatcaatcactgcattgcgtcctgcaaggcaggatttggactcagctttgctatgagttcattgggttgacaagagagatgagaactatttgacatctcaggatccttcctcatctgccctctgcctgccagccttgttcctgctgctcctcctcccttacctgcattgtagaattcacctcccagccgtcctgagctcaggggagttctgagtgactcataccaccatacctttgcacatgcagttgcctctgtgtggaatgcccttccccaagtgtgtctgcctggaaaacttttactttactcaggtgccatcctgtccatgaagtctcgagatttaggtatttttctccaagcccccattgccccatgaccaggtgttcattttagggagcacccccttgcactgacgttgttggttagcatgtctgagacagagataaggcttatgcgtcttcacacccctggtacctgccatggctccactgtgctcaggagctgtttgtaaacaatcaaatgggtgatggaataaatagcatctgtcttactgaatgc

SEQ ID NO: 270215 - DNA, 586 bp, Homo sapiens
ctaaaaatatgtattcatgagaagatggtttatagaaagggcattagttctagtgtaaatgttccatttgtaatcttcacaagaatgaactatcttagaattaatacaaatcaactttattctctacttctacaaatccttaaacatccgtatcaaaggtcttttaaacttccagcatagtcttaactttgttaaattatcaattctttcaggcaagttatccatcatcttataatttttgcaaatttgtatttgggtttgaatcccaacactccatactagatgtgctaccagagcaagttacaaatctttctaagtctcagtttttataatctctaaaatggacataatatgggaacctacctcttagtgttgatgtttaggttgaagtttaagaaaatgcacgaagaatgtgacaaatagtaagaacttactgcaagttattatccactgttgttttatattccttattataccaggaacgtgggcacacaaaaatgattttttgaagatgctaatgtagaattaatgtacaattgaaatgacaggcatactcaggatgttgtgagtgagattaagattggag

SEQ ID NO: 270216 - DNA, 446 bp, Homo sapiens
acattttttaaaaaataaaaagtaaattcctaataatcttatagggatattatctactactattattttgaatttcaaacaactgcctgatatacaagttcactcacttgtactggctctttttctaaatgactaaggcctgcatcatattcatatatatataaatatatatatatatactcaaataagtgagaaagttgtacatatttatccaaagtatagcagcaagaagttgtgaccagtctgaaggtgttgcttccatcctgcactgttcattacaataaggaaaaatgtgctttcgagcaaagtatttgtatgcctggcctctgtgaaaagggctttttctttcttttaaaagtttgagtgaaaatgattttaccacttttgagttatgtgaggatcccaaaataataaaaattgctcaaatcttctttggcttatgttac

SEQ ID NO: 270217 - DNA, 433 bp, Homo sapiens
ccatccacatttcaaatgacagcattgtcaggctttggctatcttccccttctgcaaatgggaaactgaggctgcaagaagggaagtgacttgctcaaagacaccttgcaatttggtggcagcctggagctcagaccccctgactcccatgcagggcctaccactccatccccctcaaaacccacaaagattccgttttgttctgtcctcagccaacgcggtggcccacccaccttgggcgaccagagccaagaggttgtttgtctgttttagacactctcgtcgctgtgtttcttctttatcttttaagggctcgagactcaggaaaaccaactcaacgtgcataatttggcaattatttcttgtgttcatcctcacggccgtggctgcatacagatattggaatttgcataaaacaatcttgctcccagta

SEQ ID NO: 270218 - DNA, 445 bp, Homo sapiens
tttatatatagccaggttttgttaattttttttttttttggaaacttgtcaaatctcttagttcccagtatcctgcagtttcacaatgacgtgccttgatgtgggcctgttttcatcaattgtgtcaggcattgggtgcaatcttttcttttagaaatccatggccttggccgggcacagtggctcatgcctataatcccagcactttgggaggctgaggccggtggatcacctggcagtttgagaccagcctggccagccttgccaacatggtgaaaccccgtctctactgaaaatacaaaaaattagctgggtgtaggggcgggcacctgtaatcccagctactcaggaggctgaggcaggagaatcgattgaacccgggaggcagaggttgcagtgagccgagattgtgtccaacctgggggacagagcaagattccgtctc

SEQ ID NO: 270219 - DNA, 242 bp, Homo sapiens
tgtatttacagataggtcaagaagaaagttgggactcttaagtcagaataagttaatatggctatacatttaaatgctaataattcaatcattttaaaaaggagagattgatcaggcatagtggctcatgcctgtaatcccagcactttgagagtttgaggcaggacagctgctggataccagtgagccgagatcgcgccactgtactccagcctgggcatcaacagtggaactccgtctca

SEQ ID NO: 270220 - DNA, 613 bp, Homo sapiens
agcctcactccgtgacttcctggaaggggagaggtactgaggttgagtctatccccaatggccaatgatgtcatcaatcatgcctaaataatgaagcctccataaaaactcaaaaggatgggatttggagaacttctggaatgctgagcatgtggaggtgcctggagagggcatggaagctccacatgcctgcccacatactttgcactgtgcatcccttccatctggctgttcatctgtatcctttgtaatatcctttataataaataggtattatggtttggatgtatgtgtccctccaaaattcatatgctggaacttaaactctaacgtaatagtgttaaaaggtgggatctttggtgaagtgattaagtcaagagggttgtacccttatgaatgggattaatgcccttataaaagaaaatgaagggagtgcccagccctttcagccccttctaccatgtgaggatgcagcaagaaaatgccatgttggaaggagagagtagccctcaccagacactgaatctgctggtgccttgatcttgaacttcccagtctctagaactgtaaaaaaaaaagtgtttattatttataaattacccaatctaaggta

SEQ ID NO: 270221 - DNA, 449 bp, Homo sapiens
agcctcactccgtgacttcctggaaggggagaggtactgaggttgagtctatccccaatggccaatgatgtcatcaatcatgcctaaataatgaagcctccataaaaactcaaaaggatgggatttggagaacttctggaatgctgagcatgtggaggtgcctggagagggcatggaagctccacatgcctgcccacatactttgcactgtgcatcccttccatctggctgttcatctgtatcctttcattgtgagaacaagctcattcttgtacctttcctccgtggatttggtgatcacaacaagggacttatccatcattggagtggccacaatctgaacaagttccacccactgcctgagagtcctgccctgaattttagactttgatcataaaaaaatggataatataatttaacagtgaataaattagatatcaatgaagttg

SEQ ID NO: 270222 - DNA, 420 bp, Homo sapiens
gctggcgacaggcgtaaataaaagttggatctgaagatttctgcctcggttaatgtggaagtctcacgcactcctgatttgatattttggctgaattcctagcttcaggagaaaaagcttttaattgattaggagaaaaagaaaggaggaatgatagtgaaaagatggattctcaaaaagatcttagaagcacataggaaatatttttgacgctggagaaaaaagtcaaatgcaaaagactgggcgtgaggtttgattttgtgtagcaattattatgcaaataacacacaaacagaagagattgtagttccattatgagaacacagccttgctgcttgtttataaaatgagaacgtcagggtaatatacagttttcttcaaatccacaaacgctccatattgagactgatttaagtgact

SEQ ID NO: 270223 - DNA, 567 bp, Homo sapiens
gacagagagggattgtcattatgtaggttttacatctggatatgatatgcagcttctcccacactggaaaatgagctgcgtgcataaccaattggaggcgtgtaaagagttaggagcaagatccctgcttttgtgcatttcactccatttgtagccacttgttgcactccatctggaaagaaagaagccgctgcagggcatgcgccagacctgcgctgggccgtcgcttccattgtacggaagatgaacaggcggcgttattttggatcacatagcagcttgttcaaaagcatcttgcattccccagctgttccacaacttcttcgcatatgggagagaacttgccagctgctggggcaactgtacttacatttgctgcctttgttcagtaaacaaggaaggtaaaaagacaggcgcctttgttaaactgtagtcattgtaaagagacttacttgtttctgttatgtcaatgttattccagatatagtctgtcaggggaggcggtttaaaaggaaatgtcagaattaacatttttttttaatccaaataaatgttattttagggtaa

SEQ ID NO: 270224 - DNA, 484 bp, Homo sapiens
agaagtcctcatatattgtttactcttatcattttctcaaaactgtgattattagacccattgctaggtcttaggtacagtttttacaggttgagtatgtcttagccaaagtgcttgggaccagaagtgtttcagatttctgaatatttcattatacttaccagttgagcatctctaatccaaaaacctgaaatccgaaaagctccagtgagtattttgtttcagcgtcatgtcagtgttcaaaaagttttggatttgggagtatttcagattctgtatttttagaatggggtgttcaacctatataaaaagggggttaaattactgtatcttacatttgatttttatattattttgaaaactgtctcataattaatttctttataaatccgtgtattttattatacacattaactgttgttctaagaaagtgttcgtaggcttcctcaggctgccataaagattgataatacaaaagagattt

SEQ ID NO: 270225 - DNA, 307 bp, Homo sapiens
gaccctggtcaggagacatcacagacaggctcccttctcccgccttcattcagggctctgctcaaacagcccatttgcaataggacttcctgcagtgtcctagttaaataccccaacccatgcccccatcgtacgctatcccttcccctgctttatgtttcttcatggtgctcagcaccctgacatatctatgtctgtatttgtttacttattgttgggtctgtttttgaatgaagtgctatgtctgtggtgtaaagtccaacatgtggcagattctaggtgctcaataaatatctattcagtgaat

SEQ ID NO: 270226 - DNA, 422 bp, Homo sapiens
  misc_feature (57)..(57): n is a, c, g, or t
  misc_feature (88)..(88): n is a, c, g, or t
cccccgaattggccaccggtgctcacagccccactgcattgttcgcctctgacgggntgcagatggtgcacagaaggccacccacttntgccacacatgctgggagatgtagttcttagaatatttaaacaccagcaaaaactacagttattaaagagaacagtgcctaagggactgagctgagcttgtaagaagagcacgcctgcttgctaatgattacagcggtagcagaattccatctagggctggataccaaggccagtaatgcctgtaatctcagcactttgagagaccaaagtgggaggatcacttgagcccaggaattcaagcccaccctgggcaacacagcaagaccctgccactccattattttttaaaataaaaaataaataaataaaaatttgtttttctatagcctaaag

SEQ ID NO: 270227 - DNA, 498 bp, Homo sapiens
gattcacaggccaagacgctgccttggcgcagcactccccgtgttgacgtggaaggtggtgatggcagtgagcaaaaaagtgatccatgcacagatgcatttgtgaacgccggatgaaacaaagttaaaataggacccagcggatgaagtggactgaaacactgaatctgaaacattgatgatcactacagcaaagggaagagctcggtaaattgtgcatatcgttcttagatcttccacccaaaagtaacacttccacttacatgtattggccacgagacaggattgtgccatgttgcccaggctggtctggaactcctggactcaagtgatccacccacctcgaacctcaacttcctaaagtgctgggattacaggcgcgaaccactgtgtctggcctccgggtggttttaagtgggaacttttatttctcacacattcttctgtatattctatattttctacaagaaatatatattacttttctaatcaggaaaa

SEQ ID NO: 270228 - DNA, 540 bp, Homo sapiens
atctactctgcaccaataggcatactgcatgcaccgtgtgcacatctccatgatcacccatgctggcaatgtgtgctaaacccgtgcatgcctgccgagcacacccacagagtgaacacacatgggcacacacatgcacatacataagaatgtcactatagtagctaacattaattgaatgtttactacatgctagggacttttctatgaaataccttctctagtcctcaccacaactcatgaaagaggtaggataatcatctccattttacagatgaggaaactgaggctcagaaaggttaagtaacttgcccaagatcacacagctagaaagtgacagagatgagaagactgaatgcagagaagctcaaggtcaaaagcaaggtcagcctgtactgagtatgagcacacacacatcccatgttctatttcttgtgctcagtctgcaaagctggaacatgttcctaattcccacgcactctggctgagtgctcacatggaatgcacgtgtgcccatgagctcacgtttacatctgagtg

SEQ ID NO: 270229 - DNA, 794 bp, Homo sapiens
tgaacgggctgtcatgtcccccagctaccacggattggctcagtgaagagaggctgtggtcacctctgcatggtttcctggtacaaacacaaatttcctttcctctggctgcattcctaaaattaattaaatcttggctcaagaaggcttcttcatgccagcaagatgagaagactgaatgcagagaagctcaaggtcaaaagcaaggatgtcagctccatgaggttggggaccttgcctgttgtattcacttctatctcctagaacagcggctggcacagagtctttccaactcaaatggttgcaaggagaaggaagaggaggtagagaagaggaacgctgtttctagtgcttaatgtgtcccagaccctattgtagaggcttcagacatctataatggcatcttcaagagacctgtgtgcaccttgtctgagttgaagtacacaccctgaagaggagccagttatgaaggaccaaatgcacatattaaaattaaacatcacacgattctcaaagtattggttattaatgcccagtggtctcacttgcgctgggatccacattatttctgtgcacatttggaagacacattatcatggcaaactgccaggctgagatgaactgtgggttcaaccaatcaccaaagggttcattcatttatccctgagacaatttcctcagagaggaaaaggcacttgcctaaggtcacactgctggtaagtggcaaagccgaggtgtaaactcaggcaacctgtctctaagcacctcacataggcggtgcttcagtctgtttg

SEQ ID NO: 270230 - DNA, 434 bp, Homo sapiens
tcttacatttcagtcatttatttgcagacatctataatggcatcttcaagagacctgtgtgcaccttgtctgagttgaagtacacaccctgaagaggagccagttatgaaggaccaaatgcacatattaaaattaaacatcacacgattctcaaagtattggttattaatgcccagtggtctcacttgcgctgggatccacattatttctgtgcacatttggaagacacattatcatggcaaactgccaggctgagatgaactgtgggttcaaccaatcaccaaagggttcattcatttatccctgagacaatttcctcagagaggaaaaggcacttgcctaaggtcacactgctggtaagtggcaaagccgaggtgtaaactcaggcaacctgtctctaagcacctcacataggcggtgcttcagtctgtttg

SEQ ID NO: 270231 - DNA, 367 bp, Homo sapiens
acaacaataataaaaagccaaacagtacatacacaatggtttgcaagccccattacattaggaatgaaggggagtgatctctgaaagatggggcgctctcagggaaagatgagtactaccatcactcagcttagtgtcctaagaaagttctcagactacagcccaacaagggggaacctaagcagagcccagcagattccctacaatggggagacagaactgagagtcccaggaaaccaaagcaggtcaaggtcacaagataaaagtactgaaaaagggaactccacacatggagactactctgggatcctgtgatgtgttcctctcaagtactgaactgggcactgatcagcataaacaagtgaaa

SEQ ID NO: 270232 - DNA, 537 bp, Homo sapiens
aaagtaaaatgtacccattttaagtgtacaatttgatgtttgacacatttatatatctgtgtaaccaccacaataatcaaggcataaaacattcccatcaccacaaaaagttctctcatgtgccttctgcatgacctttgaatagcccgttggatattcttgaaggtgaaaaacctgtttataaatatctgagcctagaaactaattacatatatataaacacaaaatatttttagcatagttttaatgtacacttgattttccagaaatgtaactgtgatgtaagttgagaacaaaatggtattttgttcagaattttgtcagaggtttgctattctggaaaaacatgtcagagacagcatcagcttcactattcatggcatttgagacaagaagtcaacattcctctatcagtctgcatttgtagctaccacatttatgtgattctacataaaggtgtaaacacctatttcattatatcttttatggtgttcatgtctgcacatttacatattaaaatatatattattataaaaa

SEQ ID NO: 270233 - DNA, 377 bp, Homo sapiens
aaccagatattgtcctaagcatatatatatataaaatatatataatttacatatataaaaatgtataaaatatgtataatttacatatataatatatataactcatatatatataatactcattcgatctttataacaaccctataaggtaggggtgctattcatatcctcatttcacatgggaggaaactgaggcacagcaaagcttagtaattcgcccaaggttatacagtagtggaaacaggatttggacccaagcaatttacttctggcattggggctcttaaccagcctagtatgtctcataaactgaaatcagatctattttttaaaagcttttttgggttccagtctcttggaagttacttcttaagaaa

SEQ ID NO: 270234 - DNA, 344 bp, Homo sapiens
aaggatcaaacctcaggacactcccattttaaaaggtcaagtacaaagaagatggagaggccaggtgtgatggctcacacctataatcccagcactctgggaggccgaggtaggtggactgcttgagctcaggagttcgagaccagcctgggcaatgtggtaaaaccccgtctctaccaaaaatacaaaaaaaaaatagccaggcatggtggtgtgcacctgtagacccagctacttgggaggctgaggtggaagaatcacttgagctgatgttgcagtgagcagagatcacactgctgtactctagcctgggtgacagagcaagacccatctcaaaaaaaaaa

SEQ ID NO: 270235 - DNA, 152 bp, Homo sapiens
aactagaaaccagtaacaaaaagagaagtagaaactcctcacgtgtctggaaattaaaacatacttttctgatgtgcccattggtcaggaaaaaagatcagaatggaaatgagaaagtaattcaaattaaatgattgtgaaattactaaaca

SEQ ID NO: 270236 - DNA, 531 bp, Homo sapiens
cacgagggtgtgccttctcttctcctgaccaccagccccagccttacttgatttgagggagcagaaactttgctctgccatcctaactttccttttggttactgtggcctacagcttcctcaagtctttgtttcagtcccattaaaggaaagaaagtggctttcagggtacctgtgggagaaaaggaggagtagaaataaaaaaaacaggatatatatagattctctacgttctttgaggaacaaaagcattaacacatttaaagtttctaatcacagtgtctggttcattacaaggacctaagtcatagtagctattatggtttgtgatagattcattgcaaacataggcccaattctctatattttcccacatccatgctcctttccaatgtgactttgtagctcctcctattaagcgggggagactactgcctcattccttggatctgggagaccttctgacttgctttggccaacaggatgtggggagatgccagtgatggaatgccagtgctgagcgaggccttca

SEQ ID NO: 270237 - DNA, 397 bp, Homo sapiens
ctcatgagatctgatggttttataagtgtttgacagttcctccttcacacgctcacactctctctcctgctgccttgtgaagaaggtgcctgcttccccttttgccatgattgtaagtttcctgaggcctccccagccacgcagaactttgagttatttaaacctcttccctttataaattacccagtctccggtatttctttatagccttgtcagaacaggctaatacagatggtatcaagagtacaccaggtgaaatccatggaaggcatgaaaagaaagaggaagactgactcacacggacattaggctgaataaccatgtgagatgtgcagggatagacagaatataatgtaaatctatgcttcttaaactttgatgtgccttgaatcacctt

SEQ ID NO: 270238 - DNA, 653 bp, Homo sapiens
ttacaaccccacgatcacaaattatgcagtcgaggtgccgatgaatagcgaggtctgagggaggtctcaccaatcagcatctcacctgtgccctctttgtcttctcttgtgtcagccaggggcagagaatcatggggtgtctctcaggagaagccggggggagggggctgagaagctcctacttggtgttttgagtgaagggcatgtcctccccagaggacggagctggatggagacttggttggtgagaggaagctaaggactctactcccctggggaaggaagctgagatggggatggctctctcctccccagcactccccctgctccccgcccatgtccctgctgtgtctctcactctcttgctcatctcccagttgtctgttcatgtttctttctactattaatgaatgctgagcccttataacaggagctggggtggagacatcacgaggggtcgggggacagcaaagggcaggaagcaggatgcagggctggcaggaggtgggcctgtggcatcagcaggcccagcgggcgagtgtggtccctgcagcagcttcccacctcctttgttcataaggagcttgtgttggcctcccacagtcctgtctgctggacgtttttcagagttgggttctctctctttgatgtct

SEQ ID NO: 270239 - DNA, 827 bp, Homo sapiens
tctatgaaatgaagtttcccgatctgtgtgtatactgaattccaagagcctgagctcctcaaggagatggggtctgaggaggggctcacctcacgcccaccccgaccacatggagatctggctgtgatctctgagaaaacatcaccttagatggcagcgcctcccaggctaagccaaggtggagactctctggtccttcttggccctcctacctcctcctcgtcttccctgagggaggtctcaccaatcagcatctcacctgtgccctctttgtcttctcttgtgtcagccaggggcagagaatcatggggtgtctctcaggagaagccggggggagggggctgagaagctcctacttggtgttttgagtgaagggcatgtcctccccagaggacggagctggatggagacttggttggtgagaggaagctaaggactctactcccctggggaaggaagctgagatggggatggctctctcctccccagcactccccctgctccccgcccatgtccctgctgtgtctctcactctcttgctcatctcccagttgtctgttcatgtttctttctactattaatgaatgctgagcccttataacaggagctggggtggagacatcacgaggggtcgggggacagcaaagggcaggaagcaggatgcagggctggcaggaggtgggcctgtggcatcagcaggcccagcgggcgagtgtggtccctgcagcagcttcccacctcctttgttcataaggagcttgtgttggcctcccacagtcctgtctgctggacgtttttcagagttgggttctctctctttgatgtct

SEQ ID NO: 270240 - DNA, 285 bp, Homo sapiens
tatatttttgatgctcaaatacttctacatttgtccattgaaagtcctctgactatagcttctgtttccttttgaccaatttccatcatcttttgagcacttcttggctttctggtacaatacgactggctggaatcttcaaagaagtcaacatcccaagagatgaaatgatggactcgctgcttgacattgcagggaatgaaagaatcatgtcaagccatgcagtgtggtcctagattggatgctaaattgaaaataaaagctctcactttggactgtatttta

SEQ ID NO: 270241 - DNA, 1338 bp, Homo sapiens
agcggcaggccttccggcggtcgttacgggacgccgctgccatctacagcactccgtgaagaatatgctggccgccttcatctcccgcgtgttgaggcgagttgcccagaaatcagctcgcagagtgctggtggcatcccgtaactcctcaaatgacgctacatttgaaattaagaaatgtgatctttatctgttggaagagggtccccctgtcactacagtgctcactagggcggaggggcttaaatactacaggatgatgctgactgttcgccgcatggaattgaaggcagatcagctgtacaaacagaaattcattcgcggtttctgtcacctgtgcgatggtcaggaagcttgttgcgtgggccttgaggccggcataaacccctcggatcacgtcattacatcctatagggctcatggtgtgtgctatactcggggactttctgtccgatccattctcgcagagctgacgggaagaagaggaggttgtgctaaaggaaaaggaggatcgatgcatatgtataccaagaacttctatgggggcaatggcatcgtcggtgcacagggccccctgggcgctggcattgctctggcctgtaaatataaaggaaacgatgagatctgtttgactttatatggggatggcgctgcgaatcaggggcagatagccgaagctttcaatatggcagctttatggaaattaccttgtgttttcatctgtgagaataacctatatggaatgggaacatctactgagagagcagcagccagccctgattactacaagaggggcaattttatccctgggctaaaggtcgatggaatggatgttctgtgtgttcgtgaggcaacaaaatttgcagctaactactgtagatctggaaaggggcccatactgatggagctgcaaacctaccgttatcatggacacagtatgagtgatcctggagtcagttatcgtacacgagaagaaattcaggaagtaagaagtaagagggatcctataataattctccaagatagaatggtaaacagcaagctcgccactgtggaagaattaaaggaaattggggctgaggtgaggaaagaaattgatgatgctgcccagtttgctaccactgatcctgagccacatttggaagaattaggccatcacatctacagcagtgattcatcttttgaagttcgtggtgcaaatccatggatcaagtttaagtccgtcagttaaagggaggctacgtgtgaatttatcatcagtctctcaatggaatgttcatggtcaaatttaagaaactgtgttctcaactcaaggaggaataaaactcataaaacaaa

SEQ ID NO: 270242 - DNA, 350 bp, Homo sapiens
cccagttggattacagagaggaaagaatggaaaaaacagaacaggacataacagatgtgatcaaaaggcctaatatatgtgtaattggagtcccaggagtgaagagtgaaaatgaggcagaaaaaaattcaagtgagaatggctaagaatttccccaaactgatgaaaggcatccacccacaaatcccaattttgtacttccaaccactgttataccacccccctcaacaatgcctataaatgtttgttgaaaatgagtgaatgaatgtactccaatcattttctcacttggatgttccctactttttgctcttcttagaaaataataaatggtacaataatatctccca

SEQ ID NO: 270243 - DNA, 525 bp, Homo sapiens
atgaatgagaatctcttgtctactatttgcaagaattgctgcgtattttctaggaagaagtccactgctttagtcctattctgaaaggcatttggtgttagacacaagagaacaggttccctggctgacattttcagaggcccgtgcccttcggtcttcaggtgaggctgggcttgagggaggctttgtggaacggtgagaagaacagcgtgactaaggcacagaaggctgagtgatgccctgcagtgcttttgtagggttggaggccagctgggaaagaaggaacccttgcgttagagaatgggaacatgccttaggatatagaaatggcaaatctgagatagtttgaagtgagaatactagaagtgttcccaccaaacaaggtgtgtcttggtgcctgctgtatcccaggctccgtgaggtgccggagtcagcactgaacaaacagagcttcctatgcttgcggaaatgcatttcgttgggggaagggatttttctgctgactctggctattaatagtaacaa

SEQ ID NO: 270244 - DNA, 498 bp, Homo sapiens
atgaatgagaatctcttgtctactatttgcaagaattgctgcgtattttctaggaagaagtccactgctttagtcctattctgaaaggcatttggtgttagacacaagagaacaggttccctggctgacattttcagaggcccgtgcccttcggtcttcaggtgaggctgggcttgagggaggctttgtggaacggtgagaagaacagcgtgactaaggcacagaaggctgagtgatgccctgcagtgcttttgtagggttggaggccagctgggaaagaaggaacccttgcgttagagaatgggaacatgccttaggatatagaaatggcaaatctgagatagtttgaagtgagaatactagaagtgttcccaccaaacaaggtgtgtcttggtgcctgctgtatcccaggctccgtgaggtgccggagtcagcactgaacaaacagagcttcctatgcttgcggaaatgccagtaaacaagatcctgctagagtca

SEQ ID NO: 270245 - DNA, 389 bp, Homo sapiens
tgcattgcaaggagcccagaggcaggtgaggctgggcttgagggaggctttgtggaacggtgagaagaacagcgtgactaaggcacagaaggctgagtgatgccctgcagtgcttttgtagggttggaggccagctgggaaagaaggaacccttgcgttagagaatgggaacatgccttaggatatagaaatggcaaatctgagatagtttgaagtgagaatactagaagtgttcccaccaaacaaggtgtgtcttggtgcctgctgtatcccaggctccgtgaggtgccggagtcagcactgaacaaacagagcttcctatgcttgcggaaatgcatttcgttgggggaagggatttttctgctgactctggctattaatagtaacaa

SEQ ID NO: 270246 - DNA, 318 bp, Homo sapiens
tgtttgttgatttaagttccttataggttctggatattagaactttgttcaatgcatagcttgtaaatacattctttcattgtttaggttgcctatttagtctcttgaatggttccttttcctatgcagaagctcctttgtttaactaggtcccaatttttctttctttttttttttctttaacaaaatttttacttaataaatggttaaaatcgcagtgccaaaaatacattcacatttagcaatttcactgaaaggaagaaactacagaatgcacggtttcagaaagctattttaagttatttacaaataaagtat

SEQ ID NO: 270247 - DNA, 458 bp, Homo sapiens
caaactgctgggagtttcaaattcaatttagttgctttctaccagtaatttttaagtagagtataacagaattaaaatgaaaatagaattgtatcacaagtagtaattttaaaggttatttttcattaaacctttgcagttttttttttaatttaaatatacacataagctctgtgtcataatgtatcaggaatttcttaatttttacttgggttgaagttaaacattttgaaagccaataataaagagttatcaattggctgaggaagagatcagtaaaagggaaaaaagtaacagaccactctaataggagaagaaagagaaaatgagggtgtgaatcaaagtaaaggaaataaaaaagaaatgtcagatccttttgggaggccaaatgcgagtggatcacttgaggtcaggcattcgagaccagccttgccaacatgtgaaaccctgactctact

SEQ ID NO: 270248 - DNA, 283 bp, Homo sapiens
attttttgttgttgttgaaaattgcatatttgaaactaataatgtagaagccctggaaatcagaccttttctcttccccaaggtttactgttaccgtttgtattttgtggggttattgttgccagtctctgtgctaagtattagctttttttgttaacttgtggtcttaagtattttctgagcctgcatgtttccctggttatgtgccatgactttctcatttcctctgttgttttcaaatgccctggttatcaaggtctgtctcccaaaatgagaaaaagta

SEQ ID NO: 270249 - DNA, 362 bp, Homo sapiens
cgcgctccttccgggctcagacgccctcccctcgcccctccgcctcaccgctgccaggggcggggtcgctgctcggcccgctccgttcctcggccttccaggcgaagggcaagagcgagccctggcggaccgtgcggaggggtgcagagacctggatgcggcctgcgatctccttccccgccccggcgttctccgcccacccggggtccttcccgccaaaacctctcacctacaagtacagcgcgtcctaaatttggcaccggcaaagaactgtggctgagcaatgcgttgctcacaggctcctttctttgtgtccttttctcttctcgttgctatatataataaaaccctccacgttttga

SEQ ID NO: 270250 - DNA, 480 bp, Homo sapiens
cattcaacacacaagaaggtcaggagactttaccataacaaagattaaaatgttcgttcataaggttgcagatcccctagttcaccttacttattagaaaaaaaaaaaaaaaacttagtttttgtgtaaaaaatcaaagaatattcatatcttttcagaaaagcaatcaaaatattcctccaactataaatctctgggagcctgaattttctttatatacttaaataaaaacaacatattgctaataattgaatgcagaaacatatataagacccagctacatcacaataaaccagaaactgaagagatttgtaaaaatgtaaaacagttaccctcatctaagttttgttgtaatttgcttctgtagtaaaatatcgtcttcatagatatacctacattataaatattttgttcattttaacatgtattttaatattcttattttaaataacataaataaatatatttttaattctcaaa

SEQ ID NO: 270251 - DNA, 407 bp, Homo sapiens
ttcagcttgcccgtggccaagtaactagcagaaggaggaggctggtgttcaaaggcagccacaaagggcttatgggcccacactcaagccccccaccactcgtctgccctgtacacgtgatcatatggccaccacctacatatttacataccacctacataatgtggacaacccgtctcagattcaaattgactctgtagctgcaacattcctgccttctcctcactggagtattaacaggctctggtagaagtggaatgatgacaatcagaggacagacatctctctgggagctgcttttccctaagaccagggatacaatttctgaacacattcttaattttatcccatgtatctagacattaatcctagtctgataaattcctggagtgccctcacgctacatt

SEQ ID NO: 270252 - DNA, 500 bp, Homo sapiens
gtgacctctctgcacctttcctcctctgtagcatgttcccacatgaacatagggtataggaaggttggtgtgtcaagtgattaacagcagtacctggcacatatttcatgcttagtaggtgatagctcctaatgttcttaggaaacaccaagtcatatcacttaactgtgccaacagtgttgagacagggttattactatactttatagatgagctgagaaaggttaagtcgcttgcccaactggcagcagagccatgtgctgacccccagtgtgcctgactcctacctaggccaggctctgcgaggggagtttacttgcaatcctggctctggcactaacttagcaggacactgcaggcaggccccgtcgctctctgggcttcaagcttcccataggcgggatgggggaccagcataactctttgtgcaggataagtctcacagaatgtgggggctgctctctttgctccaaccacagcagaaggctttgctttaaaaa

SEQ ID NO: 270253 - DNA, 440 bp, Homo sapiens
gcaggagaatcacttgaacctgggaggcggagtttgcagtgagccaagattgcaccactgcactccagcctgggcgacagagcaagattctgtcttgagggaaaaaaaagcccctaaggcatgatgccactgaaggccaagtcagccacgggccatatgtggccagaacaggtgagcagcatcagtctcattgctatggaggtggtgaacccagtgattgggctggtgggctgagggtcatccttgtcttttctcctctggtacagcgcccggggttcctccaggcttcaccctaacacgggctgagcagagaaaaaggaaaaggtggcaccgagattaggaaggagctagggaggggctggggagtctgggaagggtgagcaacagttgacaatggagggaggaaagtaggggatggggagaaccgaagaaacgaccca

SEQ ID NO: 270254 - DNA, 262 bp, Homo sapiens
agttttaaacgcttgctacagactagggaattctttgtgtcttaaacacaagggtgctaacatctattgaagaagtcacaccaatgttgtctggggttttaatttacactggcttatcttatgcctggagagccccttctggaaaagtttgcagtcaaagggaagccagagccctagttcaagggagggaggttgctgagaattagccaggtggtttaagcacccggcaagcctcagtaatggagcgtgatgtataaccctg

SEQ ID NO: 270255 - DNA, 474 bp, Homo sapiens
agcacttttaatcagggacttcatttttttctccattaataaaaattttaattttctactgatacataatggatgtacatattttggtagtacatgtgataatttaatgcattcatataatttgtaaaaatgaaactaatgtaattgagtatccaacaccttaaatatttgtctgtttcttatgctagaaacacctgaatgattatcttctaactattctgaactgtacagtagcttgttgtaaactattatttctgggcaaggccagctccacggctacacgatcagtgtggctgcagagacaggcacttggttttatgctctacttcaaagtcttagaattcttaataatttttgaacaaggtacctcacattttcatcgagccttgtaaacagtgtatccagttagtttccttgataatatcgaggtgtgatatttaatgtttctttcaataaacattaccagtgtgaata

SEQ ID NO: 270256 - DNA, 443 bp, Homo sapiens
gtcaacaaaagtgggaaggaaataattttgtatctcagtgacagcggcagtcaggaaaatttctaaaatgtcttaagtgccaagacatggcattgttgaaaaactcaggcaaaaagacaagtttcattgtctatatggaaacttgcaactcacaaatacctgggcatagcaatacttgtgaagaaagtaagtaacattatggaaactagacggaaaaaataattcaaattgacttagcaagattttagtaaaataaccagtgttaaagtgctgccaatttgaggccattgctttaaaaagccaaacattcccctaatgtttgctggatcaaagggatgtgatcacaaaataaaatgcattcaaaagcatacatggaaatgtaatggcaaaatagagatagctacaaataagattatttttggaaaaaacttcacactctatca

SEQ ID NO: 270257 - DNA, 437 bp, Homo sapiens
atttatttcctgttgcaaagagatggagcttcttgcagtccacgaaactgccatatacctctatgattttgtttttggattctgtaagataccatgtttagtagacctgtgttgttgtccacgagtctacaggaagatgttcatgttttgtttcagaaaatatttctgttgttttgtgcttttcttaactcatcaaatacaatgtgtggctcgcccttggcccttcatattgcttaccttaattgtgtagaccataaccagtttctactttgactaaagtttgacgtacacaagttacttgaatgtggggattctgtctatccctctacgccctagtgtacatagtactatatattatagtctctttaagtgttaaatgaaaaaccagtctaaaatgcaggatttatattaaaaatcgagttgcctgcttaaaaaaa

SEQ ID NO: 270258 - DNA, 704 bp, Homo sapiens
caagccttaacagacattggaattagcacttgcaagattttgattaattaggtgggtcagggcctaaaatcatttcctacaaacacccaagctgcgggtcttagatttttttcattcttacatccattaaactttttttttcccctcctttttaaattggcaactgaatataaatgttttacatttggcttaaccttgtagtgaaatccgtaagaaaaattgaacatcttttctcctgaagttagatgaaatgtgatcaaaatacatctcacaaatgcattctagttttaaataacaaaacacttatgtgagccaggtgcagtggtgcatgccagcagtcccagatactctgggggccgaggtgggaggatcccttaagcccaggagttcgaggtgagcctgggcaacatagcaagaccctgtctctaaaaagttaaaattaaaaatgcttaatgtttatctcaagcattcattccctcaatactaagcaagaaggagttttctttggcatttgaaactgtattgtttttggaatgtgagaaaatagaaaattgcttaaatgcataatatgatattgatgaaatacttatctgtagttaattactaatcatttatttgagagatctatttttgttgataattacttatttgagagatctatgttgattcaaaaggaattttaaaaagaaatattttcttaaaat

SEQ ID NO: 270259 - DNA, 392 bp, Homo sapiens
atgtattcccctatagccaaagtgtgactagtagtcagccagccaatagaaatgtcttattttttgtatacatttttctcagctatgattcattctatagaaaagactggggcatagctctgatacttttaaataacggaaaatttcatgtcttactagttcaactattggaaagagactatagagacctcatgtttcgccctgagcccaaactcttgggggaaggggcagattacccagctagattagcttgctgaccccccatgattaagcagctatgacgcagaatggatcacttcatattaccagtattaataaagtagtagaaggtggtggtagtgatagtagtaacagtgatagcaattaatatttattgagcactgatggaatag

SEQ ID NO: 270260 - DNA, 331 bp, Homo sapiens
agtcaggcatggcatgggatggaggggaacagagtgaggctacagtcagtgcccagtcttgaaaatgtcccttcgagtgtccctaggggccatccttgttttcagtgcttattacccctgctcccctctgcttgctcccagagagctgtctcctgcctcccagctctgcgtctcagatcctggctctgatcccacgctgctgttgcttacactcatgtacccattgctaatgtcatcattcccttcggcagctaagtgcaaagttaatttcccatttgaaaagcagtctgtactaataacaatcaactgggagacccaaaagagtgcagtt

SEQ ID NO: 270261 - DNA, 506 bp, Homo sapiens
aatctcaagcttctagaaatttggcacactcaccaaagaactgaatactcctttgcagtcagaccatgtgttccagacaacataactagaaagatgtgagaaggcacttcatgtgggagataagccttgttttacttaatccactgagatgtcagagttaattgttacagcagcagcctgttgtataggctgactaacacatggtaactaacagaacactttggattcttgacaaaataagagcaagaaagcagcagcagaagcagaaatcagaggggcgagaaaccaaaagcaacagagcaagatctactctctacacatcgacatcctgctctcttccagggagagtaacctacatgaaccataccagtggttcccatccaggacagttcccactcacctccccatggacatttggaaatatctagagacatttttgcatatcacaaaatgcaaaaaaaaaataaaatgtaccctgcaaagccacaagagcagagcagaccaag

SEQ ID NO: 270262 - DNA, 448 bp, Homo sapiens
cagatctgaaggccatagatggcagaaatgtgacccaaggcctagattcagtgtggagaagagaggacacataatctgctgtgtagccctaactaaagccacaatcatgtctagacttcatcagtgttatgcagtagctgctgtgcactgaattgtgttccctcaaaatttgtatgttgaagacctaacaccctacatgactgcatgggagatacggcctataagaagatgattaaggttaatgatgtcagaaggtggaaccctgattggagacaagtgtaagagacccaagagattctctctccgccatgtgatgacacagcatgaaggcagccatcggcaagccagaaagagaggcttcaccagaaaccaaacctttctggaaccttgatcttggactttccagcctccagaactgtgagaaaataaatttctattgtttaagcca

SEQ ID NO: 270263 - DNA, 434 bp, Homo sapiens
gatttgcccagagcccctttatgtcctgtgatatcaagcacaatgccctttgggatgagctggggcagaagcctcaaggttgggagtctgattgaaactttaaactcttgtgaatcacaagagttttctaatgcttcttggtactcttctgatccccaccccaaccctttccaaacctttcttctcatcctggtaaccctctcctttctgctatcagggaacctgtcctttatcaaagaaactaaatatagattaaaaattatagacaaaataaaatcaaactaaagtggtagtggctaccaggagcttagtttcttgtccttcccatggagatatttgtcatttaaaagcagatacttaggaaaggtaattctgatttcaaaggaatgaacctctaatatgagaatttacagaataaggtagcaaaagtggga

SEQ ID NO: 270264 - DNA, 194 bp, Homo sapiens
tggggtggtaagacaccctgcattttacatcattatatgcctcttttagtcctaaaacatgtagaaaaacttgacctgaagcatagtttcagtgtcttgatctttctaggctctcccatcccacaggccttgaaggccattgcacaggccagtggctagctcttccctgatctgagtcaccatcatcattacaa

SEQ ID NO: 270265 - DNA, 412 bp, Homo sapiens
cccaaaacaaataatgagtgacgctctctcaaatatatgtacaatcaaatgtgaaacggaggtaaagatggggaagatcttaggctcagagattgtattcaggcctttatggtggcaatcttgatataattacgcatttaaaaataaattgtcatcagatcagtctgaaatttatagaggcttttgttggtgagaaacgtagtttacataatttacccacaggaatgtttttgattaatgttatctattaaagactgcagttcacaatatttcccctgttaatagtacatatgtttttggagctgatctgggagatataattcaagttgagatttgagtggagacacagccaaaccatatcaagaacattatatgaaacatcctaaatgtcaataaacacattgtattaaaa

SEQ ID NO: 270266 - DNA, 470 bp, Homo sapiens
tcttgcatcagtgtgccttcaatattaatagttaatttatagagaaactgaactaattttatctctcaaaattggccgttacaatctcacacacccacctcttccatgatagtccctgggccttgaggaatttaatagttttaatttctggccttgtgccttatgaacacagtgtattttgattggtatcttctactgggtctgaagataaggctttaactgctgtcattgtttaagatttagcaagacttggtgttctttttatatccaggagtcaacgccctgtaacttaaaggcacaaggactttaaaagcaagaaagttacgtggatatagtaaccttgatttaaaagaaaaatttaacctcagtttttttctaagcaaattaaaacttaataacaatggcataggagttattttgataaaatgtaaaatttgttagaccagttaccaaaaggcaagaaaaaaaaa

SEQ ID NO: 270267 - DNA, 386 bp, Homo sapiens
cagtgagtcacaaatgtaaatgtattgagtgcccaatgtatggagccctttctccaagacctcactgccgtaaatacaaatataactgagaactggtgatttgaagatgattcttgggatagcgggctaggcggcacttcacactggcttttggggccacataggggtgtaatcatgttatcaccctgcacaaccccagagggtaccatacacaacccatttgaccaaacatggcagtcctgaaaggaatgatgattgaaagccaagactgagctttggcaaggaaaccacctctgaattaccaactcattgtctataatgtaatgatagcatctacctcttagtaattttgtgaacattaaatgaataaagcatgacaaaaggcc

SEQ ID NO: 270268 - DNA, 464 bp, Homo sapiens
cagaaagcagcctcaccaaaggccaaagataataaatttgttattataataaaaatgaaagaacttggagaaaggaagtaagacaggttggctggtggctcagtgctgatgcctgagctagagcagctggattctcgcttccttcacttcctcaccctgcctgccttttttgcagtctctgctttgctttcacaagcagcccctggctggcggctctttcctattaaaaaaaacagtgtgggaaggcctcaaacttcaggcatctcagagaaacaaagaaggtcaaaccaagtctccttattagttgttatagcaacaaagaaactattgcagcgacgttgaaaatgcctcctggaatcccacctctggagctgcaattacagcacatctccccttcctgtgtgttatcccaggtacggaatcgcgtctttacctgtgtgccagaattctgcatctcctgacaa

SEQ ID NO: 270269 - DNA, 1555 bp, Homo sapiens
tgagccgagatcgtcgtgccactgcactccagcctgggtgacagagtgagactccgtctcaaaaaagaaaaaaaaaaaaaagatatgtcatgaatttagagaatttaaagtatggagaaaatactcacttttaaagcatagtggctaggaactcaaagttgggttgccgtaataccaattttacgatcttgggtaacataaggtctctaatccttagttttctcacctatgagataagaagcccttatcttataaggtgattgtgaggtttcaatgaaattatatatgtaaaatacactgcttaacaaatgttagctaatagtttatattaggctttatagcagtgtacttttattgttgaactccttatgtattcttttacttgtttaatccttttactttgagaaagtggtaacttgtagagaggaaaagatactgataaatgtaaataatccattgcaaatggctgagtgaaaatcctggaaaatgttttaattgaactttattgatgtaatataaaactattcaaatatctgtcaataaagggtaggattgtatgaaggctcattttagaaacttgagactaagtgactgatctattattttagaagttaataagtggtatagatatatggctgtcaagctggaaacaacatgtactaactttccttgaacgttggtatggcctctgaggttttggcagtggattgtgaatagaagtcatgtgtgacacctttgtgttttgccttaaaaagcaatacatgagtactgccccctacctgtgtcctcttcttgtgtactgataattgatgaaaactcgagtccgcagaatttggacccagagattgaagtatgtgttgacctgcctcaccagctctacacagcttatttctagactattacttgagaaggaaatcattttctatcatatttaagccatgtattttaggatctctttgttacagggtcttagcctatatcctaactgataccttttaaagaacagccaaacagatttaaaaggaaccaaatagtacttctaaatatgaaaaagggaattgaaataaaaactcaatgggtaaatagggatgcctagagaaatggttggttggttccaggtctgggacaggaaaaacagaggatgatcctagaacactgtggtgcaagaaagtaaggaagtgcttaaaagaatattgcttggcaatttaaaaaaagggaagaactgatacatgtgatggtatggatgaacctcaaaaacattgtgctaaatgaaacagccagacacataagactgcatattgtatgaaatttctagaaaaggtaaaactaaagacacagaaagtaaatcaatgtttgcctgcagttgggtattggaaccgggattgactgcagatagacattatagaacttttggagtgatgaaagtattctaaaactggattgtgatgaacgttgcacagctaaatacatttgttaaaagttgtacacttaaaataggtgaattgtgtgtaaattatatttcagtaagactgtaaaaaattttgagagatactgt

SEQ ID NO: 270270 - DNA, 1342 bp, Homo sapiens
  misc_feature (32)..(32): n is a, c, g, or t
  misc_feature (570)..(570): n is a, c, g, or t
gtagaagtttatgcgtgcttccggtccgcganccctgagagctaacttggggtcttttcccaaggtggatgtagaagcgggctccggcgtcccactctcccttccatatgggcttagcgtctgggtcactgagaacgacgtctgaatagggccctgggtccttgccatggatgaatgtggttcccgcatccgccggcgggtgtctctccccaaaaggaaccgtccaagcttggggtgtatttttggcgctcccaccgcggccgagctcgagcccggagatgaggggaaagaggaggaggaaatggtggctgagaacaggaggcggaaaaccgcgggcgtactgccggttgaggtacagccccttctactctcagattccccggaatgtctcgtccttggaggtggtgatacaaacccggacctcctacgtcacatgcccactgacagaggggtgggagaccaggtacggaggacttggaacttgaaactgcaaacttttggcatccttcccagatgcaaagagttgaccagttttatcgccttcgtttacttctctcgtcttcgttaccnctgttaatcggcacttaggagcctaatgacagtgaagtggacatgtttggtgactatgatagctttactgaaaactcctttatagctcaagttgacgacctggaacaaaaatatatgcaactccctgaacataagaaacatgctacagactttgccactgaaaatctttgctcggaaagtatcaaaaacaaactcagcattactaccataggcaaccttactgaattacaaactgataagcacacagagaaccagagtggatatgaaggtgtcactattgaacctggagctgatcttttgtatgatgtaccttcctcacaggctatatactttgaaaatttgcagaactcttcaaatgatttgggtgatcattctatgaaagaaagggattggaagtcatcctctcacaacactgtgaatgaggaactgccccataattgcatagagcaaccccagcaaaatgatgagtcctcttccaaagtcagaactagttcagatatgaacaggagaaaaagtattaaagatcatctaaaaaatgccatgactggaaatgcgaaggcccagacaccaatattttctagaagtaaacagctcaaagacactctcctatctgaggaaattaatgttgctaagaaaacaattgagtcatcatcaaatgaccttggtcctttttattcattacccagcaaagtgagagacctttatgcccaattcaagggaattgaaaaattatatgaatggcaacatacttgtttaacattgaattctgtgc

SEQ ID NO: 270271 - DNA, 2547 bp, Homo sapiens
  misc_feature (32)..(32): n is a, c, g, or t
gtagaagtttatgcgtgcttccggtccgcganccctgagagctaacttggggtcttttcccaaggtggatgtagaagcgggctccggcgtcccactctcccttccatatgggcttagcgtctgggtcactgagaacgacgtctgaatagggccctgggtccttgccatggatgaatgtggttcccgcatccgccggcgggtgtctctccccaaaaggaaccgtccaagcttggggtgtatttttggcgctcccaccgcggccgagctcgagcccggagatgaggggaaagaggaggaggaaatggtggctgagaacaggaggcggaaaaccgcgggcgtactgccggttgaggtacagccccttctactctcagattccccggaatgtctcgtccttggaggtggtgatacaaacccggacctcctacgtcacatgcccactgacagaggggtgggagaccagcctaatgacagtgaagtggacatgtttggtgactatgatagctttactgaaaactcctttatagctcaagttgacgacctggaacaaaaatatatgcaactccctgaacataagaaacatgctacagactttgccactgaaaatctttgctcggaaagtatcaaaaacaaactcagcattactaccataggcaaccttactgaattacaaactgataagcacacagagaaccagagtggatatgaaggtgtcactattgaacctggagctgatcttttgtatgatgtaccttcctcacaggctatatactttgaaaatttgcagaactcttcaaatgatttgggtgatcattctatgaaagaaagggattggaagtcatcctctcacaacactgtgaatgaggaactgccccataattgcatagagcaaccccagcaaaatgatgagtcctcttccaaagtcagaactagttcagatatgaacaggagaaaaagtattaaagatcatctaaaaaatgccatgactggaaatgcgaaggcccagacaccaatattttctagaagtaaacagctcaaagacactctcctatctgaggaaattaatgttgctaagaaaacaattgagtcatcatcaaatgaccttggtcctttttattcattacccagcaaagtgagagacctttatgcccaattcaagggaattgaaaaattatatggtaatgctttttgctggaataaaaaaatttttttcctatcattaccataatattagtgcaagtaaatagaagcaaatgctttcatggtccatactgtttctcattttgaaaacaaaagatcagtgatctctcagccccttccattcctacctgtcctgctaccactgaacctctttccttccctcacagtcacacttatcaaaccagttatcctttctgtctgtttccttacctgacataattcctctaattcctcatctataagaaagggataataagttgttagcaagtcagattctggttcaaagacatgccaaattcaatgttggtaatgattttcaataattatattggtagcttctaagtaagaactttagtaaattaccccactctaattctgggttctgtgctctcattctctcacttaagatctgatgactgagacgtctaaacacagtgttacttttaatgtttaccttacctgacttctcaataacttacctgatgctattgactacacccttcttgaaattcttgtttctggatgtccttacaaccactcctgttttttgaccccgattgtctagtagagatcctcagctttcttagttgtatttccttggctggctctgtcttctctaccaaaacctagctgttgtggtatgtctttgacactcacatgtcttgagtgaaagaagtcagttattagtaatactgttgattaaaccaaacatctttccccccacaccagcagccgcagctacctctccccacgggtgcatccctgccaccacccagatgctctgccttgtgctgcctttcccaaagctagacatctttaaagacagctgcaattaagttttaagtcagggatgtccaatcttttggcttccttgggccactttggaaaaagtattgtcttgagccacaataaaatacagtaacacgatagctgatgagccaagaaaaaaaattgcaaaaaaaaaaatctcataatgttttaagaaagtttacaaatttgtgttgggccacattcaaagccattctgggcctcatgagggccgtgggttggacaaacttgttttaagtgcaaagaagcaataatattaagaaggtatcttgtaatgtttttcaaaaatccagggtccttgcatatatttcagatatgtgtcattttagaccaagaagggacagttgctgccatactggagggtcagccccatcaaccttccacttcgtaagttttctggaactcctgttaggatcttatgaatgatatgaaaacttgggttcttgcagagaagacaatcaggttggagaagcagaactacaggaaacaaagtctaataaaagactctacaagaaaaaa

SEQ ID NO: 270272 - DNA, 1257 bp, Homo sapiens
  misc_feature (32)..(32): n is a, c, g, or t
gtagaagtttatgcgtgcttccggtccgcganccctgagagctaacttggggtcttttcccaaggtggatgtagaagcgggctccggcgtcccactctcccttccatatgggcttagcgtctgggtcactgagaacgacgtctgaatagggccctgggtccttgccatggatgaatgtggttcccgcatccgccggcgggtgtctctccccaaaaggaaccgtccaagcttggggtgtatttttggcgctcccaccgcggccgagctcgagcccggagatgaggggaaagaggaggaggaaatggtggctgagaacaggaggcggaaaaccgcgggcgtactgccggttgaggtacagccccttctactctcagattccccggaatgtctcgtccttggaggtggtgatacaaacccggacctcctacgtcacatgcccactgacagaggggtgggagaccagcctaatgacagtgaagtggacatgtttggtgactatgatagctttactgaaaactcctttatagctcaagttgacgacctggaacaaaaatatatgcaactccctgaacataagaaacatgctacagactttgccactgaaaatctttgctcggaaagtatcaaaaacaaactcagcattactaccataggcaaccttactgaattacaaactgataagcacacagagaaccagagtggatatgaaggtgtcactattgaacctggagctgatcttttgtatgatgtaccttcctcacaggctatatactttgaaaatttgcagaactcttcaaatgatttgggtgatcattctatgaaagaaagggattggaagtcatcctctcacaacactgtgaatgaggaactgccccataattgcatagagcaaccccagcaaaatgatgagtcctcttccaaagtcagaactagttcagatatgaacaggagaaaaagtattaaagatcatctaaaaaatgccatgactggaaatgcgaaggcccagacaccaatattttctagaagtaaacagctcaaagacactctcctatctgaggaaattaatgttgctaagaaaacaattgagtcatcatcaaatgaccttggtcctttttattcattacccagcaaagtgagagacctttatgcccaattcaagggaattgaaaaattatatggtaatgctttttgctggaataaaaaaatttttttcctatcattaccataatattagtgcaagtaaatagaagcaaatgc

SEQ ID NO: 270273 - DNA, 454 bp, Homo sapiens
  misc_feature (298)..(298): n is a, c, g, or t
ccggagatgaggggaaagaggaggaggaaatggtggctgagaacaggaggcggaaaaccgcgggcgtactgccggttgaggtacagccccttctactctcagattccccggaatgtctcgtccttggaggtggtgatacaaacccggacctcctacgtcacatgcccactgacagaggggtgggagaccaggtacggaggacttggaacttgaaactgcaaacttttggcatccttcccagatgcaaagagttgaccagttttatcgccttcgtttacttctctcgtcttcgttaccnctgttaatcggcacttaggaggtattgattgccttgttatttacatttctatataaatatgaaatgtaaaccccgagacataaaagttgtgcacgcagcagttaagtggcatgactgagacacaaatctaggcttccagataactgcagctcctac

SEQ ID NO: 270274 - DNA, 318 bp, Homo sapiens
tcttttttttcatttttataatttgtcctttccaactgaatgtgaataatgagtaccttttcagtagttagtgtgccaggagctgtgatattgaatagggtcacagagatgagtaagacaagtctaaacactctcatgagggaggccacagatttctacttaaagcctttcagtatgtaaaagtcacttcccacatttttgttcgttcaaaaatgtcttctctcagaatcctggtatggtttcacaaaaagaagagagactgttcacatatttttgggggggactgaatctctattctcataattaaaattttttccc

SEQ ID NO: 270275 - DNA, 433 bp, Homo sapiens
acttggttcttctggcctcacatcccatctcgcctacacttcaggaaagcacgcagactttattcacttcagccacctaaacttgctatctgggtgatccagggaaagccacctgaaggtttttcacattcgcatgagcccatgcgggagtactgggggacttctctgagagatgaaagtttctagccgcaaggtgagaccagagaaatcccaacacatcgttgcttatgtggatgcctggctgtttgcttgggatcagcttctcagacccccatttccagtagttgcctgtggtccatgaataaagacgaaaatcagagctggctttgtggattctttctagaaaagctcagaagtgtagaacatcctagaaaagactcttctcaaaaacaaagtgaaaaataactttttatatttgtttaatttaaaaggg

SEQ ID NO: 270276 - DNA, 476 bp, Homo sapiens
cccaaggcagtactgggctcacatgtcagagcacactgttgcacacagtggtgcatgcatacatctataaaagatgcgctgcgtacacagtagtgttttagccaatgtgctagccaatgaattctgcatcagtggttatctcttgctacacaagaggtgaagaaccattccttcaagcgtcccagagctctaaggcgaagctgctatagaatgatttgcctagaactttgccttagggcaaacctcaagtactgcttttaggaatgaaatctaatggtggccttgtccctggtgcgggcatagtatgtactcagtgttaattgtttacaccaaaagcctggaagctgcattgtcttttggccttcagaaaccttgtatcttaactgttaagatctgaacattgggaatcattcacctctgacctgttgggctggttttattccgctctataaagtacacccaggtgctttaggaaa

SEQ ID NO: 270277 - DNA, 707 bp, Homo sapiens
ggtgcccgtctctagttccagctacttgggaggctgaggcatgagaattgcttgaactcgggaggtggagattgcagtgaaccaagatcacaacgctgcactccaggttgggcgacagagtgagactctgtctcaatcaatcaacaaaacaagtaatagccaaaaatagataagtcagtcagtcagcataagtgcctgactgacagggatatcagaggcctaggatgcactgacatattatcttcaaaagatttttgtaagaatcaaaatatcataatgcaaatattagaaaagtattcaagaaccatttttttgaaaaaaggtgcaaaaatcctttaaaaatattaccaaattgaatccagcaatgtacaaaatggaccaccatgacccagtggggtttatcccggaaatgcaatatttgtataacatacaaaaatcagtcagtgtaagccatcacattaaacagacaaaaaattaaaaaagtataatcatctcaacagatgcataaaaagcattagataatgttcaacactgattcataaaaaccaaacaaaaaacaaggaatagaaggaaataatctcacctaggtaaagggcactgacaaagatacctatagttaacattaaactaaatggggaaaggctgaccataatgccctcaagattgggaacaaagtaaggatgtctactctcactatatctatttaa

SEQ ID NO: 270278 - DNA, 434 bp, Homo sapiens
tacgaggttgactgatttactagattccagtggttagaaatacatgtagcctgtgctgtaaacctgattttctgacttgtagttcagctctcttctccatctccttgtacagccaagataccccagaaattatttgcgtttccgaagttgtaggatgaaaagacatgtctttgcttaactgagttagccccctagaacaatattgagatggagctggaatggtgaagaaatgcaagagtccaatcccttgggtatgtgcaattcccagttaccccttgaaacagtgcttcattataaatttagatgttagaggctgggcatggtggctcatgcctcgaatcccagtgctttgggaggccaaggcggtgggatcgcctgaggctaggagttcaagaccagcctgggccacagagtgagaccctgtctctaaaaaa

SEQ ID NO: 270279 - DNA, 658 bp, Homo sapiens
tttatttgtattattttttattgttgtgttattttgtattgggtttttttcccctgggtattttagatctacacttggctgaattcccaaatgtggaattcgtgtccccagagggcccactatattgtttcttcactacttactactactactactcacaattttagtcccagatacttgcttaaagaaggtatagaaaaagacaagcagtaacttgtagtatagaaagaagggaaatgtttaagaagctatatttacttctcagtaaacaatcaatctcatgcttctctcactgcaagtgaactagagccactgattttagagtttttaagagagtagatcagctctagcaagaactctagcattcttcataaaagtttctttagatgccacaaaatgagacctgcagattacaacattaagtatcctgaaaatcaaacaaaataatgaaaaagggtaatactcctcaattctctggtggtctcaaatagaaaggagcaccacaacctcacagtacacctcagctaatagaactatctttaaacactaaaagtaactttgtcttcccagagacaaatatcatttccttaaagatcccatgtgtaggaaaaaaataaataaataaataactctttcttatgcctggtatggttcaaac

SEQ ID NO: 270280 - DNA, 557 bp, Homo sapiens
ccagtgcatagcattgcacgctacagagaaatctttcgtgaaaggaagagtcaatcgatgcagcaagcttccctgttttcttattttaagatttcaacagatttctgaaggtcagccaggagggctgcgctgcgctgccacaccgttgaggagctgcagagaaggccagagacgctcagccacgaggtcaggaagggctctcggctcggagtcagaaggcattggctgagggctgaggttgaggcaggcatgctgctgaagagagaaacagtgactgaatcagcacttccatccctcaatccttatccaaaatggaaagcaagtaacagctgatatttccccagtgccaaaccccagaggttctcctccaagaaactgaaaggaatgttggggaaagctgatgctcctaacttggaaggtggcattccaaattaaaaatatttgttgttgttgttgttgttactatttgagggacttgcatctcacagctagctccttacccacttcctgtgaagaaagagtcctaagcagcgctgtgtgctgacctccatacacct

SEQ ID NO: 270281 - DNA, 388 bp, Homo sapiens
gaagacccagccaggctgtctgaagaaggggtgttcttgagtaggagggaaggtctgctccaatacgaaaaatctaacaatagcatagtccttaagagcttgagctttgaagagggagaacagacccatttaaggcacgaaaaataaaggaaactcttgagtccctccaaggaaaattccagccacctggctagcctcaagaagtagatgagcaccctgataagtaagaaggtaataatagcttaaaacaatagtcaagaaaattagagccacgaactaatcttaaatgacgagttaatgggtgcagcacaccaacatggtacatgtatacatacgtaacagacctgcacgttgtgcacatgtacctaaaacttaaagtataattaaa

SEQ ID NO: 270282 - DNA, 344 bp, Homo sapiens
tggttcaaatctttatgtcttacagcacagttttgtagttttctttcaatctataccctccacatttcttgttaatggttattctttatatataaacagatcatgttgctattaaagtggtgggatgtatatttttcataatattcatcatatttgatttattgttcatatatagcaaagttagtgatttgggtagtttattgtataaccagctccttagcaaatgttttgatgagttctgatagtttggcagttgatttactgaagtttgtacgtggattgtcattcggtaattcttacccctttctgatagatttacttatttatttttattgccttctccc

SEQ ID NO: 270283 - DNA, 420 bp, Homo sapiens
ttttgatcttagagcgaaagcctataatcactgcgcccgctcataaggggatggccatggctaggtttatagatagttgggtggttggtgtaaatgagtgaggcaggagtccgaggaggttagttgtggcaataaaaatgattaaggtaggataatggccaaataatatgaaaagatacaatattttgtagttagcaaaaaaaatttttctaaaatctacactcattttataaaaataaatggttataacctaaaaagtttggcatatgcgaaccaaatattagccatagttattatctgaatggtaaaattcttctttttccttccagtattattgttacaaaaaagcaaaacaattttattaaaataagaaaacaaaaaggttttattatactaagaaagccaaaagttagatttttg

SEQ ID NO: 270284 - DNA, 359 bp, Homo sapiens
catatctaattgtatgttcgcttaaaagttccagagactaaatcttgaaacaatataggcatctgtggaaatctccaccaggagattgattcaaggctacagttaatttataactcagcccagcccgagatgatgccagcccattcaccagatgggcagtaactcaagacaagtcatcagaactcgtcatgaagacctgcactgcctcaccccttgcataccctccatgccaaaacttcttaaagcctcgcattttgcttggaaatgtgaagcagctccattaaagcaaaagcctggatcgtttttccccactgctagctttggtttataataaagtcagtctccttctaccataccac

SEQ ID NO: 270285 - DNA, 297 bp, Homo sapiens
tcaggaacttttttgggttacctgggatttttgtttgtttgttatcctaaattttaaatgaattattgatgaatatcttggttgacaatagggttgcaatataagcataaggtaaccacagcttaaatacaggtggagatcaccttattccttttatctcaaaaagtagtatttaagtatttttcattagtacaacaattagtaatctattatatcaagataaatatttaagaattcattttagcataaattttctttttcctgcacaacttcaataaactaagctggtgtgttatg

SEQ ID NO: 270286 - DNA, 511 bp, Homo sapiens
aacctagattcttcagtctgaaaagacacatagagaatgtgacagaatctgtaaaataataaagaaaatggtggaggtaaacatcactgtcccatttgaaatttgaatatagtaatttccaggcacacaatacgcaatgagtagtaaaaggaacatgttatatcccataagctgtgatagaggctaaacatagaaattaatcaaagggtaattaaataattcttgattgaccgggcacagtggcttaggcttgtaatcccagcacttcggaaggccgaggcaggtggatcacttgcaatcaggaattcgagaccagcctggccaacatggtgaaaccccatctctactaaaaatacaaaaattggccaggcatgggggcgtgtgcctgtaatctcagctactgggaaggctgaggcaggagaatcgcttgaacccgggaggtggaagttacagtgagctgagattgtgccactgcactccagccttggcaccagagcgagactccatctca

SEQ ID NO: 270287 - DNA, 431 bp, Homo sapiens
gccagcatcactgatggtgacagagacacactgcttcacacacagctggctttcctttttttctgaggtaccaagtgtttgccaccaacagtgtatctaagacacaatgtctggctagtcttttgctattagaaaggtaagacgtttgcagaaatggtgacaacacaaagccatacattggtgaagacatttcacaccaagttcctttaaatattttgaatcaaaacataccatttttaaagatataattgggttaatattcaacaaggtggctttcatcccagctttgacggataatagaaaaaccttcgcaaagcagaaaaagtaaattgtgaacaaaaattaaggacaagaaattacaagttgtgccagtctttcgtaagtgattttgtctcaggcaccaagcacaagtagaaaaacatgaagacaaa

SEQ ID NO: 270288 - DNA, 486 bp, Homo sapiens
ggtccctggaatttgtccctaggctttcccatatcagagacctctgacttggtgagactcccctaaagtcctgccggctgtccttaagtgtgtttgaagtacaggaaagatatttactgtagcagtcaagtcattgagactcagtacataaaaacagtaggactcaaggttctagatttgtatttttgaaatgagaagtaactacagagccgtcttgatgtatctgaatgctcatgaattggaggggggtaccagttagctgtcctccatttccaatgacaataaaacctgaagaagtagctttctgttgcattaaaaatgatttgaggttaatgatcatagcaattaatttcagaaaaaaatacacagatatgatcaagaaatagagcatagaatagaaccgtggacctgaacaagatcataaaagatcatctggttcaggcctctaccttcagacagggtattttctccattctaatagatgag

SEQ ID NO: 270289 - DNA, 375 bp, Homo sapiens
aagttcagtgccatgcatgtggagtccttgtcaacccctctgctaccactgggcccagacagtggggagcagatagagccataaaaggcctcatgttatgaagaggatcgtggttctggctccaggtggagtccggcagactcaggtccttcgggcagcagcttgccttctgagggccgcgtccgttctcctccactcagagtgacaactgtggcagcgagccaggatctggagagtgctgtcccctgagcacaggaagccctctgatgacaaaggtctagcagtgacagcaacctattgtatcatcactgtaataacccagggctcatagcccagtgtctggcacatggtaggtgccaaggaaatgctaagaaa

SEQ ID NO: 270290 - DNA, 460 bp, Homo sapiens
gataaggcctggttcctgctgttaagaagctaatggagggatactaatgaacactatgtaaattttttaactcaatctgagtcatgatgtttcaagatccccacagtttgcttatcccaaaagacatccgcaacatgagctattctgctgattagtctggaacatcaagtttctataggaagtgtatagtgtgttttgaggaggccatgtagcatgatgaaaagacaggtatgtgtttatatggactcagatactcgttaattcactaattaatactctcaggtacctgggtaagtttgttcatttctttgaatctcagtttccttatttgtaaaatgtggagattaaaatactcacagagttattgtgatggttaaaagtgataagatatataacattcctggcacagtccctggcatagggtagataataaatggtggaattaataagaaaaaaaata

SEQ ID NO: 270291 - DNA, 608 bp, Homo sapiens
attagtcaaatcactaacctgaattatgccacaaatctgacccacttgtacctacaaaacaattgtatttcatgtatagagaacctcaggtcattaaagaaactggaaaaactgtatctgggaggcaattacattgctgtcatagaaggtttagaaggattaggagaactaagagagcttcatgttgagaatcagaggcttccccttggggaaaagcttctgtttgatccaagaactcttcattctctggcaaaatccctctgtatattgaatatcagcaataataatattgatgacattacagacttagaactactagagaatcttaatcagctcatagccgttgacaaccaacttctgcatgtgaaggaatctctctttgaagcaatctgaaagcttgctgacaaaaaatgatgtgcatgaacctcacctcttccataacccagaagaaaaagaaaatttgtttgtggaaaatgagtaaattcagcctcaagtgacaggaaacgtttgattttgtttttaaccttatatgactaggcaacaatatcttttgtgggtttgtagctttatggtatctcataatataaggaaaaacttttaagttattg

SEQ ID NO: 270292 - DNA, 504 bp, Homo sapiens
ctaatgctaacttcgttatttttcttacagaaatccctctgtatattgaatatcagcaataataatattgatgacattacagacttagaactactagagaatcttaatcagctcatagccgttgacaaccaacttctgcatgtgaaggatttggagtttttactgaacaagttgatgaagctgtggaaaattgatctaaatggaaatcctgtttgtctcaaaccaaaatacagggacagactgatattggtgtccaaatcactgggaatctctctttgaagcaatctgaaagcttgctgacaaaaaatgatgtgcatgaacctcacctcttccataacccagaagaaaaagaaaatttgtttgtggaaaatgagtaaattcagcctcaagtgacaggaaacgtttgattttgtttttaaccttatatgactaggcaacaatatcttttgtgggtttgtagctttatggtatctcataatataaggaaaaacttttaagttattg

SEQ ID NO: 270293 - DNA, 905 bp, Homo sapiens
attagtcaaatcactaacctgaattatgccacaaatctgacccacttgtacctacaaaacaattgtatttcatgtatagagaacctcaggtcattaaagaaactggaaaaactgtatctgggaggcaattacattgctgtcatagaaggtttagaaggattaggagaactaagagagcttcatgttgagaatcagaggcttccccttggggaaaagcttctgtttgatccaagaactcttcattctctggcaaaatccctctgtatattgaatatcagcaataataatattgatgacattacagacttagaactactagagaatcttaatcagctcatagccgttgacaaccaacttctgcatgtgaaggatttggagtttttactgaacaagttgatgaagctgtggaaaattgatctaaatggaaatcctgtttgtctcaaaccaaaatacagggacagactgatattggtgtccaaatcactggaatttcttgatggaaaagaaattaaaaatatagaaagacaattcctaatgaattggaaagcatccaaagatgccaagaaaatcagcaaaaaaaggagcagtaaaaatgaggatgcaagcaattcactcataagtaacttcaaaacaatgcatcatatagttcctgtttattacccacaggaatctctctttgaagcaatctgaaagcttgctgacaaaaaatgatgtgcatgaacctcacctcttccataacccagaagaaaaagaaaatttgtttgtggaaaatgagtaaattcagcctcaagtgacaggaaacgtttgattttgtttttaaccttatatgactaggcaacaatatcttttgtgggtttgtagctttatggtatctcataatataaggaaaaacttttaagttattg

SEQ ID NO: 270294 - DNA, 773 bp, Homo sapiens
attagtcaaatcactaacctgaattatgccacaaatctgacccacttgtacctacaaaacaattgtatttcatgtatagagaacctcaggtcattaaagaaactggaaaaactgtatctgggaggcaattacattgctgtcatagaaggtttagaaggattaggagaactaagagagcttcatgttgagaatcagaggcttccccttggggaaaagcttctgtttgatccaagaactcttcattctctggcaaaatccctctgtatattgaatatcagcaataataatattgatgacattacagacttagaactactagagaatcttaatcagctcatagccgttgacaaccaacttctgcatgtgaaggatttggagtttttactgaacaagttgatgaagctgtggaaaattgatctaaatggaaatcctgtttgtctcaaaccaaaatacagggacagactgatattggtgtccaaatcactgggtaacttcaaaacaatgcatcatatagttcctgtttattacccacaggaatctctctttgaagcaatctgaaagcttgctgacaaaaaatgatgtgcatgaacctcacctcttccataacccagaagaaaaagaaaatttgtttgtggaaaatgagtaaattcagcctcaagtgacaggaaacgtttgattttgtttttaaccttatatgactaggcaacaatatcttttgtgggtttgtagctttatggtatctcataatataaggaaaaacttttaagttattg

SEQ ID NO: 270295 - DNA, 1018 bp, Homo sapiens
attagtcaaatcactaacctgaattatgccacaaatctgacccacttgtacctacaaaacaattgtatttcatgtatagagaacctcaggtcattaaagaaactggaaaaactgtatctgggaggcaattacattgctgtcatagaaggtttagaaggattaggagaactaagagagcttcatgttgagaatcagaggcttccccttggggaaaagcttctgtttgatccaagaactcttcattctctggcaaaatccctctgtatattgaatatcagcaataataatattgatgacattacagacttagaactactagagaatcttaatcagctcatagccgttgacaaccaacttctgcatgtgaaggatttggagtttttactgaacaagttgatgaagctgtggaaaattgatctaaatggaaatcctgtttgtctcaaaccaaaatacagggacagactgatattggtgtccaaatcactggaatttcttgatggaaaagaaattaaaaatatagaaagacaattcctaatgaattggaaagcatccaaagatgccaagaaaatcagcaaaaaaaggagcagtaaaaatgaggatgcaagcaattcactcataagtaacttcaaaacaatgcatcatatagttcctgtttattacccacaggtgggtaagccaaaattagcctttttctctgaaatacagagataccctgtaaatgcaaatgcatctccagaaagttcctgagaagattacactaaaattatttaagagatggggaatctctctttgaagcaatctgaaagcttgctgacaaaaaatgatgtgcatgaacctcacctcttccataacccagaagaaaaagaaaatttgtttgtggaaaatgagtaaattcagcctcaagtgacaggaaacgtttgattttgtttttaaccttatatgactaggcaacaatatcttttgtgggtttgtagctttatggtatctcataatataaggaaaaacttttaagttattg

SEQ ID NO: 270296 - DNA, 463 bp, Homo sapiens
attagtcaaatcactaacctgaattatgccacaaatctgacccacttgtacctacaaaacaattgtatttcatgtatagagaacctcaggtcattaaagaaactggaaaaactgtatctgggaggcaattacattgctgtcatagaaggtttagaaggattaggagaactaagagagcttcatgttgagaatcagaggcttccccttggggaaaagcttctgtttgatccaagaactcttcattctctggcaaaatccctctgtatattgaatatcagcaataataatattgatgacattacagacttagaactactagagaatcttaatcagctcatagccgttgacaaccaacttctgcatgtgaaggtagtgtaaagagaaattaatttttaagatatttacatgaaattatgattgaaaaatgttttgtaatagctataaaataaatatatcacataaa

SEQ ID NO: 270297 - DNA, 349 bp, Homo sapiens
gttcgtaaacttgcccagcccgggacccttttgttgccaaatctgcctcggtctgcccaactcctcctgcgaaattttacactcagtatgcaggaagcctcgctcaaaatctgacactcctccacgcccttggtccccaaatccattccttctctttgttttccaacccgagaacccctcgttttccccgctcagccttccccaccccgcttgtcccccgcacacagcagggccgctccgagacttgtccactcagcaagagcagagctgagaatcagccagggacgccagctgaaggcccttctcccaaattaaggaaataattgttgagggcttaacttcacgcccc

SEQ ID NO: 270298 - DNA, 432 bp, Homo sapiens
ttcatcctaatgacatagaagaaacattttgaagacctgaaaaaagtagatctgtgtcatcaatgtccttttgtcagtgttcaaaattattaccattattatttttattttactctcatttcttgattaaccccatcttatataaattcttgataatgtatctcctatactatttcctaaaccaaataaatatatacatatataattattatgaatctctatatagtaaatacattttcaattttgcctaaggtgcatactatctatattccttatgtaccttggccttcatctcagtaatcatatccttattctatgttctcattttatatttagcacttcagtcaggcatataaaatgaatagtatttgtacagttgaattaaatgtatgttaatgtgaaaagactcaataaaaagtatagtcagttgag

SEQ ID NO: 270299 - DNA, 1236 bp, Homo sapiens
tggggtccagttccagtctgtgggaggtttgttctttcgctcttctcagtgactcttgctgttgctcactttttggggctgcgctaatctttatgagctgtaacactcactgcgaaggtctgcacttcactcctgaagacagcgagaccacgaagggagaccaccgggagggacgaacaactctggagtgccagctttatgaactgtaaccctcaccgcgaaggtctgcagcttcactcctgaagtcagcgagaccacaaacccagcagtaggaagaaactccagacacgtctgaacatcagaaggaacaaactctggacacaccatctttaagaactgtaacactcaccacaagtgtccgcggcttcatacttgaagtcagtgagaccaagaacccgccaattccggacacagtagctgggattacatgcgcccgccaccacacccaggtaacattttgtatttttagtagagacggggtttcaccatgttggccaggctggtctggaactcctgatctcaggcgatccaccctcttcagccttccaaagtgtgggattacaggtgtgagccaccatgcccagctctaaaattatttaccttttcaaggaataagagtgttgggagttaatggtgtgtctggtggttgcaataagtcaaaaactgctgcaggctgggagcggtggctcacacctagcactttcggaggctgaggcgggtgggtcacctgaggccagtgttgtaggaaaaaaagccaggttcttgtcacacgaccaggaaaagttaggcacacagacactttgaaggggagagggaatggaatttattgtgtgaaaaggaagaaaacctctcagaaaagtgagagaagttcctgttaacggggccccatttcacagtttgaatcccaggttctacccaggaacagaaggggccagcctcccccagtgcaaacagcgcaaatttcccgagactccaccccatccctccatcacgcaggccggtgggagattctctggggatattcaccgttattttcctcctgcagctatcattcctccctctgaagaagtacatgtcactgccatcagagtaaggataaggatgaagatcaatcttaactgcttcctgctgacagggggcactgttttgaggaaatggtagtcagagctccctcagaggtctatgtaagggtccttggcagaaggggccagcatccaaggcttcaactgcatgacc

SEQ ID NO: 270300 - DNA, 377 bp, Homo sapiens
gcagagtccaattaacaagagcaagttctggtagaaagaaggtgactttattccagagctcaggtgtttgaactgatgtctgatgaggatgaatccagcgactacctctgcctgtccatcctgggcctcttctgttgccttcccctagccatcccagccgtgatcttttcttgcctgacaaagaactacaataaatccagtgactatgagctggcagccaagacctccaaacaagcctactactgggccatcgcgagcatcactgtgggaatcttaggtaccatcttgtacacctacctgatatacttacttagattgtaaactgcttcccagctcttgaacaaaccaccaaatatacaccacagtgcaatttacct

SEQ ID NO: 270301 - DNA, 390 bp, Homo sapiens
gagaaaatacttgtgaacaacaaatttgtcaacgaatttgtaagtagaatatataaagaacttaaagaactctcaaaactctgaagtataaaacaacaacagtaacagcacaccacccaattagaaacttggcaataggtacaaacaaccatttcgctacagagggtgtgaaaagatgcccaatatctttagccatgaaggaaatataaattagaatcactctgaaatactaggacacatctgccagcaaggtgaaaatacccactgctggtgaagctgcagggccactagctcactcctacactgcttttggaaatggaaagtgacaaagccattccggaaaacagtttgtcagatttttaaataaaaaatgcttgttatacaacccag

SEQ ID NO: 270302 - DNA, 510 bp, Homo sapiens
atttgtttggcttacggttctgcaggctgtactggcatgacaccaacatctgcttggcgagttgaggcctcaggaagtttttactcatggaagaaggcgaagggtgagcaggtgtgacacatggcaaaagaagagtgagagagaggaggaggttctgggctcttttaaacaaccagctctcatgtgaactaatagagtaagaacttgctcattactgtgaggacagcaccaagccattcgtgaggaatctgccctatgacggaaacatcccccgactaggcccgcctccaaccttgggaattacatttcaacatgaaacttggaagagacacacatccaaatcatatcaattacttccatcattgcttctctcagactttccagatatactattgtgtcatctgtaaatagttttttttccttcttttccagtgtttatgcctttaactatttatctaattgcactgactaatatctccagaacaagattaaatagcagtgtaacaatgt

SEQ ID NO: 270303 - DNA, 797 bp, Homo sapiens
atttcaatttggtgggcacatttaaaataaaaaatttaatactgtaaaatactccaaacatatagaaaagtaaataatagacaccatgtacccattatctactttcatcagacataaatattttacatgatcgcttaaacattttaataacttgatactgaaatattaatattctaggtttgctttaactctttctatatatgtacataatagtttgagaataaactgcataatgctccttcacctcgtatttcttaaaaacaatggcatctcttacataatcacaatatgattccaagtggccatctaatgttccttattggaaaagagtaaaaaaatgtcctggtcaaggatcgaattcaggatcataggatcacacattgtatttagttgtaaagtctccttagtctccgtcaatctgacacagttcctcagtctttgtctttcttgatgttatgaagagtataaaatatttatatcatagaatatgcctcattctatgggtttatgggtttgtgtgtttactcactctcggatggcaggttacacatttttggcaggaatactacagacataatgtgtgtccttcttagtccatcatatctgggaggcgatattatatctatttgtcccattattagtgatcctaattttgatcacttgtttaaggttttatctgctaggtttctccactgtaaaattatcatttttacctttgtaactgataagtattttgggggaggacactttgagactatataaatatcccttttttcatcaaatgttcactaatttta

SEQ ID NO: 270304 - DNA, 272 bp, Homo sapiens
aaattgataaagaggaagtcaaactgttgctgtttgctgataatatgatcatatacctagaaaaccctaaagcctcctccaaaaagctcctagaactgataaatgaattcaccaaagtttcaggatataaaattaatgtacacaaatcagtagctctgctatacaccaacagccaccaagctgagaatcaaatcaagaactcaaccccctttacaatagctgcaaaataaaataaaatacttaggaatatatctagccaaggtgaaagaccc

SEQ ID NO: 270305 - DNA, 540 bp, Homo sapiens
aactagagtcaaatcagactttgtcagaaagtgtgatgtcccagttccaaacagtgtatttagtactgtccttgtgaagaagtgtttcgtttaaatcttaattctaagataaaaaaataaggcatagtgcattccgacgaggttgtctcttgcggggaacaactgctctcttcagaattgtttagcaaagctctcaccttaggcatagcttatgagggactatctggagctatgcttttggagccagggattttctttcaccctggtgctgtctgtgtacgttggaaagatgggcaagaagtatgcctctctcagtaaagtggagaggggaagaaccagaagactcctcaggccccttgtataatagaagagtatgttacatggcatataacggattgattaccttagatgtttgcacctaactgtatatgagcaaatgatgctggattaatggttcatcataatcagtatggaaatggcattttgactaggaaaatgtcctcattcttaagggatgcaggctgaagtcttcagccattt

SEQ ID NO: 270306 - DNA, 292 bp, Homo sapiens
cagtaataataatgatgaaaatgatctagacaacttcccagggagatctgatgtaagttacagcagaatgtttttccctggaacacagacccagcagatcagccgttattcaaccactctgagatctagcgaatgctacactttcatttttttccagttggttaaatttagagtatatggttcattgtaacagacataatgaaaatatttcatgtactatgccacttttgatttcacatatgtgtctggaatgtggaacaaggtcactttagaaaataaaatctaatctttt

SEQ ID NO: 270307 - DNA, 361 bp, Homo sapiens
gtcaaggtcatcaaaaaagtctgagaaattgccacagccaaaggagtctagagacatgatgactaaatgttaggtggtgtcctgcgtggggtcctagaacagaaaaaggacattagaaaaacataaggaaatactaatgtaagatgagaaactggtaaggtttataagaactctgtagcatgtttgcaattttttggtaaatagaaaacttgtaaacaatagttctgttgtttaggtgggagcaatcaaggccgtgcgtggtggctcgcgcctgtaatcccagcactttgggaggccaaggcgggtgtatcacctgaggtcaggggatcaagaccagcctgtccaacatgatgaaaccccc

SEQ ID NO: 270308 - DNA, 313 bp, Homo sapiens
gacgtgccccatcggtggcgaaagaaggggcttcctgacccaactcccccagacagccgccaactccgatcactctggccgagtttgtctactcttcaccccaccccaactccaaacgatgaccttcagtcagacttcatcttcaaatttgacgctggcccctagcaccattctctatacaggaaataaggtgttgttcaatgaatggaatttcagtgtccacgagaaagcccaatacctacacatccaattcccattatcaaatgtttgcacaagaatcgcaaattaaagccaccacttcatcaactggtca

SEQ ID NO: 270309 - DNA, 291 bp, Homo sapiens
tactactactaaattcgcggccgcgtcgacattccgaggattggatagtccattgggtccatggcccattaccagaatcatgtgagaggcatgtaaaatgcagattcctgggctccaccccaatcacaggagtaccacagcaatcaccaaactataactgagctcccaatttttgtacagtcatgagctaagaattatttgtacatataaacgttgcagtcaatttgatggtatggaacactctttgaatcccaataacatttcaagtcattggtcgacgcggccgcgaat

SEQ ID NO: 270310 - DNA, 1133 bp, Homo sapiens
  misc_feature (19)..(20): n is a, c, g, or t
atacatatacaatcgagcnngtaccccaggtagactaacgtatcaactaatttagtccccacaacagcactatgaggtaggtattattattatcatcgtcatcgtgcatatggaaattgaggcatacaggggttatcatgtgaccagtgagtggcagaaccaggattcaaactcagccagtctgcatactcaacctctacactctactgcctcctttgaaacaccctttttttcttaagatactgtaaggaagagctttttcttctccagctttggagtggtgccaccgtagaaagagaatgagttttctattattgaagacgctgaaatgaagagtggatagcatcctggttggagatattagagggccaggaggttcaggaccaggggctgtggattatcattttatgaagccttgcactgagtttgctttagcacatcacagtgggttaggttgaagtggatctggcctttaaggtgctgggggacacattttgagtaaggagaagacaagcaggagctgctcaggcagtctgcatctgcagccaaaaaaactcaacataactggcatgtctttagtatctgggacatagtatgctcatagcacctcatggatcatctcacttaatcatcccagcaactctttaagggtaggccaagcagtgcaatgccacccctgttgtgaggatgaatcatctgatttttggagaggttgagcaactggtaggtgcacagccgggttctcgcactgcaaaaccacaggcccctttggtggacagagattccgaggattggatagtccattgggtccatggcccattaccagaatcatgtgagaggcatgtaaaatgcagattcctgggctccaccccaatcacaggagtaccacagcaatcaccaaactataactgagctcccaatttttgtacagtcatgagctaagaattatttgtacatataaacgttgcagtcaatttgatggtatggaacactctttgaatcccaatgacttgaaatgttattctcccaaaaaataagaaatccacttgtctcgttaacagatctcgttacaaaaaaaaaattgtactcaatatattctgaactttatcaataaaagaattgtggaaatgtgt

SEQ ID NO: 270311 - DNA, 361 bp, Homo sapiens
caggaatttttggaattacaactgtgactaacgcctttaagcaactgtcagctggctggccccagggctacatcctgcaatttgcacctgtctgttggaaaattactccagacacaagcagtccaggtggctaggctcctgcgcatgtccttgaatttgctctccaggccctcctgtttggctgccgctctggctcctaagcaaggagtacccggaggtactctttttgacagtaatgcgttaaaggcaaagaagaaagtatggctttcacagttttactgggaggcctagaatgatttgaaacggacttttgtttcattaatgggaaaagcaaagcaaaacaaaaagcctatcatctaaa

SEQ ID NO: 270312 - DNA, 451 bp, Homo sapiens
caagcaagaattctgtatttgtcaaaactgttaaagaataggggcactcaaggggacattaagatatttccagataagcaaaagctaaaggagtttgttactaatagatctgccctacaagaaatgctaacgggagtcctccaggctgaaataagatgctagatggtaattgaaagccatatgaagaataaagaaaactgatgaaagtaactacatagaggttgaaaggatggaaaaagatattccacaccagaagagagctataatagctgttttattatccaaaaaaaccaggttttaagtccaaaagggatccaagagacagaattattatatattgataaatataaaatattaatctttcaggaagatgtagcaattataaccacatatgtacctaacaacagaatccttaaaatatatatagcaaaaattgaaagacttggagaga

SEQ ID NO: 270313 - DNA, 344 bp, Homo sapiens
aaaaacagcaagttacagaatggtctcataaaacaaaaacaaaaacaaacaaaccaaaaaacacttttcctcctcaagaaaacaaaaataagaacaaaaaaacctcctaaattacacatatgcgtatgtgtttgtatgaacctaggaaaatgtcaggaaggatgtgatggcctctgggggacaggcttggaggaagaaggaagcttatgttttacttcatatccttctgtcctgttccaccttatttgaacaagcatgtgttgctttttattacaatgttaaaaggaaaaatccttagactaactaagttcaacagtttacttgaccaattaaaatgattcaaa

SEQ ID NO: 270314 - DNA, 908 bp, Homo sapiens
ccacaacgcacccacgataagagtccctgcctcagcctcctcttttactaactccaccctttctcatctctgggacccagcagggacctggagaggccaacagccactgctacctttgtagtcttcaaaatattgaactgcaggtcccaagatgcatttcaggatttaagacaggtgcactaatgataaccattccttcaccaagtagcaacattcttgccagagttcttgggaaacctgtttttttctctactctccatctctgctgctctcatgctttaaattgataaaatatgggctcaaaaaaagaaagccgccaaagactcttatccttattggtgccccatcattggccaccccagccataggtgtgtgctgttggtgggaaatggtctccttcctcagcgttgtgtttgggttactggtgaggccagctcacagagtgacatcatggtcaccagtacatgtcgctggagtaaaatcttgcctttagaaactaggttgagctgttcagaaaggtcaattctcttctgtattccccctcaacatttatctgggtctaaagctcagcactgagtcacaatttcacacaagatcaaagtgaggcagtgttaggaaaccatgggctgggtgcagtgcctctcgcctgtaatcgtagcactttgggaggccgaggcgggcacattgcttgagctcaggagttcaagaccagcctgggcaacatgacaaaaccctgtctctacaaaaatacaaaaattagctgggtgtggtggggcatgcctgtagtcctggctactcaagaggctgaggtgggaggattgcttgagcgcaggaggcggaggttgtagagccaagatcacaccactgcactccagcctgggtgacagagcaagaccctgtctcaaaaa

SEQ ID NO: 270315 - DNA, 475 bp, Homo sapiens
ctcctttgatacaaaagtttcattctgtcagaaataagccatagtacagactcagagatagaggcagtttctagagaactcggtcttatcgtgggttctggagcacacctctcagaccagtcaggaacactggggaggtgacagcaggtccccaggggcctgcagggaatctttcagctgcacggattgggatttccctccaaaccaaactgtcctttaaggggcagcctcctcttttactaactccaccctttctcatctctgggacccagcagggacctggagaggccaacagccactgctacctttgtagtcttcaaaatattgaactgcaggtcccaagatgcatttcaggatttaagacaggtgcactaatgataaccattccttcaccaagtagcaacattcttgccagagttcttgggaaacctgtttttttctctactctccatctctgctgctctcatgctttaaa

SEQ ID NO: 270316 - DNA, 492 bp, Homo sapiens
tagacacagacagaactgtctatattaacatttcctcctaaaaaacaacaggaatcctggggaaagaccactggcctgggactccatgagccctggcttctatctctggctttatcaggtgaccacaggcaagtcacctagcctccatggtctaggccctcctgcctgttgggtgggaatcattacatatcacaatcattacagctgaccttcagggaggctgtactctgggtcaggaattgtgttgggtgcattatcatatttattctcacagcaccctttgcagtagctactattttcatacccattctcagatgaggaaactgtggaacaggctggttaggggacatgcccaaagtgacaaacttagcaaaggtggacctggcactcagtaccacatctgtttttccatgctcttaaccactgtaacatacagagcccttttacagagatcaaggacagaggtaaaagtgttttgaaagcaaaaaaaaa

SEQ ID NO: 270317 - DNA, 290 bp, Homo sapiens
ttgccatgctgtggtgagttctgcacagtcagttaacactgcaagggaaaaaccagctactcaagcctcagtaatggtggacacccctccctcactgagctcgattgtcagaggttgacttcagactgctgtgctggcagcaagaaattcaagccagtggttcttagcttgttgggctctgtgggagtgggaccctttgtgcaagaccacttggctccctggcttcagtaccctttccaggggagtggacagatctgtctcactggtttccgaggtgccacagggcaaaa

SEQ ID NO: 270318 - DNA, 235 bp, Homo sapiens
agctgaggtgctaaaaacaaatacgttaatttccacttcaaatgcagttttatgcttaaaaaatatatgtatattttgaaaatgacggtattccaaaatagtgtttgtcaggttgctgtttttcatgaggactagctcctttccaaaccacaaatctgcttctgtattttcagttccacctctcagtttctttagattttttttcggtgtcctaattctgttgtaaatgacctat

SEQ ID NO: 270319 - DNA, 1045 bp, Homo sapiens
agtacattttccttcttctaaagtatatcctatagatatactcctttaataatggtctattagggaaactgtgatgtctttcattttctgaaaagttattttatcctcattcttttaaaattattcttgttgagtctctttgacttgtggaaccattcatatctctttttttctatataatattgtattatgtaccaccaaaaccttagtgatgcaatagttcttaaatgacaatttcacttttttgtcctaaatttttcccgttaatccatcgtcatcagtttggcaagttttgatacaggtgcttttaatgtttgcatgtaagcaggcagtaactattatgtcacagcagcccctgggccaacaacaattcataattttgattgattgtaataaacaccttgatataagagatattaaaaagtgacaaatttgaatagaattgatggaaacagcattattctgtagtcttttagcttccatttttgctattaaaaaattatttgtcagcctaaaaaaaaaaaaaaaaagaaaaacaaaaaaaaaaataatacacaacaaaggagagaaaaaaaaataaaaaaaaaacacaaaaaaaaaagaaaaaaaaaggggggggggggcgaaatcccccccgggggggccccgacacgatcgcctcaccccaccgttttgagctgaaaaagaacggcgcccaccattggggagcacgtctgtataaaagagaaccgcaagacggcgggcggtgttaccaaaacattggaacagaggaaacaaacccaagcattccagacagcctctagggaggaaaaaaaccaccacctatccggtgggggggtgacacagcaagatggagagaacacacccgaccctcagacagagaatgaacggccaccagcgggggcaaaacagcaactaatgcatgggctgtcgacgtgttgggtcacccccgacactcaacgaacgacagccggccagagaaaaaacttgaacaacacacgatcatatacacgacgaaaaaacacacgcgaggggatgaaaaact

SEQ ID NO: 270320 - DNA, 440 bp, Homo sapiens
tttttaacagttctcatattactagtaaacaaatttaacctgggcatggtggcatgtgcctatagctccaattgcttggaaggctgtggcaaaaggcttgagcccacgagtgaggctgcagtgagctatgatctatgatcatgccactgcaatccagcctggtgatggagcaagactccatctcttaaaaaaaaaaaaatagagttttagaataagaaaacattgttttgtacaaggaatattattttatttatgtatttttttttttgagacagagtatcactctgtcacccagactgccagactggctcggctcactgcaacctccacctcccgggtccaagtaattctcctgtctcagcctcctgagtagctgggattacaggcgtacaccaccacacccagctaatttttgtatttttagtagagacagggtttcg

SEQ ID NO: 270321 - DNA, 494 bp, Homo sapiens
atatttcagagataccattataacaagccacatggaatgaagttaactaaaaatgtgtttataactaattcaggaggaggaaggttcagaggagaccaggagggagtgtgggatctagagaacaaggggatagaacagcttttgtggaaggggagggtggctaactcttcctccggtgaatcactgtgtttgatgcatgtgcaccaaggctgggacactgggtgaatagaggatagcggcgatcgggacattgcgagtgccgtcctcatagctcagaagtcatagcatgtcttaatcatggccatatcctcagtgcctggcccatagtaggtgtcctttaagtgattatgaactgagttgctggtaggagctggaggattagggaacactctggaggcgataggtgataatagttgaacttgctgcctgagggcagtggttcctaaacattgaactgtgcagctgaatcacctagggggcttgttcatacttcc

SEQ ID NO: 270322 - DNA, 299 bp, Homo sapiens
ccgtggagacagtgtctccagaggggcgtggcgaaaagcgtccgcggcccgacagggaagaaactctggtgacgcaaatagatgagcctccctcgtacgaggaggcactaaagcaaggcctgcccaccacccgtcccatcgcgcccatggctaccggagtgctgggccagcacacacctgtaacgctggacctgcctccccccgctgacacccagcagaaacctgtgctgccagggccgtccgccgttgttgtaacccgccctagccgcgcgtccctgcgccgtgccgccagcggtccg

SEQ ID NO: 270323 - DNA, 553 bp, Homo sapiens
tggccgttcttagttggtggagcgatttgtctggttaattccgaataagtgatttgtccaagatcacagttaatgaaattgtcaagtgagaatgctcttggtgtacttgcaactaactccccccacccacctccacatcataaaagcaaaatttcagttgggttgtattttaggcttaccaaaaattactatttcttggttaaatcaccaaatgctaaaatattcctaagaagttaataaatcaagatgcacagactcaacaacaaaaaatatcattaaaccaatggaactacaaattaacctacttaacttccaaaatggcctacaatcttattcctagttgcaggtttagaaatctttcataagccttttcctcaaacttcttataaaattctaggatccacctttttgcataattcagtaaatcatttttattctgattgaaaaaagaaagtgcatggggaaagaggatggagttgctcatttctaataagaattaagtcatatgcaaaaggtagtggtttcaatcccatctctttcaataactggcccg

SEQ ID NO: 270324 - DNA, 316 bp, Homo sapiens
ctgggagcgaaaaatccgggatccggcaactttgggcagcgcatgcggcccgcgacgctccatcccaaacacacacacatttttcccccggacttggaaagtcacccaaagccgccccaagtgcaggcaaacagaccttgctgactgaaggcaaagactcctccatcccacctgccctcccagctgccacggccatcgacccctcctttacaaggggctcctgcaactccccagcagcacgtgttggaatggacttcggaccctggcctcttgggatgcaaaggtagatgcttccggttcccaagatgccactagg

SEQ ID NO: 270325 - DNA, 261 bp, Homo sapiens
tgtctaaccggcctccggcagagtggcagatcatctgactctctgaaccactctgaacatcagtctcttcatctctaaatgagggtgctggccgtgtggatccgcaggggtatcctgaggtttgccacgtacaaaaagcttaggacagtaaatactaataggctggtgcaaaataaattgcgtttttgtcactaaaaaaaagtagcaaaacccgcaattattttccaccaacctaatattaaatgtgagtgactgggtcaa

SEQ ID NO: 270326 - DNA, 409 bp, Homo sapiens
tataaggtttctcactattatcatgacagccgtctgctaacagtgcaattttctgctgtattcatgtgtttagataaaagaagattgcaaaaaattttcaaataaaggtttacctcattctcttgccaggtaacttttgtcattaatgtgctgagttatggtctcggcatcatgcacagtcaagagagctgatcctctctgctgggtcatatatatgctttccttcctaatacccataagaggcattagggggaaggagaagaatataaacacagaaaccacatcctaacagctgcctctagttagctctgcttccccccccatccccacccccgagcttttaaatcttgcagcggcacctaatttgtcccacatggctttcctcccagtggaaccactggcccttttc

SEQ ID NO: 270327 - DNA, 419 bp, Homo sapiens
tttgctgaaacattctagtttctgaattctcacttttgcactctctactagagaccaggctttatgctgcttctgtgaatgggaaaactcaacaatgagggggaaaatgtcctccaaaatgaagttttagccccagtactgtcccatgagcaggaaaaccacctttcattccttacattattttaaggcacctattctgcctccaattaacatgttacttaaatagtaacattttatgtctgaaagttaaccagaatcactgcctaagaataagtacatgactcgaggccatgatagcaaaatagagagctcaactcagtacactgtctccattaaagaggccttgcccaaatacaactattacatcctattttccaagatccatctattgaggaaccatacaggtcacacaggtttac

SEQ ID NO: 270328 - DNA, 466 bp, Homo sapiens
agatcaaaggagaaatcaatgaaatttaaaaaaacacagaatgaaatcgaaggcatttgtttttgttttcagaaaatgaataaaattgataaacttctatcaagaatgatcagaaaaaaatacagaagacacaaattatcaacatcaggaatgacagaggtggcagtactacagattatacagatattaaaaggataataagtaaataatatgaactatttcatgtgaacaaatgtgacaacacatacaatgaacaaattccttgaagatacaagttatcaaagttcacccaagaataaagagataacaggaatagccctgttactatttaagaagttgaggccaggcatggtggctcatatctgtaatctcagcactttgggaggccgaggtggacagattgcttgaacccaagagttcaagaccagcctgggcaacatggtaaaaccctatctctaccaaaaaa

SEQ ID NO: 270329 - DNA, 637 bp, Homo sapiens
tcatcctgtcccacagcttagtatctatatgccaatgattcccaaatctatacccccacttagaattcttccctgaactccagattcgcatatccaccatttagtctatatctccacttggatgtctgcttttcctctcaaatttaacacacctaaaacagaacatctaaagcccccacctctgcagtcaaaacctgcttttcccatagcctttcaaatttcggttaatggtaactctcatcagttactcaagccaaaaatcttggattcatcacagactcctctctttcactaatctcttctttcccacatctaatccaagaggaaatcctattgttctaccttcattggccaggcactgtgactcatataatcccagcacattgggaggctgaggcgggaggatggcttgagcccaggagttccagaccagcctgggaaacatagtgagaccccatctctacaaaaaattaaaaaaattagcagtcaaggtggcatgtgtctgtaatccaagctacttgggaggctaaggtgggaggatttcttgagcccaggaagtcgaggctgcattgagccacagttgtgccacggcactccagcctgggtgacagagtgagacccctgtttccaaaaaaaa

SEQ ID NO: 270330 - DNA, 725 bp, Homo sapiens
aatcttacaagaaatgctcgaatctttaacaaaaatgagtggggctataggggaaagtgaggtcaaggcactatggtgtgcatgcttgcatttgtttcctccgtccattcaaagtgagaatgctcccattttcttactttaccattgatgtgctacaagcttatttattttaagactaacctagcctaaaaatcaactgtccccacaaaataaaaatcacattaaaaaaactaatagtgttcagactaatcttgctcaaacttatgtttccctagtcttgatgcaactgattgagtcacctggggagttggttataaacctgggcagagaccccaaatgcaatggctcagagaagataggagcttatttctgtcttatgcaatagtcagaatgggttttacagactggtgagtagctcaacatctcacagtcattcaggcacccatgttcctcccattttgtttctctgccaccccttaaggacttgccctgactgcatgattattgccgtgttgcctcaaacaggttgcagcttatgggaagcaaaaacacggtatggtagaagctctcccatagactgatggcttggctcaagagtggccgactttatttctgtacatatcccactggatagaatttagtcaatcctaagctgcattgagccacagttgtgccacggcactccagcctgggtgacagagtgagacccctgtttccaaaaaaaa

SEQ ID NO: 270331 - DNA, 1536 bp, Homo sapiens
aatcttacaagaaatgctcgaatctttaacaaaaatgagtggggctataggggaaagtgaggtcaaggcactatggtgtgcatgcttgcatttgtttcctccgtccattcaaagtgagaatgctcccattttcttactttaccattgatgtgctacaagcttatttattttaagactaacctagcctaaaaatcaactgtccccacaaaataaaaatcacattaaaaaaactaatagtgttcagactaatcttgctcaaacttatgtttccctagtcttgatgcaactgattgagtcacctggggagttggttataaacctgggcagagaccccaaatgcaatggctcagagaagataggagcttatttctgtcttatgcaatagtcagaatgggttttacagactggtgagtagctcaacatctcacagtcattcaggcacccatgttcctcccattttgtttctctgccaccccttaaggacttgccctgactgcatgattattgccgtgttgcctcaaacaggttgcagcttatgggaagcaaaaacacggtatggtagaagctctcccatagactgatggcttggctcaagagtggccgactttatttctgtacatatcccactggatagaatttagtcaatcctaactgcagagggagccagggaacacagcccaggcatgtgcctaggaaggggagaatgggtttaggttgacacttagcagctgccactatatgtggctatagtatgtatcattggaatagatgtttaactttagggacaaataaaaaaccaaaacaaaaaaaggagtaaggggagagatttgcagcaaatctttatttttaccaacctcaactatcattaatttcagtgaaccctaaatggtatccaacaaaatatctttctagaccattcaccgtctctgcctcatagatgatcatatcatgttttcttctcttctgaaacctctaatacccttgtcctatcctcattctaagctgatgaccttacttcctatttcacaaaaataatagaaaaaaaaaacagaatttccacaaacccccacctaatttatctgcctcctgccatcagtgccaatatactgtgcttttcttctgtggatacattatttaggccactattcagggccaacccctccacctgcctactagaggccatcaccacttgtttattcaagggcacagctccaggtagttttccttctcttggggatcatcagtttccttctgtctaccaggtcattcccattagcatgtttttgccgcttttcttaagagataatatctcaaccctaattcctcccgctaacttactaccatcatttatttagtaaaatatctcaaaaaagtagttaatcttgttgtttctgattctgctcctcccctcccccacctgttttttttgggagacaggatttcttgagcccaggaagtcgaggctgcattgagccacagttgtgccacggcactccagcctgggtgacagagtgagacccctgtttccaaaaaaaa

SEQ ID NO: 270332 - DNA, 1639 bp, Homo sapiens
aatcttacaagaaatgctcgaatctttaacaaaaatgagtggggctataggggaaagtgaggtcaaggcactatggtgtgcatgcttgcatttgtttcctccgtccattcaaagtgagaatgctcccattttcttactttaccattgatgtgctacaagcttatttattttaagactaacctagcctaaaaatcaactgtccccacaaaataaaaatcacattaaaaaaactaatagtgttcagactaatcttgctcaaacttatgtttccctagtcttgatgcaactgattgagtcacctggggagttggttataaacctgggcagagaccccaaatgcaatggctcagagaagataggagcttatttctgtcttatgcaatagtcagaatgggttttacagactggtgagtagctcaacatctcacagtcattcaggcacccatgttcctcccattttgtttctctgccaccccttaaggacttgccctgactgcatgattattgccgtgttgcctcaaacaggttgcagcttatgggaagcaaaaacacggtatggtagaagctctcccatagactgatggcttggctcaagagtggccgactttatttctgtacatatcccactggatagaatttagtcaatcctaactgcagagggagccagggaacacagcccaggcatgtgcctaggaaggggagaatgggtttaggttgacacttagcagctgccactatatgtggctatagtatgtatcattggaatagatgtttaactttagggacaaataaaaaaccaaaacaaaaaaaggagtaaggggagagatttgcagcaaatctttatttttaccaacctcaactatcattaatttcagtgaaccctaaatggtatccaacaaaatatctttctagaccattcaccgtctctgcctcatagatgatcatatcatgttttcttctcttctgaaacctctaatacccttgtcctatcctcattctaagctgatgaccttacttcctatttcacaaaaataatagaaccaatatactgtgcttttcttctgtggatacattatttaggccactattcagggccaacccctccacctgcctactagaggccatcaccacttgtttattcaagggcacagctccaggtagttttccttctcttggggatcatcagtttccttctgtctaccaggtcattcccattagcatgtttttgccgcttttcttaagagataatatctcaaccctaattcctcccgctaacttactaccatcatttatttagtaaaatatctcaaaaaagtagttaatcttgttgtttctgattctgctcctcccctcccccacctgttttttttgggagacaggatttcactctattgcccaggctggagtgcagtggcgcgattatagctctctcatgcgataagtcagtaccaatatgtacctatgttgactatcagaggcttgatacggcgagcctcctttggtgccgctctaggggatacgggtctcccaaaggggggcacaatttgtcgcactcattcgcaatagattagctgaggtgggagactatcgggaggatacagcgaacatatgatcaaccccaagtcctcgcctcgtgtcc

SEQ ID NO: 270333 - DNA, 487 bp, Homo sapiens
gctagatgccagactatcatttgttgattggttgattcattgtttggaaaatacctggactactataataggtgccaggcatcatacccagagagggacctagcataaccagaattcattcaaaggaggacttccagaattctgagaggtctagagtgctgggacggtgtcttatttatctctacactttttcttcctagcactgtgtctagcactcaggatattcataataaaagtttgataaaacaatggatttacaaatggtggttgaggctcttttacccactggcaggctatcttcctgaagttgcctatatccctgtctgcctgttagctgttaatacctcctaagccaggatgttccactactgtgctgtgccaaacagctgtgacccatcaccacctcctgtgagatacattctttttaccctgcatcatgctaaagatgttaactcttgactagaaccacttcttggggctgtggttg

SEQ ID NO: 270334 - DNA, 280 bp, Homo sapiens
gccagagtgaattcaaatctttatgaccaactcgctgtgccttcttgggtgagttccacatcctgtgagcctccctttcctcttctgcaaaatggagatattaaggaaagcgttgttttcaggatcctgtgaaatgacctacgtgaaacacgtagcttagtgtttggcatatagaaggtgctcctgacagtaaaatgtatgtatgcgtgaatgaatagaagcagccaagttcagaagactatttctggaaggatgctacattgaagattttaggccctat

SEQ ID NO: 270335 - DNA, 513 bp, Homo sapiens
actaaaaatacaaaaaaattagccgggcatggtggtgcctataatcccagctactcgggaggctgaggcaggagaattgcttgaaccttggaggtggaggttgcagtgagctgagatcgcatcactgcactccagcctgggcgacagagcaagactgtctcaaatacctttttcattttcaggagcattttcttaaaattaatatatgtaaattaaattactcaaactataggaatatgcatgtatttgagggggacataaatatttttagggcttgcaatacatattgacaaactgctttccaacaagttataccaatttatcccaagaattgatttggaaattggatgcttgtccacttttctctgcaaagaaagaagattccactgtacatatgatgtcttccacagatttattgtgcaaactgaacggatcacccttagagtatctatctgatcctcttgcccttatgaagtctcacacttcctgatgaaactgttcaccaaattgcca

SEQ ID NO: 270336 - DNA, 910 bp, Homo sapiens
tttagctgtcagggatcctgttgcagctctgcctcagccagtctgtgcacagagcatggagcaccagggccatggagcatgtgggctatggaatcgggttgcctattttcatcttgactccatcacttgctgggcaaccttgactcaatgaatgacatcataaaaatggaacattcaaatgagaatgtccaaggacctgctgacttcactgatgaattctaccaaatatttaaagaagaactcatattttccaaaaaaccaaagaggaaggaatacttccaaactctttttacaaggcaagcattaccctgataacaaaactagacaaggacactgcaagaagagaaaattatagtccagtatgcttcaagaacataaatgcaaaaatcttcaacaaagtaccagcaaaccaaattcaatagcacattagaaagaccattcaccgtgattacatgggatttaaccctagggtgcaaggatggctcaacatatgcaaatcaataaatgttatacaccatattaacagaagggataaaaaccatatgatcatctcaatagtttcagaaaaagcatttgacaaaatgcaacattttttcctgattaaaaactctcaacagattcggtatagaagaaatgtacctcaacacaatgaagcccatatactgcaaacccatagctaacatccaactcagtggtgaaaagttcagagatttttcctctaatatcaggttcaagaccaggatgcccactctcatcacttctatttaacatagtactggaatttctagccagagcaattagacaaaggaaggaagtaaaagatgccaagaacacacaatggggagagaagactttgctaagttgtgctcagaaaactggatattcacatgcagaagaataaaattagacc

SEQ ID NO: 270337 - DNA, 331 bp, Homo sapiens
tttagctgtcagggatcctgttgcagctctgcctcagccagtctgtgcacagagcatggagcaccagggccatggagcatgtgggctatggaatcgggttgcctattttcatcttgactccatcacttgctgggcaaccttgaggagcggactcaaacctttcaaatattttgagtggttggaaagaagaaacacaaaacaattctattttctgagttttaaaaatgtctgaacccctggaagacccagccagaccaaatctgctttttctcctggatccataatgtacagtggtaaattaaaggcttcgagaagctctgtagtaaagaac

SEQ ID NO: 270338 - DNA, 272 bp, Homo sapiens
aattcgcggccgcgtcgaccgacagaagggagggcagcaagctgtaaagtgctgctgcaagtcaggattctgaggtccagttcctcagggattttacttttgttggtctggggtgggaaatccacattttaaagatgagctccaggtgatctaatatccttggcctactgatctcactttgagaaacactgacttagcacacagaaagaagcagctatgtgaaacgacacgatttttattttcttcattatacttttatattgcccaacatt

SEQ ID NO: 270339 - DNA, 419 bp, Homo sapiens
atcaccttatatccgttaagcagtcattcgctattcctttctccccctagaccctagcaaccactcatctgctttctgtctttgtggattagcctattctagacatttcatataaagggaatcatgtaatatgttgccttttgtgattggcttctttaatgttttcaagattcatccatgttgtatcatgaatcatcactttactccttttcattgctgaataatggttccattatatggacatttccattttttacggaaatgtcttatgtgaacatatgaacatttgtgtacaagtttttcattgaacatctgtttttaattctcttaagtatatatatttcaaaggagaattcctgggtcttgtggtaatgctatgtttaactttttgaggaaccatcaaatacacaaattatttt

SEQ ID NO: 270340 - DNA, 367 bp, Homo sapiens
ccttgttcctacttcataggaaaattctttagaggtgggaattccctaaacatatgtaaggtggttcatttaggctgatcacatctttaacagttgccaaaggatcttataccagatgttaacattctattttctatcaaagagccatgttggattttttcattatttaatatgagaacaatagaagtgaacttttatgaagttccttccctatggaatccaactgaagttaactagacacactttaagaaagatggtgaccatttcagagatattctatttactgagcatccggcctgagaacaaaatggacctcaaccttgagaaactcacaagctgatgcgggatttgtagagcatatttaaaa

SEQ ID NO: 270341 - DNA, 339 bp, Homo sapiens
ccaaccaaaaggcagagtgcattgaagcctggagcatgcaggctgtagagttcaatcttcaaggggtgcaaagagtttacagtaattctttgtttcctcatcttttgcatattcttaggattgtggcatctgactcacaattccctttggtctcttaaatctattctatctaaatatctccattgagagttccactttaccctcttgggttatttgccatgtcagttatatcatcaagatttaatcagaaaacagaaaataaagtagaaagatttcaaataaacaatctaatgatgcatcctaaggaactggaaaggcaaaaatgaacaaaacctcaaa

SEQ ID NO: 270342 - DNA, 393 bp, Homo sapiens
ttttctctattaatttcctattttcaatttcattgatttcttccacattaatttttattaatgaaaaattaatcttcattaatgtttattatttgttttcttctgcttactttggatataatttgccctttttctagtttcctaaggaagaagcatagatgattgattttttggttcccacaacttatcaaaacatttttattttttatttttacttggttcaaaatattcttaaatttctcttgtgattttttttctttgactcatccctcttccacttttaattacattggattgaactaaataatccagggttatttccctattttaacataggcttcttagcaaccttaatttcatttacaaccttaactgccctttatcatgtaatca

SEQ ID NO: 270343 - DNA, 426 bp, Homo sapiens
gcactgggagggagggagatgggggacaatttgggggttcagcttccctttgcctcagcctccacccagatgccagagtgaccttcccaggctctggttcccagcccggcccattttccccctcctcccagagcctccaactgcatgtgaaattaacagggcctccgcctctgcctccctcggtgggtctgggctctgggctctgggttcagggctcagggttcagggcagggtaggaacgcaggcagtccttgcacagcttgttccctgggtcactggcccgcatcctgaccccactggagttcctctgaccgttccagcctccaggcctttgtgctctgccaggaacacttcctcacctcacccgttccacccagggaaaccccatccatctttcaaagcctagctgcgcccgagcgcggtggc

SEQ ID NO: 270344 - DNA, 431 bp, Homo sapiens
tatacgtcatgttgtttatccattcatccatggatgaacatttgggttccttccacattttggctattgtgactttatcctgttttatattctgcagcaatttacatctttattttcagaactattaagtttcttcatattaacagtcataggaaaagagcaatgaaagacttttatttgatttcattttgtggccattccttttttttttttttttttggcagccacgaagactgggatttctaattctatgttatgataagtagacaatttaagccatctatctttttttctgtttcctttttaaaaaaaaagaaaatagcatttttctaaaatatgatcatgtcagtttggtctatttttatacgtgttaaggagagcactaacagacaaaagaataacaatatagcgattaggtatttagtttttaa

SEQ ID NO: 270345 - DNA, 364 bp, Homo sapiens
agtataaacaagtaccaagtgaagactttgaacgcactcctcagagtccgactctcccacctgctaaggtagctgcccctaatctaagtcgaatgggcgcgattcctgtgatgattcccgcacagagcaaggatgggtctatagtatagagcctccatacatctcatctgtgctctccgtgttcctttcctttttttgatatatgaaaacctattctggtctaaattttgttactagcctcagaatgtatcagaaaataagttaatcaggagctgtaaggaatatatttttaaaaatttttgtttggttatatcgaaatagttacgggcattaaagttagtaaagacaagtttaccatctgaaa

SEQ ID NO: 270346 - DNA, 421 bp, Homo sapiens
ggccagcaggaccaagccactgtcaactgaggaagtgcgtcagctgggcgacaccagctgccagcagctcggggccttgccctgtggggctctgctccttgcaccgtctcggcatctgcggggctttatggtgaccctgctggcattccacaggctgggaagtcactgagttcgccactttacaccagaggaaacaggtctttgaaactggtggtgacctttggccgggctgacgggaccatgttggctgtctggttatgagtgaagttctcgccctgtgatggcaggtttgttttttagtgcggcataagtgtaagctatatttgtgtaggaagtcctagccctgccccaaaaagaggccaaaagagaattatgatcttttgaaacaagatatttgttttaaataaataatataatttta

SEQ ID NO: 270347 - DNA, 454 bp, Homo sapiens
catattgtgtttctcatttctgggtcaatgttactagaaaatatagacttaagatttagatgtttcattgacttcaatgccagattatagatagttgggttgtacaatgacataaagcaaagactccaggattttgaagttcttcacttctcagatataggcaatttggtcttaagatacctatgagcaaagtaacttcaaaaatgtattggtaagaattaagttggtgatagaagggttgtctgtaaatgtaaagaattacctggtgcaaatgcatacgggtggatgtcggtggggattttgcgtgcacactgcttggtatgcaatatggctggtgaactcaagtacccaatactgtacgtaatgggaaccagatgtctaacagagagagaaaaatattttatagcaataaatgtgacattgactcttaaagggtttgctgtttttaaacaac

SEQ ID NO: 270348 - DNA, 375 bp, Homo sapiens
tgtattgattcaattcagcatgcacttataagcccttgttttatgccagtgttaaaataagtaactgggaggccattaggacgagacagctccagcgctttgggttcctatgtaagcaaacgaaaactcaaatcagtgtgaccgatcatatcccagcaaaatgaaactgaagtttaaccaatcagaaactgccaattaacctctaacgagggactttccactttaaccaatcaaacattttctttgtctttcttccctgaacacctagtaaaaatttgcctcttgttcctcctaggtagagcctacactactaatgatttggcactgcctaattcatcaattgctgtctactcaaataaactctttaaaatctta

SEQ ID NO: 270349 - DNA, 242 bp, Homo sapiens
attttttatgtagtacagggatagcactaaaggtaaagtaaaagaaatgtaggacactatctcttccttttagttgattggtagacaagacctgcacattaaaatattagacaatacattcaatattttgctacacagaacattatagttaataaacgttggaaaagaggaaagtcattgctttctggaaacttagccagagtcctgtggaagagatgggattgaacaggatttgataagag

SEQ ID NO: 270350 - DNA, 415 bp, Homo sapiens
attaatcattacctgaaaaattcctaacagcagtgggttgagtgggaaaaaaggcatggaggatgaaatcatgttctttttttttttttctttttgttggcgtgtttgataggtttaatatgttactgagtctgccagttcaaatagcccacttagggatcttagggatttgtatttatttacatttagggttacctcaaatcctatggcaagcaaaaaaataaaaataaatccccaattatttccctcaaatcaaaccagaattcctactgtttctcaaaaaatcttagtttcttagtctatatatgcaatcataaagcttcttccagtgtttgtataattttggtggcctagatcttggtcagatgggacagggaggggaatttttgtatgaaggaacataaccaaaaaaaaa

SEQ ID NO: 270351 - DNA, 406 bp, Homo sapiens
gatcttgtagctgggcatggcccttgcacagaatggggagctatgcccagagcgtgtttcaagagctttggctcctatggggcgtgaggctcttctaccaggatagcttccactcctacctctctgcacctgaacagactcccacgtgcactgctgcaagggtgcctgcagaaggcgacttgtcctccatcctctgaacagacccagtgccctatgtggcccacggtcatctgtgagtctgaatgttcacaacctaagaaggtgacttgttggcagacggggcaataacatttcaacttcagaggactgttgtgagagtaaatgaggtaattggcctgtcatgtaccaagtggctcaaaatgcagaagctgttattaattacataaagcattattatatcgttaaa

SEQ ID NO: 270352 - DNA, 332 bp, Homo sapiens
cccagaaagattttaggacccaggaggtgcttttcctccagctgttgccagtgtccttctgagcctggattctccggggatttccgtcgtggtggatggacttcacatcagcagcagttctggtacagaattgtaatgtgttttcatttctctgtaggattcacctctcaccagcgtctgtcttaaaggtagggccaatttcatggagcatttttctgtgtgtgtccttgttgcttttgccagaaaaagtggatttgacatgcgtgccccgatgccaccatagcccctaggccaacaatgtcatggtctaaacaccaaaaagtgatgccccg

SEQ ID NO: 270353 - DNA, 359 bp, Homo sapiens
gaaaggataaccacaatccaatgacactggttatctaaataaagggatggataggaacggggtagaagggagagaagcagtaagactcctctgagcatactttttttttgacagttttaactttgaggactttcttaatgtatcttatgtattcaaaaataaaattgaacctggccggccgggcgcggtggcccacgcctgtaatctcagcactttggtctcagcgcttggtccctctgggtatcctcagcccgctctcccttactttggtgcatgaaaaactgtacaatgaggttcagcacagccagcatcagccgagctttttggtgaaactcagatcagccacccaggaggaagag

SEQ ID NO: 270354 - DNA, 261 bp, Homo sapiens
agatcattaaatagtaacagagaaagtaatttcatatcctctctgtcactatgagagaatagaattacttcctttgtttaccagttgggttgaaaacaaagaacatacccacatgtagaagaaaaaccaagaacatacccctccattaaaattcatcccacatacaaagtttcctttatgcttctgagagcctatctagctgtataatcaaagaaaatatgtttctaataaacttcaaatagacacagtactactatcctt

SEQ ID NO: 270355 - DNA, 383 bp, Homo sapiens
ggagtgcagtggtgcaatctcggctcactacaacctccgcctgccaggttcaagtgattctcttgcctcagcctccagagtagctgggactacaggcacatgccaccacgcccggctaattttttgtatttttagtagagacggtgtttcactgtgttagccaggatggtctcagtctcctgaccttgtgatctgcccgcctgggccccccaaagagctgggattatagatgtgagccaccatgcccaggctgtaggttgtctctttactctcatttcctttgctgtacagaagctttttactttgatgtagtatgtttatctgtttttgcatttgtcagtgcttttgaggtattattaaaaaatccttgcccagatcagtgt

SEQ ID NO: 270356 - DNA, 1004 bp, Homo sapiens
tatgtagctctattttattgtaatgttggcgtggtactgcattgtgtagatgtaccaaattatagttaactgtcacttactatgtcctgtccgtatatattgcccagtattcttcaaaattatctgtttctcattagactacagatttcattaatcctttgtgaaatatatggcaaatattttcaagaattatcaatgctttggtttaaaatgcccaggctttttatctcaggtaagaaggtagtccccactcaaaaattcttaaaatcttctcctatattgcctgttaattctctttttatgatttactcattaaaacatctgaaaatgatttttgtatgctaagataaggatttaatttttttctttgtttttatgactaggcagccattttttcctgaaatcatttgttgaaatcatttctctcccaactgactagaaatacctccttaatatcgtaaattctcaagtgtacatgcatcttttctttagactcatctgttgctttgatctttttgtctcttcctttaaaaataccaatctgctttgatattacgttttctagtaattcataggacaagtccctcttcatttttccttttcaaaattttcttgaatataattgcattatctttgagataaaatttaacataaactgttcatgcttcattaaaatactctttttgggatttaaccattatattttcttatattttgtgactggtatgtagatgagtgtttatgtatctggccaactttctaaatttattaattttaataaattgtttcacttgaattttctaggaaaacaatcatctaattataattcatcttatctctttctttctttgctttagtgaattgctggcttccccagaatagtggtaaataaaacagtgattctggccatcctttatcttgtttcttagtttggggatgtttttattatgtcatcattaaatatgaagttactattaatatctaataaattatatttatcaggg

SEQ ID NO: 270357 - DNA, 595 bp, Homo sapiens
catgagcttcctgtttgcattggtacctttgtgcctccataggggagacgcagggctgcccggggctggtgctgtgtttacagtgggtctgcattcacagccaaggatccctgagtttaggaaacccccaatcttaagaagtctgccagtaaacccagccaacttttcctatggaggaagaagctatctttattatcctggtcaggaatcaaacttgctctctgcctcagaggaagacactaatcttgctgtacaaatgtccttgaaaagagagtcttggataacacatggagaattgcctcccacccctgcaacaatattctagcgagataaaggaagaatccaagaaagaggacaatacaggatacacttatgtaaaaattagttacagttgaatatgaccaggagaaatgtataacattagaaagaaaataaaatggaattgctgtgagatggttggaagacactcccttgaccagcagagtttaagttgcatagcattacgtttacatttcattctatctggcttatggatggaaccacattctaattctatgatgaataaagtttgcatgactttttaatgtgataaata

SEQ ID NO: 270358 - DNA, 412 bp, Homo sapiens
ttatggagacaagggaaacaggcccttgaaaagaaggcttccgaggcaattgggcggtgtcagtcttcagctgctaagccgagaagatctgggaaggagtcagagagctttgggccagagttccaggggctctgggagtggttgccaggtatgaattattgattctcaaaaggatattagttgtaattgagaagaagccatccttattgtcttattttgttgggatcatcatcataaaaagtaaagaagcagaagaaaaatcttaagggttaatcttttgatattgcaaatggcttattattgtgaaattaggatagtcaaagttggctccattgttactgagtccaacaaaaatgccatgagagatgaagagatatttaaataaagaaaataaagtagaagagaaagattg

SEQ ID NO: 270359 - DNA, 263 bp, Homo sapiens
gatcttctcatcagagacaaggtgcccaagaactgaatgggagggaggtgggcacgccaccttatagcccaagaatcattagtcaggacagcctatttataaaaatagcttgctaagaggagttttaaagaccacagaagagtacatttctttactagttttatttactaaaagtgtaaaaattagacttttaaatcatttgattccagaggcacattttttaaaaaatgtagtttttgagaattataagaggtatattaaaa

SEQ ID NO: 270360 - DNA, 458 bp, Homo sapiens
cagcttttttctctgaatatctttcttctttaatctgaaaatatgtccttgtatctggtgacttttatcagatgagaacttcagagttggtcattgttaccagtaagaaaaatataatgcttaagaagaaataacgaaggttgaacattatgtgttttagatcagaaatagtttctggccaggcacagtggttcacgcctgtaatcccagcactatgggaggctgaggcaggcggatcagctgaggtcaggagttcgagaccagcctgaccaacatggtgaaaccctgtctctactaaaaatacagaattagccgggcgtggtggtgcatgcctgtaatcccagctacttgggtggctgaggcagaagaatcgcttgactctgggaggtagaggttgcagtgagccaaaatcgtgccattgtactccagcgggggcaacaggagcgaaactccatctc

SEQ ID NO: 270361 - DNA, 164 bp, Homo sapiens
tctgacctagttttgaaccctgggtacaccaattttttgttaagtaacttcagaaaagttacttaacctatctatgcatcctaaccatctcacctactaagtggacatcctcattaaggttgccatgagatttagatgtgatgatgtatgcaaggtacttagta

SEQ ID NO: 270362 - DNA, 950 bp, Homo sapiens
gcacatattagtattcctcactttaactctgtttcattatgtatgttaactatactatttactcaaactcttctttctctggagttgtaactagacagctcaggtgataaggccttagcttagggataaatagtaaagggaaggaagagaagtatttccaagggcttcatggaaactaaaagcaccattcagaatatttgcacaatcttcacacagaagtcacagagaactggaatgtcactcaggacacatgtcactatggtagtccaaaatgttacaaatgacctggtggtcatactagtggttgccacctcagaagaaagtttctgttgttctgtcaggctcaggtacttatctggttttacctgatatttcatttctctttctactctcctctttacatcatcttttgcttattgcctggtttttggccttgtgctgtttccataggacctgccctttgaactggaaaagagagagggtatgattggttcagctgattacctttcagtgtaaataatttggaggcagttgatttgattacccttcagcataaagaatttgggggcagaccggtcatgcctggtcatcataagaactgaaggcttgcctgaagttggctactcttaggttaataatcaaatgtcatctactcatctgtccaaggaaacaggtccgtgaggcaccaaccacagcatcataggtacatgaaacaatctagagaaacaatctagggatcattcagaagagtaccttggatgtggctgcctaaaagatgagagctgataaattctctaaaatacaaagcaactacgtctctatagtatcatctatgataagattcactagcaatcgtaaaacctaaaagctataaagccacagttggatctgaggaatctaagacagcatcaattgcacgatgtctcatagatttaacaagtcttttgaaa

SEQ ID NO: 270363 - DNA, 451 bp, Homo sapiens
agggtttggggcatacatggtatgcagctgggagttctgacaggtccgggggtgcaaggtgacttatagcagcagtttgcggaatggatgatggtaaggtgtattagtgttatggtctgagtatgggtgtccccaaaattcatatgctggaacttaactcccaaagtgatggtatgaagaggtggggcctttgggagatgattagctcaggagggctctgccaccataaatgggattagtgcccttagaaaaaggcctgatgtatcctgtttgccctttgccccttctgccacgtgaggacacagagaaggtgccatctatgaggaacaggccttcatcagacaccagatctgttggtgccttgatcttcaatttcctagcctccaaaactgtgagcaatacatttctgttgtttataaatgacccagtctgtaatggaggaattggtaaa

SEQ ID NO: 270364 - DNA, 346 bp, Homo sapiens
gtcaccagctctatcactacatcaccttttacattttcctttccctgtccacaaatagcatctagagttgttcttcataactaaataattcaatgctatctttcagcttgcatatgccacagagcaaaacaaaagctgcataggtactggcataacctaggattctcggaaagctcacaccaatcaattgattatcccttgtattccaagtgtttcaaggataggatcatctccaacacatctttttactgagctaatagagtggaagagtaattggaaattttgatgctaagaaaaacaagatttttttccttatgtgaactcaatacagtacattttctgtaaa

SEQ ID NO: 270365 - DNA, 215 bp, Homo sapiens
gtgagaaacatcttcctttatttactaaataaaagaatttaaaataagataaaattgaaagaggagacttacactgtctacagatggtagcataccgtggctgagtgtggtggcttacgcttataatcccagcactgtgggaggccgaggtgggagcatcacttgtgcccaggaatttgagaccagcctgggcaacatagcgagaccctgtctct

SEQ ID NO: 270366 - DNA, 443 bp, Homo sapiens
caaactgggacatcgaagcaaggattggtagagtgggaattaacccctcccataactccaccccatcaccaatgtcaatctcatatacccttcaccttggtttatgatttctaatgctggtttggagtataagagagcaaagtgaagaaaaagtagaagagttgatagacaacaatctaaggagcagggcaagtagtttgcacttagcatcatcccaaagaagaggatgggcttttaagcaatttatatattaaaaaaaaaagcatcttgcccattcctcttcgccagtgtccctgggaggaaatggaggcctgatcatctgatggtgctaaagtcaacaaatttacaatagaaaaggattttctctcctggaaatatacccaagctattttctttgtttaaaaaaataaagatctgctcttacgatcctttgtgaagttaaa

SEQ ID NO: 270367 - DNA, 475 bp, Homo sapiens
gctcatagacattctacacacacttcttgaaattgctcctggcctgatattttggatgttaggtagtcagtgtccaataatactgttgtccgtgcaggttaatctagccattccttcatttgtgtgaagcataaataatgtaagtaaatacagcaactgaactttttatgttctataatagagcacttttatgtttttaatatcatttattatttctctgaaaatccagttaagatggcagatgattctattttttcatattatagcatctacccacaatatttctaactaactgtatttgaacaaagaacttccttagtctttcaatttaaattatgtatttgcttaatacatttttatatttgtaactgtggtaaaaaaaaaaatctatatagcatcttgcatacattctcactagtacaggaataaaactgcagtttgttgaaggagagtgctctgtcttctattcacctgc

SEQ ID NO: 270368 - DNA, 337 bp, Homo sapiens
acttgtcgtaaagttgtaaaaattacatatcatttatttagtactgtttggggtacatagtaagtgctcaatacattgcagtatttctacagataaagaaaccaagatggcagatcagctgaggtcaggagtttgagaccagcctggccaacatggtgaaaccctgtctctactaaaaatacaaaattagccagggatggtggtccatagtagtcccagctactcgggaggctgaggcaggagaatcacttgaatctaggaggctgaggttgcagtgagctgagattgcgccactgcactccagtctgggccacagagcgagactccatgaccccaa

SEQ ID NO: 270369 - DNA, 402 bp, Homo sapiens
aaaattttaagtgaagtttctgaggatgtttgaagagataaatgaagaaataagtttgattaaaaagaatagaatatttggtaaaatgaaggtaaaatataaagtaagagggccaggcgcagtggctcacgcctgtaatcccagcactttgagaggctgaggcgggcggatcacaaggtcaggagatcaagaccatcctggctaacacagtgaaaccccgtctctactaaaaatacaaaaaattagctgggcgtggtggcgggtgtctgtagtcccagctactcgggaggctgaggcaggagaatggcgtgaacctgggaggcacagcttgcagtgatccgagatagcaccactgcactccagcctgggtgacagagcaagactccatctcaaaaaaaaaaa

SEQ ID NO: 270370 - DNA, 433 bp, Homo sapiens
gatataattcaaccatttaccggtctttggagaaggaggatgttttcacgatttacacatacctaatacaaatcactgggggctttcagaggctgagaggtaaggcccctgagtcaaagcacaggacgagtcttgtgctctcagtaccaatagccaaatggcctcccagcaaggctgcagcactgttcactccaagggcaatgtgaaaataagctgccctggcacacttcaacgacacgaagtgctccatgggtcacctagcaaagatggttttattaggtagtaagaaggggaaaaacacattttatatttggacattaggagcagagatatattaccatgaagctaagaaaccgtaatcttcagagccttccacttgactaagccctgcccattctcattctaaataaaccattcacttttgtaaaaaaaa

SEQ ID NO: 270371 - DNA, 558 bp, Homo sapiens
agattaaacatttatttgtgtgtctgtgcaggtgtttctggatgagattagtatttcagtcggtggactcagaaaagtacctagccctgcccaatgtgaatggacatcatccaagcctctgagagcctgaatagaaaaaaaagaggcagaggacggagaaatttgccccttttgcttcctgcctgccttctgagctgggacatgggtcttctcctgcctttgcactgggatttataccatcggcttctctggttctcaggcattgggactcagaccaaattacatcaccagctttctcctgaatgttcagattgtggaacttctcagcctccttactcatgtgagccaactcctcagaataaatgtcttactgggaagctgggcatgggggctcacgcgtgtaacccagctattttggaggtcaaggcggaaggattgcttgaggccaggagttcgaggctgcagtgagctataattgtgccacagcattccagcctggatgacagagtgagacccggtctctcaaataaatgaataaataaacaaatctcttagtga

SEQ ID NO: 270372 - DNA, 428 bp, Homo sapiens
cagtgcttcactatagctgcgctccgtgctaggcctgtgaggtacctggggtgggtgcatggcctcctgcaactgagaataggtgtgtgggagctgtctggggtcaccacctgtgtgactttcaccttcttaagccacggttgactcatctgtgaaaaggaaatagcgatgtgttaacggttgttgagagagtgagtgagctcatatttagcacactgttagcgttcatcacattttagttattgctaggccatggccttgtgccgtcgaagctacccgctgcactctgccacgtcctggtccctgatcgccgaggttctggtcctcacgttgaaccagaatgctgagcccgccctgtgctcccgcggctcgccgcggaccgcaccgacgcccgtgaagggcgagccctttcccggcccgaggcgcga

SEQ ID NO: 270373 - DNA, 545 bp, Homo sapiens
actacaattctacaacattgttctctggggcttagcaaatgatacaagtactgggaatggaagagactgaatgtaagatagtttacctcatggagagattgaatgttattcacaaagtgtaagatagtccacctagaaaatacatcccagaaactgaaaaactgctaggagagttcagtaaggtgacaaagttcaagataaatatgcaaaattatttaatattagtttccttattcaccacacacacacacaaatcaaaatgtgatagatgtaaactacccaggtatacatttaacagaaatactcaagatatgtatgaataaaacacattttgctaaagaagagatgaattataaggaaaatataattggatgggatcaatgtacagatgaccatgccatttttttctacaaattaaatctaatccagaaaggcttaaaaaaaatttctttttattgagacagggtctcactgtagtacaagacgaggtagagcccaggagtttgaaactagcctgggcaacatagggaaacccggtctcaaaa

SEQ ID NO: 270374 - DNA, 277 bp, Homo sapiens
caaaaaaaaaaaaaagaaactgagaagaaaaatatgatccaagcagcatttcctataagctccccaaagtaaattttgctccaaaactaatttgggggtatctgcatagagtttctggccagcaatacttgagcaagaagagtaaaaaataatctctcttgtggggaatgaatagggtcttcatctctaggtatgctggatgttttctttctttccttccagattacgctcctctattctgtagcctgttctctgtcctgggagactgacctatatg

SEQ ID NO: 270375 - DNA, 238 bp, Homo sapiens
  misc_feature (169)..(169): n is a, c, g, or t
  misc_feature (176)..(176): n is a, c, g, or t
  misc_feature (198)..(198): n is a, c, g, or t
  misc_feature (213)..(213): n is a, c, g, or t
agaaaatgttaaggaatctgcaaaggaaaagctattagaaacaaaaaactaggcagagttgcaggatataagatgagtatataagtatcagttgtctgaaagcaaagcttttaagtgtatgtgttcaggttatattcttcttcttttctgttgcaccagctgagaagtngcaacgntgatcagctgggcaagggactntgaagactagagagntagctttactggaattgtatctgct

SEQ ID NO: 270376 - DNA, 437 bp, Homo sapiens
atctcctattctgtgcccactgtgaagcaagaagttattgagtggaggtatgcagaatcatgaatcatgattcatagaatcatctatatgaatcatttctttctctccttcccgttgctgaagataatagatgaaatcctgcaaattgaatggaagtatggtacatttccactgtattcatcttggcctctaagctgaattaacgtaaaagaacataaaacatctgagattgtgggatttgcatcatgttataaatgagctaagtgatttaaaaatatctctcctagatgcaaagaatggaacttgcacagatggaggcgttttggagtagtgtaactaaccatactttgtattacgtgaccagaactgctatttgagattctggaagccagtgatgcagtcttgcttgggtatttacctagggagggagggaggga

SEQ ID NO: 270377 - DNA, 458 bp, Homo sapiens
ctagaatcccactttgctctttttctaataagaaactatatttgtccattctcacaccactataaagaaataacctgagactgggtaatttataaagaaaagaggtttaattgactcacagttctgcatggctggggaggcctcaggaaacttacagtcatggtggatggcacctcttcacagggcagcaggagagagaatgagtgccaacaggggaaatgccagatgcctatgaaaccatcagatctcatgagaactcactcactatcatgagaacagcatgggggaaactgcccccaatattcaattacttctcactgggcccatcccataacacatggggattatgggaactataagatgagatttgggtggggacataaccaaaccatatcattctgccccctggcccctcccaaatctcatgtcctcacatttcaatgcataatcatgccttc

SEQ ID NO: 270378 - DNA, 364 bp, Homo sapiens
tgtgcattccacagatcagcacattgtctaagggaacagagggcttcttccagcaaacagggattaagtgtatgcacatctgcattgtccacagccaggtcttacccataagtgccacttactggtccagaggttaactggcacaacccaataggaaatatctaacacaagtgcacagcaccaggaaacgagataagcttcctgacatctccattaccacagcctcacaggaggcagtgaacctgttcaaatgcccaatacatcactactatgaccaggattcggaaaagccagcatacaaaggctgtctataaccaaggaacttatacacagtatttgccactgaaagcataaaaaaaaaaaa

SEQ ID NO: 270379 - DNA, 1810 bp, Homo sapiens
cggggcaggggcgctcccctgcgggccccggacgtggagacgctcgagtcaggctgacgcgcgcgccgggaacgaactcttgcgtgtgacttgggatgaccggatgggatgagtgatgccagtggcagtgggagagaggatgaggagaaacggaatgaggaagtgcgctcctgtgttcgcgcccgtgcctcctctcacacaggctccacagtgcttcacccagccctgcgcacgcatctgttttctacctcttaggactcacttctgcaataggtgtcttggggacacaaaggaatccccaaacccaggtgcctccacgtgtaaactccaaataaagctgctgaaacatcaacactccatacgggaaacaagggaaggccgcccccaaatttaattgttacagaatttttaaaatgtcgattacaaacacaccatcattctgaaaaaaagagaaagaagaaacggggaagaaagaaaaaagaaaaattcaggaaaacagagagaagaaagtactcacccaaatcccatcgactaatcgatttctgggacatgacgtgggaagccgtttatcctatgttaatggctagttactcttcagatgaacttaaaaatggacttgtccaagattgaccttgtgttggtaattattgaagctatgtaatacattaaagtattcctctaattttttaatatatttgaaaaagtccatgctaaaaggttttttttaaggattgatttgtcaaatccctttgcaaattcttttaagattttggtcagaaatgaactctattaatagattgagtgctgtttccggtcatacccggaagcaggagttcaagccgcagctggtagggattggcggctgctggccatctgagttttattaaaactgctcgccgcgaagccagtcttcagccagaatgtccagcagaaacaacaacaagctgcccagcaacctgactgcagttacagaatctgatgaagcgagacccaccaccctccatctaggagtttctacagcagtataatcactacacatccaatgtggagattttcaaattgcaaccatataaacccggtaaagaactagcagagctggtggtgtttatggcacagaacgtcctaaatatgtgcatctgaataataggagagaaagagagaaacttcagaagagcctttgctttgttatagattagttactgctacccagggtatctaagtaattttcctcaagtggtgaaagatcttctgtcctgtaatcatactgtattggatccagatcttcgaatgacattttgcaaagctttgatcttgctgagaaataagaatctcatcaatccatcaagcctgctagaactcttctttgaacttctctgttgccatgataagcttctgcaaaagacttcatacacatatatcgtgactgatatcaagaatataaatgcaaaacacaagaataaagtggatgtagtattgtaaaatttcatgtataccatgttgagagatagcaatgcaactgcagccaagatgtctttagatgttatgattgaactctacagaaggaacatctggaatgataccaaaactgtcaatgttatcacaactgcatgtttctcttaggtcaccaagatattagttgctgctttgacattctttcttggaaaagatgaagatgaaaaacaggccagtgactccgaatctgaggatgacggaccaacagcaagagacctgctagcacagtatgctacagggaacaaagttcccaaaacaagaaaaagttggaaaaggcaatgaaagtgctcaagaaaca

SEQ ID NO: 270380 - DNA, 1594 bp, Homo sapiens
catgtaatcagatttatcattcttacatggcttggggagacagtcacaccaagattactaatctataattcccttataactttttctaattttcttataggcttaactttacatttagagctctaatccatctgaaatttattttccatatgctgtaaattatttaacttcaattcttcccaattttgtagcccattgacctaataatattaattttaagccatcctttctacactgatttgaaattgcacctttgtcactctctgaatgaccacaaaaatgtgagtctgtttcagggctatctgcaatacctctgttagataactattaaagtttctcttcctttgtctttttcagatgttaatggctagttactcttcagatgaacttaaaaatggacttgtccaagattgaccttgtgttggtaattattgaagctatgtaatacattaaagtattcctctaattttttaatatatttgaaaaagtccatgctaaaaggttttttttaaggattgatttgtcaaatccctttgcaaattcttttaagattttggtcagaaatgaactctattaatagattgagtgctgtttccggtcatacccggaagcaggagttcaagccgcagctggtagggattggcggctgctggccatctgagttttattaaaactgctcgccgcgaagccagtcttcagccagaatgtccagcagaaacaacaacaagctgcccagcaacctgactgcagttacagaatctgatgaagcgagacccaccaccctccatctaggagtttctacagcagtataatcactacacatccaatgtggagattttcaaattgcaaccatataaacccggtaaagaactagcagagctggtggtgtttatggcacagaacgtcctaaatatgtgcatctgaataataggagagaaagagagaaacttcagaagagcctttgctttgttatagattagttactgctacccagggtatctaagtaattttcctcaagtggtgaaagatcttctgtcctgtaatcatactgtattggatccagatcttcgaatgacattttgcaaagctttgatcttgctgagaaataagaatctcatcaatccatcaagcctgctagaactcttctttgaacttctctgttgccatgataagcttctgcaaaagacttcatacacatatatcgtgactgatatcaagaatataaatgcaaaacacaagaataaagtggatgtagtattgtaaaatttcatgtataccatgttgagagatagcaatgcaactgcagccaagatgtctttagatgttatgattgaactctacagaaggaacatctggaatgataccaaaactgtcaatgttatcacaactgcatgtttctcttaggtcaccaagatattagttgctgctttgacattctttcttggaaaagatgaagatgaaaaacaggccagtgactccgaatctgaggatgacggaccaacagcaagagacctgctagcacagtatgctacagggaacaaagttcccaaaacaagaaaaagttggaaaaggcaatgaaagtgctcaagaaaca

SEQ ID NO: 270381 - DNA, 482 bp, Homo sapiens
caaactctactctgtattgtatctcccacggcacctttagtatctagatcaaccaagctggaaggaaaggaaagttttgaagtggaggtggagaaggaaatctggtgttaaggaaaacataggatcgtatcaagatggcagcctgaccatgtaatgtcatctctactttctgccttaaatgacacacacacacatacacacacacacacagacacacacacactttagcttataattgtgctagaagacaaagtataccattgtgtagataagggataattaagtatctctgaaaaagagaaggcaggtaggatgataagtttgatgtggaaaccatagtccaaaatgatcacagcaaaagctggggacattgtaaactatgtttgtaaaaggatctggcaatttggaaaataataatgttccagataaagtctaatacaaggaaagtagttttagcaatataaatatcgacaaaatacaaa

SEQ ID NO: 270382 - DNA, 806 bp, Homo sapiens
cccacactcagggtgagagggagattctgaagctttgtgtttcttgctagctagtcaaaggtgactaagatagaaaaataatacatgccaaaagaaatttgaggaacaaattcagccctgagacaggtcacggaaacagccctccagtcttcctcaagaaatgtagactgaatcagcatttacccacccctggaaaaacgcaggagctgcgcattcctgggatctcagcagggcttttgggaagagcagaactgggctggagtcacggtttctgggctgactctagattttccccggcttttgccacctgtgatggctggagagtatctgaagatgacagccagtgtccttagcttgtgaagattggatgatggccggggccctcagaccccttggcccctccttaactgcaggtcttcaaaagcccaacacctgttcgtcatttctgtggcttcccagggagtcttactcttctgcttcaagctgctgggtttgactctgagcagtttctgtgcagccacaaagattcttatgtgagacacactgctgcttcagagtgctccaacccatctcccctgattaaacactaaccagggctgccacagcaaagtggctcaaatgggtgacgtcaacaacagatttactttctcatagttctggaggcaggtgtctaggatcaaggtggtggcaaggctattccttctgttgcctccctccttgccttgtggatgaccgtcttctccgcgtctttccaagatctctcctctgtgcatgtcagtgtccttgcttcctcttcttatgaagac

SEQ ID NO: 270383 - DNA, 1129 bp, Homo sapiens
cccacactcagggtgagagggagattctgaagctttgtgtttcttgctagctagtcaaaggtgactaacccgtgtgacaggagctacaaatatgttccatgaggtcctgagttgaccagcttctttcaagacgtaggtcagggcagtcacatagaagtatcatggtgaccttggggatggtgacagtggctaaaagacgttgagagagacagtgcaagagaggaaagcatcttcaccctggaccctaatatggagacacctttgactagctagcaagaaagataaaacttaaaatctccctctcttctgtcgaatgtgggcggaacacagtgattctgaagctgcggagagtgggaagccatccccagggaaatgtaaacaccaagagcaggatagaaaaataatacatgccaaaagaaatttgaggaacaaattcagccctgagacaggtcacggaaacagccctccagtcttcctcaagaaatgtagactgaatcagcatttacccacccctggaaaaacgcaggagctgcgcattcctgggatctcagcagggcttttgggaagagcagaactgggctggagtcacggtttctgggctgactctagattttccccggcttttgccacctgtgatggctggagagtatctgaagatgacagccagtgtccttagcttgtgaagattggatgatggccggggccctcagaccccttggcccctccttaactgcaggtcttcaaaagcccaacacctgttcgtcatttctgtggcttcccagggagtcttactcttctgcttcaagctgctgggtttgactctgagcagtttctgtgcagccacaaagattcttatgtgagacacactgctgcttcagagtgctccaacccatctcccctgattaaacactaaccagggctgccacagcaaagtggctcaaatgggtgacgtcaacaacagatttactttctcatagttctggaggcaggtgtctaggatcaaggtggtggcaaggctattccttctgttgcctccctccttgccttgtggatgaccgtcttctccgcgtctttccaagatctctcctctgtgcatgtcagtgtccttgcttcctcttcttatgaagac

SEQ ID NO: 270384 - DNA, 515 bp, Homo sapiens
cccacactcagggtgagagggagattctgaagctttgtgtttcttgctagctagtcaaaggtgactaagatagaaaaataatacatgccaaaagaaatttgaggaacaaattcagccctgagacaggtcacggaaacagccctccagtcttcctcaagaaatgtagactgaatcagcatttacccacccctggaaaaacgcaggagctgcgcattcctgggatctcagcagggcttttgggaagagcagaactgggctggagtcacggtttctgggctgactctagattttccccggcttttgccacctgtgatggctggagagtatctgaagatgacagaccccctactcccagtgacacaagatggttggacccacggctgatttactgctttactcccattctttatggggccagctttaatgagcacccaagcagaaatgcctttgactcctgcactgtgaataactgttattaataaaagggcaagctgcttgccatggaaccttgcata

SEQ ID NO: 270385 - DNA, 559 bp, Homo sapiens
cccacactcagggtgagagggagattctgaagctttgtgtttcttgctagctagtcaaaggtgactaagatagaaaaataatacatgccaaaagaaatttgaggaacaaattcagccctgagacaggtcacggaaacagccctccagtcttcctcaagaaatgtagactgaatcagcatttacccacccctggaaaaacgcaggagctgcgcattcctgggatctcagcagggcttttgggaagagcagaactgggctggagtcacggtttctgggctgactctagattttccccggcttttgccacctgtgatggctggagagtatctgaagatgacagccagtgtccttagcttgtgaagattggatgatgggccatggagaggaactgggggtgatggctatggggcgctgggtttcttttgggttaataaacatgttctattattgattgcggtgaactttgcgaatgtgctaaaagccattgaattgtacactttcaatgggagaattgtatgtgatgtgaattatatcaataaaactgttaaataaagaaaaa

SEQ ID NO: 270386 - DNA, 431 bp, Homo sapiens
tgagtcactgcgcccggccatatatcttctatttttaaaatgtgcttatttctagtatatgtgctgctgaagcgagcagtaaaatgtgcttatttctattaatgaattctttattataaaagtggtacattattacaaaagtagtaaatgtttattaagattagaaacaaattctaattatacagaagagtacttactgagacccagcacagtggctcacgcctataatcccagcactttgggaggatgaggtggttggatcacttgagctcaggagttcaagaccagcctgggcaatatggcgaaaccccgtctctacaaaaaatacaaaaattagcctggcctggtggcgtctgcctgtagtcccagctacttgagaggctgaggtgggaagattgcttcagctttggagtttgaagctgcagtgagct

SEQ ID NO: 270387 - DNA, 3208 bp, Homo sapiens
  misc_feature (2055)..(2055): n is a, c, g, or t
ccacagcaggtgagtggaggcaggagccacgggtggggccaggccacacagcctgggaggcgcaggggctgggcagctgccagtgacccaagcccacacagagacttgcacagctgccccagccccaaattagggggatcccctggcccaccttctcttggctcagccactctgggaggtgggcacacaggggcaccgaagggagcaggcagccctggcatcccacagccgccaggagaaaaacttaggcctccccaagacctggcacagagcaggccggccctggcccccaagcagaggaggctgcacctccctcgcgtctgcgcctgcctcaacgcgggttaaactttgaccaaggaaatgattgctaaactcgattccataagtgtcaccggtcacactttaattccagtctaaaattaaagtcttcagtctccacattccctactttccaaattcagctttcccgggaggtctggagcagctgcctctctggggagatgctggaggtctcggaatcacctcacacggcctcagggcccagttggagccaccccaagtgacaccagcaggcagatgaccagagagcctgagcctccggccccgagtctgtgaagcctagccgctgggctggagaagccactgtgggcaccaccgtgggggaaacaggcccgttgccctggcctctttgccctgggccagcctttgtgaagtgggcccctcttctgggccccttgagtaggttccatggcattttctgaactcctggacctcgtgggtggcctgggcaggttccaggttctccagacgatggctctgatggtctccatcatgtggctgtgtacccagagcatgctggagaacttctcggccgccgtgcccagccaccgctgctgggcacccctcctggacaacagcacggctcaggccagcatcctagggagcttgagtcctgaggccctcctggctatttccatcccgccgggccccaaccagaggccccatcagtgccgccgcttccgccagccacagtggcagctcttggaccccaatgccacggccaccagctggagcgaggccgacacggagccgtgtgtggatggctgggtctatgaccgcagcatcttcacctccacaatcgtggccaagtggaacctcgtgtgtgactctcacgctctgaagcccatggccagtccatctacctggctgggattctggtgggagctgctgcgtgcggccctgcctcagacaggtttgggcgcaggctggtgctaacctggagctaccttcagatggctgtgatgggtacggcagctgccttcgcccctgccttccccgtgtactgcctgttccgcttcctgttggcctttgccgtggcaggcgtcatgatgaacacgggcactctcctgatggagtggacggcggcacgggcccgacccttggtgatgaccttgaactctctgggcttcagcttcggccatggcctgacagctgcagtggcctacggtgtgcgggactggacactgctgcagctggtggtctcggtccccttcttcctctgctttttgtactcctggtggctggcagagtcggcacgatggctcctcaccacaggcaggctggattggggcctgcaggagctgtggagggtggctgccatcaacggaaagggggcagtgcaggacaccctgacccctgaggtcttgctttcagccatgcgggaggagctgagcatgggccagcctcctgccagcctgggcaccctgctccgcatgcccggactgcgcttccggacctgtatctccacgttgtgctggttcgcctttggcttcaccttcttcggcctggccctggacctgcaggccctgggcagcaacatcttcctgctccaaatgttcattggtgtcgtggacatcccagccaagatgggcgccctgctgctgctgagccacctgggccgccgccccacgctggccgcatccctgttgctggcggggctctgcattctggccaacacgctggtgccccacgaaatgggggctctgcgctcagccntggccgtgctggggctgggcggggtgggggctgccttcacctgcatcaccatctacagcagcgagctcttccccactgtgctcaggatgacggcagtgggcttgggccagatggcagcccgtggaggagccatcctggggcctctggtccggctgctgggtgtccatggcccctggctgcccttgctggtgtatgggacggtgccagtgctgagtggcctggccgcactgcttctgcccgagacccagagcttgccgctgcccgacaccatccaagatgtgcagaaccaggcagtaaagaaggcaacacatggcacgctggggaactctgtcctaaaatccacacagttttagcctcctggggaacctgcgatgggacggtcagaggaagagacttcttctgttctctggagaaggcaggaggaaagcaaagacctccatttccagaggcccagaggctgccctctgaggtccccactctcccccagggctgcccctccaggtgagccctgcccctctcacagtccaaggggcccccttcaatactgaaggggaaaaggacagtttgattggcaggaggtgacccagtgcaccatcaccctgccctgccctcgtggcttcggagagcagaggggtcaggcccagggaacgagctggccttgccaaccctctgcttgactccgcactgccacttgtccccccacacccgtccacctgcccagagctcagagctaaccaccatccatggtcaagacctctcctagctccacacaagcagtagagtctcagctccacagctttacccagaagccctgtaagcctggcccctggcccctccccatgtccctccaggcctcagccacctgcccaccacatcctctgcctgctgtccccttcccaccctcatccctgaccgactccacttaacccccaaacccagccccccttccaggggtccagggccagcctgagatgcccgtgaaactcctacccacagttacagccacaagcctgcctcctcccaccctgccagcctatgagttcccagagggttggggcagtcccatgaccccatgtcccagctccccacacagcgctgggccagagaggcattggtgcgagggattgaataaagaaacaaatgaatggctgcc

SEQ ID NO: 270388 - DNA, 454 bp, Homo sapiens
tataccatcttctctgctcttgtatgtttcaaattttccacaactaacaagatttaaaacaatcaatctagaggtgaacaaatgcatctataaggagagcagacccatcacagaaaatacataacacacaaggccagtaagtatttgaaaagaggcacaacctccagagtaactaaagaaatgcaaatgcaattggggaaacattttgcacctagtgcgtgacagaggttaaaacctctgatgatgcccagggctcacctggggagcaggtgctcacatcttgtgatggtgcctgtggagagacacaacctctactatcattttattttagtgttttctttttattgagacggagtcttgctcttgttgcccaggctggagtgcaatggcgtgatcttggctcactgcaacctctacttcccgggttcaagcgattctcctgcctcagcctcct

SEQ ID NO: 270389 - DNA, 715 bp, Homo sapiens
gcctaggtgacagagcaagactctgtttctaaaaggataaatacatacataataaaataaagttaaattaaaaagagacatataaggaagtaaaactgaggccaagcacagtggctcacgcctgtaatcccaacactttgcaaggctgaggagagaatcactcgagcctaggagttcaagaccagtctgggcaacaaagtgagaccctgtctctacaaaaaattttacaattagctgggcacggtggtgcattcctgtaactgcagctacttgggaggctgaggtaagaggatcacttgagcccaggaagtcgaggctgcagtgagctatgatcatgccactgcactcaagcctgggcgacagagcaagactctgtctcaaaaaacaggtaaagctgagaaaagaggaggcctgttctttcactgggtggttgtaagcagccatgcagaatgcccaaggttttccaaagagtttcttctttctgaaaggatctgagtccccaaaactttggggactagtctcatggttgaaggcatttttcatgagggcataatccttttataaaaaaattatttcataaaacctgcaatttaaaaaatctaaagtgtaagggcagcaaaagttaacattaattaaaacaatatgttgggaatatgggtaagctatatttcatgtttttctttgcattgtgaaatatttcctatgtgtaaaaaag

SEQ ID NO: 270390 - DNA, 720 bp, Homo sapiens
  misc_feature (7)..(7): n is a, c, g, or t
  misc_feature (18)..(18): n is a, c, g, or t
  misc_feature (38)..(38): n is a, c, g, or t
  misc_feature (49)..(49): n is a, c, g, or t
  misc_feature (56)..(56): n is a, c, g, or t
  misc_feature (77)..(77): n is a, c, g, or t
  misc_feature (178)..(178): n is a, c, g, or t
  misc_feature (188)..(188): n is a, c, g, or t
aggccancggccacatgntactcccaccatctgggctntggactcttcnttacatnttaaactctgcttgacctgtncatgcatgtaagcatgcatggaaacagtgggtgggcgtcttgatacatcatctgttgttccgttcaaaatccagagcctttctacacttcagttgatgttntttcaaaatnccgatgtttctttctgactcatgaagctgctgtctttgaatctgacattagagggaagcgaaactttacaatgtgtggggcagcctggtgtggtggctcaggtctgtaatccagcaccttgggaggccaaggatggcggatcactcgagccctggagtccgagaccagcctgggcgacagagcaagactctgtctcaaaaaacaggtaaagctgagaaaagaggaggcctgttctttcactgggtggttgtaagcagccatgcagaatgcccaaggttttccaaagagtttcttctttctgaaaggatctgagtccccaaaactttggggactagtctcatggttgaaggcatttttcatgagggcataatccttttataaaaaaattatttcataaaacctgcaatttaaaaaatctaaagtgtaagggcagcaaaagttaacattaattaaaacaatatgttgggaatatgggtaagctatatttcatgtttttctttgcattgtgaaatatttcctatgtgtaaaaaag

SEQ ID NO: 270391 - DNA, 419 bp, Homo sapiens
agcaaagcatgtgtttttaatctgttgtgggtatcgtattatgctaataagcaacaatgtctaaaactcatcccaatgcctataacaccgccatctacataacatacttgtcctttactccaatgaagcttaaactagactcgaactcagaccatttccccctcctggcacacagaaatatacgagggggaatccaagaaatcagatatgttaagtgccggtatcttcttccaaagtagggtcaaattcgtgtttgcccgcaaatgtcaccgtcctagtaagtctgcaaattctcactagcgctggagtacaaagaggcctgaccacggaaacacctgtcctagcaccaggaagacagtgggaaatataaccctccctgggtctgagcccgccccaaagactcagcagcagcgatggtg

SEQ ID NO: 270392 - DNA, 386 bp, Homo sapiens
cactgattcctcatctcccttccacctatacctgtggatatgactctggttgagggaaagggctttctgaaaacactcttgtgctttgatgttgtcttcagttaggaggcagaaggcaccatagtccaaccagtgatccagattctggggctcacggaccaatctctaagcatcaggagagccaaggttattgtgatactatgtcctatttttatgcatacgacatcacatggtaaacactgtaaatactgtaagttctatgaaagcacagattgtgacttcttttttgcttatcactgaatctcaaatgcctagtgcaatcactgttctggcctttagtaggtggttgaaaaaagtattaatataattaaaaatttgaatcatca

SEQ ID NO: 270393 - DNA, 480 bp, Homo sapiens
cagtggcctcatttttcctttggacaatgtggtacttaatagagtaaaatcttgatcctacttagttattatgtttcatgtttgaaaataccattttagatatattgggctgaaaggagcatcttccctcataaaatcctacatatgtaaggaaggaaaaatactgtgacttgctcaaaatcacccaggaagactgggtccagcactttttccaccttacctccacttattcttgtgtcgctattgaccatctgggcctgttaggagagtgtcacaatcatggcttcagtgcctgcacctcatttgaaaggagatgttgaaaatcatcagagtagccattcattgccacatgaaacccctccctttacccattctccattcattcaactcttcttcattaagaacgttctgtattccaggcactgggctaggcactgaggattgaatgataaacaagatggtcaagtttcctgccctcct

SEQ ID NO: 270394 - DNA, 251 bp, Homo sapiens
catgtttgttacataggtgtaaacgtgccatggtggtgtgctgcacccatcaacccatcatctaagttttcaaccagcattcaagaccatttgtgttgaattctggttcctgctggtaccatgtcctgggatatttcttcccttaggggcaaagagttttctagacagactgagtcagaatcacttagtctttatctcaagagcagccttgtcacccacagtagaaggcagaattactgtggagtctagca

SEQ ID NO: 270395 - DNA, 164 bp, Homo sapiens
gtcatgcataggcgtgtggccatagaaacagagttagcgtagtttgcttttgggatcatactgtacgcatttttctgtagcttgcttgttttccttgggaataagtgagaattctttccgcatcagcacaaatagatcaatgtctttcttgacaactaccacac

SEQ ID NO: 270396 - DNA, 428 bp, Homo sapiens
atgcaggcttgaaactgaaggagccaagtcagccccctaaggaaggttataattgctaaaggaaatactgaggagggaggtggatggatgcgctatggctgagagattgtgtgtcttgggaccttggcaactcaaacttctccacaaaagcagagaaggaacaaggagaaagtcagtggcagctggaccccaaggccaccagcaccccagcagtgactgtgtctaaagcaaggtcatccacgtagatgactgcagtgagaatggatactcagctgcagagcgagaatgagctctcattattagcggctgttttaaaatcatttaacaatttgggctaagggctgttgagaatataaaacagtgtgagccaaggaacttagcctctggttagaaaggtaaaactaattcataaatacacattgaatgcg

SEQ ID NO: 270397 - DNA, 377 bp, Homo sapiens
tttttttttagaaagtcttgctctgtcacccaggctggagtgcagtggtgcaatctcggctcacagcaacctccacctcctgggttcaaacgattctcctgtctcagcctcccaagtagctgggactacaggcacatgccaccatacccagctaatttttgtattttcagtagagacagggttccaccatgttggccaggctgatcttgaactcctgacctcaagtgatctgcctgcctcagacttccaaagtgctgggattacggggacatgacccaggcccaaagtgatgtctttttgtatgttgatgattaactgatggctggcagctgctaggtggctttaggataagagcaaggcagaattagaggattgtg

SEQ ID NO: 270398 - DNA, 990 bp, Homo sapiens
tatttggtatgagattcgctcaatggtgtgtatgtgtgtgtgtgtgtgtgtatttgtgtgttagaattcatcagacaagaaaattaatttctattttagatattttacaaagaatcacttattcctaggattgttccccaagacatctgaaatcttaatttgcatatctatgtggcaaagctttaaatttaagttatccagtagtttaacataaaatcatactgaaacactcattaacacatttgagtatactatgtaagttcagaatataaattacttagtactgagccatgctgcattaagttaatctttatgttgttagattatttttatgttaaggaaacattatcccagattcggtttttctagatacatagaaagggacatactggatgtttttattatgttgaatgaagctgtgcattgaagctattatacttaagaaacatttttatgacagtttagctttttcagctgctttcattatgttgtgttttttagaagtctattcagggtatttttaatgtcttaactaacaatatgatttttgagctatgtttctgtcgtgttgtttctcatcactatatggatagaattagttatatagtaacaatgcctctgtgctcctttaccaccacaaaatacttattttattttaattcttatttattagttgaattatttattacattaatttaattcttattttctttgatgttttatgaagcagagtttattttcataattgtgtctcataattctgtacaataattgttggaggagtatgtttagtgaaaacaaattaaaggtggaagagatactattcttcctcagcattggtaataatgaagctcaatttcaagtcatatacttttttgttatttgggtattgaatatcagtttttgtgaaactaatattgcaacctatacagttgaagaaagagatatttctgatgtaatcttataaatcagggtgtaggaaaataaaaa

SEQ ID NO: 270399 - DNA, 1554 bp, Homo sapiens
gggaaagaaacctggaaaggtagggaggtatggatatggacaagctatgccaaggagcagggctttgtcatggagagtgactaggtgcttttacataggaaagtcacctgataatattaaaacctgtgaaatatcactctggtggaagtgtgaatgaatttgaaaggggtgtaacactgttctactttgtttactcctcagtacccttggctgtgtacatttgagtaaagagagcactataaaatcaaaaaccaatgaaatggtttccagaacacagaactattaagcttaagaaaaggacagaaggaactgaagagagaggaactgttttggagcatcacacttccacctcagaagaaataaggaaggaaggaggagggtgttcccacggctcttcaaccaggccggctcttcagcctacatccccatctcatcaagtaaaagggatttttcaactggaccaaccagatggtttaacagtgcactcccacaccattcaactacgcaagggagatacacttaacatatgcagtcgtataacacctactaacattttcaaacattaaacctttaaaaaagagttctaaagaaatagaagcttgaagtatcatctctcaagtatatagacactacttcatggtgtggtaatatatgcatatagaagctagtaaacacctccaggagatgcaaaaggaattagaactgccacaaggtgcaagcaaaaccttgaggtaatcaatctgcatcccattttggatgagaatatttgcaactttgaaggttattttaaggacagcagcagaattatggcagctcttcacggaaaaaaaaatggcaacaataaaatcagcaactcctgccaaataaatgggcataaaaaagaaatcatagactgctggcaatggtggggaaaaagttataaaaattgtctctgcaccatcttccttttgtcctctaaaatattcacattagcaaaagtatataacagctgatgaagaaatactgataatttgtctttttctgtttttcctcttctaatccttcacccatctgagctaaagtctagacctaaggaggctactaattcagggatcgagtaatctgccaagcaagagtttattcaagcacagtttgaaataaaggtttcaaatgcatagcctgtcgatactttggaaggattctcatcataacgagtatgcaatttgctataaagaagaatgcccattacggactaaatgtttatgtcctcctaaaattcatatgttgaaggcctaactctcaatgtgatgattatgtggagatggtgcctttgggaggtaactgggcttagatgtgggcgtgagggtggggcctcatggtgaaatttgtgcccttgtaagaaaaacacaccacaggttttcattcttcctctgccacatgaggccacagtaagaatgtgaccatctgctagccaggaggaaagtcctcactggaacccgcccataataacactccagtctggggcttttcagcctccagaaccatgagaaataaatttctagtgtttaagtcacc

SEQ ID NO: 270400 - DNA, 435 bp, Homo sapiens
caaacgtggtaccatgcctcttttctatgcctatgatggacatttgttaattgatcatatctgtgtgtgaaacagagccatgctgagttagcaatatctgccatgggtacaagggtttatggtagaacagatggcaggcagctgacattatggttcaaacctgtcagcagaacctaagtgtgaaagtggcataccatgatggtttgagtcctttaccaggattcctttgtccaagtttctttagcagtccccagggaatgcttgcatgttccaggaatctgtgtggttgatgcataccgtcttcatcactcatccagctctgagtcttatcaatccccactcaccactaccactacatagcaggccatttcctaccacttctaacttttttaaaaaattaaataagctttaaaaatgttatttttaaaatgcata

SEQ ID NO: 270401 - DNA, 511 bp, Homo sapiens
agatccaatccatgaaaaagggaactttctggaccaggatctctgaggtcctgagacactgggtttaagaaatgtatctgtcctgtgaccttggttggggagatccagcccctctctcttctggcactccagctttggtgcatttaatagaaagaaaccttttcaggactatgaaaggcagcattctccagctcctccctagaccctcctttggacctgtgagatctgaagagtatgccatctgtttccattcattttgtgaccatgtggggaaggattgttgcccatatttggccacctcaccttctctctccaggctgcccaaggctttttttcccatgcaatgagcctaccacctccaactcatctcctgttgcctgcagtttcctaagcctgggcaactcagccaaatccaaggcagaagtaaagtaggaagactgatgttgtcgtgaagtccaagttgcattctgctattcatattactcaaaataaaactgattacttaatttga

SEQ ID NO: 270402 - DNA, 424 bp, Homo sapiens
  misc_feature (35)..(35): n is a, c, g, or t
aattcgcggccgcgtcgacacggcgagaagacganagaagggggtggccagcacaaaagtattgttgggctacagtgaaaactaggtcggggcccaaacccttttctgcaaagagcccctccaaagagtagagtgccaacaagccactaatttggctgtttgacattgatactggtttctgacaggtttctgacttactgatggcacattgagtcatttaagattctgaaatctttttccattgctgtctgaacctttcaatttggaatctctgagatgtctttgactctttttccttatttctcatatctatcactcagttgctaaaaagctttatattctgactatagccaactttttcttgcccataaatagcactgttagttagatgtttggtcacctctcatctggctgttgcagtacc

SEQ ID NO: 270403 - DNA, 411 bp, Homo sapiens
aattcaaaaggtcactttttactgattaagattgctttagcctacttatactaaaaatgtagcatcagcctcaatggacagcttggtactccagcctaggtgacaaagtaagaccctgtctgaaaacaaacaaacaaaacaaaacaaaaacagtacaagttctgaggccatatctcagacctattgagtcagaacctctgatatggaggcttatgaatctgtattttaaagaactctctgggcattttctcaagtttaaaaggcattgctccggatccttgtcatccctgtggcttttcctaaaacactggtaaatctaaggggctgtgggtagggagtaggggtggggaagggagtgtggaaggtcactggtaagggaaaggccccagatatcatcctctgggaaaaaaa

SEQ ID NO: 270404 - DNA, 432 bp, Homo sapiens
gactccatctcaaaaaaaaaaaaaagaatatatcatccacctcttcagggaagttacattctaataaaccctatttacacaaaactacatgtaactataggattttaaaatgctgtaaataggcaagtcagctcaggatccaccaagccccccgccccgcccccttccatttttaggaaggaggcaaagaaatgatagggctcagagcaaaacccatgggtcctgggctggtcccatatcgtcttttatcatatgataaagcccctcaacaaatcactgggagatctgagtgaggtttcagtttaaataggcattgccaaaccataatcacaacagcagggactgtggctgcttggtaacccccgtaacccttgtgcctaagacaatgcttgacatatagcaggatgtgaaacttgttcaatagttgaaagg

SEQ ID NO: 270405 - DNA, 278 bp, Homo sapiens
gtcccatttataatttggtatcttattgccactaagagtctgttctgttcatcttatgatgtctattttaacaataatgctgatcagttgttgtgtctacatcataaaagagagggtatatagtgaagcctgtctaacctaccatcctgacatggccaggaacttggttttaaggtttttctggagtcccgttggctacctgggcattcatttagttggtgggatagggggtggttaggattttattttaaatttatattataattggcaaataaaaa

SEQ ID NO: 270406 - DNA, 643 bp, Homo sapiens
tccacttagggtgaaaggaggaagaaaaaaagcattgagagaaagttgtaagaaggtaagaacaatcaatataatttgcactaccgagatttcaaaggaaagatttctgaattggttaagagaagtcctttaaagtgccccaaagaaagtttgatgtttaaatgcttttaaaaaatattatttaaaaaaccctgagtgtattttattaagatatcagttgtgcaagaaatattaggtattttacttttattaccctgtgtgttacaagtggtactaaattttcctatacttcttcccctaaatctaatatcaaggtcgggaagtaaattcagtcagaggctccctagagtctgaaactaaaggaaaaacactttagtcctgaggaagttctcattataacctctagatttaagtcagtggataaagtaatatactaggggtttccataaaattcactcattccagtagttcaagtgaacatttgtaatgacccactgtaaaagcatgatctcataaacataagatcttatgaagacgacatggggcgttttccactccatcttaaaatagctcatatgataatgaattagtgcctaaaatgaaggacatttgaaatgagttttaattacaaaaggcacagctg

SEQ ID NO: 270407 - DNA, 521 bp, Homo sapiens
actttacatacgtaaaatcctaagtagtccaagcaatcaaaagtaacattttccagtgacatctccataaaagccactttcttctgaacaaatacaaactttccagagatgtctaagccacagaactgcacaggcagatgtgaaatgtaagccctatagagaaacagagaaacgaaacaaaatctgcatttgaacattggagttttatcacaattgcaatacatctaacagtcttctttgttttagttactatactttttcttaccatcatgaagaaaagatatcacagaaaatgatgttaaagacaggcctaacatacattttctgagctttctggtgaaagattatgttttcaaaaaacttctccaagggaaactctttgaagtgtttttactgccatttgatcagttaaaattttgttatttgcattattttgaaatgtctttgtactctaaaggctggtaaaagaatgcataattgtggaaaacaatttaataaataagagaaaactaacaacaaca

SEQ ID NO: 270408 - DNA, 470 bp, Homo sapiens
tagagacaggttctcactttgtgtggtatgtttgtgtgtgtgctgtgtttttaaaaagtggaatattatacagcctgtgggccaaatgcatccgaagtctgtttttacactgcccacaagaatggttttaatttttaagatgtttaaaaataaagaacacgtgacagagaccatatgtggcctgcagtgcctaaaatatttacttgctggccctttacagaaaaaatctgctaagtcctgatctgcagctacacgccaacaatgtggatgagtcctagcaatgtaatcgagttgcgctgtccaagacagtagccatcagccacatgtggcttattaaattagtgtaaattaaatgaaaatttcaattcctcatttgcactagctacaataaagtcaaaacagctaaaaccaaaaggattttttttttagagaagtgcacacagatgaaatgaaattatatagaaaggaaa

SEQ ID NO: 270409 - DNA, 452 bp, Homo sapiens
gtaggggggtgcttttgctttcctcactgaagaatcctttaagctctctcactcatggactggcctcttttcatatgtaattctaacaagcttggttatctattttctaaactcagcttgagaagaggatgaagaggagagtctgccagaggcaggagcaccattaatagcaagaagtgacaagagagatttaaaaagctataaaaagcaaacataattctggggctattttaagaaaaggaaaacaaccctatgtacttccttggtccctgagggtagtacaatgtttattctataaggatgattttgagtcataaaaattaatattcagcattctctgtttaagggattgaaacagtgtataccatttaataaaagatacccataaagtggttaaaacgtttaaaaccatgatatcactacatgcctattagaatggctaaaagagaaaa

SEQ ID NO: 270410 - DNA, 1109 bp, Homo sapiens
acagccttgagtttccctagtcttgactggggaatggtcttcgcctctctggaaaaggccacctccccgattgaatattccaccatgggaagtggtgaaatggcgccctgagaccccgggggagcatccttccccatcccggcccgtggaaccagcaggtggcagatgtggcagcagagcctcctcaccttgtactcaaggccctcttacttgtgtagagctcagcttcctggtctatggacttactttgccttttctgtatgaaggccatcctcgatgaactgtaaagccaatcagtgttgaatgagtgaggaaaaagcggaatgaaaacagtaaataaggagttgccttctctgtattaatattagaatctctgcctcagccgtagagaaaatcattgacgtgcttgctagaagcagctctgaaagacgtttttgtaaaacgctttttatcccgtcaaaggctcagctcatttggggctaaggcttcctgcatccaccatgggcttgaacgtgaggcttggaaaaagcggagacaacgttggaaagaatgaggcctgagaacgagtcagtgccgcctcatccgcgtcaccacatccctgtaggatgcagtgtcttcattcgtaaaacaagggtgttggactactgtatcttgagggtcccttggcgctgaatttccatctttgagagacaatggcactcttacctttgagcttttgggagaaatccctgtgaatgtgccctggggtcttgcatgcctctcagcattctccttgggaggtcacaggcgccggtctcatcaggtgagaaggacaaaagcagccctggccgccgtcagctgagagctggcccgtgctactcagccagggcgttgaacacgccaggggatgccacaatcagatgcgcgtgctcagtgacccaaggagctgaggccaaagggagatcttccgcagtcaaagctgagtgcatatcagaacactgcacacagcacagaaatgaccagctttccccctcccagctaacagggcttgtctgctccaaatttagccctgctccactcttgctacctactagataaaaattattaaaatatccaactattaaactacc

SEQ ID NO: 270411 - DNA, 495 bp, Homo sapiens
ctcccaaagtactgggattatagaaatgcactttataatgtttatttatgaacgtattccttctctctagctgtgcttttgtatttgttaaccaacccctggcttttctccctcctcactaccctttccaggctctagtagccactattctactctctgctcctatgagatcaactctgttagcttccacacatgagtgagaacatgcagtatttatgtttctgtgcctagcttatttcacttaaaacaatgtcctccaagctcatccacattgccatgaatgtcagaatcaatctttttaattttatcagtaaatagtatttaattgtgtaagtatacagcacattttctttatccattcatctgttgatggacacttaggttgattccatatcttagcgattgtgaatagtgctgcaataaacttatttattttgctgttgttgttgttgttgagcctgggcgacagaccatagactctgtctcaaaaaaaaa

SEQ ID NO: 270412 - DNA, 418 bp, Homo sapiens
ttcagagtttcttcaatacctgtacagtagtgtggtcattggaattacatggcattggcctggtcaaatgcagaagaccgatattgagacccttcaagacacagctgctataggggaaactgagctcatataaccaggagaaggggaaagatgggtttctgaaaaaaggcttcaagctacatagaatcctctcaggatgctgagaaactcccagggcaggtagttatcagcctggtgagcaagtgcaagaaataactggattatgagaggcatgcctcacaagtggccccttcaatatagaagcatcagtgctcccagatgctggacaatggacggcagacaaaggctgcagctgagtcccccaactggcagctgcccttgggtgaagaagcctgcctcatgcaaggtcacacccctt

SEQ ID NO: 270413 - DNA, 332 bp, Homo sapiens
cacatagtttgcaaaatattgcattagatgaagcctattaattgtgttggtcaaatctcaactttattactgatgtctgactcctgactgatttttatcaattattgaggtgtgttaacatcacattaagacataactatcacataagacggattctggagccagagtgactaagcttaactcccatctctaccacttactacacaggtaaccctgggaaatttacctaacctctcttgcctccatttccccacctgtaaattaaggataacagaaacttaactactagaattgttacaattaaatgagttaaaacatgtaaagcacttaaa

SEQ ID NO: 270414 - DNA, 226 bp, Homo sapiens
  misc_feature (17)..(17): n is a, c, g, or t
ggcggacgggggcggantcacgaggtcaggagatcgagaccatcccggctcggcctcccaaagtgactatgctaattttttataatgaacatccatttgttgtataatttgaaatgctgtatcataatcttatgtgtagaacactgtttaacttttatctgacacagaataatggtagaaataagagattaagcttccctgccaaagtgatacaacattataatca

SEQ ID NO: 270415 - DNA, 341 bp, Homo sapiens
ctggcaaggttcaaaggccttagggcaagaaatgttagtagagtcctggaagacgatgtggggaacgggtagcggccaccggatggtgatcgttcttctacaagaccttgacatggatggggagaaacagagaagaaccttccaagtttgtcccactggacatgcccaccacactttaccagccctttctagaaggcctgtgcgtaacacatgaaaaagctccgctcgacctttccctgaccttttaaaagaaaacatttgctgcatctaatccgcctagatataaggaggttcccaaatgtatgacagagtcagaaaattacatgtcttgtaagttacca

SEQ ID NO: 270416 - DNA, 267 bp, Homo sapiens
ggaaaattagtcaagttttcctatttaatagaagcttctagaagaaaagtaattgcccaattaatgtttgtttaataatatttttcagtgctgatgatgtactaggtactgttctgggtactcttatgcttgaaaaggtcactgtgtttgtttacaatatagtctcctatccatgaggcccagcactgggcatacatttattctatcttttatgtggtttgtatataaccatagaaaccttaagaataaaaaaaaactcttttaaaa

SEQ ID NO: 270417 - DNA, 306 bp, Homo sapiens
tcctatatgctgggggagaagaaaaaatgctggtgtctttgaacacctctgccagttcttctgtgctcctaaagcctacggctttggaaagaaggctacgtttgtataggcacacttgaatttcaatcacttgcaaatcattttcaagatttttgttttatctgccctgagcgtctattattatttacctgtttttaaaattaacttattgtcctaaacaataacatttgcaagatcagatgtactgttttagctacattttaaacggtgacattaaaataaatacagaaagattcaaatttaaaa

SEQ ID NO: 270418 - DNA, 601 bp, Homo sapiens
gtaggtaacacactgacagccgcatccctgtaggaacgctcaataaaacggctccatatttacttctctggtcacggttcatactccacgattttaacaaaggagtcgaggaagctagatactgtaagtggaacggtgtgtctctggaggtaagcaggcttgctgatttcttgttttataattctttttttaattacaatgtaactactaagagcttcagttcccactggagtggtgcacacatctcattactactaaaaccacaggaatgttccagggaaacagactatcatcactgagcgaggtggaatccagccaaaaccccaggctaacatccagatgcctgcagatcagctaaaatccttttaaaggacttggaatctccagacgattgtgaaataggtaggtttgagggatgagggaggaggaatacctgttgaacatttaaactgtgaagtttgccacctattttcccctttattgaaggtttcaggaggtagaatttaaaaaaacaaaactctgggctgcaagggtcagagatggtcattacggtatcttaatagagtaatttcttttttttgacggaggtttgctcttgttg

SEQ ID NO: 270419 - DNA, 419 bp, Homo sapiens
gggtttcaccatgttggccaggctggtcttgaactcctgacctcaggtgatccacctgcctcggcctcccaaagtgctgggattacaggcgtgagccaccatgcctggccaaaagatgtcttattatataatagacaagttctgctctttactattctttttaaaagttgatttagctttcaaaaacgtttattaattctcgaaataaattttaaagtaagtttattaagcgcctcaaaaaaatccaactaaaatgggattatcatgacacttaatctattgattaatctggaaaattttaacaacttaataagttatcccatccaagactgtggaatgtctttccatttattaaaatcatctcctatcatagattattttaataaaattttaaagttttaaaaatttaagatcttgtg

SEQ ID NO: 270420 - DNA, 1793 bp, Homo sapiens
tctgtattgcctgaagtgtaaatcagaggtcaacaattagattgcaaatcatgaaaagcataacttctaattgtttagtctttttagggaaacaagcccagaaaaaaagtaagattctcattcattggagataagatttctatttatcaaagatactacacaagagttagatagcaagtagttcaaatgtcttttaaaggtatctgacatctttaaagctctgtaatttttaaattctaaattttgttacagctaatttttaaaaattaattgctaagtcatggtcaagtatttctgatgacttacatgctgtctttggtatattttaagtttctaaaccaaaactactatttgactctattacaccctgttttagaaaaacatttgagttatacaacttactaaaatgtattttagcggtgatgttttggagcactggtaatatagtgtttaacttattttctattttttatccctctatattcgtgaaattacttctatttgaaaagttttccgccagtgataaaaaaaggctgagcactatctgtaaaaatttttaaggtgtccactaggtggagatattgtgctacatttccaagtgttgtagttaaacttttattagtctgaattaaactcttttatagtgttttattgttttaaaccacaaagatttataatcatttatatctatttatctaatgttattcaaatgttttctgcattgtatgaagctaagataaatgtaaaaaaaacaaacaaaaaaaacctcactttgtgtttggtaatcattagacgatttaacctaatatatcttcccatatgatatgatctttgcatatggcatacttcattcatatgacatagttagaatcttttcccacaaacaatgagtgatgatatctcatttgaaaactcgtgtaacattgtatcagccactgttataaagtgatttacccatgttagtctcataacaactctatgagatcagtaccgtacacatggggaaacttagtatagagaggtgaagtattttttccaagattacaaaataactgtctgagctgggattcgtaaccaggcagcctgactccaaaatcaatattcttaactctattgttatgatggagaaaggcatgaagtctaccttcaaattcatggcattttagaaggaaaaattgtcgcaagtaatgtgattatacttcctagttttataggtcagaaaaatgaggtccacactaattttgcctcttccacagggagatagattctcatctaccattgtgtcttttgtttctgtttttgtcatgatacctcaaattgatatatgttgtaattatgaatttaaggaagtaaaaaaataactcagggctggagccttcagccatattaacatacattgacataaagacctttgttttaatatgaatgattccagttaacaaatggagaaatagttgtttgaaaattaatatttagcttctcaaaagagactcctgtttggaagcaaattgttggtttaacaggacatactttagatatttgaaaaattctctgtggaatcacaatctcttatttttaagaatgtaggaatatgtgttctatatgcttttaagttatgtattacatactattctctaaaatagaaatgtttatttggcttctaaaagtcatttgtgagttgatgttatttaaaactgcttttcagtcaacttattctttataaaaaagtttgttcaaatagcatgtttttattttgtttctaaataaattcatgtttgataatattttataat

SEQ ID NO: 270421 - DNA, 641 bp, Homo sapiens
cagaggatcccaaagattttgagcatcacccaagacagtagttgttacaaaaggaatgtttgaatcgccaataagcatgtgtaaaagtgtttaaaatcattagttaacaaggaaatgcaaatttaagataccatttggtgcccaataaaatgagagaattgaatatattcacagaaagatatatgtgaatgtttatgacagttttattcatagttgccaaatgtccattagcacgagaacagacaaatggtgataatataatgaaatactattcagcaataaaaaggaacacaatttttggggtaaatctgaaaaacatattaagtaacagaaatcagacataaaagaagacagtttgttggactgttcatagagcctgtatagaccatttacgtgaagtttaagaacaagcaccactaatcttcagtgatggagatcagaacatagttgttgcatgtggatgtatgtgtatgggtatgtcagagtggggagaaattgactggttagggacatgaaacattttgggggtgattgaaagtgttcagtatctcttgaacccaggaggtggaggttacagtgagccaagatcacacaattgcactccagcctgggtgacaagagtaaaactccatctcaaaaaa

SEQ ID NO: 270422 - DNA, 407 bp, Homo sapiens
gacccctttgaggtcatgggatcacggagccagaaatgcctgtagagcaatctagatttgagggggatgacatttgaactgcgatctgaagggacaagaggaaggtagccctgaaaggaacatagcgaaaagcatccctggtagaaggaaaataagcaaagattgtgaggccgaaatgaagagtaacatcaagggaacttggtttatgatacagacggcattacaagtcagtgggcgaaaggacagactcttcaataaatggcgatgagacattttttccaaaagggaaataaatgattagatttctacctcaaaccatttccaaaaataaggccgagatggattaaagacctgcaaacatttttcagaaaataaaaatagctttataatgtcaaaaatagggaaga

SEQ ID NO: 270423 - DNA, 454 bp, Homo sapiens
gaagaggtgttcagtacaatattagacagtttgtatcatcagacatagatttatgtaaggttcttgacaatcacaaaacatgaaaaaaaatgcagaccaatagaattctcatttgttaagaaattgtccagaaaacgcatcaggagacaattctatccacctttctcttgatcattcaatctaacggaagaaggaaaaaagaagatgtctggaatgcaatgtggaatttgtttaaaaaaatgctattaaggatttacttctaatcattccttgactgtatgattatgtattataatgatgtcacaacaccaattttttgatggaatgtcagaaacatttcacaagtctatgactccctgaaaactcaagtgcttttataactccttgaagttactataataggcattattctttcttttaaatgactgtcagagggacctactgttatcttgat

SEQ ID NO: 270424 - DNA, 619 bp, Homo sapiens
ttgaggctagcagtgattgaggcttggctctccaaggacaggacttggccctggtggggtgggtggcagcactgcccaggttcggccacacctggcctcaggggaggctgcccatgtcatctatagcttggctccctccctgctctcaggctgctgagccatggaatctgttttctatctcccagtttaaagtcctcaagaagaatgtcagtagcattcagaggaagtgctgggatccaggaagaatcctctccgtcagtctcctttaagggttgtattagtctgttctcattctactaataaagacatacccaaaactggataatttataaaggaaagaggtttaattgactcacagttcagcatggccggggaggcctcaggaaacaacttacaatcgtggtggaaggggaagcaaacatgtccttcttcacatggcggcaggaaggagaagtgctgagcaaaagggggaaaagccttatgaaaccatcagatcagccgggcgcagtggcttatgcctgtaatcccagcactttgggaggccaaggcaggcagatcacctgaagtcaggagttcaagaccagcctagccaacatagtgaaaccccgtctgtaaaata

SEQ ID NO: 270425 - DNA, 657 bp, Homo sapiens
cttcctttctgttctgtgttcgtccctatttcctagattctttggtgttctctctctccttttcctttcttgctctgatggaaggtcctttcacgtcctgtttctggttcagtcctgaatctggaatccagaattcaggattctgcagcaaaaactccagctatcccaccttcagctttgcgccacccaccctggaaggcagttcagttctagcgttctctgctctactaaattcacacgctggccttccatcttacaagatttggttggtatttctctgggaagtttctgggcttatactgtttttattccttatcatcattttaaaatttttattagtttttttgagacagagtgagaccctgtcttttaaaggaaatggatgtctatctgatcttattctaaatgttgactctactatccgtaaccccttctggaaatatttaatagttgtctccttaggaggctgttgtttggtttgcacatggttaatgtagtactgccgagtttatagccggtcctgagcttggacgtttcagcattcactgtggacctttagtgaagtctgaagctttgtatttggctggcttttgggaatgtattttggcttttggatgtacatcaaatgttattagttcagtgttggctgaaagattg

SEQ ID NO: 270426 - DNA, 368 bp, Homo sapiens
gaaaaaaaattaatatctaattatgtatcccatttgttaaaaattctcatttacctttttctttcccagagtgagtttacaagtttcctcaggtgtgttttttttatggctgggtgcattcaaacagaattccaaggcttagcttttagaatgctagctaccaaggaaaagaatagggaaaaatctctattcattctggctgtacagaatgaatacatttccatgagataatgtggtagataattggtgagttacatagattcatgaaaacatcagttgctctttttgcagggtgaatttgtgactaaatatctctgttcaaatcctgttatcttgatttctgagtttcatgctacattttatgagat

SEQ ID NO: 270427 - DNA, 315 bp, Homo sapiens
aggaagttgttgggagaagcaaagtgtctctcctccttcttgacaaatatggaagattatttccttctggttgggaaaacatatctcagataatctcacatagctccattccattataaaatttagttttttattaaaatttctcaagaagacaaatattttaagtgtgggaatttgaaactatctaaacaatactttctctgagaaaaaaattctgtaaatgggagaaagcaagaaggccctcttctttgttcagtactacatattgcgtgattaattttacactaaaaataaaatgatgatacaataagtaac

SEQ ID NO: 270428 - DNA, 457 bp, Homo sapiens
tgcagcccccggaatcaccaggtccattcgtaattgcggtggatggcatttccactggaaagcctgtggctgtcgctggaaatgttcacccgctggccttgtgacagagccccctggaagctctgactcaggagtgctcagcccctacccctctctggctgcagagccaggcagggaggccatgtctggcacagaagggaagctccccacctctccagctttcaggctccaggcgctagacaagtgacgagcttggctaagcctttctttcggcctctttggcaaagagaaatccagattatgtcgacaaagggtatgtggcaacaataataaaaatgtagagggaagattaggaaaggattatgctaatcagatcaaagagcaatgactgtagtagcgctttcaccctctgcaattacagggcagtaattaaataaaaaccatttagcgtcaaaaa

SEQ ID NO: 270429 - DNA, 621 bp, Homo sapiens
agacattctgagggaatattaaggaacaattctaacagtcctgattattctatccacaacttcctgacactagaatgagacaaaaacttccatgggcttacaagagcatttggacatcccactgtctgtttccctccttagtgagttttattcagaccaagtggtgaaatctgaaaattgagatttcacatgtatgattcaaatgactacccaaatgagttttataactgatcaaaaaatttaaaaatccaagccgggcatggtggctcacacctgtaatcccaacactttgggaggccgaggcaggaagatcacctgaggtcaggagttcaagaccagcctggccaacatagtgaaaccctgtctctactaaaaattcaaaaattagccaggtgtggtggtacacacctgaggtaccagctgctcaggaggctgaggcaggatgattgattgagcccgggaagtcaaggctctggcgagctgtgatcacaccattgcgctccagcccaggtgacatagcgagatcctgtctcaaaagagaaaaaaagtgtttttaataaatacaggctgaaagaaaagatggagtagtctcccagcgcttggagctaaatagacaaagga

SEQ ID NO: 270430 - DNA, 399 bp, Homo sapiens
agacattctgagggaatattaaggaacaattctaacagtcctgattattctatccacaacttcctgacactagaatgagacaaaaacttccatgggcttacaagagcatttggacatcccactgtctgtttccctccttagtgagttttattcagaccaagtggtgaaatctgaaaattgagatttcacatgtatgattcaaatgactacccaaatgagttttataactgatcaaaaaatttaaaaatccaagccgggcatggtggctcacacctgtaatcccaacactttgggaggccgaggcaggagaattgcttgaacccaggagacggaggttgcagtgagccaagatctcaccactgcactccagcctgggcaacagaatgagactctgtctca

SEQ ID NO: 270431 - DNA, 426 bp, Homo sapiens
tttttttttgagagggggtttcccttttgttccccaggcaggagtgcagtggcacgatgtcacctcactgcaacctccgcctcctgggttcaagccattctcctgcctcagcctcctgagtagctggggtttcaggtatgtgccactacgcctgactaattttgtatttttagtagagacggggtttctctatgttggtcaggctggtctcgaactcccgacctcaggtgatccgcccgcctcagcctcccaaagtgctaggattacaggcgtgagccaccatgcccggctggaagttttttcttaaaaggtgttggttttttaaaaagccgacatgctctgacttacagagaatagtttcctaagatgcagtcggcagggaatggaatgaaaacggatggcaaaggtaaagtctcagagctgagg

SEQ ID NO: 270432 - DNA, 313 bp, Homo sapiens
aggtatattgagtattcaagcatgattttaaacaaatatggaatttaatcttgtaatggtttcctcttggtggcatatgtagacctaattcccaaatttttagaaattttctgtttctgttaagcgtgagcacttaagattttctctggcatcagaatatggaatctcatgtctttcagcaactttattgtttcttatgttttaacttaaatggaacactttagggttggcagacttatagaaattatctctttcctgtctttaacagtgaatatttgaaaaattcatctatgaaagctcttagaatgcactt

SEQ ID NO: 270433 - DNA, 374 bp, Homo sapiens
ccgaaagcaccccactgctctccagcctgggtgacggagcgagactccatctcaaaaaaaacaaaacaaaaaccatgttgtacagtagattacttgaactgatttctacaaaaaatatgggacacttcatgaatttgcatgtcatccttgttcaggggtcatgctaatcttcgtatcatttcaatgtttagtatatgtgttgccaaagcaggcactcatttcatcttttaaataactcagtatgtatctctaaaacagtgggagtcttttttgcttctaaaccacagtactattatcatgtataataataatttcttaattatcatcaagtatttagttagtattcacattttcttgattgtcttgtaaatgtc

SEQ ID NO: 270434 - DNA, 595 bp, Homo sapiens
tccatgaggtactgtagaattgcatcaagttatggtggccagattgagcaaataaaaatacaggatgccagggaaaacttgtttttctcatacaattttaaaaattgacatataattcacataccataaaattcacgcttttaaagtgtgcaataaattcagtgttttaagcatactcacagagttgtgtaaccatcaccacgatctgattccaggacatttgtatcatccccaaaagaaaccctgtacctattagcagccagtcctcattccccctctctcagcccctggcaactaccaatctgccaccgcgcccatcccacttacatgtataatcttaaaaaaaaaaagtcgaatatctaggcaccgaaagtagaactgtggttaccggggatggagagaaggaggaaatgggggagatgtaggtcaaaggaatacaatttgtagttacgcagcacaaataaatctagagttccaaggtacagtagagaactataattaaaaataatgtatattgaaaatttgctaaaagaatagatttacaggcgtgagccaccgcgcccatcccacttacatgtataatcttaaaaaaaaa

SEQ ID NO: 270435 - DNA, 485 bp, Homo sapiens
gattcttttccttagtgtaaactatccccacctctcagggtggcctgaaattcagtctctcatttatcttatttttctgtaatgcacatcttaaccaccagagagagcctgatacaaaggaatctcaactccaagtacaacagagaaattaagctgggcataagatgtggaatcctggatacaactgcagcgattctcaatggtagggtagggaatggatcccagtgcctcctctatgggccttcttagacccatcccaaggagagggggtggggcatgctgccacaacctagaatttagcagctagccagatgtaaggtcaccaggaaagaggtgaggtgggtaaggatgagggccagatctagtttagggacctgaatttctgtatctcaagcaaaagagactctcaactctgctcataagccaccaggcccaactccttcctgggctaccccatggcaggccaggtcatctagctggcccgg

SEQ ID NO: 270436 - DNA, 711 bp, Homo sapiens
gcattcacattcttttgttaagctggaattggactagaatgagggattccctaaacatcaatctataaattgaatacctactgatggccaagctgaaccacttgccagcctctgaatatagctcctttctcttgcacgtgctgtttcttgaaactccatttcacagcttggcctggttatatgtaaggcattgttcatttcaggccttcttttcttccagaagctccccctggcccattttgtacacaacacattttccctcctgtgtgtgtcgtttacaccatttgcttaattctacttaacatgtctcctccccatcttcatccttacattttctatacaccctacttccccactctcaactcctctcaccccccaacacacacacacacacacacacacacacaccacacacacacacacacacacctgagatcccagggtacacggtccagcagcacagcagcattcatatttctttctcttattttttttttttttgagacagagtctcccactgtcaccgaggctggagttccagcacatgatctcggctcactatagcctccgcctcccaggttcaagcaattctcatgcctcagcctccagagtagctgggactacaggtatgtgccatcacatccacccaatttttgtatttttagcagagacagggtttcatcaagtattaatccttttatctttagtgta

SEQ ID NO: 270437 - DNA, 705 bp, Homo sapiens
cccaaaccaagtcacgagctgcactttgatgctatttaaggaatctcagttgagccctgtgatgactttgaggctcatacaggtactcagtagtctcagttctagatgtgtcacactatcttgggcccttggaaatgagaagtattctgggatcgtttctttcagcacaccaaaatagatggtcccaaattctgcagcacaaatctaatttgtttcctccttgagtgaatggcacttctcatcctgcttttggtccctctcctcttgcctgacagtggttccgaagcctattcaggtaatgaacattaggcatttgccctgagtagagtctattttaattctgtttctcacaaaaactgcttctgcatcataggcgggtctgagctcagcctgaggcctgcagtgttgatttgagcagctagagttgggaaaacagcacttcacaagagctctgagggataattgctgtctcttctaaacctgggctcataactcagggcctctgtctgagatctataattcttctttctcccagtgaggctcccaagaataggctaaagtgttatggctgaagattgtttccagacttctcgaggcctggggattagagtgcagggtgtgtatggaatgaaagccacttctggaaaacatgggctgggtctccagggaagctttcctatcttccctgaggtggcctcagacagg

SEQ ID NO: 270438 - DNA, 275 bp, Homo sapiens
ctgagaagcgggcccttggtgtggcccaggagatgaaggaaagccgctcagggcgaagcttagagaggagccacagcctggatgtcagggccagaggggcgccctaagcttcttttccctcctggagtatcgagggtaagtaaaatggagaaagcaggccctgtggtagaccacagtggagaaggtggaatttctagacttagcaggccagcgctgctacagaagccttccgggggcacttggagcagtttcactggcatgacctgagtgctgta

SEQ ID NO: 270439 - DNA, 504 bp, Homo sapiens
tgatttcagatgaagatggtgctggcagtttccccatcagcgcaatggagtttgagcaaaggatctcactggagaagtcgcagcgacagtggatctaagagcagagggcaagggctgcctgagccttgtgaagctcaattctgccccctggtgcccagaatgccgcgccagcaatgggatgcaggaagaagaggcaggagacacctgaggtctcttaccttttccaagctactcagacctccctcttacagggcagggaacacagggcaccagccctactaacccaatctgaggggaaactctgaggctccctctcctgcagagatctcagactctgtggtagagttggtgtggggggacacgtgacgtcagcaatagccctgtccatccagcacctggacaccccgagtggttccttctatgggaggcagaggcagggctgccccctctgctgtgcaattcctggggtcttcatctgagttaaattcttttaagtcaggattt

SEQ ID NO: 270440 - DNA, 554 bp, Homo sapiens
gaaggaatgtccactgttgccatcagtcctgaaaagatttccttgcaccaaatcaaaatggttcgagtttgctgttgttgatattttttttccttttgtgttctgcttactgactgacatctgctatcatgctaagcaggtgttcctatgtaaacgaacgtgccctgtttgtgtttcgccatcctcgctgctgcgcacccaaatgagcagcgtgattaagaatcctgtaaatttttgaaaggaaacggatggctaccctactagaacataattacaccgttccaacatccgcagctcactgctgcagcagagttggagaacagcagaaattaataatatataatagcatcattctagtaatttataaatgaaataaagtagagaggagattctgctgatatgcattttctccttaattctaaaagacaaagtatagattagaattttagtggggtgaaacctggccagcagtctcccactagttgcctgattcatgataggagtgtttttgcttagggaaaagagctaatatgttttattaggccagaggaaaa

SEQ ID NO: 270441 - DNA, 162 bp, Homo sapiens
tgccatatatgaaaattaacttcaaatggataaaatactaaaatgggaaagaaaaatctacattgacaacaaaaaaaatagtataagatactatgtttggaactctgagacagaaaagctttcttaaatatgactatgtatcataaatactaaaaaaaaaaa

SEQ ID NO: 270442 - DNA, 327 bp, Homo sapiens
ttttcatgaagaattgacccctttatcattttgtactatccctctttatccctaataatttttcttgttccgctctcctccatctaaaattaatatagctactataagtagattattaatagttattctgattattttacctaaagtattatttgaataggatttatagtactaaaaactccatcactaaaataattttagggtattattccttctcaaaatctaaaatattataatatggtttggactataaaacatagtacatgttagatcatgaatagcgtacctttaaaagctcataagaaggaagggaaagttcctaggacc

SEQ ID NO: 270443 - DNA, 566 bp, Homo sapiens
aattgtactccaaaggagatcttggttatacattgataccagcatagtttgagcctaccctcttccctgtaccctcaaaacccttgttaacatcttatgttttgccagtctgctgaagaaaaaatggtatccaattgtttaattcaattacttgattactagtgaagtgagaatttttttatatttatcataatttgtattgcctgtaatctgaaagggttattcatatttttttgcctacttttctattaagtcatgtctctctaagatctagcttaaacgttactttttccaaaaaaccttccctgatctcccacaactcaaaacattatcttcctactttagtttcttacaatattttatctacatttctcttataacaccactttctactttgtatgattgttattttagtactatctaatcagtcctttaatttcctttggggactattttatggtgattaatccttatgacacatattgtccacatttttggacaaaattcttcaatgaagattgataattaaaattaataaaaattaaattaattaaaaatttaaaaaa

SEQ ID NO: 270444 - DNA, 394 bp, Homo sapiens
gacctaagcatatatggacattggatttataacaatggcattatagtggagtgaggaaaggacaatcttttcaataaatggtatggaataattgagtatccatgtgtaaaaagggtaattagaaccctgtttcacatcaaattccaggtggattacaaacctaaatgtgaaaggcaaaacaatacagcttctagatgataatgcaggaaatgttttaacctcaagagaggaaagatttcttaagacaaagagcatattaaaatgtttgtaaatatgctgcattgataagaaaaaaatctgcagtttttaaaaaataaaaacacattcatgtcctttgtagggacatggatgaaattggaaatcatcattctcagtaaactatcgcaagaacaaa

SEQ ID NO: 270445 - DNA, 633 bp, Homo sapiens
ccagctgccagcaggggcaggctttccagcgaagcacctcgcaggaaaggtgccaccgcgttggggcgcattctatatgtttgggaaattagacttgctttctaagtaaataagcggttagggtgccagtggttagagctggcagtggttggtagtgtccccaggatagttctagttgttttggctgaaaacaaattgttctaaagcaggatgaaaacaatatgatcaaggtgaaaattaggtccaaaataatgagttggcaaaaagaaaaatcagtactccccagtactggatttccatgtattggtaattctggtgcactcttcatttagtcaacaaatattaaccatttattataggttgtagacagtgggggttgagggagggtacatcaatgaacaaaacgagagttccgtccagagagcttgcgtgctgataaaggagacagacaatgcaaaaataaatacatcttagatagctagctaggtaggtaacatgttaagtggtgatggcactaggaaaaaaaacaaaaacaaaggacagtcaggccctaatatttacgggtgagtgatttctgtttgaaactggtgtccagagaaggcctctctgagatggtgctggagcagagattgg

SEQ ID NO: 270446 - DNA, 302 bp, Homo sapiens
tggagatgtggctagatctcctagccctaacatgcttacttattttgataagcaaagatgaagctcacatgggtcccgtgtgctcttgaacttctgtacattgtaccattaaccacacttggatgctggcaatcgcagttttagttaaataaagtgacttgcccaccatactataaaaaattaattttggtagcatgttgattctgtatcctaaccataagaccacacagagccatggctagtaaactttagcttgtgcgtaaatgcctgccaagacctgctaaatactgttgcttacattt

SEQ ID NO: 270447 - DNA, 556 bp, Homo sapiens
ctagaaagaaaacctatggaaagatcctgtgctggaagaaagcatgaagtaattcaaatgactaaaaggtcttaaacatctttgccatcatttataatgcagacttcatgctgagaagagcactcgacactgccaccgaagttctgtttctggtgttgttttgtcaattatgctgatgccacgggaccatggaacagtgccactatttccaagagcaacagcaaatcgaaaaatcttcatgcaatggttgttctagaaaagtctattacattggtttatgctttaaatatagttaccaccagagtagtaattttccaatctatcctttaaaagttcaagtgtattattgcattttttaagttgtaaaagaatgatgtacacatatccttaaacatagtatataaaagcaactactcaatggggatttatgtgatgagattacttacgtaaagaaaattatttgtcttttgattaatagtgcaatttaaaactggaagtcgttttctttaaaaatgcattctctataccattgaaataaaaaaaccaaatgtaaaac

SEQ ID NO: 270448 - DNA, 797 bp, Homo sapiens
ctagaaagaaaacctatggaaagatcctgtgctggaagaaagcatgaagtaattcaaatgactaaaaggtcttaaacatctttgccatcatttataatgcagacttcatgctgagaagagcactcgacactgccaccgaagttctgtttctggtgttgttttgtcaattatgctgatgccacgggaccatggaacagtgccactatttccaagagcaacagcaaatcgaaaaatcttcatgcaatggttgttctagaaaagtctattacattggtttatgctttaaatatagttaccaccagagtagtaattttccaatctatcctttaaaagttcaagtgtattattgcattttttaagttgtaaaagaatgatgtacacatatccttaaacatagtatataaaagcaactactcaatggggatttatgtgatgagattacttacgtaaagaaaattatttgtcttttgattaatagtgcaatttaaaactggaagtcgttttctttaaaaatgcattctctataccattgaaataaaaaaaccaaatgtaaaactaaacaaaaaaaaaaaatggcctggttgtgcctcatcagttgaagctaatacagtcgttcagcttttattcagggtgcactcttgatcttcctccactcgctcattcgcgctcggcgatccacgaacgatcacagtaggtacgtggtcaccgtacctctcgacagtccgggcccccacctctctgcgcatactcacacaacatgccccatcacgacccctccccaccgtactaccactaca

SEQ ID NO: 270449 - DNA, 646 bp, Homo sapiens
ctagaaagaaaacctatggaaagatcctgtgctggaagaaagcatgaagtaattcaaatgactaaaaggtcttaaacatctttgccatcatttataatgcagacttcatgctgagaagagcactcgacactgccaccgaagttctgtttctggtgttgttttgtcaattatgctgatgccacgggaccatggaacagtgccactatttccaagagcaacagcaaatcgaaaaatcttcatgcaatggttgttctagaaaagtctattacattggtttatgctttaaatatagttaccaccagagtagtaattttccaatctatcctttaaaagttcaagtgtattattgcattttttaagttgtaaaagaatgatgtacacatatccttaaacatagtatataaaagcaactactcaatggggatttatgtgatgagattacttacgtaaagaaaattatttgtcttttgattaatagtgcaatttaaaactggaagtcgttttctttaaaaatgcattctctataccattgaaataaaaaaaccaaatgtaaaaccatgtgaaaagtcctacctttttgaattaatagggacttataaaatttttattgaacaataagaatattaaaacctaacatattttttac

SEQ ID NO: 270450 - DNA, 450 bp, Homo sapiens
ccaataaggacaggtggattttttaatgttggatggaaatgtacattctaatgatcaagcatcactaacataatttactattgtctgtgaaatcagactttcaaatgagctgcatttctcttcctcaaagcatactcttggatttacttatgtttttacaaatctaggtcttaaacatctttgccatcatttataatgcagacttcatgctgagaagagcactcgacactgccaccgaagttctgtttctggtgttgttttgtcaattatgctgatgccacgggaccatggaacagtgccactatttccaagagcaacagcaaatcgaaaaatcttcatgcaatggttgttctagaaaagtctattacattggtttatgctttaaatatagttaccaccagagtagtaattttccaatctatcctttaaaagttcaagtgtattattgca

SEQ ID NO: 270451 - DNA, 522 bp, Homo sapiens
ctagaaagaaaacctatggaaagatcctgtgctggaagaaagcatgaagtaattcaaatgactaaaagacttcatgctgagaagagcactcgacactgccaccgaagttctgtttctggtgttgttttgtcaattatgctgatgccacgggaccatggaacagtgccactatttccaagagcaacagcaaatcgaaaaatcttcatgcaatggttgttctagaaaagtctattacattggtttatgctttaaatatagttaccaccagagtagtaattttccaatctatcctttaaaagttcaagtgtattattgcattttttaagttgtaaaagaatgatgtacacatatccttaaacatagtatataaaagcaactactcaatggggatttatgtgatgagattacttacgtaaagaaaattatttgtcttttgattaatagtgcaatttaaaactggaagtcgttttctttaaaaatgcattctctataccattgaaataaaaaaaccaaatgtaaaac

SEQ ID NO: 270452 - DNA, 202 bp, Homo sapiens
gaaaatcctgccccacttccccaataggaagagtggtgggggaataataaagttgttttatgatgcatcctgtggacttctactcgacagaatggtaacattcaactgtaatcaggatgagcaagccactttattaaactaaaattttaaactttaataaatataatacaaactgaaaaataaaaataatttttcaactcta

SEQ ID NO: 270453 - DNA, 270 bp, Homo sapiens
tttttttttcaagatgttagcaattcctgtggaaccatctggatgttattaagaaagtgtcccgggtcctctgaggcagctggctgggcctcttgccttgtttcctgtgtcctggatgtctaagttgactttcataagaaatttggaatattagcttaaaaaaagaaacagtcaatatttttcaggcgttgagctcttgcagcttaatttccccggctgggactttgcatttcgagttcccatctttggcccctgctctgggaaggatga

SEQ ID NO: 270454 - DNA, 315 bp, Homo sapiens
tagaggaacatcaggaaaagatggtgtgatcatagtctagaagcagggctgcctatctggagctggggccaaagaaaaaaggtctgtccaataggaactggggcaatagaggaggagcactgcagctactggccattcccattggccaaacctatttgtaatctagagggcaaaggaggccaagaaatgcagtttcctgcaatacacagagcagaacaggggaaagccataggtaaatctaagagtaaataatgtagttgaccagcactccagacttaggtgcatcaagtaattatatagccttagaagtttaaa

SEQ ID NO: 270455 - DNA, 2363 bp, Homo sapiens
  misc_feature (1394)..(1394): n is a, c, g, or t
gatgccaaaattacttttttccttccaaatatcaccttctgactgtttccaccatggttaagagggctgaataagatgatcattctttagatgacgaattaacccttgcttcttcgaaaggttttagggaaattaacaaaaaaattcccagatgccaacagccaccattcaaaagaccaccaatctattgcatcataccagatgccactctctcttcctagtagggatttctctcctcggtcctgatcaaggtgttataatagagacattttcattatagacagtgtcctgaagggattccagctcaaatataggaattcttaaacctagctgaaactcccaaagtgatttcattgctgggcatattttaacatacttaggggaaagcaaatctttaaacaaagcaaaacaccaaactacagttttaaaaagaagaaaggagagcgtattttagtttcaaaattacattacattttaatttaattttccttctaattttcctgtcagcattttatttacaaaaactgtgcagcaaacgagggaaaatcttccaacacaaacaactctgtaatgactaaattggttttattcatatattttagacatttggttaacttggatctttttcataagttctttgtgatgctttgtaaggttagtgtaactgaagtgtttgtgagtttgatttggtcccacagtgcttaattcagtggatatttgcatagtttaggtttaatgtaaacttgggtggttaactgactattaagtgtaacctattgtgatttctaagaggagtcctgccaagaactgtatgtccaaaactgatctgttttaacagttagtgaggaacagcttccgagataaagtaagttcatttttctattgctaattttgctttttaaaatagcagtgttgtaagactaatatttccacttaccaccaatagagggagcattaattaactatgtcatggaattgttttgatattttggaaaacaagtgattccacccataaaatgaaaagagaagattgaccttaagaaaaaaactcttaaagctaggagacaatgacatgaaatcactcaatacatgttacaaatgaaagaaggccaaaagccactttaaaatattttaaactgtttcacagtagatttgaaagtgtctttgttcaaatttagcaaagtaggaagaattttcactaataccgcctgaaaagttgatcttaggtgccattatgggccacgtgtagctttctgtttctcaaatctgagagagacccatttgccttaatgctgatttgccatgtaaaatgctaagcaattgggttagaatccaccttttcttttggtagaacatgtagagaaaaagctgcaggtgacttgaaaccctgaggngtctatcatcctttccctgtaaaggaagtgtctcttaaaaaaaagggagtgggggaggaggtggaggatccctaaagaattcttaatgaggtgatataatcattgtagtccatgacaaaatggaccagccaggtttgcatagcagtagacatattcctactgtacatttatccttcccaaatatgtcacattctaaaatagttgacaaattattttgtggaaagaggaagaagctggattggagtgggagatctaatctggaggagcaaagaggtagttgtttattgctatgttcctggcccatcaaatggccactttccaaactgacccacattttaggaaataaaccaatctggacctgtttcaaaaggatagagatgcttttagattgtcaattctcacttttaagttaaacaatcacaaatatctttagaaatagggaaagacatttgcttcaaaatcaaagaatgagtgtggatctttttaatttttttttgtttcaagtcctacagtcatcttacatttagaccttcatggtagggtgatatgagtgctaaaaaaatttctttctagtagccaggaaacagatagataagataaaagcaaatgttccagatttaagacttcttaggatgagtacaaggaagagagaaatagtatggaaaggacattttttagcaatttataattttaaaatggaatttgccaaacaagggagaggaaaaaaagtcaaaggggaatttttatctcaagatatttagatatggtttataaaaaaataatattttctaccactaaaaacactggtattatctcagcatcatgggcaatttttccttattacatgccaatatttgtacaaaaagggcccccaaatgtgtgaaatataatcctaaaaaagaaaataattggaacacatggatctgttacaattctacacagggggaaacaagctaagcaaagaaaaaa

SEQ ID NO: 270456 - DNA, 2365 bp, Homo sapiens
  misc_feature (1394)..(1394): n is a, c, g, or t
gatgccaaaattacttttttccttccaaatatcaccttctgactgtttccaccatggttaagagggctgaataagatgatcattctttagatgacgaattaacccttgcttcttcgaaaggttttagggaaattaacaaaaaaattcccagatgccaacagccaccattcaaaagaccaccaatctattgcatcataccagatgccactctctcttcctagtagggatttctctcctcggtcctgatcaaggtgttataatagagacattttcattatagacagtgtcctgaagggattccagctcaaatataggaattcttaaacctagctgaaactcccaaagtgatttcattgctgggcatattttaacatacttaggggaaagcaaatctttaaacaaagcaaaacaccaaactacagttttaaaaagaagaaaggagagcgtattttagtttcaaaattacattacattttaatttaattttccttctaattttcctgtcagcattttatttacaaaaactgtgcagcaaacgagggaaaatcttccaacacaaacaactctgtaatgactaaattggttttattcatatattttagacatttggttaacttggatctttttcataagttctttgtgatgctttgtaaggttagtgtaactgaagtgtttgtgagtttgatttggtcccacagtgcttaattcagtggatatttgcatagtttaggtttaatgtaaacttgggtggttaactgactattaagtgtaacctattgtgatttctaagaggagtcctgccaagaactgtatgtccaaaactgatctgttttaacagttagtgaggaacagcttccgagataaagtaagttcatttttctattgctaattttgctttttaaaatagcagtgttgtaagactaatatttccacttaccaccaatagagggagcattaattaactatgtcatggaattgttttgatattttggaaaacaagtgattccacccataaaatgaaaagagaagattgaccttaagaaaaaaactcttaaagctaggagacaatgacatgaaatcactcaatacatgttacaaatgaaagaaggccaaaagccactttaaaatattttaaactgtttcacagtagatttgaaagtgtctttgttcaaatttagcaaagtaggaagaattttcactaataccgcctgaaaagttgatcttaggtgccattatgggccacgtgtagctttctgtttctcaaatctgagagagacccatttgccttaatgctgatttgccatgtaaaatgctaagcaattgggttagaatccaccttttcttttggtagaacatgtagagaaaaagctgcaggtgacttgaaaccctgaggngtctatcatcctttccctgtaaaggaagtgtctcttaaaaaaaagggagtgggggaggaggtggaggatccctaaagaattcttaatgaggtgatataatcattgtagtccatgacaaaatggaccagccaggtttgcatagcagtagacatattcctactgtacatttatccttcccaaatatgtcacattctaaaatagttgacaaattattttgtggaaagaggaagaagctggattggagtgggagatctaatctggaggagcaaagaggtagttgtttattgctatgttcctggcccatcaaatggccactttccaaactgacccacattttaggaaataaaccaatctggacctgtttcaaaaggatagagatgcttttagattgtcaattctcacttttaagttaaacaatcacaaatatctttagaaatagggaaagacatttgcttcaaaatcaaagaatgagtgtggatctttttaatttttttttgtttcaagtcctacagtcatcttacatttagaccttcatggtagggtgatatgagtgctaaaaaaatttctttctagtagccaggaaacagatagataagataaaagcaaatgttccagatttaagacttcttaggatgagtacaaggaagagagaaatagtatggaaaggacattttttagcaatttattttgtggaaagaggaagaagctggattggagtgggagatctaatctggaggagcaaagaggtagttgtttattgctatgttcctggcccatcaaatggccactttccaactgacccacattttaggaaataaaccatctggacctgtttcaaaggatagagatgcttttagattgtcaattctcacttttaagttaaacatcacaatatctttagaaatagggaaagacatttgcttcaaaatcaagaatgagtgtggatctttttctctcttccttgtactcat

SEQ ID NO: 270457 - DNA, 432 bp, Homo sapiens
cctctattcccctttgtttcctagggaacctctgattcttcaaagagtagccttgatagatcttgcaccctcttgtaagggaacaccctgggtagagagagcagcgattaaagttttcatgtgtgctgatctcactgcagcaactaccctaattctgtcagttctggagctctctagctagacatttgcagctgtcaatactgttctcaaccactaggggacacactgtttcccttagctcttttggcatagttgcaggcagaaatcccctttttccttcagtctgtacctggtcctggggccaccatgtttggccctgcaggttgtgcatggcacagctccagtgagttccattctcataaagtaggatgctcctggattcatgcagtgcggtgaccctgactttgttcaaccaaggcaatgtcattttgt

SEQ ID NO: 270458 - DNA, 258 bp, Homo sapiens
gccttccgatgaaacatgtgcctagttgacctaggtgtttcctctcgtctctcttcttcccctttgttctctccctctgttatgggcactaccaagcacacaggtgcaaaagctggaccttcggttcctccttcatcacttctttcccctctgtctgttttcaaatggctaccacgaatagtgattctactttaaaatatcactaatttataaatggtttccgttataaagctgataggaccatgtcagaataataaa

SEQ ID NO: 270459 - DNA, 280 bp, Homo sapiens
tgatgtaaaaatttgctattaatattaccgagaatcacttgtatgtgatgagccacttctccctttctgcttttaagattccttgctttagagagtttaattatgaggtgtctagctctgggtctctttgaatttttcccatgtggagtttaacttcttgaatgtgccagttaatgtttctcatcaaatctggacattttcagccattattagttcaaatagcctttctgccactttctctttttcttctccctctggagttcccattatgtacatgctg

SEQ ID NO: 270460 - DNA, 366 bp, Homo sapiens
taataatccttctatgtttatgtgctgatttgcaaataaatgggcctatatagtctttatctagtgttggattggggtcaaaagttttatgaaatcattgtttttagtatacgtacagatggataattgtataaataagtacagatgtgtataaatgtgtgagtatacatacatacattttctagctcttctaacaaaagggcctagaaacaacatcatcccagtaacaatgagaacaccattctccaattgaaggaaccaaggctccttggggacatatttgatatcaggattgggcagggaaaatacaagattagtttgaaatattttgtcatgttagaaagtaaggaaatgctcacaaaatgg

SEQ ID NO: 270461 - DNA, 405 bp, Homo sapiens
cccagccaaacacccttacagcccacaggaaccccagctgggagaataccaatctcacctgaattaaaaaaggaaggcccccgcctccaccactctccttatttccatcacatgagcagacaggacttgaggaccacatcctgtagctgcatggtggggatgctaacatctactcctggatcaactgctaaccagccctctacccttgctggggcagggacacccgccgacacccctcccttctgcacatctgtccactcaacagtaacagtgcacatggtccctccctgtacaccccacctccagaattctagaacctcttccattcctttaggaactttctttggtgagaagctgttggggtctgttggggcgtgtccccaccgccactggtatttaacaccc

SEQ ID NO: 270462 - DNA, 454 bp, Homo sapiens
caccaaatgttctgtttgttgaagattaaattataaaattaaatttcagcaatatgcatatataattaatgaacccagagaaaagatcaaaatggtgagcatataatataaatgtgtacatattacaaagaaaaaatatggaaagctactatcatacttacttgtttttctaatctgtcatgaggccattttttttttttaagacaaggtttcactctatcatccaggctagagtggagtggccccatcatggctcactccagcctgggtttcctgggctcaactgatcctcccaccttagtatccagagaagctgggactcacagcatacataaaaattaatttcaaaatggatcaaagacctaaatataagaactaaactataaaactttttgaaaaaaacataggggtaaatgtttgtaactttggatcagaaaaataattttttaaatat

SEQ ID NO: 270463 - DNA, 355 bp, Homo sapiens
tcctcactactattctgtacccacagtgtctttgggtgctagtccaagcagaactgggtgtgatcagctccggccatattcaccacaggcagagcaatgtggtatatggatgctgctcaggcaaattctctgattcctagccttgtttttccatccggacaaaaattcatccatccatctaagacaggtcaaatctggcctgctgcctgtttttatatggtctaggagctaagaatcattgatattacacttgtaaatgattgaaagcaaatcaaaagaagaagagtattttgtgacacataaaaattgtacgaaaatcaaatttcagtgttaataaagttatattagaatacag

SEQ ID NO: 270464 - DNA, 338 bp, Homo sapiens
gtactctccagtgactcttagcaggaagctgcctatgcaagtacaaaatgggtggaatgatggtctttagctgatagcagaaatggacagtcggccttcaccaacccaccctaccttgtgtctcatacacagcaagttttaaagatttccaggaaacatatcttaccaacttccttagtaactaattccggaagaaatgaagaaatccacctgcaagctagaaatgaaatccgcttgatggcacagaatattcaagtgagtttctaactcagttaacaatatgataaaaccaaatatatgcacatgcaaaattattaaagatttgtttatgtgagact

SEQ ID NO: 270465 - DNA, 357 bp, Homo sapiens
ttttattcccgttattgaaaccccagtgcctaccacttagcaggaactccatgaatatctagtaaaatcaagactgtttatacgaagatgattgctacagtctagcagcaaaggggatagacatgcaaagacatgatgtgcagttcagatggtggagtgacactagaaaacttgacaaagtactaagggagccccaaggaaggagacgcctgtgtacgtggagaaatacagccagattcaaggaggacttcacatagcattctgagtcattttttcttttttctttttctgtttttagaaacaagttcttactctgtcacccagggtggagtgcaagaacttgtttctaaaaacagt

SEQ ID NO: 270466 - DNA, 576 bp, Homo sapiens
gaatatttagaataaataagcagctccttcaactcaataagaaaaagacaaatagcccaatggaaaaaaatcagtaaaaggcacaaataggcaattcacaaaagggcaaatatgaaaaaaatgtgcaactgactaataaactataaagagatactatctcacagctgctggattagcaaaagtttaaaaaaaaatctgacaataccaagtgactacagaagggatatataaattgttgtatattcttataatgcatactatacagcagtgagaatgaatgtgcattaggtgccaacatctatgactccaaatcacaatgagggaaaaaagttacattgtaggccaggcgctgtcgtcacgcctgtaatcccagcactttgggagattctgttgaagggggattgaatatacatgttcgagctctgttcccttttaaaaccacactaaattggtaggaaactgattttttaaaagaaaaaccaaaggatcttagaagaaaacataggggcaaatcttcatgactctggatttggtgatggtttcttaaatgtcacaccaaaagcagaggtgaaaaaa

SEQ ID NO: 270467 - DNA, 354 bp, Homo sapiens
tctcagattactcatctgtaaattgggaataattttagtatatttctcataaaattgttgtgcctattaaataagagaatgcctataaatcaagtaacacagttcctagcacttagtagatactgcttgttattatttttgaagttaacactattttcagtgttctttatcacaatggtaataggtatactatatgaagtatacaaggtattctacataaaatatagtagaacttggctgggcacgatggctcacgcctgtaatcccagcactttgggaggtcgaggcaggtgggtcgcttgagcccagaagttctagaccagcctgagcaatatagtgaaaccccatctctga

SEQ ID NO: 270468 - DNA, 260 bp, Homo sapiens
cgccattggcctccaagtgctgggattacaggcatgagccacggcgcccagcctaaataagatcttaagattagattggcaattttcagagtggctcctctgacacggggaaaccgaggcctgatggtaactctcctaactgcctgagaggaaggtggctgcctcctctgacatggggaaaccgaggcccaatgttaaccactgttgagaagtcacagggggaagtgacccccttaacatcaagtcaggtccggtccatc

SEQ ID NO: 270469 - DNA, 431 bp, Homo sapiens
gggtgcagagcgtgcaggccaaacccacgctcagccccaccgtttgcatactgcacgctcaagctgctccaggcctgggtgaaggcatgcacactgtcctgggtccaggtagcccagagcgtggatgaccaaagcaaaattccattaaagtcaaaccagatctcacccatagctctttgtttgtttatctgagaacaaagtcaaaggccaaggaggccccactctcctgccacgggggaaccagtgtgcaagctctaggcacctactagagggtacagaggtggcctccacagtggactcggagttctttcccccttcttcggcaatgaggggtttcttcctagggcctattttcctgcagggttagagttaggttttagagcccttttccttaaccctcttctctacttcctatcccaattcatttattt

SEQ ID NO: 270470 - DNA, 448 bp, Homo sapiens
atagaacacttccccaccccaacaccataccaccacattactaaaggctaatcaacagcagttccttttaaccagtgcctcatgtccagctataaagaaaaaattacaagacatattgaaaggcaaaaatgtagtttgaagagacagagaaagcctgagaaccagcctaaaatatgtcagggatggtggaattattaggctggaaatttaaaacaactattattaacatgcttagggctgtaatggataaagtagacagcatgcaagaacagatgggcaatgtaagcagagggatggaaatcccaagaaagaaccaaaaataaatgctagagctcaaaagcagtgtaatcagaatgaagaatgcgtctgatggcttattagcagactgcacacagccgaaaaagaatctgtaaacttgaagatacctcagtagaaacctcccagacta

SEQ ID NO: 270471 - DNA, 313 bp, Homo sapiens
acagtcaagtcaggaaggatccataaatctctacttcacggagataacaaacactggcactagcattttgtgaccaaggtttttgaactcgaactatgcaccatgtgggagagagatggaccagagttaaggcctgggtggtgagtggaatagcagattgaatcagctgtccttcacaaaaaaccagaaagctaggagtccaaagggtgaaatataataggtgaattaggaaaacaaaacaaaacacagactgcttgtttgtcatgattccaggtgtggagggtacctgtagtctaattcctaagcttgtgga

SEQ ID NO: 270472 - DNA, 375 bp, Homo sapiens
atgtatcaacatgactcaaagtggcaaaaacaaagtgggatggagttactatcaagaacctggtgtttgaaggaaaagagatgagaaaggtaacagcttactgtccacatctagggaagatgattgtcttgacactttgacagttttatagtcaaggacaaagggaattctaaaggcacacataattagagcatttcaatttatgttagtcctgagagatctgcctattattaagaaacctgagatttgataacattttttatacaaacagattttatacaacagcatagtaaagttctgtattctcttgattttatgtcgattataggtgcaatgttatagaaaaaattaaacttaaatttgtatatttctaaa

SEQ ID NO: 270473 - DNA, 502 bp, Homo sapiens
gtttgtcaagtgcctgttattgacaaattttctattaaaatatgtatattttgttgtatagttcacgataggtcagattttacaacataaccagcatattatttacaatattctgcaatataattaataaaataggttaactcacttaaactaggaatttaaaattctctgatgttcattgtaccacttttcctccaaagctgaaatattagtgagtttttattagaagggagaaaatgtaagtttatatgaactctgtttctaaactctgaagaaatgttttttgagaaatgttttaaaccctgagttaggatttggaaattgagtttggttttgaaggataatatttcttttaaacctgttatttctgtgatctcctggaattgtgtaatgtaaattgttagtccagaagcaaatatcaatgtcctgattctcatactctaaaagaaaattgcagtttaaagaattctaattgtgttttattcagaatgtttttctcttc

SEQ ID NO: 270474 - DNA, 515 bp, Homo sapiens
tgatgaaaatgaaatattaatatgcaggttatgttagatgctgcttcggaatttcagaaaaatgaacagtaatcaaatgagggtgtcacataatacacagcaagcagagagccaattatgtaaatgaacacccaaggttagcttgatacaatgctctttaatttgacaaatattaaaatcaacttgttcttaatgtaatagatggctgtgacaaaagttaaagagcacccagtgtttttgtaatccctgtcaaattaaaaatgctaatgtgagtgagctgctttcatcagtacaatagttgaaaggcccaaaatgtacaacatttcctgggtttcagtaacattagactaaaacgtttctgagataaaagtcataatgaccagtgtacatctacttccaacaactgaaaatacataacggtaaactcctgttgcctcagtacatttacaaaataagaagagcttctcccatttagctgattttatttgaataaactgcagatacattttcataat

SEQ ID NO: 270475 - DNA, 337 bp, Homo sapiens
cctagctgctgtggtcttaatacagcccccaaagttcatgtgttggaaacttaatccccaatgcagcagtgttgggaggtggaggattttgggaggtgtttaggtcatgagaactccaccctcatgaatgaattcatgtcattataaaaggacttaatggagagagtttgttttttttcaccccttccattccttctgccatctgaggacacagggtttgtccccctctgaatgatgcagtaacaaggcaccatcttggaagcagagagcagccctcaccagacacccagcttgctggtaccttgatcttgggcttcctaacctttagaactgtgag

SEQ ID NO: 270476 - DNA, 542 bp, Homo sapiens
atggcgaattggctttgggaatgaagaatttgacttccctggttccagttcaagacatacgggtgggaactcccactgggtatccactctgctttcttgggaaagcttcacggtatctttaggaaggaagcctgggattccacaccctggagatactggatctcttattctctatgcacttccttacacactttctcttccttcaagggcctctcagttgaggcactactccaccttaaatccaggtggccacattcagaagcactgtcacgctggcctctcagcaacatgctaacacagaaaaggaggctgtttatgagtcagctctgccaacaggattgcttcctaggaaaagtgcaaattgatttttttcctcctgttggtctgctgggggattggaggcagccacggacaattcattagcacatgtaggaaggccagggagaaaaataagctaagttgctctcatactagaaagcatttaggaagcaaacccataaacatggataattattgtgtgtccattaaaatttaaaaaaaaa

SEQ ID NO: 270477 - DNA, 204 bp, Homo sapiens
cactctccattctgctccattggtcagactatctgtctaaagtactatatgttataacaggtcttcgtatctggaaatgtaagtcctctggctttgttcacctacttcatgatggcatggctattcttggcctcaactcatgattttttaaaaaaatgtatcctagcactgcctactaaatcatggcctgaactcacgattaca

SEQ ID NO: 270478 - DNA, 169 bp, Homo sapiens
gcttgcttctgttattgtccaaatcttaactgactctgacttggcctataaggcaggttcacccacccggtagagccatgctagtggctcctagcagcccaagagcccagcctgtaaccattcatccctggagggaaaggagctgaacctaaagtttccagtacaacct

SEQ ID NO: 270479 - DNA, 280 bp, Homo sapiens
cccatctaagatccaacatctgagatttccctgatggttttagaatgatttctgtaccatccccaacccttccaggtatgatcttgtccctttttactgttctgatcactgtctcacatttaggttgaagctttatgttctggccataatgacttttttccctttcctcctgcaaacgaagcccattgttgtctcagcagttttgcactttctcttcactttgtatgaaaatttcaggtcttacacagaatcctgtttttcaacattcaggtttcagttc

SEQ ID NO: 270480 - DNA, 173 bp, Homo sapiens
atcaaaaagtttttattttggcaaatttaacttcatatttcattaatagtagcttacttgttccatgtatattaataaattgaggtgtaatgagaagaaagaactgccgacagattatcttctgttcaatttcaaactcaaatcaactgcttaagcctttaagctcatgagca

SEQ ID NO: 270481 - DNA, 525 bp, Homo sapiens
ccagcggccaggctctgttcccaagctggagagagaggcaagtggtgagggagggcaggaggaccagtcatgggtttaatgcaaaatgacagttacgggggttgccattttagagtaaaacaggccatgtgactgaggagcaggtagcattcatattattcatatttcgagcttggtagatgtagaattttgcagtggaggccaggagaggatgtgagagctgcaggacagaggcataggtttttggaggtggttgtggtgttccccgatggcaatcaacttcacggagagaagaggttattttctacttaggttgcctggagcctacattccaaacttttagtcctcttcatctagcactaagttttgcatctcccttattcctgtcatacattattagtgtgcactgttttaaagtcttttacatacatatgtcttgcattccctacttaattgtaagctccttgaaggcattgcctgtgtattatgtttctttgaatctctctgtggtggctaatgctctgc

SEQ ID NO: 270482 - DNA, 400 bp, Homo sapiens
cttccattgggttcttcctttagtccaggccatcccatgtaaggcctgctctcgggtggcaatttggggagttttaggtgatgcagtggcagtgggcgctgctgctacagactcatctgaacacaccttgaaagcctggcctctttccaaatctagtttctattggcatctttgaggggggtgagtgacaagtgtgccaatcacccagtgactgagcaatgaggtcctcactgaagcccactctgaaagagagactcaaatacagtccagagaagttcagtgggaaaaatgtatacaacattgtaaatgttttggtcagaattgttgaaaattctgggtgaacgtccagagaaaactggtttcctgctaacccatgaaacgtgattcctttctcagagta

SEQ ID NO: 270483 - DNA, 473 bp, Homo sapiens
aaaataatacctattttacacaaactcttccagataattgaacaggagtacttattctgtaaagcctgtttaccctgattccaaatctgacaaatatattacaagaaagaaaaactatagttcactattccttcatgcacatagattttaaaatttcaaacaacatgtcagcaaatcaaatccatctatatgtaaaaaggatggggccgggcagtgagtcatgcctgtaatcctagcactttgggaggccaaggtgggagaacagcttgaagccaggagttcaagaccagcctaggcaacatagtaagactccatctctacaaaaaaaaaaattttttttaattagctgggtgccacaagctactggggaggctgaggtgggaggatcacttgagcccaggagtttgaggctgtagtgagctatgatcgtgccattgcagtccagcttgcataacagagcaaaaccttgtttc

SEQ ID NO: 270484 - DNA, 268 bp, Homo sapiens
cctacaaagaaggacacaattatgaaaacaaccataattttcatatgaatactcccaaatactttttatgaaacatttaaaacaagaagttattggctgggaaaatctaagaaaaaaagtatgtaagataaaaagaagagattaatgaaagtgggaaaatacacatgaagaacctcaacttaaaaaacacatggtatctatgcagtgggaaattacctccatttgtaaactatgttgcttaataaaaacatttctctaaattgttttc

SEQ ID NO: 270485 - DNA, 318 bp, Homo sapiens
caattccttacctgtcagtacaacatgcattggttccccttccccccaacagatggcaaggtgaattatgaaatctcataaaaaaaaaatacaactagtctactcttggaaggtagagatatgtccttatttgaaatggtttgcggtgtttttcaaggagatgagcacctactgatctctttctgtgcctattaaaaccagaaatcggagctggatgtggtgggcacctctgtagtctcagctgcttgggaggattgcttgagctcaggaatttgaggccagcctaggcaacatagtaaaaccactgtccctaaaaaa

SEQ ID NO: 270486 - DNA, 254 bp, Homo sapiens
catgcatgaggtactggatacattaaacacacacacacacacacacacacacacacacatatggcattgagttctagtcatatcctaaagaaaaactatggtgcgctatgttatttatagtactatactctgtgtgagtgactctgtgtgtatgtgtgttggtggaggtcagggatgacttgtttgtaatataccttaaggaagtctgtccgaatttgcccttcaaatactaaataaattcatctctcacctca

SEQ ID NO: 270487 - DNA, 605 bp, Homo sapiens
cttcaagtgggctggagacctgggagctgatgaagaatccatcaggaatctgtttgactttacccccaagtacagagcaacccatgaggaccaaaagtttaagaaagtaaaggagtgttcctcagagctgaagtacagcatggagctagatgaagtatggagcatggtacctcaagcctaagttgtggaaaaagctaagaagtgatgaacctttgattgaccccaagctcttacttaaaaagcctgatgaacctgacgttcttgacgatctttatggaccaattgcctttaaggatttcattctaagcaagggctatgaaatgcctggcatcattcaaaggctgtttgccaggaggggatggacttatgactctgttaagactcctattcaacgtgcaatgatattttacaagtacaaagaaatcgtagaggcatcggaagaagattaggcagttttcaatttactactcaattgggtatttcttgctctcattttaatcatcaatcataatttatgatgactggccccgtggatgcacaactttggcaacatctgtaaattcaatacctaatgtttatcaatatttcttaatgaactgctttgg

SEQ ID NO: 270488 - DNA, 338 bp, Homo sapiens
gcacatttttttttgtttgcttgtttctttgagacagagtctctctctctctcccaggctggatggagtgcagtgttgtgatttcagctcactgcaacttcttcagcttcacttgaaccgggttcaagtgattctcctgccttagcctcccaagtaactgggatgacaggcgcccaccaccacaggccctcagagccttcacccaagctgtatacatgagagacagagaagaagcatactcccttaactcactgccatcttccacacccacgtcatctccacgtccatggcgctcccagatagactgtggtacgacagccaaagcattcgttccctca

SEQ ID NO: 270489 - DNA, 808 bp, Homo sapiens
  misc_feature (18)..(18): n is a, c, g, or t
tgctccggcgcggagccnagagccggttcggccgtcgactgcccagagtccgcggccggggcggggatggagccaagccgccatggctaccacagcttcctggtggagcccatcagctgccacgcctggaacaaggaccgcacccagattgccatctgccccaacaaccatgaggtgcatatctatgaggtgacaggcatcgactgggcccccgagagtaaccgtattgtgacctgcggcacagaccgcaacgcctacgtgtggacgctgaagggccgcacatggaagcccacgctggtcatcctgcggatcaaccgggctgcccgctgcgtgcgctgggcccccaacgagaacaagtttgctgtgggcagcggctctcgtgtgatctccatctgttatttcgagcaggagaatgactggtgggtttgcaagcacatcaagaagcccatccgctccaccgtcctcagcctggactggcaccccaacaatgtgctgctggctgccggctcctgtgacttcaagtgtcggatcttttcagcctacatcaaggaggtggaggaacggccggcacccaccccgtggggctccaagatgccctttggggaactgatgttcgaatccagcagtagctgcggctgggtacatggcgtctgtttctcaggccagcgggagccgcgtggcctgggtaagccacgacagcaccgtctgcctggctgatgccgacaagaagatggccgtcgcgactctggcctctgaaacactaccactgcgcggctgggtacatggcgtctgtttctcagccagcggg

SEQ ID NO: 270490 - DNA, 862 bp, Homo sapiens
  misc_feature (18)..(18): n is a, c, g, or t
tgctccggcgcggagccnagagccggttcggccgtcgactgcccagagtccgcggccggggcggggatggagccaagccgccatggctaccacagcttcctggtggagcccatcagctgccacgcctggaacaaggaccgcacccagattgccatctgccccaacaaccatgaggtgcatatctatgaaaagagcggtgccaaatggaccaaggtgcacgagctcaaggagcacaacgggcaggtgacaggcatcgactgggcccccgagagtaaccgtattgtgacctgcggcacagaccgcaacgcctacgtgtggacgctgaagggccgcacatggaagcccacgctggtcatcctgcggatcaaccgggctgcccgctgcgtgcgctgggcccccaacgagaacaagtttgctgtgggcagcggctctcgtgtgatctccatctgttatttcgagcaggagaatgactggtgggtttgcaagcacatcaagaagcccatccgctccaccgtcctcagcctggactggcaccccaacaatgtgctgctggctgccggctcctgtgacttcaagtgtcggatcttttcagcctacatcaaggaggtggaggaacggccggcacccaccccgtggggctccaagatgccctttggggaactgatgttcgaatccagcagtagctgcggctgggtacatggcgtctgtttctcaggccagcgggagccgcgtggcctgggtaagccacgacagcaccgtctgcctggctgatgccgacaagaagatggccgtcgcgactctggcctctgaaacactaccactgcgcggctgggtacatggcgtctgtttctcagccagcggg

SEQ ID NO: 270491 - DNA, 368 bp, Homo sapiens
  misc_feature (17)..(19): n is a, c, g, or t
  misc_feature (24)..(24): n is a, c, g, or t
tactactactaaattcnnngccgntcgactagagttcctacctcattagaaattctagaatatcaaggtacattttgagcaggaagtgatatcatgaaacaataatttgcccagaggctaaaggcaaatttaaaatatttttctttatcctttcctcctgcaccatcaccccttaaaaagtatatatcatttaatccactaatcttactgtttgaaatttacccttcaagaaaaccttaaaaacgtaaaaaaactattgcactaattgagtcatttcagtgttagttacaaaaattggaagctattcaagtgccttatagtataatgtttaaataaatgtcgacgcggccgcgaatttagtagtagta

SEQ ID NO: 270492 - DNA, 355 bp, Homo sapiens
aagttccagttcagtccttaagtccataaagcatgaagagacttctgagtcttggaaaagggaactggaagataattggaaaatactcctgatgtgtaggaatatttttgatcctaaggtccctgtgttgtcacacaatctggccgttgtggctcttcatcataaggggctttggcacataagccagagactgaccttagattcctgggcagacactggacaataaattcactatttaaggtaaatatcttagggaggcagagctgggaggatcactggagcccaggagtttgaagctgcagtgagccatgatatcaccactgcactccagcctgggtgacaagaccccaacttt

SEQ ID NO: 270493 - DNA, 521 bp, Homo sapiens
agactgtgaagggcttgaaagtgatcagttgtttcctgctcaaatggacccttcagtgccaaccctaccggccttggtccactttcagattcagatgaaatcattgcagtctcccggattaactaaatggatgagccaaattcactgctgacattgatgcccaggtgttcaagtcaaacctccatgatcacagttttaagatgtggttggcaacatgctgccttaagttctctaaagtgttcaggctgtgggatgagaagtgataggactttggagcaaaggctgtcctgactcatcctgaaaactggaaaatggggtacatttcacagctcagtagcttcatgtcttaagaacgagaaatcacttcattatggttataaaacagtaaaggatggataacatccttcaaaaccccaaccacaagaattgccaagagaaagagtgatttttaaatttttattcatttgcttatattatgatctttttgtaattacagaataaaagaaagactcagtaacacc

SEQ ID NO: 270494 - DNA, 741 bp, Homo sapiens
attacattataaccattctgttattcctgctatataccgtgttcttcatttcaactattatattgttcacacctaatgtttttgcttggctctcttcttcttgtccttgtttcatattgctaatattttctcatttcttttagtatggttaccgctccccagtttaaaattcttggtcagcagttctaatattgttgctcctgaccaaaacttgtagttgattgtgttgtttttcttttgaaatgtactcttggccaggcgtggtggctcatgcctgcaattctagcactttgggaggccgaggcgggcagatggcctgagctcaggagttcgagaccagcctgggcaacacggtgaaaccctgtctctactaaaatacaaacgaaattagctgggtgtggcagagtgcacctgtagtcccagctactcgggaggtgaggcaggagaactgcttgaatctgggatgcagaggttgcagtgaaccgagatcacgctactgcactccagcctaggcaacagagccagactccatctctaaaaaatccatgagtatcagctatcccatcaggcactggaatggagggggccccagtccatgctagtactagtaagttctgggtagggggtggatgagtcctaggagtggggggccccaggcacacaggaaccatagttaaccactcttcacctacagaagagctcctcaggtcagcttcactgtacagtccccttctaccccag

SEQ ID NO: 270495 - DNA, 799 bp, Homo sapiens
attacattataaccattctgttattcctgctatataccgtgttcttcatttcaactattatattgttcacacctaatgtttttgcttggctctcttcttcttgtccttgtttcatattgctaatattttctcatttcttttagtatggttaccgctccccagtttaaaattcttggtcagcagttctaatattgttgctcctgaccaaaacttgtagttgattgtgttgtttttcttttgaaatgtactcttggccaggcgtggtggctcatgcctgcaattctagcactttgggaggccgaggcgggcagatggcctgagctcaggagttcgagaccagcctgggcaacacggtgaaaccctgtctctactaaaatacaaacgaaattagctgggtgtggcagagtgcacctgtagtcccagctactcgggaggtgaggcaggagaactgcttgaatctgggatgcagaggttgcagtgaaccgagatcacgctactgcactccagcctaggcaacagagccagactccatctctaaaaaaaaaaaaagaaatatattcttaaaatatctttttattttagcctacaaactgcttttcatccatgagtatcagctatcccatcaggcactggaatggagggggccccagtccatgctagtactagtaagttctgggtagggggtggatgagtcctaggagtggggggccccaggcacacaggaaccatagttaaccactcttcacctacagaagagctcctcaggtcagcttcactgtacagtccccttctaccccag

SEQ ID NO: 270496 - DNA, 464 bp, Homo sapiens
acatcctagttcttaaatgccttggaccagaagtattgtctttccttgctagaattgagtcgtggcctcaaatcagctgcacaggaggtactatatctctgtcaccatcaagaatttgcatgacaatccaggtttacatgtaacctgcttgtaccttttaaagggaatctccacttcaaatacatacatatctagtctgtgattcatgacttttgccagattttgggagctgtgtggagcaggaacctgaagagcttagctgaaaacctctcatcagtaggaatccactgaggtagttacagatacctgaggctcagatgggaagccctggaggaccatacccaagaataggagcaaaccagctcaacgccatgccctctgcctggtggttcattgtgattggtttattgtgtagatattgaagaaaaagagaatattttaggttgacatttttaagccaaaaa

SEQ ID NO: 270497 - DNA, 315 bp, Homo sapiens
agtcagccctgacacattaataccctgcacagatcagagactgctggccatacagactcaccaagccacagacttgtcttccacaagcacgttcttacctcagtcacgaagtgaccaagccacacgtactaaaggttgaactcaaagatatgtacagggtattaaacgaataccgaggggaacagttaacttgaatacaaggtcaaaaaatccagtgctgacgtcagatacaagcttcaaggacaatttcttttcaaaggcttattccagtttcatgaggttagcatgaggtgtatgcatttgccaagggcaaat

SEQ ID NO: 270498 - DNA, 741 bp, Homo sapiens
aaggtgaaaaaatgctttgagaactacacagaatgacataggtcatacgggaaagcagaccatagatcatttgcttttcttgtgactttaatacagaagtgtaacactgctgtatgacagtagacctcaaatgcaaaaaaggggcagggaagggacggagcaagcatcactttagtttgcggtaagaattagagtcgaggtatgttctgagaataaagaaaaaagtactggttaaccaaagtacaggaaggaagggtatgtcatgttctatatttcacaagctgtaagaaaattagcttttgtttagtagaaatgtgggtaaatttctcacagtataactttcagactaatttatgacttcagtcaggctttagaagaaacttctggtgcatagtgattcattctgatataatttactaggaaaaaaattgaaaagtgtttttttaacttgaaagttctcaaatatgtattactggtgaattccattaattgacaacctgttatgaaaatgcatttttctagaagggcatttgataaaccaaatttgaatcaagtagattgggaattactttatcatgtggctgaagaacacaaccatgacaaacagattagtaatatatttttggaagtgaacttttatttatgactttctaccttgtaataattttatatcttaagatacagatagcatttaaaatcccagtttgcgctgaatagatcaaacttggaaatagtatgtgt

SEQ ID NO: 270499 - DNA, 728 bp, Homo sapiens
tttggccgtggcgagggttcccaaaatggtggtgctgttatcagggttcacctccctttggtttttccaccttcatctggaaagtggagccagtctcccctgcttataggctttgcagggctgctgacgtgttcttggatagaaggatgctttagagaccaccacgtgccgcaggtgtggccgttaatacgaggcattggaacaattctttgccagactctaggctgcccaggagctgagcggtatagaggttgagagcctggcagcctgggttcaaatccagaccccaccacttcctagcagggtgacctcagccaagtgatttctctgggcctcagtttcttctctgtaaaatgggactttgatgaggattggaggagtcagatcatgtaaagtacttagaccaatgtttcctacataacaagtgccatataagagccatcatttggccggacaaggtggctcacacctgtaatcccagcactttcggaggccgaggagggtggatcacctgagatcaggagtttgagaccagcctggccaacatggtgaatccccatctctactaaaaatacaaaaaaaaaaaaaaaattagccaggtgtggtggcacgcacttgtaatcccagctacttgagaggccgaggcaggaaaattgcttgaacccgggaggcggaggttgcagtgagccaagatcacacctggctgacaagagtgaaactccatctca

SEQ ID NO: 270500 - DNA, 391 bp, Homo sapiens
tcgcacagtggggtacgatgggctactctgcccaatctgtgtactctccttgggctactctgcccaaactgtgatttggggcatatagctatgccttctctggttcctctgtaccaaggtctctccagtggctacctcttctactcagcaggacagagaagctctcttggtttttattcttaggatccaggttcagaaaacaaataaacaaacaaacaaacaaaaaacctcatggtagctaatctgccccctcccttctctatgaaatgggcaggcagagaaaatccccctggccctgcctagcccatccattcctaagggaccttcccatagccagattgcaagaggagagcaaatttaaatgaaataaatatgaatttcctcctaacaa

SEQ ID NO: 270501 - DNA, 730 bp, Homo sapiens
tggaatctcgttgctggactctgtgccccgcagtggatgacagttctccatcagggtctgcagtcctctaccctggacttgctgcatcctggagcccccagcagtcaggtaccggctctcagaactgcctgcatcccattggcctgagctgctgtctgccagggctgctggtaaccaggcccacagggttggatattcccccaacagggcagctcccagtccaagcccaactgttaccagcccagaaagatgtttcaggatacccctttcctccccacttccctgccctctgcagctccagctggtgcaccccatctttctctccccctccctgctaggctgggccctaacaggagacctttgaggtggttgggcttgttctgcaaccttgagtacccttgagctactgcctcactcctcagttttcttcttcttaaggtttctaattggactttgccagtgtatttatttcaaaactggtcatcttactgacctcgctcatagtctcttattacttttctagttgattctcttgagttttctggataaacaataatatcatgtacaaataatgatgacaatttctcctcctttccaaatgttgtgtttccttttgtgtattaatgtactcttgccttggctaaaacttccaaaacaatgtaaaataattgtgttaatagcaggctttctcattctaccctgactaaaatatgaatgaccctggctaggt

SEQ ID NO: 270502 - DNA, 407 bp, Homo sapiens
acagaacatattctaaggtccaccacatccttggacataaagcaaatcacaataaattcaaagaaatcaaaaccataccaagcaaactctcagaccatagtgcaataaaagcagaaatcaataccaagatctctcaaaactaccagaaaatggaaattaaacaactttctcctgaataactcttgggcaaaaaacaaaattaagacagtaattaaaaattactttgaaattaatgaaataggagacacagcttaccaaatctttgagatgcagttaaagcagtggtaagagacaaatttgtagtgctaaacaccttcatcaagaggttagaaagatgtcaaattaacaacctaaagacagtcagataaacaagaaaaaagaacatccaactccgaataaagtagaag

SEQ ID NO: 270503 - DNA, 410 bp, Homo sapiens
gacccaggcacatttccgaagctctctccttccccgccccctacctcttcctgcctcctggacaaactttcccagttctgtcttccctctgcgggcagcatggacagacgcaaggacacgccctgtctgctgtccgctccctgtctgtagcacagctgaccaggccctcagtgaagcctgcgctccctggatgggggaccctgtagtgtctgtagggatactccagcctccccggccaccacacggtccccgaacccttggctttgacatgtcctaacctgtggcccttctctcctggggtggtcagatccatggtctgtgcctcgagcatcgcctgtgtgttgtattgactcccaaattgacttggccagtgctgcccctcaacagggttcccaaaagcatcacaaata

SEQ ID NO: 270504 - DNA, 127 bp, Homo sapiens
tttgtgcagatcctattactttgccttggttgcttgctataagacttgtttaagatagaacttgccctgtggagaagaatagagtagaataaaataatttaaaaataagaaaaaaaaagattaaaga

SEQ ID NO: 270505 - DNA, 766 bp, Homo sapiens
  misc_feature (23)..(23): n is a, c, g, or t
  misc_feature (102)..(102): n is a, c, g, or t
  misc_feature (296)..(296): n is a, c, g, or t
tgtggtggctcatgcctgtaatnccagcactttgggaggccaaggtgggcagatcactaggtcaggagattgagaccatcctggctaacacagtgaaacccngtctccactaaaaatacaaaaaattagccgggcacggtggtgggcgcctgtagtcccagctactcggaaggctgaggcaggagaacggcatgaacctgggaggcggagcttgcagtgagctgagatcgcgccactgcactccagcctgggtgacagagcgagactctgtctcaaaaaacaaacaaacaaaacanaaaacaaaaaacaaaaccccaaacaaaacaaaacattgactcaattataaccaatgtgccacatcagtgcaagatagtatgggaaactgagggagaagggggtatttggaaacactctgtattttctgcttttttgtaaacctacaactgctccaaaaataaagtattaaaaatatatacatatacataaaaatgaactaacgtgtttttgtattatgataatatggtatccctgaaaagtaactttttctgtgctgcattaatgaacttagttaacaaattgcatcctgtcaagtcatcctaaattacacacttttggcaatggctagttttcagggctaaaaggaaaaaaaatgactttgtagaagtcaaaaacccacaaacctagctttatgcaaagcttaattttattgtctatgtagttagaaaacagtctgaaagaaaactcagtgttaaaacttatctatata

SEQ ID NO: 270506 - DNA, 217 bp, Homo sapiens
  misc_feature (202)..(203): n is a, c, g, or t
caggcacggctcgccccgtggagcccttcgtttcttcctcaggaggtcctgggacagaatcagtctcttttcctgccagggtgggctccgggcacctggtgggtgtgtagggctgggcaggtgtggatgtggcaggtacgggcgtggcaagcaccagccgacggccgcagccttccgactctgcacgccactcttcccgcanncgccagcgaagccg

SEQ ID NO: 270507 - DNA, 393 bp, Homo sapiens
gaggaagcaggcttaggattggttcgtgtgaatgtcttcagtgggctctggttatctggtacctggcccggggtgatgagggtagatagaggcccagaaggtgagagcctaatacccagagcggtcgggggggtgggtaggctcagggctggttggtttgggaagcatgtttgtgggcccgttggttaccgtctcaaggaatgggctaggcctgggtgtggctgtccttctaggatcagcaaggcagcaaatatcaaagcaccagaatacacaaagtaaaagactgcattaatacagggtagtttacaaagaaatgggaaattgttggttctgagctgggtggggattgaaacggtgttccctgcagatccatttaaagtctctctgtaaata

SEQ ID NO: 270508 - DNA, 953 bp, Homo sapiens
gtaaagagagaataggagaaattacaaatcatatacctggtaagagacttgtacccagaatatataaagactcttactacccaataagacaactaaaaaaatgggtaaataatttgaataaacactgctttaaggaagatacacaaatagccaataagcacaagaaagaatgctcaacatagtatcagagaatagcaaaccaaaactagatagagatcccatttcatatccactagagtgactaaaatcaaaatgtcaggtaaacaagtattggcaaggatgcagagaaaatggaacctgcatacactgctggtgggaaagtaaaaagatgtagctgctttgggaaacaatgacagctcctcaaatgattaacatagttatcatataacctaaaaattctactcctaggtaagaaatgaaaacacatatgcacataaagacttgtacacgtttatagcagctttagtcaggacagccaaagggtggaaatacccaaaatgtccaacttacaaatgtataaacaaagtgctacagccatacaatgaagtattttcagacatactaatgaatgtgctgatacatgctcgaatatagatgaacctcttaagacatgtaaagtgaaggaagccagtaaccaaagaccacgtattatgattccatgtacatgaaatgtccagaataaggaaatctatgagatgaaaagaggtagtatggatggcgggggatgacaggagaaggataaaagctaaactatacaaggtttctatctgaggtgatgaaaacattctaaaattgattattggaatggttgcatttatctgtgtatatactaaaagctactgaattacacaccttaaatgggtgaaatgtatgttgttacaataaagcgtttttcttaattatatatgatcccatttataacatgcttgaagacaaaaatatggagatgggga

SEQ ID NO: 270509 - DNA, 838 bp, Homo sapiens
atgaagttcagaaaggggtaaatgcagttttggggagggctgagactaagagagaacacaataagacaggcaattaagactgacatgaaagatcagtcacattgataggatatactcttgatatgatataatgagaatggcagtttaccgctgtggttttcttttcccaaaacccataaccacagcctaaccatgagaaagacatcaaacaaatcccaatttgggacattctgtagaatacctaacccagtattccttaaaaacaatgaaagtcagagatactgtcacagccaagaggagcctagggagacatgacaactaagtgtaatgtggtatcctggatagaattctagaacagaaaaaaattaaaaactaaagaaatcatgtatgagcttcagttaataaggtatcaatattgtttcattaattttgtcaaatttaccatactaatgtaagatgtcactattataggggaaactggctgtggtgcacatgagaactcgttgtactatcttcacaatttttctgtaaacctaaaactgttctaaccctaaacctagccagtaatggtgccttggtaattaaaacaccatgctgatgagtatatgatttctagctagctttatgaaccccatgatagaatttggatatgtcagtccaaatttatcactcttagtggaaaatcagggtaggttcacttcattgttaagaatacaacagtaacattattcgcctttgtaacttaaaacacatcccagcgtcacataccatttgtacccccacctcccctctcaaacccattgcttccccactggccgccccctaccccccaccaaaa

SEQ ID NO: 270510 - DNA, 273 bp, Homo sapiens
gaattgcttgctgtaaatagaaagatttttctagttacacttaaatgataaaaatctggttcagctggctggatgactataaaaaatgtcatagcaaaccactttagggcaagcttgagaaggtgaaatagtgcagatgcatgaaatgaaaatatccatacattcatttatttaatttagcaaaaaacttcagagcacctactgtattccaggcctgtgttaagcagtagaatacagaaaccaataaaaaggagtatgcactatctagatgct

SEQ ID NO: 270511 - DNA, 380 bp, Homo sapiens
cttctttgggaaaaaagcctttgtaactcttctttcttcttcctgcctaggacccatgtgcacaggcttagatgtgcaacagccatatctaattacaataatggcaagagccacctactatgctggtgaaacaagaagacagaaaaagaggaccactgctaacccatttgacacctgtggaattagaaataagtgctatagaaacctgagggacacacagggaaatcagaagactaagtggagaagggagaatcacagactgggttttgtattagaaaaaattatccagaagctgataccgtctgtcttaattaccatctgttaatttccttaccaagttctggagattaaaaatggacactggaggaacctaaagttat

SEQ ID NO: 270512 - DNA, 928 bp, Homo sapiens
ggcgctctggggccgggatcggcgtcggggtcggggttggggttggttcaccgcagcagccccagctcctgcgccctccctggactgaggtgtgctcgctttgaggagaagcctggagtgatccgctgcctcgggtcggaacgtttccattcattccgctagcatttattgagcgcttatgatatgtcagtccccggagtccgaaagaggaatcagacacagcttccctgccctgtatgttacaagtcactctgcctctgtggggagaaggcaacttcttcatgaactcgaacatcctttgcaattctgtatcagatacttggcagggtttaaaaaaacatggcacctcttataacttttcacccccaatattatgttttatctgctaataaaataattatttggtaaaacacccgcacaggcgttcacttgaccctcaaaacaactttgatttttaaaatgaggaaaatgaaaattaaagaggttaaatggcttgactaaatcacagctgtgattaaatcgtaatgatgaaaccaaaagtcaaagtcctggtctccaaatcttgtggttccccagtatgcataattatcaataactgccttgctttccaatacttttattctttcttctacaatattcctcactgttaccagtaagtttggctgtctgaactgacatcaaatttaaaaggactgcagaaaagagaatcagttcaatgtatgggaaatcatttcctgaagagaattcttcaataaactgcttattggtatctgtgagttctgttttgttaaaataatagaggagcagctgactcttttattatttttaaatttttgtgacagagtctcgctctgtggcccaggctggagtgcagtggcgcaatctcagctcactgcaacctctgcctcctagcttcaagcgattctca

SEQ ID NO: 270513 - DNA, 837 bp, Homo sapiens
tagcaggtacctcattttctgaagatttattctttaagctggacagaggctgttttcattaacacagtctcgtgttcttccggggtctggtacatggggcacaatgcgggcttcattatccaggaggaaaacatcttttcttctggaatcttcagccagctccaagttccaggacagcacagcagcagctttcctctttcctcaacttgtgaatgagaacacattcttcaatacagatgagcccaggcaagaatcattcagcacactttgcacagtgggggcctccttctcacctctttctgctgctgcttcttccagatgaatcagagtgccagccacgtgtaccatttgtaccaagtccattaaagatcgatgagcttgttcttcatctgtaaggacagactatcctcacccttctaatgattttaacagccacaacatctccaacaaataacgcacctctttttattattttggagatctaccttttaacagtacagcacactgagaatcactacagcctcatggcctgtaacatattacagtttctttctacatatgagagcttgtgatgcaccccaaactaccaatgtttcagatgtgggttcttctgtttttaggaaatactgtgaaatcgtttgctagagaaaaaggaagaaagatattggttgaaataaaagctgggctcacctttggattttaatgtgcactctgcccctgttgtgtagcatgattaatacatatctgaactgtattgtaatacaaagactgtttctctttactcttttaaatcaacacactgtcatcaccaatatattgaattcaaataaaaaaaaa

SEQ ID NO: 270514 - DNA, 344 bp, Homo sapiens
gataacaatgactgtcaggtttgttcagacctagcttatctatagaaagctcgcttaggtcttttgtatctcactcagtaggaaatttccatcccagagacacagcttcagtataagagactggatagagttctactttaaagatggtagcatgaagagctcccatagatctgcttcccagtaaagcaaacaaagctagggaaaactataaaaaagcaaccatcaaggctgggcatggtggctcatacctataatctcagcactttgggaggccaaggtgggagaactgcttgagtccaggactttgagaccagcctgggcaacatggcaagaccctgtatgta

SEQ ID NO: 270515 - DNA, 571 bp, Homo sapiens
cttttgaagcactgtaaaacctgaatatatgggtagtgaggatataatcggaaccagaataaggattgtttttaaatactgagttcttcagtgtactgtgaagtgctgggaggtactactaaaatgtatctcttcttttctcttcattattaatgctactgccaaggttagctcctcccctgactgttagaatatttcgttacttctgtgggaattacttctttcatgctgcttatgagaagttgtgtgtgtgtgtttgtgtgtgtgtgtgtgtaccatttcttttcagataagtggatattcaatatgatagaattgaaatgctaaagaactataaggaaggcctttttcagtctcactcaaaccttttttcagtgtggttaccggttcttgcacccaccctggttgcttaccatattgcagctttgttacttgaatagtatttcagtttttaacacatttgtttttgtgttggttctgtttcctagtatggctgttttttttgttttgttttgagatggtgagatggggtattactccagcctgggcaacaagagcgaaattccgtctc

SEQ ID NO: 270516 - DNA, 443 bp, Homo sapiens
tactcactctgtttatatacataagaaattggctgatctgttatcactgatcgttaccaccaccctttgtatcgtaattaaagtgctttatagtaatggcattgtggaagcacacaggtaagtgtgtgctgcttatatggatgaaaatgagaaatcactttactacagcctttgcgtttcctccagaatgagtcgctttttctcttctgacttaacggtgattgtttgcttcatgtctttgccctctgtgatttctcatttttgtttaagtaaaattgccatggtgacattgctgcacaattccctagtgcttcggaggtttcagtgagctgagattatgccaccacactccagcctgagctgagattatgccaccacactccagcctgagctgagattatgccaccacactccagcctgggtgacgagcaaaactccatctc

SEQ ID NO: 270517 - DNA, 364 bp, Homo sapiens
ggagttcgaggctacagtgagctatgatcgcatcactgtattcaagcctgggtgccgcagcaagaccttgtctctaaaaaacagaaggaaaaaaggggggaaagacttgaatagacatttctctggaggtgatacacaaatggtcaataagcatatgaagagatgctccacgtcgctaacttccaggcaaatgcaaatcagaaccacaaagggataacacctcacactcaccagaatggctgctctaaaaacaaaacagaaaataacaagtgttggtgaggacgtgggcaattgggacctttgtgcactgttagtgggagtgtaaaatggtgcatctgctgtggaaactgtatgacaattcctc

SEQ ID NO: 270518 - DNA, 488 bp, Homo sapiens
tctgagttaccaggatgctgctggaggcctgtgctgctgagagggacaaatagaatcctgatatgactggaaccaggaatagggccaccatcagctctagaacccagggagcaaatggcaggagcaacaccaggcagtcggccctcagcccagcacagacctggtgtgttggcttcagaaaatcctggaaacatctctgctgtgtttggagctcctattctgtgagaagtgttttataggctttgctccatttaatccttacgataacccaataggacatactattaatgatcccctttttttcagaccggaaaactgaggttcggagacattaagtaatttgcctaaagtcacacagccacatcctgtaggacttggaattatgaactcaggtctatctgaattttaaagcctggatttttccccctttgctacatgcctgggaagaaccatgtattgacaatgaagaatcctaaactctcgttaat

SEQ ID NO: 270519 - DNA, 672 bp, Homo sapiens
tttaaggaaaactccaggcccaaatggctttactggtaaattctatcaaatatttaagaaataatactgatcatatacaaatccttccagaaaaacaaataggaagaaatatttttcaactcatttgataaggctctaatatcaagacaaaaaaaaagcaaacaagaaaatgacagatgagtatttctaatgaacaaagatgtaaaaatccatgacaaaatgttagcaaatcaaatccagcaatatataaacatcttgcacacacgcttgctcactctctcgcatgctcattctcttgcatgcactctctctctctctctctctctatatatatatatatgcagcaatggatttatcctgggaatacaaggctaattcagtatattcaaagccaataaaaaaaattcactaaagcaatgttctaagaaaaaccatatgatgatgttattagatgtgaaaaaagctttacaaaaatataacatccgtttataacaactctcagtaaactatgaactgaaggaaacactctcaacctaaaaacagataactacaaagaaactacagctaatttcctacttaatgatgaaagactgaataccttccctgtaagatcagaaacagggcaagaatatctgatgatattggaggtcctaggcagtgcaatggcagcca

SEQ ID NO: 270520 - DNA, 418 bp, Homo sapiens
caaaagataagcaccttaaaattttcttatatgaacactgtttttgaatcattttgctggatttttcaaacacttagtttcaaaaactaagtgaatgactctgacatgtaattaaagcttgagcccaatgactgcaagctaaggttaattttgagctagcaaacggaggttattaaaggcccatttagttccttctggaaagcctttcctgcagatgtcccagcctgcttaccgcagccatggaagaagcctctatagtgagagaagctacagagccctggaaagctggggccccacaggcagatgcagttaaggttaagatagaaggggtttgggagtgtcttattgaagataaaattgttactgttttgaggcagttttgagaggttttaaaataaccagctagatgtacattaaa

SEQ ID NO: 270521 - DNA, 468 bp, Homo sapiens
tccctaaatgctgggattacaggtgtgagccaccaggcccgcctctagattcttatctattatgttgctgcaaaagtaattgtggttgatggcaaaaactgcttttgcaccaaccctaatagttaggtccagggaccagggcttgtggccaccagagttccacctaaaatgagcaaacatttgcttaactgggtgtgttgtcatagatgctgtgctgctgggagcaccagctgccagatgggaggggtgaagggcagggagcccagagcccagcatggagtctccacatcagcccaggacccgcacgcactgccactgctagccgtggccacgacagttccctgtgcctcagagcctcattttcttcatctgcgaggtgcagatagtgcacccctatgaagctgtggtgaggctgagattaattagggatcgtgtgtgggaatgctcctgaaactcccagcaagtctg

SEQ ID NO: 270522 - DNA, 420 bp, Homo sapiens
gcagtgagaataatagatgtattttggttttaacttaagcagcacactgaagccggtatctatttggatggcaaatcaaggctatttaagtgcttagaaaacatggaaagagggaaatttacatagtcacctatgtggaaaagtagtatgtataaagtggaaggcaaagggaataagagaaatattttctttccatctggaactgagaggatacttataggatacagatatcaaaattttgccatgcatacacaaaagcttccagctagaaaatggcctactttctgggtatgtgtcaggcaggttcgtagattctagaccacttgaacatattgaacacacctgaagaagaaaggaaatgaagggaatctagtatcagtggaatctgatgtctgccaggcactctgctggatgctttgc

SEQ ID NO: 270523 - DNA, 429 bp, Homo sapiens
aagggttttttcctgtccaggagtatgatatgcaatgatggcttccacattgattgatatctgtgatttagtaacatcaccaaccttcttttggcatactgattgtagttcattgccacctgttctccacttatctcttgctgtgattcctattgttctgttcattctattactaaataaatctgtttcattttgtaaggctgtgttttggctcgtactacacaacaataagcccttggaaacttggctcttcacacttacttctgatatcattttaatggattttggcacacacaggaaaactacaggtagtccattttctaaaggattattttttcagaattgatgagaagatattaaaatcttagataaggttttttcttaaattaaagtttctttttgagctcttcaaaactgtaagatgatgag

SEQ ID NO: 270524 - DNA, 386 bp, Homo sapiens
gctgaggacccagatactgttcaggagtccttggtgccccaaagagcccaaaagtcaatgaataaacaaggtttccagagaacccaggaacaacggccacatccccgccgcccagcccgtaagcacccgtctgcgaggtcacaacagcatggaccaccagggagagggggactgtgggtgcctgagtatctggcagtacaaggtgctccccaatattcaagtgaagtgaccagccaggggccacaggaaaggcatcagaactcctcggggacacgagaagttcaggcagggtcagggcgcttcctggagacggcgccaagctggagcctgggacccaaggtggaggttcctgacagctgacccccccacctccctctccccctctc

SEQ ID NO: 270525 - DNA, 206 bp, Homo sapiens
gagtctggcatgccaggaagcgcttgcatgaggctgcctgaacttagccctaggctttgtgttgaacagcatgaaagacctgcccttctaaaggttatattctgatgtggttgaacagacagtaaattcacagcaagagaaaagggaggatttctgagagtgacgaatgctatggagtaaataaacaagataagtggtttcaaaga

SEQ ID NO: 270526 - DNA, 432 bp, Homo sapiens
tatcaaataaacctctaccctcaccaaaaaatgttagatttttttaaagaaaccatgattccatattccaccagtcagcctcactggcagacgcattagttcaggcctaaccaggagtgaggatgttcatggctggactgaaggaactgtcctgctagggaggtctgggccggccacttatgggtcagactttggaatttttggaagtagtaaaaggaggcttttgtctcccagaatagcaacagttatcatttaaaaccagtggcttctatatacagcaagtgcttctatatatacactcatgtattgtttatataggactattttaagatctgtgtcacatttttctggtgtattttatggtgggaaaattcaattggaaaaaatgtacttagatctggtggggatggtaaggtaaaataagtacttaaa

SEQ ID NO: 270527 - DNA, 462 bp, Homo sapiens
ggaagcacacaaagtcggaggtagtgcagccaacaccaacactacaactcataccagcctgagaccaggacagcctccactcacagccaacactcgctgaaacaggctgaaggacggggagggggtggaacttgagaccacagtcctggggacctgcagttgacactctcttgctgagaggtcttaggtgagagacattttatttgtaagcttctagatctgcaggtttcaagttgcccctcgcttagcatgaagccttcagaagcccagtggtaccatgggtgacagctttaggcatcttgtggtatggagatggagactgaggctgactcaaaacctggttatggacacggttggtggaacttgccatggccagaagactatccagtaatttcaatttgctcagcaatctacacaatggagtttgggttttttgtttttttttgttttttccagaatcag

SEQ ID NO: 270528 - DNA, 158 bp, Homo sapiens
tgacccattttaatctggataagggcagaaatggttcacactccattatttgtaaagttatctgctgttagctttcattatttttgctacactcattttatttgtatttaaaatgtttcaggcaacctaagaacaaatgtaaaagtaaagatgcagga

SEQ ID NO: 270529 - DNA, 547 bp, Homo sapiens
agagccccttctgggcctggagccagctctaaaaacataatcatatgaattattgaagatggtgagagtaaggcttgttcagtctagagagtttagacaataccttcacctctggaagaaccctgctaggtatgtgaggaactctagcagagggaaggggccccctggcagatgggtttccctccaggatgggcatttgcagttgcctggggctccttctactggccataccaaaacacttgccctggacagtgtcaaagaaggctgagtgttggtgggtgatcagcagcatctctttctgggggaatccagccccctgtctggaggcctttgcgtcacccacatcaccatagcaactggaacatactcagactgactcccagaccttgggattcagcctctctctctcctacttcctagattttcctcgctggacttaggttggtccttggttgcgctgatctcttagcactggtagccagatgccggtttctaaaatcccatggaactgtcttagggggctggccagtggtgaacctgagccatc

SEQ ID NO: 270530 - DNA, 219 bp, Homo sapiens
aaaacgcttagcaagtttgaagaaccgaaaagggcactgtgtctgagtgggtaggcagggcagaatgtcgcgctggtgaggcggggctggggcactgtagccgtaaggaacctggatgctgaacggaggggagagtcgctgaacaaatggtcaagggaggaaataaacggatgagcgtgtcgcctctcccgggcgcagccaggtggcttccccgacgct

SEQ ID NO: 270531 - DNA, 600 bp, Homo sapiens
aggcgtcagcttcagactcaagcaaaactggttttagaggaaaacaagttgttgctggagcagttggagattcagcaaaggaaagccaaggacagccaccaggagcgcctccaagaagtttctaagctgactaaacaactaatgctcctggaggcaaaaacccacggccaggaaaaggagctggcggagaacagggaacagctggagattttacgtgccaaatgccaagaactcaaaacacactcggatggcaaaatcgcagtggaagttcataaatcaattgtgaatgaattaaaaagccaaattacagaaggaagaagagacagaaagggctgagatggaggagttgatggagaagctgacagtcctgcaagcgcagaagaagagcctgctgttagagaagaacagtttgacagagcaaaacaaagcactggaagccgaacttgaacgagcacagaaaatcaataggaaatctcaaaagaaaattgaggtcctcaaaaagcaggtggaaaaagccatggggaaacgaaatgtctgctcatccagtacctggcaaacctgtgttggctggcagaaaaatatacccaggaacgtgacagt

SEQ ID NO: 270532 - DNA, 604 bp, Homo sapiens
tcaaaagatctttaaaaggtcatttttatcagctgactctcattagtatttcctaatagccaataattgtgttttgtgaggtcttctgtgccaagtttttatcctcctcttttgattttcagtttctaagctgactaaacaactaatgctcctggaggcaaaaacccacggccaggaaaaggagctggcggagaacagggaacagctggagattttacgtgccaaatgccaagaactcaaaacacactcggatggcaaaatcgcagtggaagttcataaatcaattgtgaatgaattaaaaagccaaattacagaaggaagaagagacagaaagggctgagatggaggagttgatggagaagctgacagtcctgcaagcgcagaagaagagcctgctgttagagaagaacagtttgacagagcaaaacaaagcactggaagccgaacttgaacgagcacagaaaatcaataggaaatctcaaaagaaaattgaggtcctcaaaaagcaggtggaaaaagccatggggaaacgaaatgtctgctcatccagtacctggcaaacctgtgttggctggcagaaaaatatacccaggaacgtgacagt

SEQ ID NO: 270533 - DNA, 669 bp, Homo sapiens
agcaactcacctggggacacagggtaaactgagtgaggcccagaacttagacccagctcattctcctttgtaagtagagttaggagtttaatgcttcatccactcaaacttaacacatacatgaacatgtttagtggcctcaaggcagctttgtgtctaaacctcttacgggcaggtttatcaattttgtgcaagtcagtggacagtcactgtgcccctgactttcatccctctctggagaccagttgcttccaagttggtaccaggcagggaataaacatgatcacatggttaagagtctggactttagagtctgatatggtttggctgtgtccccacccaaatctcatcttgaattgtaactcccacaattcccacatgtggtgggtggatccaggtgggaggtgattgaattatggggtgagtcttttctgtgctgttcttgtgatagtgaatgagtctcaggagatctgatggtttttaaaatgggagtttccctgcccaagttctctctctttgcctactgccatccatgtaagaggtgacttgctctcaagcaatcttcccacctccgcttcccaaagtgccgagattacaggcatgagccactgcgcctggcctatatatattttgcaaatacaatcatggcatttaaatttccattaattt

SEQ ID NO: 270534 - DNA, 1127 bp, Homo sapiens
atcattgggtgacatgtaaaaagaaagaatagcccttatatacacacaggtccaggacagcagagcaaaagtacctgcaggcaaccctatcctagaccccatcctacagggtctctagcccaggccttcctagggcccctaccgggagcactgccaggggcctagggccaactaggctggaagccttgccttttccctgtggaggcgcagaggctctggtttgtctgtcctggccccgggatcattttccagcacacagcacagtctagtccatccactctccccactccccaaattcaaggtcatcagggttctggtggcctggagatgggtacaacattctcatactcaggttcctcctgcctttcctcttcagcctgcttctggggatcctgttctggggagccacagccagagactggctcctgggctctccttgaactctcggtgccagcccccagcccccggggtatgagtggacatgtgacacagtgttggtggttgtagaagtgtatgactattactgtgttgctttggaagcttgatgccataacaaaagtgcagaattccatgtttgataactttctgacttgatgaaaatgaattgtggatacagatttcactatccatgaattgtggccttaactttctcatgtacttactttaaatcagagagcccacctgtccaattctagcttctcctgggcatcctgtatttgacacagcccctcccagcattctgagtcatcgtctgctgctcttgcactgtccgttttccaaatgaggaactcatcggtaaggccagaaaggaaagggagaaaaaacaaacaaacaaacaaacaaaaaataggaaaaaaagaaagagcgtatttatagatggtagagaattctgggcatgagaaacccagccaaacaagtggaatgtgtgcataggtgggactgctgatcttgttttatgaaagaaataaaggcaagtcaaacagatcctttcgcaaggatccccatgtgtgtatgtctaacccagtgacaggtaaggcagccaggagctgctgttatttcagtgcaaagctgttttcacaatcacagacatgcacagctcagaaaccctcacatggtcactcaatacc

SEQ ID NO: 270535 - DNA, 192 bp, Homo sapiens
ctgggacttcatcaaatttacacagaggttgtgtgtctgctttgtccctgcttgataataaatacattctttaaataactgtagcagaaaagctcacttgtgagaacatgacaggagtactttgacccatttccctctccatatcagaacttgtgatctgttcccatttaaagtgttcaaaactgccagatg

SEQ ID NO: 270536 - DNA, 424 bp, Homo sapiens
ctgtcctcctgctctttgctctgtgagaaagatccacctacaacctcgggtcctcagaccaaccagctccaggaacatctcaccaattttaaattggaagacaagaatgtcaggactctgagcccaagcctgcacatatacatccagatggcacgaagctactgaagaatcacaaaagaagtgaaaatggtcggttcctgccttaactgatgacattaccttgtgaaattccttctggctcagaagctcccccactgagcaccttgtgacccccgcccctgccctcaagagaacaaccccctttgactgtaattttccactacctacccaaatcctataaaactgccccagccctaacttcctttgctgactctctttttggacttagcccacctgcaattaaaaagctttattgctcacacaa

SEQ ID NO: 270537 - DNA, 430 bp, Homo sapiens
aacctttgcttttctaactttactttgtgagatacagcagggaatatgagacattttagcattctcctgggattacaatcactacatgtttgccagaatggatatcagaatggtagagacacatttctggtgacagaagccaacaagcccaatccactaatgcagcttggaagaactgtgacatatgactcatccttccgctaattgatcaaccatcatcaattatttctattatttgtataatcttaaagtgattgtgttttatgttgcatataattggtatgcagaccataaattactgaataaattagtaaaataaaaatattatcttatattattacttgaacattagggaatagttcagtaaactcagaaaatgtgaatattctaagtcctaaatcttacctgatgccataagtcagttaacatg

SEQ ID NO: 270538 - DNA, 358 bp, Homo sapiens
atcctcctctcaatgtcttaccagggtgcaatcagtgccagctgggctgtgttctcatctggaggcttaactatggaagattccatttccaagctccttcaggctgttggcagaaattatttccttgcagatgtatgactggggacccagcttgttcctggctgccagatggagcctgctcaacatcctagaagctacttgcaattccctgccacaagacccctcccacaggcagtttgcaacatggtggtttgcttcttcaaggccagcaagaaaatctctttagtctaccaagaaggagtcttatacaataaaacaatcatgggagtggcattcccatcactagtgccatattcta

SEQ ID NO: 270539 - DNA, 356 bp, Homo sapiens
gccactggataaattgcacagcacgccggcctgaaaaagcggaagtgagagatgcttttccccacttctgaatctaccagatgctggggttctcaaccatgctccactcatgacttcctttttataaaatgtattttgtgtaattacagtaatttttgaacattttaggcagatttattgaggtattgacatataataaactgcctagagattacaatttgataatatctgagccttagtatacagctgaaatcattatcacaatcaagatagtgaagaaagccatcctcccaaaaaatttccttgttgccccttggtgatcctgcttcctgccctttctacttccctctcacccc

SEQ ID NO: 270540 - DNA, 670 bp, Homo sapiens
agtttagaatcttaagtaggcttatagctgttcttcaagacctgtcaatttcctgagtgttcccctcaataattctttaatttttatacccactgttattggtcccaccctcttccttcagatttcaataatcaaatatagttatttgcttctgaaataaagaaggtcaattcccagcgtgagtgcctggtttatttatactatataacactagttagtggatcttgtatttctacttatttcccaagacttttagattttcccttctgtctcctggaccacacctgctactttatatacattttagacaggtgaactgagatttggaggagtgaaatgagttgcccaagatcatggagctaggaaatgatataattagttttatatgtcctcaaagcctatgtgtgctttttttttttaattaactgcagcacactgctaacctcataagcactaggcctaagctgctgtcttaaattatgtactaatgtcccttatgttgaattcatttctcatttccaaatggatggtgaggaggaagtaggctttaggatataaattttttctttttagtcaattttgttgaaaggaatttgtttatgtatttagtgatagccatatgatggtcactaaattttgttttttaaatatagtttgacagagaaaaagg

SEQ ID NO: 270541 - DNA, 315 bp, Homo sapiens
ggaggcactgtgaggaagggatggagccggaagtaggaagtagaacaagattctacttatgggtggatgagatggccccagaaagaagagcagggaaggcaacatagaacaggaaatggaccaggccccacgggagactggacagtttccacatttgctgtagttctaggcagagccagtcttctaagaagcaaagaatcactgaatggtaaagatacttggagggcctctctaccttcccacccaaaataccttcccaccgatccctgatgcatgaaatcacaccattaaagagtggttcctttgactgtgaaa

SEQ ID NO: 270542 - DNA, 655 bp, Homo sapiens
  misc_feature (1)..(1): n is a, c, g, or t
  misc_feature (15)..(15): n is a, c, g, or t
  misc_feature (23)..(23): n is a, c, g, or t
  misc_feature (64)..(64): n is a, c, g, or t
ntttagcaggcttcnctttttgnttggaactcattcggtcctgctgtcctgtgaagaagtgccngcttctcctttgtcttccaccatgatttaagtttcctgaggcatctccagcaatgtggaatggtaagctaatcttgccatctctttgtcctttgcctacgagaatgtttggagtctctcaaattgaatccagttacttcgtagcaggtccagccttgtcaatgccaataaacatggtccaacaaaaaggaaataagtaacacggtcagtctaaagaagaaaactggcaggtctgccatgcattttatgctgaccactgcgcttctactaatttagactaaagtcacatgaactacttcggcatttacgtcaaaatgttaagtcattgatgtttgtgtcaactgaagtccataagaatttttgttttaatataatctgctgttacggccatttggttctttgaaattaatttcatggctttcacttgcagttattagaggtcacttgtcagatgtggtctatttttctagtctgtcaaaatcatctttgtgtcacaattttgttctctaatgtttcatgttaacaaaaatatatctatatgctatctacatgctaaaattaagccaatgataaatatattcaattaaccaag

SEQ ID NO: 270543 - DNA, 365 bp, Homo sapiens
acatttaaaaatattttacttatcacttcatacagaattttttttttcgttttcaaattctagagtatctttgtgttttattttcttagaatatttttctgacttttctggatgttagcataactgataaggttatttcctacattttgagttagtgtttttacatccaatgcaattaaagatctaaacatttcttttctttccttattttgagaccagcctgggaaaacacattgagaccctatctctacaaaaaatgggaaaattggctgggtgtggttgcatgtgcctgtcctcctagctgctctggaggctgaggcaggaggatggcttgatcccaggcatttgaggctgcagtgaaccat

SEQ ID NO: 270544 - DNA, 250 bp, Homo sapiens
gcaagtgatgagtgtgactttggaccacctccttgaagatgcagctgcttcccaggacttctttcccacttcccacaggctggagagtgggcacccaggctttagtcacaaccaccaagatgaccctgtggggaggtgacagggagagaagatggacctcttggagaggagcagccacttctccagctatggactgctgacataagtactatttagagagaggaaaataaactatcccgtgtaagtcagc

SEQ ID NO: 270545 - DNA, 404 bp, Homo sapiens
aaacatacattggagtcttagcttacagaagaagtaaaagtaaaaattgcagcataaagaaaggaaatgacattcagcatacatttcggaaactgaaagatattttgataaaaacaagaagaagcaaataaatgagtttaataccaatgtaagaagctggaaaaggaccaaatggccaggcatggtggttcatacctgaaatcccagcattatgggagcctgaagtgggaagatacgtgggaccaggagttcaagaccagcctgggcaagagagtgagacactgtctctagtacaaaaattagccaagtgtggtggtgcttgcttgtagtcccagctacttgggaggctgaggcaggagaatcacttggaatagcctgggtaacagagcaaggccccatctctt

SEQ ID NO: 270546 - DNA, 338 bp, Homo sapiens
gctcaggaaaactcacccaagtgaggagttcatatataagtaataaactcatcttgagggtgtggcagtatttaaattacatgagcagtgctaaagaggttggtggattttgtttttaggttgtaaaattaaaacactgtatgaaagtacagaacttgagattgtgggaaatcttgtcagcctaacgttcttacatatctgagttgtttcactagtgaatatactgttgtcagggttcatttgcatacactgttgggttttttttttttaattgatagctttatctttttattctctggtacagagagcatcactccatatcctgaaaactagcgctg

SEQ ID NO: 270547 - DNA, 475 bp, Homo sapiens
cagtccctgcctctggatatcattctctgggatgtgcagtaggtctttcctttcaggaattggatgaaacaaggtgaagtggcttaatgacagaagttatcaagattgtcctactaactccccttgctctgattccatgcttaagagcgatcttatgatttgggccttccatgtagatatgtatactggatgaaaatgtattgatatgcctatcttgagtactttatcattttcccctctgtgttgttaatgctttattagttcccttctggttttagactaaatgtgaaccctttagcagtataacactatgagctcatagaatattaaaattagagggatcttgacagtggctgattacaaacatggtcaaatgtgaatatcgttgaggttaattacaaatcctagtattaacggtttattaatatcacagcatcttatattaactgaataaaagcaaccagacaatcaaaaa

SEQ ID NO: 270548 - DNA, 409 bp, Homo sapiens
gctccaccataaaatatgtaagtacaagatccctggactccttgaagagattatcacgttgtaaatatcagttacaggattatctaaatgaagagcttcagagtttcaattttttttgatagaataattgtaagtagactttgtatccagaatgtcagtagattttaaaatctaccttaaaatttaatgcaaatagaaataatttaatatttataataggtgtttgtgaatcttaatttccccaacagaatagtcttagaactttcagctaataataagtatgtctcacattaacaaaacttgatatttgctaaatgatttctattgttaagtgacaaaaggatgaaaaacatggttcttgtaaaaagggacttccctgtctctaaaggaaccattgggttaaaagaac

SEQ ID NO: 270549 - DNA, 453 bp, Homo sapiens
ttttgtttccaataatttctaatgtatagagccctattaactcctattactggttgcaggcaggcattacacaaatgaaatgacctcatccagtttcttttctgaagagttccatcactttgttcctagtctgtttttttctgcagccatcttacacagcatggtgatctcttatgtcataaatagtcccatagagattattagaagaaatgagtggtaataagaataaagttgagttttaaaagatgaaagaaaaatgtatatgaccaggaaaacttgagctttgactaacaagtaaaagaaaatacctggctgggcgcggtggtcacgcctgtaatcccagcactgaggtgggagtgtcccttgagcctaggagttggaggctacagtgagctatgatcacaccactgtactccagcctagatgacagagcaagaccatctcttaaaaaaa

SEQ ID NO: 270550 - DNA, 348 bp, Homo sapiens
gctgcagccaccactgccatttcaaaggtgagaaggaactgtctgtgtggacctctcatcccgcacagtgagggaggcgggagctgggtggtgcagggaattaggaaaggcaaacctgggacctgctgtgccctgcagtgcagtttccagaggaaagcagcccggggtggcagacatttgcatttggatgttagaaatgctcttcctggctgggcacggtggctcacacctgtaatcccagcactttgggaggccgaggtggacagatcacgaagtcaggagatggagaccatcctggctaacacgttgaaatcccgtctctactaaaaatacaaaaaattagccagg

SEQ ID NO: 270551 - DNA, 240 bp, Homo sapiens
ccctgggaatggaatgtctcagtgtaaagccgaccattcccattcgttctattctaagataggagaaaaccgctctgtggctagaggcaagatatgctggcagcaatactgctctgttactctttgctacactgagatgtttgtgtaacgtgaaacaaatctggcctacgtgcacatctgggcatagtacctttccttgaacttattcatgataaagattcctttgctcacatgtttccc

SEQ ID NO: 270552 - DNA, 404 bp, Homo sapiens
tgctcttctctgctagactctgtgcctcagaaggtggaatttttcataaactattccagctggggtctcatgccagttggttttgaccaatgggtaacaccatcagtagattggaggatggaaaaggaaaaaaggttaggatatgtttcaccacctcttttcctgcttctggctgggttctgatggtggctttgtcccttgaaggctcctcctgcaaggcagccctgctccactgtgccagccttcactgggctctactaacgtgattccctccccttatttcttcaggcctagctgtgctaactcctaggtacctccatgtttcttgtttcctttcatccaaccctaaccctaacttctataaatagttcccgcaataaagtctcttcagctgaaacatctga

SEQ ID NO: 270553 - DNA, 438 bp, Homo sapiens
acatcttagggtcttgaaaaaagaatcgacccctggaacgtcttaatatcttccatcttgaagccagcacttaaggagcgggaccctctgggcccacctccttccagccccaacttctaagaccccagtgaacctggcacctgaagctatagcaggagacagaagtcagtgctccttgtggtttcgatgggcctgggaaccaccaccttccctgcccagtggccacacaggccctgagtccgcctggattccgcaagttgtttagaaccgaagaaccgcacagatccgcttgctcggtgccttctctacgtgtgctcttgcttctgccttcggtcccccaggcctttggaaagacacaggcttatggtagagctcaagctcaacctgtcaacccagtgatcatggcgattaaaaactatctggtcacagcaagacctg

SEQ ID NO: 270554 - DNA, 88 bp, Homo sapiens
tcttcctcggcgctgcctacggaggtggcagccatctcctcctcggcatcatggccgccctcagaccccttgtgaagcccaagatcgt

SEQ ID NO: 270555 - DNA, 502 bp, Homo sapiens
gaggattcgaataatcagggagtgcttgagtgtgttgggggaacgagagatttggacagaattgtgatgtggaatttgaggtggcctttggagaaggtatacaatttagctgtatctcctcaaggagagagagaatcaaaactttgaaacattaggatgagataaaaaaaatcagggagagtggtttcaatagtaattaaagagtcattaaaaagtgtttgaggctgggtacggtggctcatgcctgtaatcccagcacttcgggaggccgaggcgggtggatcagctgaggtcaggagtttgagaccagccttactaacatggcgaaaccctgtctctacaaaaaatacaaaaattagccgggcgtgatggcaggtgcttgtattcccagctactcgggaggctgaggcaggagaatcgcttgaacccggcaggcggaggttgcagtgagccaagactgagccattgcactccagcctgggcgacaggagcaaaactcctc

SEQ ID NO: 270556 - DNA, 559 bp, Homo sapiens
cagaagatacctgttacgattatggctagtggcaacagattatttcaacactgtcttctttatcatttgttgcatatattccacaatgtgtcaatactgagaaaaacacaagcattttaaaatcagaaaataataaacattttccaagtgcattttatgattgcaatacttctgcctacaggtttgggctggagggaatttatgaagcgacgaagtctgttatgggagactgcagcatggtgcctgattttcctttgctttccaaagtgggtcttttcaccattaactttaaaaacacacacagagaaaaagacctcagaggaataagaaatcaaaacttaaactatgagccaagggtccatcttctttcttttgcacccttttggtaccagaagctccaagggcagccaaggaatctggcctgacctgtactttctcatggaaggtctgcactcggttctggacaaacaagtccccaacaggaagtgaaagcccacatccgttgtctttcttgattttatgcagcacgtgcaagacacactccaggaggctggtctct

SEQ ID NO: 270557 - DNA, 168 bp, Homo sapiens
cacagttggaaagagaacaggctctgttatcagactgcttgcactttggatgttagctctgtttcctaatttccttatctgtaaattgaaactgttaataacatctatgttctaaagttgctgggtgagttgaataaaatgaatatatttaaagtgcttagagaagca

SEQ ID NO: 270558 - DNA, 421 bp, Homo sapiens
aaggacggtgtctccattcctggggtgtagcactgggtgggatgggccttccaggaagcagaattgtgacaaaatatacgttcagttttagacaagttgaatttgacaggtgtttggggcagccaagttaatatacgtggctgccagtttgactgaaattaaccaataagcacaagaatttggacagaaatccaagccctctgactccaaataattaatgggtatactttagagcccttgaatctagacaatgcttttgtatttgtctacccttgaaagagtactagaaactgtatgcatattccagcagagggcaatattcaactaaagtggaaacattcaattagtttttgtccattcatgagtctggaggagactcaactgaaagaacaaaacattttgagcataagagcttcctctt

SEQ ID NO: 270559 - DNA, 661 bp, Homo sapiens
atctaaagttctgttgccgcctttaaaaaattttacaattgttaaaaagtctgggttgtgttttttgtttgtttttattttattaaatgcctcttgagtcataagaactgtgttgtttatctgtggaaaagacaggttcaattattttctgaaatattccccacattctggattttcctgattgcattcccatcgcgtcatttgaaatattcttctgcccctatatttcctgtaaattggtaactgggaatacagatttgattagatgcaggctttattttttgacatgaaaataatatacatagatggtgttgtaaattgcatctcatcacgtggcacacaatgtctgtttctctttttgtgttattaaaattgatccttgggtccagatgttgtcagcttgatctgttgtaaagtttcacatcagcttttttcctaatgattttaatagccattgataattattgcctgggtgtaatatagatgttacatgcagaatttagaagcttctgaatttggaaaagctcacctatttccaccttctcactcctgatttgttctggcatcttgaccatttattgtctctttcttaatctttaatagacttctaattcttgaatgaactattctccagctatgttacatggaacacaacgctgtc

SEQ ID NO: 270560 - DNA, 350 bp, Homo sapiens
taatcagtttcttaatacagaaaaggtgcataatcatttgtaccacacagggctgtgataaaaagtaaatgctatagatgtgtgttttgtaaacaccaaagtgttacataaatataagacacctctatgaccagttccttttgttacatactttattttttattaaatatttccgtctaaagcaatttcgtggaaatgaaagtctggttcagaatctctgaacggctgaaaattgtagactcacttttatagttcatgttcttttgtttatttgatcctaccaactcacaagattaaaaaaaaaaggtacagttccacaccaaataaaaaagtgtactcaagtctctcta

SEQ ID NO: 270561 - DNA, 410 bp, Homo sapiens
taaattttgccctcaaaaagctcttaatgtaagaagaaaagtatagtagcccccttatctacaatttcacttacagtggtttcagttacccatggtcaaccatggtccaaaaatagctgaggacagtacagtaagatactttgatagacagagtgggagagaccacattcacataacttttattgcagtatattgttgtatttgttctaccttattgttagctatttttgttaatttcttactgtgcctaatttataaattaaactttatcataggtgtgtatatatgggaaaaatgtataaataggatttagtactattgatggtttcaggcattccctggggttcttggaacataccccctgggggaataagcagggactactatatatgatattttaactttaatat

SEQ ID NO: 270562 - DNA, 398 bp, Homo sapiens
ggaagagagttgcagagatccccaagagtcagagcagtaaagcccaggtccagaggagagattcggaggcctgaattctaagacagaagcagattctagaaggggctgagaagcccatcaggctctgcagcagagccggctcaaacctctaaccctgcgtgggagcaagacagcgtgtcccacaagtgtccagctgtggttatccctcagtcatgtaaggaaatctgttccccattaagtgcatctgtttctgcacttcttggttctgttgtctttccctttcatttttcagcaaagttttgggattaaaaaaaaattccatcctatcctttttcccccctaattcattccatctacaaatattttgtatgtatctcagaaagataaagacttttaaa

SEQ ID NO: 270563 - DNA, 489 bp, Homo sapiens
ttaaaatgagggtcaccagcctgggtcctagggtaaacgtttaattctgacatcagagtttctgtttgaaggaagtagcatatgaaaattttcttttttaaaaaattcagttaaataaatgtattaatttagtatggagaggttttggatggtttagcaagatataccacaaataccaattaagatacacaatatttaaagcaatgtccaagaacaattttccaaaacataagcccttagctcttcaaagtagaggtttttttttctccactctgtaatgtcttacatggggataatgtaaagaaaaaaggagactccttggttttgctgtggggtgaaacagagctaggagctggccaggcagacatgttctctgtgatttgcatgttatcaggaagcctctggcttgctgaaattcttcattagaaactccaactccaatttgatacatttcagacgtcacaattttcactaataaagagattgaag

SEQ ID NO: 270564 - DNA, 440 bp, Homo sapiens
agttccttaatgtctctgagtcctgatcttttcatctctaaacttgggaccacgtccgatcttttgaggaggctttccaaagtggaggctttggttgcccccgtcctaatgctctggcagtggggtgatgttgaggtttgtaggaataaggttgtagatgcctggctctgctgaggttcagcctgtcagatatttaggttacaggctctagacctgcacagtccagtacagccactgacagccacacgtggctactgagcttttaatatgtggctggtcccaattgagacgtgccgtgagtgtaaaatgcaccctggatttcaagacttagtatgaaaagaatgtaaaatacctcgttactaattttatattggttatatgttaaagtgataagattttagatctgttgggttaaataaaatatactattaacattaaaa

SEQ ID NO: 270565 - DNA, 482 bp, Homo sapiens
caacattgctccaccctgggtctgtagctccacgaccctcagactagaacaagacctctcctccctgggtcgccagcttcctgaccctcgaattacaacaaaattgctcctccctgggtctgcagctccacgaccctcacactagaacaagacctctcctccctgggtcgccagcttcctgaccctcgaactacaacaaaattgctcctccctgggtcggcagctccacgaccctcaaactcgaacaagacttctcctccccgggttgccagctaccagaccctcgaacttacaacaacattgctcctccctgggtctgcagctccacgaccctcagactagtacaagacctctccctgggtcgccagcttcctgaccgtcgaactacaacaaaattgctcctccctgggtctgcagctccacgaccctcacactagaacaagacctctcctccctgggtcgccagcttcctgaccctcgaa

SEQ ID NO: 270566 - DNA, 475 bp, Homo sapiens
ctgcagctccatgaccctcaaactacaacagcaacacaggctcctccctgaatctccagctcaacaactctcagacttgagaggcagaaacgtctcctccctaagtctccagctccaacaccctcagatctgagcagcggcagcaccagctcctttctgggtcttctgtttcacgatccttaaattagaacagcagcaccatcttctccctgggtctccagctccacgaaactcaagctagaatagcagcaccggctcctctgggatcttcagctccacgaccctaagacatcagtggcagcaccggctcctcccctggactccagctccaggaccctcaaacttgaacagaaacaccagctcctccccaggcctccagctccttgaccctcataaacaatcccttctcatgaaatgtagcagtcaggaaaactgtagaggaagtaaataaataaatgttttcctttcaaattga

SEQ ID NO: 270567 - DNA, 360 bp, Homo sapiens
aatctaattccactgtgaactatgctgacatccatcaaggcctttacctcctacctcttggtttgaaatgggtctccaagacttccaccatccacaactgatccagaaatggctctggcagtacccaagggttccttgaaggcaggtctgggtctggttctccggatcccaacaccacgaggtactttattttaaaaggattaaaaaagccactgcttgtcaaatcttgaactaaaggactaacaccaattctcataacatccttaagccggccatgtgaaatgggtgctgtaattaccatcctaatcttaagggcatggaaaataaagcacagagggtaaatcctatggctaatcagga

SEQ ID NO: 270568 - DNA, 496 bp, Homo sapiens
tgcaatggagcctttgttattttcttgattccctgaagagttctagattccctgaagagttgagtctaagtgattgatttatatacaaaattgattttgcctttttacgttattttgggatcttatagcataaaataaaacttactaataggcatattaagcaaaatgttttttgtttctttcaattttgtgccttttattacttttcctatcaactttatagacgttgaaagggaagacatctgttttcattgagagaagatcttttaaaaaacgagctatttcagagttcctattataatagggttctacctattgtaaataaaagaagttaatctgggccagatgaggtattaaaaataacagataactatgtgaatacactaaaatctattgagttgcatactttaaatgggtgctttgtatggtatgtgaaatatatctcaacaaagctgcaaaagaaaaaatacataaataggtaaaatggaaaaaaaaa

SEQ ID NO: 270569 - DNA, 392 bp, Homo sapiens
tggaattacaagtgtgagcctctgcacctgataagaatattgatagttcatacagcaggacataaagtcatttttattttatttcacatatttttaaaaagagtttgaccaggccgggtacggtggctcacgcctgtaatcccagcactttgggaagccaaggtgggaggatcacttgaggtcaggagttcaagaccagccttgccaacatagcaaaaccctgtctctactaaaatacaaaattcagctgggcgtggtggcatgtgcctgtaatcccagctactcgggaggctgaggcaggagaatcacttagacccggaatgcgaaggatgcagtgaaccaagatcacaccactgcacaccagcctgggcaacagagcaagactccatctc

SEQ ID NO: 270570 - DNA, 404 bp, Homo sapiens
cgtgtttctctgtcagagcactggttacataggtggttcaagtttataaaattcaccaagctgtaccttgagggcattacactaagtgaaatgagttcatcacagcaggaccaaatctgtatgattctattacatgaggtacccagagtagtcgaatccgtagagacagaaggtacaatggggattgccagggcctgggccaggggacaggggagtgggggatctgtgtttaatgagaatgaagcttcagcctgggaagatgaaaacgttttgagatgaatggtggtgtttgcacagcaatgtgaatgtacttgataccactgaactgtgcccccaaaatgattaaaataataaattttgtgttatgtataatttatcacaattaaaaaaattaacctgcgtat

SEQ ID NO: 270571 - DNA, 485 bp, Homo sapiens
gaaatccactaagaaaatcattcacatattggttcactcaacaagcatttattaaatatatattcactattctagactaatagcaagaccggggatcttgtttaggaagaagcagtccctgttctccagaatttgcaaaaccattaaaaaagcacctactttaagccattttttttcagcaaggagtcattctgccagaaaaatgtagtacacaaatacaggataatataacaaatgtaaaatttctcatttctagtgaattaaactttccagtaattttacatctcacctcattcttatgatgctcagtttgcttaattattggcaaacataatggtaaaatgtttgtactgtattagagctttactgttcgattattaagatatttatccagtatcttagagatgctggacttcaattttccttattttatctttttaaaataaaatatcatgcatgcttctgatttgttatagaaatatttt

SEQ ID NO: 270572 - DNA, 485 bp, Homo sapiens
cattttccggctatgtcactgaggattctctactatgattactttgatcaatttacccccaatcccctagaatatttccatatttcaactcaaccaggagtgtcctgaacatgatttcaatgaattctatgagggttgaccaactcttcgctacactatcaccaatgtagcaacaactaaactcaaattaaagaaaatatttaagccgggcagggtgactcacacctgtaatcccagcactttgggaggctgaggtgggtggatcacgaggtcaggagtttgagaccagcttggccaacatggtgaaaccccctctctagtaaaaacacaaaaattagccaggcgcagtggctcatgcctgtaatcccagctactcaggatgaggcaagagaattgcttgaacctgaaagatggaggttgtcatgagccgagatcaagccactgcactccagcatgggtgacagagtgagactctatctcaaaaa

SEQ ID NO: 270573 - DNA, 428 bp, Homo sapiens
tctcccgaaaatgagacgacgttaagcagtctgtgctaagctgtacaatgctgtacaagtttggaggaggaagtatcggagtagaccagacgacgaagaaaggcttcttaagagagagaggccttgaagagtctgaggattcagataagaaaacagggaacatgatggcactttaggcaggatgggaatatcgtaggtaaagacagaattaagaggccttaaggtaggagtaaaggttctatattggggaggaatggaattacagctgccagaatgagagtttgatttctttatacatgtcacaatgataagtacttataacagggaacctaccatgtgcctgccaggggctttcataaaaaataccaccaatcctcatgctatccttgtgaaacaggtgttattttagatgtacgaaaactgaggct

SEQ ID NO: 270574 - DNA, 308 bp, Homo sapiens
tcatgttttaatgtggtctgtgtactggtgccagacggtgaactttgccaccagcttttgatgggataaatacaaacagtgcctagggcagggcttgtggcagcagagatgatcagtaagaatctggcaggtgaagacaaccctagctttgagtccctctcggcctctactggccactcccagaagccggtgccatctaatgttatggaatgtctagcagtgcccttgcctttaaagatgtgaacatgtttccatgagagggaacctctatgactaataagacaaataaaagaataaccccttatgtt

SEQ ID NO: 270575 - DNA, 326 bp, Homo sapiens
tctcccgaaaatgagacgacgttaagcagtctgtgctaagctgtacaatgctgtacaagtttggaggaggaagtatcggagtagaccagacgacgaagaaaggcttcttaagagagagaggccttgaagagtctgaggattcaggcaggtgaagacaaccctagctttgagtccctctcggcctctactggccactcccagaagccggtgccatctaatgttatggaatgtctagcagtgcccttgcctttaaagatgtgaacatgtttccatgagagggaacctctatgactaataagacaaataaaagaataaccccttatgtt

SEQ ID NO: 270576 - DNA, 403 bp, Homo sapiens
ggcagctgtgcagttggcttgagtagttgagtattatgcacaaaatgcttagaatgataccttgcccatggtaagcttgcaaggagtattgtccagatgacaccataaaggaaattagagaggaggggtgctggtcactgtggctcatgcctgtaatcacagcactttaggaagccatagtggaggagcatctgaagccaggagttcttgagaccactgtcggcagcgtagtgagacctccatctctatatacaaagaatttttaataaattagcgaggtgtggtggtgggtgcctatagtcctagctactcaggaggattgcttgagtgcaggagtttgaggctgaagtgagctatgattgagccactgcactccagggtgacagagtgagacccaatctct

SEQ ID NO: 270577 - DNA, 333 bp, Homo sapiens
aagtcagaggtgttaaggaaaattatctaacacttgcaaataaggggaaaagatgactgaatatattttcagtgtcatgctaatgcagtgcttctccaagtatgggctgaaacactagggaatcccaaaaccctttcaggagctcggtaaggtcaaaactagttcttaataacaggaagatgttacttgcctttttcactatgttgacatttgcacactgatacaaaaccaacagtgggtaaaactgcttgtgccttggtacaaatcagggtagggcaggaaactttgctattagtcgttgtatacttcccctaccaccacctctcagcaaaa

SEQ ID NO: 270578 - DNA, 327 bp, Homo sapiens
tgttttcaaacaaactttgaaacaatgggtgccttggcaaaaaacgatggtgtgaccctcttcaataaatagtgtgggaaaattggatatccatatgtagaagaatgaaattggaccctcctctctccctatatacaaatatcaactcacaatggattcaagacttaaatgtaagacctgaaactgtaaaactaccagaataaaacataggggaaacacttcaaaacattggtctaggcaaagatttcattgctaagacctcaaaagcgtagacagctataacaaaaatagacaaatcggattatattaaactaaaaagttttggca

SEQ ID NO: 270579 - DNA, 139 bp, Homo sapiens
tcagcgcccactggtctacgttccagcctcctggagtccctctgagtgtgtctgtggctgcagctggacccagttttgaattcttttcaagtttcatttcaaatgggatttcagaataaaaacgactacaccctgccct

SEQ ID NO: 270580 - DNA, 453 bp, Homo sapiens
ttttttaataataatagatttcaaactcttgagatcaaaaccaaagaaaatgactgggcatggtggctcacgcctgtagtcccaacactttgtggggctgaggatctcttgagggcaggagtttgaaactagcctaggtcacatagtgagacctggtctctacaaaaaaaaccaaacaaacaaaagacacaaacaacagaaaaattggccaggtgtggtggcatccacctgtagtcctagctgctcaggaggctgaggcaggaggattgcttgagcccaagagtttgagactacagtgagctatgtgtgggccactgcattgcagcctggtgacagagcaagaccttgtctcttttaaaaaaagaaagaaaatgagatcatacaagtaccagctaggaaaaaaaaaagagtaaattgcttcccctcaacccagcccctgccaacaattgataa

SEQ ID NO: 270581 - DNA, 571 bp, Homo sapiens
gaggtactgagccctctgccttagtggatgacaacggtagtgaggaggacttcagctatgaagacctctgccaggccagccctcggtacctgcagcccggcggggagcagctggccatcaatgagctgatcagtgatggcaacgtggtctgcgcagaagccctgtgggaccatgtgaccatggatgaccaggaactgggcttcaaagccggggatgtcatccaggttctggaagcctccaacaaggactggtggtggggccgcagtgaagataaggaagcctggttccccgcgagcttcgtcagattgcgagtgaatcaggaagagctgtcggaaaactccagcagcacccccagtgaggagcaggacgaggaggccagccagagccgccacagacactgtgagaacaagcagcagatgcggaccaacgtcatccgggagatcatggacaccgagcgggtgtacatcaaacacctcagggacatctgtgagggctatatccgacagtgccgcaagcacacaggaatgttcaccgttgcgcagctagccactatttttggaaacattgaaga

SEQ ID NO: 270582 - DNA, 407 bp, Homo sapiens
cgcatatctgagctgcagagtgttcttatattcaaacacccatccctatggctcctctgggatactggagatgactgccggcaggataacaggtgtgggagccagggacaaggcgggaagagggcttgctactcagggaatagagtaccccattgatgctggtcactcttcctttcctaccagggatgctcaggcattccactccttcacagacagcaaccttgccctgagaaaagaaaggcttatgtgtgattattcactatggaaaataaggaggaaacagatcaggagaaacaggaaaaataaagtttcacttgctaaagtgaaactgcaaagaggcaccagcctgaaaggcaaaaccaaggcctagatagacaagacagcagcaggcccaaaatgcccactga

SEQ ID NO: 270583 - DNA, 458 bp, Homo sapiens
aaggcaacagaggccagaggaggttcagtgatgcacccagggccacataaccagtgaatgttggggatcagattagagtgcccacgtctccagcctccttctgccattgacaccatcacatcgaccatccgggcaagacccccgcaccgcccccaagggcgcaggcttgatttcactgccaagccaataatgtcagcaacagcacttatggtgctggaccataaatgaaacaagctttgagaactaactgccaccccagaggcctcagggaggaggtggctgccctcaaaggctcagtctcgtattctgtaacctctctaccctgaagaagatcccaccagctgcctcttcttccagatcctgccaagaattaggcatctcccaaccccactcctgggcctcttctccacattctccctgccaatcatcccctttaataaaaaacggtgaataatttt

SEQ ID NO: 270584 - DNA, 392 bp, Homo sapiens
tcccgcctataatcccagcactttgggaggatgaggtgggcagatcacttgagcccaggagttcgagaccagcctgggcaacatggtgaaaccctgtctttacaaaaaatacaaaaattagacgggcatggtggcaggcgcctgtaatcccagctactcatgaggctgaggtgggaggatcacctgtcacctgagcttgggaggttgaggctgcagtgagccgtgcttgtgccactgcactccagcctgggtgacagagtgagaccctgtatattaaaaagaaaagtatggagctagaagctagtctgtgaaaaagcctctcagtcctcagatgctcaaaacctaccgaggtcttctgttgcctaaagcttacataattttgggatcccttt

SEQ ID NO: 270585 - DNA, 654 bp, Homo sapiens
ccttcctgtgttgttcagtgggcagttacattgattgtggataggttttaaaaagcaaggccagttcttgtctgtgcatttgactttgtatgtgatatactgactctgtagcaaggaaacatactttcttggtcttcttcctttgaccgccagtcattatttgtcttcattgcaaattaagggcagttatttccaatccattccagaattacagaaaattgaaggctatggaatctgaaaccatagctgctgtggaataatcctgagctgctgccactgtgtgagttggagggcagtggaacagggtacatgatggggcctgatcaggtggtctccggataagtcaacccctattcattttttcctccatccctaaaacagaggccaaaccataattgtactcattggactaaagttctcaagaaggatcttgcttcattcatttttgtgtgtttggaacctagcacaaaacctgacacatatccacccgcctcagcaaatatttgatgaaaaatgttgaaagacggaatagattgatattcatatagatatatgcatcaattaattctgtattttctatatatatattctaattacaaagggttatatgttcattttagaaactatagatcatacataaaagtccaaaggaaa

SEQ ID NO: 270586 - DNA, 300 bp, Homo sapiens
ggcagagctggctgtctctgaaggttgggccttgggaaggacctgcatcacagggaggctgggctttcctgggagcggcagggcaggcttggtccagggcgggggacggggctgaccagcttccttcctgcacggggaccagtagctccgtcccacaatacatcgctgtgccctgagccaccagggaccccggtcacctgatctccgggagagcctgctcccctgtctacaccagtgtgcctgtgctggcggctcagaacaaagaggccatccccaccctgcctctctctcccactggct

SEQ ID NO: 270587 - DNA, 483 bp, Homo sapiens
gtcgggacgttcttagtaaatatttgtggaatatatgaatgcatgatgaacaaatgaatacatgaaattgcaacatctttaaagcacattagtctgagatgggtgaccaatcccggtggtgttctggcccattgcagtccccctggcctctgttaaagcttagagaatatgcatggtttttcttcaaagcttccttcaaattgagcccattattatgggacattccactcagtcactagtaattttctcagcacagcttgaaactcgcttctcctccagtaggtattttgctttcctttcactcctcagagctatttttctaaatgggattgcttttcacatgaactgtgtgtgtcctgcagtgtgtggggcctgctggggaagacttacggggagtggagattttccacagccccttacctggtgatgccaactctgtgttagttcctagtggcatcgtgacttagtcttcctacatttaaa

SEQ ID NO: 270588 - DNA, 599 bp, Homo sapiens
tacactcaagacaggtatctccagatttcttgtgggctatttttctcccccagccccagcctattagtagtattgtttacaaacctacattgccattaatacgtgtgcctgcatgctgctcaactgaaagtcacatgggtgataagagaaaaccagtctgaaagtctcttagcggttcttcaccttcccaccttcacgagagctttctggagttggcctccagacatttcaagatatattaaaggctagccaaccaaataacacatctggagcagagagctaaaactgtgaatcactagaaaaatctgcaggtggctggatgcggtggctcctgcctgtaatcccaacactttgggaggccaaggcaggcggatctcttcagttcaggagttgcagaccaacttgagcaacatggcaaaaccttgtctctaaaaaaaaaatacaaaaaattagccaggcatggtggcacatgcctgtagtcacagctacttgggaggcttaagtgggagggtcacctgaacctggggagtcaaggctgcagtgagccgtgattgcgccaatgcactctagcctgggcaacagagtgagactctgtctca

SEQ ID NO: 270589 - DNA, 418 bp, Homo sapiens
ctgtactttgcagagctggtcacagtaaaaatttgtttttaagtttaaaaatttaaaatactggactttcttccacctatcgtgggacagaatttgcatcagctaggttggaaagttttttaatagcctatagtagcagactgcaattggtagtgataaaatggagagtccatttgggaggccgaggcaggcggatcacgaggtcaggagatcgggaccatcctggctaacacggtgaaacccagtctttactaaaaatacaaaaaaattagctggacatggtggcacatgcctgtagtcccagctacttgggaggctgaggcaggagaatggcttgaacccaggaggcggagcttgcagtgagcagagatcgtgccactgcactccagcctgggtgacagagcgagactccatctca

SEQ ID NO: 270590 - DNA, 389 bp, Homo sapiens
aaaaaagaaagaaaaaagaaaagaaaagaagaagagactcccaagttattcaattttgtatgacttctgcccctaactaaacccaaagccagcagaagaaaagaaatgacaaagatcagacctgaactaaatgaattgaaacaaaaaaaatacaaacgataaatgaaattaaaagctggttctcagaaaacataaacaaaactgataggccattagcaagattaaccaagaaaagaagatccaaataatcgaaattagaaatgaaaccggagattttacaactgataccacagaaatacataatataattcaaggctactatgaacacctttacactcacaaactagaaaatctgaaggaaatgaataaaaccctcctacattaaatca

SEQ ID NO: 270591 - DNA, 529 bp, Homo sapiens
gtttgggaattaataaaacaaagtcatacaacacattttctttgtaattgagaactagataacatggtaacagagaattgattttcatatgaatcttaactccacagtaaaatagttgacatcataatatgaagagaaagaaaaggaaaaacagaaatgtaaaagttgtttaattcttggtttgcctaattcgttttcctatttcttttcatacaaataaaggatacctggatttatttaggttattaagactgccgttagtttgttttgttctagtgcacttcatattccatgttatctactgcatcaaaaaacccctctgattggagggtggtattttctgggtttaaaataatcacatgaaatgcagtgatcaatataagccagaatgagttcactaaaaacctttttgaaacaaggctgctaaattcaaagaacttccataggcttaaactgtctcaaatattttcaagatgtggtaattttgtttcttaatatatagttaggaaaattaaaaataatttgtgta

SEQ ID NO: 270592 - DNA, 388 bp, Homo sapiens
cagtagaaataatagactggaagccaaatcctcagtctacttctggctctcctaacatcatacttcctaccacctatatctgtggcaagtgatgctgagggtcaatatagtgtttaaagtcaactcgatttcctctttaattgacaaactcttgtgaaatttttaaattttactctcatgggaaacagtagtaaaggtcattatctgtgcactattttgacagtctcacccagccttcagtccctggttcatcctcctcccctccctctctttcaatctcttaaggcctcagctcttccagggaatcttctcagatctctgttttctctcttctttgggctctgataatcaaaccgtaatcccttcctgccagcagaagtgtgcaaaa

SEQ ID NO: 270593 - DNA, 178 bp, Homo sapiens
ttagtagagatgatgtcacattatgttgcccaaactcatagctggtcttgaactcctgcccccaagtgatcctcctgccttggcctcccaaagtgctaggattataggcatgagccattgcacctggccaatgctttctgaaattaccgtttcaataaactgctttttatccccatta

SEQ ID NO: 270594 - DNA, 347 bp, Homo sapiens
ctcgcaatcatttactcatttaacaaatatttattgagtacccccagtttgccagactcttgtagtctcagtgcttattaaacatctgtggaaatgaagtgaagttataagcctgtctttaagtccctggcaacacactcccttctctgcttagttactgctattttcaggtacttggaaacacatccgtgtcctcaggttcctagtgcctactggagcccacacagctaatatttctctttccccctctctgacccaagactcacgtcaatgttcctgcccagggctgattctaggttctaattgttatatggatgttgttcagaggcctctgaaatgcccctcag

SEQ ID NO: 270595 - DNA, 399 bp, Homo sapiens
gcagctattataatttataaatgtttgttttccctcttggattaatcccagagtgtcagggagaatgaactttaactaagcatgcactggtttactaggagggctggtggaattataaagagagcaagggcttgagaaactatcccatggattttgaatgctatttctgccactttacatcggacaatctcgggcaaattgcatattccttaaatctcagttttcttgaaagaaaacccaactctaaaatgagcaaaaaattttcacattttcccaaaaaagataaacaaatggccaaaaagcacataaaacatgttcaactttgactggtctttaggaaaatggaaataaaaccaaaataatatatcattttatatccattatgatggctactattaa

SEQ ID NO: 270596 - DNA, 197 bp, Homo sapiens
catgcctataaacccagctactgtagggggctgaggcatgaaaatggttttaactgggaggcagaggttgctgtgagctgagatcacacccctgcatactagcctgggcaacagaacaagactttgtctcaaaaaaataaaaataaagaggagtcctgaaacttgcttaaagtcaatttagtttatcaaacagctcc

SEQ ID NO: 270597 - DNA, 308 bp, Homo sapiens
tgagagatgagctctctatagagtgaaggcagagacgttctaggcaatgagaatagcacgtaaaggtatcataattttgttggcacaatttgtagcagagaaaagattagtaaggtagctgagtcttctgatgagaggccgtatactcaaaatataaggtataaagtacatacttcagacatttatattttattaaatggacagcagtaggccccagggggttttgagcaagtgacagctatgatcagaagggcacacatgggtaattaatttttcacaaaagtatctagttgtgctggagatgactc

SEQ ID NO: 270598 - DNA, 348 bp, Homo sapiens
taatatagctttatttacaaaaccaagcatcaggctgagtttgaccaagagcccggatttaccacctctgaattaggacataggaccctccgagggattttacaagccattctgaggaacattttgggtcttgtgctcaaggaaatggcttcttcaaggattccacaagataagttataccctcagttctttgctttacatggacaagagctttgacctccaaaactgggtgaaatgagacatttgcttttatttgtttttattttaagcagctcttcatatgtataatttccttttgccccattgagaagagtacattataatttccagagaattcaaactttcttt

SEQ ID NO: 270599 - DNA, 216 bp, Homo sapiens
tactccactatcttgctgatgttacatctacctaactctatttagtatttccatagtctctatatgtttagacagtatctattgactcttagatatgagcaatgcagatttagtgtattttttcttcttttcctcctattatctagcctacttacagcaatatcatattatttttcttactgcttatccttatatatttaataaatttaaacttaa

SEQ ID NO: 270600 - DNA, 545 bp, Homo sapiens
agttttgtatcttaagacagaagagaatggcctcttaatcctcactactgcccagcaaagaggaaatataatatattcgggctgatattgaggcccaagacttaaaaagatttaatattataccttttctttttaatttcctaactattgtctcacccccaccccatcctcttttctctggtttgtttctgatatagccactgaatagcatcgaagtggttataaataaactgatttggcatagtcattctaccactgactggtgaaacgttgagcctgacactttaggaagtgtaaatgatctcatggcagaaataaagattagacttggtttccaactgggcagagaagagattttgtgaggaaaagtgctgatattctttgtatgtttcagtacacaaaataactttatgacatctgtaagttagagccacttacttctagaggtaccttcttagttctaggagatttaactttgggattccttgtgccttgaattaaagtctttattttacaaaaagtagaatatgtaagagaggacagtc

SEQ ID NO: 270601 - DNA, 517 bp, Homo sapiens
cagagccaaaaagagcttagtaatcacctgtgtgtccctttgctgcgcaatgagggtgctgcggcagaggccgcacctcttagctgtgtcacctctggagctggaccgccctctctggcctgctgctggtggtgctcctgcgtgttgacgcttggacactttttgaacaacatttcttccataactgcagtggcccctgtgagtaaaatctccctgaggcaggttctatgccttctcttgtccattccccttgggcacccagtatgccctgagtgtccttgtgaccagagccactcctgttttgcagtaagggaagccaaacaaggagcagagtcaaggcaaacgttccagtgcgttctgtattgggattcttcccttcaggcacagaaattctcatttgcactccccatttgccctggtgggcatcccagctgtacctgagtatcaggtaaacctgccttggctacatcaagtccagggatatgatgaaccatctagaactaaccacattcaatta

SEQ ID NO: 270602 - DNA, 428 bp, Homo sapiens
cttccaggtactctctggagccctgggctcccatgtaagatgtttggctaccctgacgtcaccaagttgaagaaaccatgtggagagaccacaaagaaatagaaatagaaagagatacctgagtggtcccagtgattccatcactgagagttttggcctgtgcaccagaggtgtaagtcctgtaccagatatgtgaggaaatcttcaaagttacccatctgaaaagcaacctcctctgagaccccaaaccagaacagtccagccaagccgcccctgcatctggaaactgtgagagatgagaaataacgattgttgtttgaagtcactaagttttggggtgatttgttaggcaccaataggtaactaatgcacatacccatataacttgctgctggtagagtaaagtgctacatcctcaaagaagatta

SEQ ID NO: 270603 - DNA, 462 bp, Homo sapiens
aaaaaggaaaaaagttgtcatcggccttcctctccagtcccactggtatcagattttgagtccctaggaggatctgaaagttctgggcagcaaaaccagaagattccacagctgccgtctagccctgagaacctggtgtcagagatcccacctccccagcttggttatgcagtctctgatgagaacttgactttggggaagaaagctgagctacagcatttcccgggtatctggaaggtgctcaacagtgagatggtgctcttcctccaaatctgttgacatgacaggacagtgccgcttatgaatctctgacaaatagcaaagtggaaaattcctgctcttggcagctaaaacttggattgatcacaatatttcaggaaacagagaagaaagacagtatttcccagttagcaagatcttgagtcttatgatttttttctgacattaaatctgcagcataaa

SEQ ID NO: 270604 - DNA, 359 bp, Homo sapiens
aaaaaggaaaaaagttgtcatcggccttcctctccagtcccactggtatcagattttgagtccctaggaggatctgaaagttctgggcagcaaaaccagaagattccacagctgccgtctagccctgagaacctggtgtcagagatcccacctccccagcttggttatgcagtctctgatgagaacttgactttggggaagaaagctgagctacaggtaagcaacaacgcaggagaagatacaactgaggtcaacacagaccctttccctgagacttggcttgctattcagccttccttgtctcttgctctgccttcttcagaaacagatctaacccagggagcaaatcctcagttgga

SEQ ID NO: 270605 - DNA, 258 bp, Homo sapiens
ttctcactcggaaccttcttttgatgaaccagtgtgcagcataccaggatgagttggatttgggtgggatccacacagtcattttcaggcagatttgctgcaatggagctgagataagaagccttgattagagacaattaattcgaaattcagtatataaatattatctggaaagaaaggattagttgtctctaagcagtgcttaccacatgcccagcgtacaccatatatcagctattttttttttttttttttttt

SEQ ID NO: 270606 - DNA, 561 bp, Homo sapiens
aggccatggcccctcttgactccacctcctgggggcccagggttggatgggaagctgaatctggccacactcgttctggaactcccttacctctgtatctttgcccctgctaggcgttgcccacccgtgagtctacacttcctctgagaatctcagtgtgtctgaggcctggtggcactttgggaccctccagggtgggcacacagcagaactcagcattggtctttggtgcccgacatgcttagaaaatagtgactggaggaatcttctctccctccctaccttttaggtctctccccacctgcagcacagccaggcagcggctggcagtggtgatggtctttgcgtggggtcaggcaggtatgatgccccactctgctgcttggcggctggtaggccttgggagttctgccttatctctgcagctcagctttctttcctatcaatagtaacacccacttcactggattattgggaagattaaatgagatccactaagcagtgcttaccacatgcccagcgtacaccatatatcagctattttttttttttttttttttt

SEQ ID NO: 270607 - DNA, 398 bp, Homo sapiens
aggccatggcccctcttgactccacctcctgggggcccagggttggatgggaagctgaatctggccacactcgttctggaactcccttacctctgtatctttgcccctgctaggcgttgcccacccgtctctccccacctgcagcacagccaggcagcggctggcagtggtgatggtctttgcgtggggtcaggcaggtatgatgccccactctgctgcttggcggctggtaggccttgggagttctgccttatctctgcagctcagctttctttcctatcaatagtaacacccacttcactggattattgggaagattaaatgagatccactaagcagtgcttaccacatgcccagcgtacaccatatatcagctattttttttttttttttttttt

SEQ ID NO: 270608 - DNA, 419 bp, Homo sapiens
tttaaattccgcaatataacatcagtgttccaatgtgaaacttcgaagctgtccctttcagatttagcatgtgctcccatcctcctacctgtaaccgtcatcacctctcccaagtaccttaggtcttgtatattttgtgttattattattattaagacagagtcagaccatgtctcaaaaaaaaaaaaaaaaaaaaaaagaaaaaaaaaagtttctagcagaagcaaatgcatatcatgaagtttcataatatgaggacctgctatgggtccttttaatacttataagagaccatattgaaaaccatttgtacagtgtcttcagaatgaggcctctacataactctggaagctatgggacaagtagctttacccaaaacagcttgggcgacagagtcagaccatgtctcaaaaaaaaaa

SEQ ID NO: 270609 - DNA, 575 bp, Homo sapiens
ctctgtgaagcaggcacatcggtgtgtgctgtggagctcaggagtgccccttgaatctactggcgcttgagggtaggggtttacggctccaactgcccgacgaactaaatccttaaccaaatccttccccccagcaagcatgaggggagcgctcggaaaaaaagctccttccagctttaagctgtgtggccgcaggcgactcgcggaacctctcccggggcccggcacacagtaggtgctctataattactaccgactgagtggatggatgaatggaccaacacggaacggagctccagttcttttcacaaaacagaatgaggggcctgggttagattcatcccagaggttccttcgcgtttaagcgtccatgcggtagctttagccaacttcccctctcagaacctctctccctttctgtagaagaggagccgggactggacccgggcgatcccttccgagtctcacggaccacgccggccagccccgaccgagtcgccccagctctgggaacctcttgcatgatgaggtgggggaggggccgcgccgtggctctccccagcctggcggccgct

SEQ ID NO: 270610 - DNA, 470 bp, Homo sapiens
tgtggagggagatacaactggtaagtgaaatttagccaaggatacctatgaattttggtcatgtatagaatacgtgtaatttttgcctccatatatcttaaggtaagggagtcattttgatacgtgaatggtattttttgtcaaaatatgaattttgatatttagatccttatctaaaagtaattgcataatttatcgagaatattttattgaatccttgatttaaagcttaatattttaaaaaggtattttataaataggtgctaaagtacacattctgcaggagttgtatcataaaaatgacactcatgctgggcgtggtatcatgagcctgtagtcccagctatgcaggaggctgaggtgggaggattgcttgagcccagaaattcaaggctgcagtgagctatgatttcgcctttgtctagccactgcactccagcctgggcaacagagggagaccctgtctctat

SEQ ID NO: 270611 - DNA, 456 bp, Homo sapiens
atacaacactatcaaatgactcctagggatttccacatcagcctaaactaatatgtgccacgagtaatagtatgctttagtcctacttacaaatggcatttcatctaaggacacacaaagcagtacacttgggaaatataaattatagacatgtaagacacggaatgactgactgaactttacaagagaaagaagaaaactggctaggcacagtggctcatacctctcatcccagcactttgggaagctgaggcaggtagattgcttgagctcaggagttcaagaccagcctgaacaacatggcaaaaccctgcctctacaaaaaatacaaaaattagccaggcatggtggtatgcctgtagtcccagaaggtggagggtgcagtgagccgagattgcaccactgcactccagcctgggtgacagagcaagaccctgtctcgtaaaaaaaaaaaaa

SEQ ID NO: 270612 - DNA, 831 bp, Homo sapiens
aaagaatggacctggttgtccatgaaactctgccactaattagtttccccactccctttctagttcacagctctgaattcttgtggcgtgccagggactgaacaagtcagacatggcctctgctctcatggaacttaaagtctagcagggaagacataatgaactgtaatgacaagagtgatgaactttcctgaaggggaagttcaggccactgtgaggctctgacagagggatttcacctgtcctcaggaattagggaaggctttcctggggagtgacatttgaatgtgaagatagaaagataagtagatgttaattaagggaaggaggattttatgtcccccagccacacccatctgtgccatatcaggctttggagagatgagaaaaaccagataggggtagaagcaaagttggaacattgtttttatcattaaaacaaagatgacagaatcaaaaccattcaaattgtgttgccccaaacccctgcgcctggtcctggggtcagccttaagggaaccaggacccagcagtaaggggtatgtggagaagggattgtgaagattttatacagtttaagggaatcaagaagcttgttgggtaaaggagttccttcttggcccccatgcctttgcttatgcctttttgcctctccctagaacacacagtcatattcctccctcttgaaaactctatttgaagcatgggctctggagtcagacgtccacgttgattcctggcgccaccctttaccacctgtttcacttgagcaggttgcttaagctctctgtgctgctgtttcctcatctataaagtggtgataataatagt

SEQ ID NO: 270613 - DNA, 976 bp, Homo sapiens
tagctttctcctttatctatcagtctcttaacgagtttggtaggaactaggtcacaggacctttaataaatactccctggtaaattatgaaaggttgaatttctgaccctgcaaaatgaaagaccagagctttaatagtgagtgcactaagttggacttccctttgtgttaatttggaccctcggttagacatgcaggagagttggagagtttgtgggggatgtagtaggggagggtcgaggagtctgggaaagctgtcagactatgatacagatctaacctctggagaagaaataggaaggaggggtgggtaggaaaagtcttgtgcagttctaagatggtttcagctagaccaaagtgagttgagccagagtcacctgtcagaggagccctgctacatcagccatcataagcagttcatgctattgcctcttggcctccatctcagccatcgtggctgctgtgctcatgtgcccattatgccattgctgtggtagccagtgacaaaggcctgtgaaccgggttaagtcatttcgtctgcttgcttttatatgtggcaaggaattggatcacacaattatgagggctggttaggcaagcctaaaattcatgaaacaagagctgacactggtgggatttcttcagggaaatctgttttcctcttgaggctttcaactgattggttgaggcccacccacagtatcaatggtaatcattacttaactgatcgtagatgttaaccaaatctacaaaatccactactcccccgttatcaacgggatatgttccaagacccccagtggatgcctgaaactggctaatgctgaaccctacatatactatgttttttctgtacatatatatgataaagtttaaattataaatgaggtacagtaacaacaataacagtaaaacaacagttataacaatatactgtaataaaagtcatgtgaatgtggtgtttctcaaaaaaaat

SEQ ID NO: 270614 - DNA, 479 bp, Homo sapiens
cagaaatgtttactctgatattagtattgaagaaaccagacaaatctaatatataacacaaatggtcttgactcagatgttaatgctgtgaaagaatgaaaaatctgggaattactttagcttaaaagagattgatcggtgcatatccctttgttaggttttggattgggggaaatagttttaggtggtactaggaaaattggaatatggaatatgttagaaactctatttgttagtaataccacatcaggtagttttataaattacactgattaaaagtctctactactcagatttttaattaaaataataaaaacttatttttggctgagctctgtggaagtattagccagcatacacctgtagtcccagctactgaggaggctgagcccaggagttcaaggttcccatgagctaaaaattgtgctaatgctctccagtctgggtgatagagcgaatctctatctcaaaaagaaaaa

SEQ ID NO: 270615 - DNA, 997 bp, Homo sapiens
agccgttcgggagtacccgctgctttcggggagctgggttctctggtgtctttttggtaccagagccctcactgtacgggccaagctgaggtggaggctgaggctgacccttcccttggcccggacgcgtactctgcagcgtttcccacggtgtctgctcctcggttgacctgccctcctccgcgccagtccagcgtcccggggccgcttttatttatgaggcgggcgggagggacttggggctggggttgtcgcacgctaactggttgctgggcggtgcggaagaggcggaataggtggttactgaagcttctttggagccaagaaacacagggcctgtaaggccctttactaagtggtgtgtaaggattacagctctgtgcagaaaagctgtgtaaaagatgcgtgaacaaatgtgattctcatatgccactctacatttagttttcttcttaaacccgggtttccagtttcttttccttttagtctagtctctgtcccactccttctcaaaacacattacacacacaacacaacttctttcttactccctactagtagtttcttttctgaagggaaaaataactaattaactctgggctacgtaagtgcttacgtgtgatggtcacttttccctatccttagttgatctagagtgggatatgttctttaaatctgggaacagccaaaccttggatcaattctgtgtgcttaagaaacttgagtttcattaaggcgtggaatttgtgtaattggaattcatattcccagcatttaacataatacaggagacttcagtagctaatttgcttaacgaatgccttcttgggatgttttaataatgacctgaaaacatgtggaccgaaagttgtattttctgttttatcgtgaataaatatatcagttattataaagttgtaaatccgttacaaataaagcaaaatttctttgtacttgaactgaattaaatgatttattgactttatggcctctagca

SEQ ID NO: 270616 - DNA, 409 bp, Homo sapiens
tttcctcaaagctgagcataaaaatacacaagttttcatctgtttctctgggtcttctttgccttatgaagtctcccatatcacataaaacctatattaaataaatttgtattttttttcttgttaatttgtcttttgttatagggacctcagccatgaatctaatgatggctgaagaagaaaaatattttcctaccctgcattaatagtataagactcaataataatactaataacattagctgacaataatctgcatttactttttactagtcactgtgcaaagtgctttcattgcacttattaatcaatttttaacatgcattacatctcaaaattgcccgaaattccattttttttgacagccacatgttggacaagtgagtcaagcaatattattagggttctt

SEQ ID NO: 270617 - DNA, 331 bp, Homo sapiens
tcaggttatgagggctccaccctcatgaatgaaattagtgcctttataaaagaggcttgatggaaacttttggcccttccagcatgttctgacacagagaagcagctataaggaataggccctcaccagacactgcatctgctggtgccatgatcttggaattcccagtctccagaactgtaatacatttctattgcttataaattacccagcctaaagtattttttatagcaggctaaatggattaagataggaagtaaatctcaaaactgatttttaggaattgttaatcttgagaataaaaaaaacaaattattcactggttctcaaa

SEQ ID NO: 270618 - DNA, 1071 bp, Homo sapiens
gaacagattgtggcaagggtggatgtgagtcccttctgctcaggatctacatacagctacaggaagaatacgttctttctgctgcttcccacaggtggccttggagtgtctgtaccatcgagagaagaggattgggattgatttggtccatgacaacgtggagaaaaaccttatccgggaagtggatttgctaaaatgttgccaagaacagatgagaaaattagctcaaagaattgatatccagatgcgggataaccgggatgctcagcacgtgctggagagggacctcgaagacaaaagctcggcccagtgtatcgatgagaagtgctttaacctgagaaatacgtcagactgcatcagcttcttccacggcatggagaaaattgacggcacgatctccgtacctgagacctgggccaagttcagtaacgacaacatcaaacactctcagaacatgcgggccaactccatccggctgcgggaggaggcggagcacctctttgagaccttgtcggatcagatgtggaggcagttcacagacaccaacctggccttcaacgcccgcatctctgaggtgacggatgtgaagaataagctgcagacgcagctggcgaagacgctgcaggagatcttccaggccgagaacaccatcatgctgctggaaaggtccatcatggccaaggagggcccgctgaaggtggcccagacaaggctggagtgccggacccggcgccccaacatggagctgtgcagggacatcccgcagttgaagctggtgaacgaggtgttcaccatcgacgacaccctgcagaccctcaagctgcggctgcgggagacacaggacacgctgcagctgctggtcatgaccaagtgccggctggagcacgagctcgccatcaaggccaacaccctctgcatcgacaaggagaagtgcatgggcatgcgtaagaccttcccctgcaccccgcgcctggtgggccacacctgagcaccgccctggcgcctcattccgcgctggcgtaaaattggaaaaggctgagaaacaaagtaaaacagtattttgtttgaaag

SEQ ID NO: 270619 - DNA, 1078 bp, Homo sapiens
tgtaaggcccagggttaggtggcagggttgtcttgaccacttccccaaactgtccctccactggaagatctgcaaagaggggttttcatgcatattcacaggtggccttggagtgtctgtaccatcgagagaagaggattgggattgatttggtccatgacaacgtggagaaaaaccttatccgggaagtggatttgctaaaatgttgccaagaacagatgagaaaattagctcaaagaattgatatccagatgcgggataaccgggatgctcagcacgtgctggagagggacctcgaagacaaaagctcggcccagtgtatcgatgagaagtgctttaacctgagaaatacgtcagactgcatcagcttcttccacggcatggagaaaattgacggcacgatctccgtacctgagacctgggccaagttcagtaacgacaacatcaaacactctcagaacatgcgggccaactccatccggctgcgggaggaggcggagcacctctttgagaccttgtcggatcagatgtggaggcagttcacagacaccaacctggccttcaacgcccgcatctctgaggtgacggatgtgaagaataagctgcagacgcagctggcgaagacgctgcaggagatcttccaggccgagaacaccatcatgctgctggaaaggtccatcatggccaaggagggcccgctgaaggtggcccagacaaggctggagtgccggacccggcgccccaacatggagctgtgcagggacatcccgcagttgaagctggtgaacgaggtgttcaccatcgacgacaccctgcagaccctcaagctgcggctgcgggagacacaggacacgctgcagctgctggtcatgaccaagtgccggctggagcacgagctcgccatcaaggccaacaccctctgcatcgacaaggagaagtgcatgggcatgcgtaagaccttcccctgcaccccgcgcctggtgggccacacctgagcaccgccctggcgcctcattccgcgctggcgtaaaattggaaaaggctgagaaacaaagtaaaacagtattttgtttgaaag

SEQ ID NO: 270620 - DNA, 505 bp, Homo sapiens
ctcctctgccttccaccatgattgtaaggccttcctagtcatgtggaactacgctgcaggagatcttccaggccgagaacaccatcatgctgctggaaaggtccatcatggccaaggagggcccgctgaaggtggcccagacaaggctggagtgccggacccggcgccccaacatggagctgtgcagggacatcccgcagttgaagctggtgaacgaggtgttcaccatcgacgacaccctgcagaccctcaagctgcggctgcgggagacacaggacacgctgcagctgctggtcatgaccaagtgccggctggagcacgagctcgccatcaaggccaacaccctctgcatcgacaaggagaagtgcatgggcatgcgtaagaccttcccctgcaccccgcgcctggtgggccacacctgagcaccgccctggcgcctcattccgcgctggcgtaaaattggaaaaggctgagaaacaaagtaaaacagtattttgtttgaaag

SEQ ID NO: 270621 - DNA, 440 bp, Homo sapiens
gtgtaaaagacggctaaacatttaaattgcctttatttacttagcttaattgcattttagatgctacgtatttctagcttcccctgtgctaaccagcttcacagtccatagagatgagatgtgagttggaagatctaagtctggtcaaagtccttgaatccaggagaaagaaggctcatgtcatcttcaacacaagattagcaatctcaggaagcaatgtgccctggagaactgacagctattctgaggatgtggatcaagtacagagcaccctaaatcaaagcatcaggagaactgtatttctgtgacagcttaatgggcaagtggcacacaatatatttatttacaccctggctacttttaagacgaacccaccaggtgatttgcagctgttcacttatggttatacaggtttggattaaatattttttcattcttaa

SEQ ID NO: 270622 - DNA, 1108 bp, Homo sapiens
tattaagtaaaacttatattcttacaagacttcctccaggtccctgttacaaccagattttctttgcagacttttaaattatggaagttctggtgctgccactgagttgtgtagattattattagatattcaataaataaagttggtagatgtgaagaggtactagacaatagtcctattttgttttggtttgtttgttttgtaatttattctgaaaaaatgtttatgtggagagaaaagggaaaacatacagaaatacacagcacacaaacaaattcttacttttttttggtagtctttctaattttccaaggtcaccagctaatagcaaatgagagttgtagggggtggggtgaaggctggggtcttaatcggggtctatctgattctagatagaccagattctagattttccactcggttactcaatcttcttagtggtcagtttaataacctggaatttaagacatgactgtgtgatgatgggcaaatcacagcaggactgaatgggagctggtaatttctcagaggttgtttgtgtgacatatgcatgtaagttcattcacctgatttagctacttacatgaaccattgtgcactgagctgcttctatatctttagcatattctgtatctatgtaaaattcacataagattgtatgacttttataaaaaacaaaaagacatctttgattaatttgtcttcactatgaatactgatgtgatgtgttacaatcatcctgaaaaggaggctaacaaaggacaggactgagtctgtcttgaggtgagtgatatgatggaaagaatggattttcccccacccaactcatttttgatattacataaagtgaaaaacattaaataattcaccaaagtatctagatttttttttgtttttgaagtgcaagggaagtaacttgacctttgttaaacactttgatcatggaaaacacataaggttctcatcttattccaggaagtgtagacactagataatcttttcatagtcatccaaaaagcatattaagtgaaccaggtaaatccatcctacactttttattccagagacaagttggctaaactttgaggagactaaaacaaaacaaaaa

SEQ ID NO: 270623 - DNA, 408 bp, Homo sapiens
caattctgaagtattactgtaactaccaacatgttatagatgaggaaacaaagagaagttaagcaacttgctccagtgacgcagctggtaagcagcagagctgggattaaaacccaggcattctgattccaccacctacacacttagccattccgccccactgagaatgaaaatgtcaaaaaatactaggccagtaagtgttagcaaggcaagaaatttccacaccaaaggtgagtatgttgtttggaaagattgggatggaaatgagtaaagtatgtttctttttaaaagtcttttagtaagctttaaagctctatatgtaagaagcagatgaaaataccaagtgaatttttagatttgatgttatgtaaggttttgttttgttaattaaaatttggtcattttgtg

SEQ ID NO: 270624 - DNA, 518 bp, Homo sapiens
cactatgggttttataaattttgtgataagtctaaactgcctttgcagaagctttgcaacccaataaatgcatacatacacacttatttcactgagttgtgattatcaagggaaattatatgcaaatgcctgccatagtgcctgtggcattcctattaacctcaataaatgctgattctattgagcaatttttaggaaagttaattattttgttagaacatctcagaaaatcagacttttcaagcccaggtagggaagaaaaccatccattttcagaaaaggagctgatgtttactactgcagatgattttttgatgtctgattttctattaaagtaggtgtgtgagttccagggtcagattctggagaaaattaggaagactgattaaacagtaactttggtagaaggcatgctccctagtaaccgttcccaagttttttctgtatcagttgcctcattcatccatcttttcattcaagaaacacctactgtatgtcaggtacaatgtttgctgcta

SEQ ID NO: 270625 - DNA, 463 bp, Homo sapiens
ccttcattatgctgtattttccttcttttcctagttggtagagtgttttatgaaaaaatgttgactttgtcacatgctttatctgcatcaattgagatgatcataaaattttttttcccttcattatgtgaatgtattgtatttattgacttttgtgtgttgaaccatcctcgcattccagcaataaatctcagttatggtatataatttttttttaatttctctttttaagagacatgatctcactcttttacccaggcagtagtcctatggctgttcacaggcagagtcatggtaataatggtaataatgctgctatggtaataatgctgctgtgaacatcagtgtatgaatatccttttttacacccctggcctcaaatgatcctcctgccacagccttccaattagcaggaactacagatgggtacctctgcacctggctttaattgcatttaactaaa

SEQ ID NO: 270626 - DNA, 393 bp, Homo sapiens
attgtcaaaggttttgtaagacagacaaatgtcttttcaaggattgtgttttcagcctgtaggatcccagcctggttgctatagttagtagtttagattcataatgttattcacagtacactccactgtctctcttataataatacatgttgatgatggaacacgagttgtaagttctctttctgtttcattttcctgggtttgcaaatcagcttaggctcgtcatagcttctgagttagttagcatagggttgttgtttgtcagcagtcttgagaagttggtgtcaaattgggtgttgagctggcgtttgttttagagggattatggggagaggggccaattcagtaagttatctttccttaaagtctttgttcctttgaccattgcggcct

SEQ ID NO: 270627 - DNA, 828 bp, Homo sapiens
catctggattcaactagtcatggttcacaaatacccagggctgggtgcagtggcccacacctgcaatttcagcactttgggaggctgaagtgggaagatcacttgatcccaggagttcgtgaccagcctgggcaaaagacggtgagaccgtgtctctacaaaaaaatttttttaactttttaaaaagaaaaaaaaaatcaaggaaaaaacaaacaatttaaagataatacaaatttttaaaaatacagtgcaacaaatatttacatagcatttactttgtataaggtgttataactaacatagagatgatttaaagtatgtgggaagctatacataggttatatgcaaatactatgctactttatcggagggacttgagcatctgcagattttggtatcgcagtgggtcatggaaccaacccccatggatactaaggggatgactatgtgtgtgaagtgtccagcacagcacctaatacatagtgggcattctataaatggtaaccttcagattttacctcctgagtttaacataatgttttccactgtaatctaggcacctctgagatctttgtttcctcccattaaaacaggacagtatcacctagctcatagagtggttgtcagatttcattgaaatagttcttgtgcaggtggtttgtaaattataagaaactatccaaggctgggcatggtggctcatgcctgtaatccaatccaagcattctgggagaccgaggtgggagtttgagctcaggagtttgagaccagcctgggcaacataatgagaccttgtcactaaaaaaaaaaaaaaaaaaagaaactatc

SEQ ID NO: 270628 - DNA, 442 bp, Homo sapiens
ataaggacattttaaatgaagctaattcttgcctgacttcaaaacagaaataggaaaaaaattgttcatattatgacctgggaaacagttgttatgaaacattaaaacttattaaattggctgagagaggtggctcacgcctgtaatcccaacactttgggagaccaaggcaggaggattgcttgagcccaggagtttgagaccagcctgggcaacagggagagccctcatctctgggcaacagagagagaccccagggcatggcagtgggcctgtggttctaactacttgggaagctgaggtgggaggatcatttgaacccacgaggtcaaggctgcagtcagccatctttgtgctactgcactccagcttgggcaacagagcaagaccctgtctcaaaaaaataaataaataaataaataaataaaacaagtattaaata

SEQ ID NO: 270629 - DNA, 398 bp, Homo sapiens
gggaagacaggatttgcagggacacacctatgaggagggattcccctgcgatggacaggggaggggtttaggtgcaggtagcaccctgggcgcagggaagaaggcgtcacagtgagggcagaaaagacactcctcagatcctggaagcagcaacctgacccccaggggccactaagaccaaatcatggccatctcagcagcagcgtgtgtgacagttactggaaaaagatacctcacacctggcactgcctaacccccgagaacctaatgccactctgagaaagctcagtacgggtgcaagttggattaagtaattgcagtgcgagttttcctgtgttttattggtgtaatgctccttttggacattaaaaaaacttgacatatacaatgatcattta

SEQ ID NO: 270630 - DNA, 498 bp, Homo sapiens
gaaagtccctaggcagagaagcgctgtgtgggcagttggcagtcaggctggtgtgcactaaagtagtaagggctggggggaaagaggtgagtacaaattgagttcatctgtgaggcaggaaatgcttatcaaaccccaaattaatcatttttaaataacccatgatctattgacttgtaagagtgcagaaatttaaaatgaggctacattattttaaacatgctcctgtttcacttttactgatcaataaacagtaagtccttaggaaagggcaaggaccccgaggctatagttccagcccattctcatatcataagacatgtcacggtctatataaaatcaaacaacagctaaccccatctctactacacatacaaaaaaattagccaggcatggtggcacacgcctgtaatcccagctactcgagaggctgagacaggagaatcacttgaaatcagtagatggaggtcgcagtgagccaagatcacgccactacac

SEQ ID NO: 270631 - DNA, 570 bp, Homo sapiens
ttcattaagttttcttctctccagatttgggattatttttaggaattctcaagagttttgttgacttaccaactaggtttcttgaagatggtgagtgaggataggaacttggcctggtttggctcacctctcagattcattggaagaggcaagttcattagcacagtttcagtccaccattacagcatttttttcctgaattattataagtcttagtcaatatttccagataatcatcattatctgtttaaattactgcacagtattctattttactgatgtaccattgtgcaaatactatgatgttttattatttttaagttttgctataacagataagtctgcagagattttattcagctctgtattgttttgcttctgttgcattgtttcctcagattgaatttctaggagtagaattgctatgtcaaagagaataacaagtatctctgagccttgccgcatactgcttttttcatttttaaaggttataccaagttagagtctcactagaactgaatgagtgtactaattttactgtagctagtttctttttttttaaaaaaaaaa

SEQ ID NO: 270632 - DNA, 438 bp, Homo sapiens
gggaccgtggcaggtgctggccacagataccaatgtggtgtgttcccatgaagcagggaaaatctggagaataggaattaaccaccctcacctctgcctccttttctccctgctgttggcaaactttgagttccctaggcctgtttatgccatggagtatggtcttcttccatgggttgagggtttagtctacaggaactgatgctacccatttacattgtgcctgtggcctggctttggatccctccagcctggtctttctaaggtctcagcctgaagcttggaatcaggattgggactgaaaagatatttcagagactctttctatttagatagtgtctcaaatgagtgctgctgaatttggttatcagccagcaagggatttcctttgttaacttccctatcagaaataatgttgggaagagggagtcctctcac

SEQ ID NO: 270633 - DNA, 532 bp, Homo sapiens
tgtttttcctcctgtgagtggacaactaaagccgcgtgatgatgcggatgaaaatattctggtctgtgtgtatacaatgaattgtcagtcttcagacctcatggtcgttaagaaaatagggaactcacaaaccctgctgcgcactacatttacttctttatctgcaagtacagggagtccatacagtcaagaaacacacagatacacataatgctattgaggacattgtcattctgtaagaaaacagaatattatctagatttccagagttagtgcagaccctgtgataacagtctgtgggtttgtggccagcgccaaaggtgtgtgtattttcagaaatggtccctatttgtcagtgatagtgttttttttttcttaagtttgacaaagggggtggtaatatcacattctttagatttgaaataattatcagctccaagaatctgtgaacatagtaataacaataaaaattcaacatcgaccctccctaacctgctcaccatacctccccaccccatgcctctgaagaaag

SEQ ID NO: 270634 - DNA, 612 bp, Homo sapiens
tcatgaacatactcataagagctgattttaaatccttgtctgctgatctgattacatcatgttgctttttatcttgtgtatacattacattttcatctttcttcacacatttcatgaattttaatgtgttctatgagtttctggtggttatagagactctaaattctgctgtattcttttgaagagcattgttattatttgaagaaggggttaatttggctggattcaaactgcaatacctgtctctcctgcagtgggcacagctgaaatcctcattcagttcttatgcacatatatgtattttatatagatgtgtgattctatgtaactgtatatactatgcagattttatcacagttacatgtgagagtgttagttcaacaatactccagtactactggaagccagaaccttagttttgtttgcttactggattttatataaatgaaataatatagtatggatacttttacacctactttcttttacatgtcattatgtttgtgatattcatctttgctgttgcagattgctataatttgtacactttaaaaagcattgtttacactgtggtaaaatatacataaaattaaccactttaaccatttttaa

SEQ ID NO: 270635 - DNA, 457 bp, Homo sapiens
ggggatagaaggtgggttcctttttaacatcgacaagcatttttgttgctgttgttattgctgtttggagatttggaagggggaggttgtttttcatgttcaattgtatttctttttaaatggataatatatttgcatgaatcaacattcaaaaagaagactaaagagacatgatgactaaacacagtctgggacctgggttggatcccagaacagagaagggacattagtagaaaacaggtttgatgaaatccaaatagagtctggagttgagttaatagtaacatatcaacgtgggtttcttagctttgacaaatgtaccacggtaatgcaagatgatgacattaggggaaactgaaacccagtgaggggtgtactgggattttctgttctatctttgcaacttttctgtaagccttaaattattccaaaataaaaagtttactttaaaaaaaat

SEQ ID NO: 270636 - DNA, 387 bp, Homo sapiens
gtacatctaagcaagaggggaaaaagagaagtactaaccaccctgcccaacttgctttaacccttaacacactagtactggagagaaaagtaggcttagaaataatcagccaaacacccaagtagagccttttctttcccttttctgcagagtaaagtgcttttgtattatcaaagacaattccatgacaagggaagtttcactcactttaaaataaatgtggatggaaccatccacaaaatcttctgagaacaagagttctaaccacaagagctgcttaatatgtacttccttgaccttttaaatgaaaatcagaataatgatttgtacaaaaactttcccaggaattgtcatggcccctcatgtcagataccttcatttacgaac

SEQ ID NO: 270637 - DNA, 206 bp, Homo sapiens
agaaaaatatctgggggataaataaatatctaggcttagaaataatgccaaaagcattaagtgaaatgaacatgaagcaaatggaaagttccagtgatactgtttaggctctaatctattcacattttattataagcccttaaggtttttaaagtaaatcactttgcaaatatttattattcatctaccaatgccatataatgcat

SEQ ID NO: 270638 - DNA, 364 bp, Homo sapiens
agctttattataaaagacaacttctattgattttcaagggggtgggtggttgtcaagctcactcctttctatgcactgagggaaaattattgtaagcgatctgtaaaacaatagatgaaaaaagaggagataaaaattaaataaaatttaaataaaaactaggatcctaagtggaaaaatagctttaaattagaaattaataccaaaaaataatgatatgtaatctaaggtgaaaatattttgaagactatcaggatatctcccttaaatgttatttagttctgaaaaatatgtattgaagaactgttatattttactttacgtcatattaaatgtgctaaaattaaagagaaacaagtagata

SEQ ID NO: 270639 - DNA, 404 bp, Homo sapiens
ctttttatgttactgctttcaggatgctgttggcatagttgaaatgttaggctttatttgtggctatgtattttgtgtattctacttgggatctcgatttccccaactatatagaaatgtaagtacgttatttgctctgtttgttctgatgaatcaaaagtgcttcttatgactttgtgtctacctttggaagagatcttggaattctgagtagtgcttttgggaccaaaatatggaagtcaaagtcacaagaatcgattcttgatcaattttttgtttgtttgttaagctccttcaagtttaggcagcagaatttagatcagctggaattgttgtctaaatctgttttcctgggtttgcatattaatggcagagtaatgaagtcacaataaattatgcaaagc

SEQ ID NO: 270640 - DNA, 365 bp, Homo sapiens
attggagctaataacaactaaccacttaagtgccaactgatccacaacgtatcagacattgaattttataattctgatttaattctcacatcaacctggcaatatgggcagtgttatctttacagatgatgaaattgaggctcaatgaaattacaaaacttgtccaagcacaccactagaaagggaccataacagaaaatgtcagaattaggaattcaaaccactatggtccaactccaaaccccacgctccttctactctaccattccttcacacaaacatttctttatgtctagctgacagctaattaggtctcaaactggtagtttttcaaaagacactaaggctatcaaactacattttag

SEQ ID NO: 270641 - DNA, 416 bp, Homo sapiens
tgcaccgtccacttgcacgtgtaccttaggaacaccgtgcagtgtgttgtttactggctgccctagaagctcatgttttggaaagctcactgagcagaggaagatgcgttctgcaagtggcgtgtcctaccccacagcagggcctgagcccgtgccgagcatggagcctgccagctagaagggcagccactttcctctgctgtctttgcattactcatctcaagggtagaatttcttactcgtgctttgaaaggctaaggagagtgttcaccccagagaaagagcaggtcaaactcttttgggctaggcccatgcctggtagtgcataagctatttttgggtttcatctgggaccatgggtacccaggaagagcaccctgggcttgggtcccctccttatcttcagccacacctgg

SEQ ID NO: 270642 - DNA, 640 bp, Homo sapiens
tctctaggcttcttagctatgaaggtcatggaagctcaaggctgctggagaccacccctgctgtcacttagaactcatcctgcctgatcatgaagccaactagcaaaaaggagagccaagagatgtcaggaggaaaataagtcctactgttgtgcagtaaggccctagtcaaccaaggaacatcactgtgtgtcacgtgtccaccttcctttcccttgcctcgcatgccctgcctcatccaggcacagcctggaaggtagaggtgagtgacaagcacgcaggaagctttatggaacatccaacacctcaagactcagctcagacaccacctcctccaggaagcctcgcctggtgccctagtgtgccttctcaggctggttcatagcccatctctgctggtccacagcctttattgagggcagcaccatgcataagggctagactctggaacccagatgtccctgattggaatgtcagctcttgccagctgtgtgaccttgaacgtacgagtaacctatccgttccttggtttcatcacctataaaattaacatcagtctctctacctagtcctactttgttgtgagatttgtcactgagttagaacagaggccagcacatggctactcctcaggtatgaa

SEQ ID NO: 270643 - DNA, 499 bp, Homo sapiens
aaaagagtagacacatagattaatgggacagaatagagagtacagaaatagacccacataaataccactgacttatctttgatacaggagcaaacaaaggctattcagtgaatgatcttttcaacaaatggggctggcacaactagacatccacatgcataaaaatatagacacagaccttaaacctttcacaaaaaaatcttactaaaaatggatctggactgggcgcggtggatcacacctataatcccagcactttgggaggccaagatgggcggatcacgaggtcaggagatcgacaccatcctggctaacatggtgaaaccctgtctctaataaaaatacaaaaaatcagctgggcatggtggcgggcgcctgtagtcccagccactcggtaggctgaggcagaagaattgcttgaacccaggagcagaggttgcagtgagctgagatgttgccactgcagtccggcctgggtgacagagcaagactccatctc

SEQ ID NO: 270644 - DNA, 656 bp, Homo sapiens
tcactcagctggtaagtagcacagtcagtattagaacttgagccttttttattccaaagcaggggtaccatcaagtctacccgagtctgacaaagaattaagagcagtggtgggtactgttgtagttcagggtgggagaaggcctctttggactggagatgcaaaaagtgttttcctggaggaggtagcttctaggcctggtccttgaaggacaggtggcatgtggcaggcagtatgcttagtggttaggagcttggatcctggtcagattgcccaggtttgaatcctggctcccaatttactagctttgtgatcttgggcaagtaacttaatctctctgttcttttggttttgtgatctgtgaaatggggatacagtacctgcctcatgtgttgtgatgattaaatgatataatgtgtgttactttgaacaatgttcacatgtattgaagacagtatggtatgaacgtgataaatattagctattataattgggctaggccaaccgtttgcagtcatttcagacccagtgccccctttttataaccaatgtatatatttaaaaactctcattacttttctggaatgaaactcacatataataaaacctttttatgcccataatttaaaaagaatcaatattgtctatgatgtgat

SEQ ID NO: 270645 - DNA, 158 bp, Homo sapiens
gaacctcaatgtcagtctcttacttaatataaatattaactcaaaatcaatcacagatttaaatgtaaaacattaaatgacaaacctttttgaaaatctttgtgacctagcattaagcaagatattcttagatatcatcaccaaaacacaaatcataa

SEQ ID NO: 270646 - DNA, 707 bp, Homo sapiens
gtgggagcgacccagtgggagctaatttaaataatgggtgtggttccccatatagttctcatggtagtgaataagtctcacaagatctgacagttttatcaggggtttctacttttgcatcttcctcattttctcttgctgctgccatgtaagaagtgactttcacctcccaccatgattctgaggcctccccagccatgtggaactgttaagtccaactaaacctctttttcttcccagtctcaggtatgtctttatcagtagtgtgaaaactgactaatacagtaaattggtaccagaagtgggatgttgctgaaaagatacctgaaaatgtggaagtgacgtaggaactgggtaacaggcagaggttggaacagcttggagggctcagaagatgacaggaaaatgtggaaaagtttggagatccctagagacttgttgaatggctttgcccaaaatgctaatagtgatatggacaataaggtccagtctgaggtgttctcagaaggagatgaggaacttgttgggaactagagcaaaggtgactcttgttatgttttaacaaagagacttgtggcattttgcttctgctgcagagatttgtggaactttgagcttgagagagatgatttagggtatctggcagaagaaatttctaagaagcaatgcattcaagaggtgacttgggtgctgttaaaagcattcca

SEQ ID NO: 270647 - DNA, 482 bp, Homo sapiens
ttagttttaaaaatcttagtgatcatcatatgtcttgaagtctaaatgatccagtcttcaatatgcttgaatgcactatcattggaggagtacccaagaaactgtaacagtggttgtcaaaggtggcagtgggggagatattggacagagggataggagaaatagcctgcctgctttttacagtataagcttctgaattttctatcatgtccgtgtactacttatgtaaaaattatattaaaaataaaaagaactgtgtgaagaaaggaaccagggaacaaacccagtcctatctgtctctacaacctacttccttcttatagcactgtgctttagcactaatgctccacatgtctacctttagctgattatgagcgtggacaaataatttattcactttaggccctagttatattatgaaaagtaatgttggatctgttgatttctaaaattatgataaatgatcagagtgcaattgaaat

SEQ ID NO: 270648 - DNA, 356 bp, Homo sapiens
  misc_feature (289)..(289): n is a, c, g, or t
catggatcccagcaatgcaagaagatcccaccctaaatccaaacacagagggaggggatagagggaaacccttgaggaaatgaatcaagaagcagcgaggcaccaagaaggaagaaaccaaagaggaggcgacagactaagggcttgaggggagagaaagccaggagagaaactacacacagtcacccacaagcaaacaaaacctgcacatacacacagtcaaaggagaagcatcagccgagaccacagatgaaatttaaagttgttatggcaaccagaacaggtgggntgggcacttatgcccaccgaatttacaaaattaaagtaagcattgcatttgctaactaattaaataa

SEQ ID NO: 270649 - DNA, 1486 bp, Homo sapiens
ggtgtcggagggcgggccccgcgcggtgctagggttccgtctggactggcggtggtgggtcccaaccggcggtaccgggttccttcccgaccagcggtgctaggttcggttcggacgcgcgctgctggatctaaatgggcagtgctgggtccgatgggtggtgctgtgttgggtccggacgcgcggtgcagagtccggacgggcggtgctggatccaaatgggcggtgctggatctggacgggcggtgatgggtccgatgggcggtgctatgttcggttcggacgggcggtgctaggtctaaatgggcgctgctgggtccgatgggcggtgctgcgttcggtccggacgggcggggacgggcggtgctgggtccaaatgggtggtgatggatctgtggacgggcggtgctggttccagacgggcggtgctgggtccagacgggcggtgggtccgatgggcggtgctaggttcggttcggatgggtggtgctaggtctaaatgggcggcgccggatccgatgggcggtgctgggttcggtccggactggcgggtccgggtctggacgggcggtgctggatccaaatgggggtgcagtgctggatctggacgggcggtgctgggtccgaacgggcgatgggtcccatgggcggtgctaggttcggttcggactggcggtgctgggtctaaatgggcggcgctgggtccgatgggtggtactgggtccggacgggcggttctgggtctggacgggcggtgcagtatccaaatgggcgctgctgggtccggacgggcggtgctaggttcggtccggacgggtggtgctgggtctaaatgggcggtgctaggctcagcaggggaccggtgggcgtggcggcacaggtacggagcgcagggccggtggagcgccctctccgaagggccctgcgctccccgcgctcgctgctcctcctgcccgcgcattgccccggggctgctgcgtgtttcttccagggtgattcctttccgctgggtcacttcaaagccgaccttttcaagctgttttcttccgcggaggacacgttgttaggctttgtgtgcatttcaagggtcatgttttctgaaccgcgctctgccgctcttggggtgttcgagcccccacactgctgtgcggtgttcctctcacagagtgaggttggagggtcccactccctttgtgtgtctccttagaaaacgcctcttctctcagacacatcgttatctgccaattcttcgcagacgtagagaacggactgcagagttaataaacgtcgaggggaagctttgatgcgccccatttggccctgagagatgccacgtgatcgtcattttaaatcctagcgccatctctgcagtctccccacgccgggttcagtcaggcgaagttgcgttatctgtgatgtgttgtaacaaaaagcgtttatctttgaaacactaagacaattaaagaattctgtcatcccaaaaaaa

SEQ ID NO: 270650 - DNA, 360 bp, Homo sapiens
atgtggaaataatttttctctccaccaactggatttcctcttttgcagacaattaaagaattctgtcatccccactgggttctgtcttttctaccgcacttgtccagtacagctacataaggaggcttctcagcagaggagcctggggtgttgaaccagtgccatgagggaatgaattattcaatagatcgctagtctcctttcttaaaattaaagtgtggtgacttgcagaaaagcatctgtgtctaaatgtcatcttcgtgttctagcactcggtttctttatgcctttcagttcctgggcttcccgatggactcgagtttttactatgtgagcatcccggtgcctgcacagcaagga

SEQ ID NO: 270651 - DNA, 2272 bp, Homo sapiens
  misc_feature (2272)..(2272): n is a, c, g, or t
ggtgtcggagggcgggccccgcgcggtgctagggttccgtctggactggcggtggtgggtcccaaccggcggtaccgggttccttcccgaccagcggtgctaggttcggttcggacgcgcgctgctggatctaaatgggcagtgctgggtccgatgggtggtgctgtgttgggtccggacgcgcggtgcagagtccggacgggcggtgctggatccaaatgggcggtgctggatctggacgggcggtgatgggtccgatgggcggtgctatgttcggttcggacgggcggtgctaggtctaaatgggcgctgctgggtccgatgggcggtgctgcgttcggtccggacgggcggggacgggcggtgctgggtccaaatgggtggtgatggatctgtggacgggcggtgctggttccagacgggcggtgctgggtccagacgggcggtgggtccgatgggcggtgctaggttcggttcggatgggtggtgctaggtctaaatgggcggcgccggatccgatgggcggtgctgggttcggtccggactggcgggtccgggtctggacgggcggtgctggatccaaatgggggtgcagtgctggatctggacgggcggtgctgggtccgaacgggcgatgggtcccatgggcggtgctaggttcggttcggactggcggtgctgggtctaaatgggcggcgctgggtccgatgggtggtactgggtccggacgggcggttctgggtctggacgggcggtgcagtatccaaatgggcgctgctgggtccggacgggcggtgctaggttcggtccggacgggtggtgctgggtctaaatgggcggtgctaggctcagcaggggaccggtgggcgtggcggcacaggtacggagcgcagggccggtggagcgccctctccgaagggccctgcgctccccgcgctcgctgctcctcctgcccgcgcattgccccggggctgctgcgtgtttcttccagggtgattcctttccgctgggtcacttcaaagccgaccttttcaagctgttttcttccgcggaggacacgttgttaggctttgtgtgcatttcaagggtcatgttttctgaaccgcgctctgccgctcttggggtgttcgagcccccacactgctgtgcggtgttcctctcacagagtgaggttggagggtcccactccctttgtgtgtctccttagaaaacgcctcttctctcagacacatcgttatctgccaattcttcgcagacgtagagaacggactgcagagttaataaacgtcgaggggaagctttgatgcgccccatttggccctgagagatgccacgtgatcgtcattttaaatcctttcctgggcttcccgatggactcgagtttttactatgtgagcatcccggtgcctgcacagcaaggactctcattgggttccacacgtgctgcgcagatccctgacgcagcgttcactgaacctcaactgcaggagcttcattcctgaggacgctgttaccaagaatgacttgcctcttgaagaatgagtttgcaaagccggcagttagattgctgatgtccaaagtaagtatgtgtagcatcactaaagagaaaattcaggattcctggaaaacagttatgggctctctgcagtgttatttttgtaataaaaaacatatagcatatgtgaaatacctactgggtgatgcaggacacatagaaggctcgaaattaatgtgaatcattctcgtttttctgactgtcattaaaagtccccatttgtattatgtatgagtggtatatcaatatctaaactacactttattgtaggtcccaaccaacattagtttattgacaaatgtttaagagcagccaaaaattcatagaatacctatgattcttaaatcatgaacactcccataactggtatatgtttaggacatgaaaatttccaggctgacaaataatttcgctgtcatcggtcaagactccaggatgatattctgagccatatgttaattttgataaccacctagaacaataaaaggtaaacatgctaccatcttctattctcattgcaccactggattctggtacatctaaaaattgtacttaaatgatatccaagaaatgctgtaaaaaacaaaatagggccgggcgcagtggctcacacctgtaatcccagcattttggaggccaaggcgggcagatcacgaggtcaggagatcaagaccatcctggctaacacggtgaaaccccgtctctactaaaaatacn

SEQ ID NO: 270652 - DNA, 1918 bp, Homo sapiens
  misc_feature (1918)..(1918): n is a, c, g, or t
ggtgtcggagggcgggccccgcgcggtgctagggttccgtctggactggcggtggtgggtcccaaccggcggtaccgggttccttcccgaccagcggtgctaggttcggttcggacgcgcgctgctggatctaaatgggcagtgctgggtccgatgggtggtgctgtgttgggtccggacgcgcggtgcagagtccggacgggcggtgctggatccaaatgggcggtgctggatctggacgggcggtgatgggtccgatgggcggtgctatgttcggttcggacgggcggtgctaggtctaaatgggcgctgctgggtccgatgggcggtgctgcgttcggtccggacgggcggggacgggcggtgctgggtccaaatgggtggtgatggatctgtggacgggcggtgctggttccagacgggcggtgctgggtccagacgggcggtgggtccgatgggcggtgctaggttcggttcggatgggtggtgctaggtctaaatgggcggcgccggatccgatgggcggtgctgggttcggtccggactggcgggtccgggtctggacgggcggtgctggatccaaatgggggtgcagtgctggatctggacgggcggtgctgggtccgaacgggcgatgggtcccatgggcggtgctaggttcggttcggactggcggtgctgggtctaaatgggcggcgctgggtccgatgggtggtactgggtccggacgggcggttctgggtctggacgggcggtgcagtatccaaatgggcgctgctgggtccggacgggcggtgctaggttcggtccggacgggtggtgctgggtctaaatgggcggtgctaggctcagcaggggaccggtgggcgtggcggcacaggtacggagcgcagggccggtggagcgccctctccgaagggccctgcgctccccgcgctcgctgctcctcctgcccgcgcattgccccggggctgctgcgtgtttcttccagggtgattcctttccgctgggtcacttcaaagccgaccttttcaagctgttttcttccgcggaggacacgttgttaggctttgtgtgcatttcaagggtcatgttttctgaaccgcgctctgccgctcttggggtgttcgagcccccacactgctgtgcggtgttcctctcacagagtgaggttggagggtcccactccctttgtgtgtctccttagaaaacgcctcttctctcagacacatcgttatctgccaattcttcgcagacgtagagaacggactgcagagttaataaacgtcgaggggaagctttgatgcgccccatttggccctgagagatgccacgtgatcgtcattttaaatcctttcctgggcttcccgatggactcgagtttttactatgtgagcatcccggtgcctgcacagcaaggactctcattgggttccacacgtgctgcgcagatccctgacgcagcgttcactgaacctcaactgcaggagcttcattcctgaggacgctgttaccaagaatgacttgcctcttgaagaatgagtttgcaaagccggcagttagattgctgatgtccaaagacatgaaaatttccaggctgacaaataatttcgctgtcatcggtcaagactccaggatgatattctgagccatatgttaattttgataaccacctagaacaataaaaggtaaacatgctaccatcttctattctcattgcaccactggattctggtacatctaaaaattgtacttaaatgatatccaagaaatgctgtaaaaaacaaaatagggccgggcgcagtggctcacacctgtaatcccagcattttggaggccaaggcgggcagatcacgaggtcaggagatcaagaccatcctggctaacacggtgaaaccccgtctctactaaaaatacn

SEQ ID NO: 270653 - DNA, 448 bp, Homo sapiens
aaattttaagtgcatcatttgatgagttttgacagatgcatttacctttgtaaactacctatcaagatacaggacatttctgtcaccccggaactttcttttatcacccttcccaatcaggctctgtcccaacacaccctcagaggcaaccactatctgatttatttcactctacattggctttgtcttcatataagtgaaagtatacagtttatacccttctgtggaaggctgtttaactcagtatacagctttgagattcatctttagtattatactcctttttattgctgagtactattacgttgtatgaatatgtcctagtttgtacatctactctcctatcatgaataccttggatttgggctaatgtgaataaagttactatgaaattatttcttattttagtaaaatatatatagcataaagtgtgccattttaaactgat

SEQ ID NO: 270654 - DNA, 571 bp, Homo sapiens
aaagagaaaacggttggaatatggctagctagagattctgtggtctctattccctttaaaattaccatgtccatgtccatgtgtgattgggcacatacacacatgtgcatgagtgtgcacatgcacacagttttcttttatatgtaatacattttttaaagggatgaacttggattagaagaaagaaaacgagatggcaaagagagatactaaatgtgactgcctctggggagcaatccttaaatatgccctcttcctccacccctactcatccctctctaaagcagagtgagaggcaccttttccctgttcttctagcactttggtgaaatctctctgtgcatcttatactatgtgatactgtttgcttatatatgtctcttctcttcttgtctgtgatccacctatatccgggatgtcccttttgtttactttgagtgagatggacagatcacaccgtgacttccagtgtccttagaacatcttatgttaaagaatagactgtaggaagtctgagattgttctactaaaaactcatgataaaatgatgtatgactcattctgtatcata

SEQ ID NO: 270655 - DNA, 514 bp, Homo sapiens
gttgataagtagttgtagtctagtctaggtgcttaaggctagaatctaatagaggaaatgaatacttaactaccagacaaaagaggtaagaacaaaaatgttatttgggaaacccagaagaagaagcagtaagtaagaaatcttgtcattatttgtggagttggatctttttacaactggcaaagtcatgtttaggccaatcatgtaataatttagcctatctgtgcttcattttccccatttatagtactaggttttgcctgtttaatgccttgccactttttcacttgaatgtctggcttctttgaccaaattcctgcttttaatttctggaaggtttaacatactttcattaatattatttaagaaaaagttagaaaatttagaaaatgatgaccaccgttcaatatttttaacttttcgttgatttattgggatctaaccccattgtaaatagagcagcatctgtacataaaatataacctggaagttgttgctatgggggaaaaacagt

SEQ ID NO: 270656 - DNA, 310 bp, Homo sapiens
  misc_feature (236)..(236): n is a, c, g, or t
  misc_feature (271)..(271): n is a, c, g, or t
  misc_feature (287)..(287): n is a, c, g, or t
aagaaaaacacaagtggtggtgatgacatgattttgctttatctgttagagtttcttaaattaaaaaatgtggtaaaggagattcaaaagaagatgagatataaaaggaagtgctactagttcctaaatatgggaataaaaattaacatatgaaaagcaaaatgaaagttatataaatttactgtgctagtcttagtatgttttaatgactttcaaaaatgtttgaaacttttctnagtaggggtgtcactctgtcacccaggctgcagtnagctgtgatcgtagcnctgcactccagcctgggtgacaa

SEQ ID NO: 270657 - DNA, 631 bp, Homo sapiens
aataattctgttcattagcagctagccatctttgatgagtgctgacttctctcctttcagcacagagcaggaaatgcctgcctcccatgactctgggttggagtgaaggggaatgcataccagccaccctcttgcagaggtggggcaggtgctggcacagagcctcaggttaggccgaggggatgcaatctcagatcagcagccagcagtgtttgtaaacaacaggagggagattgtgctggtgatgtccaactcacaccaatgaagatcaaccggtttgtgctttgggcagcaggctgcagatggacagtgcctcctgagggcatcgccatgttttagggatccatgttgcaggatacctgtctgcaagagagagtcaaggagggctttttaagcccctggggttcaggcctggcatctgggtgttaagtagagtgaatctcctgaagtccaaactaacatatgacattttaaaatgaggaaaacaaatggctctgaaaaggtctataggattataggtaagtggttaatacggaagatgttataaaggtctcaggaggagatggggtgatccagggttggttgaagtcgttgaaatggaattaccctgtcttttacctgtctgtgggaa

SEQ ID NO: 270658 - DNA, 375 bp, Homo sapiens
ctccgtctcaaaaaaaaaaaaaaaaaaaaaaattaaaaagaaggcaagtcttttttaatttggtgtatagtgaagaaaagacgactttgggccagaatgaaccgttctaaacctagcaatgtgactgtaggcaaataacccaacctctagaaaaatggagataatgcctacatcccaagatgatgaggattaaatgagttgatgtaaaaatggcaaaatgtggcacctagcgtatacaattggtgtctgaaaaatgttagtttccttttttttttttctggcctgtgttatttagagttttccactagaatagtttgtggcgtaagacttctgttttccttacataaaagcagtgtttttgggtacccactttga

SEQ ID NO: 270659 - DNA, 660 bp, Homo sapiens
atactctgtcaacccaggctggagtgcagcagcatgatctcggctcactgcaacctctgccttctggattcaagcgattctcctgcctcagcctcccgaatagctgggattacagacgtgcatcaccacgcctggctaatttttgcatttttagtagagacagggtttcaccatgttggccatgctagtctcgaactcctcacctcagatgatccgtccgcctcagcctcccaaactgctgggattacaggtgtgagccaccgcgcccggccggaattttttacatcgttttctacaaggtcagtacatagaaatgcattatagtgctccaaatataaagaattcacatactgaaaatgttttgcttttgtccagccttcttaacatacatatttaattacaaggcatgaggattaatggggctttgaatatttaaagctcttttcccaagatgaatttgatttagctactgagatgggcatctgcagtgctggtgacttgccatgtggctgggagtttgagagcagaggaggtgagaccaggactgatgtcaggttggcttctggtgttttacttccttttccactatgccccctcccctctcacttttagctcaccgctttgtcttttcagtttgctgaggaaagaggaaaaagtaat

SEQ ID NO: 270660 - DNA, 474 bp, Homo sapiens
aaagagcgaagaaactatttctgagtagcttcatatggcagaactaaaatgagtgtcaatttttactttaagtaaattttatgtcaaatgatttcataggtctattacaaaaatattattcaatttaacatgtttgttgaagacctactatttgcagtcgccccagatagatatgaaatatgtgcatgggtggagggacaagtagcataaggatgatgagaacaccgttaggaacatgcgctttggtagccagtgagcttccacacctgcaaatgcatttagaagtgcccccagtatggcgtagtgcaggtgttaggtcagtgtgttcaattcattcaactagaataaattaaacatttttttcctaaatagttttgataactctctgatttatgtgcatattctcactatatgtttaacttttagtaagggtaaatggttttatgagatatacactggtgtttacttccaacc

SEQ ID NO: 270661 - DNA, 327 bp, Homo sapiens
gattacaggcgtgagcccatggtgcctggccatgtgtgtttacatttaataaacctttattaaatataatcttactgtatttatgaatttatactgttttaattatagcttcaaaataacgcctgtagctttttcccttaggattattttttaaattgacaaataaaatttgtatatatttttggtgtacagcacgatgttttgaaatatatatatatgtacacattgtggaatagctaaattaagttaattaacatatgcattaccacacatatttattcatggtgggaaatctctcttagcagttttcaagtaaacaacatgttg

SEQ ID NO: 270662 - DNA, 144 bp, Homo sapiens
gtcagttccttcagaataatcatgaaattttcgagttagaaaaaggtgatgggccaggcgtggtggctcatgcctgtaatcccaacactttgggaagcctaggtaggaggattgcttcagcccaggagtcggagaccagcctgg

SEQ ID NO: 270663 - DNA, 360 bp, Homo sapiens
ccaaaactgcaaacagccacagcccttctgacagatcactaaacatgataaaattatgtaaaaagtaggcaatgccacctatgatctctaacatcagtgaacttccacttaaaaagaaagaaggaaaagaaaaataagtgatacgcactcttggactgcccaagatacttaaaacattctaaataaatcccactcctctatagtattagaatacagaaaggtaacttttcattgtttttgcccatgaaatattagtctctccttcaaattctaagatcaggccaggcgcagtggctcacacaatattctttttttgtttgtttgttttgagacaagagtctcgctctgttgcccaggctg

SEQ ID NO: 270664 - DNA, 429 bp, Homo sapiens
caatttcgtaatatcacctaggaaagccatagcattgagcttaagtatttggtgactgtatcagtttcctgtgactgctcttacctccttgcttatttcaaagtctgaagggtttcatgttgggtttagaaaagctgtagagcggcgccacctgatggttactacccagagtgcctgaactgaccttgcaatttcaaacgcagtatcttggctagctcagaagacttcttcctaatgctttacatgaaaagagcaaactgaaatacgttcctcttggaaaatcagaaacataaagaaaatgttttaaattttgacagaagcaaacccactcatatacagaataatctaccaccaaaaaagagtttgtatatgatattcattgaatactattagatttcaaataggtaataaataagattttattatcca

SEQ ID NO: 270665 - DNA, 748 bp, Homo sapiens
cagtgctgtgctaagaacttgggggacttcaaaaagttcaccagttcctgtgtccatgggtgaaaagattttctacatctttccttgactagaaacagaagtcctgaaacaaggtacaccttcttgaggcttacttgaatataacgtcaggaggccagaggctttgtcctgcctaatgtgttatttccacactgaataaaagcacctgagtcctggttctggagattggggcatgatatcttccttgggccattacttgtcctgccacttggaataggtgcttataagccacctctaagataatgaataacttgcaatttgatccgtgatttacataacgtgtatgtttttcctgtttgcaaaggcatatggcaagggagtaaagccaaactttttaccacatggcaaaaataattgtattttgcaacagactaaaagcttaatgctatacagactttgggttggtggagttacttgaggatttactccagcaaaacaaaaaaaagaatgaaagaaagagaaagataaaaatatgaaagaagcaacagacctattccagaaatgtaatgaaaaaaggccacgaagtttgacaactatgtattaaatttacaatcagtccaaattagactggtagtcagattgatatgagaagtacattttcaaaaagatgtactataccaaataatatgagtgcaaaactctggatgattttagtaataatgtgaagacacatatttcttttgacaat

SEQ ID NO: 270666 - DNA, 480 bp, Homo sapiens
gaatctgtagtactgtcactgcaaccatacgctctagaaatatattgctttagagaaaaagcagcaaggccaaataaattgatacagaagaaatgtttagatatgtttttgcaagtttctgcatatctgaaatagaaccaatacatcacatggaaagccaatggctgtgttttgagtttatggagagccatatgtggcaaggaactgagggtggcatccaggcaacagacttcaagaaactgaggctgtcagtccaacaacccacaagaactgaatctgaccaacaatcacaggaacaaacttagaagtatactctttcccagacaaaccttcagatgagaccacagccccagccataagcttgaaaacaatctcatgagggaccttgagccacaggcatgtagtaaagctatgccaggaatcctgcctgccccacagaaaatgtaaaaaaaataaatttttattgttttaagccaaaaa

SEQ ID NO: 270667 - DNA, 712 bp, Homo sapiens
cagtgctgtgctaagaacttgggggacttcaaaaagttcaccagttcctgtgtccatgggtgaaaagattttctacatctttccttgactagaaacagaagtcctgaaacaaggtacaccttcttgaggcttacttgaatataacgtcaggaggccagaggctttgtcctgcctaatgtgttatttccacactgaataaaagcacctgagtcctggtaagtctaatttgctaggtgtggcaatatgaccagtgaaaaacaacaagggcagcatttcctgcagttcggtggcacagtatggttcaaagaggtataaaaggaagtcacaggcattttaaaaaggttgtacatctagcaatacctaacaaaataggaaatcaacttggaaagccaatggctgtgttttgagtttatggagagccatatgtggcaaggaactgagggtggcatccaggcaacagacttcaagaaactgaggctgtcagtccaacaacccacaagaactgaatctgaccaacaatcacaggaacaaacttagaagtatactctttcccagacaaaccttcagatgagaccacagccccagccataagcttgaaaacaatctcatgagggaccttgagccacaggcatgtagtaaagctatgccaggaatcctgcctgccccacagaaaatgtaaaaaaaataaatttttattgttttaagccaaaaa

SEQ ID NO: 270668 - DNA, 609 bp, Homo sapiens
gtgtgtgtgccatgtgtacatgactgtgagtgcatgtgtatatgacagtgtgtgaatgcacatgtacatgaaggtgtgtcgtgtacatgatggtgtgagtgcatgtgtacatggtgtgtgctatgtgtacatgacagtgtgtgtgccatgtgtacatcacagtgtgtgagtgcacgtgtacatgacggtgtgtgtgtgagtgcattgtacatgatggtgtgagtgcacgtgtacatgacctcatgccatgtgtacatgacgtgtgagtgcacgtgtacatgatgtacatgacagtgtgtgtgagtatacgtgtacatgaaggtgtgtgtgccatgtgtatatgatggtgtgtgtgagtgcacatgtgtatgtgaaagtgtattgttatgtgtacatgcgtacgtataactgcatgtgcatgcatgactgcatgtgagtgcacgtgtgtacataaatgtatgtggctgtgcacatgtgtgtacgtaacggtgtctttgcatgcatgtatatgtgatcatgttgtgccatgcctgtgtggtaacgatcacagtgaggccaggggctctgcgggcactcgggggtcttcaggctgacgtggggtggggtaga

SEQ ID NO: 270669 - DNA, 431 bp, Homo sapiens
gtatttttagtagagacggggtttcaccgtgttagccaggatggtctcgatcttctgacctcgtgatccaaccgcctcggcctcccaaagtgctgggattacaggcgtgagccaccgcgcccggccttatttatactttttgtagacacggggtgcttgctatgttgcccaggctggtcttgatctcctggcctcaagtgatcctctggtatcagcttctcagagtgttgggatgacaggcgtgagccaccgcgccctacccagtttcctcatttgtaaaatactttctaaggttgtcaccatgagcaaattaacaaagaatgcacgtgtagctcgcagcatacagcaggcgctcagtgagtggcaggttattattccgttttgttttgttttgtgcgccaggttattattcccacttagtgtcagcaccc

SEQ ID NO: 270670 - DNA, 1197 bp, Homo sapiens
ttttgcagatgaggagactcggacttaaacctccccagcattaaggcaagaaaggtgtctctgttttttccgaagtgtgcctgcttgactcctttgatttttctctgggattcttcatcctccatcaagttgatcgatccctctggatcttggtcagtttcctgacatctctatgaagttcagtgacccagactgagtccacgtctcaaataaggttctgactaatgcagagtctaacagaaagattactgaacatgtcatgcactattaataactcctgttatcgaggatttttttttcacaataggaatgaacagagttctgactcactctaggtttgtggtaaattgcagatcactttctgctttatttagcgggagtccctgttgtcatctttctccttctctcttggccctcataattatcatatcttccccaaacgttcttcagctgtgaatagccctaagcactattcagagtgagtgacagctctcttatttcgtgctgggggacatacaaacccttggacaaacacttgtcactgtgtgccaagaagctgaaaaattcttcttgcctcagagccataattacacttttggtagcatattctaaggaagtcatcccatgtacaggaaaagctgcaatgtgtcaggatgttcattccagcaatatttatagtagtgaaaaactgaaagcaaccaaatgcccaagaaaaaaattacagtatatccactggatggaatagtatgaagccatttaggacagattgtgaaaaccctgtggcagtatggggaatgtttgctaagttatatgaaaagatgaggacacaaaatagcataacatacattccccagggatatagtcagcaaagtctagaatgaagaaaattaggacaaacacccaattcccttaacaaataaaactggggccaggtatggtgactcacgcctgtaatcccagcactttgagaggccaaggcttgtgtccaggagttcgagaccaacctggacaacatggtaaaaccccgtggtctacaaaaaatacaaaaattagttgggcatggtggtgtgtctatagtcccagctactcaggaggctgaggtgggaggatcaattgagcccgggaggtcaaggctgcagtgagctgtgatcgtgccagtgcattccagtctgggcagcagagtgagatcctgtctca

SEQ ID NO: 270671 - DNA, 515 bp, Homo sapiens
cctttacatctataaatactatcttcatcagacagtgatgacctctgacccatctgacagctggatgacctcactatctgaaaggacaattagcttcttctgatttggtttactactcgaagattccaaattcccagagttctttttttcatgttcttcctccctgatgacatcatcaagatcttgggcataataaattcggctatagagttgaaattccacctcactatcaacactcagttcactagataactcgtccctataaagatcatcttcatatgcttctatagtctcatagccaccaaacatcataaaaaatcggtaactttgatgtgctgcagctgcaaacctacttttcttaataaattataatgatgtaatattcatcatttatccattatatttcaaatatattttgccagtttgtcattttaaaaattttatttatgactttttaatgttctgaagttttaaatgtttatgtcatctattaaaaatagtatctattattcttc

SEQ ID NO: 270672 - DNA, 1146 bp, Homo sapiens
caattgtgtaagccagttccttaaaatgtatcttttaaattaatttcttacatgaatctctctttcctttctctcttgctatatatgtatacatagacatatatatttaatacagatagaaatatatacatatctatgtatatctacataaatatatatctttgttgatatgtagacattgatcaatatacatagatacatagatgcatgtctttatagatgtatagatatctatatgaacatagatatgcatatagaacatgtatgaacataaatatagctatctgttcctatatatctatacccatagatatatagatattgatatttatatatatagagagagagatttatatatatgtagttatttacatatctatctgtttatctggagaaccttggctaatactgtagatattattatctctacatttttgatggagaaactgaaattatgtaacctttccagggttacacagctgggaaatagcagttctctaaatattaataactctaaaatctgtgtttttgccactcactgccattcctcttaaagtgaggctgaacggaaccattttccctgcttctctctacccctaaattctctttagatgaccatatataaaataaatacattcctgaacactgactataaagtcaaattcttgggcacaaacactttttttatttacttaaatttaaaaattacatcctggtcttactgaatgctgcagtttctgtggcagcaggaagtctaaactttgaaatagaattttaaggcaaatactacaaacaagtaacttagataaacaaatcagagaaggtacagattttacctcaactgtttatcttgtataattttaatctagctctttattcacaaagcattttgatacttatattggttttatcagctccatcaataaaaataagtcaaatgaagaattggactgacagcttctggactggcttgaagaggtgaagtcagttaaaataatcaaacaggtttgtttatgttgatgatacttgaacgaaatagtggatagttttatttcctttcagtttttttactatatatattggaaatatatacagatcacatttctctatttcacatctctctaagtgttagtaaagtgttaagca

SEQ ID NO: 270673 - DNA, 372 bp, Homo sapiens
tttaatttttatatcatgaatatatttgtataatattacatattcttttactgaactattttttgaactgtaaattagacacatagcaatgtatttaacccatcttcagttttaggatgtttaaaacatttctcatactttaaggacatccttgtagttaaaactgtgcaaatgtcccactaaacctttaggataaattactgagtgtgaaaaatgtttataaaacatatataaaaactaaaaactttttataaaaatgaaaaatttctcttcagaggtttgtacaaatttgcatacctaacagaaatttggattcgggttgtctaaatacaccctggtgggttattgtgattaaatgattttaaaaaggga

SEQ ID NO: 270674 - DNA, 888 bp, Homo sapiens
agaaagggcaaaatcagccaagttataaccagggcatgtaataagcaaaccacatggaatgcaataaacagaaggcaagaaaagtagtttaattccctcccatcatttctattttgaagcaagttgatctctgcaattttataaaagtactaaatttagtacagcaatatcatgaggaccagaatctatctaaccatctcatcctttccatgtcaaatacatggcctttgcatgtattttcatcagtatcttcagggcagtgaccttggtaagtcattaaggtggtaagtggagcagcaaagccgatatgtcactaggtagtcagcagacccagactgaagcctgaagagtgaaacaactttcctgctgggtggccctctgttcgttctattcctattttatcctgatggggagaagtgctttttaaaaatgatctttaatatttccagagtggctaacttccaaaaaacataacctaaagagtaaaaacattcttttctaaagaatgagaatcatgatatgctcttgacaagtatatgagccatcaactacagaagacttaaacaggttccagcgccctgcctcctgggcactgggttcactgatgtaattcatatttggaactgtcttgccatgtatattacaggaagctatgacccctgaccttagattgtacttgggagctacaaacaacatagcttatattggttcttgctagaatgcttttctcccagaaatctcgagtactttacaaagcttcctttagaacagtggttctcaaattttacatgagaaattattgaggagcccaaagaacttttgtttatatgggttacagccgtcagtttttatgatatttaaaattaaaactaaaaaaattttcaacta

SEQ ID NO: 270675 - DNA, 268 bp, Homo sapiens
ttcctgctagcatactggcaaagactattggaaaaaaaaaaagtgtgtaaaatttgattttattgctaccctaaggtggcataattagccataaggtggaaatgtgagaaatctcccactttgcaaaaggatgtcagcgtatcggacctctgggctctatggaaattggtaataaattcttagaactttgtacctaatgcagagaattgtttagttagttgctatcataaaaacagagaggcatgcccttctttttttgttctttttt

SEQ ID NO: 270676 - DNA, 484 bp, Homo sapiens
caaatgtatacaaccacacaaccaccattttaatcgagatatagaacatttccatgaccaccgagaaaatttcttgatacttccttccagacaatactatccccacctcctcactccaccctccttccttgtgcaagcaaccaataagccttatttcactatagattagcttaacctgttctagaattttatataatcggggtcatataatacattatgtatctagtttttcttgcttagcatgtttttgaaattcattcgtgtggctatgtgtataagtagttcagtccttttcattgcttggtagtatttcattggataaatagatcataatttgtttttctgttcatttattttttggcatttaggcaaaatatgtttttctgttcatttgttttttggcatttgtttataatgctttttactattgtgaataaaactgcttaaaaattaagcagtgcacatttgtgcacaagtctttctg

SEQ ID NO: 270677 - DNA, 470 bp, Homo sapiens
tattattactgtaatgatggaatgaatttcagatgctgggacataaacctctgacccctttttaaattatgtcagagagagattcctagaaatgggattagcagatcgaagagctgaatcctcctcaagtcctatgcacaattgagctgcttgccagaaaggtcaagcatgtttcccattctcatcagcaacacgtgagaggactcagtgagctgaaacacggccagcgctgcaactggtcatttaaaaactctgccaattggggccaggcctggtggctccatgaggctttgttgtttctatgaaaaagtggggagacaaagttaaagtgtagagtttttactagttttcttcttgcttgttagtttgtgcaagcagaattaagttgttatcagcttaaaataatgggttataagatagtatttgcaagcctcatggtaacctcaaattgagaaacacaacagatacac

SEQ ID NO: 270678 - DNA, 418 bp, Homo sapiens
caaaaaaaaattttttttttaaaggtcgtttttccaggactgggtttaaatcctagctttgctggtagctctgggcaagtgacttcacctttctggtcctcgggtttttttgcatctgtaaaatgggcacaatgatggtctgaaggccgggcgcagtggctcacacctgtaatcccagcactttgggaggcctaggcaggtggatcacctgaggtcaggactttgagaccagctggccggcatggtaaaaccccatctctactaaaaatacaaaaattagccgggcatggtggcagatacctgtaatcccggctactcaggaggctgaggcaggagaatcacttgaacccaggaggcgaggttgcagtgagccaagatcactccgctgcacgccagcctgggagggagaccccatctc

SEQ ID NO: 270679 - DNA, 387 bp, Homo sapiens
ggacattgttctagaatgtatcagttaaaagctgctgaaagatctcagacatgtgttctgttaagtgcctacaggttcaccaaacttattgaaaatagttaaaatggtccttgacttcagcttccagaactgttgtaagttccttagttcaaacacaaagcaataaaactggccccaataaaacacattagcctcaattctaagcagtttctgataaccataatcatagactaatgtgcacagcctttgaacttagcaattgcaacactaatgtacatgagactatttatcaccaaaaatcaagtaatctagggagaaaaaatgggagagggtatgtgtagagatttgagggaaacccaaaatatacacaaaatagtttatgactta

SEQ ID NO: 270680 - DNA, 415 bp, Homo sapiens
caaggaaactacagtctgggagacatttctcaggctacaaaccagttttgaggctcgcctgccctgcgtcactatcattgtttccttgggtttcccaggaatgtacatgtgtgagactgctgccctgcttatagatctgtttccctgcaggaaacaggagtatcttgcctggggcttccagagttggagatacatgtagtttcactactgagtgctaacatttaattttggaatcaagtgatgcattcagactggctgctatcattctgtggtatacatgtagtgaacacatttgtgactgagtttcctgcttttagctggagcaagaaagttttgtaattgtgatttgtacaaaaaaatcataggcaagagaatgtgtgtaaaataaactttattgtcagaggtttctaaaggc

SEQ ID NO: 270681 - DNA, 222 bp, Homo sapiens
cctcagaatcctgctgctggatgacaccacaggcaaagttcagcagcttcacttacagactctgaaacaaaagagaaaattatcaagaaatacagagaagcagagactcaatctccagaatgaatgagaagcagaatcatgaattccaacactttctctcccttaggattcttgtctatttggcattaatctgggaacaataaaattcagttgacaaggcac

SEQ ID NO: 270682 - DNA, 531 bp, Homo sapiens
gggtagtatctgagaaggcttcatgtgctgtgagggacatctgtgttgtcaaatagaagaggaattctctcacaacaaggggaaacattgagcgcaccctgcatagtgatttctcacacagccccccacatgggatatcttgatgctgtcatgcaacaattacacacatgcctaagacaaatactttgctctagtgaggaaatttgggaagaactcttatcataaggcttccattagcccctttcattttagggagtagaatttgctgttcccacattaggaatcgattccattctctccaagatcttaagagctaccaattggctgtttccaatgcctagttgtagcttaatcctacatcagtatctcccagaacttgttacagcctaacccagcgatgtggaataggttttatctcgcatatgtactctgatagccatagaaacactgaagcttagaagatgccgaggctgtgttcaagggaagggaggaggaagaaaacttacattaatcattgccattaaagtcttt

SEQ ID NO: 270683 - DNA, 440 bp, Homo sapiens
agactaacagcatagatgtcaattcttttataacatactgcaaatttactaacatgcacgtgtttccataattttgctttatattacttatatgaaaataaaaatatattaagcaccctttatatttgaaaagctgatggagtttgagaaggaacaaagaaattgtgacatcttaagaagtataattgaggatggaatagaaacgtgaagagttttaactgggaataatggttcagtcagtaatatttgtatgtgattgctaaatatacagaattttttttaattcaaaggaggaatactttctacattggacctagattgcatgtcccccaccgactttgttattattgctataattttttggtagtatggcccattgcacattctaggaggacataaagaggatgaaatccacttgtggattattagaagtatttgtt

SEQ ID NO: 270684 - DNA, 197 bp, Homo sapiens
gccattgtgtttccagctcaccaagctcctgtatctactggaaaatggaagtccagccttaccaacttgtgaaccttgtctgaagggagccagggcctgccaatggaaccacctccaggagctgcaactgctgttgtcattaataccattgtgtctattttttgagagagataaacttttcatggtgttacattttg

SEQ ID NO: 270685 - DNA, 331 bp, Homo sapiens
gtactacaagtagactctctgggctgaacattgagtgaggggcatagacagatattagagtaacttactaccagagattttgggggttgagtcatcaagatcttgagagaaaatgtttggcattgtaattcagctgaagattctgggatcccaagggcaccctaaggcatgacttggaaacgaagatacagtcattcacaatgacacatgatcacggctgaccggaagacttgagtattcatgaattttggtatacatgggagccctggacctaatcccctgtgtataccaactgtatttctgaaagaataaatgcttgtattaaactaca

SEQ ID NO: 270686 - DNA, 420 bp, Homo sapiens
ggtgagaccgtgtcaaaaacaaacaaaaaagcaattctgatgacgaactcaggtccacagaagggagcccaaataattctgctgatcattgagtgagttgtggtactttcaacactttagaggtttaaaggactgctttaggctgggtgcggtggctcacgcctgtaatcccagcactttgggaggccgaggcgggcggatcacctgaggttgggagttcaaaactagcctgaccaacatggagaaaccccatctctactaaaaattcaaaattagctgggtgtggtggcacattcctgtaatcctagccactcgggaggctgaggcaggagaattgcttgaacccaggaggtggaggttgcggtgagccaagatcgtgtcattgcactccagcctgcaacaagagcgaaactccgtccc

SEQ ID NO: 270687 - DNA, 490 bp, Homo sapiens
tagaaggagtctcactctgtcaccaggctgaagagggattgcaatggcacgatctcagctcactgcaacctccacctcccaggttcaagtgattctcctgcctcagcctcctgagggactacaggcacatgccaccatcccttgctaatttttgtatttttagtagagacggggtttcaccatgttggccaggatggtctcgatctcttgacctcatgatccacctgcctcagcctcccaaagtgctgggattacaggtgtgagctaccacacccggctaatttttgtatttttaatagggatgggtttcactatgttggccagaatggtctcaaactcctgacctcaagtgatccactggccttggcctcctaaagtgctgggattagagatgtgagccaccctgcctggccctaattttaaatacatttaaaaataatctactcaattcctaaagctttagagaaaagaaaatggtaccacatttctt

SEQ ID NO: 270688 - DNA, 535 bp, Homo sapiens
gcactaggtgactctgtgcttctctgaggaaaaataactaaacttggtaaaagaagatcctaagaagccaagaggcaaaaggtcatcatatgcattctttgtgcaaacttccaggaggagaacaagaagcagcactcatgcttcagttaacttctcggaattttctaaaaaatgctcagagaggtggaaagccgtatctgctaaagagaaaggaaaatctgaagacatggcaaagggggacaaggatggctattaaagagaaacttacatccctcctaaagaagaaacaaaaaagtttagggatcccaatgtacccaagagggctccttcagtcttttcattttgccctgagtactgcccaaaaatctaaggagaatatccaaacctatccattcgtgatgtttcaaagaaactgggaaagatgtggatatggtgcatatgacaagcagccttatgaaaaggctgtgaagctgaagaaaaactaagaaatggatattgctgcatactgagctaaaggaaggcctcatgcagcaaa

SEQ ID NO: 270689 - DNA, 608 bp, Homo sapiens
cagttgttttaggaattccaggagctgtgtgggtcacaggcctgctaattgcctgactactgggaaccttcgggtatgacactattgaaatgagacattagaccttcacagggtggagctgtgggccatgctgggctggaagtaaggagtagggtttgagaggggaaaaaaagtagcttggaggaattagcaataaaggtgggtggaagtcttacatttctagaaggtcattcgaccaaataaggctggtgctagggttgttggaagggtaaatgacataatctctgtgcagcacttagcacaggccctcatttatagttagtgctcagtaatttgcagctgttattcctattattgttatggcctctgtcatattacttatgtgaagtacactagactgtaatttcctgtggtgtggctgtgtcgagccacatgtataccaatgaagtggaagacattctggagctaactccgtcttctcgtggggtctcctctcttcctgctcagcctgttatactcccagcctctcaaccttctcaggatcctacctaggcaagctacaccaagtataactgagatatgctttgaagcactgcagaagccccttt

SEQ ID NO: 270690 - DNA, 553 bp, Homo sapiens
taaggaaattacatataagctgaaacttgaagaccacatataggaaggaagggagacggcagggatagatcgtgcagatgaatagtttaaaataagaaacttgctgtatttcagagatgtcatgaggacctatgtcatgttaattcccagggcaaaatactttgtgcagagtcagggaaatattttgttttctaagttggttaatttttttctgccttacattatctcatgccttaaagggcatggacaagtccccactgttaagggagcagggccggacgtggtggctcacgcctgtaatcccaacactttgggagtccgaggcgggtggatcatgaggtcaggagattgagaccatcctggtgaacacggtgaaaccccatctctactaaaaatacaaaaaattagccgggcgcggtggcgggcacctgtagtcccagctacttgggaggctgaggcaggagaatggagtgaacctgggaggtgcagcttgcagtgagcccagatcacaccactgcactccagcctgggcgacagagcaagattccgtctc

SEQ ID NO: 270691 - DNA, 718 bp, Homo sapiens
tgatattttttgggagaaaaatgtattttctggctcttctctctctctctgcatgtatgtgagtgtacttaaaactgccactttggcatacaaactcaagaacatgaataacattgcaacttttttttttttaatttaagattggctgggattctgtgattagaatcttgtcacattacttaagatttcaaaattattttcaccccaaagctcacagccagagagacaagatccattagcagatgaatagtttaaaataagaaacttgctgtatttcagagatgtcatgaggacctatgtcatgttaattcccagggcaaaatactttgtgcagagtcagggaaatattttgttttctaagttggttaatttttttctgccttacattatctcatgccttaaagggcatggacaagtccccactgttaagggagcagggccggacgtggtggctcacgcctgtaatcccaacactttgggagtccgaggcgggtggatcatgaggtcaggagattgagaccatcctggtgaacacggtgaaaccccatctctactaaaaatacaaaaaattagccgggcgcggtggcgggcacctgtagtcccagctacttgggaggctgaggcaggagaatggagtgaacctgggaggtgcagcttgcagtgagcccagatcacaccactgcactccagcctgggcgacagagcaagattccgtctc

SEQ ID NO: 270692 - DNA, 491 bp, Homo sapiens
gtggagatggggtcatgctttgttgcccaggctggtcttgaactcctggcctcaagtgatcggcactccttttcgtcccaaaaagttggaattacaggcatgagccactgtgcctggctcagttttaaaatatgctcatgtatagtataagtctgcattagtggggactgatacaggttggctatatgtccccattcaaatatcatcttgaattataatccccatgtgtcaaatgagggacctggtgggaggtgattggataaccgggatggatttccccttgctgttctcatgatagtgagtgagtccttatgcagtctggttgtttgataggtgtctggtgcttcccccttctcactctctcctgccaccatgttaagaggtgccttgcttccccttccccttctgccatgattgtaaatttcctgtggcctccccagccatgcggaactgtgagtcaattaaacttcttttgtatgtaaattacccag

SEQ ID NO: 270693 - DNA, 262 bp, Homo sapiens
ctgggaagcggaggctgcagtgagccgagatcgcgccactgtacttcagcctggacaacaaaaggagactccatctcaaaaaataaaaaaaaaaaaatgaatgaatgaaattaaccttggtatactactattaagtgaggcctggcgggatgttgtggctcacactgtaatctcagcactttgggaggccaaggtgggtggatcacttgaggccaggagtttgagaccagcctagacaacatatcaaaaccctgtctctaca

SEQ ID NO: 270694 - DNA, 933 bp, Homo sapiens
gtcatctctgtaggctttatcctttaattaattatggatttttatctgcatatatgtgaagctaatgattgacttggttcggacactgaattgtcggcttaaacctgccattccactgggcttcatcactatgttctatgggtgtgaagcctttgttttttcagagacccatttccaccagcgggtttgcactgtaagtgtttccacaggaactctgccctttgccagtgtcactgttgtggctatgcagcagaacccacagggcggaggtgtttcagccctcactgaaaatgcaacagatcttaacatctcttgctgcaaattttccagtgtgttctggtctaccttggtatcttaaaaccaggctcactgactaccacatgagaaatgacagtggggtgtcttaaatgatctgttgaagaccagcagccaaaaagattgcccttagtgtttctctctaccggctaacattagacaatgccatgtagaagctgctgttagggtttgagaactgtgtcgcctcattctcaagatagccaaggaagtgtcatctctggagaaggcagttctgtctctttcagtttctccatggatccgatattgttctgaaagaggtggttttaccaattcgtctcacacagacttcttgcctttacttttatctgactgctgacagggtgggctggaatataatcgctacttaactggacttgactttcaaggcctgattggcgtttccagtatagcagttgcctgagtcatctagttttggaactgataaatcaaaggactggcttggaggctagtgtcctgtctggagaatgggcttaatgtaacttcagttaagaaattaatgaatctgaaatagttataacccaaggaagagattttcctaaagaatgtccctttagagaaataatgaccagttccctc

SEQ ID NO: 270695 - DNA, 813 bp, Homo sapiens
ggctggggggggagacaagatggcggctgcgggagggggtcctcgcttctcagctcccccgctcacccgccttctccttccctgccgccgccctcgctccaggagagagctttcgcaccgcccccgccctgctcggtgcctgcacgactcccagaaagtcgcgtctcccctaacccccatgcccaggacctgaggacaaaggtctagcgattgtccatcccctcccccagtgaggacagccgggaaagacctgcctttgttgtgtacaggtggtatctcactgtgttatccagactggactcaaatttctgggctccaatggtcctctcacctcagcctcccaagtagtcaggactacagaactccatggcaatgttttgaggattaaagaggagagtgatgactatccaaacgtcagagaacgcaactatgagactagagacactggaaaactaaaaaagtaacgggcctttgctgactcagggagatgatttcccaagagggaagaaaactggaacctgagaaataagtgatttagtaatgtggctgctaaaatacggaaaaactagaatgaatggcttacacatttttgaaatgaagttagaagagggttatactgtgaagaagaatgaaaaagccaaacatttcattcaggtaagcatatcacataggagaaactctaggtgactttggtttggcagtgagtttttagatacaacaccaaagcacaatccataaaagaaaagaaagatagataagttggacttcattaaaatgaaaaacttctgctctgcaaagacactgttaagagaa

SEQ ID NO: 270696 - DNA, 597 bp, Homo sapiens
ggctggggggggagacaagatggcggctgcgggagggggtcctcgcttctcagctcccccgctcacccgccttctccttccctgccgccgccctcgctccaggagagagctttcgcaccgcccccgccctgctcggtgcctgcacgactcccagaaagtcgcgtctcccctaacccccatgcccaggacctgaggacaaaggtctagcgattgtccatcccctcccccagtgaggacagccgggaaagacctgcctttgttgtgtacaggtggtatctcactgtgttatccagactggactcaaatttctgggctccaatggtcctctcacctcagcctcccaagtagtcaggactacagtgttgctgtcctcattttacagatgaagaaactgaggccccagatcacagggctggtgagaagaacgtgatatctccagagctaacacttaactactatagtgtaccacacaaggagagagcagcattagagaggggtgccacttcctctgatggaagataaaaaagaaagattgccagcctgggcaacatagtgagaccctgtctctacaaaaaataaaaataaaaaaattaaaaa

SEQ ID NO: 270697 - DNA, 607 bp, Homo sapiens
tttcctggcttcctttcctccctgtctccctggcctacccttcctcttccctcagctgttccttccctttctctccagtgaagactaagggccaagcatgagcctttcttcctgctcttttacccttgaggcagcaggagaggatattcacctcctgacatgacagattctgacgctatctgctcctctgtgactttgggaagcggggtatgtgctgctcctgggctgatgggggaaagtgcctctcccagcaatgctggtgccacttggtgtgctacggccccccagggcagtgcggagccatctgggacagttagacaatgagagacgtgaagccatttcaaggtgcttccttgaaaatgctccagaaaaacagcagaggcggcctctctggggatccggtccagcccttgaaaagaatctgtttgtttcaccactgaactcaaataagccaacagattgaaggaagggagtttccacgcgcccctccccaccaagcagttacctgagttccagagtccagtccgatggatcccattttaccctggtttaaattgtttccttagaaaaaaataaacagaacctcttctctcactctccagtggaa

SEQ ID NO: 270698 - DNA, 468 bp, Homo sapiens
tgtaacaaaatttgatttgaactacctataaatgaaaagtcggggtttattactttatatgtaatgctgagaggagactgttgggaacagttatgtcaatgagcaaactagaaattggcttcaaagtctgatacttttaaaagcatgtgttttgtgtatatgctcacaaaatgtctgtgaagagatttctttcagcttttgctcagctttatggtggggtgtactgttttatctgggcggtgagggtattgatttacataaaaactgtagacaaacacagtacgagtctcagcacgttttgcatttattgtactgcccaaattgtttttatgttaaaagtcacgtttcataatctgcaatatttttgtcaaagtgcacactgtactttcttcttaaaaacgtgattaaagagatcactttgtccggatgaagcagctgttggcattatccgctgaggcttgaacacca

SEQ ID NO: 270699 - DNA, 419 bp, Homo sapiens
agtccataaaatattgcacctgataacagtgtctgtggatgtctgtagccttgggacatgcggtacaagtttaatcagtgatttatagtgaatgtctacttttgttttgctggagagggctgtcgtctgagtattgtggtcagttccccaggtgttccatagtctatgattcattccccaaacacagccctggacaagagagctcagcggcactccccttgttgtcaacacttcacacaagccatcttacctcacagctgaacaattacacatgtgtagaaggctccactgtgagaggacacctgagagcttgtgcctggattctccagggcttcactccttgtgccttttgtctttacttattttaaattgtatcatttttctgtaataaactgttcctgtgaatagaacagttatga

SEQ ID NO: 270700 - DNA, 623 bp, Homo sapiens
agatcactcccaagcggattggagattgtcccaatacttagacctatagcaaggccttgggagaaatggtggtgcagcaggagagcaggaacctaaccattgccatcctaaggccctccattgtgcggagcaacgtggcaccagcttttcctgggttgggttgataatctaaatggatgtagccgactcattattgcggtatgtatagggatgaagaagtaactgtaatgtagtggaggaatagtaagaaaattcttagtgctggcttagcttcattgatccaaaaacataaatgctactttactatcaattgaagcatattatttcaattattctggttataatatggaggcaggatgaaattgtttttattcttttagaattttttttatcaggaaaacagaggtaaagtgctatcaattactatttaagagttctattttgaaaagtctttaataaggatttttcttttctttttaaaaaagacttttttaaaaattaaaaataaaagaagcaaaagtcttaggaaaatgaggcaagtagccctgccactctatgtacagtaataacaatatctgtcccagttattatgtacaatattataaaaaatgtcgcagacagta

SEQ ID NO: 270701 - DNA, 710 bp, Homo sapiens
cattcatgactcctgctacaaacaacaatcctggccaaattttaattcttgcacaaactgcagaaaatagccaacgctttgccattgatctttgggatcttaatcatactgaattagatagttctatcggctggagtctcagtgcccttgtttgaaatttattaagattagacggcagatgttccaaagatacaacaattttctgaaatgtgtaaccaatggaaattttctttcttttagggttgggttgataatctaaatggatgtagccgactcattattgcggtatgtatagggatgaagaagtaactgtaatgtagtggaggaatagtaagaaaattcttagtgctggcttagcttcattgatccaaaaacataaatgctactttactatcaattgaagcatattatttcaattattctggttataatatggaggcaggatgaaattgtttttattcttttagaattttttttatcaggaaaacagaggtaaagtgctatcaattactatttaagagttctattttgaaaagtctttaataaggatttttcttttctttttaaaaaagacttttttaaaaattaaaaataaaagaagcaaaagtcttaggaaaatgaggcaagtagccctgccactctatgtacagtaataacaatatctgtcccagttattatgtacaatattataaaaaatgtcgcagacagta

SEQ ID NO: 270702 - DNA, 824 bp, Homo sapiens
  misc_feature (528)..(528): n is a, c, g, or t
  misc_feature (538)..(538): n is a, c, g, or t
  misc_feature (684)..(684): n is a, c, g, or t
ttctttgtctgcatttgtgaatataccacacatgatggtgtctctgagccgaccagattatggaaactcaattgtcagaggacccaaaacaaaacttagagtgatttggatattgcctctctgtcaatgctgaaccttaagacattttaagtaaacatcctcctcctctctaccccccaggatttgtgcgttcaccccacccaagacttcaggaagtgtcatagcactcgtggactaggtttcatgggacaaaggcattctgcaagaagtagaagcttgtggccgggtgcagtggctcatgcctgtaatccaagcattttgagaggccaaggaggtggatcaattgaggccaggagtttgagaccagcctggcaacatgggagaccccatctctactaaaatacaaaaattagtgagcatgttgacacacgcccgtaatcccagctactcaggaggctgaggtgggagaatcgcttgaacccaggaggtgcaggttgcagtgagccgagatgcgccactgactctagnctaagcaatngagcaagacctatccaaaaaaaaaaaaaaaaaaaaaattttgggggggcgggccggaaagttttaaacatctgtgggccggccctagtaatggaacgtgcagctgtgcagagatcggctgaggggggttcccccaaaaagccgggnacggggttcgaccatcaagggtccggtcctcgtcccacagtcagacctactccccccgcggcgcgcggattaaaaaccaaaaaaaagagacagaagaaaccaagaatacgaaaagaaaaggaacaacacgatagagacgg

SEQ ID NO: 270703 - DNA, 1401 bp, Homo sapiens
catctgccagccaagaaacaaatttaagtcccacctagtttagttcctacagaaatgggtaggaataggctaggcatggtgtttcagacctgtaatttcagcattttgggagactgagttgggaggattgcttgtgtaacatttagtacttaaccatatgtaattatgaatgcaagttttttgtcctaggtgcaagattatatttatttgagcgtatcaagtgaacaagtttacatttaaaggcaaaagttacaggtcagcactggcaacatagcgagaccctatatctacaaaaaattaaaaaaattagctgggcgtcgtggctcatgactgtggtcccaaatactcaggaggctgaggcaggaggatcacctgagcccagaagttcgaagattgctatgaatgtgccagtgcactctagcctgggcagtagagggagacgatgtctcaaaaaaaaaaaaaaaaaaaagtatgggaatcatttaatcatcttgttagatgcctgatcttattacttattaggactaattattaagaaattaaagcacaactcatttgctgttgtcttcagcgtagttggtgactttggaaggtggcagatttagcccagtgattgtcgtcttttctcaaaatgttttcagaactccttttttactattacaacaacataatatccattgttggaataagcatatcattccctttaaagtcatactctcagtcgtgatattaattctggtatatttattaaagtcagctcgtgctttactctttttagaagtattcaacttccataggctaacattgccccaacaaagtaaaaatataggtcacgagaagggcatcttttactgaatccattttgctagatttcgtgtgagctgtttctgaagtctcccaagaaaattttctgaaatttcttgaatttttaaatatgctccttttcgatgaccttttgatagttatatccttctttaaatctgacctacagtaacattacctttctaaagaacagaaatccttggtgttgggggaggagcggcttttatatagttgcttatgaggtttgttttgtttttttcctaaggaaggctgggttgcttttgtgattttatctgtttcaaatggttaatattcagttccattcacttctcctgtatacagcttcataaaggtagatgagatgaaccttagaacatacaatctttttctgcagacagaatttcttaatcattacataaacgttattctgaaaagttttcagtaatttcatggccctccccaatagtaactttcagtatttatactgaatagctctttgcaactagcctaaaagagtcctttatttttgttcttttttctctcttatctgtggagattgaaaatatatagccatccttc

SEQ ID NO: 270704 - DNA, 391 bp, Homo sapiens
tgtcacatataattattatggcgggatcagtgattttatatagttgcttatgaggtttgttttgtttttttcctaaggaaggctgggttgcttttgtgattttatctgtttcaaatggttaatattcagttccattcacttctcctgtatacagcttcataaaggtagatgagatgaaccttagaacatacaatctttttctgcagacagaatttcttaatcattacataaacgttattctgaaaagttttcagtaatttcatggccctccccaatagtaactttcagtatttatactgaatagctctttgcaactagcctaaaagagtcctttatttttgttcttttttctctcttatctgtggagattgaaaatatatagccatccttc

SEQ ID NO: 270705 - DNA, 460 bp, Homo sapiens
ctaaagataaatttggtatcctatgaactatgttttccgtcaaggtttgcacaacggcataaaacaatccatcacatttttctggccaatagatacatgctttatttctgaatgtcaacgtttaagagactgaagtctgtgactactgttaattttgctagtaaaaataagttctccctgattttggttattatccattgaagatgttatcttcaatagttatccatgcctatgtcatgatatcttcacttcttcccaaatattatcttcctcagatattcaattgtgaatgaaaagtcaagctccttgtccatttttactgtacctcagccttcaaaggcctaaattaccatttcatttctgttgctgatcatcagcaactagaagacagaatttggatattctcacaccaatgtactattgctgcagaaatcctttgggctaactgagaggaccgaaa

SEQ ID NO: 270706 - DNA, 977 bp, Homo sapiens
caagcccctgggagcaggtgtgggagctccgggccagccctggcacgggcacctcccaggatgttcgtaagacacacgcttcctgcccgcgcatcttgccctgtggcctcaggacagccggtccgagggagggcaggtgcagcagccacgtcccagtcgctgcggcctggcttctccaggtgcagctcgccctccttgcacctgcagcgcggaaggcagagccaaaaggcgccccctgggctcccggagctctgagccacttcaggagttcgggcatgtggggttttgtctccggttttagtctggccatgtttgttggttccaattcctatgctctgttacctgaacctgtttgattcttttgattttcttctttctgaaaaagacttttcacggtttcctattctgcctttcttccgtatgcctctcaacgggacgagcagctgaaattaaaaagatagtagcaggtacgaacccaaaggagtgtgctgaagtcaagagcctgtctggcgggccacagacctgagcgcagcccctcggtggcacacctgccccagggacagccctgcatggggacacgtgtcaggccccagacctgcgcacgcacccaggctcagccacagcccctcaggcagggtcccgatgcccactctgctcccttgtgttacaaatgccgtggtccttctcagccctgctgtggccttgcctgtcatcagagggcagctggtctctgcaagcgtctgagtgcaggctgcttagggcaccagccaaggggggatgctgcctgcactgctgcctcatgggccaccttgacagatctgcatgggtctcaacaggtgggtggcttcgtgccttctgcagcccagtccccgtggtcttggtgggctctggctgtaggaacagcctgtctcctccacggtgcttcacatgtgtcccacgtggcttctggctggacgtggcatggctccttcccccct

SEQ ID NO: 270707 - DNA, 471 bp, Homo sapiens
tgccctcgtcaggaggcccagcatgtagcaggcaagcagcaggcagcaggcaggtgctgagtgggtgtggaaggtgtggcccctcacacctctgtgtcctatgctcagcgctgtgcttgggcatggcgaggcctcagcagatactgtgcagcacagtgacaccaatggaacccagtaaaaagacagtttccaattttcctcgctgctggggcccacccagatcctggagcagagcatggcctgcaggaagcacaggctggtggactgtggctgtgtcacggcgagcttccagtggctctcgcagaactcaattggcacggtaaagggacaaatgaagtttccagcttttttcttttaatagctcagatatcaattttatagctctgatggacataatttataaaataagtctatatcttactgtaaatttgagacggttaacctttaataaagttaagaaggggcttgtca

SEQ ID NO: 270708 - DNA, 432 bp, Homo sapiens
ccatactgtgggcagcttttcccaagatgatggaacataactccccatcctaatgacactcttgcccctcttaattcttccttgtttatgcctacctctttgatttggcaggataatttcacaatcggtagatattgtgggtgacttgacagaatctgacttcataaatcctttagtccacccagggggtaatactggcaacatcctcagtaaactttttgttcaaattgtactaatggtcttttttaaaacagagttagctctctctgctttaattcaagccagtcatggaatgctaagtaataggattgctgtgtaccagctaaacaaagagatgtctgtgcttttgctcatactacatgctgtacctggatacattcctttggggaatttatatacacaaaataagaaaatagcccacatggtaaaaaa

SEQ ID NO: 270709 - DNA, 313 bp, Homo sapiens
cagtgtgttactatcttttactggattgtgatgctttaaatatccaagattttgtcattaagctagcttctgtggccttttgacatgacaacatcattctttgagcatgtcattacttcctggcacaagaagatattccaggctcatatgtgctttccctgccccaagcctggaatcagtcatttctcttagggtacctggttctttttagtgtagaatgatatttagatttgggtgctatggtgatgttaatacagatgcttcttcacttaaaataagattacgtcccaataaatccatcgtaaattgaaaa

SEQ ID NO: 270710 - DNA, 442 bp, Homo sapiens
tgtccatttatttccctgtctctcatacagacatgaatgccacccagtcccacataaacccttttactttatgtattattcttatcattttattcatgattttattacatattgcgttttatctatttgttttacttctttgtattttcgtagcaccttctacaggctattgtatagtgacatgtttttatagtgctaaaccgaagctatgtctgcctcctaaaggttgtttatgaaactatcattcattgttcacacgcagagtcattcaataatatttcatataaaacctccaagaccagtctatataatgaatgctgtaaaaaatatcatggaatgttctacctgtgggggggaggaaaaccacaaactactgttaaagttagaatactgcatgaaaataaaaactttttttctacattaaatgaaactaaaatgaaag

SEQ ID NO: 270711 - DNA, 402 bp, Homo sapiens
gagaggacatcaaagttggattctgaaagacaaatgggaatttaatgcaaataagtactcatacatggaagtatgcaaaatgtagtagggaaactataagcaattcagtgttcctaaagcataaattataggggcagttaaggaaggtggggaatgaaatttggtaagatgagaaatatttaaaaggccagatcatgaagggctttgtaatccacgttaaggagcgtggattccattttgaggcagcagggagctaacgaatgttttaagcagtgcagtgatttgacatgacccttggattttaatgaaagatcacttttgctagaatgtggaagatagtgcttgcatataagattaagttaaccagtctgtttaattcacttgattataatctttagaatt

SEQ ID NO: 270712 - DNA, 170 bp, Homo sapiens
tgtgtgacactgagccagtcatttaacttctccagggctcagttttctcatctgaaacaaagagacaatgattatatataactcagagtgtggttgtgagtatcagtgagttaatacttaaaaaataacatatatttgttgtacaataaaaggtgccaaagagataattt

SEQ ID NO: 270713 - DNA, 372 bp, Homo sapiens
ctattttttattattattattttttgagatggagtctcactctcttgcccagctggaatgcaatggtgcaatcttggctcactacagccttgacctcctgggctcaagcaatcctcctgcctcagcctcccatgtagctgggactctaggtgtgtgccaccatgcccagcgaatttttttattttttgtagagacaaggtttcactatgtttctgggctggtcttgaactcctggcctcaagtgatcctgtctcagcctcccaaaatacttggattacaggcatgggctagtggctcagccacttccatatatattttagaaacagcattgctgaaacgtatttaaattaaaaactttattgatattttggt

SEQ ID NO: 270714 - DNA, 498 bp, Homo sapiens
gttcaaaacttagtaaatggtaaaaaaaaaaaaatgaataaatgacttaaataagctaggtgcggaaatatcataagctaggtgcggtagctcacacctgtaatctctccagtttgggaggctgaggcaggtgaattgcttgggcttaggagtttaaggccagcctggacactgggcatggtggctcacgcctgtaatcccagcactttgggaggctgaggcaggcagatcacctaaggttgggagttcgagaccatcctgaccaaccccatctctactaaaaatacaaaattagccaggcatggtggtgtatgcctgtaatcccagctactcgggaggctgaggcaggagaatcgcttgaacctgggaggcggaggttgcagtgaaccgagatctcgccattgcactccagcctgggcaacaagagcaaaactccatcccaaaaaaaagaagaccagcctgggcaacatggtgaaacctcatctctacaaaaaaata

SEQ ID NO: 270715 - DNA, 448 bp, Homo sapiens
tagtagaattttcttttgttcgtctaagaatcaattgattcttaattctaagcttgaagtgtaactgcatttttatgggcaaaacaatcctggacctggccagtaacccaaccaaaccaggggcagaggagatgctggtcagccagaggatacaggggaagaacagaaaaggcataacaagagggaagaagaggtgactggagaaagagagacatattcacgccacagaaagaaaacaataaaaagtcatctgatttcctcatactgagtagctccccatgtgattcgggtgttgtgggtactcatgtcctggtgactgtacctcccagctcaagctgccaatcacggtattttccctaaaatgttcccttcccaaaatggaaacctcatgttcgttgtcaagataataaaagttgcacattagcggcacatttacaatcttgctaaa

SEQ ID NO: 270716 - DNA, 672 bp, Homo sapiens
actcagagttcagctgactctctcctgtcccttaagattagtgtgtgtccctaaaactgtaacctggggtagtagagaaccttctccaatgtctgcacagtcactaagggcttccttcttgggtcccttctggctgaaggctcctttgagcttttctggattctactttctatcacatcaccttctgccagtgcctttccacacatcattctgaggttaccaaatctaagggctactttaaaagacagaggtaaagttttaaatatacagatggaaggtgttttcacatgacaaaaatgtaaaccatttgtttctaaacatgaagaacctcttaagattttagttagcttcccactaccactaccaacagccctcacacaatatgatctcactgggtctttttttttttccatgtctctctcacttatagtttttctcttatttggtataggaaagaaaacaataaaaagtcatctgatttcctcatactgagtagctccccatgtgattcgggtgttgtgggtactcatgtcctggtgactgtacctcccagctcaagctgccaatcacggtattttccctaaaatgttcccttcccaaaatggaaacctcatgttcgttgtcaagataataaaagttgcacattagcggcacatttacaatcttgctaaa

SEQ ID NO: 270717 - DNA, 353 bp, Homo sapiens
tggtgggccaggctggccgtgtcccaggggccaagccccatgctgggctgttctaacaagaacttgaactgaaccgaaccatgacccccaaattggaaaacactgccctgattcactgaacccgaaaccgaatccaagtattattattttttgactgaactctgaattgaactaatgttttttcttaaatacctaccaaaccagttcgaactagacacaaacatatgtgttttctgaaactattgaacctgaacttcaaaataatctcctatccgagggcaaagtgagactttatttacttgagagtgttctgttcacagcaggccaataaagcctcctttatggcagaagta

SEQ ID NO: 270718 - DNA, 497 bp, Homo sapiens
caaaaaaaaagctaagcaataatacaaatgcatatgaaaatataaattgtagtatgaaagctaaacataaagacaaactcagaaaattgtaatactgtaatcatgcaccttaacatttaatacttacataaattagaaaacagaagtagtcagaataactgtatccacaaatatttttcaatttaaacataatatagaaagaagcaatatctggctgtgtgaggtgactcacagctataatgccagcactttgggaggccgagatgggaggactgcttgagcccaggagtttgagaccagtatgggcaacatagggagagctcatctctattaatttttttaattagccaagtgtgctggtgagcaccagtggtcctagctactcaggaagctaagtagagaggatcccttgatcccaagagttcagtgctgcagtgagccataattgcaccactgcactccaacctgagtgacagagtgacaccttgtctctcaaa

SEQ ID NO: 270719 - DNA, 376 bp, Homo sapiens
ctcacagtatatttattatttatgttgagacaaaatagtagctttagaaacctggaagacaccacctcaaccaagtaaccccacagaacatcagcgataatggacagatggacattgtgtggctcctgatagggagcactgagatgggctcaacatcgtgcctgtgttatttccctcaaaaatgcataacctcagtgcaatcacgaggacatattaggtaaccctcaagtatgagggatattctacaaataactgactagtaatcttcaaatgtcaaaattatgaaagaaaaaaagaaaccaaggaatagttccagaatagaggggagtaaaaaacaagcaaaataaaacaatgaaacaattaaatgcgacatgca

SEQ ID NO: 270720 - DNA, 307 bp, Homo sapiens
ggtagttatcatttttattacccacctttatcttctccatcctcataactaggatggagacactgaggctcagagaggacaggttgcttgctcaagaccatatagctcctaagtaccagagtcaatgtttgaaccgagtcttacctgaagtaggagaattatctcagcatgactttgaaactctttctgtgagctgcccaatatgttttgcctgggcactttgactacagtgagatttctggttagtattgtgaagcagttaaataacttaaatttacattaaacatttctggttttactttgatga

SEQ ID NO: 270721 - DNA, 511 bp, Homo sapiens
agtagctaacagaactacttgagttgactacagagtcgtgccatgatcatcattacctgttttcagaacattttcatgatctcaaaaaggaaactcagtatcctttagtagtcacatcccattccccattctctctagtgcctaacagatatgaagaagctatcagatcaactgtcccagtagaacagtgtttgttcaatactggctccaatatgtaagagtagagatgctgaaaattcagatgtgcaatggagaaaccttaaagtgtttcctttaagtgaaaatgtgaaagttcttcacttaataaggaaagtgaaactgaagaaggaaaaagaaattcttgctaattttgctgctgcacctcaaactgcaaaagttacagccatagtgtgaaaagtgctaacatagggtgtggtattatctgtggtttcaggcatcaactggagatcttgaaaagtatgcccacagataagggagcctactatagtctttttatgccaattccaatatc

SEQ ID NO: 270722 - DNA, 6814 bp, Homo sapiens
gaggcgcggcggcgcatgcggatcaggctgagccgcgggccggcggggccgagctgagccgggctgggccgggccgggccgggccgggcagcggacgccgacagggagggcggtcggtcgcggcgagcagcggagacagcgacgctggcggccgcgggcccaggcctcaccttccccgatggcgcaggtaccaggggaagtggacaacatggagggcctgcctgctcctaacaacaaccctgctgcccgctgggagagtccggatcggggctgggagcgggagcagccggctgcgtccaccgcagcggcctcgctctttgagtgctcccggatcaaggccttggcagatgagcgggaagccgtgcagaagaaaaccttcaccaagtgggtgaactcgcacctcgcccgcgtgggctgccacatcggggacctctatgtggacctccgggacggcttcgtgctcacgcggctcctggaagtgctgtctggggagcagctgcccaggcccacgcgcggccgcatgcggatccactcactggagaacgtggacaaggcgctgcagtttctgaaggagcagcgcgtgcacctggagaacgtgggttcgcatgacatcgtggatgggaatcaccggctgacgctggggctggtctggaccatcatcctgcgcttccagattcaagtcatcaaaattgagactgaggacaacagagagacacgctcagccaaggatgctctgctcttgtggtgtcagatgaagacagctggttaccctgaggtaaacatccagaatttcaccaccagctggcgggatggcttggccttcaatgccctcattcaccggcacaggcctgatctcgtggacttcagcaaactcaccaagtccaatgccaactacaacctgcagagagccttccgcacagctgagcagcacctggggctggcgcggctgctggatcctgaagatgtgaacatggaggctccagatgagaagtccatcatcacctacgtggtctctttctaccactatttctccaagatgaaggctctggctgtggaggggaagcgtatcgggaaggtcttggaccaggtattggaggtggggaagatcatagaacgctacgaggagctggcggctgagctgctggcctggatccaccgcaccgtgggcctcatcagcaatcagaaatttgccaactccttaagtggggtgcagcagcaactccaggctttcacggcctattgcacgctggagaagcctgtcaagttccaggagaaggggaacctagaggtgctgctcttcagcatccagagcaaactgcgtgcctgcaaccgtcgcctctttgtgcctcgggagggctgtggcatctgggatattgacaaggcatggggtgagctggagaaggctgagcatgagcgggaggctgccctacgggctgagctgattcggcaggagaagctggaactactggcacagaggtttgaccacaaggtggctatgagggagagctggctgaatgagaaccagcgtctggtctcccaggacaactttgggtatgagctgcccgcagtggaggcagccatgaagaaacacgaagcgatcgaggcagacattgcggcctacgaggagcgggtgcagggtgtggcggagctggcccaggcattggcagccgaaggctactacgatatccggcgggtggcagcccagcgtgacagcgtcctgcgccagtgggccctgctaactgggcttgtgggtgcccggcggacacgacttgagcagaaccttgccctgcagaaggtcttccaggagatggtgtacatggtggactggatggaggagatgcaggctcagctgctgtcccgggagtgtgggcagcacctggtggaggcagacgacctgttgcagaagcatggactgctggagggagacattgccgcccagagcgagcgggtggaggctctcaatgccgctgccctgcgcttctcccagccctgcgacccgcaggtcatctgcaaccgcgtgaaccacgtgcacggctgcctggcggagctgcaggagcaggcagcgcggcgacgcgcggagctggaggcttcgcggagcctgtgggcgctgctgcaggagctggaggaggccgagagctgggcgcgcgacaaggagcgtctcctggaggctgcgggcggcggcggtgcggcgggcgcagcgggcgcagcgggaacagcgggcggcgcgcatgacctgtccagcacagcgcgcctcctggcccagcacaagatcctgcagggcgagctgggcgggcggcgagcgtcgctgcagcaggccctgcggtgtggcgaggagctggttgcggccggcggtgccgtcggcccgggagcagacaccgtgcacctggtaggcctggcggagcgcgcggcgagcgcccggcgccgctggcagaggctggaagaggcggcggcgcggcgagagcggcggctgcaggaggcgcgggcgctgcaccagttcggcgctgacctcgacgggctgctggactggcttcgcgacgcttaccgcctggcagccgccggtgacttcggccacgacgaagcttccagccgccgcctggcgcgccagcaccgcgcgctcaccggggaggtggaggcacatcgcgggcccgtgagcggcctgcggcgccagctggcgacactcgggggtgccagtggcgcagggccactggtggtggcgctgcaggtgcgcgtggtggaagcagagcagttgttcgctgaggtgaccgaagtggcggcgctgaggcgccagtggctgcgggacgcgctcgctgtctaccgcatgtttggcgaggtgcacgcgtgtgagctgtggatcggcgagaaggagcaatggctgctctccatgcgtgtgccggattcactcgacgacgtcgaggtggtgcagcaccgattcgagagcctggaccaagagatgaacagcctgatgggccgcgttctggacgtgaaccacacagtccaggagctggtggaaggaggccaccccagttcagatgaggtgcgttcctgccaggaccacctcaacagcaggtggaaccgcatcgtggagctagtggaacagcgcaaagaggaaatgagcgcggtgctgctggtggagaaccacgtgctggaggtggccgaggtgcgcgcccaggtgcgtgagaagcggagagctgtggagagcgcgccccgggccggcggcgccctgcagtggcgtcttagcggcctagaggccgctctgcaggcgctggagccgcgccaggcggcccttctggaggaggcagccctgctggctgagcgcttcccggcgcaggcggcgcggctgcaccagggcgcggaggagctgggcgccgagtggggcgcgctagctagcgcggctcaggcctgcggcgaggcggtggcggcagcagggcgcctgcagcgcttcctacatgacctcgacgctttcctggactggctcgtgcgcgcccaggaggcggcgggcggcagcgaggggcccctgcccaacagcctagaagaggcggacgcgctgctggcgcgccacgctgcgctcaaggaggaggtggaccagcgcgaggaagactatgctcgcatcgtggcggccagcgaggcgctgctggccgccgacggcgcagagctgggcccgggcctggcactagacgagtggctgccacacctcgaacttggctggcataaactgctcggcttgtggaaggcgcgcaggaaggcgctggtccaggcgcacatctaccagctcttcctgcgggatctacgccaggcgctcgtggtgctgcgtaaccaggagatggcgctgtctggtgcggagctcccgggcacagtggaatcggtggaggaggccttgaaacagcaccgtgactttctcaccaccatggagctgagccagcaaaagatgcaggtggccgtgcaggctgcagagggcctgctgaggcagggcaacatctacggggagcaggctcaggaggctgtgacccggctgctggagaagaaccaagaaaaccagttacgggcccagcaatggatgcaaaagctacatgaccaacttgagctgcagcacttcctccgagactgccacgagctggatggctggatccatgagaagatgctgatggcgcgggatggcacgcgggaggacaaccacaagctgcataagagatggctccggcaccaggcattcatggccgagctggctcagaataaggagtggctggagaagatcgagcgggagggccagcaactgatgcaggagaagcccgaactggcggcctccgtgcggaagaagctgggcgagatccgccagtgctgggcggagctggagagcaccacccaggccaaggcacggcagctctttgaggccagcaaagcagaccagctggtgcagagctttgctgagctggacaagaagctccttcacatggagagccagctgcaagacgtggaccctggaggagacctggccactgtcaacagtcagctcaagaagctgcagtccatggagtcgcaggtggaggagtggtaccgcgaggtgggagagctgcaggcgcagacggcggcgctgccgctggagccggcgagcaaggagctggtgggtgagcggcagaacgcggtgggcgagcgcctggtgcgcctgctcgagccgttgcaggagcgccgccgcttgctgctggcttccaaggagttgcaccaggtggcgcacgacctggacgacgagctggcatgggttcaggagcggctgccactggccatgcagacagagcgaggcaacggtttgcaggcggtccagcagcacatcaaaaagaaccagggcctgcggcgggagatccaggcgcatgggccgcgcctggaggaggtgctggagcgcgcgggcgcgctggcgtcgctgcgcagcccggaggcagaggcagtgcgccggggcctggagcagctgcagagcgcctgggccggactgcgggaggctgccgagcgacggcagcaggtgctggacgccgccttccaggtggagcagtactacttcgacgtggctgaggtggaggcgtggctgggcgagcaggagctgctcatgatgagtgaggacaagggcaaggacgaacagagcaccctgcagctgctcaagaaacacctgcagctggagcaaggcgtggagaactacgaggaaagcatcgcgcagctgtcgcgccagtgccgggcgctgctggagatggggcacccggacagcgagcagatcagccggcggcagtctcaggtggaccgcctgtacgtggcgctcaaggagctgggtgaggagcgccgggtggctctggaacagcagtactggctgtaccagctcagccgccaggtgagcgagcttgagcactggattgccgagaaggaggtggtggctggctcacccgagctcggccaggactttgagcatgtctcggtgctgcaggagaaattctcagagtttgccagcgagacaggtatggcagggcgggaacggctggcagctgtgaaccagatggtggatgagctgatcgagtgtggccatacagcagcggccaccatggccgagtggaaggacggactgaacgaggcctgggctgagctgctggagctcatgggcacacgggcccagctgctggccgcctctcgggagcttcataagttcttcagtgacgcccgagagcttcagggacagattgaggagaagcggaggcggctgccccgcctgaccaccccgcctgagccgagacccagtgccagttccatgcagcggaccctgagagcctttgagcatgacctgcagctcctcgtgtcccaggtacggcagctgcaggagggggcggcccagctgcggacggtgtatgcgggtgaacatgccgaggccatcgctagccgggagcaggaggtgctgcagggttggaaagagctgctgtcagcctgtgaggatgcccgcctgcatgtcagctccacagccgacgccctgcgcttccacagccaagtccgcgacctgctctcctggatggatggcatcgccagccagattggggcagccgacaagcccagggacgtgtcatcagtggaggtgctcatgaactaccaccagggcctgaagactgagctggaggcgcgggtgcctgagctgaccacctgccaggagctggggcgatctctgctgctcaacaaaagtgccatggctgatgagatccaggcacagctggacaagctgggaaccaggaaggaggaggtgtcggaaaagtgggaccgccattgggagtggctgcagcagatgctggaggtgcaccagtttgcccaggaggcggtggtggctgatgcctggctgacagcccaggagccgctcctgcagagccgggagctgggcagcagcgtggatgaggtggagcagcttatccggcgacatgaggccttccgcaaagcggctgcagcctgggaagagaggttcagctctctgcggcgcctgaccacgcctaggcgggaggatcacttgaacccaggagttcaagaccagccttggcaacatactgagaagccgtctctaccaaaaccaaaagcaaacaaagaaaaaacagccaggcgtgatggcacgtgcctgtagtcccagctactcagaggggtgactgagactcgaggatcacttgagcactggaggtcaaggctgcaatgagctatgatcttgctgcttgcactccagcctgggcgacagagcaagactgtctcaaaaataaataaataaataaataaataaataaataaataaataaataaagtcttaaagtcctgg

SEQ ID NO: 270723 - DNA, 8833 bp, Homo sapiens
gaggcgcggcggcgcatgcggatcaggctgagccgcgggccggcggggccgagctgagccgggctgggccgggccgggccgggccgggcagcggacgccgacagggagggcggtcggtcgcggcgagcagcggagacagcgacgctggcggccgcgggcccaggcctcaccttccccgatggcgcaggtaccaggggaagtggacaacatggagggcctgcctgctcctaacaacaaccctgctgcccgctgggagagtccggatcggggctgggagcgggagcagccggctgcgtccaccgcagcggcctcgctctttgagtgctcccggatcaaggccttggcagatgagcgggaagccgtgcagaagaaaaccttcaccaagtgggtgaactcgcacctcgcccgcgtgggctgccacatcggggacctctatgtggacctccgggacggcttcgtgctcacgcggctcctggaagtgctgtctggggagcagctgcccaggcccacgcgcggccgcatgcggatccactcactggagaacgtggacaaggcgctgcagtttctgaaggagcagcgcgtgcacctggagaacgtgggttcgcatgacatcgtggatgggaatcaccggctgacgctggggctggtctggaccatcatcctgcgcttccagattcaagtcatcaaaattgagactgaggacaacagagagacacgctcagccaaggatgctctgctcttgtggtgtcagatgaagacagctggttaccctgaggtaaacatccagaatttcaccaccagctggcgggatggcttggccttcaatgccctcattcaccggcacaggcctgatctcgtggacttcagcaaactcaccaagtccaatgccaactacaacctgcagagagccttccgcacagctgagcagcacctggggctggcgcggctgctggatcctgaagatgtgaacatggaggctccagatgagaagtccatcatcacctacgtggtctctttctaccactatttctccaagatgaaggctctggctgtggaggggaagcgtatcgggaaggtcttggaccaggtattggaggtggggaagatcatagaacgctacgaggagctggcggctgagctgctggcctggatccaccgcaccgtgggcctcatcagcaatcagaaatttgccaactccttaagtggggtgcagcagcaactccaggctttcacggcctattgcacgctggagaagcctgtcaagttccaggagaaggggaacctagaggtgctgctcttcagcatccagagcaaactgcgtgcctgcaaccgtcgcctctttgtgcctcgggagggctgtggcatctgggatattgacaaggcatggggtgagctggagaaggctgagcatgagcgggaggctgccctacgggctgagctgattcggcaggagaagctggaactactggcacagaggtttgaccacaaggtggctatgagggagagctggctgaatgagaaccagcgtctggtctcccaggacaactttgggtatgagctgcccgcagtggaggcagccatgaagaaacacgaagcgatcgaggcagacattgcggcctacgaggagcgggtgcagggtgtggcggagctggcccaggcattggcagccgaaggctactacgatatccggcgggtggcagcccagcgtgacagcgtcctgcgccagtgggccctgctaactgggcttgtgggtgcccggcggacacgacttgagcagaaccttgccctgcagaaggtcttccaggagatggtgtacatggtggactggatggaggagatgcaggctcagctgctgtcccgggagtgtgggcagcacctggtggaggcagacgacctgttgcagaagcatggactgctggagggagacattgccgcccagagcgagcgggtggaggctctcaatgccgctgccctgcgcttctcccagccctgcgacccgcaggtcatctgcaaccgcgtgaaccacgtgcacggctgcctggcggagctgcaggagcaggcagcgcggcgacgcgcggagctggaggcttcgcggagcctgtgggcgctgctgcaggagctggaggaggccgagagctgggcgcgcgacaaggagcgtctcctggaggctgcgggcggcggcggtgcggcgggcgcagcgggcgcagcgggaacagcgggcggcgcgcatgacctgtccagcacagcgcgcctcctggcccagcacaagatcctgcagggcgagctgggcgggcggcgagcgtcgctgcagcaggccctgcggtgtggcgaggagctggttgcggccggcggtgccgtcggcccgggagcagacaccgtgcacctggtaggcctggcggagcgcgcggcgagcgcccggcgccgctggcagaggctggaagaggcggcggcgcggcgagagcggcggctgcaggaggcgcgggcgctgcaccagttcggcgctgacctcgacgggctgctggactggcttcgcgacgcttaccgcctggcagccgccggtgacttcggccacgacgaagcttccagccgccgcctggcgcgccagcaccgcgcgctcaccggggaggtggaggcacatcgcgggcccgtgagcggcctgcggcgccagctggcgacactcgggggtgccagtggcgcagggccactggtggtggcgctgcaggtgcgcgtggtggaagcagagcagttgttcgctgaggtgaccgaagtggcggcgctgaggcgccagtggctgcgggacgcgctcgctgtctaccgcatgtttggcgaggtgcacgcgtgtgagctgtggatcggcgagaaggagcaatggctgctctccatgcgtgtgccggattcactcgacgacgtcgaggtggtgcagcaccgattcgagagcctggaccaagagatgaacagcctgatgggccgcgttctggacgtgaaccacacagtccaggagctggtggaaggaggccaccccagttcagatgaggtgcgttcctgccaggaccacctcaacagcaggtggaaccgcatcgtggagctagtggaacagcgcaaagaggaaatgagcgcggtgctgctggtggagaaccacgtgctggaggtggccgaggtgcgcgcccaggtgcgtgagaagcggagagctgtggagagcgcgccccgggccggcggcgccctgcagtggcgtcttagcggcctagaggccgctctgcaggcgctggagccgcgccaggcggcccttctggaggaggcagccctgctggctgagcgcttcccggcgcaggcggcgcggctgcaccagggcgcggaggagctgggcgccgagtggggcgcgctagctagcgcggctcaggcctgcggcgaggcggtggcggcagcagggcgcctgcagcgcttcctacatgacctcgacgctttcctggactggctcgtgcgcgcccaggaggcggcgggcggcagcgaggggcccctgcccaacagcctagaagaggcggacgcgctgctggcgcgccacgctgcgctcaaggaggaggtggaccagcgcgaggaagactatgctcgcatcgtggcggccagcgaggcgctgctggccgccgacggcgcagagctgggcccgggcctggcactagacgagtggctgccacacctcgaacttggctggcataaactgctcggcttgtggaaggcgcgcaggaaggcgctggtccaggcgcacatctaccagctcttcctgcgggatctacgccaggcgctcgtggtgctgcgtaaccaggagatggcgctgtctggtgcggagctcccgggcacagtggaatcggtggaggaggccttgaaacagcaccgtgactttctcaccaccatggagctgagccagcaaaagatgcaggtggccgtgcaggctgcagagggcctgctgaggcagggcaacatctacggggagcaggctcaggaggctgtgacccggctgctggagaaatgcctcattatccatcctgctcttctgcaccctccttgggaacccccatacctccccagatccagcagctagaggccaggcacaggaaccaagaaaaccagttacgggcccagcaatggatgcaaaagctacatgaccaacttgagctgcagcacttcctccgagactgccacgagctggatggctggatccatgagaagatgctgatggcgcgggatggcacgcgggaggacaaccacaagctgcataagagatggctccggcaccaggcattcatggccgagctggctcagaataaggagtggctggagaagatcgagcgggagggccagcaactgatgcaggagaagcccgaactggcggcctccgtgcggaagaagctgggcgagatccgccagtgctgggcggagctggagagcaccacccaggccaaggcacggcagctctttgaggccagcaaagcagaccagctggtgcagagctttgctgagctggacaagaagctccttcacatggagagccagctgcaagacgtggaccctggaggagacctggccactgtcaacagtcagctcaagaagctgcagtccatggagtcgcaggtggaggagtggtaccgcgaggtgggagagctgcaggcgcagacggcggcgctgccgctggagccggcgagcaaggagctggtgggtgagcggcagaacgcggtgggcgagcgcctggtgcgcctgctcgagccgttgcaggagcgccgccgcttgctgctggcttccaaggagttgcaccaggtggcgcacgacctggacgacgagctggcatgggttcaggagcggctgccactggccatgcagacagagcgaggcaacggtttgcaggcggtccagcagcacatcaaaaagaaccagggcctgcggcgggagatccaggcgcatgggccgcgcctggaggaggtgctggagcgcgcgggcgcgctggcgtcgctgcgcagcccggaggcagaggcagtgcgccggggcctggagcagctgcagagcgcctgggccggactgcgggaggctgccgagcgacggcagcaggtgctggacgccgccttccaggtggagcagtactacttcgacgtggctgaggtggaggcgtggctgggcgagcaggagctgctcatgatgagtgaggacaagggcaaggacgaacagagcaccctgcagctgctcaagaaacacctgcagctggagcaaggcgtggagaactacgaggaaagcatcgcgcagctgtcgcgccagtgccgggcgctgctggagatggggcacccggacagcgagcagatcagccggcggcagtctcaggtggaccgcctgtacgtggcgctcaaggagctgggtgaggagcgccgggtggctctggaacagcagtactggctgtaccagctcagccgccaggtgagcgagcttgagcactggattgccgagaaggaggtggtggctggctcacccgagctcggccaggactttgagcatgtctcggtgctgcaggagaaattctcagagtttgccagcgagacaggtatggcagggcgggaacggctggcagctgtgaaccagatggtggatgagctgatcgagtgtggccatacagcagcggccaccatggccgagtggaaggacggactgaacgaggcctgggctgagctgctggagctcatgggcacacgggcccagctgctggccgcctctcgggagcttcataagttcttcagtgacgcccgagagcttcagggacagattgaggagaagcggaggcggctgccccgcctgaccaccccgcctgagccgagacccagtgccagttccatgcagcggaccctgagagcctttgagcatgacctgcagctcctcgtgtcccaggtacggcagctgcaggagggggcggcccagctgcggacggtgtatgcgggtgaacatgccgaggccatcgctagccgggagcaggaggtgctgcagggttggaaagagctgctgtcagcctgtgaggatgcccgcctgcatgtcagctccacagccgacgccctgcgcttccacagccaagtccgcgacctgctctcctggatggatggcatcgccagccagattggggcagccgacaagcccagggacgtgtcatcagtggaggtgctcatgaactaccaccagggcctgaagactgagctggaggcgcgggtgcctgagctgaccacctgccaggagctggggcgatctctgctgctcaacaaaagtgccatggctgatgagatccaggcacagctggacaagctgggaaccaggaaggaggaggtgtcggaaaagtgggaccgccattgggagtggctgcagcagatgctggaggtgcaccagtttgcccaggaggcggtggtggctgatgcctggctgacagcccaggagccgctcctgcagagccgggagctgggcagcagcgtggatgaggtggagcagcttatccggcgacatgaggccttccgcaaagcggctgcagcctgggaagagaggttcagctctctgcggcgcctgaccacgatcgagaaaatcaaagcggaacagagcaagcagccgcctaccccactgctggggcgcaagttctttggggaccccacggaactggcggccaaggcggcgcccctgctgcggccagggggctatgaaaggggcttggagcccctggcccgccgagcctcggacacgctctcggccgaggtgcggactcgggtggggtatgtgcgccaggagctcaagcccgagcgcctccagccgcgcattgaccggctgccggagatcccggggagggtggagcccgcggccctgccggccgcaccagaggacgcggcggagacccccgcgacccccgcggcggcggagcaggtgcggccacgaccggagcgccaggagtcagctgatcgcgcggaggagctgcccaggaggcggcggcctgagcggcaagagtcagtcgatcaatccgaggaggctgcgcggaggcggcggccggagcggcaggagtcagcggagcacgaggcggcacacagccttaccctgggccgctatgagcagatggagcggcggcgcgagcggcgtgagcggcgcttggagcggcaggagtccagcgaacaggagatgcccatcagaggagacctggtcaaggggaaggccaccctggctgacattgtggaacagctgcaggagaaagaggcaggcccagggctgcctgctgggccgtcgctgcctcagccacgcgagcttcccccaggtcgcctgcccaacgggcttgagctgcccgagcggacacctcggccggaccggccccgggcgcgggaccggcccaagccgcgacggcggccgcggcccagagagggtggtgagggcgggggaagccggcgctcgcgctccgccccggcccagggcggctccgcccccgcgcctccgccaccgcccactcacacagtgcagcacgagggcttcctactgcgcaagcgcgagctcgacgctaaccgcaagtcgtccaaccggtcgtgggtgagcctgtactgtgtgcttagtaagggggaactgggcttctacaaggactccaagggcccggcatccgggagcacacacggtggggaaccgctgctcagcctgcacaaggccaccagcgaggtggctagtgactacaagaaaaagaagcatgtcttcaagctccagacccaggatggcagtgagtttttgctccaggcaaaagatgaggaggagatgaacggctggctggaggctgtagcttcctcggtggcggaacacgcagagatcgcccgctggggccagacactacccactacttcatccacagatgagggcaaccctaagagggaaggcggagatcgcagggccagcgggcgcaggaagtgacttcccacccccaggacctgacacatctcgtctcccctcttttccgcactgtgggcacaaagacactttttcttccgcaggggcgggagcccctagttccaacactgaggacgcgtgacatggtgggcaccggaaaggaggggacttctcctgcaccccaagaagtggtggggagattgctgcccctatagccatatctcggccccttcccactcaccacccccaccccaggtgctgggggtcccttatttttatgcaataactgagcttgatgggggtgggcagggggccagttgagccaagcccccagccccgatctgcagatcctgccccaagaagctggggtggtgggggcagtaattcctgcccccctctctgccctagggatgggcacgggggcgctggtgaggtcccctggaccatccagggtgctagggggcagggaggggacaccccctccccgcctttacctcacttccaatgctgccttgatctctgtctgggaggggggagtgaaggggccctagccccctgcactccgccgcctcagagccatgcggttaattcctgacttagtttatttttgcaaaacgtcgatctcctcctcccccgccccgcatccgcgaaggcttttaatgggaggggcgtcaaagctcaaaactgttttcctctctcctcccccctccagttgtaaatgccacttcatgaggggaggggcgaggggaagcccacccctgcatgcttctggctggagcacctccctggggagtcgggggattgggttgtgggcagtccccatggccgcctggagaagccgctggggcccgggggtgtggggcggtgtggcgggcgcacactgtatgtacctataataaaccctttggctttg

SEQ ID NO: 270724 - DNA, 384 bp, Homo sapiens
tgggaggtggaggctgcagtgagttgtgatcacaccactgcactccagcctgagcaacagagcaagaccctgtctccaaaaaaaaagaaaaaagaaaagaaaacagagctctacctggggacacagccgtgtctgaagattccaaggaaacacagcccctgtcctggggagggggtttaggggggtcacgctctgccccagaagtctcaggggtccatccctgcccctccatgtcccccttcagcgagcagatcagccggcggcagtctcaggtggaccgcctgtacgtggcgctcaaggagctgggtgaggagcgccgggtggctctggaacagcagtactggctgtaccagctcagccgccaggtgagcgagcttgagcact

SEQ ID NO: 270725 - DNA, 8747 bp, Homo sapiens
gaggcgcggcggcgcatgcggatcaggctgagccgcgggccggcggggccgagctgagccgggctgggccgggccgggccgggccgggcagcggacgccgacagggagggcggtcggtcgcggcgagcagcggagacagcgacgctggcggccgcgggcccaggcctcaccttccccgatggcgcaggtaccaggggaagtggacaacatggagggcctgcctgctcctaacaacaaccctgctgcccgctgggagagtccggatcggggctgggagcgggagcagccggctgcgtccaccgcagcggcctcgctctttgagtgctcccggatcaaggccttggcagatgagcgggaagccgtgcagaagaaaaccttcaccaagtgggtgaactcgcacctcgcccgcgtgggctgccacatcggggacctctatgtggacctccgggacggcttcgtgctcacgcggctcctggaagtgctgtctggggagcagctgcccaggcccacgcgcggccgcatgcggatccactcactggagaacgtggacaaggcgctgcagtttctgaaggagcagcgcgtgcacctggagaacgtgggttcgcatgacatcgtggatgggaatcaccggctgacgctggggctggtctggaccatcatcctgcgcttccagattcaagtcatcaaaattgagactgaggacaacagagagacacgctcagccaaggatgctctgctcttgtggtgtcagatgaagacagctggttaccctgaggtaaacatccagaatttcaccaccagctggcgggatggcttggccttcaatgccctcattcaccggcacaggcctgatctcgtggacttcagcaaactcaccaagtccaatgccaactacaacctgcagagagccttccgcacagctgagcagcacctggggctggcgcggctgctggatcctgaagatgtgaacatggaggctccagatgagaagtccatcatcacctacgtggtctctttctaccactatttctccaagatgaaggctctggctgtggaggggaagcgtatcgggaaggtcttggaccaggtattggaggtggggaagatcatagaacgctacgaggagctggcggctgagctgctggcctggatccaccgcaccgtgggcctcatcagcaatcagaaatttgccaactccttaagtggggtgcagcagcaactccaggctttcacggcctattgcacgctggagaagcctgtcaagttccaggagaaggggaacctagaggtgctgctcttcagcatccagagcaaactgcgtgcctgcaaccgtcgcctctttgtgcctcgggagggctgtggcatctgggatattgacaaggcatggggtgagctggagaaggctgagcatgagcgggaggctgccctacgggctgagctgattcggcaggagaagctggaactactggcacagaggtttgaccacaaggtggctatgagggagagctggctgaatgagaaccagcgtctggtctcccaggacaactttgggtatgagctgcccgcagtggaggcagccatgaagaaacacgaagcgatcgaggcagacattgcggcctacgaggagcgggtgcagggtgtggcggagctggcccaggcattggcagccgaaggctactacgatatccggcgggtggcagcccagcgtgacagcgtcctgcgccagtgggccctgctaactgggcttgtgggtgcccggcggacacgacttgagcagaaccttgccctgcagaaggtcttccaggagatggtgtacatggtggactggatggaggagatgcaggctcagctgctgtcccgggagtgtgggcagcacctggtggaggcagacgacctgttgcagaagcatggactgctggagggagacattgccgcccagagcgagcgggtggaggctctcaatgccgctgccctgcgcttctcccagccctgcgacccgcaggtcatctgcaaccgcgtgaaccacgtgcacggctgcctggcggagctgcaggagcaggcagcgcggcgacgcgcggagctggaggcttcgcggagcctgtgggcgctgctgcaggagctggaggaggccgagagctgggcgcgcgacaaggagcgtctcctggaggctgcgggcggcggcggtgcggcgggcgcagcgggcgcagcgggaacagcgggcggcgcgcatgacctgtccagcacagcgcgcctcctggcccagcacaagatcctgcagggcgagctgggcgggcggcgagcgtcgctgcagcaggccctgcggtgtggcgaggagctggttgcggccggcggtgccgtcggcccgggagcagacaccgtgcacctggtaggcctggcggagcgcgcggcgagcgcccggcgccgctggcagaggctggaagaggcggcggcgcggcgagagcggcggctgcaggaggcgcgggcgctgcaccagttcggcgctgacctcgacgggctgctggactggcttcgcgacgcttaccgcctggcagccgccggtgacttcggccacgacgaagcttccagccgccgcctggcgcgccagcaccgcgcgctcaccggggaggtggaggcacatcgcgggcccgtgagcggcctgcggcgccagctggcgacactcgggggtgccagtggcgcagggccactggtggtggcgctgcaggtgcgcgtggtggaagcagagcagttgttcgctgaggtgaccgaagtggcggcgctgaggcgccagtggctgcgggacgcgctcgctgtctaccgcatgtttggcgaggtgcacgcgtgtgagctgtggatcggcgagaaggagcaatggctgctctccatgcgtgtgccggattcactcgacgacgtcgaggtggtgcagcaccgattcgagagcctggaccaagagatgaacagcctgatgggccgcgttctggacgtgaaccacacagtccaggagctggtggaaggaggccaccccagttcagatgaggtgcgttcctgccaggaccacctcaacagcaggtggaaccgcatcgtggagctagtggaacagcgcaaagaggaaatgagcgcggtgctgctggtggagaaccacgtgctggaggtggccgaggtgcgcgcccaggtgcgtgagaagcggagagctgtggagagcgcgccccgggccggcggcgccctgcagtggcgtcttagcggcctagaggccgctctgcaggcgctggagccgcgccaggcggcccttctggaggaggcagccctgctggctgagcgcttcccggcgcaggcggcgcggctgcaccagggcgcggaggagctgggcgccgagtggggcgcgctagctagcgcggctcaggcctgcggcgaggcggtggcggcagcagggcgcctgcagcgcttcctacatgacctcgacgctttcctggactggctcgtgcgcgcccaggaggcggcgggcggcagcgaggggcccctgcccaacagcctagaagaggcggacgcgctgctggcgcgccacgctgcgctcaaggaggaggtggaccagcgcgaggaagactatgctcgcatcgtggcggccagcgaggcgctgctggccgccgacggcgcagagctgggcccgggcctggcactagacgagtggctgccacacctcgaacttggctggcataaactgctcggcttgtggaaggcgcgcaggaaggcgctggtccaggcgcacatctaccagctcttcctgcgggatctacgccaggcgctcgtggtgctgcgtaaccaggagatggcgctgtctggtgcggagctcccgggcacagtggaatcggtggaggaggccttgaaacagcaccgtgactttctcaccaccatggagctgagccagcaaaagatgcaggtggccgtgcaggctgcagagggcctgctgaggcagggcaacatctacggggagcaggctcaggaggctgtgacccggctgctggagaagaaccaagaaaaccagttacgggcccagcaatggatgcaaaagctacatgaccaacttgagctgcagcacttcctccgagactgccacgagctggatggctggatccatgagaagatgctgatggcgcgggatggcacgcgggaggacaaccacaagctgcataagagatggctccggcaccaggcattcatggccgagctggctcagaataaggagtggctggagaagatcgagcgggagggccagcaactgatgcaggagaagcccgaactggcggcctccgtgcggaagaagctgggcgagatccgccagtgctgggcggagctggagagcaccacccaggccaaggcacggcagctctttgaggccagcaaagcagaccagctggtgcagagctttgctgagctggacaagaagctccttcacatggagagccagctgcaagacgtggaccctggaggagacctggccactgtcaacagtcagctcaagaagctgcagtccatggagtcgcaggtggaggagtggtaccgcgaggtgggagagctgcaggcgcagacggcggcgctgccgctggagccggcgagcaaggagctggtgggtgagcggcagaacgcggtgggcgagcgcctggtgcgcctgctcgagccgttgcaggagcgccgccgcttgctgctggcttccaaggagttgcaccaggtggcgcacgacctggacgacgagctggcatgggttcaggagcggctgccactggccatgcagacagagcgaggcaacggtttgcaggcggtccagcagcacatcaaaaagaaccagggcctgcggcgggagatccaggcgcatgggccgcgcctggaggaggtgctggagcgcgcgggcgcgctggcgtcgctgcgcagcccggaggcagaggcagtgcgccggggcctggagcagctgcagagcgcctgggccggactgcgggaggctgccgagcgacggcagcaggtgctggacgccgccttccaggtggagcagtactacttcgacgtggctgaggtggaggcgtggctgggcgagcaggagctgctcatgatgagtgaggacaagggcaaggacgaacagagcaccctgcagctgctcaagaaacacctgcagctggagcaaggcgtggagaactacgaggaaagcatcgcgcagctgtcgcgccagtgccgggcgctgctggagatggggcacccggacagcgagcagatcagccggcggcagtctcaggtggaccgcctgtacgtggcgctcaaggagctgggtgaggagcgccgggtggctctggaacagcagtactggctgtaccagctcagccgccaggtgagcgagcttgagcactggattgccgagaaggaggtggtggctggctcacccgagctcggccaggactttgagcatgtctcggtgctgcaggagaaattctcagagtttgccagcgagacaggtatggcagggcgggaacggctggcagctgtgaaccagatggtggatgagctgatcgagtgtggccatacagcagcggccaccatggccgagtggaaggacggactgaacgaggcctgggctgagctgctggagctcatgggcacacgggcccagctgctggccgcctctcgggagcttcataagttcttcagtgacgcccgagagcttcagggacagattgaggagaagcggaggcggctgccccgcctgaccaccccgcctgagccgagacccagtgccagttccatgcagcggaccctgagagcctttgagcatgacctgcagctcctcgtgtcccaggtacggcagctgcaggagggggcggcccagctgcggacggtgtatgcgggtgaacatgccgaggccatcgctagccgggagcaggaggtgctgcagggttggaaagagctgctgtcagcctgtgaggatgcccgcctgcatgtcagctccacagccgacgccctgcgcttccacagccaagtccgcgacctgctctcctggatggatggcatcgccagccagattggggcagccgacaagcccagggacgtgtcatcagtggaggtgctcatgaactaccaccagggcctgaagactgagctggaggcgcgggtgcctgagctgaccacctgccaggagctggggcgatctctgctgctcaacaaaagtgccatggctgatgagatccaggcacagctggacaagctgggaaccaggaaggaggaggtgtcggaaaagtgggaccgccattgggagtggctgcagcagatgctggaggtgcaccagtttgcccaggaggcggtggtggctgatgcctggctgacagcccaggagccgctcctgcagagccgggagctgggcagcagcgtggatgaggtggagcagcttatccggcgacatgaggccttccgcaaagcggctgcagcctgggaagagaggttcagctctctgcggcgcctgaccacgatcgagaaaatcaaagcggaacagagcaagcagccgcctaccccactgctggggcgcaagttctttggggaccccacggaactggcggccaaggcggcgcccctgctgcggccagggggctatgaaaggggcttggagcccctggcccgccgagcctcggacacgctctcggccgaggtgcggactcgggtggggtatgtgcgccaggagctcaagcccgagcgcctccagccgcgcattgaccggctgccggagatcccggggagggtggagcccgcggccctgccggccgcaccagaggacgcggcggagacccccgcgacccccgcggcggcggagcaggtgcggccacgaccggagcgccaggagtcagctgatcgcgcggaggagctgcccaggaggcggcggcctgagcggcaagagtcagtcgatcaatccgaggaggctgcgcggaggcggcggccggagcggcaggagtcagcggagcacgaggcggcacacagccttaccctgggccgctatgagcagatggagcggcggcgcgagcggcgtgagcggcgcttggagcggcaggagtccagcgaacaggagatgcccatcagaggagacctggtcaaggggaaggccaccctggctgacattgtggaacagctgcaggagaaagaggcaggcccagggctgcctgctgggccgtcgctgcctcagccacgcgagcttcccccaggtcgcctgcccaacgggcttgagctgcccgagcggacacctcggccggaccggccccgggcgcgggaccggcccaagccgcgacggcggccgcggcccagagagggtggtgagggcgggggaagccggcgctcgcgctccgccccggcccagggcggctccgcccccgcgcctccgccaccgcccactcacacagtgcagcacgagggcttcctactgcgcaagcgcgagctcgacgctaaccgcaagtcgtccaaccggtcgtgggtgagcctgtactgtgtgcttagtaagggggaactgggcttctacaaggactccaagggcccggcatccgggagcacacacggtggggaaccgctgctcagcctgcacaaggccaccagcgaggtggctagtgactacaagaaaaagaagcatgtcttcaagctccagacccaggatggcagtgagtttttgctccaggcaaaagatgaggaggagatgaacggctggctggaggctgtagcttcctcggtggcggaacacgcagagatcgcccgctggggccagacactacccactacttcatccacagatgagggcaaccctaagagggaaggcggagatcgcagggccagcgggcgcaggaagtgacttcccacccccaggacctgacacatctcgtctcccctcttttccgcactgtgggcacaaagacactttttcttccgcaggggcgggagcccctagttccaacactgaggacgcgtgacatggtgggcaccggaaaggaggggacttctcctgcaccccaagaagtggtggggagattgctgcccctatagccatatctcggccccttcccactcaccacccccaccccaggtgctgggggtcccttatttttatgcaataactgagcttgatgggggtgggcagggggccagttgagccaagcccccagccccgatctgcagatcctgccccaagaagctggggtggtgggggcagtaattcctgcccccctctctgccctagggatgggcacgggggcgctggtgaggtcccctggaccatccagggtgctagggggcagggaggggacaccccctccccgcctttacctcacttccaatgctgccttgatctctgtctgggaggggggagtgaaggggccctagccccctgcactccgccgcctcagagccatgcggttaattcctgacttagtttatttttgcaaaacgtcgatctcctcctcccccgccccgcatccgcgaaggcttttaatgggaggggcgtcaaagctcaaaactgttttcctctctcctcccccctccagttgtaaatgccacttcatgaggggaggggcgaggggaagcccacccctgcatgcttctggctggagcacctccctggggagtcgggggattgggttgtgggcagtccccatggccgcctggagaagccgctggggcccgggggtgtggggcggtgtggcgggcgcacactgtatgtacctataataaaccctttggctttg

SEQ ID NO: 270726 - DNA, 2426 bp, Homo sapiens
gcggccgccggagcctcagccttcgccgccgctgccgctgccgtcgcagttgaggggcgagcacccgcccgcccgctgcagggacgccccgccaacgccactgccacttcagctggatggctggatccatgagaagatgctgatggcgcgggatggcacgcgggaggacaaccacaagctgcataagagatggctccggcaccaggcattcatggccgagctggctcagaataaggagtggctggagaagatcgagcgggagggccagcaactgatgcaggagaagcccgaactggcggcctccgtgcggaagaagctgggcgagatccgccagtgctgggcggagctggagagcaccacccaggccaaggcacggcagctctttgaggccagcaaagcagaccagctggtgcagagctttgctgagctggacaagaagctccttcacatggagagccagctgcaagacgtggaccctggaggagacctggccactgtcaacagtcagctcaagaagctgcagtccatggagtcgcaggtggaggagtggtaccgcgaggtgggagagctgcaggcgcagacggcggcgctgccgctggagccggcgagcaaggagctggtgggtgagcggcagaacgcggtgggcgagcgcctggtgcgcctgctcgagccgttgcaggagcgccgccgcttgctgctggcttccaaggagttgcaccaggtggcgcacgacctggacgacgagctggcatgggttcaggagcggctgccactggccatgcagacagagcgaggcaacggtttgcaggcggtccagcagcacatcaaaaagaaccagggcctgcggcgggagatccaggcgcatgggccgcgcctggaggaggtgctggagcgcgcgggcgcgctggcgtcgctgcgcagcccggaggcagaggcagtgcgccggggcctggagcagctgcagagcgcctgggccggactgcgggaggctgccgagcgacggcagcaggtgctggacgccgccttccaggtggagcagtactacttcgacgtggctgaggtggaggcgtggctgggcgagcaggagctgctcatgatgagtgaggacaagggcaaggacgaacagagcaccctgcagctgctcaagaaacacctgcagctggagcaaggcgtggagaactacgaggaaagcatcgcgcagctgtcgcgccagtgccgggcgctgctggagatggggcacccggacagcgagcagatcagccggcggcagtctcaggtggaccgcctgtacgtggcgctcaaggagctgggtgaggagcgccgggtggctctggaacagcagtactggctgtaccagctcagccgccaggtgagcgagcttgagcactggattgccgagaaggaggtggtggctggctcacccgagctcggccaggactttgagcatgtctcggtgctgcaggagaaattctcagagtttgccagcgagacaggtatggcagggcgggaacggctggcagctgtgaaccagatggtggatgagctgatcgagtgtggccatacagcagcggccaccatggccgagtggaaggacggactgaacgaggcctgggctgagctgctggagctcatgggcacacgggcccagctgctggccgcctctcgggagcttcataagttcttcagtgacgcccgagagcttcagggacagattgaggagaagcggaggcggctgccccgcctgaccaccccgcctgagccgagacccagtgccagttccatgcagcggaccctgagagcctttgagcatgacctgcagctcctcgtgtcccaggtacggcagctgcaggagggggcggcccagctgcggacggtgtatgcgggtgaacatgccgaggccatcgctagccgggagcaggaggtgctgcagggttggaaagagctgctgtcagcctgtgaggatgcccgcctgcatgtcagctccacagccgacgccctgcgcttccacagccaagtccgcgacctgctctcctggatggatggcatcgccagccagattggggcagccgacaagcccaggtgcccctcatccctcctcgggcttcctgcctccccctggtggcctaccccagccacccccagcccattgacagcccccttctcaatggaatgacaacagccaatatctgtgtggcgcctctgtgtgctaggcactgttctaggtgcttcgtgtgtatcagaccccttttttaggcctgtcattggggacttcggtcatggggcatccttctgtccgctgtccttcccagttgcctattattaccctctccatgggatgtcacagcatgaaacaggctaaagacaggatgggcaagggaggtgtgggactgtatttgtgagggtgggtgaagaattctaacaattcc

SEQ ID NO: 270727 - DNA, 752 bp, Homo sapiens
caaaaaccctacactttactcccctccacttatgttttttgatgtcagagtttctttctttgtatattttgtaattatatttatttgtagtattttttgtcttttaaccttttaaaagttaaagtgattatactgcatcattacagtattaggagtattttgaatttgactgtatagttaccagtgactttttataactgcatatggtttcatgatactaattagtcttattgcatttcagtttgaggaactccctttagggtttcttataaagcagatctagtgacagtggactcccctagattactttggggggtttctgaaaaagtctgtaagtcctagccagagcaattaggtaagaaaaagaaataaaaggcatccaaattggaaaagaagtgaaagtgtctctatttgaagatgacatgatctgtatagaagtggaataaagagtagctgacaacaatgctgaaatagttacacatgaagttttaatgagctatttcatattaagatacatattgagaattcaaaccagagagaccagttaattgatattttcccaactctgttttagggtgatcatagaaatgatatccacaagttagtcacagtggcctgcatccattttgatatatcagtgatgtattttgattggcagtgatcacccatactgactgttaaatattttgttatcactcctatgcatggtgaatttgagttctggttttctttagccttgtgttattatgtgt

SEQ ID NO: 270728 - DNA, 1013 bp, Homo sapiens
tcttcgtcgccgctctctctctcacctctcagggaaagggggggacataggggcgtcgcggggccccggcgaatgcgccccccgccgcctctcgggctgcgccgcctcgcggggatgaagcaccggccgtgaagatggaggtgacctgccttctacttctggcgctgatccccttccactgccggggacaaggagtctacgctccagcccaggcgcagatcgtgcatgcgggccaggcatgtgtggtgaaagaggacaatatcagcgagcgtgtctacaccatccgggagggggacaccctcatgctgcagtgccttgtaacagggcaccctcgaccccaggtacggtggaccaagacggcaggtagcgcctcggacaagttccaggagacatcggtgttcaacgagacgctgcgcatcgagcgtattgcacgcacgcagggcggccgctactactgcaaggctgagaacggcgtgggggtgccggccatcaagtccatccgcgtggacgtgcagtgtgagttgaggccccctctctccccgggccctgacagcccagcccgggccagagggcgccccagggatgaggtgaggtggggaagtgggcatggggtggaacggagaagctgaccttggtggaggagcctaagaggtaccaggcggtgtgtaccaccctctaccatctacaccttcgcacctgtaatctcatatgaaccttgcaacttcccttgaggtgagcagggagggcaggatgggttgatttacactccttctgcagatgagaaaactgaggtcccatgtgatttgcccacaggcatggagcggggtagcctcagagctgagaggaagacacagatctcttccccattgtccgctgcccttcccacagtacctcatgtctctgcttttgtcctgctgcagctctgagatttccctccttactacattacatataggaccaagccccactccccaggtcctagctgctagctgcatgagaagctgccagtccct

SEQ ID NO: 270729 - DNA, 338 bp, Homo sapiens
acgagtctgtctgggttcgtttcctaggcctgcgtgtgccccacgtgcgcttgtgaaaaagtatgggagaaagggggtgccgttgcagggcactcagcgctgaggcccccaccccgtgtgagtctgacagtctgactctgccccgcctggcggcccaggtacggtggaccaagacggcaggtagcgcctcggacaagttccaggagacatcggtgttcaacgagacgctgcgcatcgagcgtattgcacgcacgcagggcggccgctactactgcaaggctgagaacggcgtgggggtgccggccatcaagtccatccgcgtggacgtgcagtgtgag

SEQ ID NO: 270730 - DNA, 513 bp, Homo sapiens
ggagctccattggctgtgagagccgttacccctgtctcaatagcccatggtacagccgtaatgagactatcagtgcctcctcagcaggcatctgggcagactcctcctcgagttatcggtgtagtcatacaggggccggaggttaaatcaaaagcagtggcaaaaaagcaagaacgtgatgtggaaactttgcagttcgtagaagaaaaactggctgatggaaataagacagtgacccatgtagtggttgtcagtgtgccttcagctactgcccttcctgtaactatgaaaacagaaggactagtgacatgtgagaaataaaatagcagccccaccatggacttcaggctgttagtggcagtactgacataaacattggcaagggaagtcatcaagaaaagtcaaagaagactttaaaacatgtttaatgcatgtaagaaaacaagcgaacttactggaaataaattacctatcccatgtttcagtgggaaataaactatgtattgagatgct

SEQ ID NO: 270731 - DNA, 395 bp, Homo sapiens
tttacttataggaaatttagaaggaatatttttgcctaagtattttgatttcagtaataacttttggtaaacggtcatttaaccttaaatgtcaacccttgctaatggtccaaattaacataagtctaattaagtattgctttaattaagagaaaatctgaacagtgttcttcctcccagataaagcataataatgctatgattcctggccactttccactgtaaaaaattatcccactcttagagctcagaaccttatggtgttactccacaggtcttggctgaaatatacacaataagattcatccttgggatgcaagaaccttcatttaaccccttcttcctgtgtgtgctgattaagcagcaaattttgtgtcccctaagaagctgcatga

SEQ ID NO: 270732 - DNA, 893 bp, Homo sapiens
aaataaataaataaataaataaaaattgattgtagtgacagttgcacaactctgttaatatactaaaaacaattgaacttacattttagatgggcaaattatattgtgtgtgattatatctcggtaaagctgaagaaaaggaaatatctaattcaccaatgaatctgccaagctagttaaataaataaaactagtgaatgaatagctgtttcccatgcagttgacaaaaatatgccctagttccaaagtctaaaatgaattcccttgactgtctcaggggcatgcttgcgcctagctctcgggaacccattagtgtactaataagaaacctgataattcagtcaataattcctgaggttgtcagtgccactccggaagaagagagaaatgcacagactatttctttcgatacaagctgtgggattgcagagcgaggggccgccaggatgttctgcctggaaaagggcccctggagatctcactgtggtctgttcccacttggctaatcttgagtcatttatgtgggcttatctgactattcctgtttttcccctcaccctggacattcagaaggactgttgtagttaaagctccagaataaagtaactcctgaggttctgtgggaataatttcactgtgaaggacacaaacacttcaatggatgtcaatcacatgtcagggaaggagtgcttgtttaaaataaagattcttgggccccattcctggagattcaaattttgtaagactaggataaggccatgggctctgcattttaaataaagcattaggccaggtgtggtggctcatgcctgtaattccagcactttgagaggatggcttgaagccagcagttcaagaccagcatgggcaacatagcaagacccctctttcta

SEQ ID NO: 270733 - DNA, 464 bp, Homo sapiens
aggcacactgcactctcttggaagaaaaaaatgtgctccctctaaatataagctcacaacaaaaaattgcaaagcaaacgagaaaaaagtctactatgagagagcagccagcagacacaaaaacaagatgaactccccatcggtgatggaaaaatagaacaacgtgcacaagattataccatagctgtgtttaaagtgactaaaaacccattaaagtacaatttttttaaaactaaacaagctggctcaaaagttcataaaagaaaagaaaaattaagaaagaagagttggaaattctgaaaaaagaataatgaaaaggaactaatactataagatatatcaatggaatagtacagaaaatccagaaacagatatacatctcccaaatatttactagaatttggtatgcagtaattttaggatttaaagtaaaaaaaagtaagttatttgataaatgttataac

SEQ ID NO: 270734 - DNA, 326 bp, Homo sapiens
tgtggcagactgtattttcctagaattcccacgacaagatttctagtcctatatgctcttcaacaacctcgtgactcgctaccaaaaggtggagttcactgcttgaactgcctaggactgccctgacaaatgctgtgaggcagaagtgatgctgcgtgactgccaaggctaggtcataaaaggcagtactgcatctgtctggttctctccctctctctctctctctctctctctctctctgtgtgtgtgtgtgtgtgtgtgtgtgtgtgtgtgtgtctgtgcatattttactttgtgattgtctatgtttggtttcattaatctac

SEQ ID NO: 270735 - DNA, 334 bp, Homo sapiens
atattcttggtgggttgaatgaagctgcatgtggtggcaggctgtctccagtgatggatggggaagggcaggatgaacccaggagggagtttaaaaccactgttgggtgggggagtagaagaatcttgcccctcagaaaagcacaagtagactagaaatggtgcagactgtgtggcgtttgtgatggcttcagggcttcccccttgccacacagccactgagacttggcactttgagagccatgggcttcccttgggtatggtaactggtcacagagcagcaagctgccccctgcttttctgattggcaggatacatttattaaaatagttgga

SEQ ID NO: 270736 - DNA, 1638 bp, Homo sapiens
  misc_feature (350)..(350): n is a, c, g, or t
  misc_feature (359)..(359): n is a, c, g, or t
  misc_feature (365)..(366): n is a, c, g, or t
  misc_feature (383)..(383): n is a, c, g, or t
  misc_feature (392)..(392): n is a, c, g, or t
  misc_feature (444)..(444): n is a, c, g, or t
  misc_feature (452)..(452): n is a, c, g, or t
  misc_feature (472)..(472): n is a, c, g, or t
acaaaaggtagagctaaaatccgtaagatgaaggtgacaacgaaaatcaaccatcatgacaaaatcaatggaaagaggaagaccgccaaaaaacagtaagatgtttcaacgtgcgcaagagttgcggcggcgagcagaggactaccacaaatgcaaaatccccccttctgcaagaaaggctctttgcaactgggtcagaatggcggcagcggagcatcgtcattcttcaggattgccctactggccctacctcacagctgaaattttaaaaaacaggatgggccaccagccacctcctccaactcaacaacattctataattgataactccctgagcctcaagacacctnccgagtgtntgctcnntccccttccaccctcancggatgatnatctcaagacacctcccgagtgtctgctcactccccttccaccctcagctcnaccctcancggatgataatctcaagacncctcccgagtagctgggattacaggtgcctgccaccacgcctggctaattttttgtatttttagtagagacggggtttcaccgtattagccaggatggtctcaatctcctgacctcgtgatccatccgccccgccctcccagagtgctgggattacaggcgtcagccaccgtgaccggctcagactgtactcttatagccatctgaaatacgttttctaggtagagatagattgtgtaagggtacagttgtgaggataacagaaacatggcagattatttaaaatcatcctgaaagtggtgctttatctgatgaaagtgattgtaatccataggaaaatgtttcaacgtgcgcaagagttgcggcggcgggcagaggactaccacaaatgcaaagtaaggagcttcctccctgcagttgcaggatagttcagtgctgatgcagatgatgccacggcccttagactctctcaacattcaatttctcatgtgttggctttttcagatccccccttctgcaagaaaggctctttgcaactgggtcagaatggcggcagcggagcatcgtcattcttcaggattgccctactggccctacctcacagctgaaactttaaaaaacaggatgggccaccagccacctcctccaactcaacaacattctataactgataactccctgagcctcaagacacctcccgagtgtctgctcactccccttccaccctcagcggatgtaatctcaagacacctcccgagtgtctgctcactccccttccaccctcagctccaccctcagcggatgataatctcaagacacctcccttagctactcaggaggctgaggcagaaaaaccacccaaacccaagaggtggagagcggctgagatggaatcaccacccgaacccaagaggcggagggccgctgaggtggaatcaccacccgaacccaagaggcggagggccgctgaggtggaaccatcatcacccgagcccaagaggcggaggttgagtaagctgagaacaggccattgcactcaagcctgagcaataagaataaaactgagtagaacaaaataaaaaaatcaaaaaacaaaacaaaacccacactccaaaaacaaactaacaaagaataaataaataatataaaaataaaataaatactgca

SEQ ID NO: 270737 - DNA, 1529 bp, Homo sapiens
  misc_feature (350)..(350): n is a, c, g, or t
  misc_feature (359)..(359): n is a, c, g, or t
  misc_feature (365)..(366): n is a, c, g, or t
  misc_feature (383)..(383): n is a, c, g, or t
  misc_feature (392)..(392): n is a, c, g, or t
  misc_feature (444)..(444): n is a, c, g, or t
  misc_feature (452)..(452): n is a, c, g, or t
  misc_feature (472)..(472): n is a, c, g, or t
acaaaaggtagagctaaaatccgtaagatgaaggtgacaacgaaaatcaaccatcatgacaaaatcaatggaaagaggaagaccgccaaaaaacagtaagatgtttcaacgtgcgcaagagttgcggcggcgagcagaggactaccacaaatgcaaaatccccccttctgcaagaaaggctctttgcaactgggtcagaatggcggcagcggagcatcgtcattcttcaggattgccctactggccctacctcacagctgaaattttaaaaaacaggatgggccaccagccacctcctccaactcaacaacattctataattgataactccctgagcctcaagacacctnccgagtgtntgctcnntccccttccaccctcancggatgatnatctcaagacacctcccgagtgtctgctcactccccttccaccctcagctcnaccctcancggatgataatctcaagacncctcccgagtagctgggattacaggtgcctgccaccacgcctggctaattttttgtatttttagtagagacggggtttcaccgtattagccaggatggtctcaatctcctgacctcgtgatccatccgccccgccctcccagagtgctgggattacaggcgtcagccaccgtgaccggctcagactgtactcttatagccatctgaaatacgttttctaggtagagatagattgtgtaagggtacagttgtgaggataacagaaacatggcagattatttaaaatcatcctgaaagtggtgctttatctgatgaaagtgattgtaatccataggaaaatgtttcaacgtgcgcaagagttgcggcggcgggcagaggactaccacaaatgcaaaatccccccttctgcaagaaaggctctttgcaactgggtcagaatggcggcagcggagcatcgtcattcttcaggattgccctactggccctacctcacagctgaaactttaaaaaacaggatgggccaccagccacctcctccaactcaacaacattctataactgataactccctgagcctcaagacacctcccgagtgtctgctcactccccttccaccctcagcggatgtaatctcaagacacctcccgagtgtctgctcactccccttccaccctcagctccaccctcagcggatgataatctcaagacacctcccttagctactcaggaggctgaggcagaaaaaccacccaaacccaagaggtggagagcggctgagatggaatcaccacccgaacccaagaggcggagggccgctgaggtggaatcaccacccgaacccaagaggcggagggccgctgaggtggaaccatcatcacccgagcccaagaggcggaggttgagtaagctgagaacaggccattgcactcaagcctgagcaataagaataaaactgagtagaacaaaataaaaaaatcaaaaaacaaaacaaaacccacactccaaaaacaaactaacaaagaataaataaataatataaaaataaaataaatactgca

SEQ ID NO: 270738 - DNA, 1740 bp, Homo sapiens
  misc_feature (350)..(350): n is a, c, g, or t
  misc_feature (359)..(359): n is a, c, g, or t
  misc_feature (365)..(366): n is a, c, g, or t
  misc_feature (383)..(383): n is a, c, g, or t
  misc_feature (392)..(392): n is a, c, g, or t
  misc_feature (444)..(444): n is a, c, g, or t
  misc_feature (452)..(452): n is a, c, g, or t
  misc_feature (472)..(472): n is a, c, g, or t
  misc_feature (1316)..(1316): n is a, c, g, or t
  misc_feature (1357)..(1357): n is a, c, g, or t
acaaaaggtagagctaaaatccgtaagatgaaggtgacaacgaaaatcaaccatcatgacaaaatcaatggaaagaggaagaccgccaaaaaacagtaagatgtttcaacgtgcgcaagagttgcggcggcgagcagaggactaccacaaatgcaaaatccccccttctgcaagaaaggctctttgcaactgggtcagaatggcggcagcggagcatcgtcattcttcaggattgccctactggccctacctcacagctgaaattttaaaaaacaggatgggccaccagccacctcctccaactcaacaacattctataattgataactccctgagcctcaagacacctnccgagtgtntgctcnntccccttccaccctcancggatgatnatctcaagacacctcccgagtgtctgctcactccccttccaccctcagctcnaccctcancggatgataatctcaagacncctcccgagtagctgggattacaggtgcctgccaccacgcctggctaattttttgtatttttagtagagacggggtttcaccgtattagccaggatggtctcaatctcctgacctcgtgatccatccgccccgccctcccagagtgctgggattacaggcgtcagccaccgtgaccggctcagactgtactcttatagccatctgaaatacgttttctaggtagagatagattgtgtaagggtacagttgtgaggataacagaaacatggcagattatttaaaatcatcctgaaagtggtgctttatctgatgaaagtgattgtaatccataggaaaatgtttcaacgtgcgcaagagttgcggcggcgggcagaggactaccacaaatgcaaagtaaggagcttcctccctgcagttgcaggatagttcagtgctgatgcagatgatgccacggcccttagactctctcaacattcaatttctcatgtgttggctttttcagatccccccttctgcaagaaaggctctttgcaactgggtcagaatggcggcagcggagcatcgtcattcttcaggattgccctactggccctacctcacagctgaaactttaaaaaacaggatgggccaccagccacctcctccaactcaacaacattctataactgataactccctgagcctcaagacacctcccgagtgtctgctcactccccttccaccctcagcggatgtaatctcaagacacctcccgagtgtctgctcactccccttccaccctcagcggatgataatctcaagacacctcccgagtgtgtgctcactccccttccaccctcagcngatgataatctcaagacacctcctgagtgtctgctcactcnccttccaccctcagcggatgataatctcaagacacctcccttagctactcaggaggctgaggcagaaaaaccacccaaacccaagaggtggagagcggctgagatggaatcaccacccgaacccaagaggcggagggccgctgaggtggaatcaccacccgaacccaagaggcggagggccgctgaggtggaaccatcatcacccgagcccaagaggcggaggttgagtaagctgagaacaggccattgcactcaagcctgagcaataagaataaaactgagtagaacaaaataaaaaaatcaaaaaacaaaacaaaacccacactccaaaaacaaactaacaaagaataaataaataatataaaaataaaataaatactgca

SEQ ID NO: 270739 - DNA, 1349 bp, Homo sapiens
  misc_feature (350)..(350): n is a, c, g, or t
  misc_feature (359)..(359): n is a, c, g, or t
  misc_feature (365)..(366): n is a, c, g, or t
  misc_feature (383)..(383): n is a, c, g, or t
  misc_feature (392)..(392): n is a, c, g, or t
  misc_feature (444)..(444): n is a, c, g, or t
  misc_feature (452)..(452): n is a, c, g, or t
  misc_feature (472)..(472): n is a, c, g, or t
acaaaaggtagagctaaaatccgtaagatgaaggtgacaacgaaaatcaaccatcatgacaaaatcaatggaaagaggaagaccgccaaaaaacagtaagatgtttcaacgtgcgcaagagttgcggcggcgagcagaggactaccacaaatgcaaaatccccccttctgcaagaaaggctctttgcaactgggtcagaatggcggcagcggagcatcgtcattcttcaggattgccctactggccctacctcacagctgaaattttaaaaaacaggatgggccaccagccacctcctccaactcaacaacattctataattgataactccctgagcctcaagacacctnccgagtgtntgctcnntccccttccaccctcancggatgatnatctcaagacacctcccgagtgtctgctcactccccttccaccctcagctcnaccctcancggatgataatctcaagacncctcccgagtagctgggattacaggtgcctgccaccacgcctggctaattttttgtatttttagtagagacggggtttcaccgtattagccaggatggtctcaatctcctgacctcgtgatccatccgccccgccctcccagagtgctgggattacaggcgtcagccaccgtgaccggctcagactgtactcttatagccatctgaaatacgttttctaggtagagatagattgtgtaagggtacagttgtgaggataacagaaacatggcagattatttaaaatcatcctgaaagtggtgctttatctgatgaaagtgattgtaatccataggaaaatgtttcaacgtgcgcaagagttgcggcggcgggcagaggactaccacaaatgcaaagtaaggagcttcctccctgcagttgcaggatagttcagtgctgatgcagatgatgccacggcccttagactctctcaacattcaatttctcatgtgttggctttttcagatccccccttctgcaagaaaggctctttgcaactgggtcagaatggcggcagcggagcatcgtcattcttcaggattgccctactggccctacctcacagctgaaactttaaaaaacaggatgggccaccagccacctcctccaactcaacaacattctataactgataactccctgagcctcaagacacctcccgagtcccaagaggcggaggttgagtaagctgagaacaggccattgcactcaagcctgagcaataagaataaaactgagtagaacaaaataaaaaaatcaaaaaacaaaacaaaacccacactccaaaaacaaactaacaaagaataaataaataatataaaaataaaataaatactgca

SEQ ID NO: 270740 - DNA, 1240 bp, Homo sapiens
  misc_feature (350)..(350): n is a, c, g, or t
  misc_feature (359)..(359): n is a, c, g, or t
  misc_feature (365)..(366): n is a, c, g, or t
  misc_feature (383)..(383): n is a, c, g, or t
  misc_feature (392)..(392): n is a, c, g, or t
  misc_feature (444)..(444): n is a, c, g, or t
  misc_feature (452)..(452): n is a, c, g, or t
  misc_feature (472)..(472): n is a, c, g, or t
acaaaaggtagagctaaaatccgtaagatgaaggtgacaacgaaaatcaaccatcatgacaaaatcaatggaaagaggaagaccgccaaaaaacagtaagatgtttcaacgtgcgcaagagttgcggcggcgagcagaggactaccacaaatgcaaaatccccccttctgcaagaaaggctctttgcaactgggtcagaatggcggcagcggagcatcgtcattcttcaggattgccctactggccctacctcacagctgaaattttaaaaaacaggatgggccaccagccacctcctccaactcaacaacattctataattgataactccctgagcctcaagacacctnccgagtgtntgctcnntccccttccaccctcancggatgatnatctcaagacacctcccgagtgtctgctcactccccttccaccctcagctcnaccctcancggatgataatctcaagacncctcccgagtagctgggattacaggtgcctgccaccacgcctggctaattttttgtatttttagtagagacggggtttcaccgtattagccaggatggtctcaatctcctgacctcgtgatccatccgccccgccctcccagagtgctgggattacaggcgtcagccaccgtgaccggctcagactgtactcttatagccatctgaaatacgttttctaggtagagatagattgtgtaagggtacagttgtgaggataacagaaacatggcagattatttaaaatcatcctgaaagtggtgctttatctgatgaaagtgattgtaatccataggaaaatgtttcaacgtgcgcaagagttgcggcggcgggcagaggactaccacaaatgcaaaatccccccttctgcaagaaaggctctttgcaactgggtcagaatggcggcagcggagcatcgtcattcttcaggattgccctactggccctacctcacagctgaaactttaaaaaacaggatgggccaccagccacctcctccaactcaacaacattctataactgataactccctgagcctcaagacacctcccgagtcccaagaggcggaggttgagtaagctgagaacaggccattgcactcaagcctgagcaataagaataaaactgagtagaacaaaataaaaaaatcaaaaaacaaaacaaaacccacactccaaaaacaaactaacaaagaataaataaataatataaaaataaaataaatactgca

SEQ ID NO: 270741 - DNA, 277 bp, Homo sapiens
tgggaaagggagggcagatgactcacagagagcatcaaagcccagagagaatgaggagggtgtccagagtatgtgcgctggcacctgacgtggcatgtcggagcccaggctgaggaaagtgaccccgcaggggtctggccagcatgtggttccttttgcccattcccatttctccttcagtgcactgctcttcctggagtaaggaacgaatccggagaagcagaaggcaatgagccggcttttagagcagccaaggcttggtccatggcagagccat

SEQ ID NO: 270742 - DNA, 462 bp, Homo sapiens
accgatactggggtaagaaaacctaaactgtaattaacatactgctggaggctcactacagagaagtctgagagttaaaaactgcaggagtacccagtcatgagaagtcgggggctctccacacttttgttagttttacttccaggagcttgactgggtcctcacgatggatgtcgaagaaaaatcttgccctgattctgacagagggaggaaaaaagtagccatttgaaacacacaaaagcattctgttcttttcagcaaggcctgccctcaggagaaactatattgtcagaacttaactgactttggtaagggaaatactcaactctagccccctctagtcttccatgtggaagaaggggagtacccaactccagcccatcctagatattctgttccacctaaggagggggaaagactgagaagcacttgtgaaactcgtagcccaggagcacaggccta

SEQ ID NO: 270743 - DNA, 421 bp, Homo sapiens
gcacagatgggggctgtaccggagatgctgatcctttctgtgcagagggaaagaatgagggctggattggaaggaaggaggcacaagactgccaaggaggaagaagactatcgccatgaggccaccaggtcctactcagctgccctcccctcctcaccaggagacagccctgtaaccacccaaacattacgggaatgtgggctggctaatagaagagggacaactcagggtcagaacacagaggcctactcaccaggaatgagcatctagttggggacaaagacagacttttccacaatcactcccctctcacattaacgttctccacagaagacgccacttgtatctcctcagcccctccttcccaccacaatatttccctgaactaataaatacctatgttccttcaaacagcactgaa

SEQ ID NO: 270744 - DNA, 295 bp, Homo sapiens
catacagattaataagtgaaaactgcttttatttacagacatattttttttaggtaggaagttctaaagtgtcaacaaaataacataccagagctagtaaacactttcaataagttgcagaatatactaggccaatacgcaaaattcaattatttatataagttgcaatgaacaattaaaaactaaaacatgaaaaacaataccattaataacagcacgcaaaaacctgaagtacttaggaataaatttaacaaagtacatgcaagaactgtacactaatacctgtttgtcgacg

SEQ ID NO: 270745 - DNA, 529 bp, Homo sapiens
tgctaattttattttcttttgtagagattggggtctctctatgttgaccaggctgattttgaactcctggcctcaagcaatcttcttgcctaggccttccaaagtgctgggattacaggcatcagccactgtgcctggctcctggagagttttagaacaataaaatagaattgttactccatggcagaagtgtagagaacatgcctgccagattccagccagatgactcctataaacacaacatacagtcagtgtaaatgaacctaaacagatttaccagtacctgtacattactaaacagatgtaaatgaaaagatacactatgcattgaacttaatgctacttttttgttttttgttttttgtttttctagtagatgtgagtttaaatatagcaggaataggattttcatcttctcttgttgaaagtcttcgtggaagtggatttaagttctagcatattcagtaggagaaatttgagctggaatgaaggacatcacagcctgcataatttgttaaatgtctcttta

SEQ ID NO: 270746 - DNA, 469 bp, Homo sapiens
cagaaagctgaagcagtggaagtattctatttaagagaaccagacatgacctgcccccgttatgatgcagtggaaagtacacaacaccacctatgaagttgatttgtcaaaaaaagaaagaaaacaaaagaaaatcaccctacatgtaatcaagcctctagacctatcttcagtttagaggcaagagctccaaagaaagaaacatgttaaacaacaccattttatgactggggaggtgctgcccagtcaaacccagtaaaatccagtttctccaacaaataaacacatgaggtgggggggaaatgtgtacagaggatgttaaagattaaaagacacttaaagttaatcctcaaataaaagtttgttgaaaaaagaggactgaagagatacatcaaccaaatgcaatgtgcggactgtgtttgaatcttaattaaacaaagcaaattataaataaaagcttttttaagaa

SEQ ID NO: 270747 - DNA, 556 bp, Homo sapiens
ctgcatacatgagggatgccagaagaaagatctgagagccactcttcctggcactgaaggaaacagggcccatcagagcaaacaagtaccttttgcctctctcatctccttggaggcaaatgtttataatctctggttttgtgtaaagtttataacagtatttttcattcaggttgctacctattagtggatggtgaaattaatttggtggatcacattcagaatatttttttaaaatcaaaagaatacaagctgggctcagtgactcacacctgtaagcccaacagtttgggaagaccaggcaggaggattgcttgagaacaggagttcagaatcagcctgggcaacatggcgagaccctatgtctgcaaaaattttaaaatatgccagatctggtggcatgtgtccatagtcctagctactcaggaggctaaggcagcaggattgtttgttataaggagttcgaggctgcagtcaaacttctggtcgaaatcctggtcatgccactgcatttcagcctggacaacagagtaaaaccccatctttaaaaaaaaat

SEQ ID NO: 270748 - DNA, 441 bp, Homo sapiens
catagtagtgcatgcctatagttccaactacttgggaggctgaggtgagaggatcatttgagcccaggaggtcgaggctgcagtgatccaagaaaactatacttcatcctgtgcaatagagcaagaccctgcctcaaaaacaaaacaaaaccaaaacgcatatgtcagccataaaaaatgatgagttcatgtcctttgtagggacatggatgaaattggaaatcatcattctcagtaaactatcgcaagaacaaaaaaccaaacactgcatattctcactcataggtgggaattgaacaatgagaacacctacccttactatatacccatgaaaattaaaaatctaaaaaaaaaaaatttaaaaaggaggtgattggaagctgttacagaacagatcatgaagattttgattgtgatctctgatcctgggggaaaaaaaaa

SEQ ID NO: 270749 - DNA, 496 bp, Homo sapiens
tctgccctgggagccctacactccacttggagtctggatggacacatgggctgggggctctgaagcagcctcactcttaacttcatgttcacactccatggaaaccccagactgggacacaggtggaagcctaggggagccgaatcagtgtttgtgaagaggcaggactggccagagtgacagacgtacggtgatccaggaggctcaaagagaagccaagtcagctttgttgtgattcgatttttttaaaaaactcttgtacaaaactgatctaattcttcactcctgctccaagggctgggctgtgggtgggatactgggattttgggccactggattttccctaaatttttcccctctttactctccttctatttttctctccttagactccctcagacctgtaaccagctttgtgtcttttttcctttcctctcttttaaaccacacattataactttgaaaaaaaaataaattagaaaaagggcagccaact

SEQ ID NO: 270750 - DNA, 172 bp, Homo sapiens
tttttctgacaatataaatacatttctgactttataattttcataagcaaataatccataatcttaagcatgccagaggagttaatacaaagtgttgagaagggatgaagctggagctacacctgggtaaggattattccccaaacctgtctaccatcaaactggatttgta

SEQ ID NO: 270751 - DNA, 646 bp, Homo sapiens
gacatcaatcaaataccctggaaacgtggaaggcaggggaaagaacaaagggagagcaaaatcgccccaatcccacatcacccgcgacgtgaaaggatttgtccttccagctgcgggactcctatttgtttatttcaaccccgcgccagctccaggcacagccgttcagggtgatgccaaagggaaatgagaacgcctggtttcgagtgccagcctgaggccccttaagccctagcctggctccaaaaactgcagcctgtttccctcaacaaaaatgacgtcaagaatacctagatgtgaccacaccgaacttgcttgcccgttttgggaaacccaactttcttcctgaatagtcagaacctctggctttcctggtctcttaagaaccgcaaactattgaaaagcagatgcgtctttcagcctctttaataaatgcagtaaggagagttgggacagagttactttcagactgtggggctcccccgtgccaaagcattcagacgaaatgtgggggatagcggggggaaggcaggcaattatctgaatgttaaacagctgaatatttggaaaccccaatctttggctgatttttaaaaacctttttcacacgtgttctcatgtttaaaaaacgccttgaacagaaaaa

SEQ ID NO: 270752 - DNA, 144 bp, Homo sapiens
aaaagagacatgcggactaaatgcagtacgtgattctggaccggatagtggactatgaaaccctgctctttttttcttttgctataaaagacactactgggaaaactggcaaaggtttgaataaagtttgtaattacagaagca

SEQ ID NO: 270753 - DNA, 226 bp, Homo sapiens
gtgttttgcaactttctggatggaacagaggcttttggtgatcccttcttgcacagagaagggaacctcacttgtaagaggttggggtcttaaaacagaggtcagcaaattttttccataaagggcgacataatacatgttttaggctttgaagcccatactatttctgtgccaactgctccactttgccattgtagcacaaaaacagctgtatacaatatgcagg

SEQ ID NO: 270754 - DNA, 647 bp, Homo sapiens
cgcccagactcttcttggactttagatgttctattatattcttctgtccataacttcttgacccaagccttcataggtctgcagtatcccttaagctttcatacgtcatggtacctaccactgctttctatgacttctgtcagcttgaaatctgagctatgtcaccattcccagtgtgagctctgaattaggtgagacaaaccagtcactaagtagccaacagacaggttagaatgttgtaaatagtttctattctgctccttctggctgagggaaagaatgcacaattgagcttttgcctgtggactgtggtctgccactccagggcaaaggtaaataaaatggattagaaatttatactgtttgaaagtggctttttcttgattgggcatttggttgcttgctgtgtatctttgactggttttcaaaactctacggagtcatttgagtcagtctccagttgattttcaaatgtttctctgaaagaacaagggcatgcggctgctgattaacattattgctctgcttcttttgattttatataatgattttataattacaagaaaaacaaagctgttttcagtttgttaattgagatggtagttcaggcagtgttatgctggatggaatcaagttatcctacacaa

SEQ ID NO: 270755 - DNA, 354 bp, Homo sapiens
acgccgcagccgccacgccaacaccgattcctcgtggccaacaggtttctcgcagccctccgagtcggcagcgccgcccgcgtccctcttccagccgggccggcgggacgccctcagagcttgtgctctctcgaggccgccgagcccactgagcccggccggggcgctggttcgcgtgggccgcggggaacaggtcccgcttctccaacgaccacggccccggcggctgcgaaacggccacctccgacccttgagtccgccagagtcgctctccctttcacatttgcaagcaaaacaacatacgtaatagtgacatcgaggcacttttccaaactaaaatgatcctaaaataat

SEQ ID NO: 270756 - DNA, 407 bp, Homo sapiens
tatcatttttttcaggattagtcccaaatactcaagtttaagttatcctaaatctttctttaggaacgcctcacaaataaaatataagaaatttggatattgtactcttggcaaagtttggctctgcttccctaatctaatgggacagtgacagcttacaatgaaacattttcaaaaacattccctgctaaatcaaactgaaatgcaggggatttacatggacatttgagatcgtttggtgtaatagagcatggactgtcaagtaagaagtttcacatggactacggagtaagaccagtccttctaccatcttggaacttgacctttttttgtaaaattggaaacataacagctcaccatcttgttgagaagactaaatgaagtaatgtgaaagttccttaaggaag

SEQ ID NO: 270757 - DNA, 472 bp, Homo sapiens
ttagggcaaaagaaataagtacaattggcatgttaatgttggttcacaaaaaatcatttaccaaatacctggtaacttccataatgagctcagacagacgccagcactcacactggcatcgtctctgggggcagctttgtttctgggggcagcattgtttctgggggatggcactgtttctggggaggcctccttcagcacaagcagctacaaaccgcagtgacacccagagccaagaagtggttatgaatagcctcttgtggctgaagctgtttgcagcctggtgctttttaaaggacttttctttaaataatagagctaaaacacaaacagccttcattcaaaataagagaaaatcatatcccgagttaaaccttcatatgagaatcaaacatgctcttccaagccccaggaaaagtaacacttagcttttatctctgatcttaaaaaatgagtattactttaaaaaaaa

SEQ ID NO: 270758 - DNA, 595 bp, Homo sapiens
agaactgggtggtgatgggttctgacagatggccaggctgtggggtcacacggttggcggtggcgggctttggtccagctgcagggctgcatcgggagccctgtgtgtttggagggaattcctgcccctgcagcaaacgtgttggtgcgggtgtaacctgtttcatggaaggtgaagaaagcctgcactaatttaacatccaagtttgccctgctgagcccagcccagatgccaacccacagagccatgagctaaatgaatgtctcagtgttgtgagccgctggggtttggggtagttaatgacacagcaagagctactgctgccccagcctcaggtggctcacgctgccttccattgctctaaactccatttacattgattcacttacctgcttactatctgtcttccccgttagaatatcagattcaagaggacttgatctttgtcaccactgcatctcaacaatactagcgtctaaacaaataataagagttcacatttattaaagatttacaatacaccaggctttgctctgtttgtgatttaatattttaatctctagtggcaataaatgggtcaacctgttaaaaaaaa

SEQ ID NO: 270759 - DNA, 397 bp, Homo sapiens
ccaggggatgagagaccatgtgattggagtcccaggtgacccggccatcccctcagcctgtatcagcccctgcagattacacatgtgtgaggggtccagccatcattgccacatcctgtcttgggccaaaagaactgccctgctgagcccagcccagatgccaacccacagagccatgagctaaatgaatgtctcagtgttgtgagccgctggggtttggggtagttaatgacacagcaagagctactgctgccccagcctcaggtggctcacgctgccttccattgctctaaactccatttacattgattcacttacctgcttactatctgtcttccccgttagaatatcagattcaagaggacttgatctttgtcaccactgcatctcaacaata

SEQ ID NO: 270760 - DNA, 244 bp, Homo sapiens
gataataaactagtttgtgacatcagcctcaaagtacctgactgtatgagacggataccaaaccaaactgtttttcttgctctgaaactcatcacaacacacttctgacaccaggcaatcagatgcaccccatctccgatgtatacatgtgacctttgtatctctcttttttcacttagcataatgtttttgaggtttatccacattttagcatatatcaatacttcattccttttcgtggctg

SEQ ID NO: 270761 - DNA, 447 bp, Homo sapiens
gtgaagctgagctgtactctctgcagcccaaatatctctggttgaacaaagaacattagcacctaaggccaacaactctcaaagtttctgtactgtgaatggtccaacagctgaaaaaactcaagttcatctcacctccaatgtctctcttgaatctattcctttctgtccatctacacagttagatactaaccatcagccatgccatctcttgccaccatacatcatttgtaatataattagtctcacacttatctcagtttcccatctcactcctctcttatctattttccacattacaaactgagtgattgttttgcttcctacaacacagttcttatcatcaccattgtcatcattgaaattatattatcataattatcataagtcaggtcttaactgtaagcaaaaaaataaactctggctaattaaagcagaaataatgaa

SEQ ID NO: 270762 - DNA, 302 bp, Homo sapiens
cactggcggcacagcatggagggcctgcgccaccacagccccctgatgcggaaccagaagaaccgagattccagctagaggagctggccttgcccagtggcctgtggcgcccaaagctggcaggtcaggcaagcagcctgcaccaccctgccactggcgaccagggagctggcttcccaaggacaagggaaaattgtagtcacctttgcacttgctgaatctgtctttgtttctgcactaattaatgcacattgagttttgtcaggttttgttttcagggggtgtaccaagggcaaggaccc

SEQ ID NO: 270763 - DNA, 386 bp, Homo sapiens
catctgctacatcacttggtgtgtcttaaatatttgctataaagtgaatcttaaaaccattgaatcaagagatcagaagaatgattggcagaatcagcatagattaggaaacagtagagaccttttataacaatgggagatgggctttgcctttcttcttgattgtgagtcacaaatctgtgtaataagccatttcatatctaattggttgtatctagacaatttaaaccttatgtcctggcaaaagaggtcaatcagatcactaatgactaagaaatatacttttttattgctgcctatggtgaaatgtctttcagaaaaatcttcatagctttttgctttgattaaaaataatggcatcattaaagctcaataacttcaacaaa

SEQ ID NO: 270764 - DNA, 453 bp, Homo sapiens
gctatttcattcttacagctctggagtaaaatggcgatgatctttggtctaccccaaaactgtcttaaatttcgcttgctttggctaactctgataggaaatagctatgggagagtaggaagggaatggggcttagagcccataattcaaaccctactaccacttctaggtatgagctgtgtaaccctgcacaggttacttatctccgttttctagattttatgcggtccatttggcatgtcctaagcacccagtacatgttcattaattattttttctcttctcaccaggtctggtctatgtcatgttcatctctatcctcattagcgtgatagtctctttgagattatttgatgaccaaattaatggggctggagtgtaacagcttaagagcaggtacattctgaagagtgagaataaactttgtctgtgtattatttactgtttaagaaa

SEQ ID NO: 270765 - DNA, 462 bp, Homo sapiens
agatggaatcattacattatcagtgtagtagagttggtaagccctcaagtgccctgtgcttaatttgaattctgatttttaatactttttagttatgtgattttgaacaagaattaaatctcttcatctgtaaaatcagaataatgcttattttatttggatgttgcgaggattaaataacatacagttcttgacacctataagttacattattagtaatatcactgccatcaaagtgagaatatgtccagcttgctgctgttgagcctcggtgagagggagaaatcatttacagcatcaagtaagagtgcctgatttattgtcttggatcatgctaaagaatggactaacccccagttattgtgcatcccctgggtgattcgatttaccacgtagaaatacgtgtcttccctattctaatttcctttagagaaataaaatctgattatttagtcaaggaaa

SEQ ID NO: 270766 - DNA, 805 bp, Homo sapiens
atcctaatacaggagtgtttatggttgggttgagacacattcagtagctgagtgattgacagcaagaggagcaagacatgaggtagatttgtattatattctcagtgaaacgggatagctttagaagctttttaataaaaaggatatatgatctaaatttcctactgttaataattatcaaatatatggcaatgctggactttagctgatcatcgtgcttctggaaaacaacaaaaattgagatatctgttcaccactttgtgtgtccaaggaccacctactttttacatgtgacaagaactacccacctccactcttcaggatagaacatgctgaagaaaagagttgcaatgagaaaatatatgggaacaaaatacctatgcaatgcagaagtctgcataactgaaccactcagaggaaaaagtttccctcccaggctggagtacaatggcgcgacctcggctcactgcaacttccacctcccagttcaagcaattctcccacctcagcttccttagtagctgggattacaagtgcctgacaccaggccaagctatttttgtatttttagtagagacggggtttcaccattttgaccaggctggtctcaaactcctgacctcagtccatcggtccacctcggcctcccaaagtgctgggattgcaggcatgagccaccgctcctggcctcaagtttaattcttaagtgagtcaatcagttatagttctgttcaaagctttcagtgcacctaaaatttcatccaacatctattatctttcatcatatgctaaaacagcttgaaga

SEQ ID NO: 270767 - DNA, 433 bp, Homo sapiens
atcctaatacaggagtgtttatggttgggttgagacacattcagtagctgagtgattgacagcaagaggagcaagacatgaggttaataattatcaaatatatggcaatgctggactttagctgatcatcgtgcttctggaaaacaacaaaaattgagatatctgttcaccactttgtgtgtccaaggaccacctactttttacatgtgacaagaactacccacctccactcttcaggatagaacatgctgaagaaaagagttgcaatgagaaaatatatgggaacaaaatacctatgcaatgcagaagtctgcataactgaaccactcagaggaaaaagattgccatttcaggacacctcctacatctgaggaaatatgcattgatcttgcagtacttttctcctccaaataaaagtcagtatgataacaac

SEQ ID NO: 270768 - DNA, 551 bp, Homo sapiens
ttttttcttttttttttttctgagacagggtctcattcttttggtcagactagggtgcagtggtgcgatcacaactcactgcagtttcaacctgccggactcaaggctgcagtgatccttcagccttgacttcctgagtacctgggactacaggcatgcaccaccacacccagctaatttttaaaattttgtagagatggaggtcttgctatgttgcccaatctggcctcaagcaatcctcccacctgggcctcccaaagtgctgggattacaggcatgagctactgcttcctaccaacttgtgtgctttaaaggacaccatcaagagagtgtaaacagctgggtgcggtggctcacgcctgtaatcccaacactttaggaggatgaggtgggaggatgtattagtccattctcattctgttatgaagaaatacctgagactgggtaatttataaaggaaagaggtttcattgactcacagcgatcctctcatctcagccttccaagtagctgggactacgggtgcacatcaccatgaattgtccatttta

SEQ ID NO: 270769 - DNA, 415 bp, Homo sapiens
tcctttggttctacttctccctttgtacccagatcaaacccagatccaatcacaaatcagcctgtaaaaattctaaaacctgtacacactgtaaagcccattccactatgccatgtggaagcagaaaggagttaactccactctaccgtgaaagctctagcaccgtttcactttttcttttttgctttttttgttctttctttcttttctttcttctttctttctctttctttttatttcattcctttttcacctttctttctttgtctctgtcttttctttttctttgctttctttctttcactagcatctcctagcattataagtcgtatgtggcaggttgtatttgaatgaattaataaatgaatgaatatacagaggaataaattaaacagtaatggagtaaacaaatgag

SEQ ID NO: 270770 - DNA, 945 bp, Homo sapiens
cggggcgggcggggcgcgtcccggaggcggaccggcatacagggtaacttcctgatgttgccatggcatttgtaaactgtgatgacgctggtgggagtgcagcagcgaggacgaccagaggtcactctcgtcgccatcttggttttggtcagtaccctagagtccatgggtccactattcctctgcgtctcatttctctgaagtgggaaactccctggactacctattcctgcacttattaccctcattctacagtgtactgaagaggatcttcggtggtctgggagttttgtttgtttgagacagggtctccctctgtcatccaggctggagtgcagtggtgcaatcatagctcactgctgcctcaacctcccaggctcaagtgattctcctgcttcagcctcccaagtagctgagactacagttgcctggacaacatacagcctctggaaacccaaccttccagccctcagtcctgccctcaagagaaatttgccaccaaggattggctcccaggacccaggccccgcctcaggctcctcgctagttgggccttctctctgccactccccacgagtgggtcactccacggggagccccaacgctggcaggagaggatcctacaggacagcaaggagatgccacctaaaaacaaagaaaaagggaagaaatctggggcacacaagaagaaaaagaactggggtgagtcatggtgggtggaggtgccccctgcttctccatgttctgccatgaagaccacgcagagctcctccagagagaattcagccttctgcaggacaggatggagctctcttgacctacctctttcatgtcctcacagccagatccagggagctgaggaagtggggaaatggtcacccacgctctcctttaagccccatctagctctgtgccttcctaatatatttgtcatgtgtattttgc

SEQ ID NO: 270771 - DNA, 452 bp, Homo sapiens
gtaggttctcgtcatcaggagcatgacgtacagatttggtgtgagtgcagtcctgctaacctgctgcgggatccgagtacccgctttataggagctttctccaagtacccactttataggagtgggaagcagtgtaggaagtaagtacgaaaagcacttttaaaatgctgttaaagggctagagacagaactaaccacaatcagggcagtccctgctgtagctccggcctggcctccccattcttgcctgactcaagacactaacttagttcctggttcggtgccctgttggtgctcctctgtccagtagcttagctcccacggtgggggaggaatcgaaggggctctgcagcccccaccagctgccctcgaatcccatccaggccagttccagattctaaactgaattttcttcatattgtcaaaacgggaaacaaaaaaaccctaaagca

SEQ ID NO: 270772 - DNA, 631 bp, Homo sapiens
ccagggactgcggggctctccaaggccatgacctgcacactgccctcagccacaacagagcctggggggctcgctgcctcctgtgtcacaaatcttgaggagtgcggcacaggccacttctgctcccagagggtctactgtcctttgttgtgtagaccgaaagtgactgaggcagatctgcctcgatccgagatttattttgcccaggtcgaggatgtacgtgggaaaaagaaatacaagttccagtgctatctgtgacctgtgcttttcctaagagggtttaggggaacttcagtatttaaaaaggaaagagcgagcaggtggggaagaaagaaggaaggagggtaggcaatgaggcaatgaggcagaggtcaccctcgtgtaaggctctgaccagcactcagtgaatctatgtgttaaatgtgaaaagaaaggcgtggagagaaagtcaatcatgcattcatctcgcgctcagtaaatctacattttacatcggataaagtgcacatgtgaaatcacagcttctgtttgggaacaaaagaaaggcagttaactttccctttagtatagtaagtttggggtcccaagaatctatttttctttcacagttgtcacatatactcaaaaaaaa

SEQ ID NO: 270773 - DNA, 287 bp, Homo sapiens
cagaactctgcattttgaagaagctttggaagttgaggcttgaacttggcctttaagaacaacttcaggcacgtctcagcatgcctccctctcatggaagttcccaggaagcccaccatgtacgtgtctgtacgtgtctgtagaagaggaggaaatttttttccgggagccggctgattacacaaagaacaaaggtatttctatgtttggttttgctcccttatctgtgcagctgcagcttgatttttcaggctgtttctatgtttaaaagaattctaccaagaacc

SEQ ID NO: 270774 - DNA, 444 bp, Homo sapiens
ggactcatcatcgaatggattcgaatggaatcatcgaataaaattgattgaaatcatcatcaaatggaatcgaatggtatcattgaatggaatcgaatggaatcatcatcagatggaaatgaatggaatcgtcatagaatggaatcgaatggaatcatcgaatggactcgaatggaataatcattgaacggaatcgaatggaatcatcatcggatggaaacgaatggaatcatcatcgaatggaaatgaaaggagtcatcatctaatggaattgcatggaatcatcataaaatggaatcgaatggaatcaacatcaaatggaatcaaatggaatcattgaacggaattgaatggaatcgtcatcgaatgaattgaatgcaatcatcgaatggtctcgaatggaatcatcttcaaatggaatggaatggaatcatcgcatagaat

SEQ ID NO: 270775 - DNA, 811 bp, Homo sapiens
acgttgacacttcaggaatgggatccctttattctgataattgattctaacagaagacttctactcaatgtgataatggaatgatttggagcaactctactatcaaatcagggaaagctagcctccagggtgatccagaggttctgctgtcaccttacaaacccaagacaagatttttcaccaggactgggctttggataacatatacgttccataacaatacctcgaaggaggcatgtgtttacatggcctagtgattttctctggttgcttttgtggaattcagatgctgattttatcagtgactaaccatgacatgtggggacattgtaagataattggtaagttttggaaaatctcacagtggctgggtaattcgatttcctttttgtgcaggatttggggatgagaatggcattcttttcttcttcttctaaaagctggaatcttgctatgttgccctggctggactcgaactcctgtgctcaagcagtcttcctgccttggcctctgagtagctagaactataggagcataccactgctcctggtgaaagtggccaggagttgaaataacagaaattttgttggcagagtgatttgtgctgtctctagcaggataacactgagcgagtaacttgacctctctgaatttcagtttctttatttgtgaaaagaaactaatattggccaggtgcagtggctcacacctgtagtcccagcactttgggaggccaaggcaggaggatcccttcagcccagaagttcaagattggcctgggcaacatagctagatcccatctctaaaaaaa

SEQ ID NO: 270776 - DNA, 691 bp, Homo sapiens
atgatagaatcgagctcggtacctggaacgtgttatccaaacccaagacaagatttttcaccaggactgggctttggataacatatacgttccataacaatacctcgaaggaggcatgtgtttacatggcctagtgattttctctggttgcttttgtggaattcagatgctgattttatcagtgactaaccatgacatgtggggacattgtaagataattggtaagttttggaaaatctcacagtggctgggtaattcgatttcctttttgtgcaggatttggggatgagaatggcattcttttcttcttcttctaaaagctggaatcttgctatgttgccctggctggactcgaactcctgtgctcaagcagtcttcctgccttggcctctgagtagctagaactataggagcataccactgctcctggtgaaagtggccaggagttgaaataacagaaattttgttggcagagtgatttgtgctgtctctagcaggataacactgagcgagtaacttgacctctctgaatttcagtttctttatttgtgaaaagaaactaatattggccaggtgcagtggctcacacctgtagtcccagcactttgggaggccaaggcaggaggatcccttcagcccagaagttcaagattggcctgggcaacatagctagatcccatctctaaaaaaa

SEQ ID NO: 270777 - DNA, 471 bp, Homo sapiens
ggaggctctcggagggaggcgcccggagaggccgtgggagctccacccgcatccccataccttgccctgagcatctctgctggctgagttgtttcctttagtaataagccagaagtggccgggtgcggtggctcacgcctttgggaggccaaggtggacagatcgcttgagttcaggggttcaaaatcaacctgggcaacatggtgagaccctctctctacaaaaaatacaaaaattagctgggcgtggcggctcatgcctgtagtccgagctacttgggaggctggggtgagaggatcgcttgagcccaagaggcagaggttgcagtgaaccaagattgcaccactgtgctccagtctgggtgacagaggcagacctgtctgcaaatgtaaaataaaaatagatatatataatataaaacattctgctgagagagagcatgacagaaaaaaaattcagtagtaggaaaca

SEQ ID NO: 270778 - DNA, 203 bp, Homo sapiens
ttgattctacaactacaggatcgttctctcaaaacaacttttgtaacccatccattttcacttcataaacctgtgaattgacatcctggagttactgctgcatttgttgataacgttaaataataaggccttttgacaatgtttgaagctgcttttttctgatgtctcttctaaaataaagaatttccaagttgatgacaata

SEQ ID NO: 270779 - DNA, 599 bp, Homo sapiens
agaaagctgagccttattgcacccttttctgaccaccttcctgaatcaccttaaagcatgtcacttaccttctttggactgtgccttggtcctcttatctatacagtaaaaatactaaaattataagtattgaaattgaattaataatttaactcttggattttgagactaacatcctactttttaatactgtctaaatgaacatgtttctaagcacacaagattttaatttacagtcagatatgaaaatttgtttattgctgcaaagtttgattttgatgtctgtcatcttattggtatttgttctgtcgtttgggtaaaacggatgtgtttgacactgccttactacatagattgtttatcttgaagttttgttgcatttttgtttgtttgccagaagaaaatttgtctactaacaattccagcccaattttggagtcagatacacaaatctaggtagttttttatctagtgattgcatgatttttctcttttactgtaggccttttcatatctccagtcaccaaatacttaagtgcttactatgtggagggctgtctgctaggtgttaggatgaataaaagaactgtagttttaaa

SEQ ID NO: 270780 - DNA, 1005 bp, Homo sapiens
cccgtcaggtatttatactttcttccttgcaaaatgtgttccagaaaaggaagcgtactgctaattatgaagttaataaaaagtgaaaaggtctaaaactatgctgtgttttggtcagaaaaatagacagttggatcaactaaaaagtaaaatgttaaacttcatgataggtgactatgacatgaatgacctatcatgaaaagaaaaagagacttcttatacattcagtgactgccctcattagtgctaaaaccacctaacactgaaaatggaaaggtggctaatttgtgctataagaatatacaaaggaaacacaggattcttgagaccaagtcaggagccttggtccaaaagcaacagatggtgaaggcaacagtgtgcctagtgacctaaactttactatgaatgaaggttgatttacgaattttaaaaggttccttcacctgatccagcattagtaggtcatatttccccttgagctaaagaaaggaccaaaggataataaccttgaacaggatgtcaacacacatgaaaccagcccatattataataccgtttctgcctttatatccaaaagggcacaggtctcattaccattcttcactgtttctttggttttaggatttcagattaactaatggttaatattcctgcagtaatgacagtgtaagctagagtggttttttgtggcagaattaaagagtttcagaaattaatttggtcctgtattttacagagtcattaagtatgggaaggattaactgtaataatgagtaaaagtttattgtactttaggggaaatttatgtctatggttatcatgacatagaatattcaaaaagctcttgcaaatggcaagagtggtcccaatgtcttctttcgaatacagagaagacaatatgctgaggctttgaagacatctctttccttgtcttttccaccataagatgtgagactactgaggagatcgtctttttgttgttgttaagtttcttccagactaaac

SEQ ID NO: 270781 - DNA, 490 bp, Homo sapiens
cccggccaggtgccctccaggatccgccttccccacccctcctgggaagcctggaccagcatcccttcttgggtggatggagcctcgtcctcatctccagctacatcagtcattctctgcagggcaaaatctcctccccctaccccagctgtttctgcagaagggcccctggctgtgttggcaggacttcggtgtccagggtagatctcccctccactgaggagtgaggtcccagaatcctgttgggtcccaggcctcagccctgcacagatgtgatgtggggcgatggctctctgggaaccctctacagatctatttttatatggaacttgttcactggacagaggtggcctgcaagcccccattaccctggtctgagctcaccctgggagggagggggccagtcggagggggttccttctggagatgtttttatatttcttgggttctctatgcaggataataaaaacttgtctgtgaaatggtgcct

SEQ ID NO: 270782 - DNA, 663 bp, Homo sapiens
ccgggcaggcctctgtcacacaggcacagcgtcctccccatggctcctcctcaggccagagcatgcttggggatcagagcagctctcgcagtggcttgcagcctgacaacgcggcgtgagccatgccctgcagagaagaagagcccctcagtgagggaagaggcgcccacaaaactcaggacacgcgcagaaacccgcaggaggtgggggcgctgcctaggggccgtgccgctcccacccctcaccttgcagatgacggaactgcggcccagagctgccaagtggcttgctcaaggccacccagcagggacaggaaggaagtcacttccccagggactgtgcgggagttcagtgacaattaaagaccagcgctaaagtttgcccaggacgagaacctcattaagggaaacagctccgggactgtcgtgttcattcggaaggcagccagtttacaactgagtttctaaaaatgtacgttttcttacatgaaaacacatccgaatgggattttgtagaaagcatctttcatcaaggcacagcccgaggggaggtccccgcttcatccctggctgtgctgtcctcagccaagggcagcagggatcagagtggtctctggggcacagcactggctgctttcaaagagtgttttgttcagttcatgaa

SEQ ID NO: 270783 - DNA, 661 bp, Homo sapiens
  misc_feature (62)..(62): n is a, c, g, or t
agaggttaccgtgcagaatcacactcaacagcaaataatgggagacaatttcacatggactntggaaatatttttttcctttgcattcatctctcaaactcctggactcaagcgatccttctacctggtcctcccaaagtgctggttccactggcgtgaaccactgtgcccgtcccggtattttcttcatatttgtgaataaatacagttttatttatcttttttcagtctggactgccttcttttttattattggactggctagaacttccctacaatgctgactagaaatggcaagagcaaacatgcttgccttattcctcatcatataggaaaagcatgcagtatttcaccattaagtatgatgttagctgtaagcttcttagagatgcactttattagactgaggaaggtgccttctattcctaatttattgagagttttttttttatcatgaatgggtattggattttattgaatatcttttttgtatctaatgagataatcacataaattttgtcctttctcctattaatattgtctattatattaattgattttcaaatgttaaatcaaccttgcattccacagatacatcccacttggtcatggtatataattctttttctctgttcctgaagttgtttcgctaatcttttgt

SEQ ID NO: 270784 - DNA, 822 bp, Homo sapiens
cgcaatcttggctcactgcaacctccgcctcccaggttcaagcgattctcctgcctcagcctcctgagtagctgggactacaggcaggggttgcagtgagccacgattgcgccactgtacggccagcctggcgaaagagtgagactccatctcaaaaaaaataaataaaagtaaaatgaatagtaatgtattatttaaggatacataaaggcgataaagtttttaagaagaaatgataaatataaaattaaacagaatggtttcatctgggtaggaggccagagaaggaaggaattcacacggcaaatacagtgatataggtaatgctctagttcagcagtgtccagtagatctttttgcaacaatggaaatgttccatatcggtgctgttcagtatagtagctaccagctttctgtggctattgagcactccagagagtggcttgtgtgactgaggaactgaatttttaattctctttaagtttaagcgggcacatatggctagtaactcatattggatagtgcaattctagttctagtggcaaatagacctatgtttattgttaggcatgaaaatttacacgtatgttaaaatagtcttaggtatatctaaaatgcagcataatcttaaaaagccatttaaaacaaaaagtaagcttcagaactcactttggtaactatagttctgctgcttccgtaggatctcagcatgacccagttagtccccaggccagcacagcaggtgataattaacccttctttacatttagcctcagaaaataccaggcatcagaacaaggatccctgaggagtaagagaaaa

SEQ ID NO: 270785 - DNA, 454 bp, Homo sapiens
agcaggatatatgtggccttgaggataacctgcactgtcctagcctaaacacaattcttacttactgccttatgtttttgtattttcttggtagactgggtaatttttgttttaaaggacaggaaactgatattttaaagaccaatctgttctacctagcattttcactagtttttctgccaggtatgttgaatgcacaaattctgtcacacatgttcattcgctgctacataatttggttcttctggaatatttatatagctcttggagtacagctatgaaaattaacaactgttaaaggaaacacttttttttttcgtaattttttccttgaagaaccaaagtattttttcagctgtttgttgaatagggttaagtctgcttggattagctgtgcctttcattactttgttacagaaatgcagggacttgtactaagacaatccatcgttta

SEQ ID NO: 270786 - DNA, 368 bp, Homo sapiens
cacatatgtctcttcattccaagtttccaatttgcaaaggcaggtgtagtatggtacctatatatttatttgtacagtcacaaaaataaaatacagagtcatatatacatactcatatattaagcacttactgtatgccacatgatatattaagacctcatatttatatctcatttctcctttataaaagttccatgaggtaaattttaatcatatccttttacagatgaagaaactgagactgactgggcatggtggcttatgcctgtaatgccaccactttgggaggccaaggtaggaggatcacttgagctcagcaatttgagaccagcctgcacaacatagcaagaccccatctctactaaaaa

SEQ ID NO: 270787 - DNA, 325 bp, Homo sapiens
cacatccatagattcaatcaatggcagatcaaaaatattcagaaaaaaataattgctgtgtattgaacatgtataggtgttttccttgtcattatcccctaacaatataacaactatttccatagcatttacattgtattagctattataagtaatctagagatgacttaaagtatacaggaatgaacgggtacaatgtacattattccaacgataaatacactcacagcctcgactttgaccactatgcaatacatccatgtaacaaaattacacttgtaccccacgaatgtatacaaataataaaaaaaattatatggtaaga

SEQ ID NO: 270788 - DNA, 1587 bp, Homo sapiens
agtcacaaaccctatgggtggagagattataccttcctatctggcctggacagtccagattatgcctctagtctcatcataagtgttaataatgctcccatctttctcaaagtatcccagtttggacaatcaattatatggtcaccctatctctagtgaacctagaagtcttgggtgatgtataagcccagataacccagaatatgtagtgaaatgatgtctgaagccttcagttaaagggatagaggatttagaactgcactgtccaatatgataaccactggctacttgaggctactgaggctatttaaatttgaattaattaaaatgaaatacattttaaaatttagtggatcagtcgcaccattcatatttcaactgttcgatagccacaggtggccagtggctacttcattagacaaagaaacgaaagatttcccatgtcacagaaaattttattgaacattactggtctagaagtcaccttgaaatttttcacatgttgagtatatccataaaagaccctaaagtaaaggtgggacaattcagtccacgaattaatctgacttgcaacaagtatggaaaatcttatctagtgagagcagattaggcttcctaaaagtcatacttaacccagtttatgtcatttcccaagaccttctgaagctttctgcttttgctttacaacctataaaaaggattgtgagctgcaagaaagaaaatgaaataggtttattctgctagctaagcacttcagcaacagcttaagatttactttgttattcttgaaacttgactgatttttgtgaagtctttgcagaattcccttgcttttcagaattctttcttggttcttatttttaatggaactttactatttacatgtctatctttttgtggattcttgacattttctgcttgctgcattgtggtacctgagggggatgtttttctcctccatatcctgattctgcctagtggtttttcatcacttctaaattccatttcaaattaacagattgtgtcgcttgaacccaggaggcagatgctgcggtgagccaagattgtgccactgcacttcaccctgggcaacagaacaagactctgtctcaaaaataaaaataaaaataaagagaatacaattaaattaacagattctgtaaaaacctaatagatacactcaatagcttaataacctaattgaaaatattttactcatggtgtacttaatttctaaagatacataatttaaaaaccaactaatacaattagcagctctaaaaagaagtttgcaggtataagtcctaaatcttatgcagaagggttcttttcctaaggtgtttaattatgttcgtaagttcaacatcagttgccggagggtttttgccagaacatgcccacctcttgcagctcccctgaagcagtatgtatatgtatattacagattgcaggtgtgaaacatctattattcatctcaaaatagtaactttgggcatttttcttgttattttttaattgttagaatatttaatacgaatatttaaatatgccttttgtatttcagtaactcttgcaatagtagttttt

SEQ ID NO: 270789 - DNA, 467 bp, Homo sapiens
aatacaactatgcacctccactatcttctggcatctaatatgaggatgctttttgagaggcttttcttcctgaaagattgcaaatgcttcaaaaactgaacaagttgataaattataccgggacgagctcacccaccactgaagtgcaaccatctttggggtagctccctacagctgtttaccaccatgctgtggtgcctaggagcagtctgtcataaagaaaagaagaatgcacttggaatataagcaacaggcaatttgcagaagagaagatataattatctagattggaatatgaccaggacaaccataccattcccacaaaccaccaagaaggcaaaaagtaagcaagagaggtttgggtatctggtatctgttaagagaggtttggatatctgataattgtttgaatcacaatctaatgtttttatgctaccaaaaaagaatgaaatttagaaacctttttg

SEQ ID NO: 270790 - DNA, 495 bp, Homo sapiens
gcgagactctgtctcaggaaaaaaaaaaaaaagaaagaattaccccagaatctcccccttcatgtcttcttctagccattaacctccaaagagtaatcactattctgacgtctgtcaccatacattagtttttcctgtttttgtacttgctataaatggaatccaactgtgtatcctcttcggtgtctagcttcttttttgtaagtcctttcattgtggtaaaataaacatagctaggcacagtggcatgcacctgtagtcccagctactctgaaggctgactcagcagtgtcacttgagcccaggagttaaaggccagcctgggcaacacagggagacctctatctctaaagataaatatatacatatacgtaacataaaacttaaaaccattttaactatttttaagtttgcaattcagtggcattaagtacattcacaaagccgggcacagtggctcatacttgtaatcccagcactttgggaggctgaggc

SEQ ID NO: 270791 - DNA, 496 bp, Homo sapiens
gaaaggaatagtaacagtcagtctgtgcccccataccttaacatatgctattccatctgactggaatccctttcctccatctttcaaatcctacttaagtctctgcaaatcttctgacccttttatcctacagatacaatcattctccatgctgtagtacttccacaaagcgtacatacttctattacggtatatgaaatggcaagaggcagtacaaatgaacgtgaaatccggcaccaaactgagtttgacactcagctctactgtgtgaccatgagcaagttatttaacctcatgttgccttaatttctttataaaatggtgatagtaataatacctaatagagttgtcataaaggtgaaatgattggctgggcacggtagctcacacctgtaatcccagcactttgggaggccaaggtggggagatctcttgaggtcaggagtttgagaccaacctgcccaacatggcaaaaccccgtctctactaaaagtac

SEQ ID NO: 270792 - DNA, 469 bp, Homo sapiens
gtccggcgtggtgacctctgcttctgcgcatccgaagggggatggactgggccgcgccccgcgcaggctgtactggttgcaaagatttcgtttcaggtttgtagcccaagtggaaagtggagtgaacaggtgttccacccagccaagtggtaacgaaaggcagcccagaggaagatacattcccgcattcatgtatactgtagcaagattaagcatattccctgtatgaagatataggtttacaaaacaggtgttgctccctaataccatagaattcttttaagtaaccaaaagcttcgttatgtttcaaatgtttgaaaaacttaactgtaagccgttgaaggcatgaagagtgtctgcgtggtccttccatgtagccccagagcttaatatccagtaaatagcgggggctgaatgtatgtcttttgaatcaatgaataaaaagtcatctacacattttgttaggcac

SEQ ID NO: 270793 - DNA, 337 bp, Homo sapiens
ggaatgaagagaccataaatggaagaatgcattcatctataattgtgtggagacttgaggaatgatgaagcttcgaggtgggagcagtcacaggtgtctctcggggggctgtcatccaggtgcgccagcaactttcctggctaggagaactccctttgtccctcaagaaagccctggcctctggactcaggacaagggtccacctgcctaagacccagcggagcttctcaggttcctgtctcctgtctcctccctcttcccctctctcctatctgcagtttctgctcggggaaatacaataacctaatatttaaataaaattctctcagatgccaag

SEQ ID NO: 270794 - DNA, 611 bp, Homo sapiens
ggaattaagactcttccatcattacctggaattattttttctgctttccctcattcctgtgaaaactctgaacaacactttttcataaaccatttgatatggtttggctgtgcctccacccaaatctcatcttgaattgtggttcccataatccccacgtgtcttgggaggtaattagattatgggggtgttccctcatgctgttctcatgatagtaagtgagttctcacaagatctgatggttttataaggggcttttccccactttgcctgcatttttctctcctgccaccttgtgaagaaagacgtgtttgcttccccttctgctatgactgtaagtttcttgaggccttcccagccatgcagaactgtgagtcaattaaacctatttcctttataaattacccagtctcgggtattaataacaatgtgagaagggactaatatgccattactataatggatgtttattcttcaagacagagttgtataaactccagggataaataaaataataaatacgcaaaagaaagaaatgaacactctgaagcaagagcctagacctattaaatttttaccaatggatcatttcagtaacatgaaaaataaaa

SEQ ID NO: 270795 - DNA, 577 bp, Homo sapiens
ggtttttttctctagcagctaaacaagcactggcctcaagataagcaatattacgacaattacagctcatcacagttcacagatgttgactgcctgagccgctgttccaccagccatagctacagctttgattgggcaagaggctgattttggtagcgttctcctgataagttggccaccgaccatggaccgactctggtcagtttacagagattgtgcattcatgcacctttgtgtcctgaaaagcccctttgacctatagggcctaatgggaatacacttccatattaaatctccaccccaatgcaaacagaggtcatttgtaatatacatgtttgttcaatatacatgtgtcagggccaccttcatgaatactcacagctctttctcttcctgtaaactgatgaatgtttatgttcagccaaccctttcagcataaagctcctaccccagcctctccttctttgaaatacctgtctctggtcttggctggaggctgtgcttctgagcccgtgggaaggccaccttgcagttgtaatcctttacaagaaataaagtcaccttctccttttccaaa

SEQ ID NO: 270796 - DNA, 706 bp, Homo sapiens
aggtatgaggtagatgacattgatgaagaaggcaaagcgtgagtgtccaggccagggcagggcatggagcctgggggcagcctaccagctgggaaggagcatccccacccggccacaggttgacacaagcccctctaccaccaggagacacaccgtgagcttgcgccggatcatcccgctgacccggtggaaggccaaccccgagacagaccccgaggccttgttagtcaaggagaaaaccatgttctcaggatgctgtgaccttggtgacagcacggccaacacaggaagcctcggcattcacctggtcactgagctcattcaagcaaagctatctccagtagggactttcccttttgagaacatgtgcaaagggtcagcaaactgacactttgctcattttaatagtaaaaaccatacccctgggtggagatttaagatgctaatgagacatgagtcctaggagcaagcatgtatagcaaatgcgcatgtgcacccagaggaccacccagaacatgcttactagtgatgcctcttcccacccattatgaagagttgtgtgagactcccataaagggagtttttcctgcagtaatcaacaccgtcccaacctgacaagcagtcccttctgaactcgctcaaggtgtattgtctattctgcaattaactttcaatatactgttttcttttgcaataagttattcta

SEQ ID NO: 270797 - DNA, 476 bp, Homo sapiens
gccgggcgggcatcgcgccagacctgctactctggataatccactctcctggataatccactaccctggataatcggctgcccgcttttgcgcatgttagggagttgacggcctgtagcattctgatgcagcaaaatatttcgcagggtctgtcatagggatctccggtgagaggaggttcccttcgaaggcagaactggaaaccttgctgctaacttggtagggttgttgagataattacatgagatggcatatgaagggcggcttagttcaatacctggcatgtagtaggtgttcagtgggcgtagttaccggattgattcagatagtctgaacgccagtgtctcttgaaagaaataaactggccgggcgtggtgactgtaatcccagcactttgggaggccgaggtgggcgaatcacttggggtcaggagtttgagaccagcctggccagcgtggtgaaaccccgtttctact

SEQ ID NO: 270798 - DNA, 500 bp, Homo sapiens
acagactctctagtcttaccatcacaccttttcaattttaattccaagaaagaaatattttattcccctcacctctataacacagaagccttgagtatcccctgaatgtcaggggtttagagtgaaaagcaaggagaaaattataagtacataaagccctgcccagttggaacatcactatccaaaaaaggaaacagacaagggaacatgtaattataagtcaacatgataaacccaataacagaaatgtgatatatagtatagggattaacccagtaagagtataaggaccatacaagcagggattatatttgattcatatctgtatatccaatacctaacagagggtctagtatttaatagattcaacaaatcagttaaatgaatgagattaattctgccttagagataagaaacaagaaagtcttcctaaatggggtgtaatctgggttttgaaattcaaatagcttagaagaagaaaaggacaaagaaaacaagtt

SEQ ID NO: 270799 - DNA, 1001 bp, Homo sapiens
ttctgtttggatggttggcctcttggttacaagcatgtacattatggctctctccttgcctggaactggatatgagaaatgcttgaattaagatctgtgaattatcttattttcttgtcagaaggatgcagattgcccatacttcatagcagagcaacaggagggacttagggacaaaaagctcaaaggcaaggaagactgaggaagctaagttactggccatatgtttaataaatataagcttaatggcagtgaatgtattaatgtcagcgaagacaagtctatgaagttaaacaggcacagagaggctaagagtcttgccaaaggccacagaggaaggaagagactaaatctggaacaaactttctattctccatttccagaagaaaccactaaaccatgcttcctcttgtcatggaagcttaaaatatttggactgtctgtggatccagggaggaatttcagaagagccaggattagtcaatcaaattaaactcaatatcacccaaataaagttggtcagatcaaactacgtttaaataagaattaaaatgccatttgtccatcacctaatggctcaatttgctcctgccttgggtgtgcacaccctgctctggaacagaccagagctctaaagaagtgactggaagttgtgaatgtcattgttatgaagcttcaaatttgctctcctctttaggacacagacatggcattagagaagggcagaaaactgcacttggctgtgcatagagaacactagagacctcttgtgcaagagaggggactaggttgcgtagtgtaatgagagaagcatgggttttgagaccgctacaatgtctgtgtcttcttggccaacatttcagtaagagtagtaagcatatctccacaatagggttaagagaaccagtgtcttctgaaaaacacatgaaatcatcgtaaccctgctaagtctgtgctttgcaaaaattaaaactaaaactaattttcaaagactctgttat

SEQ ID NO: 270800 - DNA, 489 bp, Homo sapiens
ttctgtttggatggttggcctcttggttacaagcatgtacattatggctctctccttgcctggaactggatatgagaaatgcttgaattaagatctgtgaattatcttattttcttgtcagaaggatgcagattgcccatacttcatagcagagcaacaggagggacttagggacaaaaagctcaaaggcaaggaagactgaggaagctaagttactggccatatgtttaataaatataagcttaatggcagtgaatgtattaatgtcagcgaagacaagtctatgaagttaaacaggcacagagaggctaagagtcttgccaaaggccacagaggaaggaagagactaaatctggaacataagcatatctccacaatagggttaagagaaccagtgtcttctgaaaaacacatgaaatcatcgtaaccctgctaagtctgtgctttgcaaaaattaaaactaaaactaattttcaaagactctgttat

SEQ ID NO: 270801 - DNA, 498 bp, Homo sapiens
ttctgtttggatggttggcctcttggttacaagcatgtacattatggctctctccttgcctggaactggatatgagaaatgcttgaattaagatctgtgaattatcttattttcttgtcagaaggatgcagattgcccatacttcatagcagagcaacaggagggacttagggacaaaaagctcaaaggcaaggaagactgaggaagctaagttactggccatatgtttaataaatataagcttaatggcagtgaatgtattaatgtcagcgaagacaagtctatgaagttaaacaggcacagagaggctaagagtcttgccaaaggccacagaggaaggaagagactaaatctggaacaaactttctattctccatttccagaagaaaccactaaaccatgcttcctcttgtcatggaagcttaaaatatttggtatggtcatcttgcctttttttttctttccagtgactgtataaaggctttcgagatggtagtg

SEQ ID NO: 270802 - DNA, 494 bp, Homo sapiens
agctctaaagaaagagtagctctttgatggggcaatgtgtgtgaaaatgtgtatagagaagcaagaaggcctaaccttttaagtagtaacaatatgtccagacccagtgataggatccatgtgggccagaatcagtaaatccatatgggtgcagcattaggtctttgaggaatgtagtggagatcaaggttagaaagagacaccaaagccaagcgcaggggctcacgcctgtaatcccagcactttgggaggccgaggcaggcggatcacctgatgtcaggagtttgagatcagcctgaccaacatggagaaaccccatctctactaaaaatacaaaattagccaggcgtggtggcacatgcctctaatcccagatactcaggaggcagaggcaggaagatcgcttgaacccgggaggtgggggttgtggtgagggtgagctgagactgcaccattgcactccagcctgggcaacaagagcgaaattccatctc

SEQ ID NO: 270803 - DNA, 407 bp, Homo sapiens
taagagctaaaatagagtaattgttggtttctatagtagtacataagagaggtcctcaacccagatttggcatgggaggaggctggggttgctggaagtttatttaggggaacagctaagctaaccctttcatgatgagtagcaattagccaggtgaaaggaaagcgaagtacttgcaaatagatgagggcatacccggcaaaggtatcaatatgttcaaagagatgggcatctgagagagtgtgctatattcaagcactgggactaaaaaatggtctagagctagagagtataccagtccttggtgggagagatgaggaggtatataggtagaaagcagggtaagcagaaaggggtttgtgaagggcatctctcgctgggaaaccattaaaaggttttacacaaga

SEQ ID NO: 270804 - DNA, 452 bp, Homo sapiens
cccgtgatgacaaccaggcaaccactgatgcctcttggcctagctgcaaggcactctctttgcagagctccatgcaggagatcaataaaaagctgtttgatgggtccaactactccatctctttggatgaagggcaggtataccatgccaccgagcatatctagcactgggcttgggtgggagtgggcacagagaggtctttgcagacagggatcagaggagacaaaagtgggccgaggacaaagacctgaatatgtagacaccctgggatctgtcctagggcttttccactagggtaactcaccattctttcccaaaggagtctggctttcatgagtcctaaatggcaaatggttaggcgcaaatccctgttcacatacttatagaaatatcagagaagacatttttctgttgtcgacgcggccgcgaatttagtagtagtaggcggccgc

SEQ ID NO: 270805 - DNA, 515 bp, Homo sapiens
ctaagctgatgaagatgaggatgacatggcccacaccccatatggcatttgtgggatgatgcaggaaaacatgagttggatggtagaaatgtcagaagatttgcagctggggaaacgaccatatcttaaaagcccagtctgcacaaagggaggccccaaataagtgaccacaaggctttgtccttagggtgttccctctaatgttttaagagcaagttggatggccaggagtggtggctcatgcctgtaatcccagcactttgggaggctgaggcgggcagatcacttgagcccaggagttcaggaccagcctgggcatgcaacatggagaaaccccgtctctactaaaaatacaaacattagcaggctaaggtggtgcacacctgtagtcccagctacttgggaggctgaggtaagaggatgacctaagcctgggatgcagaggttgcagtgagctgagatggcaccactgcactcgagcctgggccacagagtgagactctctgtctcaaaaa

SEQ ID NO: 270806 - DNA, 582 bp, Homo sapiens
acttccgaggggtggaaaaagaggcggctccaggtgcgtctgcaaagcctcactacacactactgggacaggctgggcaggtcactggtctctgcctcaatttccttgtgtggaaaatatgaattgccccaccatttcccaatttacaggactggactgccacgaggagaaagaaaaaagtgtatccaccagccaaggaagaaaaacatatgcgactggggaaagatggaagcttctcatccttaatccccaacccagtattgtgccttcatttccttgtctgtgaaagagggtgtgggagcaggcacggtggttcatgcctgtaatcacaacactctgggaggccaaggcaggagaacaacttgaggccaagagtttgagatcagcctggacaacacagtgagacctcatctctacaaaagtaaaaaactagccagacatagtggtgtgttcctatggtcctagctacttgagaggctcaggtgggacgattgctccaacccaggaggtcgaggctgcagtgagctgtgatcactccactgcactccagcagagcaacagagcaagaccctatctctcaaa

SEQ ID NO: 270807 - DNA, 442 bp, Homo sapiens
caggggaatcgcttgaacccagaaggtggaggttgcagtgagccgagatcacgccactgcactccagcctgggtgaaagagcgagactccgtgtcaacaacaacaaaaacaacaatatctccataggtatttggtagtaaaaatgaaaaaaagagagaaaaatgtctccagtggatcctccatgagattttcatgaagaacccaggagtgctggtctgtggtgggagcttcacccgggaggagtagagagggctgggagagggtgatgtctggtacctttgggcccctctccataaaaatgtagaaaaaattagattatatgactgcatagatatacagatgaatgcaattcaggctggattccttattttagattcattgttattatgttcttttattcttctgattttaaaataaattaaaattaaacatttaaaaggcc

SEQ ID NO: 270808 - DNA, 1424 bp, Homo sapiens
aatgaaattcattcagctagaacgattgtatcatgagcaattgctcgcaaatctttctgccattcaagaacagtgggaaacaaaatggaaaactgtgcaaccacatacagttacggctctaaggaattcagaaaagggatttaatggtgaagattttgaacggcttacgaaaatttgtgcaacacatcaagatcctcttttatccaaacataagatagcagctgtggagaagtcccaggaaaggaaatgctccacgcagttactagtgtctgaagatccaaaggaaggaggagctaccaccaaagagtcagagagtaaaacttgtctcggcacagagtcaagtaaagaaagccaacatacagtggagcccctggggagcagtccctgctgtcatcagatggacgtgcaaacagattccccaagcctttcggtaactgcaggaaaggaccacatggaggagctgctctgcagcgctgaagccacgttagcgctccacacccagtcctccgagacagcagggagcccgtctgggccagactcttctgaggatgcttgtgaggatgacagtcgcttgcagctggctcaaacagaggcctgccaggatgtggccagaatagagggcattgctgaagaccctaaggtgtttctttccagcaagtcaaagacagagccgttgatttcaccaggctgtgaccgtatacctcctgcattgatttctgagggtaaatattcacaggctcagaggaaagaactccgtttgccacttcgggatgcttctgaggcgttgcccacagaccaacttgagaacaatgaattaaatgagctgcagcagcctgatcttacagacagtgatggaaaatcaccacaggcgcaggctgactcagacggttctgagaatgtgctctgtggaaataatcaaatatctgacttaggcatactgcttccagaggtgtgtatggccccagaggaaaagggagataaagacgaccaactcaacaaagaaacagaagactatttgaacagccttttagaaggatgtttaaaagatactgaagattccctttcctatgaagataaccaagacgacgactccgatctccttcaagatctctctcctgaagaagcatcctatagtctccaggagaatctgccttctgatgagagctgtctttctcttgatgatcttgccaaaaggatagagattgcagaggttgttcctactgaaggattggtctccatattaaagaagaggaatgatactgtaggagatcatcctgcccaaatgcaacacaaaccatctaagcgaagagtgagattccaagaaatagacgatagcttggatcaagaatcacttggatttggagagctgcgcactttaaatgaatgcagttatgtacataagtcatacctcaataaagttgtta

SEQ ID NO: 270809 - DNA, 1407 bp, Homo sapiens
aatgaaattcattcagctagaacgattgtatcatgagcaattgctcgcaaatctttctgccattcaagaacagtgggaaacaaaatggaaaactgtgcaaccacatacagttacggctctaaggaattcagaaaagggatttaatggtgaagattttgaacggcttacgaaaatttgtgcaacacatcaagatcctcttttatccaaacataagatagcagctgtggagaagtcccaggaaaggaaatgctccacgcagttactagtgtctgaagatccaaaggaaggaggagctaccaccaaagagtcagagagtaaaacttgtctcggcacagagtcaagtaaagaaagccaacatacagtggagcccctggggagcagtccctgctgtcatcagatggacgtgcaaacagattccccaagcctttcggtaactgcaggaaaggaccacatggaggagctgctctgcagcgctgaagccacgttagcgctccacacccagtcctccgagacagcagggagcccgtctgggccagactcttctgaggatgcttgtgaggatgacagtcgcttgcagctggctcaaacagaggcctgccaggatgtggccagaatagagggcattgctgaagaccctaaggtgtttctttccagcaagtcaaagacagagccgttgatttcaccaggctgtgaccgtatacctcctgcattgatttctgagggtaaatattcacaggctcagaggaaagaactccgtttgccacttcgggatgcttctgaggcgttgcccacagaccaacttgagaacaatgaattaaatgagctgcagcagcctgatcttacagacagtgatggaaaatcaccacaggcgcaggctgactcagacggttctgagaatgtgctctgtggaaataatcaaatatctgacttaggcatactgcttccagaggtgtgtatggccccagaggaaaagggagataaagacgaccaactcaacaaagaaacagaagactatttgaacagccttttagaaggatgtttaaaagatactgaagattccctttcctatgaagataaccaagacgacgactccgatctccttcaagatctctctcctgaagaagcatcctatagtctccaggagaatctgccttctgatgagagctgtctttctcttgatgatcttgccaaaaggatagagattgcagaggtaaatcagagatgaagtacaattaaaagtaaaatggcatttaaaaaacatatatatgtattaaatattgccttgtttttgtaagttttcccttgtctcaaacatgagggaaaattctagttaacgtaagcttttaattattagtagtttttacatttgtatgtattgaataaaatgacttttaatcattgcaatgt

SEQ ID NO: 270810 - DNA, 379 bp, Homo sapiens
taatttaaagattaaatctaattttggaattgtttgcttaatataaaaatgtaaacattataaaacatggatagaccaaatgttctaaattattcttatgctaaaactaaaccacccatcacctgatttgcagaataatttggtagaaacattaataagatttatacatgatgcataatactattaaatttcttcatttcttaaaggagtctttcaactaagaaattctgagttttgtgtaagatctatgatgacatcaactagacaagctgaagcattttctgaacttctatctttttctccgtggtcttcccatgggaaatgtttcattgtatcctctggctaaaaacagaaatcaaactctactacaatgaatacc

SEQ ID NO: 270811 - DNA, 488 bp, Homo sapiens
ttagctgtatgaaattgattgggtaatgtaagctctttagacctcatttctccgtctcttaaagagtggggagaggaagcaggagactgttagacgagttgatcttttaatatctcttccactactgacagtctatgatcatataggccagagacggcaaactcagatgcctaaattagggactaagaaagtttcataagtgaggaaatggactgaatgtgacaaaagcaaggagtgatagagattggaatgttagagttgattgagctgtcccatctaaaactccagccaattcttgcaaaaataaggactcagtgttgcctgatttttcaggagaaacaggaaaatcatatttttgataatattatacaaaacaaaacacttctactagctagatacaatttgtgggtcactaattttcaacctctgctataggtgaaaggacctcaacaagagggataattgcttgaattaaagaattaaatatg

SEQ ID NO: 270812 - DNA, 265 bp, Homo sapiens
gaaagaccagcctggacaacatggcaaaaccccatctctacaaaaaaattacctagagactaggcacggtggcccatgcctgtagtcccaaagtgctgggattacaggcgtgagccacccgcacccagtcccagccttctttctgattcactcttgttttgtagttgtggacatttaagaagactttttatttttttatttgtatttttttttttattcaaagggcttgtgctcaaataaagtgagagtaggtagagagaaaggc

SEQ ID NO: 270813 - DNA, 403 bp, Homo sapiens
aaatgtcgcagccaagaatacagaattggaagatgtcccaacacctatgcatgctgtttgagaaaatgggatgagagcttactgaatcgtacaaaaccctgaaacgcagtagtgctggtccctagagtcgctggaagtaggacctcagtagctttccttcctgcggcctagcagcaaggacatccccattgcaaccacgggttcagttatcaaagaaggtttgctgagcttccactcaatgcaaagccaatacaggagattgaagaagaatacaggctggaaagccgcctctggttgtgataatggagaataacaatgggagttaagcatgagtttcaacactttataagttgaacaaaaaatatgtctacctaatcagctataaacctaagaaaaacatcat

SEQ ID NO: 270814 - DNA, 362 bp, Homo sapiens
cttgttaaatgctatacattgatcttttaaatttcatagggaggtaactgactaatttgaagttctcataaatgaatcaatagggttgctacattatgaaagaattttactaagtttcttctataatgcagactgaaatataagaccattttaatttatcaccaccatacagtaaaaattagcttatgatatgtaggttcctccaggattctgaacaacttgccacatagcagatgctcagtaaggcatattaataaacctacactttatgaacatactttgtaatgaaatttttataaatgctgtattttatttacaatgagaaaccttattagaataaaaatgattcataaatcttaatc

SEQ ID NO: 270815 - DNA, 498 bp, Homo sapiens
agttaatgcaagtcaaggacttcttagcatcatattcgatgagtagtaaacacataaatgctagctattattgtttgtagtctcaggtcttatgattttagttttaggttttttttgttttgctttagtgttcattaaagagaagaatgggaaaagcacttgctaactttttcattctttttatatgttgatttttactttttcctttataaaggaagtcaagtatgagtgaaaactgataatataacttgtttttgactgtctatatattttttgtggaaaaatagatttgcttctaccttaaattctgttatgttgtcagcatttgccacttaattaattagatcaatatgaaatttttacattaaagaattattagaagaattataagtgaaatgaaagattgaatgtattctcaaatgtgtcactcttaattccagataaaaatgaggaaaacagtattgctgtattaaaaataaaaattatattttaaatata

SEQ ID NO: 270816 - DNA, 425 bp, Homo sapiens
cagccttcggtgaccacaaatatttacattcaaactcaataccacatacttgttacctgcttcctgtctggttgatgaaatgccaaggtgaaagggatggccaattggatcagagcgcaagtgccactccagtcgtttggcagtgtacccaatattggtcccccacaataccaccacacatccactcagggatggatagggccgactgactgaaaaaagtttgaaaaagggatagagaaggagaggtccttgtctccaacatagagcataatctatctcctcttgagaaactggacttttatcattgacatattggatcaggagttggcatatccagtccttgttcaacccaaactttggccaaaagaccaaaggtctgaggatgggttccttagtccaaataaaacagcaatactttatcattt

SEQ ID NO: 270817 - DNA, 152 bp, Homo sapiens
tttaaaaagtcagtacaaaacagttttgtgagagagtgtgtgtgtgttgtgtgtgtctgtgttttagaataaaaaagaaagtaaagatttgattattactgatacatttttctgatggttgggaaaaatacatttaaaaacagcattatcag

SEQ ID NO: 270818 - DNA, 534 bp, Homo sapiens
gccacgtgctgggggagtgcccccttgctgccatactcctcattttatcagggcaggacttcgtttgatcaaagagtctcccatctaaagaaatatttggaaaccaggagcccatttcctttattttattcaggacataggctcagcaaggtctctttttaaatgcagccaagatccacaacaatccaggactgcattctgccttcaggttttggggtgctctggacacagaattcctctcctagtaaatgaggggaacggaaggagtgagggcctgggaggccaagggaggaggttcaccagggaggagtcaggcctgtttctcctcatttcttctcttcctcattcctagcttcttccacacgtctgtgaggacagatctttctaaaacagcacatctcgaggccaggcatggtggctcatgcctgtaatcccaccactttgggaggccaaggtgggcggatcacctgaggtcaggagtttgagaccagcctgacaaacatggtgaaaccctgtctctactaaaaatacaaa

SEQ ID NO: 270819 - DNA, 526 bp, Homo sapiens
tgtttacctatgaatatgagagattgtattatgtatgttttttcttgtaatgtgcttgtgagattgtttaggctggcttcacacaatgagcttgaaaataatactcctgtctttgcaccaaatgggtcagatttgtttattgtattcttgaaatcatctttatcctgttacaatttaatcaacttgcataatcaattactgagagacatgtgttaaacttttccactgtggttatagatagatatggttgtgtcaaattttccttttatttttatcagtttttgccttgtatatttattaagatatattttgaggctaaatttttctaataaatcttttatcattataaaatgcttttctttattttaataatttttttttgcctgaaacctatgttatcttataatgtaaagcaatactagctatactttggcatgtataatatgtcttttttaattcttttactttcagtgtttatgaatcctcctatttaagggtatgtcttttaaaagcaacatgtaaattt

SEQ ID NO: 270820 - DNA, 422 bp, Homo sapiens
tgttaagccactgcaccccagccaaggaggacaaagcaagaccttgtctcaaaacaaaacaaaacactatctccaaaaacatcagcctgtatacatcatttacagctttttgtatgtcagtcagtcatactgtcaacaaagcgatttaaataatagagggccagcacagtggcttacgcctgtaatcccagcactttgggaggccgaggtgggtggatcacgaggtcaggagattgagaccacggtgaaaccccatctctactaaaaatacaaataattagctgggcacggtggcaggcgcctatagtcccagctactccagaggctgaggcaggagaatggtgtgaacctgggaggccgagcttgcagtgagccgagactgtgccactgcactccagcctgggcgacagagcgagactcca

SEQ ID NO: 270821 - DNA, 414 bp, Homo sapiens
aacctaccctcatgaagcttacattctagagggggtagacagttaattaacaagaacaagaagtaatatatatagtaagtcagatggtgacacatgctaggaaaccccagtagggacttcaggtaagacagagatgtgtgtgtgtgactgtgtgtgtgtgtgtgtgtgtgtgtgtgtgtgtgtgtgtatccatgcaacatccaatgatctgggatacctatttggcaacaagagaggaaaatctctttggcaatagtgatttggatgttagtagtgtaggaggaatgagaaagccatactgcaattatcaggacaggaaatgattcaagtttggatagaactttttaacaatgaaaaatgaagagaaacaaaaccactttcacatggcaataattaaatttctgagtttacgta

SEQ ID NO: 270822 - DNA, 399 bp, Homo sapiens
catatcttaattattcaatacagaagtaatgccattgttctaacataattattcatttttatcttgcaatctatttttacattcatatttacatgaaattatagacacaatatataatacagttgttttctattttttcactatgtgttcttgtgttctatcataatctttaccatattactatatagtctctataactcttgcatcatattccatcaagttgatgaaccatactcgttcattaattatggaacttttgcttttcatttttcactattacaaatactgttagatttaataactctatatgtataactttttaccttttcttattttgaattattttatatattgattttaagttttaaaaatgtatagcctcttccatgcttttgctat

SEQ ID NO: 270823 - DNA, 444 bp, Homo sapiens
aaaaatagtacatctaaaatatgcctttatattatttatacttaacagatttacttaaattacttgaagctctcaaagcaatttaagagttggaactagaagaacaggtttccatcacagactagaataaacagaactgctctctattagccattcagtgtttctccccagcagtatatgggttatatagtcctgggttcactgttgtctaaagcagtgttgccaagaactacatttaaatacttcttttggcccatcaaacatggtgctctttcagtgcaatcacagacttccaccccatctccctcagttccaatgaaccaaatagttatttggtatgaaggtctaaaaattgtatggttatgatagttcaggatgacaaattggaacaatcattaaaaaaattacataagcagagttaaagttcatttaagcaaaaaaaaa

SEQ ID NO: 270824 - DNA, 131 bp, Homo sapiens
agcaaggtccatgccatattttcagtttgaacactttgaccttggaagctaagtgtgtaagatgcaatgcctgggttcctgaatcactggttggagaagagctgccaggtgataatgaacaactatttttg

SEQ ID NO: 270825 - DNA, 387 bp, Homo sapiens
gaatgtgcagcagtgcctgctgtgctgggtgctggggcagtcctccccagagtggagaaaggacatcagttttagctggcatgatggattaacatgttgatttttatctcaatatttatgaattcattttcatggatattagaaaaagataaaagctagcatattaaatacatcctttcccagacattgttggtactaaatttccttttgcttgaaataaatttaagtagaaaaagtctgaaggaaaatattaggtcagatgcagtggcttatacctataatccaagtgctttgggaggccaaggcaggaggatcacttgaggccaagaagaccagcgtgggcaacatagtgagaccccatttctaaaaaacaaaaaaaagaaagaa

SEQ ID NO: 270826 - DNA, 347 bp, Homo sapiens
cacagaggccagaggggaaaaggactcaagctaaactcatagaaatggcaatttaaccatttttgatggcacttgacatttcttagtgagccctttcatggatatttccttcttgttgtcagcaggctagaaagccacattggcttacttggtgagatcggagtcgttaaagggaggtagatgacctggcttatgggatggtgtccccagccatggtgaagctgctccatcatagatccccctctggctgtctgttaatgttaaccagattcaggacatctcacctagacagttggacagactttgcctcaactctgtctgtaaaaggaggcactgacacattttgg

SEQ ID NO: 270827 - DNA, 309 bp, Homo sapiens
ggcttactgcaacctccgcctcccaggttcgagcaattcttttgcctcagcctcttgagtagctagaactacaggcatgtgccaccacacccagctaatttttagctaatatttagaagagacggggtttcaccatgttggccaggctggtcttgaactcctggcctcgtgatccacccgtctcagcctcccaaagtgagccaccacgccctgcccaacccagcctttgcaatttctaccttaagttatgtagtcctctgttctccactttaacagatgagcaacaccattgcttttaaactattcgat

SEQ ID NO: 270828 - DNA, 639 bp, Homo sapiens
tgagatgaaattcaggcctggccccatttaaatccagcccccacctccccctccttcccaattcggcctcctcatcctgcccaacctgcttcacaccccgactcagccagcaaacagaggtctccctttccttcctccaaaagggaaggggctcccccagggcctccgctggagtggttctgggtctccaaagtcggaagtgcaatcgtgaccaactctcagctgcaccctctgctgcctgcagcgggtgtttcacttgctcagcaggaatcctgcccctggtgacacctccaccccaggaggccagcaagcccctcagggagcaaaaccagttgctctgggagacctgggccttccccaccgcctccccctgtccacagagaggggcggacatgcggcaccaaaaaccgtgtttctgactctggcatcaaaggtcatcccttgtttcttcctcaagcgacgttcagtgagccctggctaggggccaggtactgtgctgggacaggcaccggtgccacagcagcaaggaaaacagacaaaaatccctgcccttctggatattacatcccggcagagagacagagacagcgttccagttacttaataagtaaataaaaatacagtgtgtctggtgacaag

SEQ ID NO: 270829 - DNA, 450 bp, Homo sapiens
cattgaacaaatatatactgaatctaattaaaagccttagattaaatgaaagagatagtcagaggtagtttgatatgtagtctcgcaaaagaaaaagatacttaaaaagaaacaataagaaactaccaaggaataaaaaactatgaaggaataggaaggaattgaagcactttaaatgtttccaaatatttaaaatatagcatatacaatactaaaaatgaaagcattgctaagagctatcctggtaagcacaacagaatgactatgtttcagtttgaacagcttatatgacagaatttggatagtttttgcaaattaacatttactgatgaatttgagatatgtacaatggatactttaaaggtactccgtcatgtctacagtgtgtttttatgtatacccattttatatatgcccactgaatatacccatttttgggtaatggttcac

SEQ ID NO: 270830 - DNA, 378 bp, Homo sapiens
tcaccctagaatctcctctcacagaactaattaaaggagatcagaaatttgagtggtgactcctgctgcctctcctgcgctggtgcccccaatttcctgcaaataaaaagcagataaatgggagcaaatagttatctatttgtgggccacaatttctttttcattgaagccatagagacatcccatctagcaacctgttttttatttttgcatatccagtagttgctctacaaggcacaagaaagtcaatataaataccaaaaaatccctctgaacagttcatcctttctttctgtatccctttcatctgtctatacagcttttattccatacattttctttttaaggtaaataaatttaaaaagtgaaagaaaaaat
